United States Patent 7,468,248 (METHODS AND SYSTEMS FOR INFERRING BOVINE TRAITS) - sequence listing, part 13

SEQ ID NO: 44318 - DNA, 1271 bp, Bovine  19866880111766
ctttgggactagaatgaaaactgaccttttccagtcctgtggccactgctgagttttccaaatttgctggcatattgagtgcagcactttaatggcatcaccttttaggatttgaaatagctcagtgagagacttcatttttgggggttccaaaatcactgcagatggtgactgcagccatgaaattaaaagacacttgctccttggaagaaaagctatgatcaacctagacagcatattaaaaagcagagacattactttgccaacaaaggtccatctagtcaaagctatggtttttccagcagtcatgtatggatgtgagagttgggctataaagaaagctgagtgctgaagagttgatgcttttgaactgtggtgttggagaagactcttgagagtcccttggagtgcaaggagatctaaccagtcagtcctaaaggaaatcagtcctgaatattcattggaaggacagatgctgaagctgaaatgccagtactttggccacctgatgggaagaactgactcatttgaaaagaccttgatgctgggaaagattgaaggcgggaagagaaggggacgacagaggatgagatatttggatggcatcaccgactctatggacatgagtttgagtaagctcccagaattggtgagggacagggaagccaggcgtgctgcagtccatggggtcgcggggagcaggacatgcctgagcgactgaactgagctgaacaagtggactagttgttatggtattttttttgcagcagtcagtggatgaaaacaggttcctgaaaacaggttcccaccttgagtgtgacacagcactgtggctcaagaaaccatagaaaagaactaaaaatttcatatccaggagctaataagattcaagctgaagaaaatcaggtcatagacttgagggaacttaacttgaactgttaaacttagatttctttttttcttttagttagacttgtaacaaaaaataggcaagagaaagtgatggacagaggccttcagaccttgtgtctaactttcctccctgatgctgcattgtgaaccccagattctttttttttttaaatttttatttacgtatggctatgctgggtattcgttgctacttccctggtggctcagatggtagagcctgcctgcaatgtgggagacctggcttcagtccctaggttgggaagatcccctgaagaaggaaatggcaacccactccagtattcttgcctgggaaattccaaggagaaaggagcctggtg

SEQ ID NO: 44319 - DNA, 3968 bp, Bovine  19866880350779
gagacccaaatgcattatcattttaccactatccatggctgataaaggttgatgaccaactcaagttatcaggatttacacgagggctacagactttcaggttagaaaaagctctaaataacacatctgttcaatttcctttagatgatggtaagtctgggctagagtcaaggtagatacacacattatacctaactatatacatgtcatatatataattggaattattatatcatcatataatttccccccctaagtttctttctctggcaaggaggctgtttcttaacccctgctcccctcgccaactttggcatctgcatgggaattctctaataccttcagccaggtctccttcatctacatttcccacagagtccccttcactcaggtggtcaactggtggctgtattaacttattttcctactttctgtattttttaaaaaagatttattttattgaagtctagttgacccataatattgtgttaatttctgctgttcagcaaagtgattcacatatgcctatatatcaatatgttctttttcatattcttttccagtttggtttatcatgaggatattgaatagagtttcctgtgctatacagtaggaccttgctgttgatccattctatatatacatgatactttgcatctgctaatcacaaactcccaatcctattttctgtatttttcatgttctgacatctaaggccttgctgactgtgggtggcctgtcccttgcaggattagctaatttctacggataaaaatcaccccatgaggaagaacaccttttctaggcaaagcctccaagccaaagccacacccccaaggacctccccctttatagctcttacattccaggccaattctctcttgcactaattaccgttggacagtctctctggagaaaagtctctctatcctgaagcctgatgaaacattcaaaatagccagtcctaaacctgcttgggcttccctggtggctcagtggtaaagaatccacctgccaatgcaggagatgcatgtttgatccctggatcaagatgatcccctggaaagggaagtggcaaaccactccaagattcttgcctgggaattccatggacagaggggcctggtgggctacagtccatggggttgcaaaagagtcggacataactgggcaactaagcaacagaaacactcattcgttcctgtgaaatgaaggctcttgttctgctgtccctcctcgctctctctgcctcctgactaacctggaacttcctgtatggtatgctgggcctctgctccagggatctgtgagtataaaaccttcttcctcatgacagttatttctgtttctgtgtgttttaccacacctgattgaaacaaaccccagtacattttaaaacagcagaactgagtgccctaagtcaacagggccttgctccaggcagccaggaggctgttcacttaagaggacatgttactcccagcacctgagtcaccagcagtggaggacatgttaccgcgagcctggaggaattccggaaccagggggaagcaggggcttcctaagagtgggccaatgctgcagcaagagccatcaccccaggggccgccacccaagaggcagggacattctagtgggtgtgcatcctcaggctgaggaaggagcgggcaggacttaccttttccaggagagcattctgccagagccggaacatcatcatgtacgtccgatcccgggccccgaacgaagtgaaaaagtgctggattgaaagagagcgtggcaagaaatgtctgtgaagacttacaaaataatggatggagacatgggactccttcctttaaaaaagctaccgagggatcttcctggtggtccagtggttaagactccatgcttccaacacagggggtgtgggttcgattcctggtcggggagctaagatcccacatgctgcgtgacatggccaaaaattaaaaaaatatatatatatttaaaaagctactaatccatcctcaaatactgcacccacgatgacagcacagggctccgcagtgaaaggggtcagttcgctgagttacccactgtcgtcaagtcctttgccatggcccaggcacctgggacctctgagtcacccactgtctctaagtccttcaatgttcatccaactctgctcagtgcttctctttctggtttgaagttttcacctccataaaaagcttcctttgcctccatacatagattggtaagtggtgagctgggaaccagcccaaaggaaagagaaggtaaacccactaatcaccctttgattcattaattcagcaaacacttgaatatcagtgtgtgccctcttctacatgtacatacactgacgcatgtgcaaacacttttctacatattttgagctcagtaacaaaacagaaagaaactgctgctcttaagaagcctacacatttgtggggaccttttataatatgcgggaagaatgcgacagaaaaccagattttactgaagacattctaggtgcttcacaaatactacttcatttaaaccacactaaaaccttggaaaataaacacaacagctaatattcaataaagagaaatagggtggtgatggtaggtgacccctgtaattacaaagctacttcatgctagaagcagaactcgaagcagagactattggactttgaagtctcagggctcttgatcctgaagtgcctgaagtcaaagggtgttatagacctgtgttcagtccatctctagccctgcaagtatcagtcttcagggcctggttaaaggtcaaagatcacagtgctttctgcactctagattttatctaccacatcttccccatggcaacaatatagacaatccgtttcctatcagactcctcactccttttgatgagctgtcctgatacataatgacacaacttccgttgtttagagctttacaatttagtgttttcaaatgtgggaggtcattccaagattctgacaaataggcatcgctggctccatttcacacataagaaaactgaggctcaggctactcccgtagccacgggactctatttcaggtgttctggctctaagttcaatgtcccagcactccactctcatgtctgctagactctaagcacctgcccaccacagaggtggttcccacaatccacttcactctaccacctctcaccccaaccctactggtctccccattaatgcgactgaagggcaggaatccaggagtagagggactggggtttgggggagtagtaagtccaagatcagactctacttaccttttctgagtcagtgcaaacttggatggcattggggatgaggcgagctgtcttttctttagtcatggagcagatgtctttcaaacgcacagttagctggcatccacacagaaacagagaaaggaaaacaagaggcagcattaatagagtcaggtgaagagtgttctccaggtaccagttcacacagaggaagtcagatcacaggctatatgcttctcaaccgcgaaggaacctcctcagagatcacttggttgagtcccttatttcagaggctgtagagcaaccctcattgggagctcaagggtctcttgattcttggtccaaggagcttgctttctcatttctacacagcctgataaacatgcatggatcccatcagaatctgccacttacagaaacacagaaccctggcaccagatgagaccttacagtcacttatctatcatttctcactttattttgtaagactaggaaataggcaaatgaagaataaaggactagcttcaaattgcatggctaattggttgcagaacccagaaagtacaagccagttctgctgagttgcaaggtcaagtttcctctgactcttacgactctgcttctgtggtggtggtttagtcacttagtcatgcccagctattgggaccccatggactgtatagcctgccagg

SEQ ID NO: 44320 - DNA, 1734 bp, Bovine  19866880360109
ttggacacgactgagcgacttcactttcctttctcctgcattgtaggcagattcttcactgtctgagcccaaaggaagtccaaagaaggctgagtgctgaagaactgatgctttcaaattgtggtgctagagaagacacatcagagtccctgagactgcaaggagatcaaaccagtcaatcctaaaggaaatcaaccctgactattcagtgggaggactgatgctgaagctcccacacttaggccatctgatgtcaagagctgactctggaaaagaccctgatgctgggaaagattgagggtagaaggagacggggcagcagaggatgagatggttagatagcattgccacctcaatggtcatgaataaaaaaaaaagtcatgaatctaagcaaactctgggagatagtggaggacaggaggccctggagtgctccagtccctgaagtcacaaagagtcggacataacttagtgactgaacaacaacaacaaaatctcatcagctaataaccaggtatctgagacctaagagagactcatctaaactcatctggactttttgaggaagggcaaacaggataagggggcttctgctgataccaaagctcccgttctttgtagagttcaagagagagagagaagtctgtcctggatctctttgttggttgctgaaactgtcaactggaaaacacacacacacacaccctaaaaatgtagaactatattttgtactgaggactggagcctgggaaggcatcccctcaggaagctctgagggactattcctaagagggaaagaggagacaggatatataggagttttgtttctttcttctttttaagtaaaattaagacaatattctactggggaatatatgcaacagatttttttttaatctctccatatctacctctggtactagcgttttataggcaaattttaaatggacacaaatttttaaaaataatgaaagccatgttttgcttagggatactattatatatatactgtacaggttattttacagcagatactcgtctgccacatttcagatgacagaatgctaagcagtgagcttggcgctgtccagctagctgtttcttggcatccaccctggagagtctgtcggtgtgtaaggtcgagaccattttgtcaccaccaagtttcttctcagaggtgactccactgtgatagaacattcatcttcttaagatgcaaggcctggcaaaaagcctcccacgagtccactggctataacaatgttctgtctgacaaattctgttgctgcttctattacattactgacttcgggtgctgccttatttgctcgtttcttcatccgtccttttgctttgtttacatctttttcacgtctcttccagttgatctgcacatagccaccatcaccggccatctgaaggagaagaaagccaccacctaccgcagtggctgcaagttttcgaactttctggaacaaaaatcccgcacaccagccactcactccacccactgcaatctgggtggctactgagtatttttctacgataggtccggagctgtgggcaaacactcgattccactagtgttgtcttctggcacactcagttaaatccaacactttgtaagagtcaccatcactttcatattcttggggaggggaggtgccgggtcgccatgatattgccgctggctgaccgaagggtgggtcccaaccctcccgccgctccccactg

SEQ ID NO: 44321 - DNA, 2095 bp, Bovine  19866880411371
cagagaggtggtctcctgagaaacggtacagtttagagtgagcgtctggccttcctctatggggacagtttccatgtggttggtccgaaaggcctctgtggaggaagagaattggggaccgtcagacaggcatgggccacactacacctgaattgagacaggggcttagacttgaggcaaccttgttcatcgtttgatcatttgtatacatttgttacagaaacagaagccaaagtcaacaccaaaaactgcaaggagaggagggaagcagtgtgctagagcaatcaagatgtctcttgaaggagcataagtgaaggtgtgggttttgatgaaaggaaagttgaacagcgtctatgaggcacttgccttgccatatgctgggaattgtatcttccatgttactgatattaaactcagctttcaaactaacgctctaaagcaccagttcccaacctttttggcaccaggggctggttttgtggaagataactcttccatggaggagggggcaatggtttcgggatgattcaatgtgcattacacgtattgtgcactccattattattacatcagctccccctcagatcatcaggcattagatcccagagtttgggtggccctgctctaaaggaagagtggttttgctcacttgatgatgaggcagtacaggttcaaggtcacagaggtcctcaagacggcatcggtgcccaggtctgtgggtgtctaagcccatgcttgtataactgggtcggactacctaagtgatgagagcccagaaaattcagcttttctggcctctgtttataaaaaggctgactcgtgttttcaagtacagttgatggggagtgggtttcagagtctaagaaagaatgttatgtcctctggggctcttgtgaattacagagctgctcttcctggggagtaggtaagcccctggggtggaagagcttctccaccagagagtggatgttcttggatctcttctgatctaatattccacagcagcgctttcctgggcacatgtaagagtctgtaatttccccaaatcataacccccagagaatgagaaacaatagttctaagcagctgcaaagttatcctcccaaagaagaaattgatagaagaataaattggctttactgctgatttggcacatttattgccatttgttattttttcaactttaaaattaaagaattctttttcctgaggatgaaaaaattcttaatgaaagtacaaaacatgtctataaacagaagaataccatggggttataaaatatgaatagcaaatgcaatgaattttattgtatcatattagctgttaaaaaaaaaggaaaaagaaatgactttatttccttgtgataaatttcaagtattaggaaaagcacattgaagagctctgggaattaactgttacagactttttagtttgttccattttgaagtcattaatttcaacctagcctccagcaataatcacccaaaattattgtattcttattgactttcatgggaaaagagttagcttgagtcctgatggaaaaatactcatatcatcagccaatactataatgaacaacaaggattcaataaaaagagattgttttcaaaaaaaaccattgaggcataggccagaattctgcttaggcaggtcatttggaaatattctcatctataaaatcaacccatgattgggtaataaggataatagtagaaatgcattgaaatgacaatggaatttcttctaagggtaagcaactcttgagccaagaatctgagtctagaccaacttgttctgtatcattccattatacgattcttgctttatctctagcccttgtgcatgatcttgcttcccacagattgaagctgcaagagggcagtgactgtactttatatttatctacaattctttcttaacagaaactgtcacagtgcaagcttggcaagtaatggtctaatgccagctttcatgatgacactgtaacacaggcaatggatagctatctttgctctcctgttgttcataagaatattgacagagaggaggacagttcctacagaaatatatgataggataaaaactaatgtta

SEQ ID NO: 44322 - DNA, 1695 bp, Bovine  19866880419158
ttcctggattgaattccaactctgggctgaacagaagcttcaggaaagccagggagtgggggagtggggtggatggagcctgtggccactgtgatgagaatctgccctccttggcttgtgttggaaaaggcaggcaacctttgcccagtctctgaccctctcttcacccatcacctctctgaaccagaaacaccagtaaaagggtaactgatacccttctgcctttctccttggccaaagactttccatggaccttgtctttttgttaattggtcaattaatacattcatcaacaactgaagtcactgctaagatcttctccacaagtacttttccaggcttaagttaactccctaatgagaatgtatctagtatgtacctgccgtgtgctcagtcgtgtcctactcgttgcaaccccatagactgtagcccgcccggctcctctgtccgtgggatttcccaggcaagaatactgaagtgggttgccatttcctcctccaggggaccttcctgatccagggatcaaaccccaatctcctgcatctgcaggtggatcctttaccccgcatcacctgggaagcctccatcgagtacctagaaggcattagacggctggctgcagatgttttggatgggctctgctacctttcattccttttgtaggattttttttttttttaattaacttcacataggtacttgaacaagatagggatggaagaatgagtcagtggaaattgttggccataaaaagtgccctgaattgtctacacagtagctacagagatggggacccagtgagggacagtgcagagagggggtgggggctgggccatgtggaccctttgagccaatattggggtgaccattggccacatagtgagtctggagaattgtcgagcttccgtttgtaaagtgtccctgcccttggtctgatctggtaacgatctagttctgcgttcttggttccaaatttcaaacagaacctgtccctgaacactgtgtctatttcacccaaaggcccaacttggaaagcccccagggcatttcagcaagttactagcacagaaaagagggaacgagctgttcatctctgtcagaatcttggtcttctggcagtggagggagacccactctgtgtcacggtctgaagttgtattgtatgaattgtggcaggaaggaagagcattatccttaaccttgctgaaatgtagcatgatgctacattctggccagagtgtggtgtgctggaaccaggctgagagagacctgctttagcgtaagttgggaagagagcttctatgccataaacaatgcatgctgtatatgctgagtcacttcagttgtgtcccattctgtgaccccgttgactgtagcccaccaggctctccttctgtgcgtgggattctccaggcaagaataaaacagaccagcaaaaagtgccaacagcaacaaaagggcatctctttagaggctgtctggcccttctcttcaaccaggtaatcacagtgtgacacataaggcaccattggctttttctcccttaaacaaggaattggacccagtggcaaagttgttgccaggtctaggttctaagtgctaggctctcaaagagtgagctctgtacatggtcaccaggcggtcctcttaggggaactgtactacattttctgtcctttccaaaccccaccccat

SEQ ID NO: 44323 - DNA, 2588 bp, Bovine  19866880434472
gtttgcctgggttatgaacacattagccctcaatgagtacagctattgttgaataaataaataaatagctgactgacctaacagaaacaccacaaaataaaaccacccaaacatctccaaaaaaataggaaacgtgagaaactttggcaaagaagaaaaagtagatcaggaagcacagaaatggaacctgtggttcttctgcagtgggtagtggtggtcctgcggtccctggttgagaataagcaaaataagggttaaaaagtgttgagcacttactcgatattatatcacgccttgtgtcattgtcatggattgttgacatcatggcttttttatagatagagccgaggcgtaagtgacttgctcagggtcacgcagcttgttcaatacggatttgaactgaagtctagtttcggaatccttgtgctgaaccacaaaaccatatctccaggactggtgtcaggcccgtgtcagttaagaatgcagcttttctctgctggtccttgtcaacaagcaagcagtttctctgccagcaagagattcttgtcttgtccttggcctggagacttccactgtgaaaatgagttaacacttgattcagctgtctgttaatggcaattctcatatgtcacttagttgagaaaggagaaatctccatttggtgggaggacagcaggaagcagctggctgtgggtgtatgggtgctcgggctccctccctgagaaaacctgagaatgttgatgcgcatcctccagggtccctgacaccatcagtcaccccgaatttctccagagaataaaccaggaaggagcagggaggggtaaatagaaatctgccttgtttcttccatctggcagcagacatgtttccttttgttatgagtgtaattagaatgaggagtgaaatgaggccacgttcccctctcctggggggtgggatttctccgaggtgtgcgatgtctttcctgacaggagggcatttacctcctagaggccgcccgtctgtctagcagcagcaggagttgtgatccaggatctgctaatgaaagagttgttgttgtttcatcattaaattgtgtcctactcttctgtgaccccctggactgaagcccaccagactcctctgtccatgggattctccaggcaaaaatcatggagcaggttgctgtttcctccaccagaggatcttcccgactcagggaatgaacctgcgagtcctgcattggcaggcggattctttacctctgagccaccagggaagcccccgatgaaggagtcctacaggtaaagcagcactgagtcaggcaggcaggtttggaaagcagggagggactttggaggaaaagtggaaggcaggataaagagcaggagtccagtcccctttgggattttcattgccatacagagcagaacccaggatggtcctgtctcctttgatcaagccgggaagtaatcatggagaggggatgtcaagagctgcttcagcagacagggagggaaagcttaactggcttccgtccccaggagagcaggggaggcagctcccatcctggcctggattagagggagaagggcctgggctggagagcgcagatggttttgaggcctttgtggtttctgggcacagggctttgctccctagcttttgctctcttcaccaacccccaccttatctcagggttgggagtaggatcagaacgaggcctcccagggcctcagtttctccttccatccagtgtggtttagtcacatctcactgggttgttgtgagaaccccagacctaatgcacgggaggccgtccgaaactcacgtggacagacacccctgtgtggaatccctggccgcccgcctccatctcatctccctccctcctctctggtcctgatgaagagggggtgggatgaagcctaccagagcttgactttgaccttgtccatcctattggttgcctggaggaaccttctggattagcagattgtgaaggaggagcgaagaaggctgggggtggggggggaggtgagtctgtctgtctagcaccctaagcaaatccctggggtgcagaggcagaaggaagcgtccttcaaatgatcagagcctggctggccttccccacgaacctctctaccccagctactccgtggcctgagccgcccctccctagagtggcccgcggggcttgagggcagaggtccaagcactggaggggtggggcgggctcaggaggccccaggctgggtgccaaccagagggcaaggccaatgcctgcagtccacaccgtcaccccagagccagtgactaatagtggcagagggtggggagaggagagtggaggagggagggcagggaggaagggagaaggcacggggaagtggtggggagcacctgatgggcgcagctctggccatctgccgtcccctcacacagcctctgttgaccgcagcgtggaattctggctggaggacgaggtgtgggggcttgttgttcaagtgttcaggaggctccccctcccccactgctcctctccactagcttcctacctccaaaatgctccttaaatataacgctctgggcgccgacgactccctctg

SEQ ID NO: 44324 - DNA, 1774 bp, Bovine  19866880511788
tgccctcagcttcctcatctgtaaaatgggtatggtatttaccacatcatggagccatcttgaagattgaaggagatgctggttatgaaaaactgtagagacttccctggtggtccagtggttaagattccatgcttccactgcaaagagcatgggtttgatccctggtcagggaaataagatcctgcaagcacatggtgcagccagtaaaaaaaaataaaatacacggtgttgcaaggatttcatcttagaaaacaggtccctggtctgtttcatcttggagtgcaggtgcaggaaaggcagaaaactaaatctttccctggtatgaaggagcatggctaagtaggtagcagaggacctaaagggtgaggtagaatagctcttaggggttagtcctggaggacttctggaagaggtggtttccaaaaaagagggggctctatgtctgcagacaagaaggcagagggcattcccttcttcctcagagaaaacccctcactgagggagaggtgagatttgatctgggtgaccgccctggccagctgaatggtctgcagctgctgcgccctggagaggcgggcccaggctccgccccactgcctggcctgagccttgtggctgcgaaggggatgggcacccgtgaggcttcccttttgaatccagcctgtgcacgtgggcccctcacacagcgcttgcctcagccacaccacccctccccgctcaggcttcctgttttgaaactaccaatagatggaaaatgtgagtgctgtcactttaacggctcaggctgtgtgtgtgtgtgcgtgcatgctgtgtgaatgtgtgaaccaagtgtgagtgggggcaagtgtgtgagtgtgagcatgcgttagttgtgagagtgtgattgtgtgagcctgagttgtgagtgtgagcatgtgtgcttgtgtatttgtgtgtgagagaagagagagaatgtgcatgtgtgtgccgcatggcctgggaaaggcaactgaggcccagagcctgcccttgccaggacacctgtgggaagaggcctgcccggagctgtaccctccctgcacacctatctgcccagcgacacgagggaggagcacgtaaagttagtgtctgcatgagttctggggaaggtggccgaggcccttcctgttaactctctaaagctcatctcttagcttgtagaaagatcttttgttcctcaagctttaaaaagaaataatttcttgtcagtccagaaatggcttcctaaggaactagttcatgtaaccaacctcacttaaaaggcaggcagtgtgtccagtctgtgcctttatccccaggcctattatagttcctggcaggtagcagagtccagtggattcattatgcagatacttatggggtgtttactgtataccatgggttgctcaaggctcttgggattcaacacagatcataacaaaatctctggtctcaggtagctgtgggaagacaattgcagttccacgtaaaaagtatggcaggtgctgttagtgttggatggaagaatggattcattttaaagctcttggtttttgctgcgttctgcagtgtgaaggtcataatcaatatacttttcttcatttactaagataataaaattgacccatgatattttgagaaaagatgaatggacaggtttctcttcccttccatgcccctcccccagcccactgttggccttcctaaagcttctagcaccttccctccttctctacgtcacacctgctggtccttctgtcttcttggctggatg

SEQ ID NO: 44325 - DNA, 1227 bp, Bovine  19866880524447
accgacattgtgtcagaacagccagagcaacactaatggtgagcagggagaaaagacgagggagaggactgaaggcttagtcacaggctggtgaatttcacacccccacctttggccccatccctgttcccctctttctcacacaccaaaccacaggcccagaaacagctggcctggcgccgggagctggggtaggtccacaaagaaacttcaatcgtccagggcagttgggactgatttccacaacttacagaggaagatggaggggaagcggctggcgagatgacatttctggggatgaatgacatttctggaactttgctttctctctctctgagagaagtgtttattaaaaaccttttttccttcagcagtgaccttgcaaaggaaattggcctcgctgctctgtagctgagagggagggcacacacacagcccctttgtgctgtatgcctgccaaaggatgctctggagggtaggtagaggggggctgctggctgcaggctgtcctcccgaaccagcctaagagactcggatcgagtgatgacagcatgtgtgtggctggaaagagacaagaggggacgaaaaacgagcccgggctggatttttccgccaggctagcacttctgtcagaccgcgcccgccgctgtcacgttccctgccttgtaggtttcatatatttaacagccgggacttataaaacaggacaacagaggtcacaggaaaaggatgggtcaggctcaggggaagccctgcaatttcctttcctggagctctctgggaccgaaatgagagacgcctgcactggaggaatgtcctggtcttccccttggcttgcactgcccctcctgtctggagcctggtccaaaccactctttgtccaagtcccaccctttccttaaaagcctctcctgacctttccaggattttacactccctgaggtcagagactctgaccaatggagtcttgctgattgacaagtgagaaagcgtacggatgcctgagatgaccttgaatggtactcaactccggtgtctgctatccctgtgctgttttttggggggtatggagggggtcctcagagttatcctccaccttcaaacctgagaggctaaactccagcttgtgttggtagtggatgcggcccgggttccaggagagagctggcaggaggagaggggactcatctgggagccggcctgcctggggggggtgacacaccaagg

SEQ ID NO: 44326 - DNA, 1258 bp, Bovine  19866880588916
agaaaattggtggcaccttggtgaagaatccacctgccactgtaggagacaggggttcaatccctgggtcgggaagatccccttggagaaggaaatagcaatccacttcagtgttcttgcctggagaatcccgttgacagaggagcctggcaggctacagttcatggggtcacaaagagctggacaccactgagagactgagcacacacctaagaaaattggtagtatcagcaggcatggcaacatgcgctgtgactaatacgtagagggagcccctccccagaaagctctcttcccagtgggccaggggatggatctttctgtcctactcgagtgcgtttgactctcgggaaagcttgtatcctgctgaagtctacctaaccagtgagcacggttttagtggaggtgttggtgtacggtagggtgtgagtggtgctggatctatctgaatcctcatccctctgtccccacccttctggccatttcttgcttcaggttttaattatgtagacatcactgtccctcatgtgagagatgcagtattcatgagaggtcttgggttacagctgggtcacaggcaatccatctactcattcagaacccccaacccagcttccctggattaaagtctgggtttgggacctcagggagggcagagtggggacctgtgaatcatccgttctcccacattaatggttcataaaacacggacaagcattaattccaaaagagatatttaatagggtctcctgggtatttgatgaccagggtacaccacgtcttttacactaagaggctgacttaaaagacctttaatggtaccccctcatattttgaattcttcagagatatgtggacctctccagctaacaatttaatttctttttctcttccaaactttgtggaagactgttgtgtttctatgtcccacttgtgcttccttgaccccctttctctctgactgcagccaactgatagcagcttggccaagaatggactgtggggtcagaaactctggtctctctttctgctgtgtaatccagggaaattatttaatctctgagatacctcagtttcctcatctgtaaaggagagttgatgtgaggattaaatgagggagtacacattaaatgtataaaaacgatttggctcatagaatgccctagagccatggtccccaacatttttgatgccagggaccggtttcacagaaaacagcttttccacggacaggtgcaggggaggggcatgggggggg

SEQ ID NO: 44327 - DNA, 3124 bp, Bovine  19866880597838
agccctgaccggactttgaatgggagaccctgatgagcatcaaagcttacaggacccaagctgcagagtgcaggctgctaagaactttcttgttggagtagctagaagtcaaaagtattctcagaaacttttgaaaggacaaatggtaaattctctaatttattccatgcatatttatttatttaaattattcagttattaaaaatagtgtattgggaccttcagggtgacttgaaaagggctatttgctggcaataaagtggtggaggtaggcctgactctgtgggattgttttactttggcttcagctcacaggcccctctcaggcagaagcagtgacagggaactctgcgaggaaccctctggatttctgggggtttgggcaggagagagtgtgtacacatgggaagcgtctcttggcttgcctcatttctaagaatcttggatcatttataggcattttctcaaaccaggagaaaaccaacacctctgttcactcccagacaaaagctgttcccttttactcgataacctgtcaaagagaagggacctcactcttgcagatcagtctgggagtgaaacatgtaaatgacatggtaacttgtggctggcagcctggcttgtaagggagtgttaaaactgccgtttctgaggttatttctccttgccagggcttttttttccctttcctacataagaactcagttatacaggagtctttctgcatcatgtagtgagacatgtgagtgtttgcactttctgcaaaaggttttgcagtttctagacaggtgagaacaatagtaaggtttgcagtccactcccactgactggggggcgggaattgacgaggctggtgttggcaaggccagccatgtctgtgactctctgctgccccgtccccatcctgggacaaaggggtagctttgcagcacagtaggatcagcagttgggagctctcggtaacggcactggtctgagagggtcaggagacctgggcctgagtcctggccccacctttggacaagtcacacacacatacacacgctccctctaagcttcagggcctgacctagactatcctaaggtcagctctagctttcacatggtcttggaggctgggtcagagcctggccaggctgggctttctctaacttggaaggcgccctgccaagagaggacaggccttctggacaagagcttctctggtgtttagatgagttgtagggtagtgtcagggttcccgggaaatccagggtagtaaaactttattctaagggctaagaggactagggaggtccactgaatgggtgggagagggagatgagaaagagagatcaagcttgctgtgttgttcagtgttaacctgggagggtgtttcttcctctgtcggcctagtcttagtttccgagggttccttccttgtaacttttataagctgggaagaggaggagggtgggaagaaggacatcatcttggactaaccttgtcttccatccctgggccgtgaagcctttcatctgtccatccttctttctctttgctagagcaaaaggtggggagaagtcattcctgatttgaccacctctcttttgtctctaacctcattggggtttggattaagtatggagctttggctaaaatccttgggttgccttagaacactgacactaagaacctgggattaccaggaaggcggaggaccaagaaacctagaggaatgctttgagagaagtggattctcttcattgccgtgtccatgacacaagcttgaccgtgtctataagtttgcaggcagcatctctagggtgaaatcttagaggcgggattaagggaaggatctttctggactgtgtggtctcagcaggatctttcctgtgccctctatgcttcatctttagctctgcagagcagccaaggccagcccatcttcccaggggcctcaggagaaaagcactctcctctcttcccccaggtggcagggcatcccctgactgcacctgcccactccactaggaagcttgagaacctctcttcctgaccctctcctcctccaaccttcgtctctaggcgatgggacaatcaccgcatccaccacttgcatcctctgccctcatcccccaacttccagcagggctggccccgctcccctccacctctagttttcttccagaagattcggttttgggtccgggaggaacatttttctggaaggccgtcttttcacccccctgctttcctgatgtggagcaggaacttgcacatggtgtagagagctccccccgcacctctctgcccacctcgttacctcactcctgctccggccatggctgtgacgggcccagccagctcctggttccgatgttctgtgtgaagctcaggggtcttgggcattgttgtctgttgtaactcgaggccctcagcaggcctgggagcccggattggagccttggctgctggcgagaagcaccttgcctgctaggagtttgatgccggacgatgtacccgacgtgtgaaggcgtaaaggacgttgtcacttctgcccctcggccctgcctacttctctcaacacgaggagatgctgcagaagcaaaacaggggcctctgctccaggcgggaacagctgactccatctggggagtaggcctgggtgccgcgcgccgagattgctgaataaaagcagccatcgttgccagcaccagtgtgtggctcccacgtttctctgtcctgcactctagggccagaccactctctgcatggacgatatcatcttcccaaacccatggtgctttccccctgactcaacctggactccaaggtggggagggatgggtcagaggccaccgcggctcctggataatcctgacctggggtggagtggggtgaggcagagggagcagcccccaacacctgcactgggccatactagggaaggaatgcagttgaattctctggccatctgcatttggatctgtaacttacttcgcctggcgctgtgcgcaaggtctgaaaacttactgctagtacctagaaacattcaaggcttcccggttcaatcttaatgtaaagtagctagagccatggaagtacagtatgaattaaaagaaaaaaatgctgaactacgaat

SEQ ID NO: 44328 - DNA, 1659 bp, Bovine  19866880612104
tatacctgttatcctttgagaagctgtttatacaggagaaggaagaagaaaatgaatgtccagtgagtaaaatccctgtagatatctacactaaataatttgggctccaaatggactctttcctctgtggcaaatttgcctcctaaattaatccttacactttcttttttgccatccagacaatgatcgaaatcactctcatgaaacctgattggccttaccccggatctccaacccgtcacctggcagcaatgtcttttcccatttcccctgcttccacacaatggtgacactttgaagcagtaccaaggatgccgtctctacttaaaattgataatctagcatacaaacctcaagcacccatttttaatgaaacctttagatgaatatcaaagaactatttgccatgtctaatgttttaattcgattatattctcaatttaacccattaaacctcctttgatgatccccatatttagtgtttagcctcagatgcacgaggtaatgaatactggaccttttgatttaatgagaatttcggctcttccagcctgcgcctctttgtataccttttattttgccagctatagaattcagttaattgaaggggtctcctaccatcacacattaaggagtataaattagcatgtccattctgattggaaaatgcaagcagacagttttgctttgatctgaggactgagctgaagaaggcagcagccctctgaaaatgagctgatggccttgttatcagggcaaaatgtagatgcgtccgtgtgtcacaaaacacttaatgtcttaattgatcaccttccaattctccctgtcctgtgtgcagcattctctttgtgagcctgtgcgcacacgtgtgcacacatgtatttgtgtgtctgtggctctgttttgctgtctctatttatcttttccgtttctctgttcagagatcagggacccaggtttcaaattaatccgaaaccaagaaaaatgaaataacaaatcctttcaccttgaaatttctaagaataccctgtaaaactattcaggacctttcacagacaaagattcttaaggactaactaacttccagtactttcaaatgggtagatcccaagccattggtactacattactgaatatgaggtaagaggggatattctgtgctttggcaacgaagtcaaccttttagtctgttgtaatgataatgctactcctgaatttaacaaattcagttacataaaagaaacatcaagataaaagatcagtacctccattgtaaaagccagaataaacaaacattaaattcaaattatgagaaatctggataaataccgtagattgaacatacacacacgtgcccatgtgcatatctgtttcactcctttggcaagctcccactaaaatcacagtaacagctttttgttttttaatggcataaacatgtaagaacagggagaacgggaagagggataccagtagcgacttttgtaaaactagaaaagggatgaatagattgtaaaataataatactaattaaaagcctcaaaaaataagaaattgtaaccaagcaatggggagatccaagaatcaatctgatttatactacagaatgcccccaaatgctcaggaactgatgaggtcaattaccactggaagtagtgg

SEQ ID NO: 44329 - DNA, 1311 bp, Bovine  19866880672117
ccccttcctcctttctaactccccaaaatatttgttaataagcatcagcctcagatcaaaaagaaccagcctgaactttgagttgtgatagacagcaactgagaattttaaatggatatgaaatcacataatacagttgtcttttctctttcttatatacatagatgcaatgtaatttccaaagaatttctcaaatagggtcgtctgagtttagtttttcaagtaggtaaatgtggaaaaggagaatttcatgtgaattgagatcattcaggccattctgatcaacaatctgggtcctcagaggaattaactctttcactcaaggttttccacctaaaattattcagaaaattatttcagatttctgccttcctttgctcacacataggactgcagcccacctaaaccacctaacaggtcatcaaaggcctaagtccacagagagggagagagagggtaagttctgaactgtcttctgtataagtacagatgctgcccagcacacactgctacacttttcaaggaaatcggagatgagatgttcaagcatcattctgagcactgaaagtccatgaaaatttgtggagaatctaataaacattatagatctggtgacagtggacttacctcagtacaaataaaagaaggactggccataatgggacttttctcttaacacctgtaatgtacttcccccgttttgagctgaaacttgtaatcaatcatgtcagcacagttacttctagatccagaagatggatcagtgtgcagtgctggaagaaatcaaggtttgtttcttaaaatataaaattcatgacatctttctctaagtgacttaaacccaacagtgatcctcttgctaattaacatgcgtagccagcatcctttcacttcctcctgttttcaaggatcattaaattctggtttcaaatgggagcgcagatctgtttttatataccatgtgttttctgcatttgggttttgaagcttatttaatgctacaatatacactgatctgttttacatgaatgctctcttcaaagggctgggatttcattttgcaggtatatcctacagagtgaactacaccgtgccagaccactgtctgctaccgtcgacagtcagctagtcacacaattaactaggcatcaataactgatgttttggtttgattgtcgtttatttttcttttaaataaactccctctaaattcaggaagcaggtgtgatgagctaccacaggatgtggtagctcccaactttcctcaagtagccctacctacctattttaatatcatagcaaaacagacga

SEQ ID NO: 44330 - DNA, 1864 bp, Bovine  19866880701838
ggttctatccctgggtcgggaagatcccctggtaggaggacatggcaaccgactctagtattcttgcctggagaaccccatggacagaggagcctggcgggcttcagtccatggggtcacacagagtcggacacgacttaagtggcttaggatgcacacgcacacatccatcctgaactccctagctatcccctccccacattgttcctcctggcaaccgtaagtttgttctcttaagtctgcatgtctgttttctcttttgtaaataagttcatttgtatcatttcttttcagatcccacatataagggatatcataccgtatttctccttctctgtctgactggcttcacttggtttgacaatctctgcatccacccatgttgtggcacatggcattctttcactctttttaatggctgagtaacattctattgtatatgtgtaccacacctttatccattccggggaagggtggttttgaacagtctacattaatacaaagccaactaaaatttcaggtgtgttagggaacaagagactagctgacagtggctggagtctggaacttgagttaggaaacagtaggagaggcagtggaaaagaccacgccaccatcccacataccagccttgccagggcaacaggaagcacatgcaaagtgtgtgtactatactggtcaatgccaagcccacaggagttgacagcccctgaggaagctggcaagagctgcctccatcagaaagaagaaatctagaaacatctgcaaggacccacccagcagtgatagaaatcagggtcattcagacaagcctttgactggacttgccgatttcatcacccagaggtagctgctgtcctccccgagccatttccagggacaccatcgtgcgggcagccggacgacagagcctaacctgtgattagaactggcaaagcaggaccttctggctggaggagactatggaccacgtggccttaccaccatgtaggggagatgaggcaggggcatttgtggtaatgaaagttctcgcctcctgatgaagcatctccttaggggaagaagctgtcctctagatggcgtctctccatactggctagttttgcctctgagctgtatgtaactcaggttgccttcctgttcagtagtagccgagtgttaatgaacagcaacagtaacgatacaaccatcttcataacccttctcattttgcagagcacctgcaattcatctcatttaagcctcaaaatagctttgaggtcagtaaatgaggcttaccacgcccatcttatagacaggccagcttaaatccagggtacttaaggggtacttattctaattaaacattagtgagacttactctagagcccggctcacctgcacccagccctgagacgtgtctacttccttgtgtgccccaccctcactcacagcctttctttgtcctcagcctctgaggatcagcagccagcctggccctcagaagagatgcctcttcgtgtgtcggcatggtgagaggatggatgtcgtgtttgggaagtactggctatcccagtgcttcgatgccaaaggtgagtgggttggttggcctgctccgcattggcatacctctcacagcctctagggggcagcggcaagctacatttatctagatggagtcactgtgttgcagaaagtgccccttactgttacactgtaagtccttcctgatagtctggagtgttaggggagagagaattgtcctcgcctccagtctatcaactgggacaccacggaccacaaaaggcagatgtcttgcccagagccacaggacaggcagacgcaggagtcctattccaggtccagaactccctccagtaagtta

SEQ ID NO: 44331 - DNA, 1132 bp, Bovine  19866880794650
ggtccagagagaatgaattttatccctgaatcaagtctttctcttcttgacacagtctcatcctaagaactttaaagcctgaaagatgctgaattcttctttgtccacttaggatgtggtgcagacttcccccactggtactaaacacacacacagacacttctccccaagccttcctcaagctgctgcttctcgttcgctcgcccggttactcttgtagcagggtctctctccagttgaagcccccggtcggtccatgggtcagagggagaattggcgggtctgtcagctgccagattccagtttctcctaattcttcacaggaacaaaacccccaagtaggggatctgaaggaagacagaaaaggaagggaaaatagaaaacagaggctgagtgctttactttttacctggatgaaggaaaattcaaaagaatgaatggggcctttgcaggcaagcatcccctccaaaatatcactaaagaaaatgaaatggatacaactgatccattagaaggaagagtattcacaatgcaagaggagtctttggaagggattcgttgaacagtgggctctcctagtatagataagtaactgtttatagatgctttcttaatagcgtgggagataaaagcaatcatgcataaagctaaggtgctaagaattccttcccgattgcaagtcaggctgaaaatgcagctcaaaagtttctgaaattatactcggacaatgggaaagattattcaagttttaaaaatgtttcatcctgctttatgtcttattatcatttttttttggcatgtgtatctaacgttcaaaactgaagctctgcccttcctaccttcagtaggcatggcatttcaaaacttattcgtgtgtgtgtgtgtgtgtctgtccagagctgcatttatgaataagacaaaagtctctgccctcaagcaacttacagactaacagaaaggaatgacacatgaacaatctttttaaaaatgagaaaaaaattgcaatcaagtttgaactggtttctctggggacagatacaggaagcatgtaactcaggctggagggaagcatgcgtgggaggatggctgatggaaaaccttccacaggcaggaagaggaggaatccagatgt

SEQ ID NO: 44332 - DNA, 770 bp, Bovine  19866880827348
catgtggtgcagagcatctctgcacagcaggagaaggaaacagtcgccaagtgcattgcagatctaaagctgctcgcaaagaaggctcaagctcagccagttatgtaaacacatcctatccctattaagacagctagaaacagttgactgactaaatggaaaccagtcaatgtgataaaatctttctgtattgctttctactgaagttacagtttacctttcctataaatgaaaagttttgagtctgatacaatgagagaattgaaacaatctattggccagtaagatctttctctaattcatcttgcttgaataaaatttggtacctggctaaaaatagtcaaaattttagtttaaatttgtaattaattcagccatcttaacaataaagtgacagttgaaacaaacaaacaaaaaaaataaagccaaccacacaagacggagtgaagtagattaagctattgtggagagttttagttctttttccagctgcgtagtatatcattatatgtatatatacacacacacatatataaatatttatatgacatcttctttatccattcatctgatttcttttttaaaaattatttacttatattacttttggctgcgctgggtcttccttgttgcacgtgggctttttctagttttaacaagtggggactactctctagttgcagtgagcaagcttctcattgcaggggtttttcttgttgcagagcatggtttctagctgcaagggcctcagtatttgcaggatgtgggtt

SEQ ID NO: 44333 - DNA, 1029 bp, Bovine  19866880839912
gagttttaaccactggacaaccagggaagccccagtctttaccagagtttcccagcggaagatgttgctgtagaagcagatccagttttcggagaggtagagtcggccctgaagaagaatgtctctttggagtgcacaggagtaatctgtagcagaatatgggagatggagctcagggacagggaggcttctcagtaaaccgctacaattaagcaagacaccgcctccccccggccccccgcccgcagccccagggagcccaactgcccaccacagactaggtgtgagagataccagcctagcggcccagggagtccctagcagcttctgattgggaacatgaagggtgtgaaacaggctactgcctggaggcagaggcaaggatgagacagcagaggaagcaagaacattagaggcagaaaggccaacataattcagctaacgccactccccctccatgatttccccagtccctcgctgggccatctgcagacacaagagtagcaacgactcctcccaggcggggctctctggagaccatcacacacggggctcagccctgagcccccatcactgggtcagcactctggatgtctcctctcccagttcccagacagacactctcacttggggaccctctagtcagagaagcagccttccttcctgcccccacacccaggtcaccccgctcaccaacaatgaggcgctccgtgtctggaagttgcttaaagagctttctgaagtcttcatttctctgcttgtatgtggggcttaacacctgagtgacaatggccaaggttagcggatgctgctaggttcatgggcgggggaggaaggtgcaggaggagagcctgcttgcatatttaaaggcaaagttgaggttccagttaaggcagagaccccaggaggccaggctaggcaaagggggctcagtgtggaaaaacatggtggagagaatttgaagctgccaagggcttcgtacccagtgttacccagcgtctatcagtagaaaacgtcaaccctactaag

SEQ ID NO: 44334 - DNA, 1732 bp, Bovine  19866880874573
tcacctgtataggtaaaactcagaatttctggctcttcaggctcctgaggctctgggacgtctgggaccagaggctcttcttctctgacatgggagatctcgtctagtctggggattggaaaggctgctcaagagagggaaacaggacatcacgattggctcaacagtcccctgtgtcaagagcagatcttttctgttcggtagactgaagaaaaatcccataggcaggccattcaaaccttccgtctctttggcttgagcccgatgggaactgtatctcttgcctttcaccggtaactcagtaatcacaaaactggcagtgttaccctcttttcctatattcaagtaagtagaatactccaaacttttattgcttgcttcaaaactgatatgcttacctatgcgcactaaactaaaactcacattaaaactataatattacagctctattttcttgttcaagtttccaactactttttaggcattttctcttccctttaattttgaaagctatcatcttcttcagctgtcctttcatgtcaccggtagggtcagtgtaagagaagtgtagtatgtgcaacgaaagtctaagacaccctcagtttccaacaagaggaagatctttgtgctcaggacactctagaaacacttgaaattccttacacagggagaccacgattccacagtcgtcttccaagacgtattccccatagaactctttctgggttggatccagatcgctccactggtcctgggagaagcatacggccacatccttgaaagcgaccaagccctgaaacaacacaaggattccattacaatgtgatgcttcatggagcctcatatctaattcctggaaggaaggtctttgatacaggcacagtccatccaagagacagagaaactcagatgggacacctggttcctttcaggacacctgtgtttcattttctgttgctgcttcccaagtttctgctcttgcaactgaccctcttcctgttccctccaatccaaccactttccctcagcaccagactacactgttcttcccaaggatattatttacaatatgagaaaggtcttggaagtcatcattctaatggaatctgtatctctgcaaaaattcatcttttctaggaagttcttcctaactacccttacccaatcatgtaccacttatacagtctacctagcatcaacaggacttccctcttcagctctacaatctaaaaacaaggatgagctctattcctttattctccagccactcagcttagtttcagggctcctgacctggtgagctcttcttgaatgccatggcctgaatgaaagagaagagaacagcaaccaaaatcagaaactgattttgcaggccagtcacccttacaaatgactatcaagtttatttcttaaaatcaaaaacaaatcctcctttgacaacttcaaagttgtaccagagttttcccaaaacaaccccattttgttagtccctcaggtcagtggcaaatcaagaagctctggagcctgcagatccaactgagatgttctccgtgagatgcagctcctccccttccagacatgcgcggaactcagagcttaacctggcaatggacagtggaagcctgtgtcctgtctgatctgttcagtgtacgggtaatgctcaatggttcctcgagttccctgcgatgcagacggaaatgagggcgcacctgtgatagagcagtaagaaggg

SEQ ID NO: 44335 - DNA, 1093 bp, Bovine  19866880882860
aagtgggatgctcaggccagtccaagagaatataatatagctcttctttttggctaggtgagtgatcaactctcccttccctctgcctgttccattaagaggtctgctagaacaagaaatctggaagagttctccttgccaaattggtataatcccttcctgataagaatctctacaagccctgtccggagctggcaggattccttgggtcatcacaggaagaaacagcagttagtgtgaaggatgctaagcacgtgcaacagggccccatgaggtcagaagaatcacgggttctgtaagccagcccccaaaggccctcaacaactcactttcctaacccatggccttcttcctattccttaatgatctcatacctctcttgggccagaggccagggaaggctttgctcctcctgctagaacttccattcctaactcagataaacagggtctggaacagccccgagtggggcagacttgattggctttttcctgcccaaacccatacactggggccaaattcattccttccaaggcttgggtcttctttcatgggcaaagtatctcagatagtcatctcccttgactaagtaggttcctcaacgagaggaaatgatgctggcagccagaaagtgcatggatgttggtgctcactacttaaacaggagctctgtggtgagaccctccattccgtccatggctaatacattcaccttctcaaaccctggaggtcctagaacaccctgattcaccctagaaatcaaaagacagctcaaagggaaggggttagagccacagacctgacttacttacaatcactgaaagagaagtttacaagatcaaaaacgctccaccctgactaataaacaatgtgctcttagggcacagaggaaaaatagggctttaggcactaaaaagtgacacttcacccagatccagcctgggaaaagaccagagagaaggggtggggtgggaaaggaaggaacccccacccttactgggtccacgccccacgcaggttagaggaaggtgcagggagtaatggaggaggatgcccttcatcagaacaccagcccttaggagcctgcagccac

SEQ ID NO: 44336 - DNA, 880 bp, Bovine  19866880898198
tagggaaacccttacatcttacagaatattcttaaatacattagatgatgtatggtgtgaattcttatccttactttacaaattgagaagctgagtcttaaatcaaggaaatgactattcacacagcaagaagtaggaaaatggggactcagctgtgcggtgtatctcacccggctccaggattccttccactgctctacgacttcttccccaagccacccttctcccccatggtctccctccagaacatctgaagaaagttagtgagaaagctgacagacacaagagctggaggatattaaagctctttgataacttctcaagttcctttagaccattgcttatttaagacacctaaaaataggcctcatacatctcaaagctcagtgacggctctgggtttgttggactgcgcattctgagtctcattctctcccttgcagctggagaggacttcacctctgtggtctcagaaatcatgatgtacatcctcctggtcttcctcactctgtggctgctcattgagatgatatattgctacaggaaggtctcgaaggctgaagaggcggcccaagaaaatgcgtaagtccaaagatgccaaaatagggatagcctgcaccttcagagcgcttgctctcatgggtaaggtggtgagcgatttacacagtcctccactttccctcacaacaagctttaaggtaggcagcaggcatatacccattttacagatgtgaaagttgagcccgagaccctttgccccagaccattataagaagcaaagcaaagtttgacttcatgcctttcattcttagccatcaggtaaggccatcagttggcaccacaatcccataaaactgcattttacgaccattttctagat

SEQ ID NO: 44337 - DNA, 1016 bp, Bovine  19866880917275
caccaccccacccaggacctccggccacagggagcactcccaagcctcctcctcctcccacctccacagccttcaagaagcagctccatctccagccagggagtcttcttcctcggagctgcacacgccaccttgcagggaatggcgaagttttccgagcaaaatctccagttgctcaaccagagaaaaagccaagtcacccacccatctgattcaaaggagaagagggagaggtagggttttatttttaaaatggaaagcaaaaatattctgaggactttggcggctacagtacagatacccacaccctaagcaagaggaagaagggcttgcaaagccccaaggtgtgtccatggtgggcaagggacatcaggcacgttagaggggagaacctgcagcacccctgccccccaactctcttctcagagagaagcctctaagaggtcagagactgctcaccaggggtgagaatgccccaggagcagggggataagggccccctgggatgctctcgggtaaagcaagtctgcaccaccagcttaatgcggacatacgggatcctgtgaaaggtttctttctttatccagttccctcagcgttcgccagccctcggccccctcgaagttggagcctctttttcagctgtagtttgattctctccacagcccctcaacttccaacaaacgcctcccccaggaagaggctggcagaaaatactgcagcggtgcagaagctggggggtgagccagatagggcaacccaactttgcagagtgtgtggaccccaccttcacccctcgatacccggctcagaagagggggcctatctgaaggagacctctcctgaggtcgtggaggtgctgggggggagcaggggaaggggggtgggggcaggaaacactggggtgaagaaagacagcggcagggggagctgcctgttccctggtctactcaccaggacagcttgaatcctttcattagtacagtcacgataatccactgaccgtgtccttagca

SEQ ID NO: 44338 - DNA, 1393 bp, Bovine  19866880936307
ccggctgctccaatcagcctaatgaaacaggatcacggcccaaactttctcaaagcgacgattggccaggcagctctcactagtctttactccccctaggagggggagcggggcggggtggtggtgggggagaacccgaggaattcagtccggaatcgccagggccacctaaggatacagggttgaggtggggaaactaggagactcttggggccggatctcctctaccgagaaaggtgctttctttcaatcacttggggtacaggtcggggcacaggaagcccggacacagtcagaggggggtcagtaaggttcctagaggctgcttccaaaatgacaagctgagaagagaggacagctctgtggaataagctgaagacagcagacatgacatatgggggaaggacagacaacaggacctgagagacacagggcacaacgggaccagtcaggaaaaggggggtggtctctacatcttgagtgaccccctccatatcagagccccattccatgcacagaataaaatcagaggaagatgagcatgaagggtgtcccagggaattgagggtactccctttacatttctgggggttgggtcaattctgcttccacttgcatggactgggtcacaaaacatctatatgtccccgggtcatggaacctagaaagttcactctctagacccaggttccaccctaagagactggccctagaactgatccacctcactgaggagtcctctgtcaagattgagtctaaagagcccagctcctatagcaaagaagttaacatgtaccctccctcccagcccagcccatctgcctttccagtaagtcttacatgtaagaaccaaagtagagatgtgtgtatgtgtgtgctcggttacttagtcatgtctgactctgtgaccccatggactgtagcccactaggcccatctgtccatgggacttcccaggcaagaatactggagtgggttgccatttcctcctccaggggatcttcccaacccagggatagaacccacgtctcctgcactggcaggtggattctttaccactgggccaccggggaagccccaagtagagatgggagctttcagacagaccaggaggaacacagataatgcaccttgaagtccaagatgcggttcttgtcttttctgccctttctatgagtccaggatgtttctgtgccaggatgaaagtcacaacagcatgtcacaaatgtccctaaactgaggagaaaccacattcctaaagaccaccagagctctgcgagaaaacacaccccttcagtttgtgtgacagctggcccctggatccaccatgccctgcagtgacacctggggagtggggcatggctccaggcatcctgacactgcacaacctccc

SEQ ID NO: 44339 - DNA, 1497 bp, Bovine  19866880940727
tttcaaagagaaagttttggggaaggataggactttttcctatcagatacaaaggttacttatagagctggactgacatagacatacaacggggggcaaacagaaaaaggcagagagcccccaaaaggttaatgcctatataataataataaaacccccactggaacttccttggtagtccagtggctaagacgccaggctcccaacacagggggcctgggttctatccttagtcaggggactagatcctacatgccacaaataagacatggtgcagccaaataaataaattaaataaataaacaaataaaataaatattttttttaaaaactgaaggaagaatgaactgtccagtaaatggtataaggacaattctttatccacatagaaaataaaacagactaaacaaaaataagttgtgagaggatttaagacaagataaaatgtaaaactataaaattctattagggaatgcaagtgcatgcatgctatgttgcttcagtcatgtctggctctttgtgaccccatggactatagcctgccaggctcctctgtctgggattttccaggcaagtgcagtgggttgccaagccctcctccagtggtcttccccacccaaggatcaagcttacatctcttatgccttctgcattggcaggtgggttctttaccactagtgccacctggggagcccatggggatataagaaaatatctttattaccttagaaaacagaatttcttaaaatacaaaagacaaatcagagaggggaaagaatgataacttttattacactataagtaaagacagtcaacagactgggagaagatatttttaggacatgaaaccatgaagaaaaaagataaatatctcagaagagaacctgggaaagcaaatgaacagtcatatcacagaagtacacacccacattgcttatatgcttatgaaaaagatgctcaatatcaccaatagtaagcaaaatgaaaacatttttgtttcccatccatccagtttggctggtttaatctaacagtattaagtcttgagaacaatgtggataaatgagaagactcgtgcattgcttatggaaggaaaaaaaccaaaactcttgattctagtctgctgaaagggccattcttcttttctcttgggtaacacggccaggaggagatgcagagacctcctgttcaagagggcatccttgttcctaggccctcgctccttcccttttcctgtttcctcttctgaatacaaaatgcactgatttttcttccctgtctctcctccaacaggtctgactacctggccatcccatcggagaacaaagagaactctgcagtcccagtggaggaatagaaggggtcaacttgaggtgatgtacagggaaaggaggggcaggtagataaggaggcaggtgtacaggtggccttgttacgcacaaaccaaggtgacttgagatttggtcccttagatttctactctacatagagtcccca

SEQ ID NO: 44340 - DNA, 1149 bp, Bovine  19866880966967
ttaaaacttaaaaaaaccccaaaaacctgcagagacagaacaaagactgcttcttgatcctgaagctttcatcaagccaggaatgcctggctcttcccctagaccctctggtcctcttcctccccgtctccataatcaaatattcttcgtcctcagctgttgtcacagtaaccacttgaatcacgtggctgtcaatttacgatcagcttatggagctgcttgtaattcttactccaaggcatagtgacagctcatttagaactaatcaaacatttattaatagaaaaccaaggggcacaggctcttgactgaaattctttggttccttggcaagggcaagagcagggggaagtaactcacaggcgggggttgggaggccatactgtgtctgggaaagagtcttggaagtcagaggaagcctgacttgactgctctttagctgtgctttctaggcaagtaataaaacccagctgagtctccatttctttcaagaggctgttgtgaggcttaaagataatgaaaataaaaggcctggctcctaggaaggagttaatatccagcaaccattgtaaatgaaagttataaagatggagtgaaacaaaaagaaaatcatggtttaagactgaaaactaaatgagtgggattatttaatccagcagctactttcaaatagaagtactttttaaaaacttaaaaaaacaatgcttatttattatttggctgtgtcaggcgtttagttgcatcatgcaggatcttaggttgtggcacatggactttgtagttggggtgcacaggcttagttgcccccatagcatatgggctctgagttccccaaccagagattgaacccacgtcccctgccttgcagggtggattcttaaccactgtaccaccagagaagttcccagaaggacttttaaaaacagaggatacatgataccaggagaaaacagagacaagcagaactgcagggcaccgtaaggggaactcatgacagtgagatttgtttctttgttttgtttgctttttgttaccagaagcataactaagggaatgtcttgcaagatcttctctgttctgtggtccagggcatgagctcatcttcagggtctaggtgatcctgccagaagcccaacagtaaccagtata

SEQ ID NO: 44341 - DNA, 1330 bp, Bovine  19866880985862
ctgtctctctggtccttacagcagtaacatgcccatctttcctggatgaagtgcaaacaccttaccatggtggtcaaagtcttccacaaacttttctgtctccagcttgccagtttctgctcacaatcgatgctctaggaacaagacggcttatttcctccgtactctagatgctgcttctcgcatctatgactcgatggtgatcctcccactgagatgccttcctgccctcctgctaacttctactctcttctgggcttatgtcttctttgtgctcccgtaacatttggtacatagttgcattcttgagtaaagcacactctatgatattcatccacttacaagcctccccgagggcggggactcatgcttagatccctaatacctggtgtagtgccttgcacaaggtaagtgatcaaaccctgtgtgttaaatgactgagtgggacgaggctgttggctctgcgtggcgggtaaggaccagacctgcaaacagctgagcatcctggagaccgattggcctctatactctcagccacccctgagtgcctcctcctcaccctcccgcaagaagctgacctacctgccatgctgagcctgaccctgccccatcactaggccacacacccctccacagggattctaccttgttcacgttgttaaaccaacccagtgccctgaacctaatagttacttaataaatctcttttgaattgagttaatgcagtgtaggaaagccatcagcagtgtccttggcatatctgctggagccagtctttgggaagaagtagccagaaaaggctatgtggtcactctgggacacttacccacaagtctggcttgcatacatccaaacaccgtgattggagcatctttctcgtaatcccggaaaccgccgctccgctgaggtaagctgtgaggcatgtttaggttggtgcgtatgtagcggcctggaaagaaatgtcagaccaaggcgacatgagtttcttgtttccttaggacttctagtgctgatcctgctggcccctccacttccattccctttcgccaaagggaaatggaactgagctctctagaaaatactgacactcttcctttggcagagtgtcttcaaatccatgcgtccattctgctgacaaaagtaagaagagcttaagtctttttttcttaataactagtattcttttttctttttaaagtctttattgaatttgttacagtattgcttctgttttttgttttgttttgtttttggccacaaggcatctgggatctcagttcctggaccagggacccaatttgcagctcctgcatttggcaggtgcagtctt

SEQ ID NO: 44342 - DNA, 1037 bp, Bovine  19866880989790
cctgtggaggttttgagcagagatgtgacagatttaaggagctacatttgggggcgttggcagtctagtggttaagaatccaccttctaatgcaggggatacaggttcaatccctggttagggaactaagatcccacatgccgtggggcatggtcaaaaaaacaggcagaagcaacactttttatcaggcaagtagtagaagttacccatagctacaacttagagaaaagtgaaagtgaaagtcactcagcatgtccgactcttttcaaccccatggactgtatattccatagaattatccaggccagaacactggagtgggtagcctttcccttctccaggggatcttcccaccccagggattaaagccaggtctcccgcattgcaggtggattctttaccagctgagccacaagggaagcccacaatgcagagaaaagatgggtacaaatttcaaagatagactctgaagtgggagtcactgcaatcaatctacacgtctgtcacggctgatacgctcggtaataccaatctctagtaaccatcttgaagagggagattggcgtcatcttgggttaggtggggtaagacaagacaacttaggatacgttttcgggaggagggagatttatagaaggatttctggctctcactgctgtggaatctaaatggattagtcatgttacgatcttgaatgtggaactacactcaagagtcttcagggacccagggtgacaagacaactcgatttcagtgaaaaagcagcatgttctttgaccctgagtacaccgatgttgaactacaatccctgaacacaggtcaagaaagatgtgaaagaaaaggaaaatgaaggcatgaggaaagaggagagaaagggaggaaacaagaggaaggttatggagagaaaagaaagaaaaaagtggggcagatctaggacggacacgaggtctgctcacagcggtcaagcctagcactgcccaaggcgcctgagctgacagagcagagacacgaggctgaaagactatagtcagtttcat

SEQ ID NO: 44343 - DNA, 1324 bp, Bovine  19866880992070
tgactgagcgttgatgaccagaagagccctgacgcctgggaaaagccggcaagtcaagtccactctaactcaaacagtttggaaggctctgctctggctggggatcgtgctgcgggtgttttctgctttggtcagggtagcatggggggctttctttggttcagaacttctggcctcgggccccaccgggccgtaggcgtgggcggccagcccctgccgccgcgccgcctctgcgcatggggtccgctggctgcgggagccgctgttggcggtggagcgcgtggaggaggagccggagcgagagcttcgcgagcccgaggaagaggagctgggcttcaccaggcgggccttcggggcttccgcatcttctcgaatttcatttggtctttcttcttcctcatatctctttttgtctttccttcggatcaacagccacactaagaggaaaatcagcagggctccggccaccatacctgtcactgctcctgcaatcatgcccacgctctgtacatctgttttactgtacggtcactcgcaccacacagctctccttcccagcctcattgcctgctgtgcactggtagagcccagaggcggacatggtgagattctgcagcaggacacgtccagggtggttgtagtcaatcttagatttgggaggcagacgttcatcctctccctccttctcctagactcgctgccaggaatacacaatgggctctgtgccagaggatgactcacactgcaaagtcaggtcgcttccttctgtcagctctccttccaattcacacttgggctttgatggtctcactaaaacttttaagatgacgtagctccacacatagcaccctcaattcctcaccttgcaggtgtacccgccctcatcactgggcttcagaggctcaatatgcagggaggcatctcctgccaggaaattggaagcgaaggccactcggcccttgtgttcctcagtcaagttattgtagacgtgatggctggagtaagtgatcacctttccaccgcatacctttcttctgcctattcctagttttttaaggaatctccataccttcttccatagtagctgtatcaatttacattcccaccagcagtgcaagagtgttcccttttctccataccctttccagcatttattgtttgtagactttttgatgatggccattctgactggtgtgaggagctatctcatcgtggttttgatttgcatttctctaataatgagcgaagttgagcatcttttcatgtgtttgttagccatctgtatgtcttcttcagagaaatgtctgtttaggtcttttcccca

SEQ ID NO: 44344 - DNA, 1718 bp, Bovine  19866880992897
cttacctagatactcctccctaggaatcctggcctgatccgccaacatgaaataattacaccttctctgctatccaaagctccagtgtgcttgccttaactgtcccgtgttacagatagcagataccatgccctggcacctgccttggtctcaggactgcttcagagaactcacaccaatgatcttctcttctcacaacaatcccatttgacagaagtaacagagatcatgcccaaggtcacacagctgggaattgaaaccaggtatattgcactccaggtctttttctattacgtcaggctagcccacaaaagatggggcttctctggtggctcagaggtaaagaatccatctgcaattcaggagacacaggaaacatgggtttgatccctggatcggtaagatccccttggaggtgggcatggcaacctactccagtattcttgcctggagaatcccatggacagaggagcctggtggggtcgcaaagagttggacatgactgaagtgacttagtatgcacacacgcatcccacaagagacaaagcctgggcacgcttattcacactcattcattgagaagcatttgtgtgtatagatcaggtccagacatggtgctgagagcctggtgtgggaccagacaagtgctctgcggcttaggtaagaaccaaggcagcaggtatgaattactgttttcaactgtgcctacatatctcatctatgagtttataaacttttcaaatatgtatgtgtgtcccacaattcattttttactatgtgagtaaatatttttctctttaaagaaatggacttaagtttgtatagatacttcttatgctttcagatgctatctcctttgagaccatctaattcttatcttcttaaaaatacaaggacttccctggtggtcctgtgactaagattctgcactctcaatgcagggagcccagggtcaatccctgatcagggaactagatcccacatgcctcaataaagatcaaagatcttgctcaccccaaataagacccaatgttgccaaataaataaataaatatttaaaaaataaatatagaagcctagttctggagagggtaagccatctgcctagagtcacataatggattaggggccggggcaagatgagaaggtgggcttggaccctggctaggttattttccacctgtccacagtgaaggtaaagccccaagtctctttgctactgcttaggcagaaaagtttacatattttctctcccagagttagttgtcaacatttaattctggattgtttccaggttggagccttcaagttcaggtcagcagaagcttgtgagttacagtgagaaatttcaaatctgacacttgccagttccctttgagctccaggtgagaaatgtccctggcctcgtccattttaatgtcacagtcatcctagcggaagagatcacctccaggtaaagtcattcaaaacaaaggtttgtcattttggtgccattcaacggtggcgcatcacagggccactctggctcacctcacaggttctgggtttcccaagcagtggggcttgagacaaaggccagttttccttgcatgtcttcccttcccacccagtgtggtcagacatatacccatgataacatagccgttgacagagtttcaaagtgctcaacctctaagaacactggacttgcagttctagtctaactttaaccactcaac

SEQ ID NO: 44345 - DNA, 1706 bp, Bovine  19866881014353
aggaaccttacctgaactctcacactctcttttgtcttctccaccccaatatgctcctgtgttcacaaagctgaaccattaccacaaacccctatttgtaggacaaataacaatcaagttacagagaaagtgattaatagttcattttcagaaagtctggctgcatccaactctgagatgccaagaatctatgacttcaccttttttttttctgacgcactcctaaaatgcacgactgggcccagttccactgggaaactaaataaatcaagaagacagagttgcctgtgagatgctgagaatttaggattcaagatagctccaactttgatttgctcttctttttcttaatggatgttctctttatttttcatggatttgtgaaatacatatcatttgcggttgaatctaccagtttttcctgtaaagcaagaaaaatttatttttattataggaaaatagaagcctagagaaggtaattggcttgaggttccccagaacacatctgttcgcttctttttattaacatttttattttgtattggaatatagcctattaacaatgtagtagtttcaggtggacagcaaaggaaatcagccatgcttatccatgtttccattctcccctaaactcccctcccatccaggctgccatataatgttaggcagactttcctgtgctatacagtgggtccttgttggttatccattttaaatacagcagtgtgtacatgtccatcccgaactccctaactatcccttccccctatcttcctcagcaaaaataagttcattctctgtctgttttgtaaataaattcatttgtatcatttctttttagattctgaatataagggatgttatacatatttctccttctctgtctactcagtatgaaaatctctaggtcattcatgttgctgcaaatggccttatttcattcttttaaatgtctgagtaatatcccgttgtatacatgtgccacatctttatccattcctctgttgatagacatttgggttgctcccatgtcttggctatcgtaaacagtgctgcaatgaacactggggtgcatgtaccctttcagaccaaaatccatctgtgtaatcaatgaaataccattatcagtgaaatgcacaagccaacagtgaggtagaagacagcaagtgtttggccgtcttctctcactgcctttcttcttgaaccagtgaatgggctgattaagttgtgatgttaaaagcctggatctggcattatctcatgagggggacttagctcctggcaagtgcaattatgagtaaggatgtggatttaactgttagctttggggacttccctggtggtccagtggctaagaatatctcttgcaatgcaggggatgccaatgtgatccctggtcaggaaactaagatcgtacatgctgtggagcaactaagcctgctagccacaactaaagaatctgtgcaccacaatgaaagatcccatgagccacaactaagagctgacgcagccaaaaagaagatgttagccttggcataagagaaatgcaaaccattttttttttttaactccaacttaagaaacactctgataatataggaacccttatacagaacatctaagtatgaatgggaatgcaataatgacttgttctttttcacaagggtcgagaatgagaaacaaggcaccaggaaaagagtctaagt

SEQ ID NO: 44346 - DNA, 1801 bp, Bovine  19866881042590
ttgcagttattattgtagccatccttattcaaacaccctacaccaagcagtctgtttggaggatcccctcaaagccccacaggccagtgacatcggcatggagtacctggattcacagcacaacctgtcacttgtctccatcttgcaggtgactcttcctctacatcatgactgagctctctaaggtgaaggggtagagaattcctcaggtccttaggaaatttcactttgcttgcttctcctactcaatgatctctttggccagcaggtgttctcctgcgtcttcatcttcaggttggcattattgaagctggccatttcccccatgtccagcttgtctgccattttcttaaaacaatccaagaggttatgctccaagcctacagtcctgctgctctcactggtgttgctgcagcaagggacctatttcattctcttagcaaataaacatggcacacttcctgcaagcatagtgccaggcagtggagcaacaacagtgcccaaggaatccctcatttcttattctgttcactgtatgagtggttccttaaccatcagggtttccgtggtggctcaggtggtaaagaatatgcctgcgatgaaggagacccacgttcgatccctgggttggggaagattcccctgggggaaggggataaccacccattccagtatccttgcctggaaaattcctggacagaggagcctggcgggctacagtcccataggatcgaagagagtcagacacgactcaagggactgagcatgcatgcatggcccattattcaacaaattcagatttagttaaaatctttgaagtgtttgctatgttaaaaactcttttgttttccttgggggtgggcgtaggattcagagataagaccttatctttatcatccctaccttccattcttatccgaaacagcacttgagatgaacaagataccgtggaggcaccgacctttttatagcatgtgattgaatgggactggattgaatggaaccacttggttcagttggatttgcagatgccttaacttctttttcttcccccgatccctccagggtgctctctggaaagtgcttttgatgctgcacaaggctctcagaaaccgattttcctttcaaaaatagaaactcatgtgagttttccatatctctgagggaaaggtttaattcagaaaaagataccttactctctcctcagtgtcctaaattcatttacaaaaaagcagtttgggaatttaggcagcaaattgttcagcccttgaaatgtggagatttgagtcaggggcaggaatgccatctggggaagcccggtcagctttgtccaggtcactgccaactctctgaggttcagctggcctctttggaggttgcactgtgacttgaggaaggatgagcacagcactgcaaatctgtaaacaccatgagtatgaaaaggccccttcccgcctcatggcaagtcagtagccttctattcatacacaattaatggttgagaataggactcgaccaagggggcctaggtttcagaaacatgctctaatgttcattaaccttatactgttggttcagttgctaagttgtgtctgactcttcgtgaccccatggctcctctgtcctccactgtctccttgagttgctcagattcatgtgcattgagtcggtgatgctatctaaccatctcattctctgtcaccctcttcttttgtcttcagtctttcccagcatcggggtcttttccaatgacttggctcttcacacacttagccagagtattggagcttcagcatcagtc

SEQ ID NO: 44347 - DNA, 1636 bp, Bovine  19866881067844
catactgtctcccccctcctttattttccaaaaggcagaccctgaacctgttttactctgtctgtaaatactactgaacacagcatatatatatatatatatatatatatatatatatcagtgccctgggtattggaaataaggcattgaagtactatccgtaattacccatttggctttgtccaatcttatctgtaacaggctcttggaagctagagaaaggattccagtcatttgatttcctcaaaaaagctgcatttgattattcagactgtttatgagctctgcagcagaagtgttcctgtagatgcaaaaacacaatagtttttctgatagacctttctcatacttacaaaagggtgcatacaaaagcctgcagataatataatgaggttctcttacttatttaattttttgattaatattggaattagagattttaattgtcacagaataacataaatataatttttttaggcaaatgcttttgtgaaccacaactttaaatatccagccagctgctgccatccacaagagagaatccctgttcatttttgtatttttctcaagatgagtcatagtaaattcattcccacggtgtctattcaatctcctgttcatcacaccaacttaaaggtccagtccacagagccatcttttaagaaagaagacttacatttgatttcaaaagactctttggaatctgattcagaaagccccactcaaaagatcaagtcccagtctgaccttgaagaccaaattcaggacaacgacatggagcctgacagcctagaggaggagaacttgagtgagacggaagaggaagcaagcagaaaagcagctcagagggccaagaaggaaaacctccacacccaagatgctgctgcaattaacaggtaagaaattggcttgtgtaagaaacagtgggttctgagatgcataattattggtactgtcccaagtgaaagtaaggacaggctcttgttttgggattttttttttatagtggatacaattgatttacaatgttgtattactttcaggtatgcaaagtgattcagttataggtatacatatatctaattcttttttcattcttgtcccattcttttcttttttcagtattaccgaatattgagtagaactccctatactatacagtaggtccctgtttattatctgttttatttatagtagtgtgtacatgttaattgcaaactcttcgtttatccctccccctgaacaacctttcccctttggcaaccagaagttcattttctaagtctatgagtctgtttctgaacaggctcttgtaacgagctcctttgtaatgtgtgtgagacagatctccaagaagttaaggacagcttagagccaagatttttgatgagaatagttattaacgataaggacatttgtatttcttatgctccttacttcctgtccatattccaaggtgctgcgacctcaccttggagaaatcccagaaagcctaatctagaaaagtgccatgatcatggactcagatgttcttgagtgggtcgaggcaatggtgtttagtgtataatttgaaataagtcccttttagtcttctgcagctcatgttttctctcctgtgaaatgagccagcctgctt

SEQ ID NO: 44348 - DNA, 1461 bp, Bovine  19866881080464
atcttgcctgccgcaactgatggtggtgcatgccgcaagcagggcctggtgcagccaagtaaatattttaaaacaaaagagacagagatacacagaggagtgaaggaaacatgtggtggagaagcaggagctgtcaggttgggcagagggcatggggcgggtcttgtattcagagaaaagacagaataaagaatgagctcacagccaacacccctcgcctccctcctcctcctcaggagcacatcagtgctgtctgataacctgcccacccgcagagacagcacctgagtcgactcttgttgcgggccacgcgggtgagcgtgtagcggttgatggtgtagaagtagtcgtgatacggtacatcgtgcgtgaggacctcggcgtcgatcacatagcactcgctctcctggctcgccttgtacatggtctgcagggaagaaagggtgaggggatggggctgaagaggagcaagacgggagaaacccctccttcccgacgacctcccccagcccgctcctgacttctgaactgggacccagaaccgagggaaacgcagcatctaagcactgtttcaggctgaacatcactcccgcccagatgttcatcctgacgtctctctcctgaatcctttacagcagaacagaggccgtgcccgcccgacctcagctcacctgcgtctccctgacggtggcagttttgggagctagagggttggtaagggtgatggtgtaaaggatcactcggctctggtttccattctcttccttcttccacggatggaagatgatatctgaggggagaggggagccaggggatgagggaaggaaaaaggcctgctgtccccacctctgagtggccccctccagcgaccttctctcggcctggttgccgactggcaccccccaaaggaagtcaaagggccgggggaggaggctgagaggagggggcgtccgagcagaaagaggctcattgtagactggccgaggacctacacaggctccggaatgcggattgttctggactagggcaggaggtcctgcgggccacctacgggggtgctggcaacactggagctactgtgatgggggcctgggatcctcgggaagaagccctctcctctgagacgtgacctcccattgctctcggcacgcccctcctcctggcagagggctgtgctgatgcccaagggctcctccgcaggcctggacgctgagcagccttactggtctccggggagctgcagggcgggagcaaggagcatccggtgcaaggcactgactctgagagccctaggtttgaaccccggttgggccccttctcagctgcatgatcttaggcaggtaacaggggtctgagatccacctccctccctggtatcatggggaccacaacaccagcacccagggcagactggaggattgaatgagacaagacagggttcatgagcctgctgggtgcaat

SEQ ID NO: 44349 - DNA, 1500 bp, Bovine  19866881134261
acctggatttgaatctcccaggtaatctactgagtatagtgaacccctagtttcctcatgagacactagaaaatggcagttgtttggagatttttcactgacacagtgcctggtgcacagtgcacagtgaaactctccctgttagtgtcacaggtaaaagctgtaacgcacaacacaactgcagtcaactgtgattattttctaggttttgggcaaatgttgtgtatgaaatgctttgcatctggtaaaagcgtaagtacctgctccatgtaattatggcatccacagagcagtaggtttactctggaattcagctcagagattagtatcatttacagtagcgacattccaggctgccagccctacagagtagaacaagtaaagacaggcagttcacggttcagctgcctctcgggggagggtttctggtgacagcgaaagccacaggagattcgacctgagtaacctctgtgtgtcagcagaaggctcttcctctctctcccagggaggatgaagcgagtgccatgtgtggtttggggcacacactgtgcagagaccgctctgggatcaggaaagcacactgctgttctgggctgtaaaagcagtcaaagctgagggctctcgccctcctcctccacaggctccatccctcactgagggccaagaggtttcgttaggcagtcaatcagcattaagcactgatgcgtgagagtgaccagagattacgacagcggcctgcaggatgagaatccagagctgtacctgctcttttctggcctgatgaatttcatcacttcccatccactgtgggagagccctctgcttcatcttatttgccacaacttgtttcttcaagcacaagggagggattcctctgtctgcaggggatgggattaactgggcagagaccctcttccaattcctgctaatggctcacagtcagtgctcatcactccctgtactaagctctttcagttcagttcagttcagtcgtgtccgactctctctttaccatcattcaatcgtcactgtttacatcatcattatgtcatcagcttaggatcaccatcccagttagataagaaaactgacgatttaaggagcttgcccaaggcctaggaggatctcaaattgtagagtcaggatttatttttgtcccctggcagcatgtaggatcccagttccctgaccagggatcaaatctgtgctccctgcagtggaagcccagggtctcaaccactgcaccgtcagggaagtcccaagagtcaggatttgaacataggcactctgcctgcctacatccacagtggaaaattctgaaagagatgggaataccagaccacctgatctgcctcttgagaaatttgtatgcaggtcaggaagcaacagttagaactggacatgaacaacagactggttccaaataggaaaaggagtatgtcaaggctgtatattgtcaccctgtttatttaacttatatgcagagacatcatagaaacg

SEQ ID NO: 44350 - DNA, 1508 bp, Bovine  19866881252519
gtctaggtacagaggatgttacagagattaggggaaagggaacttgagttcgggactgttatgtgtacaggattaagactgagctcagaactgtgactcctgtgcttaccttcatgcttagcctgttgtctgtcttcacttctctaccccaggttccttgggaggaaactcctggaggcgcctaggctgatagagggggaacgttgtgagctctcgatggtttgaggccacctcagagccagacaatggctactgccttggagccggaggaccaggatctttgggaagaagagggaattctcatggtgaaactggaagatgacttcccctgtcggccggagtctgtctcacagagggatgaccctgtgcttgagacgtcacaccagaacttccggcgcttccgctaccaggaagcagccagcccgcgggaagccctcatccgactccgagaactgtgtcgtcagtggctgaggccagagcgcaggacgaaggagcagatcctggagctgctggtgctcgagcagttcctcactgtcctgcccggagagctgcagagctgggtgcggggccagcggcccgagagcggcgaggaggccgtgaccctggtggagggtttgcagaaacagcccaggagaccaaggcggtgggtgaggagggggagtcctgatctgtgtgatgcggagggggtctaccggctggaaggatggctagggctcacagaaatcacctcgtaaacttaactgactctgcccttgggttgcacctagatccatatgccccatgggacagtggagtgtgtgtttgtgtgtgtgtgtgtgtgtgacttcctggttcttgaaacacctgcctggggaggccatctttgcggcttcatcaccaagggtgataccgctttccttttccctttcggtattgaacctcattttcctggtgggggtgggggtgtgggtagagaattctttgacttcctcagaggttctcagcccctcagtcagagaggcctctcctaagacagcagagggtgatgggaaggatggcacctcagagccccagtgatgggcagggttgagggaaaaaagaaaacagggcggtatctgaatgtcccgcgcccccgtccccgcccccgcccgttgttctggcgacagtaacctgagcttcccctcgcacacaccagggagactggacttcccccctttacctgggcccccctgggagttttctgatggcagcttcttctgatgtgagatctgtgacacccaggactttatcctgactcagcggtgactggaagttggaattgttcccaggtgactgtccatgttcacggccaggaagtcctgtccgaggagacagtgcctccaggagcagagcccgggtcacctagtgagctgcaggaccctgcacagaccttgacccccgaggagctccgtgaggagaccacacagagcccagatctgggggcgtcagaagagcagaccctgtgccaggagtcggagctccagcccctg

SEQ ID NO: 44351 - DNA, 942 bp, Bovine  19866881263094
ttctgtctctcctacttaaatatgagcagacaatcaaggttttccaaatatctgaggatattatatggctactgctaaatattactagatattatactactaaaaaggagagggaaattaaagagatcttgagagttagaaaaaggatagctgaaattaaaaattcaaaggttataaagtaaaactgaagaatttttttcaaaaagcagagcaaaaaaggcaaaaatatagaaaagtaggaaaggaataagtttagaggataaatttggaaggttgaaaaaaatcaaaataataggagttccataaagaacaaatatagaaaaaaaagagagaaatcatcaaaaaattaattcaagaaatttccccataattgaaaaaaaagagttttcacattgaaagggcctattgagcatctgaaaaagtgtgtgaaaacagacctccaacacaggcatatcactgtaaaatttcagcacactggctccaaagagaggaccctacaagcttcccaagaggaaaacaaatgaataaataagacaggctatatcaagaatcaaaatggcattagacttcacagcagcaactggaagccaaaacacgattgaattcaaaattattcaaacgcattcaaaatgatttccaattgagaattctatacttacccaaaatactaagaaactagaataaagatgtttttacacaagaatgatctcaaaacattgacctttcactaccaaccaggaagctagaggagcctgtgctccaccaaaatagagtaaaccaagaatgaggaagaaagaggaaacaagagtgaagtgaaaggcagccatgggataaaggggaagaaagatgcattgacacagaattcagggtggacaggctagaggctgtgggagagcctggttcaggaaaatgaaatgttaagaatacacgcacagggacttc

SEQ ID NO: 44352 - DNA, 1260 bp, Bovine  19866881426244
aatgctgtacacccaggcggtggtattttatagatcctaatacaaaggtttttggtgagtcaaatgctaggttatttagaagaaaacaagccagtctcccgggcacgtctcatggatgttttccatcttgatcacaaatgtcagcatacagggaacccagcagtgggcagagttttcctattgcccactcactcccacttgagcatatttctcaaggtttccaggaagcttcacaggcgcatttctgttcttggtggggattctggtacctccggtgactctgagacccgcagtgatgggcaggaggtggggctcgggggattgtgggagacatattatcaacctctcctgagagaaggatttggccacctgccccattagttaacaagattgactcattttggaggcttatggaaatgatcctttggtttctttttcttctcttccggggaagctgcagaggaaatcagtgctttgggtgaaaaatcgggctgagtgagatcaaaagacctgctttggagattcttggagtctgttgttatgtctctggcccctataagagagaggagaccttccctctcaatctggagaagtatctatagaataagagcagatggagattccctactggtctccaggatgaaatcagaaggccccgtgctcatccctaccctgtaggctcactgggtgtcatctgtgacgggacattgctcagcctcagatgatgtctcagagttgggagttttcataagatcgtctggaccaacctggaggtcaggatgtgaaatgaacctcttgcctggaagcataccctctactctacgaaagctccctattccttcaaacccagttatgcaatctgataacttctctctagaaacacaaaacatgggactcttctctcctttggatttttctctctcttccttttgtcaaatatttcctgtcctgtttgctttaaggcatgtctcctttagtctaaacattcctggttactctacactttgtcgtaggggtggctgttcagacccacactgtcttatttatcttatctgaacaatggaccttgtaaagaggggtcctctttctaggtattatttgcaggggttattacctcccttcacttgcttctgtggatgaagcccaggtgtattgtagttactcttacgtgcatactgtccatgctaagtcgcttcagtctggtccaactctttgtgaccccatggactgtagccgccgggctcctctgtccatggggtg

SEQ ID NO: 44353 - DNA, 3218 bp, Bovine  19866881447364
atggatgctgtgaagaggggggggtcccgtttctagctctcctcctttgagggtgacaggccaagaggcgggagcccatacttcgccattgtctgaagggctgggggatggacctccagccaaagaaagcagatggagaccaagcctctgctggacacccagcctctacccacctggcccaggaatccactctgagtgggaattctaggtctgcagaaatctgggacacccagtttagccctcttgaaggggagggaatcacactctttgctctctttgctgttcaggtcagtggaaaaaaacaagacattttccttcccaccttgaggttttcctttcctcccaaatttaaacaggaaatacaattcaacatgtggagtgtgggtgttgagctcactggatctaattttggtcaggacgaaagtggaggatgcagggccctgcagctgcttctcaggccagattctcaaggaccaggtggtggctgctcggtccctgagtggcctcccatctgtgtgtccccagaggggtgtcatccatctatccttcccctcccatcttccccaggttagcaaagaagcaggaggcaaactcagatccagtctgtacagctttgcagcctaagtcactctcttctgaccccaaacagggatgatgataataccagcctcacgtgttgtgatgaggttaccagaaatttcttgtatgaaagtccctagcatgatgcctgctacataacaggtgctcaataaaacactgcctcagagtgaaagcagaaatgaaccaaactgtgtttgctaaggctggatagctcaagtgggcatgggcctcggggagcttgtgtcgggcagggcagagccggccccctgtgatctggcttcagtggacagtaagcagagcaggcgtttcttactcgggactgagtaacgcaaaaaattactctctcagagcagttacagaaactgtggtgcagacggagtctatgcacctcctggggtcatggggcagggtgacattccccaaaggacatctggggactcatctgcctgatggaggggcagcagtggtcagaaccctgaaggccggcatactggcctggtgttggctgatttcaagcaaaccctccaatccccctgggctgagcctctcccagcagggatagtcatttattagcttattatgtactgagcaggatgataaattctttgtatgcactgactcatttaattctcacaacaaacctatgcattattagttgtggtcactggtgagaaaaaccaaggtcgggaaggggcaatgcccaaggtcacacggtcatagcgaggcccagccaggaccccggggccgggtgctcagaggcggctaccctcctggtccacatggccatccctgtgcctgccccgactcttcccttgaagagtgattggaaataattggaactgtcactggaagtaatgagaagtgacagaagctgggttggaaggcttattgctccgagtcagaatgacccccacaaacgcaagcctaaatttaaacaatgaactcgcaaagcaatctccctctccaggatttgacaccccctcacccccaacaccccaacaagaaaagtaagggtatgtcaggggcttagactgttcagtacaaatggacttcttctggaacaaaaaatttcttcttggcttgatcctgtttgctttccgtgcggataaatgctattaaaacctcaggtgaacagactatcgttcttaactaagagatccaaattcacttgatgtatttctctttttcttttctttttaacgtcccatgagggacagggaaccagaggcagctatggaactggcaggctgagatggagaatgacccataactttcaataggtgaggacttcgggaggtccgatccctccaggaagcactgggctgaaagccaaggactcacaccgctgaatccatcccttctgatagcgatgggggtgatccatcaactcaccagctgtttatttagcacctgccccactaatgtgcaagtgctgctggcgaccgatgaacatcagccaccagcaaacatcagccaccagcctgaagatccacgtaggaacatacagcccatctcataagacagcacaggatcgagctgcttcctccctgggacacctagaaaccctggtgctttcctcaatgacagtcttgtttatgactgtgttgccccactgggctgacttcttagatggtgggaactgcattttgtattactggcacctgggagcctagcacagagcctgaactatagaaggagcaccctgccccgccttctctaattgttttgtgagtgtgggtgtatgaatgaagtaaaaaatgttatgggacacacaaaagagctcctggaagctcccaaaagttgtggccacccttcttctgtgcaatagaaagagctcagagaagctgctctgtaaagccagaaaggctggcttttagctttggcatcctctgctcttgctttttctatgccttcctcttccgcctgctcctccttcatctcccctgttgtaatggcctgagctcttcagatctccttgctgcctggcttcagaaaaagctcccatattccacacgggagtctgaaaatggctgcccatgttcccatctcagtgtggtcacaaaggcagtggcttctcccccgccttctgcaaagacaaagcagacctcagtcttatcaccagcagactctggctggggctccacaccactgtcactagcaaaatcaagactgtttgatttcagccttcttccccattctggtctattcagtgccaaaggaaacaaacttttattttcccaggatctagacggttaagaagctcagataaccagaatttttttttcttttctttttggtatagtctgcattcttctttggggaagggaaacaaagaagtcaaaactgctgaaaagaggaatttaactagaaaaggcaatatatagggcaagtcatagccaaacgtacaccatcatcacccagtcccagtaccaacaaggagcttgagctcacgcatccttctcaaaagcacagtaaggtctccacaacaatgaccttgaggactagaagagtcttctgattcattagcgtatgtaacttcattcattggcaaacgtaatctttgtatgtcatatgcagtaattctggattgtaaacaataaacattaacccaaacattt

SEQ ID NO: 44354 - DNA, 1708 bp, Bovine  19866881496679
gagttttatgttttctgtatttttgattagcatagacaacactgtaatgaacttctctgggctctcagcttttactttaaaatcgtgcatttccttaggataaatgcccagcagtgggatttgtgcacattaccatatttgctttctaaagtgttgtactcacagtactaccaggagtgaattaggagaccaatttcactgtatcctccatgaaactggcctaatggaacactttcaaacaggaatataaaacaaatggagtgctattatgattatgattgaaacaaaagttattaccagaaatgaaagtgtgcttggagacttacacctcatttttccctgggtccctaacctgttgctctataacctcatctaagtcacaagtgacgagtttgggtccatcacagaacaccaccagtgacatgcatacaactggaaaaggccatctgatattcagataccaacagctggcactgcaattattccttctcttgacttcccaatttctatctccctctcattcgtggaaacaaagaaattgggagcatttttatttctacgtccccatttcctcatcggttcccatgagtctctcttccaatgttggtccaccttctccattcccaaagccactaaactgattctgatctttgtcatcactggtctgaatgcagaattatgacaagactcctttcttacctgaatccttcctacatacagctcccctctaatattcctgaagcacagcctctgattcagtcatctgttgttcagtcgcaaagtggtgtcccactctttgtgactccatggactgcagcaggccagtcttccctgtcctccactgtctttcagagtttgctcaaattcatgtccattgagtcgatgatgctctccaaccatctcaccctctgccacctccttctcctcttgccctcaatctttcccagcatcagggtctttcccagtgagttggctcttctcatcaggtggccaaagtattgtagcttcagcttcagcatcagtccttccagtgaatattcagggttgatttcctttaggattgactggtttgatctctttacagtccaagggactctcaagagacttctccaggaccacaattcgaaagtatcagttcttcagtgctcagccttctttatggtccaactctctcatctgtacatgactactggaaaaaccattgctttgactatatgaacttttgttgacaaagtgatgcctctgctttttaatacactgtcttagttgatcctggctttcctttcaaggagcaagtgtcttttaatttcatggtttcagtcaccatccacagtgattttggagcccaagaaaatgaaatatgtcactgcttccactttttccccatttatttgccatgaaatgatgcgacctgatgccatgatcttagttttcttaatgttgagtttcaagtcagccttttaactctcctctttcaccttcatcaagaagttcaagatcaaatcattgctctgcctcaaagtctgtaccagctatcagtcaactcaggagtggtgtccagccagatacactgatgacctagtgtatccagagtgtgcagcctccttctgcccagcctggcttacctccaccacccccattcagtcccctgaatgcctcaatccttggaatgtggtcttggcatgtctaataagatgcctctgcccgg

SEQ ID NO: 44355 - DNA, 789 bp, Bovine  19866881504413
atgggagaaaaataatatgccttgagcaaggatgtgggctacagttttagtagaagggggctgtgtgttcacgtacatccaaacatggagagaataacagggtcagacaggctggctcagatctgggtttggggagtcagaatgggaggagggaacacctctgtgagggtgggtggagagacactagaaggaaatcattttgaaatgagtacacagagtctgtggtttgggtgttgcagggatgaacattcagccttatgagcactgattgtctggctcagtcatttgatccctggctgatgaggacttagccccctcctgcccccgtagcatgagctcttcctgctccctcagcggccccctcacccaaacccaaggcataataataatagccatcatcacaacctacatttgcacagaaccttctcatttttctcaaaatcgtttcacatctatgacctcatttgagcctcactgttcatttgtaaggttgtcagggaaggtgtttctgaaggtaagagatttaagaaatctagagatttcactgactcatgatatacggagtttcattttaggtctctgggctgtggtgatcaactctgaaataggaattgtggtcactagtttcctattgggtcgtatcagctctcagtttatagcttcctttgccacctgacgtacagggaataagaaattcagagagaaaagctatcagcgaaatcctgcctcagagaaagggctctgcttttcaagggagccataataataaagaaaaagcatcagttcatt

SEQ ID NO: 44356 - DNA, 1325 bp, Bovine  19866881539648
agtggatggtcagggtgtctaagctcaaaggtgaatgcctggagtatgttccagaaagtcctgggccagattctgctgagtgctttaaagataatatggagaaggaaatggcaacccactccagtactcttgcctggaaaatcccatggacagagaagcctggtaaactacaatccatgggatcgcaaagagttggacacgactgagcgacttcacttcacttcactttaaagataataatgactgcagaaacccatctacctagaagaccctttctttcacacgagccagttgaacaagccaatgaatggctggggaaaaatattttggtttcaattgacaagatttaaaaggaaatgaaatctttggaaaaatcatgttgtaaaaggagatcttaaagtgtttctgctcctgtttggacttgagagtgaggaagagagtaggtaagtatgaaagtcccagcttactgggatcattacatggggtaggaaaaaagaaagtcgacgtgtagaaaagagaaaaaagttgaggtgatatgggaaaaaatcattggatcatactattctcctcccataggaagcattctataggaaactctctagtgggtgtcctccaaatccaccccgttagtctgagtacacacttatgatgacataaaccagcctttcttgcctctatctcctgcttagtttaggcaatcagtgttcaggtgcctgttccaattctctatcaagggcttgccaggtggctcactggtaaagaatctgcctgccagtgcaggagatgcaggagacacaggtttgatccctgagtggggaagatcctccccgagaaggaattggcaacccactccagtattcttgcctgggaaatcccatccacagaggagccaggcaggctacagtccatagtgttgcaaagagtcagacatgactgagcatgcatgcacatatacccaatcctatggggttcacacagtatttggcgatagctactagcatgttggttatttatttctgatcacatgggtatcatcatatcaaagaagtgacctggtgtcataggtattggtcactgctgtcttatgttcacttgctcacaaactatgcagctgtcaaaccctgatgcgctcctcagagcaggcattgtgccatcatgacagacgagcagtcagaggaggaagtgaagtgtgtgtgtgggcatgaattgtgtctattagaggcacagtccccgccagaaatgctaatgctaccgtgactcctggggtattattgccctcggagaggaccatgagttcctttccagcttatttccaaatggggatg

SEQ ID NO: 44357 - DNA, 1111 bp, Bovine  19866881580944
aagctatcatcctagcatcaggcatcaggagactctggtgctaatgtcccagccacaggactctgctctgtgtgtgctggaaaaacctactgccattaagcagttattctgagtgcatgtagtctggactgattgtgagtgttgctgacaaaagaatcccagggagagggggatgcagtagaggatttcagtgctgatggagattaaatagcctgagaatggctttgtatattaacttcagggaactcaggtcttgccctaaagagtgacacctgatgcctcaattgtaggtaatacatctttagtaaacctcagatttcaagtaggctgctcggaaggtgagacaaatcacatccagcccgtaaatgtctttctttacggagactgaaatgccatccctgggtactcacatttacatgaatagcagatttaacacttgagacaattgaagtttctcacgaaatgatgagtccttggccttgttgacaaagtgccccatgaagagcactgctgtcgtctgaactgtcagcagaaaaggtataatgtgattaagaccaagtggtaagccaagactttgggtctggtactcattggtggaatgacttcgggtcatttctcattggtggaaatgagagagaactggaccaagcacagtcagatggtagcagaagaagaactcctggtcacttatttttccagcagttaaaaagctgaacaaacatggatggacctagagattagcatactaagtgaagtcaggaagacagataccatctgataccagtcacatgtggaatttaaaatatgtcacaaatgaactaatctatgaaacagaaacagactcacagacacagagaacagacttgaggttgccaagagggaggaggagtggagggatggctggggaatctgggattagcagatgcaaactgtcatagatagggtggataaacagcaaggtcttacactgtatagtacaggtaactatattcttgtgataaaccagaatggaaaaggatatttaaaagcatgtatatatgtatatgagtcattttgctgtacagcagaaattgacacaacattaaaagtcaacaaaaaaggctaaacaaat

SEQ ID NO: 44358 - DNA, 1033 bp, Bovine  19866881807307
acacaactgaacgaccttcacttcacttacttgtatatatgtgtattaaaaacaaacccttggtgcactttacccacactgttttgcaacacctctttttccacaccatgtcataattactggcaagcattttccacatcccacctcccctcagactgtatcgtcatcaaggcaagatttctgccccgttcatctctgtcatcctgttacgaagctcactgctccacacggtgtatctgctcagtgaacatccgagagtgaagatatggtgggtggggcagtgctgggggtgtagggggggtggtctgaagaggcacccagttggcttcccacacatgctctctggggactgcctgcccttctagagaaacggaggctgaagaacacggtccgttgcagccccgcagtgtcccttgggacagctctgaccatggtcattccttccctgagatcatcactacactcagcctgcatcacacagagatctcaggagaagtcacctgggaggataaccctctccacccagaacattcattcctgattaactaaaagctcaggtttcttaggtaagggtgtttggactgtggatctctggagagccattaacggaaggaaccagaatgaacttggaaacagctgcttacctatcaactcttaagaaaacaccctgaaatagagtttaatcagttcttcctcagttactggtgaggcctcagtttaaccattgctgcaagaaaggaattcatcctactctcttccaaagatctgcagacaggccagcttccctgtgtgggaagcccaggccctcctgagctctggagctgccctgcgctccagaaaataaccattctctgccatggtttcctgtccaaagaatgtctgcccatcttgattataaggccaatgttaagtcacaatttaattccccttaaatgactactcattccatttgagttgcaaatcggaaaaaatactttgaagaaaccaacccccacattttatagataaggaacttggttcaagaagtgcctct

SEQ ID NO: 44359 - DNA, 1771 bp, Bovine  19866880419641
taatggcatcaagaatactcttaagtctacctgggtttttattttttcactctgcactcttcttttttcttcaaagcatgaaagacccctgtgcaaatacagagcctttgtttttccttccctgtactttggtacattgctttccttaatatagcagcatccttagcttttgtagtattttacttagtggcaactgaagaaaatcactagcctgggctttaactgggaacttagaaggttgttgtgaaactgtcaggaaggtggtgagcaaccaaaaaaactctcatagattgtgcacccagagcgcatccagctctttaaacactaagcagacttggttatctcacctcccagctcataacagatgaacacagcatattagaaggaagtggggagcctgttagaagcaggtgtattggtaagtgtagtaagaaaccactatataagcaaaacagactgcttagcagacataaaattttttaaattaaaaaaaaaaaacacaccagcaatctgaggcaaatgattatatataccttggggctaagggaatcactttataataatatcaatttgttatagccctttacaatttatgaagtattttacatacatcagagctctttagatatttgtaataacacatgaatatcacttacttttcatcatgaaaaagtgaattatactgagcatgctgtttaagaagaaggcaggtaaggtatactgacatatctgaaagacttgcatcaaaaataattacaggttttaaattttggcacttaaagagatatgcattatttatcccaaaattaatatatatgctttcttcataacccacatggtgttactgagtgagttttcatagctctcagtgactgctggtcattaaatggggatgattgtcatcagtaagttatcaaactatttatcctgttaaacacaagcttaacagatccttatggatgccaacaccatatattctaatatgggaaacactaggctcccaaaagattctctgagtgtttttcctatattgcactttctagaaaacagctttaacaataatgtgatgtgatcctggttctagatacagaagtgggaaacagatgattaaccttttccatgcttgttttcctaaagtttttggtatagcctctcttcagggatgtaacaaggagaaacaacaaaatacacatgctttttgggcttctgagaaaaaaagaccacagacattttcaaaagattaaaatacaggtctcttctgcatcagccatttcattttcacaactgaaaataaagaactactgtggagttgatgttcttaaagtcattcaacatagctttgccataaatatactactctgcagaaagcttttaaaaacaagtataatttatactatacttaccaacaattatacttatcaattataatacaatttaccagttatgaataaaaatgactaaaaattttgagttaaaaacaccagattagactttatactgaagtgaaataggacctcaaaattttaagtgtaatatcccccaatattaatagtatagcattcctgatgccttttaatttcttaatattacctgatgactttttgatcatgatcatacctcagagggggcttccctggtggctcagaaggtaaagcatctgcctgcaatgtggaagatccgggtttgattcctgggtcaggaagatcccctggagaaggaagtggcaaccactctagtactcttgcctggaaaaccccatggatggaggaac

SEQ ID NO: 44360 - DNA, 981 bp, Bovine  19866880696048
atctgatggtcgctgaatctggaaggcaggtcaggatggagggctggctgctgaggaggctgcaacagttcagcgaaggactcaggcagtgggagtaaacagaggtcatgtcttggtagaattgaagaggatgagaaagagcaaggagcctggggcctcgttccgatttctgaacggccgggtaagtggtggctccgccagctgcaacacagacctggaactctcagttttgaaaaacccaggaaactcaacataactcaagacgagttttcatccctgccccaattgctgccccaaacccagaggcaagaggtgcctgcactcacactccagcccgttgtccagagcacctgccagcctggcagcgcccaaggtgcccactgatggggtggggtttcccttcctgacctgccacgactcccctcccagccaggcacacagcattgccctttactcccccgagagctccctagtgcagtgtctgagccaccccgattacatttccagctggtttttaattatcttgtatcagccacataaatctgcctgtgtggctcgcctgccgagtggcagagggggagcggggttggggcgggggggcggttccaaatgcccattcattgccaggaagcctctcatgccctgggacagcttcctttctgaagcactggtctcaaaatgtgaaaaacatttctttccagtcacatttctaacatcttgttaataggatttatttaacaatatttttgcaaaagccatctgggaatggcttgtttgggaacttgggaggacacgtgggtactacaggcccaggccgtggtgacagattacagacctcgtacctgccatcagagaagggacagaaacatggagaaggactcagtcaggggccaggggaccagggcctgaatcccactgcttccaccggctgtgggggtcacccagcgaattatttcacgtctctgagcctcacccctgagg

SEQ ID NO: 44361 - DNA, 1189 bp, Bovine  19866880732794
cccactccagtattcttgcctggaaaatcccatggacggaggagcctggtgggctgcagtccatggggttgctaagagttggacacgactgagcgacttcactttcacttttcactttcatgcattggagaaggaaatggcagcccactccagtgttcttgcctggagaatcccagggacgggggagcctgatgggctgccgtctatggggtcgcgcagagtcggacatgactgaagcgacttagcagcagcagcagcagcccagggttcgctgacatcaggcaaacattaggccctgagcaactgtgtgtggaattgaatccaacagagattcaacaaagccgggggtcttaaatatgaattatcaccttgggccttaataaaccacactgatgaggagccacagacatcccacatgcaaaagggcacttgtcacccctggagtatcattgcagactctcctcccagctggctgcctgcctttctcacttctctctgctcagcacccttcctatacgaggccccgctccaccacactgcagggaacgtttgaaaaacaaggcatacaggcagaaaacactgaaaccgcccaggtgacacttacctgggttctaatgccaacgactttgtgtgccaaactctaaacctgaggtctttaatctgattctccttatctccataatacactttggagttcctgaaaaggtacgtgtgtgtgtgcgtgctaagttgcttcagttgtgtccaactctttgcaaccccatggactgtaaaaggtatgatattactttaagtcctacagttgggaaagggatttatttcttcagtgttaaactgcacacacacatgttcttctgatgcaattttcatcctttcactttgattgtaatatttaaagacaaattttaaaagtcactttctttccatgcataattttctcctgctgcattttatttttttctggaatgaaagcggttgccatgctgccgtgtgagactttcctagggggtgcattgttcttagccaaagccaagaaagagttaaagttgtaaaggacagtctgtcttctgtctcagtttgagggtggggtgggggtggagactacccaattgtctgtccttcttttcccctccctggggctgagtgcaggatgttgaattctcccaaaataactcggaccctgtgagta

SEQ ID NO: 44362 - DNA, 1512 bp, Bovine  19866880784699
gccctggatgtatgcaggccgtcgtagctgcacgacagactgattttcttctagtctttaaaatttccttccaaaatcttggcttcagtgaactagagcattaccaacaggaccaagacagagtcagacaatgagatcatctgggctgtctagatcctggcctccaggatcttcctcatctttaaagggcccagctgcactagaaaccctgtggcttacctgagcaggcagggacccatgcacttactccctttacacaggtgagtgccatgcaggtgagcagcctcctctgagtggggccgctggctccttacctgccagagctgggatagtgacccggttccactcccatggctgatcgtactcgtcagcgggcctgtcgtcatcctggggcagcttgctctcccgcagccgggggctgatcgtgctctctgagtccgagtccacgctttggccctcgggttcataaggggtgtcgtataactggatgcctttgtgctgcgaccggacgctttcctgcctctgaaattctgcagtcgaaaaggaaggaagcagaaatgtaaagtgtgcacagcacatgcctcctcacctgggatctgccggatgatacacatgggaattcagagccaccagccagggagatggggactgcacagaacagacccctcattgcatttaaccgctgccctccccttgagggcagtgtctctgcttcatggctcaaggcttcctcacaaagatatcaggttctggaccaaacaacagaaccagaatgcttccctgtcaccatccgctatcttcaagggcagagtccacacatgagtgtgatgtcctgggtgtgttccaacaccagcccaggacacacagagctctcagcaaccccccgcttacagatggggggggtggtcttcccactagggcagctccctggtctctggacttatcattctccgcctataagatgaggaaaatgaaagtgaaagtcgctctgttgtgtctgactttttgaaaccccatggactatacagttcataggattctccaggccagaatcctgaagtgggtagcattttccttctccagggggtcttcccgacctaggaattgaaccagggtctcctgcatggcataggcggattctttaccagctgaactaccagggataagatgaggagactgggccaaatggccctcaagtttccacacagctcacatatccatttacagacctacaaagccaagaaccacctccagagaacccagggtcgctgatttctcccctacaaagccccatgaatgaccctttgcctgcatttctacttccctcagggcctgcctgtctcctaacacgctgaatacagccaagacactggagagcagaggtccagtttcacttctgaataaggaaggaaagctcttaatcttctggagaggatgccagggcccggctccagtgtgggctgagcagcggccgcccatcgagatgaggcctcacacagggcacgatccttt

SEQ ID NO: 44363 - DNA, 1082 bp, Bovine  19866880809886
ctcgtgtgtacgccaaaaatcccatttaataatatacattctctttaaatgtatatgttgttatgcatgtgtgctgcctgcatgctacgtgcctgctaaatcgcttcagttgtgtccgactctttatgaccccatggactgcagcccaccaggctcctctgtccatgggattctccaggcaagaatactggagtgggttgccatgccctcctccagggcatctttccaacccagggattgaacctgcgtctcctgtgacaggcggggtctttaccactagtgcatatactccagtaattcatttcctaggaatttaatggacaaatatagttctttcagtgtacagatacctgtagtaaaaatgtacactgaaatattatttctaatggtgatagattgaagacaacagtaaattcatgtggtggaaaactgattgaacagaccctgctccactctacaatagaacaccatcctgcttctggaacaaagagtgatctcagtatatgctggtgaggaagtatctttaagacacatcattgggttaaaaaagcaaggggcagaacagaatgcactgtaggatcccacgtgtctatttttaaatatatgcacatatacacttacatatgcatgaaaagtttttggaagaattcctgagaaaactttaaaaagcacttaccttgaggaaggcagcctgaaggaaaatgaagaagacttttattttacgtctttattcctttctgaattatttaaattgttttatcatacacaaatgttatttttgtaattaaaaaattaattttaaaaggtaagtataaatactgtaaggcaaatgggaaattcatatgatataatattgtcaccaaaacaatttttaaaagataaatagtgcactcctgtagcatggctgtgtgcaggaggtcttttggagacaaaggcaatcctgctgcctctgtccttagttccagccctgcccatctcctccagtatctcctccctgtccccaaactttaacccctcccttctgttcagttcagttcagtcgctcagtcatgtccaactctttgcccttgctgctgctgctg

SEQ ID NO: 44364 - DNA, 1121 bp, Bovine  19866880824958
aatgtcatttctgctgcattcagttggtcaaagcaaatcacaaggtcaacctggattcaacagggaaatggactccatctcttgacataaggagtgtcaaggtcgcatttcagaggagtatggacatagggaggcaagactcattaggggccatttttaataatttgtaacactctcttttgaggatttctatgatctgtagaagtacaatagaccctagatctttctcccacaattcttatctttttaaaaatttgagtataattgctttaaaatgttgcattagtttttgctgtacaacaaagtaaatcagcttatgtatacatatatcccctcctctcgagcctccctctcaaccctctaggtcatcatagaattcgcatctttttactgtgcttcacttcatttttatttgctttctctgggttcttggagaatatatcaagcacaaatatatatatatttgttttacatatatgttttatatatatataaaatttgctcatttgattttctacagtatccaacctgagttttatggactttgtaaccttttaatttagcaattatgcttttcttttgaaaacaaatttatattatttcagaccaatccttttcatagatgcaatgtcttcctgaaagcaactgaaaatgcatattagatttttatctaagtttccttctatttcttgtagtaagtctaatttgagggagcaattttctcttaatccttcagatagagtctttttcttttgaactattgaatctcttttcatatctgatgaattttctctatttgctcatcctaacagatggggaagctatgttttgttcagaattgggagctgagatgagtttgatcagagattgtgtgactattttggttaaatctttcagttccagatgaactaaaaaggaagaagattagctttgctatgtttttacctttccagggtataatttccataggatttgagagaaacagccaaaaagagccccatggcaacaaatcttttctgatctgctgttgctgttgctgctgctgctgctgctgctgctgtcacttcagtcatgtccaactctgtgcgaccccagagacggcagcccaccaggctccccca

SEQ ID NO: 44365 - DNA, 1274 bp, Bovine  19866880838927
acctttatcttgggggcccttctgcccccctcagtacctgtgcccccttctgacactgttctcctaggtgaatcccggggcacatgcacacctggctacatataccctgctaccagccagtctccagtttagggtagtttcccttttagaatcacgtggaagagagagtctgttttcaatttaaccagcttttacccagcacatattttgcgctcagagatctctcagtacaaggacaagctaggaggaaggaataaaggctgcaaaaagacttggcagtaatttttggcctaagcctctgaaggttgctgacacccgtcaccttttcatcatttgtttcccagtgtttttgtcttcgggaatttagtgagatcttcacctaggaggcagctttgagttggatctagggatggaagtggaatttcagcgcaaggaaaggctgactgcagcctatgggagcccttaggtgtatgtgctgtgtacatgcatctgtgtgtgcatgcatgtatgtctgtgtgttggtgtgtgtgtgcatgtacatatataaaaccttaatgtggagagtgtttttggaaatgaaagcttccttgcagtgggcctcacttggaaaatgagagatgacagtgtgagataggtggaggcctgagtttggaccccacagggaaagcctggaagactgttgaatcaggaaaataatagactcagagccatggttgaggagcatcccaggctggggttgatgggtttggagttgggaggcaattacaatatagtcccagtgagagacagtgaggacttgagctcctggaaagaaaatacaaaactttagttggtggaaatattattccctcaggttgtctttataaaaaaaaataatgatgacaaagaggccagtaacttggtaggtctccttatgtgcagccagacaagtgttatccacttaggttttctgctgaagtcttgtttcttttatcataattaagtaaatgtttccactgcaactgagaaagtcgagatgcaccatgacatcagtttcccaagtttaaatacatgccgatgtgtaccaacactttgtattttgtcagcatccacagagttgagttaaataacatgcttccaaagaaataaataatatcatgttcaaatttttttttttttaaatactcaggaacagtttctgagcagcatacgaggcaggggggacctcacagagaataagtggtggcgagttgagggaagcttcttagtctgcagttaacatgagctttttaagg

SEQ ID NO: 44366 - DNA, 1522 bp, Bovine  19866880895437
ccagggctgagagtaattgggtaactgaaagggtctttggtcacctcacatctctccagtgcatttcacagcctttcctactctgggcacagtgaaagccaaggactgtccccctggcgtggttgatcccggggtgtgggagaagctagaatgggactgatgctgttccagaggtggctcttcgcaaacaccagtttgattaaagggctaaacgtttcatgtaccaactgttctagacaccaaggggccatggcaagagatgacactgcaggcagctgtggcatctcaccctctcctggactgaccaccttgcaggtcatgttacctctgacgttttggtctagtctggtgctttactgctcaaaatgtggtccctggaccagcagcatcacatcacctgggaactggtgagaaatgcagagtctcaggccccagaccagacctgcagaaagtgaaagtgttagtcgctcagtcatgtctgactctttgcaacctcatggactgtagctgctaggctcctctgtacatgggattctccaagaaagaatactgcagtaggtagccattcacttctccaggaggccttcccaacccagggatcaaacctgggtctcctgttttggaagcacattctttaccatctgagtcatcagggaagcccccagacctgcagagtcaataagtttcaaaagacccccaggggattctcaggcttgttaaaatgaaaagcacttaccccacacgacatcatctcttcagaaggctctcaggccagaacttgcccaattctgcccaaagctggttttagaactactatacatttcacaaaggatcacaaggtctcagaactggtccccacataagtttctgggccacgggtctccattctggatttggttttctgttgctgagttgctatcacatgtgtcattgtaggtcaacttcttaggctgctgttaggaggcagatgcagaatcctgtccccacctgtgtctcatcaagtcacttacctcatcaactgtgtgtcctgctctggagtggatactcattttgggtgtgtgctaaggcactcagtcacgtctgactctttgagaccccatggactgtagcccaccagactcctctgtccatgggcttctccaggcaagaatactggagtgagttgccatgccctgctccaggggatcttcccgacccaggattcaacccagggatcgaatctcctgcattgcaggtggatttactgcttagcccccagggaagccctggatactgattgtgctttccccaagaagcttttggctcagttctgatttctggggcatagaaggaagttgtttcccttggctgaagggatgctgtgagcaccagtcttgagtctttgaccagatcccctccccacatctagacagaagttgtcagatgaggagcaccctcctgtttcctagcccaccgtgtaggtggagtgaagtggatgcaccacctctcgggtaaccagaacgagtggaaacagctcgactgg

SEQ ID NO: 44367 - DNA, 865 bp, Bovine  19866880973287
gacagaaggaagctaggaggtggggctttgtcatccctctgtgggagctttctcagagatgcaggcctggctgcccaggagccccaggaatagtcctgcagcccccaaggagagattcacaggagcgagttgtggggtctacagagctgcaccccctgaactcggggcacccagcgtttcaccctcattttggatcttaacatcaactctggatcaataaggaaaagcctattcactgttctgttacctatgtcaaaagatatgtcccctatgaaataaaatcataggaatagagagacagacattctttaaaaaccgcagaatgagaattttttttaaaaaaattaaatgaaaaaggaattaatgagaaaaggaaactctgtgatagaaactaaaaatgtaatcacagaattaaaactcactattaatcccttggtgagattaaagaacagagctggtgccgtgaaatattaaatcagtgctgtagaggtcaaggttgaaaactctcatcaaaaattcagaggtaaagataaagaaattaaaatgactagaggaaagtttataggtatggagaccagagaataaagcagtgccaagcagacattccatgcttgtgtgggtgagattggagagaagcaatcatccagcagacaagagaacgccacacaaatcctgggtgtgcagctcagaagagatccacatatgccaggcaaacatcactgagatggaacaatacctagacatctcacaaaatgtttgaaggagaaggattttaaaaatcctacaagtatatgcatagaggaagaaaaatcagacaggcttcagattattgtttgtcgtcatttcaatggagtatctctataca

SEQ ID NO: 44368 - DNA, 4265 bp, Bovine  19866880990863
ccgttatctcactgagaagcactccatgaaatgctggaaaacaataccctggagccagtcatagctgtgtccagccccctgaagaatagagataatctctgatccagttttgggtccacaaaacctagcacaggacctagagaatagtgtttgcggaatgaatatatgagtgaattaatgaaatcaggtgaacctaggagttatcgctgtgtgtcaaactcacttccagggcaattaaccctatgaccaatgcatagcttggttaagaccaagcatttttatttcccaacacttacaccaattacaaactggcaggctttgaaccaaatctgtctaacaaatgagttttgtttggctagcaaacaaaactgacttttttaatgcctcaggtagagtctgaatcctgcagcacagccatgttctgcttcttcctgtctcaccccagcctcttcccacagtctcatcacctgagaactcctgaaagctttgagtttgccgtctcggtttaaatctccctgggaagtcactttttcaatctgtccatgaacatcacaagtttactttgaaagggatattcctgggtgataaatcatacagatctttaaactttagaccctctacaatgaaagagccatagagcccaacatggcccaggccctcatacacttcaggcaactccctgagccaaaccaacgatatggtggggacagcgtggtccatgtgctgtctccccagagaggtgatcctcaagcttgtcactgggagagtttgtgaaagcccactttgccaggtccacctctagagcttctgggttagtgggtcatccacggagccaagaatttgcattcctaacaaattcccagatgattctgtggttggtggccccgggaccactcttcaaaatctactactctactgtttacaaatctctctcacaactattatcttattggaccctgacaaccaacctatggtgtgaccggggtaggaatcactactcacagaccacaaatgaggaaagggggactcagagagattagctgatgaccctaggtcatatagcttgatgtgaattggagtcttccaatgccaggtcaggcagcctgaggataaagatgtggtcaagaggccatcccacatcattctgctttaggacaaggcgattggactggttaacaaccgagctagtatttcaggaagttactttcctgcaggagagagctctgcctcctgaatggaagctgacagcctttctcgggacccctcccaggactaggactccatgctgtggctctatgcgcacaaggcttgagagggtccaaaacagcccgctgcccgcattgctccaggtcctgactgccccggggttctggccctatcgcagtcccaggccaggcaaggagaggagcagagatgccccacccactggagccaagatgcccctcactgaattagctgtgtagcaaccaaaggagagtgagagacgggcacagactgcagcttctgggagggaagacggggagttgaggggggagcacagaccatatggagcaagagtgacagaatttggcagtgcaggctctgcagatgggcttacttatgtccagacgcaatctgaggccaaagactgaatcatctctctagcaatttcttgtttccaaacacgtcttttgaagaacgcagggatgctctgcacagatatgcagacaacaggaaagaaaagttgcttttgctggcagcagtgggggtggcggggatgggggagggctgcaaaatgtccccttgagtggggtggatgtcagtggatggtgagaagggcacttgatggtttgggtagcatttagaaagtccataacaagttttttacatgtgttttcctgtgtgatcctcacaacactgtaagagggttagcattaccatccccattttataagagggaagactgagattttagagggtgatttgtcaaggtctcccagctggtgagggcagagttgtgaatgaggaagaacaaatgggacatccacacacatccaaggattccccccaccccttgtgcccaataccataatccttgtaccagtctcccaggtggccctgtgccccagctgctgggtggccttccaagttactgggttcccagtagggatccccaggttctgtcttcagaataaagtctggctgctcttcctggcatttgaggtcctgtgaggccaggctccagcctgcctccctagccttggccactcccgacgtggccccaggcttgggtccatccaggcaacttgccgttccctgaaggcattctgcactgcccggcctccagtcttggctttagtgccttctggccacatttccccatggcatttctactttgttatcttttctctcatttaaaggtctggtcttccaagactgtcacctccctctcctcactgctcatccctacaccataacaaacatccttcatatgtgcattctggtctgtgcttagtcacgcagctgtgttcgactctttgccatcccacggaatgtagcccttcccaggctcctctgtccatggggattctctaggcaaggatactggagtgggttgccatgccctcctccaggggaccttcctgacccaggaattgaaccaggatctcccatattgcaggtagtttcttcaccagttgagctgccagggaaaccctcatgtatgcataccaccttacagttcccagagggccatccccctgcaaggtgacaaaagcatgtcagccccatttccacactgaggccagagaagggacgggacacctaatcagcaaggccacaggactgaacccatgtttccagagtccaggtccagtctcttcccactgtgccccagtatggggaaggggactttatttacttgagaataagctgctgccatccacaaggaggtggtgcccatgtgcctcggggttgcccttggggagaaagtggaccgtattagtttcttgttgttgctgtaacaaattaccacacacttatggctcaaggccttccctagtggttcagacggtaaagaatccacctgcaatgtgggagacctcagtttgatccctgggttgggaagatctgctggaggagggcatggcaacccactccagtattcttgtttggagactccccatggacagaggagcctggcgggctacagtccatggggtcacaaagagtcagaaacaactcagtgactaagcacactagtggctcaaacaataccgaaggatgatgatcttacagttctttaggattgaagtctaactcaagtcttgctaggctaaagtccaggtattgtggagggctccaagagggctgcactcctttctggaggctctgagagagaatctgtttcttgcattttcctactttctcgaagccacttgaattttttggcatgtggacccttcctccgtctttagcaccacaaagaaagctggtcaagtctttctcaagttgcacctctctgaccttctctcctgcctccccccttctactcttaaggatacttttgactacactggacccacccagaatccaggatactttcctccccctttttgggtcacctgattatcaacctaaattccatctgcaatgtaaatttccctttatcatggaacctaacatacactcttcagagattagggcgtagacatcttcgggggcattattctgcctatcacagggcaaagagaagattcctgcccacagaatccagcagtggtttacttggcagagtaggtgactcgggcttggaccagacatgccagagcttcagtgacctgtcctgggagtgcagttctgcaggaccttggagagttcatggatgagtgctatgctactgacagtctagtcctttaaaacctggagcaaaccccctagtgccaagtggctcagggaaacagaggctaccctcataggcatttagcaagtttcccacgtcttattaatctctcatccatgacttagcctaatatcaggacaaggcagcatctccaatcaaactcctactaccactctctacccaccacacactcagaggtctggcctgtttacaatgagaattggatcacttagaataaaatcccaagttcttatcaaggcttccaaagtcctatacactctgacctcaagatactatccccattttcactgaactccaagaagactggcctcttttccctcacctgagtataccatgtgccttcctgtctcggggccttgcacat

SEQ ID NO: 44369 - DNA, 1257 bp, Bovine  19866881206721
actgttgggctagggaactggtaacaatttagacaataattccgctgcatagcagaatcactgaattcccagttccctgaaagatacagataaaggcctggcacacagtcctaagttgtttttacaggaagcagaccagatgaaaactgcttaccacaagaacacagaccccagactggatgaaaccagaaggttgatgaggcttgaaacttcaccttgatgccaaccaatccaagaactgtccatgagcttatcatgcccctgctccttgaacactataaaactccttgctaccccctccaaggtgggtcacatgatcttgagggcattggcccactgtggagaaggcgatggcaccccactccagtactcttgcctggaaaatcccatggacagaggagcctggtgggctgcagtccatggggtcgtgaagagtcggacaccactgagcgacttcactttcacttttcactttcatgcattggaggaggaaatggaaacccactccagtattcttgcctggagaatcccagggacgggggacctggtggtctgctgtctgtggggtcgcacagtagtcggacacgactgaagcgacttagcaccagcagcagcaataaggaaaacatggagacactggttaaaaataaaaacaagagcaacaaaacatttggtttattcaactcaatggaacagaatggagtccatatatagatacaagtttagatgcaaatttagtatatgataaaggcaaatttttgaacatgtatattgggttttcaggaaaatggactacattgtaagtgatgtcaggactgttagctaaccattttgaaaaaaaatcctttttgagaaaaatagcataaaccaaaaaaaatgttcatttgttgacaaagtctaaatggaagacatgaaatgacaagaaaatatggctggattatgtatattttcctcagatagtttaggactttaagataatatctgtatttttttagggatggacaaatcatcattttgctgtgtgttaagaaaaaaatctacgaaactcctaaatattcctaatttataatttttcaaacaagtggagcaaaagtcccactgaagctctcatgaaagagcagtttataagcaaaaacacaactttgttttaaagggtcgtacagtactctttaaaaaattggcttcattgaaaataatttgcataaaataaaatttcgtgattttacttctataatgagtttaacttttaaaaattta

SEQ ID NO: 44370 - DNA, 1429 bp, Bovine  19866881222310
cgctgaggcagagatttaaaactttactgacgcttccagctggtgagtgcccaatactggatgggagcccaggctcgacccgctcccgtttcccctcactccctgcccagctgacctgttaaatgagcctttgttctgccacgttgtgtagctccctcgtgatcaccgttaaaccagaaagtcttattgggtttatttcaaaacggaccctaggaagggccggggggaggatgtggaatggggatggcccttcctcccgccaggaggagcctcagcacctttgaaaataattcccccaaaatctcctaaaaccctaggtctctacccagcagccctggcctgccgaggtaatttccaaagccccagccttgaaggctcacaaatcctccgttcatgttcagacatataaattgcattcgcagagagaactacgcatctggtggtgtgatcgtgaagaagagaagatgctggagttcaagtgcacacacgtgagcacactcggggcctggcccatctccagcagagcccagcaggaaggctgggcctctccagccctctccaggctgagatgaaaggagtccatttccctcctaagagtgtcctaggagtaggggagagggatcctcctgcactaacagactcacacacaacttcaggtgattgtcactggaattaacaggttcactcaagaggctcagcccagagcatttgctggtgtgaatggggcaaatttttcctgcagacagcccaaagactctggatttttgaattccgatgaacaaaatacttttcaatctgttcacatttaccttaaaaccttgatctgttttaggctctatgctggattctaaggacccagagattgcacctgaactcaaattctcagtccagggtggaaaccaaacagtgaatgaggtcaaggacttgaaaaggcctcttggcgggtctggaggcaaacagacctgggttcacatctcagtcttcatacttgctagttgtaaggtcttaagcacgtcatttcaataaaggagcctctgtttcttcatctggaagttagaatctatccagcagagttggtatgtggaagagagagagaggattggtatagcacccaggatggaaaagatgtgccatatatgctactgattattaagagaagagagtaaatattttcagtcgatagaattagtgaaagtttcctggaggaggtagtatctacataagatcctaaaagatggatagattttgacctggttttgagggattaaagggaagagtacaggggctttttagggcagtgaaattgttctgtatgatatagtaatagtggaaacatgtcatcatgcatttgtcagaatgtacagcacaaagagtgaaccctaatgtaaactatggacttaataataatgtatcaacattggttccttag

SEQ ID NO: 44371 - DNA, 4199 bp, Bovine  19866881334699
cttcctttgcaaggacatggtgaggcttaatgagcatgtatgtcagagcgcccacaaaggctcctctgccaagagagatcaggaagatgggagagggcataagaggtggccctcaggagtctgaccagttgcttcctgactcagcccttcacaaagcagcctggtgttctggagcctacacaggtagccagagaattgctttccgtgagcaggaagaacatgaggcagagtcctggaagcagggcctggactgatactcagattcttcaacaattatcctagagggtctccgcagcccgagagaaacattcaactcaggcccagcatgtgctaagagctcagtaactggtgcttcctttccctttctcctcctcctccccctccttcttcttctcttcaatatgttcttttattttttattttactttttggccacaccacatgcaggatcttagttccccaatcagcggaagcacagagtcttaaccattggactgccagggaagtccctcccttcctcctttaaattcagaaggaatcaggagaacgtgctcaaaaacatgaacaccaaataaacaataagagggtcacagaaggaggcacctgaatcccaaaccctgagacatatggggcaccgactcaacaggctcagaattcagggccacctgcctgtggtctgcagtacatggtgcccctgctcacatcactgtcctgctcagggtcagagcaggccaacccacgagcgttcttccatgcctggaccatcctcctgaaccagggggaccctcatggaggggttctcccctgcttgtgatctccctaccacccgcccatgcctggggtctgtcaagatggctgctatctgatatctcttaattctttaaagatgctctggaacttccctggtggtccagtggctatgattctgtgctcctcaaggcaggcggcccagttcgatccttggtctgggaactagatcccacatgctgcaactaaggatctcgcatgctgcaacaaagactgaagatcccgcatgccacaattaagacccggtgcagccaaataacctttttttttttttttaagatgttccaagtattattctggtgaaaacagacccccccaggataccacatacccggccacattcttctgggccccacactgctgctctgacaggtttcattatcaagggtcaataggaaaacagttataggaggaaagtctctgtgtttcctataaacctgccacaaagaccatggtgctttaagctgcttcctgtcctaaaacaaagattttcttggatgggggcagggataactttgtccctaaagacctagtctgcccccttctactaagtaataaaagcaaggtaactctgcctgtttctcttattgccctggatgctaggaagctccaagctttccacctcaaaagctgtatcttttttgaattagaaattcctaagggaaactccccccacctccccacttacttcttgatgaattcttgatgaattgtacttagtaccctactatctctggacagtcactgtgccctgccgggttcttcctgaggtcagtgaaacctgaacagataacctgtggtaaagattcaacacagtgccaccccccaaccaccacctccaaagtacacaccttcccctgcagaggctggccggtgaccatgtgacccatccacctccccgcggagttgcaagtgtctgtgcttaccagtcatgatcctctgggcctcatagggctccatgtagcctgcgctctctccctttcctgttttgcttttgagatcattcttggcatcaaaggggtccgagtagtcatcagcgatggtcacctgtagagaagatggcaagggtgtgagtccacctggggctttctacttcacttctgttcacagccaggctttgcttcaacaaatataaaccgagtctgtgccaggtgggcaaggaaggggaggtggaggcaggagtctgaactggtacccaccagcagggagctctgattcttgcaggggtaacagggaacctacgttacgttgctgtgctccatcctaagggagggtcctgggcctgcacaggtaggatggctgctccaggcacagtgaagtgagaacagaagcacagaggcaagaacctggagggcgtcttcgggggatgtgacttgcttagagtaatggaatgaatgtagagggaggaaagttggaaaggagctcgcagaaagcccagaaatgctgacatgctcctggtgctggctgaggcatagaagagtttgtctcgagataattatgtccagcgttccactttcccaaatctggaacacaaccatgccttgggtaatcagacaacaattcggtgagatcaacgctctgcaaagatgactgaggccccagccgggcccagtgaaaacacaagagcagctcggggatggccagacagactgctaagggcagcgagggccttggaagccacatatcagaagactctcctgtgacagatgaggaaactgaggtctagagcgggcgggggctgaaccgagacccttggctggttcctctgcctccttcctggactcctcatttgtctgtattccagaaaacaacgaaagttccacaacaaacagagcagtcacctggagccaggtggtgggggcagccaggggagtccccgagatcataaaaaaatctgagttttgaatacttcaaagctttctcttttcccaggagaaaggtaaaaattcccagttgcatgctaaaagcaaacacagcaacttttcttctcattggaggtgcccccttggggcaccctcacccagagggaaagcacaggtcccttttcaacgcatcctcgctccaccaaaactcactgtgacttgggctcctttggtcccacatctagcaaagggcaagtcctcagcctcccagccagggccacccagctgcctcttttgggaggaggggggcaggttagcctgtctctcaacccttggggtttcatgaattgttatttaaattgtaggtttaattagaaaccacaggagcctccactctcacccagctcctggaatgtaaggcatttgaggggcctgtaaacccaggggaagggaaaaatccccctttgtctgccgggtaagtggcagtttgtggcagcagccctggccgggtgagcagagtgacctccagctgcccggaatgtgatgcccacgttaggaccgcgggcagctgccctgtcaccagcatgtggccaggacggccggcgggaggcattgcacacagcagtcactgctccctgaacaagggcaggcttatccgtgaaagacccagggctggagcaccatctgagcatgtgcagggcccgctgccaccgctccgaagcggctgtgggtcaggctctagtcccagtggaggcgcttccagatgctgacattgtaattgtggcctttctggggactccctgagctcaaatgacacgggcagggagagatgggggagaggagcggtagggcctttcatgtcttccatatgatatttctactctaccatttgcagaacacattagggagaaaattagacacgtgaaccactgtcctacagaacagctcagatgcagatctggggtgcatagggttttgtgtctcagaattcaaatgatgaacctgctgtggatgacatgtaatctcatttctctcgtcctagccttccttgcagtctcttttcttcgtgaacaccctccgactattctgcaacgaggaagggagcaaatatttccctaagagaacaaaatcactttggggggattagctggggagggtgctcggctgcgtaatctagaaatcaacattccagctcctcccggaagtgctcagtaatttgcaaacacggaggcaagaaggatacaaaccaaatctttgttcgccctgggacaggagctctgggaggccttcggttcagcaggcgctatctgtattttctaattaaaatgagatctgagctcaggctgtcatgggggccctcaggctgcctgccctgcttgcttccgtttcaataagaatttacaaatcccgaaaccagggaaagctcctggtctctgctgacatatggttctagttatacctgctgacagtttgaaaatccttccgtttacaaaaaaacagtttagaattctgttagtttaagaagcaaat

SEQ ID NO: 44372 - DNA, 1822 bp, Bovine  19866881448239
tctacacgtcttgcaaaggaagcacctggaaaccaagttttgctgccttagcccagcatccacctcaactatataatagggttgagagagaagagtctgggaagggacatttctttgagacagttcttggaagtatttaccctcctctcacctgggagcctaggaatatctcccctcatctccgtatgtgtcccctagagcctagcgcagtgaactgggaatgactgactcctggaacatgcaaagccctgaggccaatactgcccacctgagggagcagaaagagaactgcatagaaatgagttcatttccaccaacagagagaggcaaagatgcacatgcttcctcatggacctgctgcaggtcacatgggggaaacaacccggggccctcttggtaaggattttgcccccagagtccccttaaaggattgatgtcccagtaagaagtacgtcggaccactggatagcacagggctcaggattgaagacaattggagtcagctggaggtgtgagctacaggtcagagatgggcttgactctgtcctggagactgtagcgggagggtcgcagttggggagatctctgtgaaacccaacaagtgccaccaggcccagagaacactaacactgacacacacagcaccaaccacaccagactgcaatttcgccgacacctgatgtgtctgggcctcacctgaggggtgaggagccacaggccaggaagctgggggcgggggtcgagtaattaggggaagtgtgacagaggggcctgtgccacctccactgaacaagggaagagaggagctttttggttctgtttcttggagaatcctgactaatatgaggcgaacagaagaggcccaagaactttgccaatttggacactgccaagtggcctggatgcctcaggtctcctccacccaccctgctgagacgcctggcacaggtgagtgtacaccttggcctctctgggcctccactgtcctatgtcatctgggaggacttggactggatgatccctgaggccctttcagctctaatctcctgggtgccctgagatgcctagttactgagaagtgaacagaaccaagcctctgcaccattttctactgccctaatcagaaggggcaatggtccactctgcctccaccccccaaaaaaggataagagcagatgttggcaaggataggcgggagacggcattcagagtaggggacacagcatgagccaaagcaccaagagggacattactccttgtattcaggaaaggcaaggtggcctgggcgataggatcactaggtgcacagagggagagatattgatgcgtgtgcagccctttgtggtttctgaatccccttaacaccctcagaaccacactatgacatcagcacttgatgctgatcttacaggaaaggaaactgaggttcagaggccagtagctacttctatagggtcagacacctgaaaatcagcagaactgagatttgaaatcaaacctatctgtgcttttccccagacaccacagagctttaaaggctgtatgacccagcatatctagtcaactaatttcgcactatcctaatgactagtgagggtgtaattcattagaccagccatatagccgttctgatttcactgtcaaagtggaggaaaagcaaatccatcatatttttgatctgaggtgatttgcttgtgattctgcctcccacccaccccctgcagagctgagggggagacatattttgattctaacagcctgtgtacatcggtgctagcctgcatgtgtacaaggtgaaggagagactatagctttattcttg

SEQ ID NO: 44373 - DNA, 699 bp, Bovine  19866881819667
aagctggcccttcggctcccattgccaagcatagagatgaggataaatgcggctgtcagcggcttcctgcctctttgttttttaatttacttagagttgggcaggagagatggcaggagaggaagcagatggctcagtgtgacagatgggctcctatccagtgacacaaggacaaggtgagagaaagcatgatcaagagaaaacacaggctctgcatgagagcacgtgttcacggctcctgtgccaggatgccagtgctccggccagctcgctgggctcagggtgttgggctggggctccaggcggcccagccccacagtgtcacctgacagtgaggaccctggggcccagagatggtctccaggtgatgcgctcaaagggcacctgactgcatgcggtgaatgtgtgcattcacccatcatgtacgcatgatgggtgatgcctgtggcctggctcccaggcttttcccctctgccccagtctcaccacacgttcttacagaagtctaccttcagccctggcttgcctatgctaacaattctccaggcaggctttcaaaagagtgtttcatgcctagaacatcccaaggtccccagcacctgaatgacagtgctagggctccagtccaggactgggggtttgggaagggcagctcccctccatctctgtccctgcaccctgaggaggtgcacaggtaga

SEQ ID NO: 44374 - DNA, 1573 bp, Bovine  19866880492462
cctgatgttgggctcagaaatttcactcctgtgaggaaatttctgcaatataattattttccagcttgtgggtttcccacctgcgtgatatgtggtttgattatattgaaactgcttccttcttacccatctctttgtgtgtgtgtgtgtatttttttttgtctttgctgcgaagtcacgtcagtcgtgtccaactctgttctaccccatagacggcagcccactaggctcccctgtccctgggattctccaggcaagaacactggagtgggttgccatttccttctccaatgcatgaaactgaaaagtgaaagtgaagtcactcagtcgtgtctgactcttagcgaccccatggactgcagcctaccaggctcctccatccatgggattttccaggcaagagtactggagtggggtgccattgccttctccattttttgtctttagaacttacccaaagagatactctatatcctgtcttttttttattgattgtttagtgttaattgtaatttgctgttcttgtggaaggaggtgagttcatggtctttttactacacttttctttaaaatattattttcaaaaaatgtctgtgtagtttttatgttcatctatattataaaatctaagtgtcatttctttactaatatcaatgaaaaatagaaaatgttcttaacatagttttgttctttatttttatatgaaattatatttgaaatactacaatagtatatggctagttttaatgttagaaacatttaactaatctactgtgtttcatcaaataaggataaatattttaaaaaattaagtttaaaattaaaattttaaagtttcttcataatgcttattataaatatgatgtccaccatagaaaatgaacaatataatgattctatttaaacagtatccatcctattcaatttcttatgtaacttcgaatttttacctgagaatagtaaggaaaagcttctgcttctcagtttctatttgtgtgaaaattttattttaaatttaaattaaatttaaattttgctctgtccaggttaggttgggcaacttagtaactataatttagaagttgatcctgactactaagtacaggatatgaaatgttaattaatttgcataagctttcagtatttctctgaaaagaattttttagcactttttcatagtgaatagtattaccaaaaaatacattagactgaatgttttcagatattctgttccaatacagagaaatgcttattaactttgaagtgtttctaagcttcattttaggttttgatttgctgtgttcaagttaattcccagataataactcgaaaacttttccaaaagtaatttagaacttaagtaatgaaatgcatctcatgaaaattgatgatgttttagggtgttgatttctctatatggtggctaaaagaatgtcaagtatattgtattttccttggttttcaaaatatgttaataccttattgaccagagattttcatacatcttttgttacctgaacattattgtccagagaggaataacggccacaggcattagttttaacaaaaatcc

SEQ ID NO: 44375 - DNA, 1928 bp, Bovine  19866880615512
ttggcacatattcccttagcacaacttctagaaaattagttcacattaagttgcatttaagtaatttagtatagttatattcttctcttaaaatatatataaaatatgaatataaacataatacccacatatccaactatttcaaagagattctgatccatctattgatcctttgagggcaatcaaactagaaattacaatttaaaaaacactaattgcaatagattttgtagcttgttgttgatattgttgtttaacaatatttacagggaaaataagaaaagcataagcttaggagtcattatttacctttaagcttgtttgccttcttagatgtcttctacttattaaaaacacagaattattttttaaagtagccttactcaccttctcaccttctcccaatatttagtcgagggcttccttggcagctcagatgggaaagaatttgcctgcaaagcaggagactggggttcaattcctgggtcaggaagattcccttgaggaggaaatggcaaaccactccagtatccttgcctggagaaatccatggacagaggagcctggtgggctacagcccatggggacacaaagagtcagacacaactgagagactgacagacaacacacactcatcttagtgtgcatatccaataagctattaagtagaaaatactttaaaaacatggaaagtgacatgaaatgtagcatattattaaatgactgatacttatatatgctataacccaatccatgaccactgatggtcatgggaggaagaaaaaaggttgcttattttttaacttagctgaatgttgttacattttttaaaaattaatactatttaccatttaacatttaaaaagtattttcaggagttgatttcaggtataatcctttttcttcaaactgaaataaatttgtcccattcagaatgtattcttagaagtagagagatacttactactctcaaacgatattcagttcagttcagttactcggtcgtgtccgactctttgcaactctatgggctgcagtacgccaggcctccctgtccgtcaccaactcccagaattcactgagactcacgtccatcgagtcagtgatgccatccagccatctcatcctctggaatgatttagaacagcgaaacactgacttggctagtaaggatgagataagaaagtaggtggggcacagtcacaggaaaggcctgtttcaggcaagctgacttataagaaaggggtaaatacttaggctgatagttcaagtctggtgattaatgtagtccacaagacatatagaatcgaagaaaatataattagaacagcaataaatgtggcagttttaagtgtggcgtgaggcatgtggaggtgatgaatttttctgtggaaaattttctgctcttttctagctatttctcaggaactatcagccacctaagttaagtgataaaacaacataaaagattaaacattgcacttatcagcagtattttccaatttaatttagagtgtggcctaaggaagggactgaataaaactattctctaaaagcactgtacttggaaaatacgactaaatgaagttaaaatctaagctctagcaaaagctgtcccatatctaggcagtttaaagaatcacttttcttcccttctaaaaccagtaatagtaacaacagtaatagttaaatgataattattgaaaatagttaattgaaaagattaaatgtgataaatttacactttgcttaaagtaagcagaattccctaaacagaactaccacagcttgtggtaagagaaggcaatgctgttcccatattgtgtcttaggcaggtgttctgttgacaggatggttttattcgttttgagctagaaagtggaaattttattaggagaactttattaccttgaagtctgtaaatttaa

SEQ ID NO: 44376 - DNA, 1527 bp, Bovine  19866880666124
tgaagagcatcatctaggaaagattcattgttctagtggaggtagcagtaattcccagcataggtaaccaaggttccaatagactctgttgagcaatgcattgttataagagttgtgaaagaatttttcctggcatacagttctcatataagtgtgatttatgaagattcagtggaataaaatcaccataattctttgagggccaagatcatagttattctagattctggatagtagctgacattgaaatatgtgctttctttatttaatccttgagtaaacaaacaaacaaaaaacagtaattcacagttcagttagtaaaaacaaaataaggcattatggtaaacaaaattctaaaatgatcacaaggattcttgcaccttcatagatgctccttatataatttcatctcaagtttggatgggagtaatcaatatgattagacaaaattcctatgatttaagtgacatttaatagaaaaccaaaggggttttgcaatcagttgttttgaattaatcatgtttctttttaggtcaggtgggcttgacctaatcagttgtggttttaaaaaatactggaaacaacaaaagatattcctcttgaaagtgttcaaaagcaagttgctgtgagaaggggcaaccatgtggtaaggaactcaggatggtttctagaagctgagagggatcttcagttgataggtggcaagtatataaggattcactttatacaagcttaaggaaatgaatctctccatggccttgaacaagacttgaaacagaatcttctatagcgaagcctccagatgagccagtaccctggcagacaacctgaattcagttctatcaaatgccaaactgtttccagacttctgatctgcagaaactttgagatacagagtgttgtttgaaggtgcaaacacttttggataatttttaagtaagccatcagtaattgctaaggtatattataaatgtatttagcttattattaaacaatgttttgaaattctcatcattgccttccttcttaaatgaattaaatatgaaagtcagaaaaatctgataatttcatttctgtatctgttgtggtaaagccatgaaaatagtccctacagtatcataatactttacaactttgtaatagatttagatattagatatagatttggaaattcaggaggtatcaaaacaaagcacatgaggagacaggtctgaaaatagtaaatgctagccctgagagtgtaagaagtacacatactagtgagaagtgcacttactggtattgaatatcaatgaggcataattgctggatgctttcatattcaagcttagcaaaataaagctgtctaattttaaaatgttgaaaatgtcaatgtatgcaaatttgaggaagggttggaaatcatagggtaacagaagggaagaaagaaaggagatgaaatcctacaattagatttccctgatatgaatatgaaatgtaaaatgcatataaaagaacccagtagtaacttttcaatgccaatgtcac

SEQ ID NO: 44377 - DNA, 1894 bp, Bovine  19866880734359
ataattattttagttagatgccttacatcctgtgaatgaagggatggatgaatgaaagaataaccaacaaaataaaccaatgaaataaataggatagactaagaattatcagataacatcctctgatatgattttttttaatttgaatatgggccataatgcatatgcattttaaagagaaattatttttatagtttagtctttgttaatatctttttaaggaagaaagtgtggtagaactttcaaaaattcctagatgaaattttttaaatgttcaaaaagaagcactttacaacatggaaattatatctgctcaaggacttacagcttaaaagcggctcggttaatgctgaaaagaagatgctttgaggaaaaaaagaattctaataaaaatggaaatgatgacctactacattcctatgcttcttcaggcaactgatcatcttgccattgtatgcaccatcactttgccatttatcactgtagggtaggctggaggacattttctagcagataacaactcttaatattgagaaagttatgacttatctgcaaccttcctctctcatctgcaaaggatactggcatttatccataaggcaggcacacaagcaacatcctgagtagtttatttctttaatgaaagtatatgcaatttgcaagaatctaaatcaggatgtaaaatttaaattctgtagctttctttaaagaagagattaatgtgattacaataatcctaattgattaataatgatggcttttgtttgcattctttgaatattaaaatgagtaatgaattgctcaattattagggagagcactaaaatagtttttaaaagttacatagccacactttagggtgcttaattttcacaaatgcaaatgaaagtgagattttaaaattgtgttccttattttgttcaatgagaagaaattttgagtacagtcaaaatttttaatttggagttaattgtttttagtaacaattttgtggttactggtaattttgtgctaccatgtaaactttaatgttgatataagcaccatttatatgacaggaactacatattcaaaaacactttagtttaagaatctcagtatttttcataactttgcctgattcatattcgatcttatataagcagtgtcactggtggcttactctgagggattttaaaggcctccatgtagatcttgctgctgttgctgctaagtcacgcaagtcgtgtctgactctgtgtgaccccatagatggcagcccaccaggctcccccatccctgggattctccagacaagaacccagtgttcttgccttctccaatgtagatcttgatgcctaaattaaatcactcatgattactgcaacatttccaaaaatatttgacatgtcaaatatttataacaattttgtttgaatattgatataagatgatttttaatctttgtgtttgaaactgttaggaaatgtactgaaagcttctttggacttcagaatttatagaaagattatcagacaagaaaaggggaaaatggttttgatggaagaggtacctttgatggggaagtgaaagaaaaagtgaacaccattaagtatatactttaagtaatatataaattacataaaatataaataatatatatataatataaaaattatatatgaaacttatttgtttatattcagttcagttcagttcagtcgctcagtcgtatccgactctttgcgaccccatgaatcacagcacgccaggcctccctgtccatcaccaactcccagagttcactgagactcacgtccatcgagtcagtgatgccatccagccatcttatcctctgtcatccccttctctccctgcccccaatccttcccagcatcacagtcttttctaatga

SEQ ID NO: 44378 - DNA, 1496 bp, Bovine  19866880770781
aaggcaagcaaacaacagtaccattagtgtgaaacactaataaactctgtagctgattaaactattgaaggaatcaatttcactctcctttagttgtttgaatctattagcttaatgtagaaaagcagcctatgttgttgtgcatattggagcaattgcttctcttgaatttaaaagctctttaacaattctaatcttacttcttaaatcactcttcaaaaatgtgtgttgtttagttttcacagcttctgagcacataatataattaattcaaataagcctgcaagtcaacaggattttttttattaatatgagattaaagtctggaaatgatggttgctgtgtgaattattgagtcccatttattttattggaccagtatgcagacttcaaagcatgtaagaaaatctcttcttttctcttttttttattgctagccatatttttctccataatttatctcttctctaaatataacttgatattcactctatactttaaaatatgcataagattttactactgattttgtcacagtatcttttttttttttttgaacaagtgttttattttatttgtttatttttactttacaatattgtattggttttgccatacatcaacatgaatccgtcatgggtgtacacgtgtttccaatcctgaacccccctcccaccttccttcccataccatccctctgggtcatcctagtgcacaagccccaagcttcctgtatcctacgtcaaacctggactggcgattcctttcttatatgatattatacatgtttcaatgccattctcccaaatcatcccccctcatatcaaaatgcaagttagttctttcccagtttactgaagacaaagatatgattaactatgactatgattcatagctaaatattataaaattctctatacaagtaaaatatactgaattaattatatgtattaattattgtattaatcactaaaagaaatagaatattttaggttaaaatgaaaatttgtcccatttgtcatttctactcattctgatgcccccaatgtaaagatagaaatgagtaaaagaactgaattcaaatccccaaatttatgaaatctatcaaacctacaataagtataaagaataaaataaatatatacacagtttagtaaatagcaaagggctaataagcatctaccctcactgtgtacttcacttatcatacaggatcacattcctatatctctccatactccttcacatgcagatattatcactacattaaattagatgattatcatttccatgtatgatttcatacttttttattttatatgtgttagttgctcagtcatatctgactctttgcaaccccatggcccaccagacacttctgtccatggaattttccaggcaaagaatactggagtgggtgaccattcctttctcaagaggatcttcccaacccagggatcaaacctgggtctcccacattacaggcagattcttta

SEQ ID NO: 44379 - DNA, 1530 bp, Bovine  19866880940931
acagcatttcaatgaagtgccagttcgaagcaccctaaaaaacacacacctggacattcttaaagtgaagttaatgctgagaaatatattgtattaaatatcttgtcattgttgaagaccccaatagcaaggagggggggcaatactgcctatcagccacctaattatctgcaatgtataagcagatattcaaagttagaggaggtctttacatttcacctctaagtaccacattagtaattcatgaatccgctactaatgtttctatggcattcaggcagagtgaaaaattaagcaataatgacttcaaaggtagaagaaccacaaaataactctgtacttctgaggtcatttttaccatttgaacataaattatatgagtgcacatcattggcttcagtatttgcaaggcattgctaatgaacagggaagttatttaggaaatggagtgcaggaggtagatatagatagaacactgaagcttaacagaattgattcctaatataaaaagaaactcatttactgctcttaaatggccataagtgcaaaatctgcaaatgaaacaaattttcaaaaattccaggaagtgcaccagagttgttcaatcaacatgatcagctttaggttcttgctttatgagaatcttctctggttcagtgggaactcacagtaatgatatatttaagactttttgttctattcagtagctgtttttgcaaatgcagtcacacaagacaaattatattctccttggattgcttaaaagcaattttcctccagctgactaaattgtacattgatatataatgtcattgtgttaaaatattaaaaatggtccagtaaaaaattatctcagccttaattgtacaatttcaaaataatacaaatgataagagaaaatttaactggtaaagtatccagtattggacatcattatgcaaaataatgaaaaataaatgtaaaacttagtaatagcattttgaaaatattctagatttttagttccatgcatatcctaccatctgatatagattaatccttttaataggatgtgtgtgacacatttttactatctgttttattagccacattgtactgacacacataataaaatattcaaatcagcaaatatgcaatgactagggactagatgtgttcaaaggattataattatatttgattcattcaatatataaatgatagctacaaaataataaaagttccaaataataattattattccacagtatatccaatattatgtctgctcattaatgtaacccagtacaactaaatttacaatgagttaaatctgatttaatatatttgggtggtattttaatacgattaaaatgatcaagtgtccaaataagattgtgtaaagtcaacaacagtcttaaaatccatcctgataaattatcaaaagaaaaatgtgtttcatatattggtatctttagaaaatattcaataggatatggatcaaatggtgtatatatatgtatatgtgtatacgctaaatcttattatctg

SEQ ID NO: 44380 - DNA, 1330 bp, Bovine  19866880991643
acggcagcccaccaggctcccccgtccttgggattctccaggcaagaacattggagtgggttgccatttccttctccaatgcatgaaagtgaaaagtgaaagtgaagtcactcagtagtgtctgactcttcgagaccccatgcactgcagcctaccaggctcctccgtccatggggttttccaggcaagaggagtagagtgggatgccatcgccttctccgtataattacagcagaaagctcaattatacaatcctttcaagctttatttttcttaccacctagcaagttgagtatacaaaataaatatgggaagaagtatgaagccctgtgaggaaactttaccttattatgaagactgagctctattgctcataatatattccaatatcacttttatcattcatagtcagtgaaatataacttttctgtaagtaaaatttaactttgtattatcctcctattcagttgataacccacataaaccttaccttgaaagaaatacatagcaaagagaattcaaaatatactgttgagaacctatctactatttaagatgagagtatagtctataaatataagaaataattgcaatagatgcaatatcatagctctcacatggctccatatattatgaatattagctgtaggttcttaaaatgtacattgcttttggaaatttaactgtaggaaagttagtgttctttgaacttatggtaaaaatattcacaaagtttttgatgtaaagtttcatacaggatgagataaagtttgtttcattaaaaaaaatgatttcaatattgctttctgtttaattaaattgcatttatagcacaatattccaaagaaagtagatctgatgatcagaaatcaagaatatttgtattcaacaaattaacacttcactatttagttcatgaatattcaataaaagattaatttattttaaaatgtctctattcctttactcactcatgtgaaaatacattgaatcatacgtctaagttcttgacaacaataaactagatttttatatggtactttccagaaacaaacacaaataaaactaaaactatttgaaaacaatagatactctagagaattaaaataatttataatatttaagcaaaataacaatatcagttgtgaaaagtaaatgactacttccagaatataaattttctttttaaaaatgtttgttcagaaaaacagttgacatttttaccaatttatgagctttcagttgagagttttcaaaataacattgcatccaaggaaacattaagtaggaagatatatcagaaatgcttgcgcagtcataaatttatttt

SEQ ID NO: 44381 - DNA, 1215 bp, Bovine  19866880380480
taaggctaatagtctatatgtatatgtctgtattttatcttttcccatgcttttttggttattatttctgaaacataatttttaaacttttttatttaatgaaagtgcctttaagtcctacagtgccttacaacttcagaagttttgcacacgattccatataatcccataattcctctttaatcccctactcctttactgtcccaccccttcctctcacctctggtaaccactagttctctgtatctgtgagtcacctttttttttgttatatttactggtttgtcatgttttttagattctgtatacaatatttgtctttctctgtctgacttatttcaattagcataatccattccaaatccttccaagttactacaaatggcaaaattccatttttttttttttttatggctgcaatggcaccccattccagcactcttgcctggaaaatcccatggacggaggagcctggggggcctgcagtccatggggttgcgaagagtcggacacgactgagcgacttcactttcacttttcattttcatgcattggagaaggaaatggcaacccactccagtgttcttgcccgaagaatcccagggacttgggagtctggtgggctgccgtctatggggtagcacagagtcggacacgactgaagcgacttagcagcagcatcaatacacacacacacacacacacacacaccatcttctttatctattctttatccatttatgagatgtaattttatctagccacatcttttattttacttatttatggcttctgggttttgcgttgcttaaaatatcttccaaacagtaagatggtaaaattgttttcccagaatgttcatgtgtgtgttacgtgtgtgtgcacacacgtatttgtgcatattgcatttgggtgaatatgttttcaaacttttatctatcagtattttatttttgcctgtgttataagatgggactctaaccgatttttccatttcattagcaaattttcccaatgctatttgttgaatcatttatcatttcctcttgatttgaaattgatctttattatagaccaaattcctatgctcttatatgtctgttcctgtattttctaatttgctttcttgaactatttttttcaatccttgtgttaatagcatagtatttaattactgtaaactttgaattttgtatctgtgtttattggtgcaag

SEQ ID NO: 44382 - DNA, 1435 bp, Bovine  19866880498620
gggcaataattaatccagagtcttttaagcatcgttgagctatagtaaacatatgttgagtctctaaaacagatggggccaaaaacagtatatcgtccatataatgaataacaagaaagtcaggaaattgttttctcacaggttcaagggctttggctacataatattgacacatggtgggagaattcatcatttcttgagtcaatacagtccattgatatcatttatgaagcctgatatgattaggaaaaggaagagagaaggcaaatctttctcagtctagaggatgtaaagatatagtaaaaaagcaatcctgtaaatctataataataatatgccagttttgaggaatagtggtaggtgatggaattcctggttgtaatgcacccataggtttcatagatgcattagcttttataaggtctgttgctgctgctgctgctgataagtcacttcagtcgtgtccgactctgtgcaaccccataggtggcagccaaccaggctcccccgtccatgggattctccaggcaagaacattggagtggggtgccatttccttgtccaatgcatgaaagtgaaaagtgaaagtgaagtcgctcagtcgtatccgactcttcgtgaccccatggactgcagcccaccaggctcctccatccctgggattctgcagacaagagtactggagtggggtgccattgccttctcctcttcttcatctcataactccccgaatcagtgctggcataaacagctcctcctcaaccccttgctgtgttccagttagcagaagccctggctttgaggtcaggtccacccaggtttgaatccaggcatcgctttttaaaaacacgtgatactgggcaagtaacctgatcttgccgagcttccgtttccttctcttcaaaataggcatcatattgtctgcttcacagtgttccaggcaggactaaatgctaaaatatatagagagtaagaatctaacccaacacctggcacaggaacccaggctctataaatcttagttcccttccttgttgctcttactttctgtccctcagaagctgctccatcttctgctggggtgtaagtaggaacagctgggaaatacctggtgaggttttgcttcattccacatgtccttgaaatgaatcttctgtcctctgtgctcctcttctcaccattaaacccccttcctttcatctctagggaaatctggaaaccagaagatgctctagcctcccatggcaaaggactgggactgatctggttaacaatatcccagagtgatctgcagtgactaatatccttatttcctccaaagtcacagtgctgcactcaaagtcccgtatccctagaaacacttcatcccaggtaagccagagccactggtcaccctcgctgtctgcagggcagtttcagagacaaatagaaagct

SEQ ID NO: 44383 - DNA, 2624 bp, Bovine  19866880512257
ttcaagccaaatgacactagtttggctgttaacttcccaagatcctcccacccaccaagggacttggggtgagtggtaccaagatggggatgccgtctttggcttcctcattggaggagggggtcctaataccaactccctgtagcttattctccctaaccccagggtgcacacaggccttagctcccctcctccccgaagcctctttctgctcctggacctccctgaccactcatgagagagccaccgggctgaggccagagaagtgggggagggaagcttgtcccacaggactgaagggcagctgtttatattataattaaggttttatagcataagctgaaatgtagcttgactattccaacaaggcgctggaggtaattaccactgctagaggcgttctccactgccaattatttccctccttaattgaatgactcaggctgcattgtagaggggcaggaaaaggcagaggttgctctggaggaggagggcaaaaaacagaggctgttccttcagagaccatagaacagctcaaaatttaacacacctttctcctaacatccttttccaggagtgtggtatggaggaaaagaatgtaagtcttctagttccaccattgactgccttgggcagattacttaaactccttaaatctgttccttcatccataaaatgggtctaattgaagagacttcacagtactcttttgatgattaaataaatgataattatccgggcacacagagaatatcaaataattctggcttatggaaatggcaccaacaaagggtgttgccatggagggggaagtgcttttgtcttctctaaccagaagggggaaattgaggcagaaagcacatctcagtccctgcgaaagtgcttagtaagtgagggccaataccaggcagaaagtgcttacagggagtaaattcctgtgagttgtaaaggaaagggcccctcccaaagaggttagacaggtcccaagatgtcctgtccccaggagggtccactgccctctcccccttctcctgtggctacacaaagtgcccagcattgggcacagaaccctggtcacttccccagatccaagcaaacctgtgattaacatcacatacatttgcagaacactttctccttttgaaatattattcttcttccacacatgttatctcttttaattctcataagcaccttgaaaagaaaagtatcattcctggttaataatctaggaaatggaggccaagtgagattaaataaagagcataatcaatcaagggctaaaacacaggtcttctgcctccaactttcccgctgctccgtggggggaggggcaagtctcctcccactcccttccccgcgtccagattcgtggccagtgagatcatagagtgtgtttcaaacatctcaaaaatcagagatgagagtgagtctcaaaatttggtgcatgttggagtctcttggggaaatgtgtttgcaaatacatattccaaagccaccctcctagggattctgactacctgggtctaagaggggcccaggaatctgaagttataatccctgagtctttctggtttcagtggttcaaaggtcaccctctgaaaaacattggatggagagaactcagtggatatctaagagggtacctctgaagtaccttatttgacctcagttagttgacttaaactttctgaacattagtttccttaaatgcaaataaagacaaatatttacctatggatatcttgtgagaattaaatgaaataatgcatgtaaggtgctgagcatgatggccaacacatgtaaagtgctcagctatgttagtaattattgacattactggggctgttgtcattaatattgaaatacagctaagcctggtgctactcaaaggatatgttactatagcttaaaactatcatcttaaaggaaatcagtcctgaatattcactggaaggactgatgatgaagctgaaactccaatactttggtcacctgatgcaaagaactgactgatttgaagaccctgatgctgggaaagattgaaggcaggaggagaaggggatggcagaggataagatagttggatggcatcaccaactcaatggacatgattttgagtaaactctgggagttggtgatggacagggagggcccggtgtgctgcagtccatggggtcccaaagagtcagacacaaatgagtaactgaactgaactgaactgaaaactttaccatttggagtcgttaagtctatagaaaattgggatatagaagggacataagtaggatttgataaacttaaatcatttttaaattagtgactcagttatactcatttagttgcctgggggtgcgatgctggtagacaagcaactattcggacaaacacgtggtttgttctctgatttgccgatgctgatgaacagtaggaaagggaggcaattggtggataagccaagaaggatttcttgagaattgcctttcaattgatgtgcttggcactttcaatcaacagcagacagcactaatgtggacaagaacactgggacctgtccccagtcacaccaaattcctcctaattatccccattctctgacactttagcaagtgcctctgaggacc

SEQ ID NO: 44384 - DNA, 792 bp, Bovine  19866880889981
acatggtgagagagtcagtgagctctggtagctgagaagggaggaggcttggaagagaagaggaggcggtcagagagaggaaacaagttccctgcccagtgtcacctggggccagccttgaaatcactgtcagatccactcactgctgtcccattcgacaagagcaatcaagcaccaagttctcccagccacggccagcttcggggacataagcctgcactgtcccacagctccctgcactcaggagggccctatgctctgttcaatgctctgatgtcaccatcttgatgttcttaaaactgcttaaaccatttgcaatttgactgcccctcgaaaattctgagttagtcctgctcctaactactccctagaacatcacaaaagccctctgaagggaggtcaggctaacctcgcaattctctcttcatcacacatgtgtttccttcagcctctttttacacattgggagacatttgaagaaatgtccttaattccgagcactttaattcacctccaccaactaagcctcttcggaggtgacttaggtatcatgtgacccaccctattattagcacacgccccacccccaaactcctgcttcccttgcccttatacatatctctctctcagcagaaaagtggcacatgacctcctagcctcaagaacacttggcacaggtccctgtttctcagccgtgtctattgttcgcgtccagaatgacactgattctaagagtctcgctgacatttctgacttttagtggggagcgccatttatcaatggctgcatctg

SEQ ID NO: 44385 - DNA, 769 bp, Bovine  19866880966338
aaggaggggcccaaaatgggagggagaagatgggcagggaggagccctggaaataacctggctgacgattgccccaggtcagccattcttggctctaggagattcaaagtctaagaacaattcccctcctccccaaagttttcctttccaagagaaatagattccctctctgcatgtctctttcaactctcagcaagaccagtacaaacacatgaaggctgtaaacctgctacttcactggggctgtttatttccagtcgacaaatattgtgccagtgttcacttcaattaggaaacacatttgacaatctgactactccatctgatgcctcaagggcaaatttcagctctttcagaaagttagggccaataacggatccatatgaataaaatatacagacaaggaatatttgaggcagtttggggaaagcaccttctgtagcaaggagagtaaaatgtctacatggaaaaaaaaatcgtataaataaagcacggggcttaaactggaggggagctgggaattcagagtgaaggctacagtgcctgctcgcctttcacctccctggagttggaaatcggtgagaatcagcactgtggagcctaagacgtgtaattctgtagaggaaatcattgcagcagagctgaactcactaacacattcactaaagttattccagcttttaaaatcatcctagaaaccagaagctcttctggttatctaattttcagtccttctgctaaatcccatctcttctttattacccttaag

SEQ ID NO: 44386 - DNA, 2594 bp, Bovine  19866880992046
tcaacttccgtttagagttagacaggatccccacggtaaaatattagacaaataatgtctcagggttttcatttcctgttacataaagtgggcctgataatagcaggcatgacaatttcccaggtccctgatgagaccccaggcaggcctgggtgtatatgaaacatcgagttctattcaaaagcaaggtatcattgtagcctttgttataatgcaacttaagcaccccaaacttccctttagcatatgctatcaactcgagcatccctacaattatgaaactatatatggtttcacccccatgtcatctcttgagactgcttgtgtctcaaagtaggattaccttatatttgtcctgaaacttcctccttcaaatcagaagctgtcccctgggttcagggttttgggatttgtgaacaaacctgttttcactctgcctgcccttttcatggttgtttaagtctcccctcatattccctcaaggtttgcttttgtagcatgagacctaattccttctggaacaaagtttcctccataactatgatcaatggtgggttctctctgaatcccctgtccactggaaatccatgtgtatcagcagctgtcttgtcttccttaactgtaagcctaaataccttctgagtaatatctcagcccaatgtgtgccagaaagctgtcttcataaacacttagaaaattgattttggtgaagaatctatggctgaggaccctaagaaaagtcagttactttcagtgtctctggctcttcaagacttaaggcttaagaaacctctaggaagacaccccagggttgctgaagattttggtaggcaagcagggaagagatttcatcatgagatttaagaggctcaggaaggtaactgcctagaaaccctttcaaacaagtccacacagttctttgagacacatcttttgttaaaattagagggccaccctgtctagtaggtaacttctaggctctggggctgggccatctggttggaatcttggctctgccatttcctaaatgtacgacttgacctctttgtgcctcaattttcctatctgtaaaatggggacaataatagccacctacttaacaggtttaagtagaaactcttaaccctgcaccctcggaacagaactcattcgtgtgtagaggacttcctgtattacatatggggcacttaccttaggctgaaccctgtgatcaaggtcttatattacctacttcagttcttacagcaagcttgtgagaaaggtgctgttttttccctatggatgaaaaagcagaggcttggggaaactggttaacttgctctacatcacatggttagcaaaggcagcaccagaagtcagagcccgtgttcttcaccacttgatcgtctgtgttttcatctatgtttccatcaagggaatttctggtcttagtttctttcctcaagtaggtatcatctagaatgctagagtttatattatcagctggtaatttggcttatggaaagggcactggattaggagtcaggagacctaaattctgatctaactctgccactgactacagcagctgagacaaagtgttttcttctgctgggctaccaagtgggaactgataatgcctgctctgcctatctcagggactatggggagggtcactttcaaatttatccaataatgagggctcactggaggctcaagctcatgtgagctgcatttgcatgtatttttcattattgttaaatcaacttgtgctgtgcttaacttaggagatgcttgaaatgtaagataccattgttcctatgagtttggacaatatgaaccagttttcctttggggtctgattgccctcagacaggctaaccatcagctgggatgaaccttatatttcagagagtgaacctcactctaggaccttccctggatttcaaccttcctctttcaactattccgtgatggggcatgtggagagctgctttggaaccaggatgccagcaaagtcaaggaggtcaaactgaggcctccccatgaagatctctgcgaacctgagatcctcacgaagtgcttctctccctgcatccatccagttgctatggtgggatgttgggttggttccattcttcactaagagattaggtataaacatgcggaagaaggatttgaccgctaaggcaatgagaaaaaatgaagccaggattcatattcagctggtatgtatcaaggtgacagatttttcccagtcagaatctgctctgatcggtcagtgcccacagagggctgcttgttatacgtactgactctcactcctggataaagctcatttgctttctggttttgcagaggctcttcttggttctgtgctctgcctggtcaactcttttcccatctgcctcttgggaacatagaggtagcacaggaaatagtacaggggctcagggaggtgcctcacaggggctgacacaatggagcaggtccccgttgccctgatgtccccaagagcctgatgggatgtgtccattcagctggctcagctctgagaacaggagccagatcttcttcaacccttcatcgtgacagttctgtgctgatgtttaaat

SEQ ID NO: 44387 - DNA, 946 bp, Bovine  19866881019423
gattttcctaaaatcctgcaaagggaagaaagatccttccggtcatatttagcaccatggtcagtagtgtggaacgtggtctcagcagaggaaaagcagtgggtcctgggccagtaagcaagcctctggtctaacgagagagaaaacccacagagcacgtgctaacttgacttcacttctggtcataaagcatccgatcactttactagtgaaacggtaaagtaaaacagcaatttttttctattctgctctcaaaatcatctttcttccctgttactaaaattgatttcattcccatttagctataagccaaacagagccctgcatccaccatctcccagttcattttccgtcgtgtccttttattttagctttagaacctgaatccttgtttacacgtaaataactcagggttacttatgctgatttaaaaacaaaaagagaccactaatcatcgattgtttgatatataccatttacagcaaaagatcctattcccactgatcattttttgttattaaaatgtagtttttagctctttttctctcagggactgggtttagataattgagctctgaagaaagattgaaaactctttccgtataaatggaggggaaaagtctgaaatgctaagtactaactcgtagtccactatcgtccttatctttaataatggaaacacagtttagcacaccatgcaaaagagcatccttatatttttaaattgcaagtgtccaattatgtacaagggtcaagacaaaattgatctgaaggagctcaattttaaaatcattttaaaaatcaggacaaaggatgccacattattcaactaaaatgttaaaaaatgaaaagtattatgcatgccgcatggcggaagatcagatttttattaatgcaagttttaaatgctgattaatcctctcgagagtcagtttcccaaagcatt

SEQ ID NO: 44388 - DNA, 1194 bp, Bovine  19866881058994
gaaagtctctaaaaagggctgaagcagtccagcatatcaaagtcaccacagctaactcacacagcggtcaacacacaggtgggtgatgggggccagatggggtggggctgggtgtggttgcaaaccacattccaaattggctaatcgtgacttcctattagctctaacactggatcctgaatatttgcttcagcttttaatccatcccatggtcgctggatcaggtgagtgatctttaccttgacagggtatgtgattagtggttatctatgactttctctccatcatcatgagtgagcaaggcttagggaagatgagtagaggtctgacagagaatacaaagttcttttcttgaggaatatgtagtcagaaaagatatatggcaaaaccaatacaatattgtaaagttaaataaaatcaaattaaaaaagaaaagaaaagaatgtactattttgaaccacaggtactttgtgtgacaggaaatgctaagtttaaaagagtggttggtgtaacctcagctaaaaaggagaagaagcacaccgtgatgattctaagagggaaaaagagagaagatgtgttttgctatagcatcctctatctagggtttatccatgaaacacaaacaccccaccacccagagagcagagcagctgctgtggagattggcttctgagtcactttcactgaagtggaactatttgttcaagttcaaaggcaacaaagaccttggcagtcatctgccctaggaatgtcaagacataagatgacatcagtggatactggtaaacctgaggaagattttctatttgaaatagggaagctctgggggtaaactaagctttgttccttctttgaaataatggcttcatccaggagtgtctctgacccacgacccttggtgatgtatcacccatctaatttagcacattgtgaactctctagagagagaatgtgctttttggaataattgttgttgtttagtcgcttggtcacgtccgactcttttgtgaccctatggatcatagcccaccaggctcctcagtccatggaattctccaggcaagaatactggagtaggtagccgttcccttctccaggggatcttccagacccaagggtcgaatttgggtctcctgaaatgtaggcagattctttattgtctgagccatgacggaataaaacaaactataaaaa

SEQ ID NO: 44389 - DNA, 880 bp, Bovine  19866881072261
tcctatttgtctctctttgcttcaaggaccaggcaacactaatcttccgcaatattcttttcccaataagagctcacatccaatctgaatgctaaataatgttgtcacgaggttgcatgggcactggttaagatctatgcccaaactataatgaatctctcttctacataactgtgattgtggccaaaattggtgagcaacccatcctcaagggagcagtgggaggagaccagaatattgtgttggattctgtcctggacacatcttcagctagactcctggagcagtttaaatcaagggctgggctgagcaggcctgaatggcttgcaaatgacagatttatggagggaggcctaattagatcacggtaatttgtagtacgacagtatcttttgctcaagatctcaaagcaaatgtctgccttgataggtgggcaaaacaaagacccacaaatgtcaagggaaagtctcaatttcacaaaataaatcctgggacagcccgggataagagtcgcacatcgcatttggaaaacattttacagttttgctctgcattcatataattttgcctcctttgagtggcccaaattcctgccgtaaaagtaggagtggtggtcggtgtttctctcgttttagaaaaggggaagatggagacactgactggctgagtggcctgcccaagatcagagtcagtagtggggttgacttttggattccctgtgtggagaaatgaagtgacttttagcaggaaaagaagaagaaggtcttgagataatgagattctgtttctaacgacttggcagaaaggagcatggttgaggaatacaagtcccagcaaagattcatttaggtcaaaggcttagaatggattgcaaacctgt

SEQ ID NO: 44390 - DNA, 849 bp, Bovine  19866881083710
cttccccctccccgacccaccaccgccgcctccttctatgacaaaggtcatctgctccttcctgactcaggtactcttgccatttatttgtgcctcctggacagacagtcaccccttctgtctgattaggcagcagtctccccatgatacccttaagggatttggttgtcatcttacggaaggggaaaacagcaaaaacagtagcacatcaggaaacacggttttccccagagagcaggtgggagttagaaaggacccttttccccatatcatctctctctcctctaaaagataccaattcccaatctctgcatccagaattataggttcagtcgtggtattggtgagcctttttgaatggtttgcccaaggtagtaattttgtaatccaccgtagctgaagtaagtatagacctgggccgacacagcctccttccttctcctccatccagccccgcgtccccacttaggtgaaaaactttgcatataaacaaactcctctcaaagacacctcaaccttgacatttctttctcccttttccaaacttgcttccttttaaaacacctcgcgctctgccctgctcccacatgaggcccaattatcagaataataattaacaggttctcattatttaggatcaaacaatgcccccctaatgaagccaagaatagccaatgtgatcccttaaaacggggcggtgagtttttccttacaccttggggcgtctaatccactgaaaccattaggcaccgagctgcccataacggcctggataacattgagtcaaggacagttaatggatgccagagcacagaccaaagtgctccaagcatgtcagtcaagactaac

SEQ ID NO: 44391 - DNA, 1053 bp, Bovine  19866881087547
caacagcagagtattacaacatgtatgtgactgatgccttgttagcaagcattaacgttagaagcagtcataacaggactaaactgcttggactccaagcaattactaacctcaacaactctgaattaacttgaattgtctcctttttttcactgtcttctgacaataacaagctggtccttttctgtcaaattccattttaaaaacacatctttgttgttcggtcactaagttgtgtctgactctttgcaaccccatggactgcagcacgccaggcttccccatccttcaccatctaccagagtttgctcaaacgcatgtccattgactcagtgatgccatccaaaccatctcatcctctgtcgctcccttctcctcctgctctcagtctttcccaggatcagggtcttttccaatcagtcggctcttcgcatcaggtggccaaagtattggagcttcagtatcagtccttccagtgaatattcagcattgatttcctttagggttgactggtagacttataaactgttggcctgccaattacatgtatatattatgtgtcaagcctatgtttttgcatctaacccattttgcagagtccagcttgactctccagatctacctttcggtcttcttttgccatcttcttatgtaattcatctacaagcttgttattgtccttgactatataagttccagatcatgtgaaattgggatgtgactcactcagcaaggccacacttggaattcactcagtccttcagtgttaagagcgggcaggagaggtttgatctgaaggacaatttccagagcctgaaggaagtgccgatcataggcatgcttccttcctctaagaacaagaaaagttggctctgggaaaaccccagacagatctgctctggtttgtttctggagccttgtcttctcaatccagaggcttccagaaacttcccagaagcaacaggactaagaatatagacctttctcatcatttaaaataattacagttttctctctctgaaactccacatgctctttcaatgaactgggctg

SEQ ID NO: 44392 - DNA, 1514 bp, Bovine  19866881159624
aagctctgaagttctagccgaacctgcctactgtgttggtttcatcctagaatgggatatctgcctcttcaaacttaggaggaagaagccttaattctctttgcttcccttgctgaggactccagttctaggaccagaagacacacccctcaacccaactaaggcttatgactcccccttgcttttatgccacgcatctcttttctggatttatacccttccccatctacctcgagatttaactacatgcattagccaccctcagaaagattcctggatgaaaaccaaaagccagttcaattcgtaggatttgactcagaccttaatgccttgcttttatactcgaagcaattatcagatatctgagggccaacattattcagcgtgagggctgaggttctcattctccactagtgtccctggaccactgaattatcctctctgtatccaccttgatggtggatttccctcagatcaacaagttcccattctggagactcctgtccgcatgttctaggttgccagtggcatatggtaatggtagctctgagttctgattcttaaagagaaaggtaaataaacacttgggccatggcctgaacattgagtgcgactactcagccacaaaaaggaatttgaatcagactgtagtgagggggatgaacttagagcctcttatacagaatgaagtgaatcagaaagagatacacaagtattgtatattaacgcacagatatggaatcgagcaaaggcactgatggaccccgtggggaacagacttgtgaacatagcaggggaggccagattcagcacgcagccttgacatatacacactgctgctgctgctaagtctcttcagtcgtgtccgactctgtgcgaccccatagacggcagcccaccaggctaccccgttcctgggattctccaggcaagaacactggagtgggtcaccatttccttctccaatgcttgaaagaaaagtgaaagtgaagtcgctcagtcgtgtctgacttttcgcaaccccacgggctgcagcccaccaggctcctgcgtccatgggattttccagcaagagtactggagtggggtgccattgccttctccggacatatacatactatcatgtgtgaaatagtggaaagttgccgtctaatgcagggagcccagcctggtgctctgtgatgccctagacggttgggatgggggaagggagggaggctcaagaggaggacatacacataattatgactgattcgagttgttgtatggcagaaagtaacacaacattatatagcaattttctgccaattaaaacacacacacacacatacactgactcagaaactcacttcactagagaaatttattaaaaagcaatacctagagcaagcataatatcaatttctttaacactgatctattttaccatgaaaatgtggtgtgaatggccacggcatagcttttcctggctcaaaaggattcatgctaggtggggtggtttccattattctcag

SEQ ID NO: 44393 - DNA, 906 bp, Bovine  19866881238214
gatccggtgcacacctgaatttccctctaccgtaactgttggcatgactgagtgtacatgtgtgtctgcctatgtacacgtctgtatcttgagctgagatcagaaaaccatatgtgtattttggggtctctgtgaagttacataagtacctttgtatttccatgacctgaatctatctcccaagggatgtttagttcaaaatttacttcttttaggaagactgtcctgattatccactcagccttagattacttccctctgaacttcctgagcacatgtgtttcacatctaaacttgcaaatgcattgctaaaagcatgtcctcaataactcatataaagtttttctcacatgagaaccctctgcctttgcctctgaccacttggaaatgagttctgggctttatcacatcccctgaaaacagatccaacccacgaagcattagtgagtaatgtagaactgactacaattttatggggagatgaaggagaaagctacatgatacaactcccagcaataaataaagacaaagatctttgctttctcttgtcagagttcctctttagtcatggggagggtgagatggtttgaaggcatcacccgacttaaaggacgtgagtttgagcaaactccaggagatagtgaagaacgggaaagtctggtgtgctgtagttcacggggtcgcagagagtcggacaccacttagtgactgaacaacaacatgggcctctgggtctcctccctccctctgaatctttccctaaagtagccactgaacatctcctcctttcctggtcagagaaattcagctcacttctgaatttcttcatcaaagccctcagctgattgtaatgtccaagaatgccagcattttccccataaaaatgaacctctctctgtaggagaa

SEQ ID NO: 44394 - DNA, 934 bp, Bovine  19866881267564
ttacatattgcatgtaaacattttgacagagtcatatacgaaacctgttttcattgcagagtatataatcaaatgtattgtttatcatatagatttttatcactcatagtgcaattttcatcattccctagagtagtatctgaagtgataagttatttctcaagtcctatcaaagtttttggaagttaaaaaaaatttgatattttgctcaacttatataagtcattttttaattgcaactgtatcttgtttcttcttttccatagtcaggtaaacattttcctttcctgttctattttccctgtttttaagttgaaatgtcacttctgttgcatatgtcccatgtagtttctctacatgtttcccatgtggagaaaaatttcttctctgtaattaaaaatatttttagccatttaaaaactgaaatagccaagcatatctatttgagtgttttgtaaccttttatgacagtaatagcaatttataatttataccaaataaccatacctagcaaaaatttcaaatcaatttcattttctaccaaagtctacaatttgcttttcatttgaggatttggtattgtcttcctcaattcttttagtgaatcttatatcctgtataaattaaatgtaattactttaacagcatttggttagcattcccttcatgagtctaagagtaaatctaggccaaattttatattttctaccaagatgttttatcttcagacatctagaaatttaatagtacataatctttgaagtgtttcaaagaatatcattgtcatcagctgaggtcatgtctcttagaaacaaattcaagctatataaactgcacaatacagaatgcatttgaattttcaaaaatactggcttgtatactttttcctagaaaactatattagttccgtcctaatgggcttccccttgtgaat

SEQ ID NO: 44395 - DNA, 1148 bp, Bovine  19866881315877
ctttgacataaactttgtcttccttcttcccttaaaagcaaaatgctcttaacaggaattaacaactgagcatttctagccatttattcttagacaggatgagctgaaaagattctagtcctacatcagcatttgaaggtaggtggaacaacatggagaacagaagactatgaaagcaccaaatttagaaactggaagaaaacagagatactatcaagagaggaaaagatacagaaagagggtgctggtgatgtcttagagcaaataatctgcccaatgactttgttacccttagcacaccaacttgcccctgccctgccattgactcgtcaagctcagcattttggcaaggattttctgaggcacaggcttatgttctttttcgttctgactttcactccccagcctcctaacagctaatgcattggctttatagccagggtcaggacttgcagctgggactatcagccattggtttgcagtccatcggcttgtctgcccacctgcccttcaccgatattccttggatctccacccatctctgacatttccagaaccgaactctctgaggtgaaggcttttgtcgccagccagagtttggggcacggagcctggcatctgcggcccttcagatatactccactgtttagatgctttcatttccaggaacaaaggcttccacccccacctctcctctctgtcccctcaaagggcacccctgtgaggcagcagaagtgcatcgtgatatcatttctgatagccataggtttcagcaatcagtaactgggttttattccaggaaaaagcaatattctttgacaaataagccatttgccgagcagtttaaatgacattgcaaagagtgacgctacaaaccaatgagcctgttttctctctgctcctattcaccgagaagcagctaatgctccagataaggagtgtagatcacatgtggcttataaacttataacgtgaatacagccctacacaaagagccccagaaggagaccaccctggtcagccactgcattcatgagagacccaaccaagccgactctgctcccttcctatcttggaatgggaacatattcccattacccccatgtccttgaggattttcttaaaggcttccattccttaaacacgcc

SEQ ID NO: 44396 - DNA, 916 bp, Bovine  19866881522416
gctgagtgcggaagaattgatggttttgaactgtggtgttggagaagacccttgagagtcctttggactgcaaggagatctaaccagtccattctgaagatcagccctgggatttctttggaagaaatgatgctaaagctgaaactgcaatactttggccacctcatgcgaagagttgactcattggaaaagactctgacgctgggagggattgggggcaggaggagaaggggaggacagacgatgagatggctggatggcatcactgactcaatggacgtgagtctgagtgaactccgggagttggtgatggacagggaggcctggcgtgctgccattcatggggttgcaaagagtcggacatgactgagtgactgatctgatctgaagaattaggaagaggaggaagactcagcaaaggagtgtctgggatgtcaggagaaaaccaggagtccctggaaaccaaataaagaaagctcttcaagcaggacaggagtgtgtattgtcaaacactgttgagtggtcagaggacacacagtggatgatgagacattgacccctgggccaccagtgaacgttcctgaccatgagcaactgtctgaccaacaggggcacttcctgtgcccagcagtttttcagtgcctgaatgcacccttgatgttttccttttggaggttaacaactcatcaagagcagacagacctatcatggagaagtttcttcttgacagaaattaagagaagtattgccttctattccccaaatgatcatattaaatcaaatataacattctccatcgagggcagcgtctcccagctccacgctctgggtgaagcaggcaacctccatcctgcccacccctgtcatgtttgaagcagcaatatcacgtgtgcatttcctattcctgatcgtttta

SEQ ID NO: 44397 - DNA, 1191 bp, Bovine  19866881550635
tctgtgagcttagaccttgtgttactctggtcaccctgtggaaaggcagtagcagaaacaaaataagactccaagaaggatgacggtctcctctgcctcgtccatcttctttctccaggcattgggatctcatccaagcagccctctttcacagagaggagggagggaatcacttcatttcacaatggacaaagaaggttcctttgtggaattttgcatggcatggggtctcaaatacgccactgatgaaaagacttaacagatggactctgagaataggaatacgttcaagaaaaaaaaaaacatttaaaaaaatcagtggaagggggttgagtctggccactgtagatgctgagtgcgggaagcgcactgagcaaatgctttggaccttagacagggtgagttcagctggtagagacgaatggaagcatctgaacacagactgtgcttgggtttttagttggcaatgttgtggggaaaaaaaaaagtcccaagatgcacggtgccaaaaattatatgtgccttcaaagagtatttttttccaacaaattgatcactttgattactcagtcacaaggcttgttattttctcagaagtgccctttgcatacatgggcatttttgcctacatttcctcatttgttagggaaaagttcaaagcagacgtggttgtgctactctcatggcataaacccttaaacacgaagggcctgccaaatcttttctgaagatctaagctataaaaacactcagaatgtatccatcaagactgtcgacagtcggcactgcgcagggttttgttttctctcaaagctaccattgctggccgtttatcacgagcatgggggcccttgtcctaatctgcaatccacatcaagtgaaggctcacagacatttgagaagaaccttgaacctagctctttggggggcactctctgtggcctttagggaaaataacaacaagatgacagctcttcctcaccactttgcaagaaagctctgtatgtgggggccaccggagggtctgggagggactggggagttcttatacggagcctgtgtgaactaaatatagtgatgaggtcttcgtgacagggagtcaacctcttgaccacagggaaattatggtgttggctcctgggactttgaggagccatgttaagaatatacaaaagggacttcactggtggt

SEQ ID NO: 44398 - DNA, 883 bp, Bovine  19866881551552
gggtttagggttaactttgctctagatgctgacatagaaagtgactagggcctatgactctggtatttccagaagaaacaaatgaaaaaatttctctggaaggacataatctttctcaagctggaatagtccctcagataaatgtccactacccatagtcactatccaaatttacgaaggacagaaggaagcaatccacaatggactagagtcatcaaattcagcaaatagcagaattttaacccctgataacacacacctgaaataaactattaggattaagctaaaaactaaagatgtttaaaattattaaatacataaaagatttttttcatttttattggggtatagttgcattacaatgtgtgtttctgccatacggcaaagtgaagcaggtatacatatatatatatacatatatatattttttagtaagggcttcctaggtggcacagtggtaaagaatctgcctgcccatgcaggagattcagcggactcagttttgatccctggatcaggaagatcctctggagtaggaaatggcaacccactctagcattcttgcctggaaaacgccaaagacagaggagcctggcaggctacagtgcatggggttgtaaagagtcagacacgactgagcatgcacgtaataccatatcaatctccccttttttagttttccttcccacttaggtcaccacagagctttgagtagagttccttgcgctatacagtaggttttcattagttatctattttatacatagtagagtatgtatggggcgtccccagtggctcagtagtaaagaattcacctgcagtgcaggaaacacaggagatgcaggttcaataccttgggtcaagaagatcttcagaaggagga

SEQ ID NO: 44399 - DNA, 1441 bp, Bovine  19866881636740
tgttagagagcgtgttgaaatctgtcccttttttcatgcctgttaagcacacacttgctgcaggtacgctctgtgccagccacagtattggggccctcctatgcattctcatttaatcttcacaacaatctcaaaaggcaggtattgttattcttcccaatttgctgacaaggaaactaaggcagtgacttgcttaagatttctctcaccaggtaccagagacacagactcacttcccttcctctcctaaggccctggtctgattcatcgcttgcttatgttcacctcctcccagaagacttccttgatactccaaactgccatgaagaaaagcctctgagctctataagtgctttcataactaacttgcctaatatcttcccaaccactatgaatgactctgatgggtcttctttatcttgtgctcaaccagtgttgagcaccatgtctgacacatgagtgtaaacgagtatttgttgaagaataaatggatggataaataagtccttgcaagaaactcattaagggacttccctggtggtctagtgtctaaaacttctagctcccagtgcaaaaagctcaggtttcttccttggtcagggaactagatcccacatgccacagctaagactggcacagccaaataaataaatatttttaaaaatataagttaaaaaaaatcttgttaagaaaacgtacacaaattctaacaaataaataaaagaatgactatcatgttaacaagtattctacagtttctattcttccccccctccccatctaccattatgctcctttacatattggtttcttgaaaatctggttcattttcaaattggagacatttttctgttacaaaaaaggagaaaggggaatcatgaagacatgtgcatgactgcacatgagtcctgggtccacacacaagctgagaggaggtccagctgaggatgctctgtcacttgcctctccctttcgagcacagagaaagctatacctcatttaaaagggcagaaagataagacagaatgccttttaaacttggaatatagctcatggaaaaatttaacccagaccttaaaaagctgaaatattccaaaccaaccacaattcagaacttgagatctccctgatgagattactatacccagaaacaccatgtttcttgtctcctaagagatatgacacctaacaattcacaacaggggggtctgagggaaataactcacctattgtgaagtcaatgttcaaatcaatatcccttggggagaaaaatattgttcattgatggagatggatttttcttcttaagaaattctcgaggggtaaacacattttttttttgtagcgaatataactaaacataccactgtcaagatctatagtttcctatcatcattaacatgatgctcaaaaatgagtagtgtaattatgaatgcctttt

SEQ ID NO: 44400 - DNA, 1410 bp, Bovine  19866881735490
gttagctttttttttttttttatggggcttggtgcaccagtggctttttttttttttttttttttgactgtgctaggtgtttgttgaggcccgagctttctctagttgtggtgcgtgggcttagttgtcccttggcatgtggggtcttagttccccaaccgggggtcaaaccccatgtcccttgcatcacgaggtggattcttagccactggacccaccaagggaagtcccatcagtggctatgtgcattcttatccaatagagcccttgcatatgccttcaaccattaccagcttctctgaagcagggaccgcacccaggtttgcttctacgtgagtttctggtgtgttcaggccagaacagagaggttatcgaggagaggaaagtgcaatggcacacgagcccgagattgtgggttgttttttttaattgaaagatttatgagtgctaagtcatcatctgtatataaacatgtatcatgtattgaaattccattataggacttatgatgcctagtattgtccagcttggggtcttagtcaggaagcagtgggaggcactgatgcagacactatgaggtaaatgaatgagtaacactgtgttgtcagacccagggaaagagatgctatatatatttgtatcttgtttcttatgaaatctactcataagagatgttatttccttaagcaggtaaacacattccccccctgacaggctctttttttcttgttgggagtaggctgttcactttagagagctcttcttcttggaagaaaactctaaaggacaggattttgatatcatttcaatatgttaattcattgtttcctttccccagtgccttctgagaagacaaactgaagctcgcctcgccactttgtatgcaccagacctccacacccgaggcttatcacaagcaattatcttacccaaataaaaaatgaaaatggaaaagttaaataaataacaggacatcttgatggaatcgcagtaacgctcatcgtggttaacattagccctgacttttggacagcgagatttgttaatgcgcttgtcctttgtttaggcatctatctctgggaatctcatgactttccaaaatgatggatggcagccctctctgctctcccctaaaaatacattctccaggaaactgggagaggcaaaatacgggcactgtagccctaagcatcactcagatcgggcaaaactctcaaaactaaattcacctaaaatgggtggcggttttctccaccccaagttggaaccttcccttgttcctgattttcctgctctgcatacctgcatgagtcaggcctcactgaacttgaactggaaactgtaacttggcggagcagccaggataggaccagtttgggctctgggagcaaactaaaattcaggaactta

SEQ ID NO: 44401 - DNA, 881 bp, Bovine  19866881796436
cccccgtacatgggtttatgacactattctgtccacttgtctcttagggttgttttgaaaatcagtgagatgatgatggtggtggtggtgatggtaaagcagcaacaacagcaagtaccttttatgtcagttgtgtgctacttattagctcttttagaactgcaacaaccctatgaggtatcactgttatgtccccattttatacccattttacagatgcgggagctgaggcacataaaggttagtaacttgcccaagaccacacagctagtcaatggtggtaatgtgatttgaacctgggcagtctgacttgtattttataaaccacaaagtatatcctgggtatcttgccatgtttttcctatagtctgagaaggtttcaacctgtggatagttgttatactgtatgtggcatctacatcattagcttgatggcagaattctggtcttccaactccttacgtaagagctggggctatgtgagtttatggtaccctagctgtcttggctgagctcatggtgtgtatagaaaattaatcacgaaaacttcagttatcattactgccttgtaaaaactattcaaaggcttgactggagatgaatatgatctatgtgttagtataaatatcacagatcatgtcgttcaacaagaaaattccttttaactttcaagtgatctcaaggtctactaatttgatttggtttgtacaagaaatagaaaaatattacaagatgaaccaacgacaaattagataaataccaattacaaatcagatgagtagatcaagaattgtgagggatagcgatcagtagtccttgaaaaaaccccaaatgtacacaatacagggcctaatttttctaataaaatgcagcaatgaata

SEQ ID NO: 44402 - DNA, 773 bp, Bovine  19866881828934
aaatctggtctttgacaaagaaacctagttggaactgaatttgctgtggaaggctcgggttttctccctcctctgtgctccaacaaaagctgccaactgtcacacacgaatggcttattcctgtgggaaggtcaaggtcgcacccattgtcctggcgaagcccacagctccttgagagtgaacaggacatcaggtctgaacccacagtactgttgtgtgatattggctaggtgaggacaggcccaaagtcacagagggaaggagcagaaatgctggaactggaagctccccctctcccaccccatccctcagccaacccacaagcaggagggaaggaaggatgcagagatgtgcatgattcagcgggaccatccccaccgcaaacgaacgaaagggaatcagaggagcaggtgcaccccgctgcttccaggtcagtccttgcctggcagatgtagcccagccagatgcagatgtttgcagacacagccagccagcccccaccctatccagcctggggtggtgtgggggtggccactcaccttccattgttatgcttggctcttctcgaagagggaatctgggctgtctgttcctgagagcaaggagcttttgattctggaggagctgtgcgttcccgactttgatctcccacagatcaggtctttgcacactcccaagaggccattttacatttctgaggctcggagctggctatctcttctgctcacctgtggagctgctctcccctccaccctcactgtggctcatcctcc

SEQ ID NO: 44403 - DNA, 733 bp, Bovine  19866881889960
atctgctgggatggcatgatgcccgctcacaagttggttggagcctatggaggtgccaggcaacaatgtgttttgatgggcagcctgcagtaaggtgggaattgccatctctggtgagtgaaggccataagcggtgccagccctggcatgccaggtctgtacacttgttcacacctgttgactctccagtgccaagaaaagcatacttgagtgagggacaagggtaggggggagaagacattcacagagcaccagcatcttcgggtatccttgtgggtacagacagaacctaaagagacgtggacagtcagacccaggaccacctctgtgtcagcactggaatggttttgtctggccctagaatgtgtcctcaaacacaatctgtgctaaggaaaaggtacccagcagggagactgcagcacagacacaattcagcacagagacaggcctgacctccaagccagaccggagagccagagagaagggcaggctgggtttaggaaagctctttccaccaactgaaagagctttcagaggacttccctggtggctcagacggtaaagcatctgtttacaatgcgggagacccaggttcaatccctgggttgggaagatcccctggagaaggcaatggcaacccactccagtactattgcctggaaaatcccatggacagaggagcctggtaggctacagtccatggggtcgcaaagagtcggacacgactgagcga

SEQ ID NO: 44404 - DNA, 1467 bp, Bovine  19866880362458
atgataaagaatccacctgcaatgcaggagacccagtttcgatccccaggctgggaagatcccctggagaagggaatggctacccactccagtattcttccctggaaaatcccaaggacagaggaggctggtgggctacagttacggtctatggggttgcaagaagtcggacatgactgactgactaacactcactttcagctggagagtaaaccagtaccctctagtctgtgagaagcccttctgtcctctttggagggctgtgcagctctgtgacaggccctcagtaagaagggaaaaggtctgatagggtcctcctgccctcatcgtcattctgcgtcaggttcccaactatatcacccttgagtcagggacctcaacctggggctccataataacctagaggggtgggatggggagagaggtgccgggatgttcaagtgggaggtgacatgggtaaacctgtggctgatccatgttgatgtttcgtagaaaccagcataatactgtaaagaaattatccttcaattaaaattaataaaatcaaataaatacaacataagcttgattcaataattggtgagatagccacgtctatgtactcatcaataaaagcataaattcaatagtaagacaatatctataccagataggctgtgtgcttagatgcagggggagttcaaggcctggagttggcagaaaatgcttcctgggtatacagccataacaccctgaacacgccccatctcgtctgatctcggaagctaaacagggttgggcctggttagtacttggatgggagaaaagcttcttggacacagaggtacttgacatgcatcttgaaagctgctttgtattaaggaagaatgagacctgaaaacacttctagagtgaggtccttgggcaaggaaaaccacagaaattcatgtatgatacattcaggatgagcttggtggctgggggtgattatgcaggcagaagtggagatgagaaaaggcaggtcaagtgggattagaaagtggtattgcttttttgctggtgataggaagtcagtgattgaaggcttttaaggacaggaatgacatgactagactagggttttagaaaacattattctggtaacagtgtttggaaaatgattacacaggcaaagagtagaaatgggaaatgaatatggttggagtgtgttacccacctaagctctggaatgcattcttggaccaaaacatccctggggtcaaaacggtcaggtcaaggcacgtggtcaaaacatcctggtcttattatacaacagttgcttgggaatccaaacgatgagtcagtcgttactggaaggagtctcagtggtgatgtttaggaaaattctctgcacacaatctgtttaaggagtgaaaagggcaaaacacttggaataatgatggctgtgaagttgtccaaaaaagtgatcagataaaattgggtctgggt

SEQ ID NO: 44405 - DNA, 2135 bp, Bovine  19866880389194
aaatgcctgccatctataaaggcttgagcatgagttaaggtggggggtcagtgagaaatgatatgaaggcagaaaacagataatggggattttaggttactaagaagcttgtccttaaccctatgaaaaatcatacaattgataggttttcacctgaggggagaaggaaatagcatagtcagattttcagtttaaacacagcgtcctgtctatgttgtgggaaatggtttgtaggcaacacactgatggcaggagcagaggaagagaatgctcttgaagagttgatggaaagatgagctcaggcaatgagatggggatggagaggaaagagagagatgagaggctttggctgtaccttatctggactcgatccactcataggatgcgctttgtccatgaaatgatacatgaatactagtaaaatgtctgttttatttgcaaagtgcaacagaggagctgcataaatacttgctgtcaggctctgtgtggtttctgagatctgtgagagattttgacggcttcatggaggctcctgcaggtgcagttttgatgagagatgagaaccacggccagatgtgctcagcgcacaggacccactgaaagagggcccacttgtttgtgtagcacatcacaactcactaactggagttgtgccagatgtagaggctttgcagggagatagacctgaaatccgggcttccctgtggctcagacagtcaagaatacgcctgaaatgcaggagacctgggctcaatctctggatcaggaagatcccctggaggagggcatggcaactcattccagtatttttgcttggagaatcccacggacagaggagcctggcgggctacagtccagagggtcacaaagagtcagacacgactgaaatgacttagcacacatgcagaactaaagttcaggccccatatggctactcacaagccagtggaacattttcaatttacatcatttccatgaactggttttctcatctgtatgggagggaggagatgggttggaaaataaagaataaagaaaaggatattagtcagagttcaccggagaaatagaccaaaagcagagagagagagagagatttactgtgaggaaatggcttatgctactgtggagacttggcaagtccaaaatctaatggagtgggactataggctggagatttggaagagctggaattcaatttcaaaggccatttgttggcaggatttttttcttgttcagtgggatcagacctttggtctattcaagccatcaactgattggctgaggcccacctaattatggggagagagcaatctgccttactccaattaaatgttactcatccagaaaaagaacacttcatagaaacatccagaataacatgtgaccaagtatctgagccaatgtgacatataaaaataactttctagaaggaaaaggagaaaaaaagaaggaaaagaaaagttttaaagcataatgttctctgttaaaagtccaggaccttgtagtcactcatcaaattataatttattttagtattgttattattatattatttttactgtccatccttctttcacagacaaagagactgagattttgagatgtgaaatccccctcccagatatatgcaggttctttctttcctctgttgaagtcattcaatcaatcactggatgttcttgatcatttttccatctgtggctcattctgagaagggcacaatacttaggttttgtgtctaactgacttgatttcccattcagcaggcaccaatcagaacgatcaactgagaggacaattgaattcatttgtaaataacagaaaaaactgacctaatttacattgttgagacaggctccagggcgcccagctctgcttaaagggagctaagtttgccaatgggctttgtttcacgtggacatcatctattcatttactgattcaacaggacattatgcacatatactgtaatgttatatgcctaacacagggcttaactttgaaggaacccagaaaagtggagaacattaatgagggttgagttcttacattcacctcattatattcacatgtatgacctcattttatcctcgttttattttaagctgggctcaactttgggagatatgagt

SEQ ID NO: 44406 - DNA, 3922 bp, Bovine  19866880395878
ctgtgatcattgtgtgaaggggtttattgtacactgttaaaattttacggttgctggtgattatcacataatagtctgtgctgactaaaccctctctcattctgaattaggagacccttgttttaggactcactgtgccatgtactctatttttattacagcgcttatcatattaaatggcatttgattttacatacttgtcttccctgttagttcgacaagccctccagggcaagagattgtgtgcttgtttaccagttttcctccagtgcccagaacacagtgccatttggaacatgtctaaatgttttgaatcaatctcttgacccacaaatcttgcttgatactgatcaattgaattaatagccatcgaagagattattatcaataactaagatcagaaagacatgttgagcatgcagttaagatcagaaaggtaggcattatagaaataaacagagcttggcattttccagtagtaattatggtgtataatactgagggaagaattctgtacatgatatattagagtcaatacgagactttggcattcagaggacttttccactgaactcctaaaccatgtggattcactttttctttacggttgccaagaagaaaagtcacattcacaacatccttgcatttaaaggaggatgagattttgttgtaagtaaaacatatcataaaaaggtatcaactctccttcagtcggggattcataataaccccctggaaccttgtcattctgccttagttgtgtcactttctgatatctgctgctaattctgttctctttttgtacagctacttgttttaatgttatcctgatgctggcagtttgtgttgcccatattggtagacaacaggacacataaaatgtgtaaggagcatccacaggaagacacactttgaaactcaaaccctacttaaaatgcaagaatggaaaactgattcatgaattcatgaattgatttgaaaatgaatattgaggggtgctgggtgctgaccagctgaccccattcctgtctctggattctttccattctaagaactggccattgaaaagataccctgaattttttcttttttttaacttgagttttgccatctgctttcccataacagaagtcagtcagagacaggtgtatttttgaaattaagctcacaaaccttatttcactggggtcaagtctgctaaattgactcactcaaggtcaacagtgcatttatcaccaaagccaggactaagaccagagtatcttcagttctaagttttattttcctcctttcccccttcatttaaaactattttttgaaggatttgttgaaaagagtttcaagaagagtcaaggagcttctataaaattttttagtagtggttgaaatgatttcttactgccgactagaacagagtgcacagtgtgagagctgcaagttaagttttatttggggccatatgaagaccgcagccagggagacagcgcctcagacagttctgagaaactgttccaaagagggaggtggggaaggacagtatatatgcaattttagagaagggggaatacacgaaataaagcacattctttagaaagtttctactggtcttgtgagctttctgctagtcataagaaacagttgtcaccatgaaggattctagtgcttttctacatatgagcagatgtaagaattgggctcataaaataatttcctgagaatatccaactgtctgaagacctgtcctgacaattttcctggagcacagagtgcctcatttctgctctccatcttgaactccttcagggggtgttggaggtcagcagccacagcagcacatgactagtccttgtagaggtagagggcaagtgcccctggccagtgccaatttgtggctgacagtactaacctctaagtttatttatttggatttcaatacatggtatacatacacatcaccaagaggtatggctctgggagcagtgagaatcagacttgggcctgatgtcttggctctttctgcatcattgtgtgttctcagataagtcacttgacagatcagagcctccgtttccatacctactaagtgtgtgaaagctacctacccattgcagggatgagaaatcacctctgacactgacaagagacatacgaatgcaagctgttaacatgtcgaatgcatttttatccactgggggttcagatcattaccatctttctgttcagctaggtcaggtgtaagcttagaatttcctgagtacattattttattgttaggcaatctgttagtatgtgagctttgaaaatatatatttttttcctctcctcattagttacagcatgtaatttctcagtaaaaacatttcctttgtgactttcataaaatcactgtgatttcttaataaggaaatatgttcaagtctacacaaggccccaatttcctaccacttaggggttgcagaatctggtcataatcactggggctgtcatcctaattgcccactcaagcttctgatgcacagctcaaagcctctgaaaaataaaagaagacaaaaaggagtttttgtgagttttaggtttatatttataaaggcttttccttccaatcgacatcatgacaaatttcaacataggccagaaaaatacatggttgtttagccaaaggtctaatgcttttgtggagaaggaaatggcaacccatccagtattcttgcctagagaatcctgtggacagaggagcctggtgggctgctgtccatagggtcgcacagagctggacatgactgaagtgacttagcatgcatgcatgcattggagaaggaaatggcaacccactccagtattcttgcctggagaatcccagggacagaggagcctggtgggctgctgtttatggggttgcacagagtcagacatgactgaagtgactcagcagcagcagctaatgcttttgacacttttgaactgtggtgttggagaagactcttgagaatccaagggacacttcaaggagatcaaactagttagtcctaaagaaaatcaaccctggatattcattggaagaactgatgctgaagctgaagctccaatactttggccacctgatgacccaactcattggaaaagtttctgatgctcagaaaaactgaaggcaggaggagaaggggacaacagaggttcagatggttggatgacatcaccaactcaatggacatgagtttgagcaagctctgggagatggtgatggacaggaaaacctgatgtgctgctgtccatgtggttgcaaagagccagacatgacagagcaactgaacaacaacaagccaaaggtaaactgtgattgactgatcgattcattcattcatttcttcatccagcgcacatgtgccagatcctgggatgtaaagatgaattggaacgcttctgcactcaaggtgctcacaggctagtaagagatgtacgagcaagtaggtgcgaaggtgattctttcctggaattctgtacaaagacttgaataaaatgctcttgaggggacgggagaagaaaataggtcaagaaggctccttagaaggctttgcaagccaaatagatgtttgtgagacaggtgtaccaggacagaagcgggagttagatggtcccccagaaagtaggacacctgcgatcatggccatgagtgtacagaataattgaggtgataagaaacagaccccaatgtctgagggggtatagggtcataaggaatggaaggggagatgaggatggacaagaagaaaagctgaagaggcagataaaggccttctggggaagtgaagtgaggaatcagaacccagaagggagagtaagttgcttaggaagtaaagtcataggacatgtcccaggggaaaggagtccggacaactccgtagatttccaattgacctactat

SEQ ID NO: 44407 - DNA, 1268 bp, Bovine  19866880452775
ctgggaagccccaattatctgacataatcatcaccagaggtcctttaaaagagcttttattaacccctagccaaccccaataagttaaaaaatgagattgcgtacaggtcagccttaggctcttttactaggatattatttctgtagcttaaaagaatgcctggtggtcatgggtgatgcattttggtaccaagacacaacaatagatcatctttagtaggagggatttgcacctcagtaaataagagaaatacattcactacaaactcactcatcttgcctacatagacatgaccatataacaagcatcaaaacttggaaaatcagataataattctcttctgggcttgaacctgcagagtatactgattctctgccaagtttttttttcagaatgatcaggagaagttgaaaacagatcaatttattcattttaagatcaaaagggtatgctatgacatgatttcattaagaattaaataatgcacatgatttcaaggttaagagcaaaaaataactactccatataatggcttaaaactcccagaaggagtctgaatgaggaatgatggcctttaactaagagcaggcccgtctaggtttaataacaagtgatttctcttaattgcaattgccttgaagaaaggtattcaaggtctcagaatctaacaagttgtagctagaattcactccaggatttaactgggggaaaaaaataatttttaaaaatactcaaccagctctaggatctcctgacagaactgaatgattttactcttcttagtgtagagcctcaggaatatcaagtcaaactgaggaagaataatatgtgggaattactgaattcattgcttgcaatgctttttcccattagtagagggcgccagtggtaaagaaaccacctgccaatacaggtagacataagagatggggggttcgatccctgggtagtgaagatctcctggaggatgtcatagcaactcactccagtattcttgcctggagaatcccatggacagagaagcctggcgggctacagtccacaggatcgcacagagtcagacaggactgaagcgactaagcacgcacacacaacccaagagcctatggattaatgtctctgcatgagggggaccttatggaagccaaagaaaaacttgaggagctcagataacagagcccgacggtgagaagttctgagaagaggatactgagagaccagcgaccactcaaagcaggagacatttgggcaagacagatggactctg

SEQ ID NO: 44408 - DNA, 1434 bp, Bovine  19866880529809
gtgtctgttttttgggagagagtggggacagtttccactttggggtacatagggcagagagatggcggagcctggattgtgctaatctttggtgaaaaaagctaattaaataagagacttagtaatcacatcatctggttaatgcacttcagcgtgcgtcccagatacttaggtcattatgctgatggaaagctttttgaaaagaaaaaaaaaaaaggccatctccctatgctcatcctgcaattatccatttcttgcctacctcttgctgtttttgataagaaccattaggataataatgacagactcgactcgtgtattaataactctgtcggtgtacacttctttctgcctctgtgaaagactgaaatgtgttaaccttttaaacatcatccattgcaggcagtgtcagacctttattaatggtcggcttcagctgcccaaactcctgctcgctgcaaatgcgtgtgatgtgtagaaacaaagccttttcattttgctcatggtcatttccctttttaggagcttgaaatgaaatactgtgtttatcctgtatagcctaagaatgtacgtcagctgcacagcctgaaatagacatggttttgctgccctaaatatttgattcttgagtcaagttattataattgctagacatccttctttaaatatagaaggacagtccatggacctgcacatttgaaataaacatcgcattcagaggtagcactgtttctatttgattttttcataacatcttcggtcttagtgagtgtagtgaaacatgtaatatttaattcatctaaagccttgcagctttaggaagacaagatcgagaggccttgggccatgagaaggtgtttcttgtagtaaacgggtgtagttaggacaggacagaaatgtcaacatgcccttttgtaaaaccattgttcatcagccattgctccaactcaatggctgctgtttcactgataagtagtttcagattaagcgttgaaggcaaatacatttactgcagacaaaagaacataggaggggacctaactgcctttgaactgtttgataacttatcttctacaggcagggccttaagcttaagttgcaaggctgccctgacatctgcagaaatagccttgggataaaaatattttcaagtggtcctgcttggcacagtctcaagttagagaaaaaaagataaacaagagactccaagttcatgtgtacacttggagtgtgcttacgtatgtgaaatattttcactgttcactcttctgaccttataacaccaggttcaacctacctttagacagtgtgcatttgaattccattgttaatttggaaagggattgatatagtttgatttcttgaaattaaacttgaggaggagatctaagtatgatttatggaagaagtccaaggaagggacttttctaaagg

SEQ ID NO: 44409 - DNA, 1168 bp, Bovine  19866880628067
cctgtattctttctattaaacccacaccaggtttgaggctcttcagccttcaagaaagaagagtggcctctgcttgaactgagagaacgtgggcttaaaataaccgtgggtcacggccctctctgaacctccttccttcctgtaaggcccgaggttgttcccatagtctctcccagaggacattagcaatgcggcttgtatttgagggtccctgggaagacaagagcttgcattcctccgggtgtgagaggagcccagtcccagggcctgtcccatgtgacttgaggaagtggcctggctatttccagaagggctgggtcaccggagtcatgtcactgcttggattagtcttctgttaatgacaaagacggtgctggcaagaagcactctttgcacgattcactgtcagctcagggattcactgtgctaagttgcttcagtcatgttcaacactttgcaatcctgtggactgtggccctctgtccacgggattctccaggcaagaatactggagtgagttgccatgccctcctccaggggatcttcctgagccaggggtcgaacccatatctcttacgtcccctgcattggcaggcgggttctctaccactattgccacctgcaaagaccaaaatgttagtcgttcagtcatgtccaatttttgcaaccctaaggacggtagccctctgtccatgggattctccaggcaagaatactggagtgggttgccatttccctctccaggggatcttccagacccagggatggaacctgtgtcccatgcatcacctacattggcaggcaggttctttgccactgagtcacctgaagtccaaaatgttagttgctcagttgtgtccatctctttgggaccccatggactgtagcccaccagactcttctgtgcatggaattctccaggcagggatactgcagtgggtatcatttcctttctggaggggatcttcccaacccagagattgaacttgggtctcctgaattgcaggcagattatttaccatctgagccaccaggaaagctagttcctgcccaaatactgtgtcctgttctaatgctattctaatcgtccttaggggtgtgttcatctacccaacaactatttatttcatacctactgtgtgctccactctaggctaagtgagggctc

SEQ ID NO: 44410 - DNA, 1299 bp, Bovine  19866880665955
attttaaacttctgattttcctatttgacatcttaaatattccagctgctctcctaaccaccatgtctcatgagcacccaaccataactagaaaagtgggaccagatgccctgccaagtggttacagtttaatagtaaataaatgagtccctggtagttttcttatagctggctggggagcccgatcccagctgctgggtccactagcagctgagtaaatacattgccagaagctgcaacctgagaattaccattcagtgcccacagcccaggacacactaggactgctgttgtttatccattaacaggtgggaaatcaccaaagccgtaaccactaaatccccttttaagttgtctgtaaaaaaagattgttctgtttattgaactggagaacaagaggcaggactattcatttagataaaattaagttaaaatctttaagttgtactcagagcctgtataaaggcctcataactaagcctgggcagcttgtccattgcagtccacctgacgcatccatcaccagcaggtgagggttcaagcaacaagccatcagttctgttttgcattcttctaatcagtgactatggaccaattctgcgttaggccctgggcttttacgctcagtaccagagtgaaatgcactgtccctggtttcatggtaaatcaaggaaagccaatatctgaagaaacagttttgattctacaggatatacacggcagtagacacatattccagagaaggcgatggcaccccactccagtactcttgcctggaaaatcccgtggatggaggagcctggtaggctgcagtccctggggtcgctaagagtcggacacgactgagcgacttcactttcacttttccctttcgtgcattggagaaggaaatggcaacccgctccagtgttcttgcctggagaatcccagggatgatggagcctgatgggctgctgtctatggggtcgcacagagtcagacacgactgaagcgacttagcagcagcagcagacacatattcgggccaaagaagcagtatctccaaacagggaacatgtgtgtacagtttcaaggatgaatttgagtgagtgttgtatgtgctgggaaagggtggtgtctgatgagaaatgtcattccacgtagagaaagtaacacacagcgaagagtggtggagtaaaccagaagcagtgtgttccaggaagtcaaaggagttgtgagtggcacaaaaatgaggctgggcagtgcctctctttccagcagtgccctttgcctatctcaaggctgagttcagcccctgcc

SEQ ID NO: 44411 - DNA, 1031 bp, Bovine  19866880727475
tcgtattatgcaatcctgcgtccggccaataattgcctctctgacatgctagcctcccgcattcctgagattcatctagaacagccagaagattagattagtgtatattttcagctagccgccatcactcctagctgttgagtctcctgtcagctgaggcactcctgtttgtcactgccctgtcagagaagtccgtccctagggcaacaaaatctctctgtggaaaggagagagagaacttcagagaaactctgttttatcccaagcccttattcaaccaaaaaatgttgagtggtagaactgcatgaccacatagcaaccaagaacaaagagaaaaattcaggtgaacaagtcattctcccacctcagagatatccatgaagtattatgtcatacaaagaacacaagtggatgtttaggaaaatggagatctagctttgtgcctgccaccaatcaactgtgtgattagacatgttcattcatttttctaaatcttggtctccagattttaaaatgaagcatgctaacaacctcattggtaagaattaaatgagattctgggtataagaacgcttggactatatttgcctggcaataaatgtcagtatcctaagtctttgtcaagtgttgcttcactgtatggatggggacccccatgtgcccagagcaatgaccacagggcttagcacagtgtgctgtcattgtgcgtaattgcatcagctcctcagagacaacaacctctctgagcccatcagagggcttcgcacccaggcggtcagtgcatttgtgctgaatgttgaaggaaggaaagaaaaagggaggaaggaaggatgaaaccagaagaaagaacagaagacaggagggagagagtggggagcggggagcggggacggggagggaaggagggaaaggagttcatgatttaacacccaagctaggggtagagtacatgtcttaatcttcagcggtcaattttcccctggtcctgatgacccattactctaaacagagctaaatctgccactctgttt

SEQ ID NO: 44412 - DNA, 1167 bp, Bovine  19866880771888
cagactgtaatatgaaaaacccacaaatacatgtgtataatgtatattttctaatagttatgtaagattctataacactcctgtcaacattcatcatttttgtccgcgtcttccttcagtatcacctcttctaatgtcatgccctctgtattgatcatggcctttaaaaacaacctgaactctgctttaaaggatagagtaattctttggggaaattttgtcttggaggttaagcacagataccacgaattttgtaaaacctttctctcctattgctaattctggagtctcaaaactaaaacagcaggacatttctttttcccaggctagagagtatctttattaataagttcacatgtgctaacacttcctggagttcagagactgcagttcctgggagacaagaagcagctttcatcaaaaatgctctgcttggctctgcagacctctctgaaattaacttcacgtgttatccaggccacccaaggttgctatggaaaccaacatgtcagctcagcaaaaaataagataaagatttggaagaagtcactgatgctgcaacctccttttcagtatctttctcattctctctttgtgcaggcacgtgtgtaattgtgtgtgtgtgtgtatgcatgcgtgtgtgatcgcatgtgcctgaatgagagcttggtgtcaaaaactacactgtccttttccactgagtgtacatgcagggttgggactcccgagcttatcttaactgctagggtgggggcttcttctgacaggcaccccggcctggggaaccataaagagagtactgcctttctaaatagacttcagagaagaaatagttatgtaaggagaaataaccaccgtcagtcctgaggactaagccacattccacagaaaggaaaataaaaaactgcggtcagtgttttgctaatgtctctgctgttaaaacagagccccaagccagagccagggaaaacatgtcattcagagcttggaggaggctcttgtaaaagtccctgtttgggcttggagggggaacccacccaggcagcacagtgggaaatctttccagtgttagaaattccagctggatgctgcagttgctttgggctctagttgggaatgaggtagactaacgagagaagcccaattgcaggcttatattcactcagg

SEQ ID NO: 44413 - DNA, 1050 bp, Bovine  19866880807342
tcaatggacatgagtttgtgtaaactcagggagttggtgatggacagggaggcctggtgtgctgtagtcaatggggttgcaaagagtcggacactactgagcaagtgaactgaactgaatggaagtagaatgcactgaaatttatttttcttaaaaggggtctttgtatctatatgtagaaaaatattttgttttctcttatgctgttaccttcccaggtgatgccaatggtaaagaactcatctgccagtgcaggagacacaagaggcacaggttcaatccctgggtcaggaagaccccttggagaagggaatggcaacccaacccagtattctggctgggagaatccaatggctagaagagcctggtggagtccatggggtcgcaaagagtgggatacaactgactgactaacacttttgctgttactcagttccaattaaataaaaaaaaaatcgttattaaacgtattattcctgctgtgtgagctgctaaatgcttactgtgatacagggctctggaaataatgtcatgctgaatttgcccttttgagggaaaagtaacttccagactgtgctgagatgaagatatatctctttctctctctcctacccagcactttgggacaagtgcacaatcaccatgatacttttgcatgctcctactgaataaagcaattttaggtcatttctcatttaaccatggacctgcatcattttacatgtggcttatcaggatcaaaaggtagggcaaggttagaggaagaaagacagaaaactgaaccagacaagaaccctaccttcaaggtaagtgtttgtttatcctacacatattggattttattatgggtcttcccaggtggctcagatagtaaagaatctgcccgcaatgtgggagacctaggttcaatccttgggtcaggatgataccctggagaaaggaatggcaacacactccagtattcttgcctggagaattccatggacagtggagcctggtgagctaccagcccacggcgttgcagagtcatacatgactcagtgactgaca

SEQ ID NO: 44414 - DNA, 1407 bp, Bovine  19866880816901
tgttttccccaaattgaatattccttggaatttcttgattttaagaaaagtaagaaagattaaattctcctctgcttgtaggcactttgatgagatgttttatagttaaagctaatgacccttcaatatttctgcagtaaaacagtcactgatttaaaaaggcaagaatgatgtctttgatctataaattagtaactgtcatttaaggaagacatggccagacagatttacacttatgaaaagtgttcattatccccaaagtgacaggacaagagatcttctggtgatctgtgggtaatcaatttcaaaaataataccacaaagaatacatcatgatgaaataatgcagcgagcccatgaatgaaaacacatgttatatacagtgtttgtccaaaagcacatgcaacatctactatactggcctccctgaccttcttccactgccagtgctgaagggttgatgggaataactagagatgctcttgttttggttagacaaatacaaataaagcaaaccacatcattttctgcactgagattattcaggtcacattctttgttttcatgttaccatgcatgttgtgactatttcaaattatgctcagagtacatgaagaggaaagagcaacaatgacataaaatcagtacgactaaataaaaatccctggattatatatatatatatatatatcccaaggctcaattgtaaagaatctgtctgccagtgcaggagtcacaggagacatgggttgatccctgggtcaagaagatcccctaaagaaggaaatagcaacccactccagtattcttgctggagactcccatggacaggggagcctggtgggctacagtctgtgggattgcagagttggacatgactgaacgactgagcacatgtatatacacacatatatgtgcgtgtgtttctcatatgtatgaaaaacccagcttcgacatctgctcagcacttaatgtcagagttcagaaagtgtgagctattctatagccttaaaacctccaatctccaaattctattttcctgggacagaaatatcagtttgcaattgtctccttttcctttgctccttgtgaaaggaagctatgaaaaccaccaggtgaggaaaataggaagcgagagcctgggttctcatcaaggtctcccaggagagcaaagggtgggaacagggccacaggtgatctcccaggggagaaacaccacaagtactcaacttactgggaggagagggcatccccaaggatgttttacactttctcaggaaaacttacatttcttcacagcctgtcttctgtctgcttctcagtcttatctcctgtccaccttctcccctcatctacactctagacacactgagttacttggggattccaaattccctcatgtatatt

SEQ ID NO: 44415 - DNA, 1591 bp, Bovine  19866880819387
tgaagaattatccaaagtttgttgtgattcacacagtcaaaggctttgactttggactgcaaggagatcaaaccagtccatcctaaaggaaatcagtcctgaatattcatttgaaggactgatgctgaagctgaatttccaatactttgtccacctgatgtgaagaactgactcattggaaaagtccctggtgctgggcaagattgaaggcaggaggagaaggggatgacagaggatgagatggttggatggtatcaccgactcagtgggcatgagtttgagcaagctccgggagttggtgatggacagggaggcctggcatgctgagtttatagggctgcatgtgtccaaagagttggacacgactgagtgactgaactgattgactgactgtctatccttcagagcttggcataggtatttcttgttaaaagctcttcctgacccttaaacagagttccctgaccctcctcttcacttctatagcaagaaataaacagggatgaaaaaagtccgaaggagtccagtttttactgactgagcacctaacatggtgtagagttagttgctcagtcgtgttcaactctttgtgattccatgtactgttgcctgccaggttcctctgtccattaaattctccaggcacgaatactggagtgagtacccattcccttctccaggggatcttcctggcccagggatcaaacctgagtctccagcattgcaggcaaatcctttaccaacagggccacctgggaagcatgatgtaagaactggtcttttcagtttaaatgtactgggcaggactagaatacatcactgtcttgctaccaggaagtactttttctgaaagaccagagttttatgctttcttcctcagttgtatcaagtggatagtaaaagctataccacagaaacataagagccagtagcaagcatacctagctgatcacaggatccctaaaaatggaggcatgacctcagaacttctctgctgcctaatcagagttagacaattgttgctggcactggctgtcccagtggaactgtccattgatcctcatttatctgtccaacctgtgcccaaccttttctccaagacctatttccacatttgcagctacctgcctgaagtgacaaacgatcaagaacagaagttaccaccccattacagttcagttaagtagaccaatgtttactcagtgcagatgacacagaggtgagtgagacgctgccgtattgtggtaccttattgcttcaaagtgtggtccctgggccagcactactgacatcacttggtagaaatgaagattcctgggcctcaccccagacctaatgaatcagaatctacatttaaacagaaccctcagaagattcttacccaaaatgaagggaaaaggatgtatttagtcatcaaattcacgaacggctgtctagggagccaaagcagtctatggtgggtcagggctgttctctttggatctgcttcgtgccttgtcaatactagtgataaatgcttctcttactttttacatacctaactcacagtttattctgactactgatgctgaacatttctatggcttccttg

SEQ ID NO: 44416 - DNA, 1492 bp, Bovine  19866880829424
acatgtatgtcttacttaaaccaaagcaaaggcagtattagagctccagtttatttactaaaaatagaagatatctacacaaatccctcaaattctacatgagcggcatgcaaatgtagtgatatgattgcatcttttggtaaggcccaaagaaaggtctcttgatattcaaacaatacattcctgagtatgattgtagagctcctcctgtttacagagagaatctatttttctatgcctgaatattctaccaaacagattcaacacaatattcaatacaaataccaacataatagtctactctgtgtaggccaataggatgaggtaggtgtgtctacagggcagttgagtacccaggccaatatgctcacattcctggatgacccctgccacaccctggaaacaagcccaggttggctccttgaaggctcacaggccacacagtaatggggggtgatctttccagttgtgtccatccaaaataggcctgcccctgccaacccagctgctgaccaatgacccagaaatgaactcagccccagccaacagagcctggtccaaatcagtagaacctcccagcttgcccattgactaggaagcgaaaatgagtatgctgggtatttgtcactgaggttttgtggttgattattgtgtattgcctttcaggcactagaaaatgaatgtggttttggagtccaaaaacatgatctaagacctggtacctccacttgtgagatatatgttcttgtaaaaaaaaagcattgcatctttctaagcccccacggtactctttgtaaaatgggaagaaccacacccaagagcagaattgcgtgatgatctgagcaacatgtaaagcactggtatttaataagcacttggtacctggaactttaattagtactccccctgctctcacaacagtcctcatccaatgattctgacagcacagacttttaaaaggcacattctctgttgaggctggcaaaccagcatgatgaggtgaaagcggttcgggggctctgagcacctcttctttaaggccaacttgtgaaaccaccagctaatttaaaacaggctcctgcggacaacagatatccccacaaccatagtgaccctggggctgggagctcacagctccctctacttagtgagatccttccctgccgggcggggcctgcccatagctcagagctctcccagagctcagcgatggtggacaactggggagtcccactcagaccacccaggagccttagctgatgcacttggctgcctagttacaacatgcactgatgagaaggcgatgttcccgcagcctgtgcttgccgctgccctgactctggctctcagggtcaccccatggggggaggcaatgcctttgatctacaaagcccatgtccactttgatcctggtcacctttcgggggtcaatctgtcagcagctggcccttcccaccatgtcagtcacctgtgccctgagacaggcatttaa

SEQ ID NO: 44417 - DNA, 967 bp, Bovine  19866880842527
tggggttgtaggtatggttaaatacaaattatgtagctatgataaaagatgatatggcaattaaactagggattatataattacagaggaatagtaaccagtccctgggcttcccatgtggctcagtggtaaagaatctgcctgccaatgcaggagatacaggttcaatccctgagtcaggaagatcccctagaggagtaaatggcaacccactccagtattcttcttgcctggtgggctacagtccatggggttggaaagagctggacatgacttatcgactgagcacagcacacattaaccagtccactctgtggaacagtcagatccagctgccctaggttgctaatctgctgtgcatgttttccagagtgtcctctatcttgaaatgcatgtaactgctccttaattcacttcttctctcattagttcattcatctagtaaatgttcagtaggtacctgctaaatgtgaagccctaaactaagtgatgtgtttgttgatcagataacaactcttgagactactatgtcacttgaaggctgatatataccatggatgatgatagtcttctttcttaactctcacatcatacctaggctcaaaaatctgtgacaggcttccaggacaaattgtagatgtggctaccatatgctgatctgcacaaatgcagaatgttccattcccctctgaggtctttgtgagtgtcacccttggaattgtgcaaaacatgaccttcttggccatacctgaaaacctgggcatagataaagggagttggaatttaagaaattcccagcaacttcgtctcccactcctcttggttctgtgcccactggcccactcacaccactctgtggactctacctctatgtctatgacttgacataggtgtctgtgacacctgcttgatgactaggacctctgtatttccctgaagttactcctttccaaggtgttccttctag

SEQ ID NO: 44418 - DNA, 1012 bp, Bovine  19866880877447
gactgagcgacttcactttcacttttcactttctgcattggagaaggaaatggcaacccactccagtgttattgcctggagaatcccagggacgggggagcctggtgggctgccgtctatggggtcacacagagtcggacacgactgaagcgacttagcagcagctgcaggtatcataagtagtctagagatgatttaaagtatacaaggatgtgtgaaggtcatatgaccactccattttatgtaaagaacttgaacattcatggattttgttatccacggaggttctggagtctatcctctgtagataccgaggaattaccgtgttcttttctgtaagttaactggggttctaatctacttacaaaagcccacaaagatgagaataaaatctacttggtttaaaaactggtgcctaggatcttagtctataccatctgtcacccagcaatcttcctctgacgtcagcactcacatttattgaaaaatttctaagcttcaatcaatgataatcattttgtaggaaaaatcatctcatttaatctttgccacaagcttttaagtagattctcttcttatttacattttcagatgatggtcctgagatttaaagctgttaagtagtttactaaatccctacagttagaaactgaatccaggatttgaaccaggttctgtcaagaatcagagttcaaattctgaaccatgacatcaaaatttccccattacttgctaacaattttcatcgtttaccaatgagagaagtccgggatctctgtgcgtactcagatcccaggtaaaatgcctctggtgtttgtgatgctttatgagctgggcaatgtgaatttgttgatttaagaggaaagctttaagttcttctaaaagagcattgctaactcacgcactgaaaaacacagagcagttcaggaattgggcggtgcagtccccagggagaaatgaaaactacggtagaacatgaagaagcaatgtcatggaaataatgaaggctttt

SEQ ID NO: 44419 - DNA, 1538 bp, Bovine  19866880898732
gattctctttctctgaataacacacacaggttcatttttaaatttttatgtcctgagtatatcaacattgttaaatattttaagaatcagccttcctgggtatctggtttttcaagcttattttatgtcaaagtgcagttccttaagttgcttggcatttggtccttcctaattttctttatatctacctctcttttaggccttaggggatttttgtttttatatttttggtagtgccatgaagcttgtgggatcttagttccctgaccagggattgtaccgaggctgtcggcagtgaaagcttggagtcctaatcactggaccttaccctcagtcttttgacactgaaacggcagccggcagtcctcaaattaggcttgtctaatttctccaacaatacctgcctctcctgctcccagaattgcccctccttgagttacttgctcatcttttgatttgaaaaccaaatcagggtggagcggatgttcagactggccagggaaacatctccctcgagaaccagaggtcagggtcagcctttcctaacactcagacactgagaagcatcaaggaagctcccaaagaacagctaaagtgacgctacctgaatgaaaacagacagtgggcaggcaaaaccccacgcaggacccctttctttactgtctaagttgggcggttttctcctcaatttttttacattctgggattctctagtgcaccagaccctcctgtatctctgagccttcacacacatttgtatttcatccccagattcttttccccatccctttttatttggcaaacttctactgatgcctcaggacccaaatatcacctcttctgtgaagcttcccttttcactgcctccgctaaacttgtccctcgctcctctgtgcccacggagcattttgtacacgaagagctggaactgaattaattagcaaggataagaaactgaactacccacatccttttgaaaatggaaagcagatgatgttggcttagataagatcaaacaacatcaaatcaacaaaagtttattgagtgtataccaggcacaggggtccccaagcaaaatcctgcttggtgtgtgtatgtgtgtgagtgtgtgtgtatttagaatcacaggctttcaggatcttggttttttaaagcttatctaattcaaccacttccttattcagatcaggaaactgaggctgaagtgggtttctctgtagctctaacaatatataatctgagccaccaaaaggaaggaaaggttggcccaattctaggctaagaaaaccacagctattatcttaaacttcctgttctaaactccaggccaggacaaagtccgtgtctccagtgacaatggccactccagacagagaatccaaatcaatctgtccttgtctctctctctccctgttctcacttccctttctctttggaaaaatggaaaacaaagagaagtgagacagttggggccagggtattggaacactgattcagattttttcctttttttttttttatatgtttatataaggaca

SEQ ID NO: 44420 - DNA, 1846 bp, Bovine  19866880930433
tgagactgtgaattctccctgatggtagggaaaggctccagcctaaacctccccatggatacacatcctttgttttctgcgtctgggaaatgccccaggattccctgctgtgttaccccgggagactgttgctcaatcccagcagctgctctgaaggaaaagaaaaagcagacatgctgaatgtatcatacacacaacgtaatatggaattgaagatctctaatgagcgagaacactttgatggtacagtctccctccagtgaggtctagttcttcatttccagtgggcattgcaggaagtcctctttaaaaaaaaaagaaagaaaatatatatattactaatgccgtggctatatgaaacaatatttggccaagatggctaagatatgattcattctttgttcatcgagttgctaagtattattcagagagtggagtcaccatatggtagaactgagtttccttgggaggctgggtgaaatatggtgttggctatagaatgtggaaatgtgcgtgtctctggtggttagagtctggatcaagctatagatggctaattccattaagtccttgtgcaaactccactgcacacggcaattggaaaaggcatagcccagcacagatcactctatgaggctggattctctctgaaactgataaagagtgggcaagccacacagctagacccagatgtgatcttgaaagaaaaatgtgtgtgggcaaatgcagtaccggctgggaaagtctaagtggctgaaacctatgactcagaaatcttaaattgccttgaaattaatgaagctctgtggagatgactcagttcattcatgtccttagcttgcaggactcaacactggcagaagggaacactgtccaaaacttggaagatcaccccttcagaggaaacaaggccaggaggtggtctgggatgtgttgtcacaggagccaggataggcaggtgagctggttttattcttcccgtgggcaagctcattcaagtgccatgctgtctggacctgatttctgtccctgtaaaatggaaaggagattagatgattcctaaaatgtggtcagctttgatattccgattagctagggtcccagtaagaaacagcgtttaccccagatgttttcaaatgaggaaatgttaacacagagactctttacagctgtctgtgccaggttaagagaataaataagaaagaataaggcccccagagacccataaagtccggaagccattgtcactcccacggcagaaaggatgcaaaggaaaaacagtattactggagcctattgagagttggaaccctggaggaacccacccaggggtctagaggaggccaccagtgggagccatagtccccagcagacacagtccctcctacacacacagtggtgactcaagagggaatagaaaagaaatgacttatgctgtgtcttatccccttcccgctctagtttcccactggtgagtctcattggccaaacccaactgggtgccatcaggcaaaggaattcagatccaacaggccacaggggttggaacagtgcaaagaagcctgaagaatgcagctggagtgggtgaaaacagaaataccagcacatattctatgactttatacatgtgattatgctctcacattagggaaaagggcagagcacacatttttaatttatttttctggagtgattgaagaatgattctcaagtcacagaattcctgagggcagggaccaggttttgttgatttttttttttttttttttgaacctatcagaatctatcaccacatctggcacatagtagaaaatcaggaaatatttggtaaattaaaggctgatca

SEQ ID NO: 44421 - DNA, 1574 bp, Bovine  19866880936723
cattttaaacctctgtttggagggaagcatcactttatgattagaacctgaacatgtggaccccagggtacttcctctgcaacatcattaaacatgaaccaagagcagcggcagctcaatagtagtttgggggtattattgtttatcacttcatgcctggtgtcatctgggctacattagcagcggttggaaagcccccaagcaatgcctccatcccacgggtctctggccacctttaggccagatgtcattgcattatctaaggtcttatgtggtacaaatgcaaaccaggcagccatgagctgtaaaactccagatgatgggcgtttgtcctgtgtgggtacaggagttatgcatgaaaaagaatgaagacagaagctctgtagccacaacctggaatttatactaggtgactgcagccttgggcatgaaggctagaccttgtccatgtagatcagggccaaggatgctaaggggactggtcaacttttgggagagaaaccgcctctttctgatgccttgcagccaattgaccaacttaggggatgcaatgatggttcccctggtccttcacccacactagcaaaggccttggaatcagtcaaccaccccccacccccacaagactgtctgtcctcctcctgatggttgagcatattcccagcaccaagaacttgcttttttcttctgcatgcaaaatccagctaccatcagctggaaatatgatgagccatcttaggggacatgaggctttgttctacaaggtaaagttaatgtactctcagcttagtctgttcatggcagacagagctttgcctcatttgcagaacaaatatatacctttgaacttttggaagatccttgcatatagaagaaggactggattgatatttttatcactatgttcataagtataaataagtctctgtttattacagcattctctttccaggcccagcacacgctcatttcaccagagaaagcaaacatctgaaagatttttaatgactttatcctttgaatctctggccacagaaaggaaatggaaaataaatacgtcctgcttattacttcagtgtatggttaactctgaactgcatttaatttgattgttagatgtacctctatgtcactctgagtcagcaagcacacttccaaagttatatatactctctttttccaacctcagaattcagtttttcttcatcttaattaaaaatgtgatatgagctagcaggaaaaacatcagttttggaatcatcagacattactttgaatctcagctccctaagttatcatagggagactagattatttacactttctcagcctgcttccttgactaaatatagagatacacactcacgttttgtgatgattatcaaatgagattacagtgccaactgcaagttcacaaaaggaatcttagttcagttttcctctcttccaaggacctcctagtagagttacaatatgaagatttatctcaattttgctttgaaatgcttactgatttgctattaaaaaaaatacagccttttggaattactgcttatttcttaatccttcaatcc

SEQ ID NO: 44422 - DNA, 1108 bp, Bovine  19866880992303
gtatggatgtgagatttggacttaaagaaagctgaatgccaaagaattgatgcttttaaactgtggtgttggagaagactcttgaaagtcccttggactgcaaggagatccaacccatcaattctaaaggcaatcaaccctgactattcattgcaaggactgatgctgaaactgaagctccaatactttggccacctgattcgaaaaactgactcatttgaaaagaccctgatgctgggaaagattgaagcaggaggagaaggggatgacagaggatgaaatggttggatggcatcaccgactcgatggacatgtgtttgagtaaactccgggagttggtgatggacagggaagcctggcgagctccagtccatggggttgcaaagagttggacacgactgagcgactgaactgaactgaactgtattctctgaatttttaactattttaaaatcttcatctttgtcttcccttcaagcccatgtgttcagggaccaactttgcagcactgagtgaagtcacctatagtccccaagaaaacctggtaaatcctaatgttcagagatgaaagaagaaaatgagccctgaattcctttgtcattaaaatttcttccttgtcgactgagtttctgtggatttgaatgaattatctaagaatcagtgttagcgtttaattggaagacagaggaaaccacaaagagtctgacaagaaagggcagacaaaataagaatgtctctaggcattgaaaagtttgacaggcgagaagagtttgtgatttgcaaagcagctggagaacatgagtcagcaggagataactaaaaaaagttaaataattaagcttacataatagctatctgattgactatctagatgtggttttaattaacacttttaacctctctttgttggtaactatatattatccaatctaaaagtggagaactttcattattaccaaaaatcattcatctacagagtgttgggggatttatttccaaacttagcaaaggagctactgtccttccaactcccttccctctctcctcctccccacacaaactcccttacaattagttctctgagtggaaattgaggacttggctcctc

SEQ ID NO: 44423 - DNA, 2359 bp, Bovine  19866881046353
ctgaggatgttctgaggttatctcattctctgagatagctgctgggagctgaccttcatctttaactgtcagtttcctctgaacagttatccctcagaacatcacagttcacgtaagctacggccaaactggagggacactgccacatggagtgtgacgcttgattgtatctctcgattcagaagctctttgttggcaattaatgaaatttaactggtaggaacatgaagaagaaaggaaaagaaacacacaggcacacacactgcattcctcttctaatctgctccaagggaacatcttccagagaaggaactgaatgttctgtctcagcatcagttaaagtcatcaggcactcctgaaggatattctgttttgatccttgaacaccttctagtaaaagtgacggattccattaaacctccagccagattttggtaccatgtcttcatgctgactggccgtggtcagctcagctctggtgacaaagcccttccatcatataggccccaagaagaaacagcatttcaagcctgtccatttgcatgcatctgactgaagtcagatttaaagtcttatctctgattttcttctttcaggaagctgtcctggacctcccatctctccccagtgattcatttcagcatccccagctgattctgtggattagtggttcattctccttttgaatcgaggctcttgaagttgaaaattatctgtgccaaatgcagatgccttggacagaggtttgttttttgtggatctggaccactgcacgctctctggcatctgtcaatgtgatgccatatttcagtggttcaaacaacaacaactaatgtttccatttatttcattcagcaaactgtgatgagagcttactgggtatgattctgtgctaagctgtgtagtaggtcaggacaacagggacaatgctaactatatatatatcccttaccctagaagagatgatattttaagccctgtgactagtgatggagatccaatagagtctctgtcctaccctgagcttactgcacaatgaggacataacgagaggcaactaaataagcaaatgtggtaagtgccacagcaggggatgtgttctaagaccacgtagcaacttgtggatttaatctatagagtccacgaatgaaaactgggagggttgaccatttaagctgagacttcaaataagtcagcacaccaaaggaagtggtcaaacatattttaagaacagggaacaatgtgtgaaggacggaaggtaagagagagcttgagatgattatgaagctgagctggataagccggatggtagggagggaagaaatgatgctaatatctgaggttaaaggactagcaaggggccagagcatgaagatccttacaaatgatgaagatcctttgaaaggctttaatcaagacattatctcgtttatgctttagaaagatttatctggttagtatgtggagaatgagttgaagggagggcaaagagtggtatgtgtatgtggtagcctgggcaagaggaaaaagtggccagataggttggtgctttccaagacacaagagagaagggagagatggggaatagttaggaggcagaggcaatcagattttgtgattcagtataggtagtgactgagatccaagtaaaatatgcaggcatgatgtcactgatagatgtgaacttgaattagatagaatggacactagtcttctggtatcaccactctggggacagcctcaatccaagctgtctagtgcaagaataccatgctatcttggaacacatggttctttctcctggttgcactttcaatccctggttggggaactgagatcccacatgccatgtggcacagccgaaaaaaaaaaaaatatctgtaagaacagatgacacatgaataatttggacaagcagtttaaactctctgaattacaattttcttatgtttaaagtaagaccaataatgatataaatgtataaacattgataattattctcattagggtgttagttggagtgtgtctatatgaaaaaaataagattctcatccactagtgttatggctgcccaaaatacaaaggtgaaaatgtgtatttgataagatgtatgaaaacagctgataggaagtgttaatccattaaagtccaaggccttggactacttcatgtccagagatagtctatcctatgcatgttctctttaattcaaaggtagatctatgcatttcctcttttattcagccctgacctctaggttctaaggatgtgctgtagatatacttcctcttggctttcataatgtgtatctagtacataaatctactctgcatagcataaggctgactgaaattgggtc

SEQ ID NO: 44424 - DNA, 1301 bp, Bovine  19866881050103
tttaacctcggacacttctcctaccctggtgggtctcagttttcttctctgtagaatggacacagtgattccggttctgcttcccctgcaaatgtaacatcctaagtatactacagggcatgtttatgctcaatttttttatttatctgaaattcagatgtcactgggtatcgtatatttttatttgctaaatctggtgaccctaaggaagacaatagggatcaacagatgtcagatggaagactttctgagtcagagggataagacctgggaattttcagaaggtcacattaaaggtgaatgaatggtgatctgaaaatagagattctcaccagtttcccatgggggtggcggttgggtctgggaggtaaaatatgcatgatgggtgaggggcatctgggagacagcagagagaaatagacactgaaggcttaaagctggggtggcaagaacatacagacggtgctcagatggtgtcttatgaaaagccaagagcaagtcaccaaatgcatgtctttctttaaaaaaaaaaaaagcaaagaagtgaagatgtctaagtgagtaatagccgcaggaagagaacccaagttgcactgagttaagaacatgttccaatgtttttcaataaatggaggaaaagctgcaaattattcatttgttatttttgtaagattttcaaatctgtgatttttttttcctgttttgtctccagtttttgtatccacaaaaatatttctcctccttcgtaagtgacttctttttgcaaatgcagtctcaaaccacaccaaaattgcaaatgtaaagtttgtttctctcctctcaggtccccgctggatagactcccaggtcagcactgggcttaatactactcccttgttccaaggagaaggcagcacttgtgtgctgtttggtttgtttggactttagaagctgctaaattcgggtctttgatatttgaccgtgtttctgagctattgaaatagacttgggttttcgtcagtaagaactgaatggcattcgtgttttctcagaacacactcagaccggtgattgaggtgcctggggttacgattcctggtttaccagtggggagactgagtcccaggcctgtgatgcagcagcccacacccttgccctgggtggatgacagctgaatgcaggcgctggtcccctccttccccactagctgtcttgccacttcagttaaaaaccatatgggcctccattgccttattgaggaaacacgatgaatatatcctttgtgcaagattattcgtgaggatcatatgaaataatatgta

SEQ ID NO: 44425 - DNA, 638 bp, Bovine  19866881076261
ccgaccgaggaccccccgggagtcgggctcggagcagacgaggtgcccggcgtctcccttttggggggcttctaactctttctccacgtagcccccttcccgtccctcccctctcgatcccttttaacatccgtggcactgaggctcctgcagccgcactcgcccgcgactcatctctccagcggtttttttttgtttgtcgagtgcgatccccacactcatgaacatacacaggtctacccccatcacaatagcaagatatgggagatcgcggaacaaaacccaggatttcgaggagttgtcgtctataaggtccgccgaacccagccagagtttcagcccgaacctcggctccccgagcccgcctgagactccgaacttgtcgcattgcgtttcttgcattgggaaatacttattgttggaacccctggagggagaccacgtttttcgggccgtgcatctgcacagtggagaggagctggtgtgcaaggtaaagagcccggggtttgcttttggctgttttgtcttttgaaaagatgccccggcctttgggagggggcgggaggttaccgagccctgcggtccgggggagggagattcgcctggttaattatccggggctcgttaaatggggttct

SEQ ID NO: 44426 - DNA, 2061 bp, Bovine  19866881158606
aaatatttttcatgatattaatatacaaattcatttcttgtatatattgaggaatggttataaattactttgtttggaactttactaagacttcgtcccgatattgaaaaatcatgtcaccaaagacatctctgataatgaaattttcatgtctgatacaaagcacagaagcttgtttgtagttatcacatacatagttattttatataaatgcacaagtaactgataccattatatctattaggatagtcattctctgtatttacctcttgaagtatctattattgcaagctccatttatttctccatgatatcatatgaaatagttctatctgcttgttcaaaaattgtgtgtaggtagattatgtaatttgtgaatttatttccagatggtcgaaaaagcagtcaaccatttgttataaaataaggaaatttgaatctgatagagttgagaaccactaactcagtataaacagacctagggtggaatctctgacagaggcaattaactgtctaccaaaattttcagctacttttctgtactggatatccaacctacaactacattttcaaacatttcaaactatatttgcctctacttaagactttgtgactagtttttagcacttgctattgcaagatgaccaagttttctctaccttctccttccctagaaggaactaactccacagacttgggggatgatcagcctcaagctagaaagaactaaatctaaaagaagaagatgaagaatctctgatcaccagaaatatccatatttgactatgttggagggagacattaagagtgatgccattgacatcatgggatttttgttatagcaactggtgttactaaactaaccagaaaaccagcctcgtcactcactcagttaagtcatttaaccaagtgaaggtccttcaaaatatttacaagcaggttaaacttagcaacttccttttactgatggaggtcttccctggtggctcagatgataaagaatctgcctgcaatgctggagacccactttgatccctgggttgggaagataacctggagaagcaaatggcaacccactccagtattctggcctatagaatcccatggacagaggagtcttgtgggctacattccttggggttacaaagaattggacgtgactgagcgagtaacacacacacacacaaacttagtaataatcttagtagagttattgtgaggtttaagtgagattatacttagaaaatcactgtactcaatgagctgtaattaagttccttcattctttgcttttttatttcaacttttgtacttatttgcctgtcatttgactccaataataaacatccaataacatccagtaataaactcctaggcctcaagttcatttaaactatggcagattgtgactagggctctaagcaggtctttttaattcagagcttcccaggtcacattctctgcttcctcactctttatgttaaatgtgccattcaaaaaatatatagccattactttccctctgaatcaagtcttacacatcaaagattctcttagatagtttgcttcattgattcatcagaaaaatatagtgtttttttcttggtgaaaactattgctaatatccatcacacttctccaaaagggagaatttgcaaattaatgtagtagaagttcagtgttcaaatcctgtttaacccccttgtataagttcctaggggggcttccagactttgcattttggcccttcataaaatacgggcatttgtttaaaaatcttgtagaaactatgaatatggaaatgctgaggctaatgccactgggtgcgtcagccgttcaatgttttattcaggggcatggcccatagacccaaagcacttgcgacaatccttttccccaaatgccatgcttcctatacgaacgagtgggcaagacttttcaaatagaggactttgtttgcaaataataccttgtttaagacttcccagatgacccattttgaaaaaacagagacattgccaaaatttaagaagggatatgcatatcggccaaaaatcttta

SEQ ID NO: 44427 - DNA, 1254 bp, Bovine  19866881180531
tttggttgtccacaagcttctccaactcaaaatttccaaaactagattccttatacccacttccttcccatggggaaaaaaagcctccttctgtgtctttctttataatcaagtagtcactcaaccaaaaacacattgaaacccagtctcaaatatcaccttcttttactcaccaaatcctagcccaccaagccctgtcaattttacttcttaaatatctttcaactctgtccatccttcacaatctcaggtacttatccttgcctggcataccttccgtaaaaacctcctcacttatcttaccagctttggtttcctcttgttaaaaaatcctccactctgtccttactctgacaacttcaggaggcaaacttgaatgagttatcctcatcttgatttcctctattgaaactataatttccagcaatttaattttagctaaagtggcaccacttttgatatgacagtgtaagcttttaagatcaacatacatgtacaaagatgcaccagacaacttttagaaatctcgaatagagaccagaagcagaaagattcttgagaatggtctccttttcttggttcttcttatgtcagacaatattcaattgcgttttgagcactgtgaatgatttgtcaatgagattgtggaaatgtatacaaagtctctgctggtcttcaatatgctttgacattgatctgtcagttgttgagcattttaaatcagagcatgaattttgaaaagcagtatcccgttgtgttcagtaatgtatgaatgtcatccaatcgccaccgctgattcaaatgaaccttaacctctcatgaagagatttaaatcaaatctcactataaaagaaaaaacattggtttctaactggataactaaatgcacagtcatatcagttactaaaatacatcctattgattttaaaacattttatccctaattatttttcttaaatttattgctatattatgattggtggtaccttaaagtcaagaatgatgttacatgtaaaagtgttgcatcaaacacctggtatttaacagatctttgattatttaaagttttataagtaaacatttaacatttgggaaaggagaaataaaattccattttataccagtctatcaaaaaaatatagttcaccagaagaggctatcctaaatgttctgtcaaatcagttctactgagtcttattctgtggtaacttatggccccttttccaagcaagaactttgtagcaacagagtttg

SEQ ID NO: 44428 - DNA, 762 bp, Bovine  19866881197126
ctttctttctgaggcccacacagcagctctgcagccatggaagaaagatccattctggggtgacccctgcatgaagtggttttctgaaggcactcttcctgctgagagtccgagggccaggacctgggtcaagggggcctgaggcactttgtcatcccgagaaagctaactgcttcacctctgtgtgtcttcctgctcctgattggccagtgcaaacaggaatcccttccctgcccacctccctggactgtttggaattagagggaacgtgtctcaggtagaaatcctccccaaaaggtcagtggcacgtgatggctaggttactgttggtgatgtcatttgtttttgcaggggcctgaataggtttattctggaggtgataattgggaagggctgtccccaagccgccaggcaccataggtaggtgggttgagctcttaaaacagaatttaatgaacaaggcagaataagacatttaactcctgtgcaggcagggcaagacaacggcgttcgctgatgtggcagaggcaagatgggctcctcgggtcttaattaatggaccctgtgaacactccttctccagcatcttttgagcatggagagcagcattgtccacggagggaacggtccccttccccgtgtcagccagctgactcccaaccctgggatctggggttcaggaagatcaggtttacatcctaatccttaggaaactttgcctcagctcaccaggtcccttccaactgaaaggtaaaggaaacg

SEQ ID NO: 44429 - DNA, 2488 bp, Bovine  19866881205195
aacatgttttacaggggatttcgtccagtcctctcctgacaattcagtggacacaggcatgaagatgcaatttagaagggaagtccaagttgtcataattccaagtcctctagcaatagatttacagtctaaggcagtttggggaatgctggtgcccagggtgcagactgtgatccataaattaatgggtgattgaaaccgtactaaggcaaacacagagccaccaatctgaatgatgcacgattattaccagccatagccagcatatgtatagaaataattggcttttaatgctcattagtcagttttattacaaataatgcatttgcatgatgtttgtaaatttatgctctagtgggaagacatggtgacagcacatataaacaagcagagcgattatgaaaaatgcatccaaatgtatgaatatgccccaaattacatttatttgtatatttatttgtttttaaccttgcttccttccaaaacaaaataatttaaggcaatttgaagaaacagaaccattatgagaatttttcaatgaaggcattatgaagaaaagaaaaatgaaggtcagaaaatacaatgaaccaagcagcgaattagtatgccagatgaatatcataatattctgtgcacaagataaaaatgtaattcaaagtaacctttgcatttattagcattcaaagcaaaggagtcaaaactgattagtgtaagattcatgtgttcataggggaaaatgtaaaaacaaaaaatatgtttttctcaagggaaatataacatttctcagttaaatgaccagaagggaaatttaccttatagttgttcagaaaggtaacatgaatataaaaggaggtgatcttcaaatattctctaaagtaaatgcaatagagatttttttttttctgataagctccagcaagtgagctgataacattttaccaaatcacacattaggtaaaaatcaggaccttgaaaatgagaatttacctctctttccaacccccttccctgctctcttcatacacatttcttggcccatcattgttccaatcgcatgcatgcttagtcacttcactcgtgtctgactctgcgacctcatggactgtagcccaccaggctcctctgtccatgggatttcccaggcaagaatgccagagtgggttgccattaccttctccacattcatctataattttaacttgataaaaatttagtatttaccttattgtgactgtaaaaactgttcacagtggaatgatatatgacactttgatgaatttcctcgcatagctttgtttttcctaaattgtcctatctctatttattattgctaattcaaccctcaaatctttaccagaaagaaaaatctccccataatgtagttgggcacaggcttctattcagagtggcagcttgttgagcctgggattgcttctcaccatcacctgggagacaccctccatcccgcctcccagacccactcccaccccagccatctctcttgtactgaattcttattttaatgaatccaaagtttgttgatgccttctcccttttaaagtaaaatacctccttgaatagttatctagaaaggagtattgggttgggggggggtagttttttgagcctgcaaacaatttcaaaatgactattttattatcatgcataattgatggtaaagatggcagagaataatggctggaggtatttctctcggaattcttaaggaggtgccgctttggcttctacctcattgctcctggaaccacattttttcctgttaggagcatagcaccatctagactcccaattcagtgagtctaaggctggatcatcgaaaaagcaagagagtttcagaaaaacatttatgtctgctttattgactatgccaaagcctttgactgtgtgaatcacaataaactgtggaaaattcttcaagagatgggaataccagaccacctgatctgcctcttgagaaacccatatgctggtcaggaagcaacagttagaactggatatggaacaacagactggttccaaataggaaaaggagtacatcaaaggctgtatattgtcaccctgcttatttaacttatatgcagagtacatcatgagaaacgctgggctggaagaagcacaagcttgaatcaagattcttgggagaaatatcaatcacctcagatatgcagatgacaccacccttatggcagaaagtgaagaagaactaaagagcctcttgatgaaagtgaaggaggagagtgaaaacgttggcttaaagctcaacattcagaaaacgaagatcatggcataaggtcccatcacttcatgggaaatagatggggaaacagtggaaacagtggccgactttatttttttgggctccaaaatcactgcagatggtgattgtagccacatgaaattaaaagatgcttactccttggaaggaaagttatcaccaacctggacagcatattaaaaagcagagaca

SEQ ID NO: 44430 - DNA, 709 bp, Bovine  19866881238614
tggtttatgctgggctttcctggtggttcagatggtaaagaattccctgtaatgcaggagacctgggttcagtccctggatagggaagatcccctggagaagggaatgggtacccacttctatattctggcctggagaattccatggacagaggagcctgaaaggctacagtccatggagttgcaaagaatcggacatgactgagtgactttcacttaatggttatgttagtgaagtcaaagtcccagaggaatgaattatgcataactgtttccaaatagtttgtccaaacttctatcctagactcacccttcccctcaactgacctttgtcctgtgtactcagttcatgactgtagccccgaccccacaataaccatccaggagaaaacagatgaaataaacacgtcccatcaggtacctgatggaaaatagcaaactgctcgtgttccctgcacagttagctttatttttaagttctcctgcgcagtaagagagccacagcataaacttcccaaactcacagtattaagttactgttaatagcgctgccttcagacaactgcgctgtggactgaccctcgggtttgtgggttttgtttttaaactccaagctcaggtcgggagcaataaggttagccacctgaaacaacaacattggcctaatctagaatgatctatttccccagcaaagattggtttctgggtta

SEQ ID NO: 44431 - DNA, 1003 bp, Bovine  19866881280526
gaagatgtctgggttgatgattacttacttttatagcttcggttttacgggctttgtttttaaaaagcaatttgtgtgtatgtgagctttatgatttgcatgtatcctcagggatacactcaagtctatttttgcccatatagactctccggatgcgatccaggggatgggtgatctgatttgcttcagggtcagagggtgcccatgtgattgagcagagtggacacgcccgttccaatatgccaaccccagactgtgccaaggatgaacagaccaggaaaaaaatattgtgtcataaagcccagaccttgaatttcctccaaaagtctcaccaaatggtgtaaggctgagtgtgagggccagagcattctgtgcaggatgtgaaagttcactatggaaggactccaaaatctatggctcgtctgaagtcagaggaaaactaccacgcaggctgcgatttgattaataccgggggatctgtttgcaaagagaggagggatttagaagttaggagaagagactctcatgcaggtgtccaaggacagtagcaatgagcaccacaaagaagcagtgatagtcgtcagagaagcccagggtcctcagagcttcagtctttacatgttgacttgagctcacttgctatccagccctccttccttgggcttccctggtggctcagatggtaaagagtctgctcacaatgtgggagacacgagcatgatccctgggtcgggaagatctcccagggaagggaatggctatctgctccagtattcttgcctagagaactccatggacaggggagcctcatgggctacagtccatgggggtggcagagagtcggacacaactgagcaattaataggttcagttttcagtttcactccttccaaacccagcatgtgatatccattggtgactgtcaaccctgcttatttaattcctcaggcccaccctctctgcactccctcttgcacttttgccaagtggggggtcataattt

SEQ ID NO: 44432 - DNA, 1620 bp, Bovine  19866881372333
tttccaactcgctgaaaatgttcttaacagtccccatagacatcattctgctcttgtaaatgtgtccaactagttttcatcagtgagtggaaaatagccaagatacaatattctatgagttctcccttaacactcagaatccactggtaacggttgccaggcaaaatgtctcatgttaaaattgcttgtcttataagatgttaaaacagttttaaagagccttcgcctctcaacatgcaagatattgttaaatttgctctttctctctctctctgaaatacaatgtggaaaaaaaatccatattttaaataagaaactttgatgttgaaaattgcagttgaatcctccaaaacaattggggaaggaaaggtgccatcagttgagatgatctattatctttgcagaatccattcggaaatgcacaggcatggaatatgggggaggaaaaaaagattgtgtttttgtccttttccttgtctcacaattttgtcttgtcaccattttcaatcgaaggccctatgtgagaagcatgatggcttagactcaagaacggatggaagtgtatctaagaaatataaactattttaattggagtataattgctttacaatgttgtgttagtctccgctgtacaatgaagtgaatcagctattcacacacatacatcccctccctcctggggccccatcccaacccaccccgcattgcaccatttaggccatcacagagcaccgagtgagcttcctgcacaaacagcaggttcccactagctatctgttttacagatatacttcaatagaagtaaatatacttcaattaaaaaagttaaaataaaaaaaaagtaatataaaaaaggaaaattccaaacagtttctgtccacagtctaccctcaaggaggctgactgtgctctctaaatgtggggttgtccatagtgacttccaggcaggcttcagtacagaaaaagaccatctttaaatggagacacccaactaacaccactcagctgagtgaaaaaggtcagcatcgccagtgatgagtcataatgatcgaaagcacccttaacacgatgtaatgaagatggcactttatctccatggttttccttcccaaatcctataactccagtgcgatgagaggaaaaaaaaaaaaaaaaaatcagatcagtcctaattgaggagtgttttacagaaggcctgactagtagtcctcaaaactgccaagactcttaaaaattaggaaagtttgagaaattgttataatcaggaggagcccaagcggacctgacctctaaatgtaacatgatgtcttggatggaatcttagaatagggggaaaaaaattgttaggtaagaactaaggacaaatgaataaatttggagtgagtaataaaatgcaattttgcttataattgtgacatatatactgtgtaaacatactgaatttacaacagaggaaactggatgtatggaaactttctgtactatctatgatttttctggcattctaaagctattctaaaacttcaagagtttatgtaaacattttgactctaggagaccatatgacttaatgtagtggcttttgataaggaatacatcagtccctggtggaattttgta

SEQ ID NO: 44433 - DNA, 1570 bp, Bovine  19866881398129
tgctagagcctgcattgcgctgaggtcgatgctgcagttccaggctcctttctcagctggctttgggctctagtccgccgacgcatatcctggaggagggacaggaatgctaggggacgggaatgctggggtgttttccctctctgtcttcgctgcagcctttccagcccagctggtgacctcgcccctggccttgggcaaactcacctcaccccactgccatccagtatcagatgacactgactttccttcttgtgtgaatctctgggttgctttgttctatttattacttatttggcttctccaatgtagctaacaccctagattaaattcctcccattttaaacaccgaaagtgacttctgtttctcttgaatgacagacagacatcctttccaccaacagacaaccatgcaatctcaagtgtgccatttcaaaaccataggagacaggacttcagttttgaagtacctgccttaaggatgagttccactgcagattgataatgctacccgaaaaaattccctttgaatagaagtcaaactgtttgtagtgagaaaagcaattttgaaagaatgatcatcagtgcctttaaaagttttcacgatgaattaagacacattatcatccacaaattttctaaaagattcatcaatatttaatttgcttctccaaatcacattaggattaacattacaaagcaaacaggcttttgttctaaggaaaaatgtatcagggctatgcagtggttttatctgacacctctgttagcataatacagtggaagggagtatatttgtgtttgtactcacaacagattctgtttctgaatttctgcccttggctacttttacaaactaaacatcatttaaccagcgggaagacacggtacacaaaactttacagcagcaggatatgttccctaatatttggctaatctttgggtgatctcaagaggagctagtggaagaatgttaagagttagcagggggtatgtgaacctctctttttattacctggctcagctaacactttgcaagatgtcatggcacaagaatctaatcattgcctccagaatctcttcactgctctcttcagaacaaatctgtgtcaggttcctaagtgctaagcttgaatagatctgctcttaataattaatcctttccttaaagtgctttgatttttcagattcggctgagtatatatttggcaactctaagcctgttgtgccaaaacaaaattgtaatgttgatggggggtgcttagctgctcagtcgtgtccgactctttgagacgccatggactgtagcccgtcaggctcctgtgtccatggaattctccaggcaagaatactggagggggttgccatttcctcctccaggagatcttcccaacccagggatcaaacccagatctcatgcattacaggaggattctttaccatctgagccaccagggaagcccattggtgggggatcaggtgtaagattccaggccccatgaaattttagggaagaagctcagatgtgccgtcttaaccctgaagagaagctggcagtcgtcacctcccc

SEQ ID NO: 44434 - DNA, 747 bp, Bovine  19866881628660
aagatagagggttctacagtattagaaaagcaagctgctaccagatctcaaatagtaacacttacaattgaaagagatttttagtgattttagtgactaaaacccagtatgtagtctcagttgaactaaactgctcaaatctagagtctttcatgaatgtcatggctttcccagttatcatttcatatagcctcaaggtgatcaccattaagttgagaagaaaaatgggaggagattggaaaaaaagaaaattatgtccaagaaagggcaaattgcacttaccttgtacttcaataaatacatttataagtgcaaagcttattttttaaaatccaggcactaaaaataatattcacttttagcgatatagatattttgtaaaattttactgccttggtaattttcaggaggccatattcacatatttaaatcttcagttttctaggagtcttgttactgtctgaacacatgattaatgactaccctaaaatagactgcaaataaaaatattatcacaatggaattgagttttattggtcactgttcaaagagaaaattgtattatgtaggatcagatctcatactctaaatgccatttcccataaaagctcattgctctccttggggcactagctctttccactttaaatatcctaggaacactctgcttttagaggactctccatgatagagagtctgttcctttgtcatgggtcagagaaataaaagaggattctgatcacatgg

SEQ ID NO: 44435 - DNA, 685 bp, Bovine  19866881690018
ctatgcctcctctatcttcctcacctccttttccccaactacactccctaaatggctttcctgatttaatgatgctaccccatttctcttattttgaaccttgatgtctaccaacagtgattctgttagttcgattttttttatccagaccccagaaactccagaacctactcactgaagagaatcaacaactctgatctgggcaggactacattaaactagagtcattacatccccttctccaggggattttcactacccatttaaaagagtaaaatgattctcttttatgtgactcataaaagagaatcacagcaggtaaccaggaaattcggactctggccccactgctttctttggtaaaccttctatcttaatccatgttttcttcatctgttaaaggaggcagggaaacttgaatttttgctttaatattggatgaatttatgaattggaggagatcagacaggtaaagaaaggcttttctgaattaatgatgtctcctgtaaaacccatcacaaagaaattaactccctgagggagaattattcagctaagcaaatgctgtgtaaatatgagaaatagcattgattttcttaacgtcacaaactaatttataaaaaaagctaatttattaaaaaaaaaagaaaaaatgaatcattcttgtttactgggagtcatttct

SEQ ID NO: 44436 - DNA, 1233 bp, Bovine  19866882149582
atcaaaagtctctgttaagaatagagttcatgttctgtacaaaatggactctgggggtaaaatcccatagacagagaagcctggtggggtttagtccaaagggtcacaaagagttggacacaactgagattacctgttcacacagactccgaaacagcaatggtgggtacaggtgctgcccatgagccacatggccaagcgaaggccatgcctggctacacagttctttggtctggatgcttctttcctaaattgcctgggatattcaagccccttgcttttacttccacagcattctgcttttccctctgactttttactaacctcaaatgctgctagtatttgtctataattctgctaaagataaaaattctaccaaataagtcatttctgtagacactcatcttgctcaaattgcccctgcaaattgctggctgcctgtcttgcttgttagcatggaagacggcaatgtgacgctgtagctctgacactaacctgactgtcacctgtacacattctatctgacagatgcattttttctctaactgcattttcttagtgtgctcaggcaatgcagagtttagaaacttaaaatattctcagctccaataatatggcagataatgtaaaaagaaataaaaaaggaaaaagtaagaatcattgtcttctctaaatcttagggaaaaaagaaaacagaaggataaaatatatccttgactccttgaattaataaggacttgaaaactagaagttagagcaagtgaactcatgatgcaaatgacgttggtgattcactaaacccagaaacataggatcttgagtgtcaacacttgcacaaaacctggagatgagatcttggtcaactccaaataagccaggagttggaaaggaaactcctactggtccccccagatatcgcacgataagtgaaagatgaagcagaaaacaaatctcccctctgccctatatgctagcagaaaagcatatccgtctctacaagcacttctggtgagtttggactctaaatttataccaccggagtcaccaggcagcaataaatatgaaaggctttggaggcacttcaacaacacaggccacataggatttgccatgggacataagagtggggaaagaggctcttaatttaagttcaaaatcaaaaattatgaagcacatgaggaaaccatctgtcctgaccagaatgaagtagacgcaccacgaggatcattaaaa

SEQ ID NO: 44437 - DNA, 3607 bp, Bovine  19866880700624
aaataaagataaatatagtttaaaggatgggcttatccctccttctttagaaggctcttccttgctaccaagtaaggtaaaaatgctttgacttgacagacaaggccattcattctccagtctgtgtccttccaacctcatctcttgcgctttctctctctcttgcttgttcctgccgcttgccctgctatacttcatcacccaggctcatgggctatgagctgtccctagacatgttctgtacttaaaaactctgtgtcttcattcttggtgctttcttctcttggaaaggtcatttaaccagtcgctgtcctttggaattcttctcatgtatttggctgcaccagttcttagttgtggcatgtgggatctagctccctgactagggatcgaacccaggcctcctgcactgagagcatagagtctcagccactggcccaccagggaaaccctccactgaagttcttatttctagtttcaataaaacttcctagtaggcccttattacagctactagtcctgttattttttgagatatttgttcactctttcaaatttttcttgtctgtctactatttagcccttattttatttagattttctgtgaagttgtccacgtgacccaacaccgcaccttattaaggttccctttagggcaggactgtgtcatgatcatctttatggtccctgttggctagcacagtgacttacataaaattgggacattagagttgttagaagggagagagggcagggaggccgaaaaaatggcactccaatctgctctctgtggacctcgatctgtgatcatgataagtattagccctgtattctaagcaactgaactgcctagctttgcaagaatatacagaaatggataaataaagtcctcttctaagcctgcatagagttgttactttttccatgctgtcagactatagaatctcagaaaatcataagccttaagggacctaagaataacagtatctccatattatagtgtctgtgaccacccatgtccagactagcctttcatcaactcctacctgccatttccaggttttccttggctttcactttcttggacttgaccactgacttcatgtccccagtaccttgatagcccaacccagggtgatagtggctcattccaggatttgttgctgagaaaagagaggaacatagactaaaagaatattgccaatgcaaggagtgagggaacccacaaagttaaagcgatggacccacaagtccatcaagcccacctgctcctcttataccaacttcaagtttggaggttcccaagaccaccttcagtgttgatcattcactggcaggactcagagttcactgaaagctgttatattcaaggttgtagtttacagcagggaaaggatgctgaggaaaatcaatcagccaaggaatcatggggcagattccagggaagttccaaatgcagagttcccattgtcctcttcccatggaactgtggacagtgttactttcccagtatccacgtatgacaacatgcacagagtattgccaaccagagaagctcccttaagccttgtgtccagagtttttactggggctcaatcctgtagatacagctgtctgcccacatggctgacctaggcccctctggacactgagctgacactacatgacccaaagcgtccaccctagatcatgttgttagtctctctgacatgacccaacatccccaggcaaacagaaacactcacacatgacattccgagaccttcgagattatttcccagaagctgaggacaaatagctgacctctttggggcaagggtatattctgcactctgcagagcccagcatagacacccttcctgactgtcattaccccccacttcagcatgctgggaaatgcatgaacttggaaccagacaggcctgtgctggctgaccatttatccttgcatgacctcaccagtcactcacatctctaagcctcagttttctcttttagaaaatggaggtaaaaatgactgtgcctcacagtattttaaaggattagaactgatgcttttagggaacttaatataattctgatgtgtagtaagtacccaacaaatgtaatagccttttcctgttcttcaattctttttttatcctccccttcctctttctttttttttctcttcctctctctccctccttccttccctccatccctctccttctccctctactcccttacgctctctcctcttccacccttccatcttctctcaggatagcagaatgtcacttcaacttgctgtgactaaggaaatgccacctcaagggacccacgttcccgcagcagctttggtataccctgctgaaatctgctgatcaaagctagctgtcctgggttggaataaacaggacttaacacattgtaatgacttagctccattccagatctggtgtaaactaaagacgaaaatgtgttttctaaaaataccgaggctgctacagatgtctgggcctgtttcacctctggttacacaacagtcctgcctggacatctctacggagttcacgtgccaggaaactaccctaagaacagccctgcctcctcactagtgttagcagtgtccaccccccacagagacagagaggttcaagcacccaagacggacactaagtgagttatgaagcaaggtcttagcaagaccagaacttgcatcatctgagttaggcatgtgtgacctcaatagctctccggatgctgcctggaattgttctgtggtttcagaaaagccaaacctctgttctgtgactgagatcgcacttccaatgacactctccccccagacactttctcctacagagctggtttagggcctccattttcagactgctgaagatctgtgtcacagatcttgccagtttctctccctgcacctctcccatgaacgtggcattgggaatggccagtgataagctgcctgcacatttgctccctgagactcccgtgatcaacctgtgacagccccagagattagagctgcatacgataaatgctgcattgaccttatttttcctgccatgtttagagagagaaagtcacttcattgagttctcaggcatttttagtgagcatagagagagactgatgtgggtaatccatgaagactgaactgcagagcatgaaagcaaacatattgctttctgtacctgcaggctatgtttatgcctgactcttgtttagtgtcaaagtcagcttcccctgtaaatatttcttccttcctcatcttgtctgcaaccattcctcctattcttcctcttctagatcaagcatcactgtccttttcaatcatgatttcttttgaatgatcaagtcagaggaataggtcctcttccttcattcattaactcaatatttaccaagttcctcttacatacaaagaactcttctaggcaatctaaaaaatgaaatggacagaacagacaaaaattcctgccttcatgtagtttatattttggtagtggggaacaagcaataagtgaataaaaattagtaaaaacatgtatcaattgatgataaatggtttggaggaaaaatgtaaggaaaaatgatagatttgggg

SEQ ID NO: 44438 - DNA, 1318 bp, Bovine  19866881056622
ccaccagagaagcccaggggagtaagaaagatagaccattggctggggatttgaactgcagggaagacaaactctttatcataaagcttgaatccaagctctaataacaaagcaaaataggtctggggaagaatctgaaaaatgcacataacagagaaacatggtgtcactggaggcatgactattaaacgtgccactggctggagttgacagaccagccgaccgctgcatccaccctgaggctctttgctctgcatttggcaccagtcaaatagacgccctctctcctctctgaagcattgcttttgcaagggctcaccccactcccacagcctcaccctgcactcacagcaggccatacactatttgggccaattcagcttatcatgtcaggtttgaatgcatcaggttctcccccaaactcagtcggtagaagaatcataaaacaagaatcccggtgtccccagacctctggactcctgtcaacaggcatgatttttttctgagcggatgacgatttatagcctctggctcgccatgatggagctcacaattccaaaagctgaggctcctgttttcaacccctgttcttagtttcatttatgtcaccagatgctgaggcttcatctgctctgtattcactctccaacagaaccccaggaaaccacgtggagctggaaagcccccacagctgtcattcctgtgtcctggtagatgtactgtgtgaccttacacaagttggataacctttctgggcctaagtttcctcatctatgaaacagagatagcagtaataatacaataaaagtaggcagttaaatggtaatataggttaagtgccataggccttagtcttttaggaaaccaacaaattgtctttcagagtggctgttccattgtaccattcaaaatgcctgtaccattcctacaaacaatgtatgagagtgcctgttgctcagcttcctctcctgtttttatttaaaaacaaaaacaaaaaactcttcttttggggcttggggaaaatgtttggatttttaaagtttctttaaatgtgtttgcacattatgtgtctgaaccaaattcatgaaatgtaatcacagacataaagtgggcatcccagtagcatgaagaagaaaatgctgtgttgttagtgttcgggatttgtgtatttaaatagggatgtatgatatctcattttaacttgcatttttctgatgacatatgatggggagctctttgcctgcttatttgacatctgtatatcttctttgttgaggtgtactgtttaggtcttcttgtccattttttagtggggttt

SEQ ID NO: 44439 - DNA, 1099 bp, Bovine  19866880699946
tgcctgatttccctctgaagtcttgatgttttccttacttactatccaccccctctattagaatgcaggccccatgccagccgggaatttcgtgtgttttcttgaccctgtggacccagcacccagcatgtcatctggcacacagtagggcctcagtgcgtagctgctgagtgactggataaaacggaaatggaaccaacaaaaattggaaggaagaaagataacagaagaatttcccattctttcattatcaggagtcagtaaacactacctacagtaaatgaactgataaagcgaggtccaggtatattatttaaaatgacagtaacagcccctagatggtcacaggggagatcagagcagtctgtagtagtggatacgtgacccctgagacaagtctgttccctctctaacctcagcctccggtgtccggcgttgtctgggaggatgcgctgtcgtccttctggagagacggcaggagcgagtcttctcccccacagtctcctccgcagtcccaggacgcggaggaaggtgggtcacctcacagccgggtccccccaagcccacgcgtctggggacacccccagctggcctctcccagagacgtcccccgactgctcacgcccctttgatggagagcgctttgttctagagctttggggtttccttggatccgtttttctaaagggcaacataagaaaaaagaaaccagatcaaggcctcaagtctccacggatctgggttttatgggcagcattgcaacaaccctcaggagggccgcggcctgcagctggcccgcctggacttgctctgggccggtcgctctccgtggaaatcccctcccacgctcaccctttaatcgctttccagcccagtgactttcctgattcacccaggctccctcgtctggagagcgcccactgcccctctcccgtctgggcttgacgcctctgatccccgctcgggtcggcggaggctgccctcgggcgtcaggccccggcctgctgggtcacctctcccacgtagctgtggtgtctgggtgcccctgccggaggagcccggagcagctctcccttggggcctcgggtccaggcgaccc

SEQ ID NO: 44440 - DNA, 2161 bp, Bovine  19866880741158
tgcctgtggccaagttcagcagctcaggccacatctgtgatcatccccaggatacatttctgcgtctggggccattcccacggccgtgtgccagggctctgccctcataccacgactagaaatcacaattttccaggagatagtaaccttgatagtagccgatgttaactgacttaattgcgtctcttcgattctcacggagcccttggtttttgctgtgttccggctaaccgtatgccttcacgaacgtcttgttcgagcttttggccgctgcttccagggggtgttgctcttgatccatgtggtagagccccctgggcctcaccgggtggcgagtgtgcttgcagtatactggtggcctgaacctgggcaagcgctttcctgtcccccagggactttaattctgcgcgctccaacctctcagcgtcttccttcaggatccctgccttcggtgcaatgctataaaggcttttcccacaacagagttgcgggagcatccatgcctggcttctgctaattgttgcgtgattcactttccacaccgcgcctttcctctgaagttgactgtgtgtcttcgtagccgacttcaaatttcctttgaaatgaaagtgattaattgatctattagttcattcatagcgtgctggggaggatacgggagagagggggtgactcacagatcgaggtccaggagagaaggacaggtgctggtggtaggggctgcctagagggctccgcccttatctcagggtgggaccctcgtctctgaggccagaggagtgggcggaggaacggttgcctggggcaggaggtgggtagggaaagggctagagaagaaggctgtgggctgggtgcccatatctccagggatacgtgggtgggcacagcaggaaggagctgggagaagggcagtgatgccaggcaggtgcaagccggacggcaggagcctggccaggacaggtgcgggcaggctgtgacttgcaggggctgcctgccggcgggccagtaaaatctggagctaacaccccacggccgtgtccaagggaaggtgggtgtcaggcagagaggccacagcaggagccagccgggggcagggagttggttccccgggggcagagcattctggattcgagaagagactgaggcggggagtgcctgccccatctgtggacaggcgccgggacaagcgtaaaccacccaatcacacagcacatctcagtgcatggcactttctcctgaatttgcaagaggcagagggtcctccctgagccgggtgggcagccaggacacgaccgaggggcgccggtgcccccaggacagggcctaacggtctcccgtcctctctccacagctcagtagccctgccgcaggcccgccggccatggacaggacagccagcctgagcgccgcgggccgcccccagcacacctccgccatccccgtgccccgcgctgcctcgcagagcaggacccagaccccagtggcatcaccccagctgcggccgcgccaggccggcctggccctgagcccccagcgggcagtctccccaagactgggcaaggccagcggcccttccaggggctcgtcccctaaggccccctggggggaagaggctcccccaaggccacgggggcaccgagggagctgtctgagggggtgggagctcccactggctccccctggagcagcccccgcgcggcccccaaggtggccctggccagccggcccaggtcgagaagagctggagagacacggggcaccccagggcagaagaggggggcccaggaggggaccgtgacccgccagacccgcggcaggagcccctcccgggccagctcccatggagacactcagataccagggactcctgaagctcaaaagccctccaaccacccagggaaagatcagagagacgttcccggcacaagttccggggtgcctaggcctttggagcctgaactgcagttggcttcggggcctccctccccgtcctgcagccccgtgcagagcccacgcccggccctgggggccgtcagctttggctcagcccacacgcatggccagcctgtcacagccactgtggcccctttccggtacaggtaagctgtggggggcagcggggggatggagcctggactcgggggcccatggaggggagggg

SEQ ID NO: 44441 - DNA, 1607 bp, Bovine  19866880875768
cgcgctcctgctctttgtccctggggccctcagacagggaccccccgggcctgcgggtgtgatggccttggcgggcgtggggcgcggtccaagtagagacgggtcttgtttctctcactattttgtgtcccagctgcggggaaaggcctgccaggggctgcacacaagctggtgaggaaacactgaccactgggagcctggggaggggagacagggacccgggtgtgggcaggatgcagccgcagggatgtgctggggacgcctgagctctcggcgcggtctcagttccatgggagacccaggtcggacagctgggctcccccgggaggaaggcgagagaaaaaaccagcggaaactgcagacacggccactctgtgcaaacgcttggaaggctccgtagatccggctcagctgttgtttacagcttttgggggaaaatggctcttatgttctctgtttgcagcttggccgctggggagacgctgccgtggccttgctcggggctgctctgtttctccccatcgtgcggggtggaaaaactgaggccaccagagactcggtctaagtcggcggactctggcaggctgagggaagggatgagaaggcgggtccccagcaaagctcacgtcctgaggagttgaggccactgtggccaggggtgggggctggctcctaaagcctcaccagctggagctccagcgcccagcctggggcggtgcaggacagggtgtgaacagacagggcacgccccaggcggggcacagggctcccgggaacctccgttaattctgacccatgactaaccaccactgtctgagcaaggctgcttcctcctgcacacacagccactgatacaatcctttctccagcgagttcacaggcatcacacgggcactcgtccacgcccgtgagttagggtgggggtgaagtggctgtttacaaacccacagacttgggggaggagaagccagcccccagtcctccgcgcccgtgtaactgaagcccaggggacacccggggagaccttctcttcggatggacttgtccaactggggctcacacagctgccaccacccgggcccacctctgggcactcacattggccgagagctgagaggtcaaggtggccactttctcctgggacgactccagttccctgcgaagctttcggatttgctgtggagggagagagaggcacactcacgttggcagaaggggtgggaggcgtgggaggaggcggtgcggggtgttaggaggcagaggcagaggtggggaccctacctcagactgcatcctctcctcagcctggagaaggagcccagaagcgggggagagagaggaggtggttacacggaggagagagtgcacagatgcgcagcggcaggaagcggggcgccaggccctcacaggctcagaccccaggccagcgtttagtctcctgccagagccgcgtcaccccgggggcccagagggagctggcctgaagactgacctcgtctccaccgaccgcaggacggcccagccccgccaggagctgccgtctccacacacccagagggtcccggacgctagggttgcccacctgccctgcctggcacagaacccaa

SEQ ID NO: 44442 - DNA, 2175 bp, Bovine  19866880969331
ttctctggtaggagtaatccagacaacgagggaatttgatagctattaaaaccagggttctgcagttggcaggtaactttgcagtctgaagaggtctgttttctgagactgactgcaatacagttcaagtcagagcaaaagaagacacctggaactccatcatgagtgaagccttaacaggagccatcctgagagcaagaaaggggtcagaatccatgctgggtaagcctcaatgggtggcattctcctggctctcatcaaaggaactggtatcttgttgataagatttgcctctgcccagtttcccaaggattctccttttgctgaaaaccccttctagttgccatcagcccatttatcatcctcaccttttggagactactgacaataccagtaggacttctctctcaggatttcttcaacagaatgagctgtaggtctaggaaggatttcagaagatcaagttcagtctgtttttaaaactgtaggtgggacaactatggccaaataggctatgaagaaacattcagaatctttttctgtttaaagaaacatggcggggaggggggtgcattcttaaaagataatacatttatttattcacacttggattgcatttgtgataaaataaatgtctaaaatctttaaaatgaaacacagtaagtacttagaagatgaagggctacacagcaaacagtcttgaagcatgactttcctcggggacttctctgcctggttttgttttcttagtcaaacaacaaaaaacgcctggagactgctctttctttaaaaaaataaataaataaagcaaggagttgctggagaaagttccagctgtggtaaggcctgcagggctctgctctgcccaacaatgactgcttggggacccagtcctgtgacttctgagctgaggaaatagagatgaagagaacccaatggatgcattcagactcgcacaaccacacagaacactgttctaacccccaggcgagtgtgtcaaactgggaaggcgcaggaagctacacaaaactcacatggttgggaacggttttgcatgatgctagctcatgttagcatccttttttttcccctccatcatcccctaccacatctctatgaggaatgcagccttatctctcttgttccccactctacccctgctaggaattgtgaatggtcaggcatatgcactcaaacagcatcagctgaatgagttacatgccagaatgatactaagatcaacataaatatattagggaatagaatggaaaactgacaaattttgaagttgggatgctgaacttcaaaagaaactaaacttccccatttctgatgagggctttaaactctgtgtccagaaattagagatcaaaggctcacacttcttagctgtgagggacacttagatggaaaagtttcagaagcctggaacatgcaataccatgatgctgctcttcctcctgttatttctttctttaaaaaatatttatttatttattatttttggccatgctgggtcttcactgctgcacgctggctttctctagctgtggctactctctagctgccatgcacagacttactgtggcggcttcttgttgcagagcacaggcttagttgcctggtagcatgtgggatctgcccagaccagggatggaactgatgtcccctgcactggcaggaggataaccactggaccaccagggaagtcctattatttccttttttaaatgcattattacctctgtataactatgagccagaacttaagagaggggatggccatgttggggaaaatatcttgcatccctcagtttgtatgtagacctagatttgctttaactttggatttacattgctgttttttttttttagctgtctattgcacaccctcagaagggtttttcctgtcatactgttaactctctaaaatagttgtaaatatacgtaatataaaatttatcattttaaccatttttaagtatacagttcagtggcattaagtgaattcacattgctgtacaacaaacaccatgatccatcacaggactctttcatcatcccaaactgacactctttacccattaaatcataactccccattccctcctcccctcagttcctggcaactaccattctattttatgtttcaataaattgactattctaggcccc

SEQ ID NO: 44443 - DNA, 1601 bp, Bovine  19866880997158
tgggccagtagtggacgcacttctgggcggggggagctgggagtcaggggctggggtctatcggctggatcagggccccccccaaggcatcccccctgccccccggcgggcttgacacctgcttgacacctgcctcccctcgccctggcttctggctagggtggcctccgtgccctgtgactcagggactgacaggtgtcctcagcccccgggggcccagcctggagctgccccacctccttgccctctcggagctgtgtgagcatgatgatgaggggcgcctcttcctgccacaccatctcccagaagtccgacactgtgttgggcatggggccctgggtggcaatgtaggccttgtcctgcccgtcgtagccctgtaggcagggaggcaggcggtgagcgcgggtccgtggcggcccggacacaagcgtcagggacgcacgcaccgggagccccgagctggtggcgacggccagcagaccgtgcgtcgtgcccacccagccaccgcggtgcgggtcagactcgacagcgtgtcgcgttcagtctttctgggcctctgtgaatggtcccttccttcctctgccttctattagccccaaaggcggggaaaaccattgccctttgacatgctactttgtggagttagcagcgaggcgtagcacacccctgccagccctttttctccccctcagaatcctcctgctcctcaggggatgggggatccagaccattcactggcccgtgcttcaccccccaggccctcagttcagttcagttcagttcatgtctgactctttgcaaccccatggaccacagcacgccaggccttcctgtccattcccaacccctggagcttactcaaactcacgtccactgagtcagtcacgccatacaatcacctcactctctgtcatcccctgctcctcccaccttcaatctttcccagcatcagggtcttttcaaaagagtcagttcttccgcatcaggtggctgatgcgggctcttcacctccgctcccggccactgtcccacccactcagagccactagagggctcacgtctgcgcctgccgcctcccaccccgcaggctggaggctgggcgctgggcactgggcactggagacaagtctaggctcggagtccacctggcctcccggcctccggttccttaattccttgacttaagctgcctccaagaaggaggggccgcctggagcagcgcaggcagagggagggaaccggccaaacgcctcactgggctgcaggcctgggagtcttgggctggggtggccagcgccgctctccatggagaggctggcaggtgtgggggaccagggggacaggagactggggtcttccttccagcgcctgacgtctgctgtgtgcatcctggcatcccggcctgttccaggagctcatggggttggagccagggcaccaggtgccccgctgcgctgggaggtgtcctggggtaggagtgtctctggacacagcgcccccttccctgccagcaactcacccgaatgtagttggcattgatgtaatccccatcctcctggctctgtgcccgacccagacagactcggctctggggtctagaa

SEQ ID NO: 44444 - DNA, 1454 bp, Bovine  19866881807659
tacacagcagtgcaggcggtgagcgaagcacccggtcaaggctgggaccgggcgtgataagcgtaactgttgtgagtgggcctccacggccgtccaggggctccctgcaccaccacccccgggacaccccagagggagcctggcaggccccgaacggggagatgggtccctgcgactcaccaaacagaacggaggagatcctcctctgggcgtacatggtgaagccttcgttcagccagaactccccccagttggcgttggtcaccaggttcccaaaccagctgtgggcgatctcgtggatgatgacgtcggccagggagcggtccccagccagaaggcagggagtgacgaaggtcaagcaggggttctccatccccccgaacgggaaggacgggggcatgaagagcacgtcgtacctgccggggcgggcggtcactgggggtggctccctcccgtcaccaggcggtccccagtgccccgtgccagggactcctctcccagcccttcccagggggatgagaccggctccctcgcacccagctccccacgcgggactggcaggcctgacggggcctcttgtcagggggacctcaagtctgaagacggcaaacagagagcgggtctgcccccagtgacgggaaaggttaagtcagccacatccgcacagcgaatcccatctccgacccagcacccgcctgctcgccgctgtcctgaaatgcccaccctgggcccacctcggtcacggccacggccacggtgggtcaggctggctgtcctctcctccccgcccctgcaccccagggtgcgggaaccgcagacgtgaagctcccgtgacacctcaccttccccacacatagggtccaaagagcttctctcccgttgccagaaactcctctatgactccgtcatactcctccttggcagcgtcgatgaggcagggctcagcccacacccggctcctgcggacaaggatgcagagagggtggcgcgggggttagagcccggagggaccagccggcttcagcctcccagggagccagggagcccatggggaggcgacctgcagcagagctgaggcccacccagagctgagggccagccccacccgcagagtgggcaccgggagggccctgggggcttctgcaggcagcaggcctcccccgcactgagccccagctccccgtctgcccagtgtcttcagaaacgactgttcttgctccgcaccagcagctcgtccgcttcctaacagaacctggcaggaggaaacccctggaagatgtccctctccttctctgctctcctgcagctgcgggcttgacgtgcttccggtcacccactgccctgtcccccaggaagggagcccttgtctcgcaggcccggggctgcccggagcccgtggctggaagcggaggccgacgggcctgcccagcgctccctctgacctcggagcggag

SEQ ID NO: 44445 - DNA, 1701 bp, Bovine  19866880402706
ccccttgacagggagtattgcagttaatgtaattattagtcagtatggcatcaccgactcgatggacacgagtttgagtgaactccgggagttggtgatagacagagaggcttggcgtgctgcaattcatggggtcgcaaagagtcggacacgactgagtgactgaactgaactgactgaactgattatgatttgattgtaattgttacatttgtataaacctccatggggttgcccctctgctctctatattgaggtattgcagtttttttcactttgtttctatagtgaattttctcttccttttgtccctttaaaatagacaagataatttagcctaaataaccactttagaaaatagtcaagtttaacgactacatttatttctattaatagctctctcaactttgggagaattgtgcttaaagatcttccctcctcttcacccactctctggcccttgaatgatcatctggcagtttgagtctctttcacatggttccttccttcttaaagtgaagttgcttagtcatgttctatctgcaaacctgtggactgtgtccaggtattttccaggcaagagtactggagtgggctgccatttccttctctaggacatcttcccgacccagggatcgaacccgggtctcctgcattgcaggcagacgccttaccatctgagccaccagggaagtccttccctttatgttacacacaattttgatgatgtgatgactgacatgcaggcagaggaaaccttgcttttatcatggattggtttcttgtggctattctctggtctcttaggtggcaccggctttttgcctgtccaattccttgtcatatcatgctttgttctcaagttcctctgatgctacatgttgacatctttgacctggcaagatgtatgcctcatcagctgagtatctttcagttcaatgcattcctttaaattctgtgtaaacctcccttccacccccgccgtgcctccaacacagactcagatgttgcctctttgaaaggaaagtcaaaagctgttgctatttttcttcttttgccccagcatttaatacattaaaccatttaaaaattgttttcatttcattattaattagaaaaatacacacacacacacgtagaagaaaaagagagataaagataaaagatttagaaatcactcaccatttaaccgtttgaatgcaaccagcgtttggcatatggaaattttttttctaggttttttccttgtgtgtgggttttttaatcatatttgaaatcattctgaatgtatagttctgtagtttgtgggttctttatttagcgtagtcagcataaacataatatagtcaggcaaaaattttccattgagtagatttaccgtagtgaaattgagctcttgttgacatttaagtgaatgcatgtattttttgctatgagaaaaagatgctaaagtgaccatatttccgtacacattttttcctttttttttttttgcataatttacttaaggtaaatttttagaatcactgaatgaaaccttaaaaaagatttctagggcttgtaatataagttatcaatttcccaaagttgggtacatatctgtatgctcactagcatattgatgattattttatggaatccttgtcagcatctctagataatataagcaaaaaatttatttcttcgtaaatcttatgggaa

SEQ ID NO: 44446 - DNA, 3346 bp, Bovine  19866880593912
atcgtgacattatgtcccctgcagaaaaggacagaaatcatgaacatgaatctagcagagcaaactacaatttctaagtactgcactagaaaagaatttggtgattagtttgagagtatagttcataaaatctaatatgaagtcactggaattagccagtgatctatcaagggtctccaaaaggaaatgttggactcagggtaatcgaaaacttctttacacacacacacacacacacatacatacacacaaacatacactaggcatttttaaaaaactaagcctgaaggaatcagaacttgtacgttaaattaaatattaatctatattgtacactggcttttaacgtacaaactaaaagtaaaattttagtacatgtcatacaacagcataagacaagaggtagatactgtttgcttctttttgtctttctgctttagtattgtctgaacgcaggtagcaccaagattaactaggcttgtgatcttatacaaatcattttacctctaaaaggttttttttgccccattggcaaaatgagagtttgaatctgaccatctgcactagagcactaccatgaaagaagaaaaattttaatatcgaatccttgatttgatttaaaaaattttttggaggaagcataatatataaaacaaatcagagctaattctattaaattagaagagattttgggcttgaacctgacctattaatcgaccagctgccatgtctcctagactatcccctgagggagtatagagaaatacagtttgaaagccagtaaagaaagaactaaggtccaagtgtcagttagctacgtctttacaggccctcataaggctgagattctaggatgctctggaggttgcaaacatgaatgtctttaggacaggtcaggtaaacaaatgagaaagcagtacggttgaagcaaacggaaaagttcgtatcatatttaaagaggacatgttactcggggtgtaggtccatggtcatcatgtaattttgtttttaaaagtgcacttgaatctggatttctgacaagtatttgcagattttgctaggcaggcaaaaacacgtgtttaaggcagatatggcccacgggctactgtgttgcagcctctggtctacagtcacagtgttagtgttggaccccagaactcaagatgtgaactttgtacttcatataatgcagcctatgaaaacagggcttgtttgcgcctagtcaacatcctaatctgaattccaattgtggatctccattgtttgattccacttcatctcagtatctcacagatgtcttcacattttgcttggaatcaggaagtgaatacaaacttaaaccaaaaagcattttaattttttgtaagaatcagggttctactgttcaaccaaataacctagattttttcgttactcctttacagatatttcatttacaattttacctagaaaaaatcaggtatactttaaatgtatttttccaacaggaatgagttctacttttactgttggcttatattcctccccattctgacctcacattcacagaatgcttactacggattgagaattctgaacaaaatgctgaaaaagattccaagcagctccaatctagtgaagatggataatttgataattaaaataaggcataaaagtattacgacagacataaagctaggcccacctaacccatggcagaggctgaagagggtagaagggaaggaaaggcttcctagagaatgtgatatttgacctgttttgaagctgaatttccttttatttcaatgaaatctatcttcttcagacttagaaactaaacctgctttttgttctaacagtgtgagattaatataaaacaaggggaaagtttattttactggatagtatttgcacagttttataaacttcaactataaactttcttaatctccagcttttctccatgaagagactaaatcattgaatgagttctcataaacttcaacttcactcatttcttttgaagtttccctctccggattttctctattaccattaacttctgagacaaatcacagtactaaaattttttctaaagcaaagtgaaaaagggaaaggaaataattttatgctcctaatagtgaacatggcactacagaacttttaataacactaaaaagaaatggaaagaagcactaaaatttaattggctcatcacagatcaaacagacacaaaaaaagtggcagaaggagagaggggttcaaagaggaaggaggggaaaacacagagaggacttctagtagagatggcagaataaagctaaaataaagaattgttctctccccaattccttaacaaatgactctgatttagtaaaaatccaatgaatgaatgagtaaagggttgaaatgtaaaatcataaaattcaaaacaaagcagctaaaagaaaaaataaaagattatggagtggtaaaacgttacttctaaatcctatttaaaaaccaattaccaaaaatagtcaatctgaaaaggctatacactgtatgattccaactgtataacattctggaaaaggaaacactaaagctaagagatagcaaaaaagattagtggctgctaggggactggagataggagggagggagggatgaaaaggtagagcacagaggatttttaaggcagtacaactattctgtatcatactgtaaaggtggatacatatcattacgcatctatcaaaacccacagagtgaacctgaatgtatactagagactgacaaaatccagtcagttaagtgtcaagtcttagtatagataccctggaaaaagcagcagcaaaaaagaaatggtggtaagcaagaattcatttaaacatgaatctaagactaaactgagaactataatttcacaagagaatgtatttgttatgagccatgacaacgaatcacaagctggaatcaagactgctgggagaaatatcaacagcctcagatatgcagatgatgccacttaaatggcacaaagtgaagaggaactaaagagccttttgatgaaggaaaaagctggcttaaaactcaatattcaaaaaaactaagatcatggcatcagatcctatcacttcatggcaaatagatgtggaaaatgtcaagagtgtcagattccattttcttgggttccaaaatcagtgcggatggtgactgcaaccacaaaattaagagatgcttgctccttggaagaatagctatgacaaacctagacagtgtattaaaaagcagagataacactttgttatcaaaggtccatatagtcaaagcaacagttttttcagtagtcatgtacggatgtgagagtggaccataaagaagg

SEQ ID NO: 44447 - DNA, 791 bp, Bovine  19866880638974
ttcagaggttaatatatttcattaaaaaaatctgtattcaaggcaactaatgaagaaaattaattttacctcaaaaacacgtagataaatgcaattaaaaaaatttataaaatagcaaaagtagaatttaaaatttaggactgacaagcaggtaaagttcctcacatccatgtaatagtgacaacagagtctctgtcagagacacttttaaactgaagtgggagcctacgagtacatttacctaagaaactggtcactggtagtgccgcagtgcataaaagagtttgctatgacagttgctgtatgacagacagaattccttactgcatcctaaaaaacaaacacagatatttatcatttgtattcatacaaatgcaagcttgcatgtaaacacacaataagaagcactattttgtggtgaaaacatgagtaaactgaatcagcatttaaaatatgaatcttggaaatttctttataaagattaaatagctagcttattaaaaaacagcaaatcaaaagttttatttgtggtcttaacttgaggtcaatagatttcaagtaagaatttaatagtagatattctaattgttagtttctaaatagtttgccatttctctttgatatcctgctcaaggtctccaagaatggatgtaacttgaggaacaatggtgtacctcttctggcactgtacctctggcagcaccagagcaattctgtttaattcaactgcactataaagataaacatcagaaaactgtcatagatgcaaatttttctcttgcacacttgta

SEQ ID NO: 44448 - DNA, 1547 bp, Bovine  19866880662107
atttctatagtcatgcagtatagtaagaaaaagaaaaacaccacaacagcagacactgaccgagcatcccatgacaaagcattctgtgaggaaggaaaacaaatgaccaataacaaacggaaaatactcaaccacactaaaaatgaagagagtgcatgttaaggcatcctttaaaaaaggttttttgtagttcaatttaaaatgttatgtattttaattttctaggtctgatataatttttaagagagagatatgcatagaattactctatttagataaaactgtattacaaaaggtgttaacgcatgcacagaaaaattctggaaatgtatatgttaatatttataagaaacattttaaagcaagaataaaaagcaagatattcacatgaagatatgagcattttgaaaaacaattagtttaaaaggcattaatctttttcttattaaaggtacggaaaatataataaattttagcattaaaaaattgttcatttgtaacatgaaaatcgagtaaattcttatgcagtcttacttcttttcccactgtgttttcccaaagtagaattgcttccaatatccgtggaatctagaaagtaacaggtggtggtcagaaacttaaaaaaactgtaaacctgaaaaatctcttcactacttatgtgcattggtttcctcatttatgaaacagggatagcaacacgtatgccactcaggttttacattttttgtgaagattaaataagatcttatttgcaaaagctaatgagaaatcactatataaatcagcaacatgttagaaggcctcctccaaaactatctaatgagtttacaaatagttgtctgaggtcttttttttctgatagggtaaaggactgtttgtcttttgaggtctttccaaggttgtgacaaaatgacgctattatcttccagcagaagaacacatttctttgccccatgatattgtcaatttcaccagtgatttcaactacatcatccaggtataatcagttggccattctgttaaatagaattctttcctccctgcagttccccgaagggtcaggtcaggtaagtgcaaagaatagggttgtgacgtggactgagtgcactccctgtcaaagtgtgtttacacttcgagtgcatcaggagtgggagctctgatttcagactcctgacaccctgcagcccaaggtcctgtgacctgcaccttctgtaactggtccaccccctgttgggagctgcttgaggttctccttgaacactgatcaccttccacagctactcctgggtctggggtatctattcaaccacctctatcccgaccttgggtggccttacccatcctatcaatgcttggtgactttcagtcattgcttcttggcctcttgaacactttttgaagaatacatgacacaggagcacttctaagtccttggagctctgctcctaagttatggcttataaagaaattttcacttacacctcctcccctcctctttccctgactcctacatcacaggggtgactctgcctctgacatctctttct

SEQ ID NO: 44449 - DNA, 1087 bp, Bovine  19866880671206
agggcatccgtgatgaagggtgggagaagatcaactaattgattaacccagactgaattatccttgaccccctatgactacggcttccccagtggcttagtggtaaagaatctgctggccagtgcaggagccaaggagacatgggttcgatcctgtgatcacgaagatcccctggaggaggaaatagcaacccaccccagtattcttgcctgggataatcccatgggcaggggagccaggtgggctgtcatccatggggttgcaaaaagtcggacacaactgagcatgcgtgcatagcctagcattcactccctaggactaggtggaaacacttggtcttaatgaacagtgcaaatagcatctctttctccagaaaacccagtggatgcagatcctagttactgaatctttagcgtatagtcagtggagcaggtatccccagaaaccagctttgtgaagatcatgacttcctggttttgcagagatggccaaggttacctctgctggaagttaggaaaatggaagcttttctatttcatttttttcacctcttagcttctctctcacacactgtcttggagaggaagacatcaactatctgatgccttccccagaatccacacaacacagacagtgctggtccgtgaatgtcacgttactttgttttttaaatttaaatttatttattttaattggaggctaattactttacaatattatattggttttgccatacatcaacatgaatccaccacgggtgtacacgtgctccccatcatgaacccccccttcccacctccctccccgtaccatccctctgggtcatcccagtgcaccagccccaagcatcctgtatcctgcattgaacctggactggcaattcgtttcttatatgatgaatgtcacatgttactttgaagaacagaatttgccttcataggcggcactaaggtctgcaaagcccctctctgatggggttgaagggcctctccacaaaggaaaagattttccaagttagcagcctcttctaaagggcacccctgcgtcccaatcactctattctttaaagtgtcatctccataaagaa

SEQ ID NO: 44450 - DNA, 1760 bp, Bovine  19866880672130
gcctgggtaatatctgatgccacctctgctcttcccatcttcctgtgaatggccctcatcctcctctggcaccccagaaccctaaccctttcctcagctcaggatggcagcaaagcctcaattggccaactgcctttgtatcttctgtctttgtggggctccagtatgcacataatttgtttttctcctattaatttgtcatctgtcaacttaattattacaccaaccaaagaatctagaatggaggaaaagaatccttttcttccccagcaacgaggagatgagcttctagcacaagggagggaggggaaggaggaaggaagaaaagactgggatgaaaaagagggagaagagaagagaaagaggtgccagcaactcaatcaacattactccttgatttctaaatcagcacttttctatcactcctcctcccaagctctacttgagcaaatacgtgtgctaagtcgcttcagtcgtgtctgactctttgtgaccccatggactatagcccaccaggctcctctgtccatgggattttccagggaagaatagtggagtgggttgtcatgccctcctccaggggattttcctgactcagggatagaacccaggtctcctgcatctcctgcattgcaggtgaattcagtaccactgagccccgggaagctgagcaaatataaagaagcaaattgtttcagaaatcctagtttcactttatgtctccattgctaaaccagagacataagagcaagcctgtttgtttcatgatttttagggcatgaacagagggaaggaagaaatactcttggcagcctaccgctttctctaaggccttcgtaatttcctgttaatttaagacctgaacctttgccaggtaaataacacaggtaaagataaacttcactggccctggactctgacctttgttgaacgccccgccccctctccaatctggcctccatcccaccgctggaaagtttggaactgttacctggaaattttgagcagagaacaaatagctgaagagacagagcatattgattttagaccagtgaaagtataaaaacaccagcacatctgagagttcctctccagtcagctgataagtttccctctctttctcaaaaaggtaacccaatggagtcaatttcccttccacgttcttgatagggctcccaccgactctgccacctcccagcttatacccacccaggctgtactttgccagcattgcacagaacaatttacttagacaagagtaatttaaataagtatttaatcgctttttctccctattgttgagcacacttatatttctcttcttgttggaaggcttcctctaacagtgatttcaaagaggggctgtatatgataaaggggttataccctttatatagctgataatctagctagagatcaaaatctaggttccaagttcttctctttgatactttaaaaatatcattcaactattttcttaaatccagtgttactgtttagaaatctgaaggcaattgatttttgttccttcctcacccctccgctaccctgttgcctggagcatagaggtaatggctggagctttcactgccagtttgaatcatgaggacaagatggaggaatagtgatccagaatgaaacctgtgtcttcaaagacccagtaaaacagagctacaacatcagccatgaactatccatctttaaacttctacaacagagaaaaataaatgttcattggtttatacagttatgtgtagtcc

SEQ ID NO: 44451 - DNA, 887 bp, Bovine  19866880728267
aggaagcacagaggagaaggaacctaatggaacatggttatgaagaaagtgggagaaaatggtgtcaagagcaaaagtttgtctttatttggagaatatttgtgtgatgatctgttacttttgaatgtacagtatccttttattagtgacagtaccccagtcctgcttggggaattttcctccctactggttcaaatcttggtgagactgtcattgaaaataaactctcatattcccctggggaaagtgtgggcctgtgactctagacaggccaatcagatgctcctctggaattttaatctttcttaagtggaaggacccaaggaccaaaaacatttcaagtttattcatcctgacagcagagtcccgacgagaccattccattagttcctattaccaagattcccagaatcaccctgctttaacctttgtgagaactagttcaccagcttttcctttaattatataagctagttccaataaactccttgtttaagctggtcagcagaggtttttgttgatggtaatcaaaaagctttatctggtaagaaaatttttacctgagatcaccagaaatttaaggcagtgatatctataaattatgtaagatttgtggataggggcatattagctgagacagaccatcctactgatctccgtcttttcgctaaagtaggacaaagttttctggctcactgagctattctcccgatagctttctaatagagactaccctaacataaaactttaaaaagtctaaaatcctgtcatggctcctcaaaataaaaacagggatgcttaataagtttttctaaaagagttacatttaaaaatcaccaaaaagattacacaagcaagaattctgactcccaaaagagtacaggcaa

SEQ ID NO: 44452 - DNA, 1912 bp, Bovine  19866880898964
tgagatggttggatggcatcaccgactcaatgaacatgagtttgggtaaactcggggagttggtgatagacagggaggcccggcgtgctgcaattcatggggtcgcaaagagtcggacatgactgagcaactgaactgaactgaatgatcctaaatggatagtaaaaccattaggtaccggacatgactgagcaactgaactgaactgaatgatcctaaatggatagtaaaaccattaggtacagggttgatggacaattttataatggacaggctgacatcatctgcatccactgatcaatctaacatcccagaagaaagacaaccagcaccgcccaacagaagcacacagtcccatccgtgaagaatcctgttcccacgccctcaactgaggctgaatctaaccaaatacaaaagaacagaggatagaggaacgtggttatgtgtgaaaccacagcatgaaataccaaacatgagagttttctacaaaacaaatggcccagttgcttcaacaaataacagtattaaaagaagagggtaggaactattacagattaaaagtgattaagagtcatatcaaccaaattcagtttgtggactatgcttgaagactgattcaaacaacctgaaaaacgacatttttggtagaaatcaaggaaatctgaacacttactgggtattattttatgcttaggtttttaagtgatattatgattatgatatggaagtgatgttgtacatccacgaggaggagaaacaggaggtaagaaataaatgaaacaggaatgttaataatttgttaaatatcaacaagatgttaataactgctgaaacttggtcatggctaggaaagggcttgctgtattatccccagttttatgtatattttccacaataaaaactaaaaggggtggtggagtggggtctcaccagtggcttctccatgctgcttctcctcacctccctaagctgaggtttctgctctggccagctcagttgagagctttaaacctttttttaaatagtgcctcaaaagttttacatgacattcagcaatgttcctctcatacccctgggctacttgacagtaaacacaggcagagctaactaattcacagattttaataatcactgctttctatgaaaaaaggaataattggctttaaaaatacacaaaggcatccggaagctgctccaagaacaccaaaatttcagactactcactacatgttcatacaggcagctgtggattgatacaacaaaatactggatgccaaaaattccatacagcaacatctcaagaagcaacatggacagttataactagaaagaaggaaatggaatgctggcctccaacacaggcactgacgcatgctctgtctaaacaagtctgaacttggggcaagtgttaaaccacagagatatgaatcagagtgaggcaagctataaggctgaggtaggacagcaagctgattcacgccaacagtcatgccaagaaaacgcttgcccaccaatttaacagaaccctgccaatgcacacgtacccagaggtggcaaacaaccctggtgtgaaacaacaggaggctaccttgccaatcagtgatgagggagaagagctttttctttaatgttttaattttaaggcttttttggttttttatttttggaaactgatgtctatccaaagataaatgactactcagtccagcagtaatgccaggaagatgcattgtggattaccaaactaagtgggttagtgggtggacacacacaggtgaaaagcaaagcgaagtacgtcataaacatgtactctgttgttgctgactgaacaaggctaagtgctacagcatccatgctccattaattgggcagcctttactgccatacagggtgcgtgtatgtccaaagaaga

SEQ ID NO: 44453 - DNA, 736 bp, Bovine  19866880969533
ccccaccccggggggtaccttagacgctcttggtgggggagataaggcacgataccaggaaggaggcgatagtcctgtgaaagacctacaaaatgctaagaaaggtacccgggaaagaccgggaccgattgatcacacccttccgcctagtagaaatttggaagacttcctgggcgaggcggtacacagccgatcttgaaggcttgtggggatttgggagagaggagggtttgcagaagagaacagtgtgtggaggggcagcaaagctagaggaggacaaaggtaaaaaggtacagtctaggaatagtagataatgcagttggttgcgtaaggccacggtgaggagtggtgtgggggcggggggcggtcgccacagtcgtttggggtccacatcctggaatactgtagaggagctgtttgagtggcattctaaggaaaacttagagctcatttctcggtgactcatgggcctagaaatggaagctggggaatattaaaggcgttcctgtgaaagaaagagaaggaggcccagtagagagttgacattctgtgccttgaatataacgtactttgaggtagattttgacagctttctggatgttcagataaatccatgtccaggctaggccaaagtaccttttgcaaaaaacttcattggatgtcagacttttaagaagtaatggaaaggtgtgtataaaatgaagtgtttctgttggtgcggttcactaaaatgcat

SEQ ID NO: 44454 - DNA, 3300 bp, Bovine  19866880997581
taagaagaaagaccccaatgccaactcttaaatcctctaatcttggctctctctaataaagccacttagcccaatcaaaaaaaaaaaaggccataatattcacattcagtctgcattatctttagcattgttggtaaccaaattcctgtcaacagtatccagttgtgcttttgttataaagaagataaaacttgggagagttgactcagtcagaagattcccctcagttaattctccaggagtccagcttgtctcatcctttttaaagaaaagtgtggtatttcaagccagaccctatactccacatatgatctaaccaggcaagaccatctatccacagatttcataatacagtcttaaactccattcatagttttgatacgttacatggcagttctctaccgagtgacttaactgacctgtctgttctgtagtgaaccacatcttcctctattgtttactactgccttttgggacattcctgctgggctgaataattattcctatcaaattgcttctgatttagattcaatatacttctgacatttcaaaatttttcctgagtttgttatccagagcagtactagctttccgtaccagattcccgtcaactacaaacctgaccagcaaagttcttcctttattccctgttaaaagtaccaatactggaacttcccaattaaagctggccatcagtctgtattgtatgtacagtcatttaaacaaccacaaggaaccacctaactgcattacccctagtagtgatagcttacaaatttctctgataccaagatactaagatcatggcatccaggcccatcacttaacagcaaacagaagaggaaaaaaatgaaagcagtgacaggttttatattcctgggctccaaaatcactgtggatggtgaccacagccgtgaaattaaaagatgcttgctccttggaaggaaagctatgacaaacctagacagtatattaaaaaccagagacatcactctgctgacaaacgtccatctagtcaaagccatggtttttccagtagtcatgtatggacgtgagcattagaccataaaaaagaatgaaagtcaaagtgttagtcgctcagtcgtgtccaactctttgcaacaccatgactgtggccctccaggctcctctgtccatggaattctccagcaagaatactagagtgggttgtcatttcctctgccaagggatctttccgacccagggactgaacccaggtgttctgcactgcaggcagattctttactgtctgagccaccagggaagcccatagcagaaggctgagcaccaaagaaatgatgcttttgaaatgtggtgctggagaagacgcaagagtccatcggacagcaaggagatccaaccagtcaatcctaaaggaaatcaaccctgaatattcactggaaggactgatgctgaagctgaagctccaatactttggccatctgatactgaagctccaatactctggccatctgatacagagagccgactcactggaaaagactgtgatgatgggaaagactgaaggcaaaaggagaaggagatggcagaggatgaaatggtttgacagcaacaccaaaactcaaaggacatgaatctgagcaaactccaggagacagtgaaggacaggcgagcctggcatgctgtagtccgtgtggtcacaaagagctggacacaacttagtgactacacaacaacaacatgtgctcatacacaaaaaataatcatcacatacatggggcttccttgatagctcagttggtaaagaatccacctgcaatgcaggagactctggttcgatttctgggtcgggaagatttctcctgggtggagaagggatgggctacctactccagtattcttgggcttcccttgtggctcagctgataaagaatccgcctgcaatgtgggagacctgggttcgatccctgggttgggaagatcccctggagaagggaaaggctacccactccagtattctgtcccggagaattccatggactctatagtccatggggtcataaagagttggacacaactgagcaactttcacttcacttcatgtcacatacacacacagtatcactgaagagcatttccctcactatgtacactacagtgagcttctccaccctattttattctctcctagcctcctgcttccttccttctctttgaaaaatgctagtcatagcccactaagttgatttcataaccaactgatagaatgggacctgcagtttgtaaaagagatttataatcaacctgagtagttcacttattaatggaagctattgtattcacaatgctgaattcatcatggggtctcaaagagtggggcacaacttagcaactgaacagtaaaacaacactgattcattcacagagattctaaggaattaagttacgttatcagtttaagaattagtttcagaaaacacgaacttcaactatttcttgacaaaccagcactgaacttagtaatatgaaaggttaatcagtgtccacatttaaaaatatgaagccatcaatcttcaagggtaaaattataaatccatttttcctctggttaaatttactactcactttgccacaaggttgtggaagcatcgtccatacgatcatgatcaaacatcacagtctggcccatgcttggtaaataagaaaagcaaacagccaatcctgttctttttaaaagatggtaattccttaaaaagaatgtgtatttcaaataaataagtgaggaaaatttgaaacaagattcaaatatgaaaaatagaacccttttagaaaattatttttttgggtcaagaatttagatagaaaaagtaagcaaatactgtggttctaaaatgttacacctgagagtgttgaaatgatttttcccccttttagttattccagtgaaggactaaattttgggaaaaaaatccttttaaaaatttataaccttaaaaactatttctagaagatcagatctaaacctggaaaatcactctccttcaaggtccagcaccgctatttctgctctggctaaatgcccaaaaaagcacaaacacgccacaaaaccagcctgagccgaagcaccatagttggagattcagtttgtttcctttttaaacggctcaaaggccaccgtatggtggtattcagtgtaaataagactttttccagcagaaatatttagagtcacagaactgcacggccctttagaggatcatttagaacatattacccaacgggatttctctgagaattctttacccttccaaatcagca

SEQ ID NO: 44455 - DNA, 1006 bp, Bovine  19866881024419
ccaggctattgaggacatggttggctatgcacaggaaactcaaccatgagaagattctccgtggtcttgcagttggcattgcgttagtgatgtacgggaggatggaagaggctgatgctctcattgaatctctctgccgtgataaggtgagatcacatattattcatccttttctccctccttttcctcacccttcagttattatatctaacatttacagaaacacttaaccttgactagaaattatctctattcccatcagaactcctaggtacatttattgatgaaacttctcgaaagatatataaagcctaataaaatttaggcaagaaaaacactgattagaagaggtgagcagagctaatttgagattaagacttcagtggttttcaaataagcagatttagaaaagatctttagaaattgtaagttgatttattttagaaataatgttttgggcatgatttcataaacatttaataggatacaaagtttacttcattgttttttcatcacaaaacagtgcccatctctggacttttttatttggatgagtttttttttcctttgccttttgtcttgtttttgaaaaactgaaaagtgaaagtcacacaatcgtgtctgactcttcacgatcgcatggactatagcctgcccagctcctctatccatggaattctccaggcaagagtactagagtgggttgccatttccttctccaggggatcttcctgacctggggatcgaacccaggtctcctgcactgcaggcagattctttaccaactgagtcacgaggaaagcccctgtcttgtctacctaccatatacaatatagtaaaaatggttttactgttgtaaaaacaaaaaacaagatgtgtgtgtgtgtgtgtgtgtcttgtttttacaacagtgaaacgatttttactgtattgcatatagtaagtagacagtggtaaacagtactgtcctctgtaatctgataaaaaaaaatccactgctacagtt

SEQ ID NO: 44456 - DNA, 1813 bp, Bovine  19866881110917
atgacttgctagcaaccctcatcctctagaagtctcatttttttgtaaaacggggatggtaacatttagaattgtaagggttgaaaatggtcatctgagtaaaataatgtgctgaacagagtgcctagcacacagagctacctgttttcctctatttctttgcactgatcattcaagaagccttctcatctctccttactattctctggaactctgcattcagttgggtatatctttccctttctcccttgccttttgcttctcttctttcctcagttatttgtaaagtctcctcagacaaccacttgtttagtctgaagccagtaggcatgctgtctcaaacactgtgacagggacttggggagatacgttggaacttgcccttaaagagcttatttataagctggctgggcagtaaaaatcccatacacacaggaaatcactcaagaacaacgaatcgcctgccaaccatgtgtcatacgtgcctgggagctgctcagagagactgattaccggggctagcggtgaggtgtaagtgaggaactccaccaggcttctaatccaagaacaaaggaaggaatatgtttattccttgttttggaggggttggttcatacccagcataagcagagagcctgggatgcatgtaaacctcctaaatctttagaacataaaccagggcttctgagagaagatcacggcatgagtcagaggctgctcacaccaggtcatgggaacacggcttggtgggaaactctttctctctgtccaaccacttgccaagtcccagctctgtgtaatgcccaagatctttgaaggtaattatctgctggatgcaattttattataaataaataactcactgacttgacaatcactgaacgcatgcacaccaaagaaaggactgcccagatcccagcaaacagatgggaaatgcccgtcagcagtgggccgtgacgtagaggcaacgggtatctggaaataatgcttttgttgacaatctctttcttaaaaggcacactggtttaggagaatggaagaagacacagacttggagcagagtatggatgtagaacgcgcagagaaatggctattaggaggtctgctgcctttggatcaaataagctcataaaacaaataggccagagacctgctttgtggaaagatgaactggagacacaactgtaaaaatggcgcttgatgtagacttcactcttttgagtgtcttcatgtgtaaaatgaggggtagaccacaccattctgactcagctaaaaattagtgactacctgcttagtgctaggttctttaacctagatagattctctcaacataatagcatctacctcacaaggtggttgtgaagcataaatcaatatatgtgatttcttgatatctagcatgtagcaagcacttactaattagccattatcatctaatccccacaaccttgaggtaaacattatttcctctgtacagatgaagaaaccattaagggacaagatctggatgtgaaccaaagtctgaagtcagggtccaccgtcttcccattacgcagtttgctttggatagggccctcccttctagctcttcactgtgaaaaatgagagggtggaaaaaaaaaaaacttgagtgctacaaacaattgagcttaggaccttctaagggattttctgtgaaaagctgaagtgtcatctcatttatgatgaggataataaggaggttggggaggggactgagacaaagtcatgaaaacttcttggcccaagttcacttatcatcatctcatgccagttagagactgcagacacatta

SEQ ID NO: 44457 - DNA, 666 bp, Bovine  19866881697720
ctgtcctggggctgtccccaggactctagtcagtgccttcagcccacctgtgggagcctggagtttggggtggggggttcagataagtccgtcaagcacaatcaatctccgggtggaaccaaagaaggaaggagccaggtctgggggcgctggccccccaggagcacatgtggggtgcccaccagccacagccacagagcaacagggtgggggtgtcttctcctgtccaggggcgaccctgccagctgagcactgagcagggatgctcaatccttcggagagaggggggctccctgctgtctccggggtagagctcttgtaggaagccatgggtgggtgggtggggggagggggagggagagccagctggtacttgggaaccctgcctcctctctggaattccagttccctctgggggaatgcagcgtttccttttccttctcacttttgcatgtttttactgattgttcgatatgctaaccgttctcagccctgaagagaagggctccgacacctccagtcagactttggtgctctctggagatgaaactcttgaagtgctttgtatattttctcaattagatctcttttcaggagtgtctgtagaacaataaacatcttgacttcgatttggctgggagagagggggggggggggggggagggg

SEQ ID NO: 44458 - DNA, 1312 bp, Bovine  19866881812749
tataagcctgcaatgattattggtgaacttgaagggatttatattttttttagtggtatctccaacccataacctggcctgccctctgaggtggtttgtggtataatcatcataaaagaggcctggactattcatacttgggatcaactcagatctacaaagacatttcaaacactttcaatgacaatgttacattgttgataccttatgtattttgaaaataatttttatctcttttcatttgaaacttctgtactgtatagtggggtccctagccctggtctggtttccagaaatttacttgcatgattctgggagtggctagtagggtgttctgtggaattggtatggctggatgcactgggatttgcagaagccacaccagagacacacagatcctcagcctggaagaaaccaagtttcagtttgatgaatttgccctggaccatctccagcacactttaggtactttatgtactattcctcagacactgtggtgatacaaataacatcttctgtatccaccctaaaatagctggagatactgcagctccttcttgggggctctgctggcaagtagaggccaggtgccaagaccatcagctgcatcctagctgccccagctgggcctgagccctggagtgctgtcacccagcctgtgcctggactggagggagtcttcttcacccttctaggtctgaacaatcctttctggaaacagtgggactaaaccacagtaactgacaatttccctgggctctcttccactgtagcagagtcttggggagtttggattccagcccaggctactgcttcagtgagggcttcgtgcctcccttccagtccctggaaggctctgacccctggattcttctggcagaggtcatcagtcacccttcactatgaggtcagagaagaaaatggcaactctccacagttcttgcctagaaaatcccatgaacagaggagcctggcaggctacagcccatagggccacaaagagtcagacacgactgagcccatgcctgttctgagatttgttctacctgccaaactcaacccattttgggggcggggggatgggtaaggggagttacctggatagaatacaacaggttgatagaactctacatctttttgcctttctgaccagcccagcatgcactgcctgaggtaggtcagtgggcttcctatgtaagtgttataagccacctcctgctgtacctccctgacatttttacacagtcatgttcactctcacctatactcactcacctgtatgcactacacaccacatcagccaagtggacaa

SEQ ID NO: 44459 - DNA, 1626 bp, Bovine  19866880362654
gggtatacttgattcttatgattctgctcaggaaggaagccaaaaaaatagtggacaatgaggtattttcatggcagcaagtcaacacaaaggttcagaagtgtcccttttgcagagaccatggggacagttcttttgaaccaagggtgctccagacaaaatatacaccatccccctgagactgagcaatgtgttcttgtaacctttcaatgtcctaaaagaacctccataatagggtcttaataaatgtttgaatacataaataactacctgcatcttaaatttataaacattgcaaaataacatcattgatataactttacatctaggtacaaggaaactgtagctttaggaatgaggcctaccttgggcacggtcctcacatgaaacagtatattttggaaggagtgtccatcattggcctgcaagactgtgatgtcagaagtgctatccgagccatcgtgaacatactggacaaggcccctagagagctcgtccagacgaaactgatagataggggccgccggggactggagcgtttggagcaactggccgtgaagtggaggatcgagcacctcgaccaccacatcctgtgggttgtcatcatctctgatgtcaagcagctgggtggtgatggttcccctctctcctctgttgatatggaggacctcattcctcagaacatagggggcctgtggagttgaagggaaggaagagaggaggcactattagcaggaaaagagaggacaatctggtggaccagaagtcagttgtgtgtagcctgattgctctttctgtgatttttaaggaaatctagatgctcctgccagagaaggcgatggcaccctctccagtactcttgcctgggaaatctcatggatggaggagcctggtaggctgcagtccatggggtcgtgaagagtcagacacgactgagcgacttcactttcactttttactttcatgcattggagaaggaaatggcaacccattccagtgttcttgcctggagaatcccagggacggcggagctgctgtctatggggtcacacagagtcagacacgactgaagcgacttagcagcagcagcagcagtataatcaaactgatagtcaattcctatttggaaacccaaagcctactccagaataatctatatcagatatatcagagtgccatcattgtcttaagaaactgtttgctatttattgaacgcttacattcaggcaccatgcttttatccctatacaattctacagctaaagtaatatgattatttcctctcataagcatttaacaagttaataattttaaacttctgtgcttttctcattaaaaaaaaaaaaacctttaattgaaggataattgcttaacaatgtcatgttggtttctgctgtacaacaaagtgaatcagctatatctatacatagatcccctccctcttgagcctctctcctgccccacgcccatccacccctatagattatcacaaaaccccagctgagctccctgtgctgctagtagcttcccactagagctctatttcacacatggtagtgtatatatgtcagggctgcatcccaccctctccttcccccactgtgtctgcaggttcattctctactt

SEQ ID NO: 44460 - DNA, 1339 bp, Bovine  19866880389517
cccttcatgggtttgttgaacagagaacaaggtatttatgaaacaataagctgttaagtcttgccatttacatttctaataataataaagataatttaaatttgaactaggttatgttgcaaaggaattaatcttctggcctttctgaataagctgtgccaaggacaatggacacgaagggacccacgttatccaaagcctccaatgtacatctaacagctttcttccactacctactcaagagagttctttttaaaactttttatttatttattcttgctgtgctgggtcttcattgctgagcatgggtttcccctagctgtggtgagcaggggctactccccagttgcggtgctcgggcttagctgctcctcagcatgtggaatcttcctggaccagggaccgattgaattcgtctccctggcaggtaggtggattcccaactgctggacctctagggaagtccaaggcactgttaaagtgagaacagactgtggatttgtagggaaatatctagagaaattaagtctgaagaaaatctctgatttccaaaattattaaatgcactcatctcagtcaaaaaccattgattgtttcctgggtgccagacgctctgtggagcctgagtctcactgctttcagctctttctggaagaacatcattggtgcaatgagcagagtcagaaccactgggctgtttcctgagcgtgggcaaagcaccgctgtgcgtggctccctgatggtggcagaggtgtgcgtctggcctcctgactctctgaggacagcaacaacattctgaacctcttttcatatcttcccaccaggcttcgaaaaatactgatcacttaataagcatactctcattttatttaataactggtccccactgcgtgccaccaatgtggcagccactttgggatggatatacaaatatggtagaaccctttttcttaaggaatttataccctactccatattgaatgatttaagagatgtgaaaagagactaatcattattcgtacttacctagaatatttgacttacttcatcatttgtaaatcactttcctatctgtcaatgaccttgtcaagtggattaagcaaaggaggtattattttgtagatcaggaaactgagactcagaaaggtaaagtaaacacttcacatcacatagttcagaacaggcagaatcaaggtttgtaacaggttgttggagtactagcctagtcctctttctgccacaccacattatcttttctcatacgtaagaacaaaaggacagtgttgtacccgcttaattgtttagtttataccaaatggcatgcagggaccttaaggaa

SEQ ID NO: 44461 - DNA, 1508 bp, Bovine  19866880391692
ctatacatcctgaggggcacacatgtttagaacctgaactacttgggatataagagtagagcattctaccatgacggcatggttctagaacagtgctgtccaatacaatggtcactacccacatgtggctatcgagcatttggtaagtggctagtgttagccaatagctaaattttaaaatttaatcttattttattgagatataattgacatactgcattagtttcaggcatacaacataatggtttgctatttgtatacactgcaaagtggtcaccataaatagctataaaattttttttcttgtgatgagggcttttaagatttacttttttttcctactcttttagcaacttgcaatatgccatacagtattattgactttttatcttttttatttcacgaggttctcatggcaagtatactggggtagtttgccattccctcctccagtgaatcacattttgtcagaactctccactgtgacccgtccatcttgggtggccctaaatggcaaggctcatagcttacaagcccttttgccaccacaaggcagtgatttatgatgctaaagcctttgactgtgtggatcataacaaactgtggaaaggtcttaaagagatgggaataccagaccatcttacctgtctattgactcattggtaaagttcctgatgctgggaaagattgaaggcagaaagagaagagggcatcagaggatgagatggctggatgtcatcaccaatgcaatggacatgaacttgggcaaactctgggagatggtgagggacagggaggcctggcatgctgcagtccatggggtcacaaagagtcgaacagacaacattattgattttagttactgtatttaattttaatgaacttgtgcttaaatagtcacatgtcaaagagctaccctactggacagcaagacagcaaatgccaggtaccgatacaaaagtcctcttacttaatgccacactcagctggaaaaatgattagtctctttgggaaacctacatcagctccatgccaggcattgtactaggcttttcttttatttgattcaaagtcaaaacccagcaaaaccaggcaggtggaaccaagaaacctgagtggttacctcggctagtgtttacaacgggtttcaagcacagatcttcactgctggatttctctgtgtgggcttagtcaggtagaggaagatgtgattgagaaatgcatgtgacagtttaaatccagccctttcagatgcatttatatttaaataagaaaaaaagcgctactttaaaacaaccacttatgtctaggaaaacatctttgaatcctttattattagaaaattttccttttccttagaagaaaaaggaattttttgtgtgtcagtgttcagcttgcaaagatcaaacctctggtttcaaagaagcttctgaacttggcaagccctgcttcccatcactaataataaaaaatgctttgtgtgcatacaccttgttctgtgtggttaa

SEQ ID NO: 44462 - DNA, 1493 bp, Bovine  19866880422002
tgctgcaagttgttcgaactaatttgccaaaagtaatctggcaacacaaggcaagcctgctgctgctgctgctaagttgcctcagtcgtgtccgactctgtgagacccaatggacggcagcccaccaggctcccccgtccctgggattctccaggcaagaacactggagtgggttgccattttcttctccaatgcgtgaaagtgaagtcgctcagttgcgtctgaccctcagcgaccccatggactgcagccttccaggctcctccatccatgggattttccaagcaagagtactggagtggggtgccattgccttctctgaatgagccctttaccaacacctagattgatggccatatattcttcaggtctaaaactttaggaatcaatttctatggtaccataaaattgctttatgaaagaagggatactagagttcctcgattgctaaaactggataaagccataaagtccaaagaaataacactgtaaagtaaattttacagattttccatgttaccattgcaattctgtcgctttataatcctctcttccaatctaacacactctgcaaaagaaatagtcttaaaatagtttttcactagaatgtagattaaaggattagattacgataaacctaaaaagcaacctaaatggtttttaatatttctagtaataagtgaataaagtgttcttgcagataatacagtgcctccatccccagacatgttgaagtaatagcaaggtgcttcaaaaaacaacaaaaactatttcactcggttaagtatttattaaatatttgtttaatgccaaaaataaacaatgactacatccctcatgagtactcaaattgctggggaaacattatttatgatattctataatagtttatcaactgttgacataatttttttatctgaatgttataataaccctattttaattattgatttatttatcccattttaaatctccttggcttgttaggccaaaaatgagaaagaaggaataaaataaccccaaaattatgctttcaagttacaaaataataagcagaatataatgtgtttttataattaaaatatattcctgtgcttggtgattcctgggtagggattcttggtgatttttgtctctttccattatccttatccatattttttgttatttcaatagcaaaatatatgtaacttatgtgatcttttaaagttaatttcaaaatataagacagagaaaaacaaaaatatggtacccttttctctacaaaccacaggtagaaagcaactgagttttgaagttgaactggcatggggggaggggagttaaaagcacccaacaaatacctaagagtgagccatttacctaaacctttgtgttattctcaaacatttcttcttgtgctcagtaagattttaaaaaactaactgtgtgtctatttgtcctttaatgccagaaaggactgcaatattccactgggcctcgtgtctgcattt

SEQ ID NO: 44463 - DNA, 1983 bp, Bovine  19866880423447
gaggcaaccatagatagatatggaggagacacacacaaggcagagagcatgacaaatgccaagaccctgacatgggtagacgcttggagtaatcaagaaacagaaagacagctgatgtggctaagccgtagagaacaaggctggggaggaaaggtataacttcagtgagttaggcaaggctagttcctatcagtgttatccactgagatgactgaaggcaggatgcagagcaagactgggatgggaggtgaccaaagtgctgtttactgtggacgcagctttgaaagggcacgtggacttctacaggaaatgtccaggaagaaactgaagtcagcatcttctgcatgccaggctcactatgagggtctgaagatataaacaagaaaggactgaacagattcacagagctccccacccagaagtgacagcagatgagaaaacacagggtttctacatcctgaaaggcggctagctcagtgtaagtaagtaaggcagcttgagaggccactggatcacgtttgagggctgttgtcctgaaaccaatcaactgcccacattactgtgaagtgggagaaataatttagtcagcacttcagcgcacctacctctgtaatgattaggaaactcattatcaacctatgagccaaattagcagacagattagctacaaaagagaactctatcaatatggaaaagaaacaggaaatgccatcaatattaagtaatatttttacattttctttgagggaagctaagaatataaatgaaatttccagaccaaccttcaaagctcggtacagtctttcagctaaaaaggcaggcgtgttccttgcacaacgaactgttacaaaaaagcaaagtaatgttcagtttcatttaatagaaattgagttaatctatagtaatacatttttaaaaaagattctttttgggtaaccataccattctcctcctccccactcctagcttttctttagaatgaaagaatgaatgaatgcttaacctgaattttgaagccttataatgtcatatttgcatggaactttaacacagtaattatccttagccacagggaaaataaaattacctgccaaagatactcccacagtagctgactcatttccagatcccagacacaccaacacctacgcttacatttgataattccctagggtgtaccgctgctccatttctaacatctttgactactgatgaatagcttgggtctaaagattgcagagatgttgctccaaataactcattaggtaaataggggcactggagctcagcttaaaagtaatttttccaacagaaagatttttttcttaagtgactgaattagaatttatagactgattaattacattataaccagtgcgtgtaatctaaattcagtcattaaaaacaaacacattaaatcgttcaattctttattttgaaataatgagtaaagcagaaacaataataataaataactgcaaaaacatgagcaaatgaattatcctttaaagtgaaagtagccaggagaaaagtctgtagggaataagtctgtttattgcaacacaattacttgtatcatcttaaatttgatctctaggtagaaagctgaccaaaagtgaatgaattttataatgaattttggagatcagaacaagaacagtggctttctcatagtgcctttcagactcttttaaggaaagtgaaaagaccttttgtgtctgtgtcttaagggaaacagagaaatgtattaggaacatggaatctgggacaaacatgataacagctacagatttgaaactgtctgagaagaaatcaaggatgtgaattggtattatctatattttcctcaaacttacattcagcaagccttaatccttcgattgagagtttttgtgcccgcttttatcctattaactctttcaatcatctcgctccccacagactaaatgcagggaatcctttctttccataatcctttatcct

SEQ ID NO: 44464 - DNA, 1361 bp, Bovine  19866880498529
ttgtgacacgcgttcttacacatctgctcactgccttgctaacctcattccttccccgccctcatctgactctgtgccagcattagtaactcagtacataaacggcttttttcttctcttcaaggaaagcctttctgaaaaaattaaatcggagaggattagaaatataaaagaatgtgctggcaagcagcacctggttcatgaaccatggtgaactctctgttcacacatcttgaagggaaaaaggagtaccattggttactgtcagtggacacttaacctggagcctctgggaatatctgtctgggttggactttatgcactgatattcaaagacagtgtctcctgacttacagtgatgttgggagcaatgtggggtgggaggacagagagggaagggcaaggagtctgttggtggtggagcctgcaagcttgaaagtgctattgggacagtgtaggtgactacccggcacagagtaggtaccaaacgaaagtgacttcaacaaattgagcgaatgaatgttctgtcttgggagtgcccagctgaaccaaaagaaggttacattattctaaagcaaagaatctatcaaaaataaacccaactacttcccttgcttaccagtcattctgaggaaaagtaaatagaaattgtgatttttgactctcagcagagaatctggaagggtattaggggatgaatgacataaattctagatgggtcccttgaaggctagatgaaaacaactcatggggaaatgatttttctatatactagatctctgctgtctaatacagtagacacatacatgctggattatttcctcctggaaggaagagcctctacatctgttacggtgtttcaggccgccagcaacagaaatgctcctctaaatgtagctaagatgaaacacttatgacctcacatagcaggaagcccagaggtgggggaagtcgcagggttggtcaggtctccatgatgttgtcttttgatctttgcagtctcccgtcctcagcatgttggcatttgctttctggcttgtcccctcatgttccagccgttgtatcttccacggcttcaggcagctcgtcctcacccactcattacttaagcctgatggaagaaaggggtgggcttttcttcttttatggggtgaggagtgtcctttcctcaacctctagcattcttcccctgcggtccccttggtgggggactaagtctgtgggctggctgcaagggaagctggaaacgtgagtatatggccatgagaactgggtctctcagcaaagagctaaagaaaaaccatctattagccagcaacactgactttctatgacgctcagtgttcccaggcctctgtgta

SEQ ID NO: 44465 - DNA, 862 bp, Bovine  19866880578383
aatactttgaaagactaaggacaagagtatggaaaaaggattcaacttaattgtctacattttacaggggacggaccaaaaaaagaaaatcaaagtatgtgcgcacaattttttaaacattcctgtgttcctcctagagtggcccgcttctgtcactgtaaatgttccaacagcttctagatgactgatcatctctaactggaaactgcagagagaactgctgctttgaataagcacttgttagaacatctgaccttcaaaatctcttccaagtgcaatgatctaagatcatacacagggtagcctggcagtggttttgcaagtgggccaacactcctaattcccttgactcctgaaggtttaaaccaagaaaaggaagacagtctgtgtatttcctacacaacatcaaggaaagtgatagcagcagcggtagtggtaggggtgataatagaagtagtagaaatagagcagctctatttattgggtgcttactctaagccaactctattctaagcacttatacattctcacttatttctcccaaatatcctaaatatgggtcccattatcattttccttttacaattagaaactgagacttagaaaactttgtaacttattcaaaagcacccagatgataaagagtggtccagcagctatgtgcatgagctctaaaggcagagaaatgtaactctgaaacccacttccaccgcttactagcttgtgaccctgagcacagctagaaagtgatggtaatccttatgaaaacgtaagtatcagttctctggaaaacacaaatgacttgttataaactaaggaaagaaaaagaggaaactaggtgaaatatgaaaggaaaagaata

SEQ ID NO: 44466 - DNA, 775 bp, Bovine  19866880737851
tctatggaggcatgtagcccagtgactgatgattgttggaacaggcataatattgctttcagcaaggcatgacaaacgccctccatgatggcttgatgggtagataagatgaccagaactaagagtcggttgaatgacagtacccattgatgtaactggctggtttcaacctggtgaaagcttccacagacaagctaaagttctcttccctagttcctatcctgtttaagtttaacccacaacttggaaacagtatgtgagtgaaacttctcctcaacacatttccttctctcttgtgtctgttaagtgcttatattcctcttccccactatgttgtacgcttagtaggtataccctcctagatcctggactaagtgcctagtatacagccaggggttcagcaaatgtttattgaattaaattgtgtcatacaaggacaggttgcagaaaatgggatgcatagcctagaaatgagaaaagatggctgtcttcacataattgaaggatgatgagatttaggctatgtggctctgaaggaaaaaaattagaactggtgaaaggaacagtgagttgatttctgttcagtagaaggaagctctttctaacaattacatctgatggaaagggaatggatggagtttcaagtcctcccacggatgattacagagggccttttagaaagaatttctgctctgagtagacaataaattaggtacacttctccacatccaagattttaatgatattacaggcttctcagttctgagtctttttt

SEQ ID NO: 44467 - DNA, 1540 bp, Bovine  19866880787855
tttaaggtgttactactattcctattacataaaggattactctgatggtgaataaaatagcattaaaaagctccagtacagaactggcccacagtagggattccataaaagttaattcacttacttattccactctatgtaccataatgccccaaactcaggatttctgattttcttgagcaactgaaaatttgtagaactcagttgtttctgaatggttctgatattccacccatcttttcacatccacagtggggaagccgtttgcaccgtccccattctcagagtcagggtgaccttccactttataatttgtgaatctttctgtatttagccaagagtcattcagaagtcaagttgcatatccaggaggctacaaaaaacactcggctcaggttgcaacgttagcatacaaaacagggcccgaaaggaaaaagggagctggagctactgcttttacttaaaccaatttattattctttttgacagtaatgataagcactagctttcaggtacggtgagcccggtcttcccttgcacctttaagcatacgctctcacgggataaaggggactttatctctggtgggaactcctataggacaggatgcacccacagtatccaagggaggactgaatggatcatcctgaagctgcagacttttgaacgttgatgcgaaggaaggcagtcctcctgacgtgccagctgttctaaggtgggtgattagaatgggccagagctgctttataaccagatccatcatgggaagaagcacagctttgaaggcaaacacggacatcactgcatctgagcacggctctgagagatgctgaaggatggccgggccccagaagctggctcattcctcatcttgtctgtagagatctgcctcctcgaactcatggaaggtcaccccaggcagcagttttcgattcaatccttttttactgcagtccgcgtaaccgcccaaggactctctccaatcttttctttcttaggttgacgagggagggaggaccccactctcttttcaccatttcttcgctgctgctgctgaggacagtttccaggaggatgccatcattaagctaagcgccctgccccagtacggctgcatcgagaacacggggacaggtaccagcctggctgtagaattgtaccagacctggagagaagaggcagggtggcagggtggaggggggtcacttcctgcaattaacctggacaaggagacccgaagaggggtggaaccatttccaagaaatggaaggaaggtcttgttgactcaacaaatattgactgagcatttcctgtatgtgaagcacttttttaagcactggggatagatcagtaaggggcttccccggtggttcagtggtaaagaatctgcctgcagtgcagaagacacaggagacatgggttcgatccctgggttgggaaggtcccctggaggagggcatggcaacccattccagtattcttgcctggaaaatcccatggacagaggagcctggtggtttcagtctatcagttgcaaaga

SEQ ID NO: 44468 - DNA, 3239 bp, Bovine  19866880822581
tgggataattgttttagatacatttttaggtatgatgttgaaagatgctgtctcttctgttctgatgagagtagtcttcaattttgatccacattctggtactgtgctaggaccatacagatttagctattaaacagtctttatttgatggttggcttatataaacatagtcctatcctttggagtttgagtaaggtctgggagttggtgatggacagggaaccctggcatgctgcagtccatggtgttgcaaagagtcggacatgactgagtgactaaactgagtgatcctttgtcaaatcattggccatgcaatattatctttgaaaaaagtcaatgttaagtaatatatgtcacacatgaatatattattctctttgaaagaaatattaaaattctggtgtgtatccttatagacatttctagacatttatatataaaaattaaatcagtagaagttttcttggcattgtattactttgcatatgtgttttatgttttttctaataaaatacatccttactatattattatctaattattaataaaatgtattttattattatatattttctactttttcctcacccagcagaatgtctcatatacctttccactttagcatgcatatatcttttttcttttaaactatggcatagacttctgtgaaatggataaacatttatcattgtttctgatattataaacattggcataattaatatgtttgctgctttaagcagatagggctgatcccaagaaatagaattgctgggtcacagggacatgaatgttttaaattttaaaagatgatgcccatttgtccatccagctataccagtgtatattcccaccagttgtatgtgcaaatatctatttcttatcaccttcaccaaccctggatataattaaacctaaattttttttgtcaacctagataaagacatgctatctcatttttaagtttttccttgttactggtgagatacagtatcttttcctatgtttttgttcttcagttattttgggggaatagtgtatgttttacttacactgttaaattgggctgtattaagatatgggaagtgtcagaatgttgacatcacttttattttgataattttcatgctttctgagtttttaactatttgctaataagaatcccagcagctgaggagttctttgtttactctccattatatttatataatgaacttctgttttagagagagttgccatagttctggaacagcactcccaggaggcaaggttattttccaggattcagtgtgttgaaccagctggatggtttgttatcttatgatgaccttcattactttcttggcaagatatggactatgcaaaataacattcatttcactttgtgaacagtatggcttctaaaagaggcatcctttagctagacttttggaacgctaaaatggttagtaaaatgacacttttttaaagatcttggatactttgttcaaaatttctgagactgggtggtgatggagtgtttctgcttaaatgggccccgtttcttagccactaattcgctgggtaaatctgcaaacttgaatcaaactgtcctgtaattgcaattgtgtttaaaagtgagaagaaaaaataggtagttaaatcttaacttagtgcattttctttcatctgatagtttggtagaatttagttccattagtattgacagtcatatctgagcaattaatgtttaaccagtgccttccttttttctatatgtacagtgtcattctaatctctgaccttgtatcaacattataaaagaaagaataaaattaggaaaagaaagccctattagaaaattcagtagtttttattatacatgcattttttttttctgttttaaaaatatttgagtaattttgttcatcagtgtgttgaaacttcacgtagctttcattttccctctgggaacaagactgagtcagtacagtttacgtgtataattaagacataagcctcttacttaaggatttaaataggttctttttaaaataaataccgtgtaagtataaatgccattaatgaatttctttgtgttgttttcagatgttagttttgtgttttctgcataactcttcatcaacttccttcagcttttaaatcttcattgtatttcagtactaggtttttaagaccatatggatttcccaggtggcgctagtggtaaagaaccccctgcagtgcaggagacataagagacaatggttcagcccctgagtcgggaaggtcccctggaggagggcatggcaacccgctccagtattcttgcctggaggagaatcccatggacagaggagcctggtgggctatagtccatggggtcacaaagaattgggaggactgaagtgacttaacacaaacgcacatgggcttttatagctgaagagaaaacagaagctgatttgacattataaattagtaaataatactgattttggaaatacaggaaattacattaaaaaaatttttttttccagttcatccagagcagcttcctccgaggccatggattacattaaaagaacgagaccaaattctgccatcaggtaaaatagtttttcttattctttcttgacttttttcagatacacttgaaatgccatttgggttttgtaatcgaattaaccttcaaattaggccttcattttacctccccctgagtttagatgagtttagaaatactgatgggtagagttaaagtcctggagaaggcaatggcatccccactccaggactcttgcctggaaaatcctatggacagaggagcctggtaggctacagtccatggggtcgctgagagtcggacacgactgagcgagcgcttcacttttcactttcctgcattggagaaggaaatggcaacccactccagtgttcttgcctggagaatcccagggatgggggagcctggtggttcccgtctatggggtcacacagagtcggacacgactgaagtgacttagcagcagcagcagcagagttaaagtccaccctaaggcttatgtacaagaatctcgtctttgaccatgatagggctcttggtttgaaaattatttcttataatagagctttccaaatggcatcttcacataaggtttggtgatttaagaaaaatgaggagtaatgaatttttttctgaaaaattttgaactacttagatttatctttctttagtgggtagactgataactcttgta

SEQ ID NO: 44469 - DNA, 1878 bp, Bovine  19866880839505
ctgcaggtcaaattcaattcctccgaggtggtctggagtcagtatgaatgatttcacatcagggagggtgtggtgctccatcacaaactgtcctatttcaaggggaaacacacagacacttatttgtaagtttgcttgtggtcaatcccctataaaagccttgaaactgaattaatattcttctataaaaaaatcaaggttatacctacccaccgggttctgagaatatatcccacactgggtgggacagcatggcctcttacctcagtccatcaccctactcatgatcattgttagggttacatatatttataaataataatgaatgtgccttgtagaaatggcactaatgagcatattcacaacaatatcagtacttatgtgacaatgaacattgaacacacttagctttgaactataaccaacatgtttcttggaggcagaaagatctcagtagttcataaatagaaatatcaatttcagattttaaaaatctcattaggaccactcaagtcctttgtggaaggaggcaattgtaaacatccttaaaaaggtaagggttactcagtaagacacctcccactcttttaaagtacagtcatttagtgtcatgaataaataaaagtagggaaactattctgtatcgaaaaaataaaaaagtaaaaaaaagtcagttgtgtctgactctgtgatctcacagactgtagcctgcctgggtcctctgttgatggaattctccaggcaagagtactggagtgggttgccatttccttctccagggaatcctcccaagtctcctgcactgcagggagagtctttaccaactgagccactagggtggctcattctatattaaaagagactaaagaggtataacagccaaaatggaatgtatggatcctgataggattcacttttgtttcatataaacagatgcaaagcaaatataaacaaatataaaaataggtatgaaagacatttgcgggacacaaatggagggaacacgaatagaaactagatgttattagattggtgtgaaatagctcggccacagtaatgctattgtgatgtgtaagagaaggtccttgtttcaggaggtgtctactgaagtacagtaagcccctgcatacgaatgagttctctttcaaaactgtgatcgtaagtccagtttgttcctaagtccaacggagtcagcctaggtatgcaactaacatgataatcggctacatagtattgtactgtaataggtttataatacttcccacacaaatagcacataaaacgcaaacacaaaacatagaaaacatttttattcttacagtacagtaccttggaaagtacagcagtacagtaaaacggctggcatcaagtcaacaggcaaaaagaattactgattggaggacagagaggagatgggagacgatagatctaaaggatcgtcagcaataggagacagagggcaagtagcaatgtcactcatgcctgatattgatggtttaagttttggtttcttgctggaactagacacacgtttgcatcttgaaaggttcgtatgtaggggcttactgtgtttagggtaacatggcatgatggctacaattatcttcaaatgcctacaattatcttcaaatcaaaaaaatgggaatatgtgtgtgtgtgtgtgtgtgtgtgtgtgtgtgtgtgtgtgcatacatgcacatagcaaaatgctaacaattgttggctttgttcttcattgtcctattctctcaacttttctctatgtttaaacatttcttagtaataataataattaaaaaaaaaacttgaggaaaagaacagcactgatattacctcgaattggcagggtcttaattcaaaaccagacggccatcctct

SEQ ID NO: 44470 - DNA, 1956 bp, Bovine  19866880849813
aatatggactggaaggggacgggggaaagctggagccggagtagccacaggcagaggcaggttacctaagagtgcttgaaatcccgaggaagttacatgtgattccctgtgggtggactggcaaatgaaaataacaagatgaaggaaatgaggctagaaagattgacaagggccagatattagggcacgtttgaagaacttcaactttttatgaagcattcatcaccattattcttattttgcagaagcatcactcactgatttgtcccacctagaaaacacacaaagcacagctggggactctctgccatctcctcatggagggcactccccgctgacctgttgggatgctccttatgtttgacgtccaggtatttcaaggtcgcgatgaaggactgagcctggaagcctcgggctgtcccagccaccactggagtgtggcagatagcactgtctgttccgatggtgacaacgttgctcctcaagggggtccccacgtggcccaccttgtccacagccttggccacacaacgtacatggaacctccggctgaagtaaatgctgtccaggacctaccaggaagaataaatcacctcagacacgtggtgcctcaacagctcttcatactgtgtcttctggatgataatctgtgaagaccattgtcagctgaaaacactgcacaacctaaaagctgagagttaggttttatacagcaggctaaactgaggacttgagcctgggatacagcatcttaggtaactgtgagagactgctccaaagaggaatgggaagagccgggatacatattaatcacgagtttttgcaacaaaggccaggtagttggaacatcaaaagataactgttaaaactggatatctcaagttaaggaattgtgcacttttccatgtatgggaagatgaaatagtttgctgctgctgctgctaagtcgctcactgaaatcattcctttaataggcatctcagctatcaggggccagtatcctgtgttttctcatcctgagtctctttaggatgccccactggctgcagtggctgatgctgcaacatcctttgctgactgacatggcaggctgcattcttagcccacaccatccattatccatccatttatccatctatgtgtccattgatctacccacctctcaccacctaagtactgactttctaccaggagccaggcaccatggacagagcactgagtacttagagcctagggtggtaagccaggtaacaagcaagtagacaaatgtggagcaagaaactagagatgactgattcccaatgacacttgttctctttacatattaggttcagaagaagtacttaatgatttttcagcccttccagcaagactcattgcctctaagtcacttttgttgaaggcatggtatcaggatatagaggaaagacacttttttcctaggagttcttagttttctttcctccctactgccattccctcccttaactcccctctaattactaagggttacaataacgtggtggagttaaagttgagaacttggcctctgacacctactggccttgaaagtctttctacagattttctcatgctccagacacacagaatccatgagtgcttaatgcaatctatgcagaggtaacctaggtcaccaaaactctctaggttactagtgcattgacatagggaagtatataataagaaaaactcattagtagttctatgtgcagcagacttcccacaaagcaatcatacaaacttataaattctaccatggaaacaattttcactgaagtccattaaaaattgaagaagatttttccattaaaatttttttaattagctgccacaactttatttatttatacatggacttcattcagaagggatttgaagcatcttacaaaaatgcacacgatacaacagtattaaataaataattgaagaaatgaa

SEQ ID NO: 44471 - DNA, 1963 bp, Bovine  19866880893041
aatgggtaaaagaaatgagaaggtaatgcccccttattaaactaatttccaaagattcatttttattagtcttcagttattagcccgatactcacaaattctgcattttcttcgtaaacacaataaccattccttgaaatgcattcaggacagcattttccctctaagtgaattaattcttcaccctgcagaataaaggttgcagaaatacacatcaaattaacatctccaggtagcagcactaaattgcgaagtggctgaattccctaagtagaatgaaaagccataacacacccctctgctttggcttatgacttactgcatctcccctgtgctatatccctatgaaaagcctagtcagtacagctcatcttccagaagtgtttttttctttccagttctgatgatctttgtgtatgatttcctacccatgaccaggaactcccatgaagaagaaaggccacaagtaatcttgtagtcatggaaagttatgagtttcagaaaaggaccttaaatttatgttcaaggtttgaacttgtgatttgatttcattaacagtgctcaaatcacaccaacattttcccttgaatacaaaatcaggcacatccctatatgcacagatgaagtctcagacataaattaaacagcagaaaactaatttctattcaatattctgaaactgttatccaattcacataatcactattttaaaaattaaaggaaagaaggaaagaaatgccacactaggaaggcagatattaaactttcaaagccatcattttatcacttttaacttatcaaaatcaatcatttcaaattttttattataaaataataaatgcttactataaaaataattctgaattctataacttagaaaacataatttcattaaacataagtcctacctcccaggaaatctgctattaaaaagacaagctttatttacaacttttcatatgcatatagtatctgtaggctaaaaagtattctttaaaacacttcccactttctaaagatgtatctactttttaaaaaatgatgatgtttctttacatgaagacattatttaatttgtgatctatattacatttgaagtgtaaaaaccatgtttaggtaaaaacagaataatataaaattgcataaacagaataatcacagtatttatgtttaaaaacactgtgcactaaataaaaatatgaaagaaaagctttggttgtctttcaattgtagcatcacgaattgattttaaagtctcttttttacttctcttgagccttcaattttctaagtgaatatgtattattttaatgaaactatcactttaaaaagaaacacaaaaatatatgaatgaccataatttttataatatctaaaaagttatttcaaaaaggaaggggttagatagatcaccattcctcaaaatctcatgccagtcagagggtgctacagggagcagacgtatttacatataaattgttttgcagaaacctgacagatcagttggtagtgaaagcctaacccacaaacacacagacatttgctttccaagcatataaaggggtttataaacatgtaatctaagtcacttaaaacaatgttttgaaacaagacagagtatgcgtacttctgttaaagttcaaatgcatgagacattattgagtgcctgctgctgttgctgagtcgcttcagtcgtgtccgactctgcgcgaccccatagacagcagcccaccaggctcctccgtccctgggattctctaggcaagaacactggagtgggttgccatttccttctccagtgcatgaaagtgaaaagtgaaagtgaagttgctcagtcgtgtccgactcagcgaccccatggactgcagcccaccaggctcctccgtccatgggattttccagcaagagtactggagtggggtgccatcgccttctccgtcttgaggcctactacaatacagac

SEQ ID NO: 44472 - DNA, 1051 bp, Bovine  19866880913389
tatcccacctgcagtcccattcctccctacaggtgatatctggaacaagttcacaggatacatcagaggaagtttatactgtcactgcttaatttgtaccagaaccacagttactaaaatagaggaactgaatttccaacccaccaatctaggagcctctgcgaggattaacggtccattctcaaagccccatctgtgcagaagggcattttccgctgaccttcccgtctgtaattgaaagaggagactaacctcaaatatgcctaaatggtgagcgcgtatcccttaattgcttaaaaacagcacagttcaggaggccgtctctcaaatcctcccattgctacttagtaagtaaatccttatttgtcactatttcaattacagtaaagagtctttaaataaaagactcattaaggatgacagcggagacagaggagagagaccccagatacatttacgtgtagcctgtttcagatcatacacattacctccatttcagacttcatatatcactatatattaaataggtggagcgaggagggtagctggaattccagttatttgtttatgtgtctgcttgctcacaaacccggtgaagtagcacgttaaacccacaaattaatgaacacatcataagggagcctggaagcagagtatcggctcacgctgaaataaatacatttcttatttttaagcaagcagtggattccatttgttttctaaatgtgcacagcatgtgcacatgctaaaaatgtaaatatgtaaaaaattaatattttgactcagcagtggcaatatcctctaatacttcatcctgctgctgtgaggaaattatatgaggtcatcacggtgtgaggctttcttcaaatcacaaaggctctgcttcgaggatcagtgaggattacccacaatcatgatggatggaagcacatggcagtgaaatgacttatttcacgtctttggagccaagtcaaaaaagcttgaagatattaaagtaaatgtgtactgtcgaagcaaggctttgcatgttggttttatggggccatgactc

SEQ ID NO: 44473 - DNA, 809 bp, Bovine  19866880939168
cgattgggatgccggtgagatgaaggaagtgaccgaagaaaatgtttcctggcatcttctgtggtttaactttttttttaacgtgtaacatctgtaagttgcattgtgagaggtgaataaaagaacctgagacgctctacgttaaccctgtcttatttattttctgaggctcccctctcacggtagaaatacatttgcttggccgtgccagcaacatagtgaaaacggcaaagtgtaaactagaaatatgaatgtgtacttggcgtatatggccttgacattttaagtttatgggatttaattttgtttttgtgggtcagcttcagcttttaccacgagcagtcaaaaaacacaccagctctagtggcaaaatactgctcttacagagttttgcataatctctttcccaatgcatgctccgggcttgcgtacttaaccagtgtcaagggtatattagcagtgttcaggattccccacgcacccacccacccacagggggcgggtgtttagcacactaaacacgtggtgttggttgcaattaatcttaggccctataatgaatgtaaaatgtcttcatctcttggggtaaaagttgctgtaaaaatgcaaatcatcatttagccacaacgggagcagttattgaaagagtccaccaaaagaagaattgcattattttcagctttgtcaccaggaagtgtgagtaattagagaagcccctcaagacgtagaagaccgcaggctactttgttttccatctgtgttgtttccatttgcctgcctagcaacatcacccccaaaccagcttctgt

SEQ ID NO: 44474 - DNA, 1901 bp, Bovine  19866880961390
tgggaccagaaggctagttacatttggccttgcaaatgactcctgaactcagagttcttaatcaatcacccagtccaaaaatatttagtagccttggtcaaggcaggcagttacagtgtgcgagaactggcttcctgtcttcttgggagactgaaaatgtatttaaagatttccacacgtgagtgtcacatgtagagctcaggtgagaaattaactgtgtgtgagaaataaagggtgattccactggcgtggaaaatcaaaagaaagatcatatggatttacgattgtgaaatattgtgactttaaaaacacatggaaattgagggaggggctgtatgaatatggacttttggttcactttgctgtacagaagaaactaacacagcatggtaaagtaattacactccaataataatatttaaaaacaaatttttttaaacacttggaaattgatccctattcaaagccacaaccagactgtaagtgatgatgtcaggtattttgttgtttctgctgatggtgtgttagtgtggccaacgctgcaggtaacaccaacccttggtgatgccactcagaggacagataaggcttgttggttgctctgagtcagctggccgagcccaaatagcctatcacccaggtaagtggcagtgctaataagtaaagtcgtttgttcagagaggcagggtgtttttgttttgttgtgtcttccttttttttaaacaggcttgtttctccctgagagctaaagtgcagaagtctattcagaaaggcagtcaactgtgctcatagcactgtcttcaggacacaattacttttctacttaaagtaccaagtatgtctcttctccctccacccgctgtggtcttagatggcgggcaatgagtcttgtgaattaatagagcacgaaattcacagaataggaaatccattccaggttgtttggtgaaggatctgggatatgtgaaatcctcaagtggcttagaccacgggcttaagacactgcaaagcagggacatttccattagagtttgaatggaatatgtcaaaaagaatcatacccatcaaaattacgagattttaaaacttgagaaatgctcattcaactactttggtattcttgccatttgtgtttcaggggattcaagcagcattgtatctgtgatttgctacacggtccccaagtcagctatgggcagtagcctctatgctctagaatcgggctctgattttaaatctagagggatgtctgccgagagtcgagtgatatttgggcctggtgtcaccatgtccacctgtgatgtcatgctcatcgatgacagcgagtacgaagaggaagaggagtttgagattgccctgacaggtgcttccgacaacgcccgcatcggaagaatggcatcggccaaggtgctcattgctggtcccaatgatgcttctaccgtgtccttgggcaacacggcttttaccatcagcgaggatgcaggtaatggagagcatctctgggctcccctcactcgtctcctgatcccttccttaaatagtttcctcttagttttgagaatgcccttaggatgttgagaatgccattcctcagtgacacagttatcagtgtgaggcaggtaatactcagcatcaaaaccaagaatgaaaggtagtgaaggttaggaaactccattcacttatcttgctctgcttactggtggcaggaaaagacctgacttagagctcactggctgacctctgtggtccaaagggagggtgtagtgctaaacatttggcatgtgaaggaggggggatgtgatctgttgaagatggaggtaaattatttagtgtcctgcaactgccataacaaataaattcaaaatttccgtgttttaacaatggaactctcatccccataa

SEQ ID NO: 44475 - DNA, 2243 bp, Bovine  19866880969925
ggattctccaggcaagaagactggagtgggttgccattcccttctccagggtatcttcccgaccagataacgaactcgtgtctctagcattgcaggcagattctttaccatctgcaccaccagggaagcctacagatgagttaattgagattaaagtgtggggctcctgacttccagtctaatgagggtagtagatgaggcaagcgtcccgctgctcctctttctggcctcctgggagtttcctgcctcctttatgaagagaagctcacctctctcagttgctaccatatgtgatggtgacattgctgagggctatgagcccaggaacagctccgactttgttaaggagaggaagggggtatgaagaaacaggcgccaattggaataaagtattttaaaaaattattccaaatgcatagttatcacgacagaactgcagtgtatactctgctgttttaagccttcattacaaactgaaaggagttttcttcaaacccaaccattaagccttgaaacccaattcctgctcatcaaatgcagtctggaaaggaaatggaatgccataaattacctcaattaaaactttttcttttgttctgttctttcggagactaatccagggaggacaagaatgcagcagaaatccaacttgccaagatgattttaatactcccagacctgagcctaattataacctttgtttaccttcttagactgctgtctcaggtaaaataaaggttcacgaggaatttagatatagggaggcttttaaaatagatattttttccatgtaggtatgagctacacctaggaatttaacaaataatgtggaattactaacctgaagtttcctgtgttttaaagggcaggagggagctgtaataacattacacatatgcttctgtaatcctggcaacaacctgtgaggtgcatgttgttattttacttgtcaagaagctgtagttcagggagctaaagtgattagcagagttacaatgagcaatctgaaaagaattcaagtctcaaaactctagagtgagaaagcaggcagttctcattccttctaaaccagcgctctgtcctccacgtttgaggcctgcgcagggcatctgagtgcatggggcaaacgtagcatcaagtcaagcttctcaagtcaagcttttagatacctatgcctttgttgatgaaaaattttatttgtgtaaatgtctttttgaagaaatgcattgcagatttccttatatgaaaccttcctccatttataatttattatgaaagtaacaacacactcacttcaaggtaaacaaagctaaaagcctagatattcttctatagttttctccaggttcatacaaaggagaactgtcatttgaaggaaaagtattgcctcattcagttcccatagaacagagagagatgaattgctgtttgcatacctgttattcacatgtaggtcactgcccctcaagcgctgcatagactttgatctcttctgaagttaaagcatttccctgcagttttgtttatcctcagcctagtctggggtacctcaaatttgaacgaagtcactcatgaatgactgaggttttgatgttgacaattctctctactgcaactcaggcgtatgtaactccactaatctgaacatttttgccatcaaaatggctaaggatctaagtatcagagtccctgaggaagaagctcctttcgttcttgggaagacatcttgtgctggctttaggacttcttcacataggagggtgttgccacgcttgtggccaacaggcccacaatggcctgttgaaacaagcagtaacccactcaggaattcaccctaggccatactcaacttcccaggaggttcatggcttgtgtctctggattttggtcttcaggtacccccttggaattgccctcagcctctgagagttcctgtgtcatcccccctctccctgtttactcttcctctgaaactgcaggaacaagcccattcttgctccaacattcctaacccagcttatcccctacctcatcacagcattgatcccccctgcagagggctggtggtggtctcctcagggtcctaatacatcatccctgcctattttcaagaagatagccacagagaccaaattgtgtagccaacagtgtattttggttggagatcttttgtttacccttccaaacctatggctcctctctggtctgaaaccctggaggctgcatgcaggactggcgcttcc

SEQ ID NO: 44476 - DNA, 1843 bp, Bovine  19866880972147
aatggatttgttcatgtatggcttcatcaggcatttattacccacatgctccctaccaggcactgtcttaggctctgaggaggcccagatgaataaaatatagtgcttgcattcccagaaacacactgtgtagtgaaggaaggagatgtttgttgaatatgacattattgtgactatatgagctgagggacagcaccctatcccaggctggaatgtgtgtgtgtatgtatgtgcattcatatgtgtgtgtgtgtatgtgtgtatgtgcacgtgtgcatatgtgtagtgggtggtgaaggccttctggaactagtcataacagatgatttggaaacatgagtaagaatgagagggctttggagatttggagaggagagcattccagaaaacaagtcaaagaatgttttctattcaggcatcaacagagagttcagtagaatgccaggtccctccaggtgctgggccctgaagcagaaggaagcaggccaggtcatgaggcctttgtgggttctgtttgaggagaacatgccctggtatcaaggctgtgataggtttttaaggaaggaagcgttttaattacgtttctgtaaagagaaagttgtgcagaagattgcgtagaagatgggggcagaaagtcctttgggagggagttgtaggaatccttgtgagagatgaagccctttgatgagaaagttgctgacgggatgaagagcagggcacagcttcagtaagcattaattgtacattaggttgacccatctgagattgctgttttgtgggggggaaaaaaagatcaaatagtgtcagtttcactgaggctaagggagagtgaatctgggggatgatttctaggattctggtctagtaagttcaaggaatgagagaaacagttgtgaaggaccagaataggaagatgatatatttgaccttgtgcaggtgggactattgaacaatctggggtagctgtccaggaggaggatggaggtctcagtgagccataaactcatctgttatcttcctttcaccctgagcctaaagtcctggaactctttttttagctcaagtgttgcttcagtcatgtcataagttaaactcctggaatatttcagtggcttttatctaaacgctggaaggtgttaggaggagccctggtgatagcaaagcagaagagagtccacccacgcagtgccctcaatagagtgtatttccaaagtccctgggaaaatctgacacaggggaagccctggagaagcaccctctcttctgcttttgtctcgtgtgaactttagaggttgataggacttactcacaggatttattctatctctgagctgtacctaacctaagatcatcatcagagacctcttaattgctcttagctgtttaagaaagaaaattacatctaatttatcacacagacaagaataagcacatcctgggaacaggtccaataacctcactgtgttatcacatatggagatgtcacacgtatgaggtttttttatccctccaagtctatcaaagcaaatacagtttgtgagatctggggccagagctgaaggctttcaacaaagacaaatgaactgggatgagaggtaagagtggataagattgcagctgacatggtgaggtgttatggaaaaccagttgttttcctccatagatttttgttttttatactttgctcacatctcaacagtgttgtccccaaatttcaaagcctggggtgctccttctctttgtctttctcagctaaaacctttctctttttcatagaaaaaggatgagaattaaaaagaaaacagaagaagacatattcaaagaagatgcattaaaaaagaca

SEQ ID NO: 44477 - DNA, 1107 bp, Bovine  19866880990972
gaaatgccacttaattcttgaatgaccgaaaaaggctttttctaagtgaataagagaaatagactctaggaagagggcctagcctaagcgaagatattagccaatgcaatgtgtgcttaataaactatccaagtgtccagacaagaagaatctagggagccaggggaagtgaaagtcgctacgttgtgtttgactctttgtgaccccactgactgcagcctgtcaggctcctctatccatggaattctccaggcaagaatactggagtgggttgctatttcttcctccaggggatcttcctgacccagggatcagacccgggtctgctgcactgcaggcagattctttaccatctgagctaccagggaagcctgagccaggggaggggatgaataaaaagtgaacttaatgttggctaggagaaggtagaagctgcactaaaagtctcactttagcttgtaggcactgtaaagtcaacatgaatcaacagggaaggaaaaggatgatcaggtctgggttttagagaacctccaacagcaagagatggtagggactagggctgggatgaatctggggctgcagaaaccatttaaccagttcttgtaacggcttaggtgagagaagacaaaggtgattgcggtgggaatgaatagtgtttttaatttctatctcctatactttaaaaaaagagcaacagattccggaaacactgcagaggccaaactgatgagcctggatgactgatggaaagtgaagcccttagaagcagcagtagggaacagctgactggtagaaatcacctcgttagtgctccggagaaggcaaccattctaattgctaaagctaatgtcattaaaaagtgctgccactcctgatttgcaggcgcacacctcttccaaagcttcctaatagacattttccacaggatgggattagtgagacagcctgtgttctggtttcatttttcctactttcacaatctgatatttcaaaatagggcatttcagaagggatgttattttaaatgattgctatttcaaatatgccaataaataggacagagcaaacagcatgcccaggaggagaatattcggaacagaagacaac

SEQ ID NO: 44478 - DNA, 823 bp, Bovine  19866881031121
ctcttgcctggaaaatcgcatggatggaggagcctggtgagctgcagtccatggggtcgctaagagtcagacatgactgagcgacttcactttcactatgtatgtgtgtgtgtgtatgaatgacatattattcattatttttctaagcccattttccttctgggtccttcattttttgctgaggggacttttatagctatatgatttttaggaatgtttgggctgagttatagaactgactgtatgcttaaaatggttagtttttaaaatataaattatactacattaaagttgattttaaaagaaattaataattctgggtaaaaactatttaagattgtaaattgtagtttcttagagtaacaaattattgtattgaacagaatgattttgaaaacttactcccttaaaagagatttttaaaaatctatcacacccttttctaatgggtatttaaatctattttttacttcccctgaacttatataaatccaatttttctctaaaaaatttggattttttttcttttaaattgttttataaaatgcttctgcctttattgttattatttaaagttttaaaaagttactgatgattggaaatatgtgaccttaaaattctagctgtcaaccatgtcaggttaagagagcatatttacatcacttgtcctttattctaaaataagtgttttccttatgttcatttaaaaagaaagggttggtttcaactcttactgttctcccaatattgcctgtgaagtagaaagcaattttgcataggttaaaagcctaaattaaacctaaaaaataagcgggggactgtc

SEQ ID NO: 44479 - DNA, 918 bp, Bovine  19866881224672
tatgtgaggctcattatgattttgtccccttgtacctttccagttttattgtttattactcctctctcttcaaacatgttctcgagcctagccaaaatgagtgacttttacgtagtctggtttgtgctttatatgtgcttacaataccttatactttatgatctcacggacttctttaataattcacgttaggtgctccaactccaggaaaccttgcctcccccttctagtctttgctttatgctctttctctgtgctcccctagcatctgtgcatccctcttttgtgacatttactataccgtcttgtatttacatggtttatgtctctgctttctcattagacagatttttaaagaatatttatttgactgcaccaggtcttagctgtggcatgtaagatctttaattgcggcatttgggatccagttccctgaccaggggttgaaccccaggctccagcattatgaacatggagtcttagccagtggaccaccaaggaagtctgtgtgctaagtcacttcagtcatatccgactctttgcaaccctatggactgtagcccaccaggctcttttgtccataggatcctccagacaagaatactggagtgggttttcattccttcctctaggagatcttcctaacccagggattgaaccagtgtctctcacatctgcaggcaggttctttaccactggcgccacctgggaagccaaaaggagtctcctagactgagatttaagtatttgttacaaagtaggagcttaatccctactatgtactaagtgtttagtatattttaggggcctagtaactgtttattgaatgaatgaatgaatcaaatgtcattgcaaatcatagaagttatatcagcaaatatgtagtagcagaaagtcatgcatccagattccaggaag

SEQ ID NO: 44480 - DNA, 1536 bp, Bovine  19866881235395
cctgaagttccatgggcagaggagtctggcaggctacagtccatggatcaccaagagttagacacgactgagcgcacacacacacacaatttcccacaccaaaaatcatggggctaagcccagtgtttttagcatgtcatatgaatatacaatgattcgagtctcctccattgatgaaaatggttgattcaattaagcagtaattgctgacagcaaaatccactagagttgtaaagtttacatgcaaagcattaatgccattgctatatagcagtttctagctcagatcatattaaaatgttctctgaaaaatccacagtccttagcccattttagaatgtgtcctcctgtttatactcttgccttctcaaaatcactcatgaagaagagcttggtgggtttctggggggaaagagcattggctcatataggtgtgaacagcggtaaaggtataagcagaaaacaagatcacctgtatagtaggcatggccgatctcctgcatttgcttgctcgtcctagtggttagaatttcgatcagtgcatcctcatttgtccccatgccctagaaagaaaaaggaaaactatttttttttaatatttatttatttgactgcactgggtcttagttgtggcattcaggatctccagttgtgacaaaccagcttagttaccccacagcatgtgggatcttagttcctcgaccagggatcaaacccatctccctcgaattggaagacagatttttaaccactgaatcaccagggaagtctcatggaaaactatttttagaacactttaaaaactcagctttatgcacttccatcttaatatcttgttttacatggaagaaaagaatcatttttagtcagtcactttctctaaaccagtatttaaattttctgtatattttagtattaaaataacaggaatcatctaaagttaactgacattaaaattttaaagaaaatgtcctgctgtagtgtaaaaattcattgactaattccaggagtaaagagtatataaagggaaagcttacatcactcaggatcggaagtgagcattcaaatgtgtcattgtatttagagagggctctgcaattcttttgaatgagttcatccttgtgtcaatgcaccgcgttggtcagcaggcatcatcctcttcattggggaggtttttaaatcctccatattgtatgggaccatgagcccagctggtttagaggctagtgattcctgagtcttggtttatattgaggtcactgagtcacactgtagaagccatttacactagcacttgatcaaagcaggtcaaggtagtgtaagaaaagaggctgaattgtgtacctctgtgacaaagattcctagtggttccccaatagatctccttttcaaattatttattatttttaaatagacttttttttgggggggtgttttccttctttttaaaactttattgaagtatagttgattacaatgtcatgttagtttcaggtgtacagcaaaatattcaggtatacataaacatatacacat

SEQ ID NO: 44481 - DNA, 1522 bp, Bovine  19866881242831
ttgctgaacttctatgaagaattttcctaccataaaagatcgccaactcagcaatctgtgcctacaaattaattgataactacttgcagactgacatctatctggtcacttgacatatccaggtttgttatttttatctcaaaaatgttctccctttctttatctaccttaatttcaaatccactttttaggaattcaagcattttgtggatgtcacagccaacgcaattcatatctaaagggttcaaagtgatgattttatatattaatatattatgaaagaatccccattgcctcatcattgatttaattaacatatccaataccttatttatttacattttttgtgtatgaaatatgtaagttctactctctcagcaaatttatattatacaatacagtgttcaactagggtcactgtgttacctattagatttgaatagaccttatttatcttacaactgaatgtttgtgccctttcaccccattttcttttacccacctcattcctgaaacccaccacactattctctacttctgcaagttcaactttctaagactctatacatatgaatgacagcatacaatattttcttcccctgtctgggttatttcatttggcatagtgcaatgcaggttcatctatattgttgcaaatagcaacatttccttcttttataagactgaataatatttcattgtatatgtgtgtgtgtgtattccattgtttgtgtatatatatatttcatggtatgtatgtgtgtatatataaatatcacatatatgtatattccactgcatgtgtgtatatatatgtatataatcaaattttctttatccatttattcattgatagacactaagattgtccttataccttgaatattgtgaatacaactataataaacacaggagtacaaatatctcttcaaaatagtaattatagtaattacatttttttggatatacaggtagtagtgcagttgttggatttgtatcatatggtgtttctacttctaatttttcaaagaatctccatactgttttcaatagagactgtgcctaccagtttacattcctaccaataatgtacaagggtgctcttttccccacattctcaccagcattgattatcttttgtctcttttatgatagatatgctaacaggagaaaatatctcattgtgattctgatttgcattaccctgatgtaccttttttgttgtcttgcaaaaattccttgtcaacagcaacagcaagtagcctacttcttatattttctcctagtagttttatggtttcaggtattgcagtttagtatttaaacatattttgagttgatttggggatatggtgtaagacaagagtctagtttcattttcttgcatgtagatatgcagttttgccagcattatttatttaaaagactatcctttttctactgtgtattcttggattattttggtcaaacttaatgaccatatacacgtgggttatttttgggctctgattcttcttttcca

SEQ ID NO: 44482 - DNA, 1413 bp, Bovine  19866881289810
agtgaaaaccatgaaattcctcttcaggaatctttgaaaccagacaaacaaacagaaaagcaaaaagctttgccccatttgaccttgaccaggctagttggattcaatgtcttctctgctgaggtccaggcccttgtgtagttggatctagaccaggtcatacactttgtcccacaggagacaaaaggtctccttatcccttttgattttataggcattgccccatgtccttcttaataactctgccaacttaccccctcagttctctaaccacattttgaagcttgttgcctggttcatatgtcagactcctgacttccagtaacctattgagtcacgccagatacactcagccaggtgtctccttggacacccagaatcatcatcattatcatcatcacaataatatttcatactgatgcctaagtgccagctaagctgtatgctttatgtaaattatctcatttaaatcttaaaacaaccctatgaggcaagtatttttctgggctcaggttattaaagaaaacacatagcaaacaagtggtagaggcaggacttgcatccaggcggtgtctttgctatttctccatctcctcccaaatcttacccaaatggagaactgaatgcgagctgcttgggtaagatccagacttccttaccatatggtgtgttggccaatcgaggggagggtatagcgccagctgcacagaacgtttctgccttctcatagtcttctcttcattcttagtggcaaggggctttattcatttcttttgtgttcaaaattagccttttacttttcatccacacaatacgccacagagtgcccagattgcattcattatgagctatcatgtcccttgtcacttgtttacaagggctctggcttggccttagcttttaggtgaagtcatcatagaaaaagtcaagagccacagaactagggtttaaaaaatgacaaacattgtaagcattcattttctactcccacaatctttattttcccatttttgttagttgaaaacaagaacagtaagacttcttagaaaatagcagatctttagaaatactcacaactatctatacacaaagggcaaatatactcacttctacatcctcactccacacaaaacagatagtagtaaaaaagacatggaaaagtgctttttatctataggtaggctacaaaaacatactcacataaatgagcaaaagacgtgaatagcaaacactcgcttactttttttagcttataaaccaaaaacacaaaaagactaaagtgggggattcagttaagaagcttgtgctgacttttaacaggtagcatttttcagtaaacatctcagtcagtctgaacagtgatattacaaaacaggagaaagtccctctaagaaactctcttgcctcatggga

SEQ ID NO: 44483 - DNA, 879 bp, Bovine  19866881324293
cctcgttgcttgctgctgctgctaagtcgcttcagtcgtgtctgactctgtgcaaccctatagaccgcagccccgccgtccctgggattctccaggcaagagcactggagtgggttgccattttcttctccaatgcatgaaagtaaaaagtgaaagtgagttgttcagttgtgtccgactcttagcgaccccatggactgcagcccaccaggctcctccacccatgggattttacaggcaagagtactggagtggtgtgccactgccttctccctcattgcttaagccagtttaagtcggattttatggttagtggctgaaaacattctaactgatatcctacagtcagatactgaacgcagttgaaaacactttgggatcagtgtgattgagtgcagccgcatagttaagggtgtgagctttaaatccagacttcctaacttggagtctgggctcttgactgttattcagccttgggctacttatttcatcttcaagttggagattttttaaaaattaatttttaaaggaatatggttggtttacagtgttgtgtttgtttcaggcatacagtactgagaatactgttattaatggtggacatcacttttcatcttggcctgcaaatatgggtcagtttagaattggaagagatgagagaaaagcccttttgatagaggatcagtgtaaataaaagcacgaatggcaaagacagtccggtttgagtaaagtgtgaaaaatgatgggataaaataccgcagagggatttttcaactccaaatcacagagggcttggaataaagcatgtgaattacattctgtagaccaattgggaccctttgaaatggaaaccatttgctcttgaattctgactctgtt

SEQ ID NO: 44484 - DNA, 865 bp, Bovine  19866881348711
agatactattaatagtgttaatcaatgtggcagttacatttatttatagtgcttgtgattttatagtttttaatttacccatgggtaaatttttaataaggaggaaggcaagggtaaatgaagaaagtcgagttatatgtctgtatctccactgaccataaaatgtttgaaatgtttctcttagtgaaaatacgacagttctgtgagtcataaacccaagaactgtaggtcaaatacatcaaatagtatctattgacatgttttatttgtctctcatggtgttttaaaagaactgcgtctatttccaaaatgtcagtttatggagatttcaaaagaaaatctgaatttctaaactgccttaaagagttggaaggtttggaaacactggcagcatattcctatggccactgtcatttgggtgttttcagaagttctgctcattaggtgggccctgtacatgtcagtttcttgttgtctccacaatgctgttttcttagacacttcttttgtttatatagactttgtcagttcagttcagtcactcagtcgtgtccgactctttgcgaccccgtgaatcacagcacgccaggcctccttgtccatcaccatctcctgaagtttactcagactcacgtccatcgagtcagtgatgccatccagccatctcatcctctgtcgtccccttctcctcctgcccccaatccctcccagcatcagagtcttttccaatgggtcaactctttgcatgaggtggccaaagtactggagtttcagctttagcatcattccttccaaagaaatcccagggctgatctcctttagaatggactttgtagtaaatgctattcctaactaatcactaaat

SEQ ID NO: 44485 - DNA, 862 bp, Bovine  19866881872285
tgaaatgagatttgttcgatcccatagggtgggccactcataggatcgcattcagtgtcctctgctttctcatgtacatcatcttgccgtatccccttgagttaagtacaacaaatattattattcccactttacagatgaggagagcaagggccagtgaagttgagtttaagatgggaaaatttttttcatccaacaagagtgtcttactagaaatttactcactgcctcctgataaactttaaaacttggcaggtccttcctagtcatgtgtgagtcatgaaagatagttagcagtggccacaatgtggataaggaccaggatgaagaactttaccttgtgtatggtgtcttgcttatgcctggagtttaggctgcttcatgtagttgagagtgaaaacttcttggcaatttggaaatccaaactacaccctcactgatgactttaaaagggccactaacctagcatgcttattttctggttatggaggggagacattccagaattccatggaatggtgagaatccaagattccttctttttcctggggggcagtttaaacttgaaagctgagggaacaaggatctatgtccactacgtggggtcttttaaaggcttcctggaaaacaagaagtggtccctaggaggtattttaacatttccttgggaaagggctgcattttattctttgagtagcacaggttgaattttttttttttttacaactttctatttcaaaattatcaaatatgaaaagaagtttgttatttttagagtagggtttcaatagagagttgccaaaaagaagagtatttcatccctttcattttgaaaggaattgctcggcaagctaacacatgt

SEQ ID NO: 44486 - DNA, 625 bp, Bovine  19866881967039
catgatctttctaaggcttttgataagagcttttactctggatgtttcaaaccaagaaaatagttacaagtgatgtctccagttagtctccagttaaaatacatctactttctagaatgcttaacatctttattggggtctgtatttacaaaggattctctagccctagtaactaatgtgcataatgacacattataataaaatgataagatataggaagttttattcaacagaagtagttgaaaatgttttatttgtgtaaaacataaatgttttaaatgtgtttgctgaagtaaaaggtggtctcataaaggaacggaaagccactgtgactcttgttgaccttttcctaaaatggcactgcaaaactaggcattagccaaaaggaagggataaaaatacgttgtactaatgtcatttctttactgtttggacttggaacattgatggcagagctactcccctggattcaagtaggttcctaaatttgtggtaaagtagggttaaggtatacctattgttgaataaagccctctccctcaaaagaactatttggttgttttggtcttgattgtgtccaaattagcaaactaaggtaattgtttacagaatttcacagtataat

SEQ ID NO: 44487 - DNA, 2779 bp, Bovine  19866880195955
tattttatacaagtctacaaaccatactactttatttattagacctttaaggtatagtttaatatctggtagacttgtgttattctttttctcctagaatttttacttacttttttttcctgtacttcttttatatcttctaactcatttatttgtatctcatgatttcaaactattttcaaaccaagaggtcaatcatgaaggaagcaaataatttactgtgaaagattgcaaattacaaggtcataatttacttacagatacaggcttggaatggacaggggaaaagactaagaaaaaggaactttggctttatgttttatggtgcaaaattacccagtactaaagagtattgatagctctgggtaccataaaaataagaagtagtcttggcttcataaaattgcaacacacacacaccagaagtaggggcctggtgggcagtgctctcaagggagtgccttctggtcacagagataagagctaactagtaatccaactggggagccaaaccagtttatggtggacaaacaagtgaaaagaacacataaatgaaacctaatgctgcatccttgttttcatgactattttaagttctcatgattatttcttaaagactcaagtacccagaagaatatgataaataggaatacacaaatgtaaagaaaaaaatttctacccaaagtttaaaagacagggaaagctaacctagagtaaaactaacaagttaattttttctgtgtttactatacaaacaaaaacaacctttgcttctactgttggaaaagaaaccgtgggtttacagggaaaaggaagcataccttgatgctggtctcacatcaacagtcaccttccccagaggcattagaacctcaaatgagaatgggccatgtgtgaagattagggaggagctgctgcaagaaatttgtctgtattccagttctattttttaaataaatttaaaggaaaaaaaaaaaatttaaaggacctgatcatttaaaggatcaaaatgttcaacaacgtttgttaaaaaacccaggaggcttccacccacacggcaaataaattcaccccatttatcttattatttagaaatgtaccttcatatctttaaataacattcatattggcacttctcaatttctgtttcaggcctcctctattgtcttcccacagagagggatgatttaattttctttgcctcttcctagcccacacccccagaagagttaaactcttcttttggttagtcaacatttagtgttcacctaattatgattatgtaaatcctattcatattaaaacccagagacattactttgccaacaaaggtccatcgagtcaaggctatggtttttccagtagtcatgtatggatgtgagagttggactataaagaaagttgagcgctgaagaattgatgcttttgaactgtggtgttggagaagactcttgagagtcccctggactgcaaggagatccaaccagtccatcctaaaggagatcagtcctgggtgttcattggaaggactgatgttgaagctgaaactccaatactttggccacctgatgcaaagaactaactcactggaaaagaccctgatgctgggaaagattgagggcaggtgagaaggggatgacagaggataagatggttggatggcatcaccgactcaatggacatgagtttgggtagactctgagagctggtgatggatagggaggcctggcatgctgcagttcatggggtcgcaaagagttagacacaactgagcgactgaactgaaatactattcataactctgattatttttcctttctatttttctggagttaataattattttatttgcttgcttagctttctatgtatttttgcaatttcaacaaacagcttctattccagttcctcacaatttgaagtttaaaggtgtatgatttagtcaaaatcttattcactgtgatattctaatagtgaaaaagtaaaaatgaaaaaccaggaaactggtaaatccattacagctttccatatcatgaaatatttggttgtttagtcactaagttgtgtctggttcttctgtaatcgcatgtaccatatagcccaccaggcttctctgttcatgggatttcccagagaagaacactggagtgggttgctatttccttctccaggggatcttcctgacccctggaacaaacccatgcctccgacattggcaggtggactttttaccactgatccatcagcgaagtccctagcagaccttaaaatgaaggttaattaacaagtctagatacatgcaccaaactgagcctttaatttcatgtcattatatgtacctgcaactctattttcaatgagcaggcatttttataattataaaaaaaaaataatcataaaaagtaatcataaccatattttgttggtggttattcatttatggccagtcacattaaaaaatttttttccattttattcagttactgggaaaaaagtctgaattttttttttttcagctacacaaatttgaatgtaggccaatcatctcagatacctaaagagattcaactttggaagaaggaaatccagaattttcctacttccaaaggaaaatgctttcagaaagtgagtttaaaggggtgactgtaaaggaagcactctttaacttgaaccagatactacatgacagacagtaaaatgcttcatttagtcccaggcagcagcaggactgagcggcacctaagggggtgagcccagggaggcgggcctggccagggca

SEQ ID NO: 44488 - DNA, 1045 bp, Bovine  19866880200992
tctgtcaaacgctcccacttctcttcagataattctcactttggaaagaaactaaagcactcagttcagttcagttcagtcgctcagtcgtgtccgactctttgcgaccccatgaattgcagcacgccaggcctccctgtccatcaccaactcccagagttcacccaaactcacgtccattgagtcagtgatgccatccagccatctcatcctctgtcctccccttctcctcctgcccccaatccttcccagcatcagagtcttttccaatgagtcaactcttcgcatgaggtggccgaagtattggagtttcagctttagcatgagtccttccaaagaacaccaaggactgatctcctttagaatggactggttggatctccttgcagtccaagggactctcaagagtcttctccaacaccacagttcaccactagcaatattaaattcttgaagaaataataggacaagtctaagcaaaaaaatctcacaggatttggggtcaattcaggatgtgtatttgtctcagggctcaagtaatgtcttctctcatattgaagttattttgttgttattttgatttgcatttctcttcataatttattttttcatataggtttgttatgaacatttaaaatgacctgacttaaagaaacttattctttaagcagcttttcagttgtaaatagtggcaagtacttatctttctatccattcttattagtttgcatgatttgatgggctattttagaaatgataagttttaaagaacatagtaattcacttggtgaatactctgtgttgtaactttgcatttaaatctgtactttaatcgaaaaagagaagaattgtttggaagaggagaaatgaccacaagcacatggaaaatattttgttgggagtagtgaaatatagacctaaaatgtatttcaataatatgtagcattaatttaaaatatatgtgcactcagcattgatatatcctaaaagaaaaaaaatatcccatgttcttctcccatctgtttcttcttttgttttccaaaaa

SEQ ID NO: 44489 - DNA, 3090 bp, Bovine  19866880351341
aggaatgaagacggttgttaaccctctgatagtgaatcagtgaaggagttaaaaattggaccaaagacccctgtttccctttacagagctggtcattgtgtcctagttcgaagtatgagtacaccatcttacacctggaagaacttagtatgcttcttagtggagagattcaaagctcattaacttacaagcatgtttgtcacctgatggtctcgatgtgcaatgtctgtcttctatcataacctacctttttttttttttgccacattgtgcggcatgcaggaatcttagttcttagtcccccacccaccccccagggatccaacccatgcccagtgcaccagaagcacggagtcctaaccccttaaccaccagggacttccctttacctaccttcctgctgtctttttccagttcaccattctaatcggtttctctggctgatgacattgtcacgttggactgtggtaagggcgctgtatagttttcccatatgggcatgtcttgacctctcttctttgctaggatctcagctgttctcttcatctaaaacccaattctaggttatagtaactaaacttatcatggtaatcattttgaaatgtatagaaatactgaatcactatattgtataacagaaactaacctaatgttgtggtcaatgattcttcaaaaacgaactcattaaaaagagatcaggtgattacccgaggcaaggtggagggaggggaaagttggatgaagtcagtcagaagatacaaacttccagttataagataaatgagtactagggaggtaatgtacaacatgataaatataattaacactgctttatgttgtatatgaaagaataaatgctaagagttctcatcacaggggaaaatttttttctatttccttaatttttaatctatatgagatgagagatgttcaacaaatttattgtggtaatcatttcatgaagcatgtaactcgaatcattatgttgtacaccttaaacttatacagtgctatatgtcaattatacctcaataaaactaggagaaaaacccacttctaggttgctttcaaaataggagtatctatgagtggatttcattctgagcacaaacttcacactaactcggcactgcaaagtgatcctttagggccttttgatggagaacttggctgttgactacttaaaaaaaaattccttctgccatgtttgaaatactagaaagcagatgggatggggcgggggaagcattcaattaagtaatcagttcagttcagtcgctcagttgtgtccgactctttgcgaccccatggactgcagcacgccaggcttccctgtgtaactttatctttgaggaggaccacggcttcttctaaaatatagcctaaagcttatgcccaatcaagatagcaaaatatagcagagctatacagtatcttttttttcccctcgaacagcagggagataggtctgtttccgtgtctgccctgctatggagtatagtgaaagcgatagaaaatttagaaacaaagggacccggtttggtgttaacccgggaccaagtgtctaggaccacggccacatttgttttctgtttgcctccaacgtacggtgtgctgtgattgattagacttaagtgtacaatgaaccacattgggaattaatatatgtgactattaataaatagtcaacatttatgaaaaaaaccttattttacaaaaatgttaacctccacgatcttgacgcacgaaaacgccctttgggaacgcgcaagtaaagcgcgaccacagtatacttgcgggccccgccccgttggccccgcccccacggaagcccgcctgcttgctattggtcgctctccctgggccgtcggttgccgtggagatcacggctatggcaaccaggagaagccatactaggtcgaggctccggaaccgccgaggggccacgaccccgcgagccgctcatggcgctctatgagctctttgcgcacccagtggagcggggctaccgtgcggggctctgctccaaggcggcgctcttcctgctgctggccaccgcgctcacgtacatcccgccgcttctggtggccttccggagccacggtgagtctgccccccgcccgggccggtgcgcgctccgcagcgctacgtggctcccgcgcggcctccctgaccccggtctctgcgccccgcactcttgttacctcagggttttggttgaaacggagcagttacgaggagcagccaaccgtgcgcttccagcaccaggtgctgctcgtggccttactaggatccgagccgggaggcttcctcgcctggagcacgttccccgccttcaaccggctgcaggagggtcatctgcgcgtcccgctcgtctcggtgagtgcttcccgcctgcgcccggccgcgcagactgggctgcggaggggatgggcggagggcgcgggcgggctggaggctccggcccctgaatcgggggggcccggtgtgcagctgaaggagtcacgaaccccagacccgagcttctgtttcctttcctgggggcttgtttgttggtacattcggcttctccaagccgtcccccaccccggttaagctggctgctgctgtcagcgtctctgttctctgcagagtctccagcccctggcatttccgtgggcctggcccttcctgagggaatggtggtcgcagagtttgctgtgtgagttgcgttgttcatcattccctaagtcgtgtccgactctatggtggtggtggtggtggtggtggtttagtcgctaagtcgtgtctgacccttgcgaccccatggactgtggccaaccaggctcctctgtgcatgggattctccaggcaagaatactggagggggttgtcatgccctcctccaggggatcttcccgacccaggaatcaaacccaggtctccggcattgcaggcagattctttaccaactgagctatgagggaagccccactctgcgagtccgtaaactgcagcacgcaaggcttccctgtctcacttcaccatcttcctgagtttgctcaaactcatgtgcattgagtcagtgacgccatccaagcatctcatcct

SEQ ID NO: 44490 - DNA, 1819 bp, Bovine  19866880490145
ggcagcctgtctttaccagcttgaggcccggacccctctctgtgtacctgctggccctggttttactgagtcctgcgtggaggcatctattgtggcctttctgggcttagtgacctctgatgtctcgagctggctcccagactgctgggttgacaccccccatctcccccgacacgtagtcaggcccctgtttagcccatgtctggacctcctgctcgtctccagtagtgcagtcaggtggccagagctcaagtgttcctagtctcaactctggagccagtgcagctcggcttcacggcagagcacgctcaggtctcctctgctgcagtctgttgcactgctaagggaagccagctgtcctcccccgcgtgcctagctggagcagtgtctgttcacggaggcttcttaggcaggacttccttggctcccgatacaatctgagagctgcttgcactacgtgcgaggagagtagcttccctttgatgacgccgatgcaggtcttgggcacaggtttctggcgggggaggttccataggaatcatgtcaggttctagctataaatcttcagaggccagctggaaggaggctctcttccccatctttgtcctccattcccacagatgggctcttgggctcttgtttcggttttctcccctgcccctggcgttcaggaagcattgtgaaagcactccttgggagctggggctggcttctgaaggatttcctcagagtgagggtgcgtcagatggtcttgccttgagataggaggctgattctagtctaatccccgattccccaaggcttaattacttttatcaacctcccaccagaggtgttacagagagtagctagtttaagtagtgggctccttatcctcaaaccatttttctcccaacagctggactcagtcatcaaccccagttctcagtgttctttctttgtttctctccttcaagcctaactatgggacagctttacgagaaggaaaaagatgaagatggattcttgtacgtggcctacagtggcgagaacactttcggcttctgagggccggcgctgggctggtgcagcgctcccgctgtggatcttgtaaatagccggccattttcagttactctaccagaacctcttcacatagacctctcagtgcatttgtaactggatttacttcttaatatattggaaggttttgtttccttagactagtaaattatcctgcagagttttattttgagtttttcttttgtgcactgtcctcatggctgtaccctccagagaacctgttcctctgggaatcttatttaatgaagatatttccatattgaagtgagggaggtgggaattaaagtgaaaggggagatgatgcatttattctggattatgtttgaagtgttagatggtgaagtgttaaaagcatccaaattaaatccatagcaatcagaacacttgctttactagattttgccaactgccagtcatggtggactgagctaatctgttcctctttctgaaactattaaggtaaataattaacaataaaacttcctcttataaaggcactgcagtgtgaccttgtcctttattcaccttgttttagatgggtgagagaaggagctcctacgtccgccaggccaggaggagggtttgtggggcccacggcagaacagctgagcacaggaagcctctgtcaggagggacttgttttaagtggtcaatataatctctaaaaaggtatatgtcaagaagtcctttctcccactgctgttttctgactaccctaaccctccaccttttggggaacttcttttactggcacatt

SEQ ID NO: 44491 - DNA, 636 bp, Bovine  19866880581278
tgaactcccgcgttgtcatcagtacccctccccacacagtcccctcaaaccagtcacatccctcagattgagccctgaacctgcagtcactccaaagaatcctcccgaaagtgtcaaagccctaagtagaccccttgccatcactggccaccagagcaccctcttctgtcactgaaacctacaaaattgccctcttgtcaccaacgccccagtcagacttgcctattgaacagtctcctgtaagggctctatcctatcagccggacccttgctcacctcttccctttactaatgtccaccgagaccccacgcctgctaccagctctcgaatacccgctccgcagtcatcagtatccctcacatacctccctgtcgcccactctatcctctcccggcgccgagagcccctctaagcccggctcctgccccgccccttgccacacggccccgccccttgacgcggagtcccgcgagtggcgccggaagccccgcccctcccggttgctaggctccggcagccggaagtcccgcctgccgtgtatcgcagccgccgccgccgtcgttgttgttgtggttggtgcgctgagctccgcggctccgagagccggctgcgtcccttcttcgccgccgccatga

SEQ ID NO: 44492 - DNA, 1709 bp, Bovine  19866880587477
cccacttgcacacacacaaagttttgtagaaaaggcataagtaatacatcgtccaactactgaagttcagtaaaaaaggaagcactagaggtcactcttacaatggaaagcacatcatgtgaagcgtccttcccttaagaaaagcagagctgaagtctggcctagaggcagtgttgtctttacagtacactggctgtttgagtttataatcagttaatgcaactgattgggctacttgtttacatttgtttgctttcttgaagtccaataaaaggcagaataacatccagtagctttctttgtaatgtatcttcttcaaaggaaagatgagctgctgagaagatctgagaagagtagaatgtttgtgggtgcttaccgctggttgggcttatttttcaagaagttgtttaatgctcttttacacattcgataaacgtaaagaacctataggttcttaaattcttagggacttttaaatattaaagttggaattcttggttaccaatatattttcagagttggctgttcttgaagtgtcataaatacaggtaaaatgacttcagataattaaaggtgcagtcagcaatttcttattcctatcacattgataatacaatttgttgcaatagatataaaagaaaaattcatttcccaatttcatttcactctttaacatttggtattttggtgtgtgaaggaagcaaggtctacatattaccaagtcagggtgcttcctgtgttgtatcttttttggaggaacaagtatacatgtttaccagaaagggtgaaattcagtgtgtggacaagtgaccatcaaccagcatgccagcatgagtatttttaaagtattgtaactccagtaattcttttggacaagacttttatattaaaacacgaatcaatcttgaacaccaatattaaagtcagggagaactgaatggaaattaagaaaattaaaggtcagtctctcaggtgaatacaaagacatggaacagctgattccccagtaaccaagtctgcggtccattgcgtcggcccaagactgcctaaggctgccagtgtgaaccttggcacaggacagcgtctctacaccagggacagctccgggatgaggcaactttaatttgaatgttagttgatgtaattaatcaacaggatgactttacattagaaggattccgtgcgaacactcacacagatattcatgtccatgtgtatgtatttgtgtgtgtgaacatatgtttatataaagatgcagaaaccgctgggcccacacgcttccacatctttggtggcttgcttctcctcttctacctaaagatgaaatatgtggaactgaccaccttctttgcctactggcaccgtacttgacatttcagaagtgttgaaccagccccaggtctttgctccttgttctggtcaaggtgtttgttattgtactgaagggctccctccacgaaagtttagagacagactcttctagaagggcttgtgctttgataagttgcacaggctgttattggtttcctcacttgctactaagacacgtgcactgagaagggagtcatctattttcaaattgctctcatgaacccagttttcttctgagcattaagacattgttaaggagcggggcgttgatgtggtggaacagctgttagtcttgaggcaagttaagagttttgctttttactcctgcacatcatgtg

SEQ ID NO: 44493 - DNA, 950 bp, Bovine  19866880603650
tttatatttaaggttaagttctgtaatcaaatccgggtcgccatcaaagtcagattccctggggatacccagtcccttggctggatcccccattctgggaagcctgccgtggggctcagaacctttacaatagtgggagaacatctttggtattagcgttctccagtatctgggtcactcacctggcgagtgtggaatctgattttatcatgattgcgtaacccctaccatcttgttgcggcttctttggacatggagtacgagggcaacttcaagtgcaaacccctactggtgtacagagcttcaatttcaccagcacttgaccttcaccggaaaagtgtgaaccatttgcagtccattggaggtggaacaaaaaaggctggatgacatctgattgattccacagctgtttcaaaccagaagttgaatactatctctagggcaactttggcttcaagattttgttaaattttgcataatgccctagtccactgctgtgaagaactcaaaaatgcccacccctatgtaaaagttcttttcacgcccccaaatactaagtctctcatccagcccctggatcagggcataataaatgtcttcaaggcacagtacacaagggagctttgtaacaaggctttcgaagttctcaaagccaacaaggaaactaccgtgatggacgaactactggcagtcagtcactatacccaatgtgattatgttggcacagcctgggacaccaagcacgagcctgttaactgttgggaaaatgtttggccaggctgtgtggaaaatttcgaaggctttgaaggtgctgcagaaagaatgaagaacagtgtcaaaaacataatgcatgctgcacagcaaataagtgaaggctttggtgacatgaaggaaaatgtggaggaaattcggcagagaaagcaatagacagtataagtcagccgaagagt

SEQ ID NO: 44494 - DNA, 1393 bp, Bovine  19866880604028
ggtaataattttcttccccgtttgggttgcctttaactctcaattcaaaactatattccattgattagaaacatacagaaatcaaactaattattcacacacattttataatagatataaagccactttatactttgcctttatgaatgacaacttaaagaggcttacaggtgatttgatcacctaagccaatttacataaatgcaatgtgaggagggctttatactgccaaattggatgaggtattttttttagtttgcataaagtattctgcaaatggttccattttcttactctgtatccaagatttctcaaaacagaatatctgttggatttacattctctgtgtgggaactaactgatggaactgaatgaaggattcagtgtaaaagatgagcctcactgagcagaaacaggcatcaaagtgacttgccttatcagaagccccaaatgactaatctataataattaaaacagtgcgatgctggcataagtggatcaattaaccaatttacattatctttaaagagactcttggtatgatacatataataaaatgaaaaggaatagattattttaaaattcactgggctaattatctatctaaacaagcacacacacacacacacatgcacagtacactccttggaatttttatcaaacctcagaagaataaatattctgaggtgttgtaagtatctatgcttatgcttatacttcaattgtagatatcacaaaagtctacaagtatattaagccaataaataattaagaaagatgtttataatttttaaaaaatctccagaggaaataatcagtcctagtgtacttaagccttccctcatagctcagttggtaaagaatctgtctgccgtgcaggagaccctggttcaatccctgggtcaggaagatcccctggaggaggaaatggcaacccactccagtatccttgcctggagaatcccaaggacaggggagcctggcaggctacagtccatggggtcccaagagtcagacacaacttagtgactaaaccaccaccagtatacttaaccccacaaaatataacctctgtacatcaaaggcactgcagaaaattaaagatcaaatgacaacccaaggaaaacatttagagcatttatgacagaataatagttaatatagagttatatttaaagtgtgtatatcatacaaatcttgagaaacaagagtaaaaaatgaagtaaaataggaaaaagatttggatggaaaaagatttaaagaaagtggaagaccagtaaatgctaaactttagaaaagataaattatccagtaataaaaatatgtatcaattaaacaccaggctgcagtgaacactcagtctttctgcagactgagtgcattgtggaacaga

SEQ ID NO: 44495 - DNA, 3503 bp, Bovine  19866880662633
tgattttgcagtgcgtttcctcaggcacttttctgcttctaatccgtaaaacccagagcacacgaattctttcttttttttccccctggcatgtcttctatgtcgagccaaagaacaaacaaaacataagtaaaacaaatgaacaatcatcatcctaataacttctttaaattcaatttaaaatttgtctaatttagagtttgtgggatgccctcctcgtttggaaaactgggacagatgtttgccatacactgttgcagtcaatcttaccgcagcatctgttcactcctttgcgtgttttcctatcctctccagtgcatttctcttgtggcgaaatagtctttgtctttttaaacggttcttcataacttatcaggtggatgtgctgttatttaaacattaagaaccaattggttgttcattgatttttaaattttcttaggttgccagtgtccacttctagtggtatatggctatctttaagatgcctgtggttctctaagtatcttaatccatttacctaggtcagtgtcatgaagtgctcaatgtctttgtcctactttaacaaaactctaaatttattttggaaggcgaaatttaaagcagtggctgtcttacacccttctcttccctgctcaagaatttataacacttaaagacggttctgtgtctcttccagcagtatcatttgttcagacatgaatcagaggtggtgggtagagatgccacactgacagatcgcagaagctcatctgtcaccctccgggaaacctgctcgctcatcagttggtcttgtcagtcacacacacagccgtgtcgtctctacagccttccgcggcatcaccaatcacccctccgtgtgtcccccttgggagctcggtgcccctggcctctgacgggctgctgcgagtgcaggtcttcaggtatcaccatgagcctgatatctcctccagaaggcacaagtctctgtttatgggaagaacctcttaactgccgtctcacgcctcacttgctactgattttgattttcctctggcatcttttgagttttgtcttccttttaaaaatatctgtaactttttccatctttttgagaaaattttaacatctcaagaagcattaggattcctccatactgtcgttctctccttaattagcaaaagcaacctatatttaaaaatgaagaccacagtgaacaagaaaagcttaagatttacgattttgaatgagaactctgtttcccagagtggatatgattctgtgaaaaagctgatacgtgtttgaatggtgttcattgatcccagtctctttctgaaaaagaaaaatatcagagacattgaggacactttgtgtctcactctttgagtgttgaccctgtttatctagcccagctctctttaaaaggttcatcttactttgctcaagcaatacactacaccttaaaatttttactctattgaacaaagcaatgagatcatcattttaatattatctttgatgtaacaatatcaatattgatgagctctctagttctaggtacaaccgtcttgaatgcttcccagttcttcatcttcccaactgtacaagtaaaaaatattaagggaaaatgatttcctagggcattaattaattggttctaaaatgagtttcttcttagtttgtacaatctaccttttgggtggacttaggtgacctgcacttaaggcaacctttcacaaaatgtatcttcatagtgttatggctatatgcttggaactatttggatactgttgaaaataaatgtattcaatcacccatttcatctgccaggcaaataccaggtgaaataccacaagcaaatgggctaatccaagaagtgaaatctattgtatcttcttgaaagtgctgtgttgttgtttttttaattaaaagatacgacttttatgatgcctggaactgagagtagcgtttttagcagagtggttggaactgaaagttgtgatcagtttttattctttatgtctttataagacaatttcttctgtcttacattcttctaaaagtaggagatgtaaactgaccaagtcccagtctgcccagcagttgccatttcaggggagcttcctgtgcgacgcccagtaaaagaaatatcctgttaccctggagttaccgtagtttggagggcaagtagaataggcaaagaaattatccattcatctcctcagcttctaaaattacatctgagtttttgttctagttaggcaggtgaaggtaaaatcataaatgcctgccactcagggacccaaaaccttttgtggaagacagaaagacatacctgaaagtaattcagatgaaaggcaggctctgatacatacttcacttcaatctagatttctgatgtaatgccattatgatttatttggtaacttagtgtgtttcctctcatttccgttaaaaatcaatatatgaccggtaatattattggagttgataagagatgagttattatatttttttactgactgtgagtttggaaatttatctccgtaaattacactgggtgaaaatgttccatattaagtgaactccataattgcactctttgggactctggctgtttttaggttggcactgatgatttagagaattatacctaagaaagaaatactagctaagaatattataaaaattcttagtgaaataacatttacattggctggatgtgcttggttgcatacaaacaattgcttttcactgggttgggtggttgttcattcagtctattaaagtattccttgctcttataattgttgaagcttcttctgctcacctcattcacatatttactcagtgaatatttagtgtgcctctgcagtgtgctgcctatcattacacatgtcttcagcatcagtggttttgaaatgttataatggtcagaatcactaacttcttgctgacaattgagaatggaagttttgactcctggattcatgaagcttttgaaaccacgttttatgcctaaggttttgactgtcttacaagaaaatgtacaatactgttcagggtactcacaggatggatgttctgtggcaagcagtgtgctcagttgctgttttggctgactctcaaccagcccacgatgggctgacgctcagtactgccatttgctagttctgtagaaaagcacactagtgtgtgataggcatgatgagagagaggaatacaaggcatttgggctgcttataggcagagcatcagagaaagctatttcttgaacaaatagaagagcctggagggggaagtgggggaagcacatttcagttagaaggagcctcacaaagcatggagcattggaatgcaccacaggcagtccagaaggactggctgaaagtgaggcccgacagcaggtaaaactaatgaaatacatagtcatgaagcatcccaggtgacgagtcttttacataaagcagagacctcagtattctccaggggatcacattattgttagaagggttatatgtaca

SEQ ID NO: 44496 - DNA, 1820 bp, Bovine  19866880689906
tgaagtattaaaacagatgtctttaaaggaatgattgttgataatttataccttgatcatttgcagatacctttccctgcccaaattgcattttgaccttgttaatttgttgattggaaaattgcatcccacttcttacttctcagtaggatggtatgtcaacggttcagtggaattctttaggattcacagttcctgaattgtcttccagataaaattggaagtgtggtttttctcagtgtaaaatatcggaatggtagctagtctttcagtggacaccttctgaaagctgaaacaagacagagccacgtgtgtactgatggtactaaagtctctctgatgggagactttttgaagcagatcccagtgtaaaactgatatgagttgggtattcttattggtgcgctgattcctcacctggccatcagacatcttctgttgggacatttcatgttgccaccgtgttctctgtattggagctccactggtctttgcaggggcaggagggcctggcgagctgactgctctctcgtcacttcagcacactttgtgaattgttctgtcctgccacttcctgtcccacagcagttataagtatttgaagtgaccttattcactcaggctatgtgtattttctctctcctctcactagagtgtaaaactgcatcaggtcaggggctgtgttttccttcttaatcatcctgtcaacagtgccaagacaggccttggcacaaattgagtgatcaatacaaaatcattgattatgtgagtgaatgaatgagggtaatattacctgatgtcatgtccatcgttgtcatcatcaatatcagaaagaatttatttaaagagtatctatggttaataatacattattgtgcgtgtacattaaaatattaagaggctccatctcctattaaatgttctaacccctcgcaaaccaacaacaaatgaacaagaaactcacgaaagaatacaaggagaattttggatatgttaagagctttggtgtaacaggtgtgagtatatgtccaaacttatcaagatgtatacattacacgtgagtgatttttttgaatatccattatgtctcaataaagattaagaaaagatgcatttgttaagcaggaccacagtattgcacaaccccagtaggctccatgtgtgtcaaaggtcaggtcttgtgcaaaagagactgaaaccaagaaagacctgattaaatacaaacttgttacaccaaagttgctcatggataatgatatatgaaatcatctcataatgaatatctctggatagttcagtaaataaacccctgtggggaaagacccccatggatccacctgtaactgaatacaaatcttgctctgtgataaacagcatttaaggcaaagagccttgaatctttgaattctctaagattcataatcacagcaaggaacttttttttttcatagaaacaagaatatacataaagtaaatttttttttatcaagttgggattaagtgctatctaacactaatttggagagagagttatatttaattgactgatttggatagtataaaatggtaataattgttgaacatggaatttaaatttcatgacttgaatttcttatgacttctttccacgtgaggattacctttgcaaatacagcataatagaaagcttttcaggaagcttttacttgcattttctctctagtgtgttgatgttgaattcaggcgttggtgacttaggagggcacaatgagaagatgaatgtgcctcccctcgggaagtgtctccagctactgactttgttctttccctgaggctgaatg

SEQ ID NO: 44497 - DNA, 1299 bp, Bovine  19866880694569
attttgaatacattattgtgcttagtcctgtgaaagcaagcatttccccttttagttgatgaaatagtctactgtttaagcacacagtggcaacatccaatagttttaacactttaacaaaatagcttcactgtgcccacactttatcaagcccaggaagcatagatgtatttaagagaggagaggaccaacagaatgcaggataagaactgcttgaagttgactttgaatggatagttgaatacgaaacaacccgcgttgtcattataatttatttaatccagagcatcatctagcggtttactcccggtagcttttaggagtttaccttcaaaggtacgctgggttagtattctttcatagggtatagacatgaccaacactgagaagaatgactaatgcttttccaaaagtgctgaatgctgggtccgcttggagttcatcttggtgaaaaatattctgatcactgaaaaactaaggcaaagtgtgagtcctgagactcatagcagctttaacaaagatagcatgagtcacatttgtcattcttagttggaaattaaaaatacatttgacatttttgtgaaacaaattctatgattttttttttgtcctgaggaagagtaaaacacttctcacctttcctggccatctctattttgttatttaaatataaagagtaaaaaatattttagaccagctactagtggggacttggatagtgctccagagatggcaatcaacagagattcagattaccctgtgacttcagtgtttgaaacatttaaaggagaaaacaatgtgaaattaggtaaactagcagcatttgtaacagagggcagtttacacagttcatttaagacagaccatggagtcaataatgtaatgctctgagtttttgttggaacctctctctagcttttcataagctcatctctgctttgcaataatttaactgttttttccctgctacaagccaatagggtatatcagcaaatgtgcagataatgaaaaatcaatgcactctgtcaaacgctcccacttctcttcagataattctcactttggaaagaaactaaagcagtcacttcagttcagttcagttgctcagtcgtgtctgactctttgcgaccccatgaattgcagcatgccaggcctccctgtccatcaccaactcccagagttcacccaaactcatgtccattgagtcagtgatgccatccagccatctcatcctctgtcgtccccttctcctcctgcccccaatccttcccagcatcagagtcttttccaatgagtcaa

SEQ ID NO: 44498 - DNA, 1799 bp, Bovine  19866880698916
ccggggggttggctgtgctgggtcttcctttgcggcatatgggctctttgatggtgtgcgtgggcttctcttgttgcagagtatggactctagagcactgaagctcagtagttgcagctcgcaagctctcaagctgcatgtggatcttagttccttgagcagggatcgaacccacatttcctgcattggaaggtggattcttaaccactggatcaccagggaagttctggtttccatctttaaagattagtcaccttccccagaaatgagtttggcaaatgtcaaagttgcagagagttggacacgactgaagcgacttagcatgcgtgcatgccttggaaaagggaaggaaatggcaacccactccagtgttcttgcctggagagtcccagggatggaggagcctggtgggctgccgtctatggggtcgcacagagtccgacacaactgaagcgacttagcagcagcagcagagttgcagagggaggaggtgattcttctgtaaactgttcacttttccatgcccaacaccattgacccttacctgaataatacattattttaaagggcaacaaaaagaaatattgttttacctgacaccaaaaacaattctattaatgtaaaaaccatcagattcattatagaaatccatgaattaatatccctacttcttatcagatacatatctgaggtacagtttgcacaactgttgatatgacaagaataaacacaaagaaaaatgcttttaaaacctcataagccatgttattggaggtttttaacctttttgtttatttccatattcctgtatgtatactatacacagataatattccttattgtttaaaatgagaaaattaagagcaatttttcattatctttcctttttctgttatcagtttgttactctattaagagttttgaggataacttttgttgaggcatcaaatcaaactaattactcagagatagcttaaagataaagtgaataggtccaaagataaaaagcgcacccacattctctggagaaacctctgttgatcagatttgaactgactcttagcaataacaaaacaacatcctgaaatagcaacagacaggaatacaaaagatagcagatcattcatggaagggtcttcctttgagatcactctcaatttatttctgaagcttaggcaacaataaactgctctttctccccatatttgcagtagcattaactccaagtccccaccacaataggatggtgttacaatcataaattcttttcattaaaaagctctgattcaactctgtgggggaacacactgtatatggaagtttagttctcaattctctctcaaaaaaaatatagcaggttccaaggacttttcttggacttagtagctgcagacttacaaaaactagctctattcaccatcttaagagataggtaaaagcaaacagttgtaccttgaaatttataaatttagtattcatgatagacctgtacttatggatgagacacaggaccatggctggcagtgacttgtaattttgttgaggtgtaaacccttcaagtacaacagtgggtcattctccatctatcattggatttacaaggtatcatatgaagtaattaaaagtctgttacttcatctgaaaaatgaccatgtgggaagacggagaaccaaaataaatactttgaagcagctatttgtgaagaaaagattatatagaagcaatgcacaaatctcaattacacatatggtcctagaaccaggaacttgtaacactcggttcatgtttgtgaaatccta

SEQ ID NO: 44499 - DNA, 1255 bp, Bovine  19866880721403
tgcctcccttgcaaggctcccacaccagacctagctttccagatcaggaaactccatcagcaacggcctcctcgaggttctccaagcaagtgtcattctcccatctcccatcccaccctgtgataaggtatcctttccgcccggagtgctcttctctgagaaagctggggctaacatcattgctaccatcaggtctgctcagatgtgatgctctcattcaagcttgtatctcctaaccttccctattaaaattccttccacccagcagtcctgctccaaaccacttcatccaaaccagttttcttttttttttttttttctggccagacattgacatatttacacataatttcttatttactatatttctttatcatttatcttgccctattagaatataagctcaacgaggcctacagtctttgcctgttttgttcaaagatagatcctatgtgtctagcacactgcctgacacatggtaggagcttaacaactattcaatgcataaaggaattaagtaaatctgtaatgaaagtagtaagactgtataaatttatatacaaaatctgaacatattatacctagtggtaaaagctaaaactaaataagagcacaagacacttctctttgcaaaatggcattttcaatgaggtgttcaaagagaaaacttaaagcacttggctgagacacacatccacacacacacaggcacgcacatacatacacacaatgtctaccaatcaccccaaaggtacctagcttaatcacttgtgaactattatttcctagatatatttattgctttgttttcagctttttttgatacagtaaaaaaagagacgcttttcactttatttccccagcaaggttctaaattaataataccttactaaattctcctaggttttagtgctttgctgttgatcaatttttcctcccagcaaattggcaggctgactctcagccctacttcttgcattgccagatcaaacatttctgaagtctttaataattcagtggattgatcagtaaatatttacatcctttctctgctcaggcattttgattggtatatttgatgtgcaaatttggggacagccaaatttcatcttagaagactagaataaaattgcaaaaatgccaaattctgtgctttaattccactacagtcagttttatttcactcaaattagtagttttggaaaaattactctgagcacatgatgtctgaaaattcagatggtaatcaggattt

SEQ ID NO: 44500 - DNA, 4396 bp, Bovine  19866880722076
ttctacagcatacattccaattcttgttcttagagaagcataaaatacaggacgcacaccaaggtcattagcaagatgctgttttagcagagagctacttcagtcaagtactattattgttcagttgccaagtagtgtccgactctttgcaatcccatggactgcagcaccccaggcctccctgtccctcaccatcgctcagaatttgcccaagttcatgtccactgaactggtgatgccatccaaccacctcatcctgtcgccctcttccccttctaccttcaatctttcccagcatcagggtcttttctaatgagtccgttctttgcatcaggtggccaaaatattggagcttcggcctcagcatcagtccttccaatgactattcaggatttacaatggactggtttgatctctttgctgtccaagggctctcaagagtcttctccagcatcacagtttgaaagcatagttcaatcaagtatagtttgtttcatgtccaaaattccatccatctgacatagaagagatctaccgctctggtagacggcagtctttcttcctgatcagccacaagaaaatctaaggcctgttcagcatgtaggaagacagtagtccaggatgaatgaatggaacacagctgttgctcatttaaactggtgatagtctgggggggtttctgatccaggatccaaacgcctgcttccggagcgcactccaggcctgctggtacgtggacgcagcctccttgtactcttggtacgtcgctagcttctgcgccctaatgcacacacaccaccaagcacacacgttctcaatggacagctcaccaccgcggccagagagatacctccgcaactggccagacagatttattaggagagtcttaggaacagaaggattctgttatgctgtcctagagtgactcttagctcctttgtaggaaattcactagaaaacaacatgggattaaaataggtaaaaataaacagtctgtttttttttcttttctttttttggtcctggtggaatcagataaaaaagagtaactgttatctactacttggtttaaagttttctacatggctataatcttcactggtaggatccagccgttagacacttctcaactgcattttcccaaagtacttttcatcttagtcatattctcctttgtaatgaaagccaacaccccttcccaaatccttcagtgtctctgactgctgaagaatggctaatgtgctgagtaatgtaacacttaacactcagataaaaagatttttttgagacaaagattctttcctttgatcaaatttgagtcaggcttctcaaagtcctcttcctgacccagccccgaccttgaactacgtccttgtcatctcacagctgaagaaactgagactcgcagctcactgagtcaggttttaccctgcttctactctttcgttctttgcaaagatcttaggagacccctgttgtttcttcactcgctacagcgcagagccgagttgctaattgtagcagacactgattctagttctttgatcaatttcccatagctttttggtggttaatggatgggagctacacgcatgacaaagttaaactttacctgagccctcagttcctaaaacaagcgatgagttaagaaacctccctcctgtattcctgtgtgtgggaaatggcagactggaaagaatcacctttcttcatgacttaagactcatgggtgcccccctggtttacctgtgacaaggccagacacaaccctccaaacacctgttttttgtctcttactgattagctgaactgtttgtacccactgacaaaatctcatcaaaatgcctgataatttgaccaaatattaattaccagttatgcttctctccttcctgcagaccccaaaacttagagccactctttctgagccggcataggcaggtgtaccaaccctttcttttaaaagcccctcctgaggactgacacttcctgttcaatggtcctgtcacactacctgctcacctcactcccacatttccagctctaactttgcttagacaaaacttctcctttgcgcctgctcttcgagaggcttacagaccttaagattgcgatgctcttgctactgcattagtccttctccacctgctgaaacaggccctgtctcttactgcaacaaagccttcaaatgacgtctctccttacctaagtccagatttgtttttaaggcatagaatgtatagcaacccacccagttccaatctgactgatttttccagacaagaaacaagcaaactgaccatggatggctggagggcatcgacaccgactgcaggatacacgatgccgcaaacaggcagcagcctcttcatacgagtgtccagctactccctggcttccccactgttgtataaagaaggatttggctggtctttgttgccacttcctaggagggaacctataaactttccgaacttccttggtgataggagtgtctttgttattcatggtggaccctttggatctcaactttttacttaacgaggtgactcatggtgggccctagatagtttcaggatgggctggctgtggctgagagatcagccatgagattacaaagctggggccctgagtcatctgctatctgacatcctggggtggggagaggagaaggtggagattgagttcagtcacatcgtgtggccagtgattccataactcatgctggatgaggaagccccagtaaacactgggcactgaaacgtggggcaggttcctggtcggtgacagacagtgatgtgctgggcaggtgatgcctcctggggacacagaagtagcaggccggatacctttgcagaccttgccctgtgcatcctgtcttttatctggcccttatttgtatcttttacaataaaaggcattcaaagtatggtgctttcctgagttctgtgagtttttctagtgaattattgaacctgagtgggtagttggaacctgagtggctttggggccccctagattgtggctggtgttaccaagtgaggtcagtttgtgggcactgtgcccttacccagtgagatttggcctgactttgttagcgtctgaactccccccacccacctgctcatcaagtggttttatagtctctacattcctgtttggaaactaatttaagtcctcgagctttagttcacaaccactgattgaacaaaagaaaaagagaatgatattcccaacagcatacactgacacctcagcgctcacattctcacagtgctctccacctggagttggactaaaggagggcctgagatgggccgggcccaattccacccacaggctctgtgactctgtcccaccaactatgtccccatcacatctcagatcacacacatgtctgcagctatagggactgaagagcatgtggtcagtactaagtactcattggcctactgaaacatcactcctgccaaaacttccagccattcataaatatgaaaaatgtaggtcaaaggcatcacctgagtgagtctggccacttgtcctctgaaatactgcttagcagcttctggaatgatctaaagagctctactttgctgattcgggatctgtttgaaaaaagatcaagaggatttattaagtgtttaatatgcaccaggccaccatcaaagatattgggcttcacatggtatctttctaggtctgaatgtcctgagcccccattttcaccaatgcttggcaagaaaaatccagatctgagagtctgattaggttgagacacaaaaatgattctcatttcataaacattatcagcagtgaaatcatcaaggtgacaggctgaaatgggctaaacgcagagggaattactaaattctgcccccaaggatacccatcagctgttatttggctaccacctttcaagggagctggcccttgggtaacactgcttacaagacattgaaaggtttgtttcagagacttgagtgttgctccctatatgaactgtggttataaagtccattcagcccaggcacctgaggaagaatctctagattcctcctatggggattacagtccttgggaggtaagtcctttgcttctgaatcaagcttcttgatggtcatagtttgaagtagtgaaggaagtcagtgtgaattccttaccagttacttgggtcttcctggtttgtctctttcataacagctggggcctagagtgtacgtgcctccttcctttccctaatatacacaattcatgggctgacttagaagctgggaagcgttgtgtgtgccaacaaggtacagtcttattttacgtaccatacccgtctcctccttgaaaatcgtaccatcagctgagacacagaggccatcgctggcatatactaaacagggaa

SEQ ID NO: 44501 - DNA, 1544 bp, Bovine  19866880730629
cacaagagggcttgcaaatgggtcacataatcactgtgtcacatccaaacccaaaagccctatggaattgcttccatctcaatgtgtctaggactctgcatttttcaaagcaagttcatctattgtctttaccatcactagcagcaagttaagtattgttattaagtccactttatttgtgagaagtgtgatgttgattgagtttatttcttacaactttatgaggtataattaatatataaaacccacatatttaatatgtacaattagatgcagaaagagtgccaatgtctttctcatgtgtcaagacagcacttaggaaaggccttctgcccttttctttgtgggaaaatcagatcccgtgcataagtgcatgcgtgctcagttgtgtccaactctttgcaaccccatggactgtagcccaccaggctcctctatccatgggatttcccaggcaagaatactagagtgagttgccatttccttctccaggggctcttccaaacccagaaagcaaacttgtatctcctgtgtctccagcattggcaggcagattctttacctctgagccacctgggaaccaatcagatcccaggagtgataaaaagtgatctctgattctgtatgttcccagaagggtgctgggactgaaatgcatacaaagggataaaagatggacataacatcaccaggacaaccaatagggttaaactgagtttttaccggattccccagagcagcaggtaaacacataacataggcttagagcaccccactccagtacttttgactggaaaaccccatggacagaggagcctggtaggctgcagtccatggggtcgctaagagtcggatacgactgagcgacttcactttcacttttcactttcatgcattggagaaggaaatggcaacccactccagtgtttttgcctggagaatcccagggacaaaggagcctggtgggctgccgtctatggggtcacacagaatcggacacgactgaagtgacttagcagcagtagcagtagaatgacaggtgcttctctgtacagtcacagggacataaagtccagcggggaagactggtcttcttggacccagattcctgaaaacacctgcctgcctatggagcgcctcatcacatacaggcagtgtcactatctaaggtcacggaaactgcccctccagaagaaagaaaactcctgaatctccaaattggtaaagccatcaccatgctgttaaatcctttattcttcatctacactaaaggaatctgtgtcctttgcctgtctcttgatatttcactgccaatcatcttctcccttgtgaaaaacatgcagagaatcaaaaagcaaataaatagtggatttggtagttcagaaattccaattacacatccaatacccttctgctgtctccttaatatgtaaaggaatcccataatataaactttataaatcacagaactgatcccagagtttataatcagaaaataataaatgctttaaggttgttgagggagttctttttctgattaggat

SEQ ID NO: 44502 - DNA, 878 bp, Bovine  19866880752863
taatctagtgggaaaaagcggaaatactgactgaaatacttgaacagtaaagcttatcctaggtgaaataacgaactaattttaacagcccctttgtggcgggtttaagttttctgtctcacacggcatattgagatgttttatttttatgtctttgttatggtctaggatgatggactggttttcaataattgctatgcccctccttcttcagattcatgtccccctcccctctcttttagggtcacagtgtttcttataaaatttctccttagagaacatagcatgaaaacaacctctggagacagatttgttttcctgcctgctcgaatgagagttccttggtggagagctgttgctgtgttcagagaggcttcgggctaggatccttggaggcagaggctgagccttcagggctgtgtgtgtgctaggtcaattcagtcatgtccgactctagattgtagcccgccaggctcctctggccatgggattctccagacaagaactctggagtgggttgtcatttccttctccacggaatcttcctgacccagggattgaccctgcatctcttatgtttcctgcattggcaggcgggttctgtaccaccagcgccgccttggaagcccagggctgaggctcacccatatctgcctctcccaggtggagggctgccattttgcaagaaaaaaaacagttttcagtgaggaaaccctgcaggaagccaagcggagctaatgaaacagagctcattggaaaaataagaaggcttttggaagcttgactgagaaggggatttgaagactagcctgagggggttttgccttattttctgtgcgtattctctcctcatctcccgtctagatatagaagttccg

SEQ ID NO: 44503 - DNA, 734 bp, Bovine  19866880772063
tctatataatcgtctattatttgccagaagataaagtgccattgaggcttgtgtaatcaaaggcaaatggttccaaatctaactttagcattggctggtgttaaaatgttgaaagaaagagcttttcaaaaataagataaatgtatatatttacttccaaatatagtcaaggtggggcttaaaaaccacagtctttcatgtgtgaatatgattttattgacgtaccatcacaggggtatattactggaattctgttttgtaggagtgatggatttttcttcagatatttcttcagtgcagctggtgtgctctggtgcagttgtaagctttaagtgattcttcctctggttggtcacaatttttcttctttcacccagtcaatatttatggttcagacagaaattcagagtcacttctccagggacagtttctgtgacctcaggactggattaggccccttgagtggataattggagctgctttacagttttcctcagctctgcttcttacactagccaggtaaagtttgtgtttgacatgacttgtctgcctcacacaactgcaagctccaagtctgctttgctcaccgttgtaaacacacttctgaccgcagctgctgaaattctgttgttgttgttcagtcgcccggtggtgtctgagtctgtgaccccaaggattgcagcacacgaggactccctgtccctcaccatctcccggagtctgcccaagttcat

SEQ ID NO: 44504 - DNA, 1655 bp, Bovine  19866880811830
gatttctggccacacaaaatccacttctaaaagtgttgccagacattgcaaacatcaatttaaagtactatgtggtctcttcagatccaatgttcttactgttattaagaacataacagcataatgattcaggaatattaattcagagatacttaatttcttcaaaaaacagaagtgagtaaaactttggttgctgaaatcttttaaatgattttttatatttgctacattaataaaagtacttagtaaaaataaataaataaaagcttgctggaaagtttaataataaacaacagcagtctcctgttttagccatcaggttaactgtatttctgcctcacttcttcatcagataaatggagacattaaaaagtctctgcctcatagaactgttgtgagcagacgtgtgaaacaatgtgcacaactcccggaacatgctaagagcaaagtaaatgttttgcgattgtcgttcagtctccatatcgtgtccaactctgcaaccccatggtacagtactccaggcttccctgtccttcactatctcccggagcttgctcaaactcaagtccatgcagtcggtgatgccatccgaccatctcgtcctctgtcgccccctctcctcctgccctcaatctttcccagcatcagagtcttttccgacgggttggctctttgcatcaggtggccaaagtattggagcttcagcatcagtccttccaatgaatattcagggttgattaaaagttagttattattactacccctaccttccctatcctaattctcttggcaaacaccctcaatctttcctctagcatttaccttcatattttaaaaagtgatgtacttttgtacattattcgcttgcctttgactctatagatggtaactctgtgaagcctcaccatcccccagtgcctcacacactcgccatgtagtttctatttcatactttttgttaactcaagactcatccatgtttacattttcattacatcagttaggaatttcagacacaagtaatagtaaagtcacccacagtgatttaaaccagccgaggttctacttttatctattgagaactttggaggtagatggttgctgttcttccctgctgtcttcagtactttgctttgtattcttggttgtcaaatcatgtggcatgacggctaactcagctccaggcaacagggccaccttcaaaagcaggaagcaggggctgaccacggcggcaaaatcttttcatctcccatggacagctcttattaggaagagaaatgactctctaagatgttacacagtacaatttctcctgcatctcattgaccaacactggatcctaaggtgactcctaactccaaggcagggtggggcagttaggattttacacaaaagaatggcattgctttaattggcttagaccaaagggtcccaaacttcctcagatcacagctccattggtgcatctgtgattatttccacagtgcccctaggcaaaagaaataaccaaacaatccccctcttttaagttgctgggactgagtaaacaatatctgtcaattgtagaaaatataataatagcttttaatgaaaagtgagtgtgtgcctgttatggctcagtgggtagagaattccccagcaatgcaggagacaca

SEQ ID NO: 44505 - DNA, 1190 bp, Bovine  19866880876565
tttagagcggtgcctggggacaggagaccccggggaggttgaatgaacagaacatgtggtacaagcacaagaactcctgaaatctggttgactcaaaactgttactgtgaccagaagcctgtatgcatcctcagcactgaatcatttgatacattactgaggacagttagagacaaggaagtttgaattatcttacaacagacctatgagtagactgggaccccgaaccaaacctgccgcactcatgccctggcatactgactccgggctgcctgggtgacgtgctctggccggtgggacatcagcagaggcttggtgtgtgtttgcacaccaggatttattctttcagaataattccacgtggagccctggctccgctgccagagaagaggctctgaaggaggagaattgcctgcagggggatgcaaggcacgctggtcgaattcccgggtgaaaaagccacttgagctaccctcaccaacaccacatagggcagacagacaacccttgagcccacacactcttgagaataaactgctttatgtcgctaagttctgaggttatcatgtagcaacaggtaaccgagacactgcactctgtcttaccatttggccagagggctcattatctgtgggtgatcacagatgaaggtaggattgatgcacgtcacttccaggaactccccaacaagctgaaggaaaaagcagagcacagctagagcccttctaaatgccattttgattggctcagtcctggtggcagaggactcaactcctatccacacctgacactacagaaatttatcttaagctgctgaaaggttggtaaggattaactaaggtaacaaacgtaactatttggcagagagcttagcacagcaggaatttaaaacttgttctttcgtttctctctctagagctttcctgtgaagctagggaagttaattctctgccgtggcgttctccttcatagggggcagggtgcatttccagtggatgtgggcatctactgccagtgcccggcctctcaccttatcaaggagcctggcagtggtccggggtggagggcactcgacatcttttgccacacagatatcatcaaggattctgcgagtttctgtaatacaaacatacaagttgggacagaagacatcacaccatcacaataccaccccaatataaggagaatta

SEQ ID NO: 44506 - DNA, 2301 bp, Bovine  19866880900863
ctgtggtacttctgcatcttgactctgatggctgtcttgaaaaatgcatatcattaaacttgcaatagtagagaaagacagtgcatatttcagcaaaataactgcttgaaagggatctgacttttgaaggaaagaaatgcacatatttaaacaacaatagcaaagatctgaaggtacaacagtaagtaaaatacattcagtgtaacagaatatgcctttagctcccatgaagctatacctctggaggattcatgatatttctttcaaatgttttctatatacatcttccctctctaaaaaatatactccctctaactcacagaattacttcaaaatgcaattctttctctctttcttcattcattaatcaggattcttgaaagactaattagacttctgcttaaaagaaaaagactgagagaagagaaagaaagcataagcaagtgcattagaaacagagaatcagagcaagacagagagagaaacaagaggaattgctttaagaaattaatgctttctttctcatcaaaaggcaggtgggaatagtgacacagcagaatgggaaagctgaagtctctgggccgcagggcatcacagaaagagaagcagctgactctgcagacacctgagaggttctgcagagaggagctccagatgtgtcaggggtaggctcctccagaaatcagggtcttgtttgaaagtttgtgcatagtgcaatcagaccttaagattttctcctccaaccaaggcagcctggttcttactttcttttaccccacaatagtcacaggtctatgcttgggaaaaactaaacccaaaaggttccatgaaatgttgagttccttctggactgaaaatctatcgcagtgcttctctgctgcctttctgagcatcagaatgtacacatttctggtcctaagcaaaagcaaacaatactcctcagagatgggataaatggaagggggggttacgttctatttacgtaaatggtcagctggccagttgctggctccatattcttttcttaggatttcattggttttcgtcctttggaagtaaaacttggaactttttctacctatcacactatttttagataaagaatccgaaatcacatatctctacactaacctgttttccccattaccaccttggtccttctgtttaagggagcattttctcttcctggttggcataaagtttttgaacagttctactgtgcaatatgaataaaaacaaattgcaaaaatctatatagtaataaaatataattaaacaactatccaggtgtcaagatttccactgagaatgaggtgctccttagcccagtgtctaggaatttcaaagagggcacccaggcagacagggtttgtgctcgtgtgttcatcagcttcatatttcaggaattacagaagccaaagtgtttcacattagtatgcatttaggatatccatcttcagtttacattacgtaaatgcatgttaaagagagtgagagcagattttacagaagtataaaggactctgaagaaagaggtacatcaagacattaaaccaatatttgcaaaatgtcactgctaggggaaagtcctgggaattttagctcaaatatgaattcagagatgacatctgtgagtggatcatctgcagagatcaatgggttgattctcattatggacgtgagcgagtcacagggggaaagctggtcatggcatcaggatatagccattgctattggaaaagaccctgatgctggcagggattgggggcaggagaagaagggcacaacagaggatgagatggctggatggcatcaccgactcaatgcacatgagtttgggtgaactccgggagctggtgatggacagggaggcctggcatactgtgattcatggggttccagagagtcggacatgactgagtgactgaactgaaccgatcctctgaatgtttggggctcccagccacccaaaattcacatgttggattcctaatacccaatatgatagtattagatcaggccttcggcaggtgaagtcatgagagtggaacccttttgaatggaattaatgcccttaaagaaaccctgtaaagctccctagccccttctgccatgtgaggatacactgagaagtccaccccagaagagggccttcacccattcatgctgggaccccaatctcagacttctagattccagaactgtgagatatgtttgtggtttttataagccacccagactgtggtattttgttatagcagcacaaacagactaagacagtcactataaactttaccatca

SEQ ID NO: 44507 - DNA, 1561 bp, Bovine  19866880969981
tggggggtataaaactgggcgtctcagaaacatcagggtccttgttggaaactgattccccttggatcctctggcataataaactttactccactgtcttgagtgtcctccgagctgtgttttacgactctatatcctacaacatattcagtgccgaagaagaaaatgggatgcgaatatccatttgtcccaattcagggctccattagggtaattataaaccagtgcccctggtgtgaatggaatacatgacactcaaaatgatgctcatttgggggaaccattatattcattttacaactaccccatccacataaagaaaacatccttcctcttgctagtctgagaaaacaacccatcaaactcttcctcagttgaaccaggggaaacattttactctaatatgcggtctggacatcttcacctgtaaagctttaatattttcctgttgtgggcactcatgcactgctggcttccgcatccttgtgtatccctttgtcatatcagggtcatggcagctcctcttgtaaacaacccataccgagctggagcaagtttggagaaacaaacagatatagctggcaaacaggaattggagaagttcgttttctgtgagttagtgagatccatgtaaggctttatttcctttttactactcgcatgttttatctatcaaacacaaagtgggggaagttccctagtgatccagtggctaagactccatgctcccaaggcagggggcctggggtttgatccctggtcatggaactagatcccacacgctgcaacgaaaagatcctgcatgccacagctaagatctggtgcagccaaataaataaaaataagtaaatatatttttaaaaaatacacaaattggtttactgcctttctttggtagccagaaggaagttaacatacaagtaactccattacttcactgcctttgcctatatctctaatgattgatccgaggagaattagttctggggacattactagacagggtcctaggcagaaccatccccccaatggtctctctctcttcgtgtgtttgccttttttaattttatagaccagccaatccccaaagaaaaactccttcagaaatgagtgggcttttttccccacggaccctgtaatgttctgcagcattttaaagacattaaacccctggcttctatttattaggatttactcttacacatgggcttcccaggggacactggtggtaaagaatctatctggcaatgcaggagatataagagacacaggttcaatccgtgcgtcgggaagatcccctggaggagggcctggccacccaccccagtattctggcctggagaatcccttggacagaggagcctggcggggtccatggggtcgcaaagcatcaaacgtgactgaagcaacttagcacgcatgcacacgatcttatacatatggaaatagtacctccaattaattctagttccttaaagatatttgggcattttgttcccataatatcttcttcagtgcagagtattaggtaggagttacataaatatgaaagaatgaagga

SEQ ID NO: 44508 - DNA, 1262 bp, Bovine  19866880970493
attcttgctgtgtcgaaacaagattcagagtcctttaaaaaaatgagaaaggacaaaatgctcaggtgtgaaaactcaaaacattcttattctcaaacaaatatgaaaaagcctcttccttaaaaggtaaggagaggaacataaagtaaatttttgatcttgttgtagagataactgttctatatgaacaattattcataaacttccaatgttctgcccacccctcccctgtaataactccatttaattaaagttgtcacttatttgtaaatgcttttttaagaaacagaaacaagaacccaacaaataaataaccaaatttggatgatttgaatatgtttggaatgttgagaatctatttacattttaataaggtatttctttggtgcaggtattagataaatctccatagagatgaggctaggacacagaattaagaagaaagaagcacccttgacaatttggagaaaaggaaagataagcagagtagtgtttaatagaaacagatgtggatgtaatccctttaggaagaaaaaaaaagccgtacaaatacaacataagagatgggaaaatggctttaaacacaaagaatgaaaaaacctgggagagttttgagaaacccaagctcagaatggcttcatgactcagactgtcttccatttcacatcccaacatggtgtgttatgtggataacttaaagaaagacacagtgttacgcacattatattatttataagaaagattaacacgggtttctgaaagtggcaacagagggttgaaaagagggtttgtcagcctaaaatgaacacatcattatatatatatagagagagagtcacagacacatattctggttggcgcatttctaatctacaaccagtgacaactgttttctagtccagcaagaaggatttgaatcaaccgtaaggataaacctattgactaaagatagagcattaaaatacattaatgggagtcaagaattctattaactctatttccttttaaaaatgattgcctgtacttgtgcaatgctttgcacactttgttgttgtttagtcacgaagtcgtgttcaactctgtgactccatggactgcagcccgccaggctcctgtgtccatgggatttcccaggcaagagtactagagtgggttgtcatttacttctccaagggatcttctcgacccaaggattgaactggcatctcctgcactggaaggcagattctttactgctgagccaccagggaagcccttgtgta

SEQ ID NO: 44509 - DNA, 1259 bp, Bovine  19866881005047
gcccaccagtgaatgacagcagggaggaagaaattaccacatccccctggaggctggccagaaccagaaaaagtttgattctacttgtgcccttcttggaagaagcctgaattccatcaggcaaggtggttctctggggcatgagtccaccatctttttggtctgccagcttttcaaataaagttgctattccccgccccaacaacttgtctctttatatactggcctgttgtgcaggaggcgcttagattcaggaacatcattcatggtgtcatgtgtggtcatttatctgtcagtaaaggcttgtgttgtatacagattcttagaactctgatactgtctctactttttaattatttcttccaccctttcacctttggatggttttgtttggtgaatttgtaggtctccttgtcctagtatctggacttcatagttgctattaaacctctaaaatcaatcagcctctggctgtgctgtcattaaaagttaactgccttcccattaatccattaactgggaaagctattcaaggctgtaacttggggtatgtaagccaatgtttgcctccaagtgaaagtttatcctattaacatcaaagagtatttatatatatattatatatatatatatatgcctagacatatatgtgcatatatacatatgtatacgtatgtgtatatatatgagtatgtatatatgaatcacccatggcttatgtagaagaaaatgcatagaaacttataggctgctactagaaatgaattcttgaaaactagaaaatcatttttgtctttgactcagctctagaaaaaatactgataaatatttacttgttttgagttgcagcagtatgttattttttagatttaagccactgattgacaaggttagaagctcatgcttgtcttatatctaacagtgggatcctcagtgaatgttaatcttcatgtcaaagacagatcactatacaagctaaagaatttagcagtgatctatactcagtggtagctaattgagttgaaatgttattttaggtaacgatgagagagaaaaatcaggataggcccatattttgtcacctactcttatgaaaacttatattttattcatgcccagttgtatcatcaccactccttaaactttcttttttctcaccagaatgtcactatgtggtagctgcctccacacactgtcagttgacatacttacacaggggagaaagggacggggtgtgataccacagccatttcttcaat

SEQ ID NO: 44510 - DNA, 716 bp, Bovine  19866881103774
tggaagaggtccgacaggttgcgcctccacggcaggtaggcctcgaacacatccatgtcgcacaggaagactgagcgcaccaggtcgcgcactgccatgtgcagcgccaaggcgctgccctgcgacagggcggcccacacgtgccacgcgggctccatcaggtagaagacatcggggtgctggctgaagagctggcccacgaaggacgagcccgagcgccacgaggacagcactagcacatgcacccgctcctcgctgctggccgcaggcggcagtctgggccgggagatcaggaagagcaggaggccggtctgcgccagcaggagcgcagtcaccgccgtgctggagacgcgccgcagccacatgccgccggccggagacctgcagagggagcaggcagtagcagtcggggatcaggggccacttgcccatcccacatcccacatcccggtctggggctgccggagagcagctctggaacttgcacaccgccccagggagatcaccccactgaggacctcccaagtcaggagtgtgacttgaaggcatgagcagtctttgcagagccaaacgccagttgcacaagactatgggcaatgttcttccctttgtctctctttctctcccctagcccttttctttctcagggggaacatatatgtaaacccggaagtcctgctttttgcttaaaattccttataggggagcaattttag

SEQ ID NO: 44511 - DNA, 1045 bp, Bovine  19866881127085
tgaaaagctcagattaactgacaattttcctacttcagaatttccctatgtatttttctccaatgacctttctgatgacaaagcctgaaatgatagtcaattaaatttatatcccaaggcacactataaatttgccagaaccaaaatgagtgcactgtgaagttcatgaaatcagctcctggtaccagggagtggaggtagatagagaagaggtggcaggtcagtccgtggtggtcaagctgacactgttagaatgatgctcagatctgcaggatctgcatgaggatgaagggcaaagaaagccctcaaagctccctaatagcaagcatttaatatcccaatttgtttcaatatcagttcagctcagttcagttcagtcgctcagtcgtgcccccatctttgcgaccccatggactacatgcagcacaccagtcttccctgtccatcgccaacaactgcagtttactcaaactcatatccactgagttggtgatgccatccaatcatctcatcctctgtcatccccttctcctcctgccttcaatcttccccagcatcagggttttttcaaatgagtcagttcttcccatcaggtggccaaagtactggagtttcagtttcagtatcagtccttctaatgaatattcaggactgatttcctttaggatggactggttggaactccttgaagtccaagggattctcaagagtgttttccaacaccacagttcaaaagcatcaattcttaggcactcagctttctttataatccaactctcacattcaaaaatgactactggaaaaaccatagccttgactagatggacctttgttggaaaagtaatgtctctgccttttaatatgctgtctaggttagtcatgcgttttcttcaaaggagcaagcttcttttaatttcatggctgcagtcaccatctgtagcgattttggagctaaaaaaaaaataatggctctcactgtttccccatatgtttgccatgaagtgatgggaccagatgccatgatcttagttttctgaatgttgag

SEQ ID NO: 44512 - DNA, 1593 bp, Bovine  19866881177621
agaactcccagatttgcctgaagaagaatttgaaaaagaagagatcaaggagaatgaagcagcagtcaaaaagatgcttgtagaagctacccgagagtttgaggagattgtggtatgttaattagaaatcactttttccctgcgtaattgcacctcactccagtactcttgcctggaaaatcccatggacggaggagcttggtatgctgaaggcataggtcttttctcacataacattctttgcaatgtgcctaaatgtagtggagcatggaggccctaatatattcatactgcagtgttttttgagtgcttattatgtgaaagcattggtaagcactgaggatgtagtgataagcaaaatacaattcctgaccttatggagcttacaacttgagagggaagtcaaatttttaacaaataatctaatgcatacatgtatactcatatatatgtgcatatatatgcatatcggagaaggcaatggcaatccactccagtactcttgtctggaaaatcccatggacagaggagcctggttaggcctgcagtccatggggtcgctaagagtcggacacgactgagcgacttcactttcccttttcactttcatgcattggagaaggaaatggcaacccactccagtgttcttgcctggagaatcccagggacgggggagcctggtgggctgccgtctatggggttgcacagagtcggatacgactgaagcgacttagcagcataggcatatatttttaacattcagtgtagcttctaatgttctttggaataccatggttatacatacacatatttatatgtatacatgtgcacacatacacacatatataccctatactcacactcctggttactctatggcatatatatatgtgtgtgtatatgtatatatgtacacatacatctagcatgactaaatgtaagaaggaacataacacattagaggaactgaaggaagtccagtggaatgaaagggaaaggaggtggtagttgggagagaccagatattttaagagtaagtgtttgtgacttcgttattatgaactggttctattcttcactttgtctaggtggatgagagtcctgattttgaaatacacataacaatgtgtgatgatgatccatgcacacctgaggaagactcagaaacacagcctgatgaggaagaagaagaagaagaaaaagtttctgcaccagaggtgggagctgccattaagatcatccggcagttgatggaaaagtttaacttggatctatcaacagttacacaggccttcctaaaaaatagtggtgagctggaggctacttcctcctttttagagtctggtcagagggctgacgggtatcctatttggtcccgacaggatgacttagatttgcaaaaagatgatgaggctactcgagatgcattggtcaaaaaatttggtgctcagaatgtagctcggaggattgaattccgaaagaaataattggcaagatagtgggaaaaaaagttgggcagataagacattaacatttttttgtgtgaccattggacttcagaaatttttacattggaaccgacactaatctttt

SEQ ID NO: 44513 - DNA, 1358 bp, Bovine  19866881220679
ccgcacgttattcacagcaggtttttcagtgtcagttttgaacacaagtaaaagcaaagtaatttctcctccttaatttgtatttaggaagaagatacgcacacacacacacacacacacacacacactactcaattccaaatgtctatctgctatgtatagcagtttcagctttataggtgggaaccaaatgtttactgtcccttctccctctgtcctcagagtcctgcccagtgagagctcatatgcagatcaaccagaatcctcccacaaacctgtcattttacccgtattgttttcataaatttgctacctcccttggtgaaaacgtatgattttcttcttcagttcacctgaaaattgcttcttcaggccttcatttggaacagtatagatttgggtattgtcagcggttcagggatatatttgaatgaagtcacactccctcgatctagggcaatgtcatcaatcacttgtgtctcaggggtttgttttgtggccccatagatctttggctccaaaatgagataaatccctcacttatgaacagggtctgcagctgcacttgatggagtctttctgtccgtttctagatgattggaccaagggtgttcccagatgaagtttgtatgtgtggacgtgttcactgaatgtatagctttttcctaaaagcttaagtattctagcaaaagagaattttatctaagaatatctatgctaggaattttatttaaattttatctaagaaactaagggtcaagtttaagaagaaaatatgaaaaatttgtattcctcctcaagttaagtgtttgaaaaaacacagaagagaaagttccaagtgtggacaacagttctagattgagtagatttgtgctaagcacaaaaatttcaattatgaaggaaaatcgcattatccagtaaaataactttttaaattatgatggtaacatagttcactctatgaaaaaacattcagaaaagtagaaaattccaaaatattggcaaagaatgtgtccattagtttctttccttctcatgtcatttacatctatatgtttatataaacatacctttatatgtttatataaaatccattcttacattatgtaatagtaatactaataagtaatattaagcactcagcctaacgtgtaccttccaattactttctcattcaattctactgaaaaaaactgtaatgcatgtattattacattcattttatagatgtgaaggctaaaacttaaagtggtaaattttccaggacacaaatttactaaggtttggtcctttgcctatgcacaattttgcatcattggctctttcaatctgcactttgcaactaacataattatgtt

SEQ ID NO: 44514 - DNA, 707 bp, Bovine  19866881273884
tccttgaatttttagcttcataaatttgtgattgaatattctggttctgagttaatggtatgagggaggatttatttaagaccttatttctaatgtaagtatcatccaaaataatttggcagagatctctccatccaggttttattagagagaagaaaagttttaaaagttgtatttggcctaaaatctctaaatgggagaatttcccccttcttgatgaatgatcaacaagctcagcaaatatgactttctctttcttgtacttcagaggaaaagcttatctgctggtaaggtctgttcaagactttgtgtcatattgttaggtttggggacacaaataagccagtaaccagatgtttgcttgggcacatcccttgagtgcactgaagcactctgatgtgggaagaacattagagatgaccttactggcacaagtcaaatgctcatttacacggaatggccactgtgctttcatgcttccattcactattaactcatttaatgggtgtggtgcctctaccactctgaaggaaaaggacttcacttgggcgctgtgctgtgcctcagtctctgttttcatttgtgggtgtaagaatgccgtgagtcaataaaatgtgcatgttttcacctagtcaaaatcttgggaggctgtcaaagtagcctttgcaacaaacaataataacacagacccacttgcacacacacaa

SEQ ID NO: 44515 - DNA, 1279 bp, Bovine  19866881274241
gagaaattaaaggggcatgttttggaaagcagctagaccatgtatttacagatccttttaagattattttccttttcctaattatattgtgtaccagcatcattattttggtggtttggtagtttcccaatttttacagagaaccatcaggctctttatgtaatttctttatgttttgttatgtgaggagatgacgcgtccctcagtcttctttaccacgtaacaggatgcacagtttcttcctcttcatatcaggtcatccatttattttaactggtggctttgctatcttcaggaatgctctaatcaataggcacatattcctaacctttcgacagtttaataaccttatggctcaatgctattattagcatgtatccctttcagaggccaattatcccagcagatgattaggttttctctgaagtatcccaggtggggattttcccagcctgctttgtggcagtcccccaggtacctcacaatcacatcttctctgtctggcgcttctgtaaggtactgccaggtgcagcttactcttccagaagaaagattagcttatttgcatccatatgtgcttcgtcatgtggaaggattggcagggaaaattgctggtggtacagtttcttgccccagggtgaggccaagcctcccactgtgaagtccagtgggcatattttaagtaactgcctgccaaagagagggctctgctgttgcactgttctcagcaaaaaagtacatcttttctggaagagcctcagaatttacagaatttggttaagaaaattgaagaaagtggtggttttggggagaaatatgtcaccatgtgtgtttcatagaagacccaggtgagtgcagccagtatgtcttccagtgacatatgtcttgggaataacgtttttgtgattgttgttgttattgttgttgcattagatccatatcctttagtcagcccctttgttagatcttttcttgagagcccatcccatggggacccacgtggtactaggttttcacagcatcttgaaagccacacatctactgctatgagctggctgggaagatttccacagtatctggccatatgggagagatttcagaatgtagatgctgttacaaaacaatgtatggtgttggttaccttatattaattcccaaaatgttcatcatgaccattctgtaatatcacatactatggtgaaaagtcagggcctgtgacagaaagggctcaggcatgaaggcagtatccggtttgatttcagattcatctatttctgca

SEQ ID NO: 44516 - DNA, 810 bp, Bovine  19866881406035
ttttaaggaattttgtttcatctttgggttgttttaggtacagaacaggagccttctttagagtatcccaattgtttatactgttgcttttctcctgaaataatgccagtgtgtttctcccaattactccacgtccctgttcccactttgacttaagcgtgagcactaatgtgcacgtgaggtgcagtgggagagcccttcagtcttcaccttggtgatctcacgtgggctctgattcagggtgacggtcatgtgacagaagaaatggagggggtttgagagacagcagacttccatctgctgctgtttccttttttgaattaataagggctaatgtctgtctagaactgttgaagtaaattttaaccataacgctcagcagccagagtttacagaaagcccagtgattttttccttggttctttatgccttttttattagattttgtttctctccttttcttccacttgtaaacttggtgtcgtcccttggtacagggtgattaaggaagtggatgccacatctaaagaagccaaatccttcttcaagcaaaatgagaaggaaaaaccccagtctaacgtccctccagcagtgccatcacttcctgccgggtcagggtgagtagtctagtctcaggccgagacgcacctggcacgttggagaagctgttttcacaacaagggcgccttgcctgtagctctcgtggctgctttcctgagagcaggaattctgctgctgttctgtctttgctgaaatacctgccaaaatggaggatgcagagaacaatacttgcagaatggaggatgcagg

SEQ ID NO: 44517 - DNA, 1225 bp, Bovine  19866881407112
atgttcatgctttgtaaaagaagttttatttctttgtgaccacgtaagttctaaatgcctatgggaggaaacgtgtaattacagaaacctaaagaaaatgagttgtctgtaaattgctctcttggcattctgatacacatccttttaattttttgttgccttttttttttttttttcttgctgtcataaatgacatttctatcaaccgtgcatataaatcctttctgttacttttatttccttaacatagagcctagaaagaaattacgatttcaaaaagcttatgaccattcttaaggattttaattcatctcgccaaaccgaatcctggaaagaatgcactaatttatagttccagccgcagagatttctttttaggtcgcaccacggactacaagagatcagaattctccatcttgttcagatgcttggactttgttatctgtagagggaaataacatctttctttactgaaagataccggtaccaggacctgctatcaagcctgagtctctgggttgaggctggagaagcggggagacagccagctgcaggcccagctcctgagggccagctggtgtcccggcgcctcgcagcccagctagtacgcgggggccctgacatccaggtgacccaggcttggctggggccgagaccaggggcttgggaagcagtttggattcctttggctgcgaggatgccaccgagagcgagcaggggcaaaattaagattcggtttctttcacaagggccttttgtgttcccaggagcctcccttctctggggattgattggagggcaaaactcttggtcaacgagtgggatgagaagcgacgcggcgggcgccccccgacaccccgcgccgagccgcgctcccccgggcccacctgcgccctcctctcgggggctcgccctcctctccggggctcgcccgcgcccgcccggggcggccgcccctcccccgaggcgtggcccctcgtcccgtggtgggcaggctagcccgagcccgggggccaaccggctctttccttcctcccctcccgccccggcgcccgcccgcccgctccgggaccgcagccacgtctgaaagcgcctcattgtgcgcgctccgctccagcccgcggctccgagcggccgcacaggtagagcgcggcgcggggccgggcgcccggggtctccgaggctgcttggtgtcctgccccccacccggggacggctccctcaa

SEQ ID NO: 44518 - DNA, 2142 bp, Bovine  19866881487049
caaagaattgatgtgtttgaactgtgattctggagaagacacttaagagtaccctggactgcaaaagagatcaaaccagtcaaccctacaggaaatcaatcctgaattttcattggaaaaactgatgctgaaactgaagttccaactctttggccacctgatgtgaagagcctactcattggaaaagtccttgatgctgggaaagattgaaggcaaaagaagaaggaggttacagaggatgagatggttagatagcatcattgactcagtggatatgaatttcagcaaactcttggggatagtggaggactgagcagcctggcgtgctgcagtccatggggtcacaaagagtcggacacgactgagcaactgaaaacaacagtgaccgttgttggcatgtggcatatgtacggttacgcacagtacgtgtattataatccgcttccttggggaagagtctctactatgaaccctgccttcagagctcatgtcacaatgcttaatttcatatttgcatgaataattattgggtttccctggtggctcagatggtaaagaatctgcctgcaatgcaggagacctgagttcaatccctggggaaaatcccctggagaaggaaatggcaacccactccagtattcttgcctgggaaatcccatggacagaggagcctggtgggctacagtccatggggtcacaaagagtcagacatgactgatagactaacacacttatttaattattatacgaccaccctctactggaagcttcacgagggcagggatccatttgcttcgtttctgttcttcagcccaaacccttggaatagcatctggctcattcaatttgctcaacaaacatttttagaatactgtattttgtttaattataatgatgggtgcttttataattaacataatgatatttgaagcaaatgttcaacaacaaaaaaaaaacctttgtgcatgaatatataatctgagaagatcattattgtccctcttgatttccctagacactgattgcactgaagttttatttcatgtgtttagtaaagtatacttagatatgctacaatttctatttgatcatatgcacctgtacaccctgataaagatccagtatatgtgagtgtattatacacagatatgtaagtgaactctttaaactattaatttaaatcagtggtctcatgggcaattttgtcctcctccacaaagggtatttggcaatgtgcagagacattttggttgtcacaaaccagagacagaagctactggcttctaaagagtagaggccaggaatttgctaagtatcctccaatgcacaggatgtcatctccccctgaaaaataactattaaaccccacatgttaatagttctgagactaagaaatcctgacttaaaccctgacctttaaattttaatacagaaaaagtataatgcatgttttctccaagttaatatgtgtgatgtaaatcattattcagaataagtaatatgttggttccttttgttggaaatgaaatgtttagcttcatcaactgcagcaatccataaagtctcaatgtcacccttgaaactgggagaaaatggagtaagtttatatttctagcatgtctcttagagctgggctcctcacgctgtgttctcactaagctccacgcacttctccatggtgtgcaggacccccggccttagctgctagggtcagctattagaagacagtgaatgggagctactgccccaatcccagagcccctctagaatctgcccctataaatcctcattcctggtgtgtttaggtaagagctccctcgtcttctgcattagcagcaagtataattccctggtgtgcccagaatggacaatgtgaaagataaaatggtgttttctgttccctgggggagacgatcatttttatgatgctctaagctactcgattagccttttacaagggaacagagtaagctgttctatgtgtgcctcaagcggaaactcttttaaaacacatttacctaaaacactttgaaaactgaatttgaccattccttcacagccttggaggatttaataatttataggtctgcacattgaccataggaatattttgtcattgatgtttccattaaattatacttg

SEQ ID NO: 44519 - DNA, 834 bp, Bovine  19866881517225
tgcacactgtgctattaatactaccctctgagaggcatgtgctcctttgggcctctttgtaatttatctccaaaaaaagttggagattggatcagaagaagcttaaagaacttgaactgggccccaaagtgggatttggatgatgaagggaagatagttaaaagcaaaccagaaggagcggcaaaatgggaagggaatagattgtatgcactagagtcaaagaaggatacaattactacgtgttagatagtctctgttttatatacacacattatttcatttagccatcacacagcattgctattataccaatgagaaatctgaaacaggtcctgggggctaataatccagttagaaaactagagcagaggctctctaaacatagcagtaggtgatacagttaaaaatattgtttaaggccagttatggaaactccttaatgcagacaggagaaaattagcctccccaccgccttatcacaaaggtttcaccatctacagaacacagagaaactaggccaccttgtccccaaaaaaacccctgaagtcaaagagacaggggaatttctgcttgaaattcaaagtttaaaatcacagtgaaaaaaaaaaagttacataaaccgagaaaaaagtctgaaagcatataatgaaatgcaaactgtggttaccacacaggaatacagtaatggagaatctttgtttttgctttcttataatttttaatttatataaaatatacatgctatttttattttgttatgagcttaaaaatattctcagccctatgacagaacaaaagctgcacccccacccaaaagataccacacagataaaa

SEQ ID NO: 44520 - DNA, 1817 bp, Bovine  19866881551725
caaagtttgggttttatggtgatgggattagtttccaggttgtctctgaccaatcattctgactcaggggccttcctggtggcacatgcattgctcagccaagagggatgtcaggaggattctgggaagtgacagacacttggcatctccttttgacctttcctgaattcttctgtttggtggtagcttgttagttctgtttcttaccagtaccttctgtcctaaaataactcacacaaaggctactatggtgcctggccagggtaggctgtttgttcgtaagtttcccctaacactttctgaaaccacccatgggtggatagggtcctgaacaaagactctttggtttaatattcagtcagagggacagggttccctgaggccggctgttatgtataaacaatatccttttaatgaacaaaagcaatgggaagcaaaagttagagaaacagatctaacatgaagtccgttattccctgtaacacccctagttgtctgtcacctagtcttggggtgatgatggtaggggaatactggcctgagtgtgagtgcactgtgagagccacataaaggaggagaatgggctttggaattgtgttttgcaaatgaaaggcagagtttggtagggttgttgctgtttctaggaattggtaaatcctagaggaatgtctttaccagtgtcagcaaggccccagatgtcaaagtatcatgacatacagaaaacatgactaataaaaggtgcagtagtgttgcaggaagggcagccccttccagggcccgaaactgggctcttgtctaacacttggaattgaagtgttcaaggagacacgtctccttttgacctttcctgaactcttctggttggtggtggcttattagctctgtgttccttagcaggacctcctgtcgtaaaacagctcatgcaagtggttactatggtgcctggccagggtgggctgtttcagtgtgcttcccctaacagtttatatctccttgcagtccaagggactctcaagagtcttctccaacaccatagttctttgccgctcagctttctttacaatccaactctcacatcccatacatgactattggagggctcttaatagtggtgctcttaatagagctcttaataatgagggctcttaatagacagtgaatcacagttctaaagaatggtttgccatgctttgccaaaattatcatttattgtaaccatgatgcaatatttatttaattaaagcctaatgaagttacattgtatattatcagtagatcattgagttacaggggaatacgctttcaacaattttgtgtggaagtgtccaaaaagaagtttgtttttcttaaaattagatactctacgaatgcgctattgaaaattttttatcttcaaggcagaatgttggtaacgctgcccctgaatttgtatttcatgctatgtaaattaacacctgaacaaagaagaaatacacggatggatatattttcatgcatatacccacagagacttcaggcttgtaagagttttcacataattggaacccaggatgtgtgaaaatatggataaaaaggaattttggattccagacaaaaaggaaaagacaaagggaaggagtatttattaagtcagtgggagaacttttcatccagactcattaacataactactaaacttacgctaaaacaggttttttcttttgttaaaataaataccaccattggtattgagaatcttggaaaggatcccatgcagtggtagaaaaggatgagaaggaaaactaattcattttgcagaaaggtggtcagtttacagc

SEQ ID NO: 44521 - DNA, 1098 bp, Bovine  19866881618099
ctgttttgtttctctatttattaacatgcaaatgagattctgaagtttaatattgtgttttaccaagagccatagaaacgaattgagaatgaaaatgagtcctactgatgaagattcctgatgagtatataaattaatgaaaaaatatgatttgattcaacaaataacacatcatatatatgtatatatacacacacacacacatagagagaatgtgtatgatttcttgaaccccaacaaatgaaataaagataagtagttacattaaattttgcatctcttttcatgggccaatcctatgaaatgttttattactcaaatggagtggtggtaaatgttaaactgctttacttttaaaaagaagtacaagatagaaacttcattctaaggtcactgttttgatggcagcattctcacaggagggaccactggctcagaatctggactagctgccttagtggcgaggaaagcccacttgcctgtagtaagggattcagaactgaaaacaagagaaatagtccaatgtgacagtaactttcactataaggcaaataaaagtaacagcaagaattatctacacaaaagtattcaaagcccacaaagttctccttgtaaactgagtaagacaaggatctcagttattactccccaatgatagtctcacactaagaaacacacaaagttatggcaactgcacccaataaaaaagaaacacacatagaggaatgtatcaaataatatcagataaaatcttttgaataaactcaaactcacactgcagtgttaggtatttataatacttatcatatagcaaaacacacaaacacacaatccatttgttctgtccagtgttcaacgtactcaaacattaaacaacagaacaaagaataagaccaaccagtaaactcagaagtggctgagcgcttccctggtggtccagcagttaaaactccgcctgccaatgcaggggacacacgttcaatccctggtccgggaagatccacgtgcgttgcggcagctaagcccgtgcacagaaacgactgagcccgtgctctgcagcctgtgctctgcaccgagagaagccaccacagcgagcag

SEQ ID NO: 44522 - DNA, 966 bp, Bovine  19866881643310
atttaacatacagaacacaatggaaaaatgaaggtatagtttgtgtgcatgtaagtaggaaaatgccacacaactctgtttgaagtcagcacttctttttcagtaactgagcatcagatttttttatcctagaaaaatggaactcttcttgggtgcttttcaagtcagtcaataccacacacactgactgaacagcatctatgtatgtgccaagctactgttgctggtacggtaaattattctatctctgcaacatgttatttggagggaaattggcactatttgcaaggaactttgggtttaatttgcatctaaaaattttaaatacccataattgtatacagccaggaacattatccatggttaaattgcatattgttcctattgttgctaagatgtgaggacatttaacaattactcccttatgccacatgacgttgcatacccgagagcaaagatcactcagggctgaggacttggcgctgaagactttaggggtcatgatgaaccaccaaacagattaacaccctttcatctcttgcccactgaatttccctttggagagtgcctcctgcccaggcttttgcagactcatccaaggactgtctggctcaattatcttggtcctagctgtctgtaagccgaatcatacttcagaggttcaaagggctctggggctatccatcaggccaattccatttcaaatataaaaaaaatcatgtgcagtctgatcaaactgacattttctccttccttatgtgtcagtagcacaaaagctgaagctccttccattttgagattctgaactttgttctccttttaatgtaacagtccttccactaaatcctttcttgggctcagtggctggttctattgataatattctgaccttgtatcccttttcttgttatgaataaaacagttattcaaaccctaatgctgagaaattttttcacagttctccag

SEQ ID NO: 44523 - DNA, 734 bp, Bovine  19866881880250
gatggtggtggctttggcctgtgggcccggtttgccatctctcagctaaaataagccccccaggccacctgtagggagagattttctttagggttgctataaggtccagctaactccaaggagtatcagccactggattctctccaatgttaagcgagaagacaagaaagatgcacagggcctgtgccttcaaccagatggagtggtgggcccccctcagcagtctcagtgcctgtcccagttcctgtttatgctgccagtcactggtccctcctactgtctcttcctggggaatctgccctaagtctcatcagaagctgccccaagcccagggagggcagtggtcctgagaactcacatttgggtccaagctctcctcctccgcagccacgccatcttcagcactgtgattgctggcggcggcctgactcagctgtttctcactgagctccttctgcttggcctccttttccgctattttcttctcagctttcaggcgtctctttagctcactgtcaggaaggtgaaagtgttcaatgtaacagatgcctgaagagtcccctacattctgccccgtcaccaattatcaaaaatatcaactgcccagagaaacacacttgtccagttccacacccccacggttatctcttagctactaaactctatacatgaaatagagaaaaaaataaacttagaataaagatgtgaaagatctttttctcagtctctatttt

SEQ ID NO: 44524 - DNA, 1090 bp, Bovine  19866881894989
ctatgatgagataccacctcacacacactgaaatggttataacttttaaaattggcaataacaaatattgacaaggatgtggggaaattggatctttatgtattgctggtggaagtgaaaaattgcacagctgttgtgggaaacagtttggctattcctcaaaaaagttacaagaagttactgtatgatagcaatttcacacctaggtgtatatactcaagagaaatgaaaacaaatgttcatagcagcattatttataacaaccaagaaatggaaacaaatggtcatcaacttatgaaaggatagataaaatgtggtataagtagctatacagtgaaatatggttcagttaaagggagtgaagtactgatacttggcactgaatcttgaaaagtttttgctaactgaaagtagtcagacacaaaagagcacacattacatatcattttatatgaaatgtccagaataagcaaatccatagagacagaaagtacattagtagttccatcttctccggattaatgaaatattctggaattagtcctgatagttgcacaatcttatcagtgtactcaaaacacctgaaatgtacactttaaaatgatgagttttatagtatgctaattacatatcaacaacacaatgaagcaagacacaattaagtcaaatattgctgctgattccaaaaggctggccttaaacatggggcaaacaatctacaccaagaatgaacaggacaccagcactgtggctgctctgggtttgacacatattctcaaccttttcaaagcccaatagtgttgccaagaaggcattttcattttaagcttcataataagctgctccattgttaccattattccttgcctggcatgtgattttattttatctccacaacaaagtaattcttgatagatcgcagtaatttcaatccgtgaggatctttcaactgtaggagtgaattagaaagatatttttatattgcctatttgagataacaggtcctagcaccacgcttcgggcaaaatacatcaaaagaatgaactgaaggttaagtttccttttagatcacaatttttataacatcaca

SEQ ID NO: 44525 - DNA, 1204 bp, Bovine  19866880155748
ttggttaaaggacctttcttttaaccctctaaaatgtctacaaacaataaatgctggagagggtgtggagaaaaggaacgtgcttgcactgttggtgggaatgtaaattgatacagccactatggaagacagtatggcgattccttaaaaaactaggaataaaaccaccatatgacccagcaatcccactcctaggcatacaccttgaggaaaccaaaattgaaagagaaacatgtatcccattgttcattgcagcactatttacaatagctagaacatagaagcaacctagatgtccatcaacagatgaatggataaagaagttgtggtacatatacacaatggaatattattgagccataaaaaggaatgcatttgagttagttctaatgaggtggatgagcctagaacctattatagagagtgaagtgagtcagaaagagaaagagaaataccatattctatacacatatatacggaatctaaaaaaatggtactgaagaatttacttacaggggcagcaatggagaaacagacatagagaatagacttatggacatgaggagaggggaggagagggtgagatgtatggagagagttacatggaaacttacattaccatatgcaaaatacatggtcaacgggaatctgctgtatggttcaggaaactcaaacaggggctcctgtatcaacctagaggggtgggatggggaggcagacgggagggaagttcaaaatggaggggatatgtgtacacctatggctgattcatgttgaggtttgacagaaaacaacaaaattctgtaaagcaattatccttcaataaaaaaataaattaattttaaaaagagagacttggaatggagaagacagagatattgtttaaagtagtatgactgtagttctctaaattggcatcaatgaaatatatcctaaataccataacagatgcagatcattcatcacatttagagaatacattgttcaagggaaaagtacatacaacttttacaacagctccaaacatacttatatttaccaatacatggccaggcctgtggcagataatcaggtgagtatccagtgaatggagaaaaatgacagattgattaggctccaacagctgctttgaatcaaataactttggacatggcccatttcaagctaatggtggggaatattattctttcataaatcactgtat

SEQ ID NO: 44526 - DNA, 1698 bp, Bovine  19866880507878
ttttaatttgaaccaaaaaaactgaagtcagtggtatttgtgtttaacataatttatttccacatctgagtgtccaaaatgttttagatttttgttaaatatatcattgttttttatatgctttctcctttcagttttttactaaaaggaaaatgtaaattaaaatttaaaaatgaaattaaattaaaaatttaaaaagaaggggaaattaaatcatgtaaaactccaacatatatatatatatttgtccttttgctcttctttttctttagttctgcttgggaatttgaaggtccaactatcatctattgtccttccagaaaaatgacagagcaagttacagctgaacttaaaaaactgaagttagcctgtggaacataccatgcaggactgagtattaacttacggaagcaagttcatcataggttcatgagagatgaaattcaggtgtgaagatggatcgtcatgactgtcttttccccatactggaaacagatatttctataatagctatttatgaagtctttattgaatatctttgttgtgttccccaacttccttgcccctgcccctccatggagggataatgttttttgttttctaattaattttttttaaagtgtatcttatagttgatttacaatgtattgttaatttcaggtatacatactatatataaaataggaactaataggaacctatggtacagcacaagtaactattcagtactctgtaatgacctatatgggaatggaatctaaaaaagagtggatatatgtatacctgattcactttactgtacagcagaaactaatacattataaaaaaaaaacattgtaagtcaactatattaaaaattaaacaaaaatttctttaaagttggaattgaacttcataatttaatcctgaaatattatttgtttaaaattgcagtggtaaagaatccccctgccagtgcaggagacgtaagagatgcgggttcgatccctgggttgggaagatcccctggagtaggaaatggcaacccactccagtattgttgcctggaagattccatggacagaggagccatggggtcgagttcaacatgactgagcacgagcacaaaaatggaaaaacagcaatgtgtattaaaaaattttaggtgtacatccatgtgattcattcatgcatatagatttgagtaccgttttgatgagcataaagcagtcactctgatagaattggtgtagaatatgggagatagataggtaagaaaactgttgcaggcaagtataaatggcagcctgtacatagaatggtgtttaggttcacagaggagggaacactagctgttaagatagattgtcaaatggagttgtacacccaggaataagcagtttgagtagaatctgaacaagtgaatagaagttcatcaggtatgcatggctagggggtgatgaaggataaggaattgattatacaactcctgaaagaaggactgatatgtgcaaggcactttggcataagagagcatcctgggttcaaggaattgtgagtagcttgcaatggttggagaaaagggaagttggagtaggaggacgcagagtataggtaaatggcaggatctggtgaagacttaggaagagagttgaattggttgtttggccaggttagagaggatcttaaaacttgcagagaggcaagctggagttggta

SEQ ID NO: 44527 - DNA, 1958 bp, Bovine  19866880512309
tctttactacttggcttctttccctgaatctgtcttcgtgttcatccatattgcagcatgtgtctgaattttacttctttttaagactgaataatattccattgtatatatgtaccacatttgtttatccattcatctgttgatgcatgttgggttgtttctacatctggggctaatgagaataacactgttaaaaacactgatccaaatatcttagtccctcctttcggttcttttgggtaaatgctcaaaggtggcattgggtcataaagtagtttcattttctgagaaaactccatatgattttgcacaacacctgcaccattttatattcccaccagcaatgcataagggttccagtttctccacatcctcaccatacttacgattctctcttttttattcaatcgtcactgtaatgagtgtaaaatgatacttcattatggcttagatttgcattttcctgatgattagtgatgcgtgggccctgtatgtttttgtttatgatgtgtctctctgtatcagtttgtcttttttttttttagagctccttctacaatgattttgttataaatatgttcttttggaataaacaaatatcgtcttcaagactatcagcaaacttgttctaaagtatcaaaagagtataaaatagataactaaggagaacctactgtttggcacagggaactctactcaatgctctgtgataacctaaacgggagggaaatcccaaaaagaggggctataggtatatgtacagctgatccactttgttgtacagtagacactaacattgtaaagcaattatattccaataaaattaattaaaaaaaataaagtatcaacagaggaaaagatagaaccgagaaccactcagaggtagagataaatagcaaagatacctgcatggcatactgagtgcctttccctaaaaaagaggaagagttaacaggaggttaacagtggatatgatatttctcattagcctattaattacaataagttttgatttttgctaatttgcacttgttctgtaaactgaactgctcctgtcctcagtactaaggagtagaagacgctccgtctcagcatggtcccagcacaaacaagaaagatcttgactcttaactctctgttctaggacaaaaccgttcaccactcttagtgtagtccactcaccagggggtgcttttgacttggtgggcaggtatagctcccctgtttctttccaggaggatttcatgcacctcagttattttttgacagttttgaggaggcaattcagctataggcacatcattccatccctttatttatttatttaaatttaattttcattttatattggggtatagttggtttacaggggcttaccaggtggctcagtggtaaagaatctgcctgccaagcaggagatgcagattcaattcctgggttgggaagatcccctggaggagggcatagcaaccctcttcaggattcttgcctggagaatcccatggacagaggagcctggcagtttatagttcatggggtctcaaggagtcggacataacttagtgacgaagggacgacgatgagttggcttacgacgtgttagtttcaggctacagcaaagtgattcagttataaataaacatatatccactctttttcagattcttctcctatgtggttacaacagaatattgagtagagttccctatgctatatggtaattcccaaagaaaacatataccacccatttcctgccctttgctctttctctttaagtacgatcattagggtaggcctctacctggttcggcagcagcagccacctgcttcagccagcaggaaagacgatgagatgggctggaccagcttctgacaggtagacaattaacccccaagctcagctccgagatgcacctgtgtatcactggcaaagcgaagaagctcaaatgtgtgtctgg

SEQ ID NO: 44528 - DNA, 1203 bp, Bovine  19866880516519
tttcacccagcgttaaatttcattcagttcactttttacaaagcctgtgtttgccaggatttgcaaaatttcagcttcttgaagacaaactactttgactttgtacctgacatgtacagagcttatacacttcagggcactcacgacacgacgacagaggcactatgacagtaacggtcaggaagccaatctgtgttaatgtaccaccaaaaagaatatacagtgctacatacacatttttcaaagtacaacagaattgaaagtacattaaaacaaaatgtaactacttccttttactaaaagaaacattacttgagctatattcagaggaaaatacctgaataaaaactcttcaatgtgtttgtttcaataagacatttctactttaatccttggcgttccttagctcagtgctattgcagtatttaaataatacatctactatgtaaatgtattacagctgcataaatatttaaaatgaacactggaaggcagggcctaaaatagagacagaatctcacaggattccaaatttaattactttttaatgtatgtagggacagaaaatgctcagattttctgtcataggtacaaaaaataaaataaaataaactggtataaattttattaaaatcatttcaagaaaagaaaaattaaaatcaagataatctttatgttctgtgagtctggcaaagtcaactaaaaacatccagtattggtgaaggtaaagaaatggaaacctctgtgtaaaaactggtcccccaaaataggttgggcaataggcaggctattgaaatttttttaagtatgccttatcttttgtcccatcaattatactttaagaaaacaacataacataactacgcaaatatatttatgtacaaggattgagcattatttataaagcttataataatagcacatagcaaaaaaattaaatttctctctgtggagcatcagaagaagtgttttaaagtgtagtcatacctggaataccatatagctattagaaaatgaactaagacagcatcagggccccagggacagtggctggccactgggaggaatcctggattctaaggataaagttgaaattgctgatgcttccaggcagaaaagaacaatttactggcaatcagaaggaacaaccagattgtcatcggacttcctccaaggaacacctaacattacatcactgccaca

SEQ ID NO: 44529 - DNA, 2934 bp, Bovine  19866880655390
attagagaggtctgggaatagaagcacctgtctggttaaggaacaggatgtgatcctatgtgattgtggctgtctgaactaatgtttcttgattgctttctcaaattcagcgtcctggaggaagagggaattaaaaagcaataagcttttgtaagacacatagaaagcagtcaatggtcaaacggattattcaattaaaggataattttgttggtttaagtttctaacctctcagttctacagagcagccagtcttggcttcttaatgatcttccatttgtcaacagcgatagaaacttctgagccgataggagtgtttctgtggattgagcacgccacccagtggccaatgtggaaattgcagagacacgccgcgtaaacagtgcaaaagagagcttttcatccaacagtgcaacagtcactgctaattaccacttccacctcccagaccagaaaccccttctggacttgactgtgtttccggctctcctgccttctgtgttgtgacgatcactacagcctgaattgattcttctgtccccattcatgtcccatctgcatccctccaacccattctccatgtcgctgccaaaaaaactctacaaacttgtactcctcgcatacattttcggagcgctatattagacaatgcagctaggcataatttgagaatattgcttataataaatataagccaaaccaaagaacaaaatgaatgtagatgataaatatgagtatgaatgtatatttatatatatatatacttacaatgcataaatacacacagacatacatagatacatcaaagaggagatctttctaaaaataatacaaaatccagaagtcacatggaaaagatcaatttgactacagacaagcttgctgctgctgctactgctaagtcgcttcagtctcgactctgtgagaccgcatagacaacagctcaccaggctcccccatccctgggattctccaggcaagaacactggagtgggttgccatttccttctccaatgcatgaaagtgaaaagtcaaagtgaagtcgctcagtcgtgtccgactcttagcgaccccatggactgcagcctaccatgctcctccgtccatgggattttccaggcaagagtactggagtggaaagttttgataaagaaaaataatgcaataaatgtttgggggctttcctgaccaaagatcagggagcatcccctttcctttggcacatttaaaacaaatacaaatataacctgtgatggaaaaattcagaattccaaaagacagatatcagtcagaatctactactcaaatgattaatatccactcaaatcattatataataatcaagtatcacaagatctgctttctcagaccaccattggtaggggggtgtttcctttcattcaactgtctaaatggtgtagaccttcacccacctattttaggaaggatcagctgacaagtttgtccaccaacaagccccatgtatgagaactgcttcctctaacccaggactgaagctacctgatgcccttttacatccaaattgatgagaatgatgagatgaaattataacttttcttacttgggtcacgttctcaaagagcaaaagacagaaaaaacttagaatatactttgttcttctgttcctttctcttctcgcaacttggataaattcacttttggcaatgaaagtcctcatgccttgttttgagaacaaaagtcacagcctatcaggcccctgtgtctccaggtggaagaaagaatgtcagacgtaaaaggtagagcaggagtcttcaccctggacgtgcaggattttccagcaaagtctcctgatgcaggtatcaaattatcaagtttaataatcacctccccacgatgcctgatggccccagcacaggtctgacctgactcaaccagccgctgacttaacatgagaaatcagagaactggaggagcccagagctgggagacctactagaggaagccaaggagtgcagtgcctgatgggaatatcttacaggatgcaggacaaggaaaccagtggcacaagatcagtgacctcgggcatatttatcaccccctgaaagcaggaatcatggcagagaaagtcccttcacaataagcacaaataataatggataagccttcccttttcaccacggccagtaactcacacacgctgcctttactgtgctggaacaaccacattcacagtgaactgggaacatggctcgcactctccctctctcaaggaagaaagcctgcagcgtaccagagtagttttgcttccacttccatgagcaactcagttcacacctgttactgctctttatcttccttgggttcacatagagaggatttttgtacctaaaggctctgaaatggccgaaacggaacatttactgaattaacttcactgcccaactgcaccctgagcctaaactcacttcctacctgtttccatctcaaatgctgccaggctgtgctgtaacagctccccagaaggacacaaggaacaaaacggacattttttaatccccagacccttcagcagtaatacaaacatgcaccaaatttcgacaatatgaatcccctcagagtgagtgctgagaaagaaattggactccagaagtaaaatcatcttatgtacgacagccaaaaaaaaatcagtccccaaatctgttcccctcccacattttcagtctgttttgtcttaaagaatctcacctcctgggtggattcaggcccctgagtcagtagctataggctaacttttacagaatgggttccttcaacacctccaagttgaattaaccagcctcacatctctgccttaaaccacttgtccaaagatcagagtaaatagcataaaagagacacctagcattagcactggatgggaacccatcgccaacaacatccctttcagctttt

SEQ ID NO: 44530 - DNA, 1300 bp, Bovine  19866880759504
accttaatatccaccattgtatgttgccataagatctctttcttgaaaatgaagtgggaatatatatatttcatacaaattataattaaatagtgtatagatgctaaaggttaacaaacatagatttaaaagtcacctctgtgattaatttatgctcctaacaagttagttaacccttaagtctcttcaaccgtaaaatggggacaaataatagtagctaactcataggttgttgtaggcattaaatgactataaatgactatatgactataaatgacattaaatgactataaagactatataaagactagcatttagcacaagcctggcaaacaatacccagaagtgttagctcttaatattaaaactatagttttaatattaaaactataattttataagtctgccttaataattgtaatactggaggcttatgtttgaactttcttctgccaatgaaataacccaacatctgatagagctttctctctcgaaaagaaagagaaaaagtgctaacacagtgattatagagaataaaaatgtgaattctgtacctgtttttaggactgttactcccagaagaaattttatcatgtgctttgtaagaatacagctgatccaagttaaactgcttttaaacatataaagatccatttaaaaaaggagacgtttcaaaaatcttttaaatatgcagaaaataaaatacaaaatattacaatgataatttttcctctgactaaacatctcatcaaagaaatcagctgaaaataagctcatgaattatcagtttctaatgttctaaaggcagttggaaatacagtgtaatgtcccattccttccaaatctagagaatatgtggtctaaagaattcttagagacatggaaagagccaaagtcataaaaatgatttaattacattctgcatactttaataaagcagaaaagattcaccagaaaatttaattcatttgtccatcaccccatcaccctagtattctaattagtggaagtctgcctgtggataagtatttaatctgtaatagttacctaagatccaaaacaaagcaagaaaatctgtgtgtgtgtaactttaatgagaacattcaggaatcaagcttgttcttccatcaactaaaagtatcataatcgctaagaaaaaaaagactccaaaacaaatgagttatgaagtaggcataaaagaaagttacttgctcaaatacttataactgttctattaatcccagaaatcatatattgcatattttattctgttcaaataatttctctctccaaattttat

SEQ ID NO: 44531 - DNA, 4157 bp, Bovine  19866880896509
ttttctatttacattttctaggaaataggatgacatattatgtaatttttaaaattaatcgtactcactgacaaaaaatagtcaaaggtactgtggtctccaacctgaaaaatcacacatcagaatcaccagtgaaaagactacagcgtgccacaacctcatagcaggtgcattaaatcacaattttcaaagttggaggatctgaaattttctaaagtttgaaaggtgattctcatgaacaataagagtagagaaccactacattgattaagattcagaatatcaaaaaaaggaaattataatatcatagaatccaagattcaacatttattcaataatatatttaaatgcctactatgtgccagtaacatactgctactgctaagtcgcttcagttgtgtccagttctgtgcgaccccacatacggcagcccaccaggctcccccgtccctgggattctccaggcaagaacactagagtgggttgccatttccttctccaatgcatgagaatgaaaagtgaaagtgaagtcgctcagtcatgtccaactcttcacgaccccatggactgcagctgaccaggctcctccatccatgggattttccaggcaagagtactggagtgaggtgccactgaaggaaatataaataaataagaagagcattttcccctaaaaagtttatagtccagtagaagaaaacaggtatacaaatagacaattataatccaggagcttactttctagggcaaaaggaattgtgggacaggacaggagagacagagatttgctggatccatccacaagtttaaagaatatctcactttaacaagtacttataaagattctatcatcccacttaccaatattagcctcaagttgccgaagcagctccaagttacctgaacagaattctggagttaggtatacaatccggtatttgcctctgtaaaaacaaacaaagaaataggaaatgtaaaaacaatcacacaatgaatataactgaaaaccataacacagtataatttttttaaataatgcattacaccacttaataaaaacaaaatgcatattatatgtgtggacatatacacatatatttgttctctgatttcatttcaattcatcaaaacaaacatggcaacaccagtcagagagtactcagtataagatgccattagaagccagattctgatttccagcagtctagccccaaaatggcagtgcttgagttaactgatccagcctacagtaaaccttctatatgttagcaatccacctgcatgtcaccttccttggagaacgacaaccccattaccctacacagttgatcccatctccacaattatacctgcagcacccacgtttctcctgtatattctgctctgttgcccacatcttcttgggccagtgatgaaaccagactaaggtcaagttagtcagtctctgtcctagaatttggagggtctaaccaagtaacaaccagtcagtctccaagcagcaagatctgtaacatgtacatgaaaaatacctgcaatctattttgtgactagaaaaacagagaatgcttaccttctgagagaaagcaagagaaagagaatttagattaaaaaaagaaggccctattgtattttcaatactgattccagtctcttcctgagggctggctaatttcttttcattgggatccacaagccattcctgtatccttactataaaatttgatattcgtttaaacgtttgattgatttctattctgtgcagacagaatcctaattaagacaatgtttgcaatgaaggttagggctagggcaaaataggtacagagtctcttttccattctatcaaatgatgacatagatcaaattaaataaaataaaataatgttctttatgaaaccacttaaaaatatttaatccactgtgtgctaggcatggtgctttcactacgaatgggtagaaaacaactaagaaaaaaagttatgcttttcatatcatgaaattgactcagtagtctaattagttctgatgccaggctatctaggtttgaatctcagttctatttcttacaagctaagtaatcttaggcaagtatttaacttcagtgtgcatcagttcttcagggtaaaacagtgataagaactataaagacagctaattctttagatagctactttcaaagtaaacccaatcaaatcccaaatcgcaatttagttgaaaaggtgatatcgaaatacaaagaacctagaatagacccaaaaaaattgaaggaaaaaaacaaacaaaccctactttgaaagaacaagaaaacaaaagtggaagacccgtactacctgatttcaagatttattataaagctatagtaatcaagacaccaatcaaggcagacagtgacaaaatagaaaataaacactgcagcaataaacccatgtatatttactcaatttagtttttacaaaggtgcaaaagcaatacagtggaaaaaagataatctccaacaaatggagctggaagaaatggatgtgcctaggtcaaaaaaaaaaaaaaaagaactgcagtcaatacctgatataatatacaagatttacacaaaatggatcatagatctacatgtaaaacataaaactataacattttttgaagaaaatataaaggaaaatctctgtgaccttgagtgaggcaccaaaaagcaacagcaaaagcaaaatccataaaaaaacacactgacaaactggacgttataaaaatgaaaacgggagaatggtgtgccttcaccaaaatcttgtatgttgaccttcctcccactgcctctttggagcagtttctaagaactgagatgctgcctcccatgctgcagtcctcattttgccccaaatgaaacttaacacacacacacacactaatctgttaagagaatgaaaaatggaatgataaactaagagaaagtgtctggtaaccatatagcaagtgaaggatttatactcagaatgtataatataaactatcaaaattcacaagtgaaaaaaaaagaataagcaaaagatggatataaacacttcatcaaagatacacagattttttaaaaaaacataaacagatggctaataagtatataaagagatgctcaacataattagtccttcagttcagttcagttgcatccgactctttgcaatcctgcaggctgcagcacacctgtccatcaccaacttccggagcttgtgcaaactcatgtccactgagtaggtgatacaatccaaccatctcatcctgtcatccccttctcctctgacttcaatctttcccagcatcagggtctttcccaatgagtcagttcttcacatcaggtggccaaagtgttggagcttcagcattagtccttccaatgtaaatccaggactgatttcctttaggattgactgattggctctccttgtagtccaagggactctcaaaagtcttctccaacaccacagttcaaaagcatcaattctttagcactcagctttctttatggtccaactttcacaaccatacataactactggaaaaaccatagctttgactagacagacctttgatggcaaagtaacatctctgcttttttttttaatatgctgtccaggttggtcatagcttttcttccaaggagcaagggtctttaaatttcatggctgcagtcaccagctaaagtgattttgaagccccccaaaataaagtctctcactgtttccccatctattctccatctatttgccatgaagtgatgggaccagatcccatgatcttcattttctgaatgctgagttttaagccaactttttcactcccctctttcactttcatcaagaggctctttactttttcactttctgccataagggtggtatcatctgcatatctgaggttattgatacttctcttggcaatcttgattccagcttgtgcttcacccagcctggcatttcacatgatgtactctgcatataagttaaataagcaggatgacaataaacagccgggaaatgtcaatgaaaaacacattgaggggcttccctggtggctcagtggcaaagaatttgcctgtcaatgcaagaaacacaggttcagtacctggttctggaggattccacatgccacagagcaactaagcccatgtg

SEQ ID NO: 44532 - DNA, 2290 bp, Bovine  19866880909122
actgagggcttccccgatggctagtggtaaacaattcgcctgccaatgcaggaaatgcaggagacgcgggtttgatccctgggttgggaagatcccctggagaagggaatggctaaccagtccagtattcctgcctggaaaatcccatggacagaggagcctggagggctacagttcatggggagcaaagagtcagacacagctgagcaactgagcatgaaacaagagatcagcagacaaggatttcttgtcccaatcctgcaactcactacatatctgttcctaagctttactgttctcctctgtgcttcaggaagggttaaggctgtattataaactgtgcctttctaccacttaatttcatcttccctgtagttccatatatatgcaagaaattgtacactgtatgcaagccaaagccataaaagtttgatagctttgtaagttaaacatccctgagccctcctctaactttcaagtgacttagaaaatttatttgcctcgagtacttccgtctatgactatggcacttttttagtttttaaatgtgaacagttggttcaatttccatcatctgagatgttttgtttttagaatcaactaaatatcacttaaaccccatcggattaatatgtgggtgatgaaatgtggcaataccatttttgattaaaaatacgtaaaaatagaaaaaatctggatgcaaaagaactaaatttcttattctgcttatgttctgattcaaaagacagttccaaaccttgaataccacaaatcttccaagtgatatttgcatactgacctcactttccaacttattaaaaaatgtatatctttgctaattaaagtcatttttgtatgggccagtcttctccactgaactacaatttacccatttttctatctctagcaccaaccatagttccttacaaaataagtacccaataaatatttactgcaaaagataaatgcgtataaactttaacatactccaacttcaggtatctttttttattgccaattacccaagtgggttcaaaaaagtagatacagtattaaaagtaatagcagtagtgaagccgttatttgaaacacttatcactctttaatggaatttaccatcatatggttatgattgagactcagttcatacatgaaaaatgacaaaggggtatctacaaaaaaaaaaaaaggcagaaatatgtagagaactacagtcataaactccttccagactcacctcttcattgtcctcttcattcacttttttccttctggtttctgcttgcctttcactcctgtttggggagaagaggggttgatgttctgcatgtctcagtgtcttctctctgagacccttgcagcctcttctcctccctcgttcgtctttccccactaagtctctctctgcccttcagtacattctcacctgcttttcagaatcatctcaccaccagccacctagtagggaaaacgacactgcgacaacagatgagctggcccttggatttttacaaacagcacaaaacactaaataacatagatagttttatgtcacaactgtagttaacagtcactgtgaacagttgtgatacacgctgtgctctgtgtaggtattttagatacagtatctcatgcaatttccactggttgtagtattattcccattttcctgctgagaaaacagacactcagaaagttaaaatacttgcctaaggttacccaactgtgaagttggttttcaagtccaggcttgatgtctggattctaaactactacattatctcaaccagttcttaaatttctttctagaggcatttaaatcctaatttcaagataatactatttatgcccttactatgcaataccaacttatgcttggatttcaggataatactactgattagatagcatattgaaaagcagagacattactttgccaacaaaggtccgtctagtcaaggctatggtttttccagtagtcatgtatggatgtgagagttggaccataaagaaagctgagtgctgaagaattgatgcttttgaactgtggtgttggagaagactcttaagagtcccttggactacaaggagatccaaccagtccattctaaaggagatcagccctgggtgttctttggaaggaatgatgctaaagctgaaactccagtcctttggccacctcatgcaaagaattgactcactggaaaagactctgatgctgggagggatcgggagcaggaggaaaaggggacgacagaggatgagatggctggatggcatcaccgactcg

SEQ ID NO: 44533 - DNA, 2174 bp, Bovine  19866880935536
ctctttagaatttcctctctctccgggacttctctgccctgcctggagttccatattcagaaaccggaaagtagagtagcgtctggaaagccagggggctgcttggggcaaacctaaaggttaagagtctatatgtaaaatagatagccagtgggagctggctgtatgatgcagggaacgcaaagcctctgtgacaacctagaggggtggggcagggagggaggtgagagggggttcaagagggaggggacatatgtatacctatggttgatttatgttgatgtataacaaaaaccatcacaatattgtaattaaaaagagtcctgggattgcaccctagcttcacctataacctgctgtgtgaacttggagcagctgctgtccctcccttcaccaaagcctcagctcaaataccagcttctcagagaagccttcctgaactcgccttgcaaactagcagcacccctacttctgtctgtttcccatgttgttttatttttctttttaaaatcaccagtggcgtagcactcacgcatatttctacacatagccccacctagcatggcagctctagcagaaaccttccttgccttgcattctgttgcatccccagcacacacacacacacacacacacacacacacaacaacaactaatatttattgagcacttactatgtgccagacatagtctcatgtattttatagatagtagttcatgtaatccctttttctgacggagatattttaaccccattttagaggtaaggagagtgaggcacagagaaggttattaatttgcctgaggttacacaaagtggcagaaccgagattcacacctggaaaggtggacttctagcacccacaactctggacttcttgacttctgtgctagtccatcaaggtgctccctaacaacggtgcctgaatgcaaactagatggagaggaatccaaaagattcttcctcccatccgcgctggccctactttagagaaagcacttgttccatctgggttaaagaaaagaaagaggcaggaggggcttcacgtggcccattttgatcagttaaatcatcaggccggtggctgccttcagttgcttcaaatttccccactgtgatgttgtgatttataataagaaatatacatttgatcttcatcctccatcctgggctcacaactccagaaatctttgaaatttcctaaatgataagagtgatggagcatcttttgttcaaataactgttcttgtgttctcacttctgaaaaagctccagagccataaaggcaaaacctgtgtcttattattcatatcaaatcccttgcagtcacacccaagtttctgtcagtaggtggcttttggaaagaccccaagaatgggggctggttaccagggaaatgaaccatgtgattagagggctggaactttcaattccaaccacttacctctgggttgggaagaggggctagaggttgaatcaatcaccagtgaccaatgattctatcagcatgcctgttaaggaagtctccataaaacctcaaaaggatgggattcagaaagcttccaggggaacttccctagtggtccagtggttaagaatttgcctgtcagtgcaggggacaccagttcagtccttgatccaggaagattcccacatgccttggggcaactaagcccgtgtgccacagctactgaagcccgtgtacctagaattcatgctctgcaacgagagaagccactgaaacaagaagcccacgcaccacaactagagaaaagcccacacgcagcaacgaagactcagcgcagccaaaaataaaaataagtaaataataaaacaaaattttttttaagcacaggtaacacctgaacctgtgactggtatgtgaaattaaggcagtcttgtaggagggagcccttaacctgtgagctctagtattacttcccattgtagacaatgtcggaattgagttaaacagtagcacacccagctggtgtcactgaattttttggtgtaggggagggaaaaaaacccacatttggtgaccgtgtcaggagtattgagagtagaggcaacatgtgggaagagttttcctttatgcctctcatatcacatcacctgttattacccacattgtgtagagagtgaaactaacccaggatgggaacttaggagg

SEQ ID NO: 44534 - DNA, 1973 bp, Bovine  19866880971018
aacatatggagaaggaaatggcaacccactccagtattcttgcctggagaatcccagggacaggggagcctggtgggctgccgtctatggggtcacacagagtcggacacgactgaagcgacttagcagcagcagcagcagaaactaacataacattgtaaagcaactgtattctaataaaaattaatttttgaaaaagatctttggtacatacataagcatcagtggctgcatagactttctggtcctcagtgaggggaaacctactccagtcgctacagcggatagaccggtctttcagaagctgtttaccaaagaggtatttaaccaaaccattgaggctccaggtctctatacatttcagctaaaaataatggaaaaatcaactcaggagaagttatttctttccttttattcttagatatttctaaccgataccaaacgaccatgtcacatgtaaagttgaaaatgttacaccaaaatataaggcagagatagtccttagtagatttccagtcactaaaaacctcatttgcagtctaccttacaagaatgtaattctatcatttcctcaatgtaggtattaaaattctaggactgtcaaagtatcattcatggacaaaagttgaataggttggtgattttcctacttctcagccaaatgaacacttggctaacgtgagaatgtaacttaaatgactacattaataaaatatatgaaatatgggccatggaaatgatggtcaaacttccactaagaggatcacaccacaaaagctgcattatgttcacgtcaaaaaaaaaaaaacaggggatatcgatatagatgggttaaagagagaaactttaaatataataattaaattcacaaatatataaaacaaagtgaaacagtactaaatatgggagagggtgtttgcttaaagaaactatttgctaaggcaacccattagaactgaaagttttcattatgagacatgcattagggacttctttttttctaaaaacattacgtagcttaaaatatgctctcaaaaaaaatatctaacagtcagaagggacattctgtaaacacaaatttattttgtttttattctgaaaataatatatgtattatgtctaccttttcattggcaacatctgtcagctccacaatactcttcaagttgatatcaaagtcacgtagaagtttccactgatcttgttcaattcccacacctgcctttttaattgcttcattttcaagcaacatttttagtccctgagggaaacctataattttttatattaatgtttatataatatttatataatatataatatttatttccataggttctatcaaacatgacagatttattatgttctacttcatacacattttatgtttaaatttgtgtttaaattcagaaaccaacgcttaccttgaatgtttttgagagctttttttttcacctaaagcaaaaagtcctgactgataaatgacaagaaaaacaactaatttaaatgctaaattatcactaacatttagcccctctgcacttccgttctccaccctgtgaaacaggaataatatcatcattgactgacagatatgacatgaaaattacataaaacagggatatgagtgaaaacttaaaatataaatacttaaatataaggtgatgagagaggcacctgttaattcaagagcttaatttcatatggacaaagttgacataatacaattatctaccatataaaaatgaaacaaatacaagagataccaacctgacatagaagaaatatgaaacaagtagcacttgctctctgccacacacagctgaatgagggccactctgctcagtgtccctttcttgaacggtggcccctcgatgtcaaatccgaccacatctccatcagagagactcatgctaaaggggggaaaataaaataagttatttaattaaaattttaatttctgcatcactgga

SEQ ID NO: 44535 - DNA, 1556 bp, Bovine  19866880994317
taatagttcgtattgcaaatcagcacattgcgaacacttgccatttcttttttaacatctgtatagtagcattgatatgctgtaatttaataagtcctctgttgatgggcccttgttgttcagacacttagtcgtatccaactctttgcaaccccatggactacaggcacgccagggcttccctctccttcactatctcctgtggtttgttcaaactcagggtccattgatgaccacttgaggttgtttctagtattttccttttaaaaggatgctgcaggcaacctttctgcttttctatgttgtagttcttctagggtaaatgctcagaagtgggtttgctgaatcaagggcttctgtgcatttctgttgccaaattcccttccaaggaatcatatcaatttgcattgtttaccagtggtgtgttagagggcctgtttgcttatagccttaccaattgagttgtcagataaggatttttgccagtgtaatagatgagaaatatcttagtggaagttgagtatcttttcctctgttgatggtcattggcatttctttttttgtgatttatatgttcctgtttttgggtccttttcttgttagctttttggaactgttcaaatgttaggaaggttaactttctgtgataagaattgcaaatgtttttttctcattttattgtttgattttatgtagcttcaagtttgaactcagttctgattttatagtccattctcttcatcactataattgtactgcctcaaataattacacattctgcattcctgaaaagattcatttagcctattatttaatacatctagcattttaaaactgtcttcaaatagcaatttcttccttcaatagacacggcatcagcgaggagatacacatcctcttactttagaagaaattttggatgaaacgcaacatttagatattggactcaagcagaagcaatggctaatgagtgaggtaagaatagtcttaaattattgtaaaaaatgtttttactgtcagaagggttttcatatgctgaaatctgataagttttttcttaaaagaattggtatagggtttgttttttttaaacatacacattttgagattgatttgttttcatatattctgtgtatctatttttaaatgtcagacagtagcattaaagttgtaaagaagtcagtcactactaatttttcagtttttacagaataattgatgcttattttgaattgctaaatttgtatgtattgacagattgtattgtttctatgttttgggacatttaaagcatgaagtattatagggaaagcaagatatttgttaagaaatgtatttgttgtactgctactgctattatgagttgatagtgatgttcctgcctctggcaagtcacttggaaaaataaccacgaatattttgtatatatacacacaacattggaagaaaatgaatctgaaaacagtgactgtgttaatttggaaatgagtagcactttaaaaattgagatattcgtctcttttcggttaagtataaacgacaattcagtaaagcaa

SEQ ID NO: 44536 - DNA, 1565 bp, Bovine  19866881009282
cgcaacttagcaacttcactgccaccacagcataagataaaattttgtttccttcccacctaaatgttttaagttcatcgacctgctgtagatattagtggtcactactattagtggtcactactgctgcacctgcattcacacttccttggggaaccaaaacaggattgaaggccatactgccatgattacttttaagcatttgagccaaaattttaatttattttttttctgtgtgtataaattagtattttcacatgaataaatctgacttggaaaacctttcacattctaggagtttttttgtttgcttggccataccaggcggggcatcctggatcttagttccctgaccaggaatcaaacccctgccctctgcatgggaagcatggaatcttaaccactggactgccagggaagtcccaattctatggtgtatttgaaacagatgttttatatcttttcttagatataaagacacatttactgtggtcaataaaagaatgtgtcttaatttttctccagttacaaagagcctgtttgggtttagtgtgctgatacaaaatccatgtcgtctgcagagtacatcatagaccccattctgggatatgttgctctctgtggggaacggtgagggtaggagttttgacatgaaaaaagagaagtgacaccaaccttcacgatggttcttcagtgggtatattttgcttagtcgtaatgctgttgaacgttttatattcaagtttaatttacatacagttcttataccagtcagtcagtttgggcaagtatcaatacatagaacgttttcctcacgccagttcccatgtatcccttcccagtcaccacgcacaccgtccccccatcctgacttccagaagcagtcaccagtctgatttctcaccccataagtcactttcatctatcctggaatttcatataagttgataagtattttttgtttgacttccttcactcagtctagtagtttcttgaccatccctgttgttgaatttatatttcctttttattgctaatgattctttttttaaacaggcgaaaaataagcagatcttttctgagtatcttaactgaatcatggcagcaaccctgtagtaaggatggaggggacaaaatatctgctaatattaaatgatagtgctcctaacattcaggcaactctcctatatcttagttatattcgtactcttttgagagaccctaaattatgctattgttctattaaaagcagaagtaatgggcttgtgcagttcaacaattcaatagccagtgaaccgttactgcttttttttttttttttttactttatagctctgttttgagctcagaaagtaatgtgaaaaataattccaggctaggagacacttcttatgatatctctatatatctggattatcaaaacatgcaggaaggaatgctttcattgtttatcagtatggtgatgcctcagttgcttgtatacacttttaaaattatatactgtaaaccttatgaactcagttttattactggaaactcacatgggtccatattttatgtaatga

SEQ ID NO: 44537 - DNA, 748 bp, Bovine  19866881049881
ctgtcaatttttaatatttataacattaagtatagccttgttgtacagaagctattcagtaaatacttagtcactcactcaatacagctcactcataatatagactttctcttaagcaattattaaaattcacaaccttccaagaagcgttttctaataaaaaattaatttgtaagtttaaaggtagacatttgttaaggcatctctcatatacacagtcattcatatcattttacagataatatgaatggtttaatctaaaaggttaattagtaaattcattttgcaaggcaacatttaaagcattctcaatttttacaattctgtaaactacatacttgtttgcttcaacaagttcgctctcttagacttacaaaactcactttaaaacattcattaccttttgttttttacaactgggaacagcagtatctttctcttgttcctgagagtctccacatttgtctacagtgataggtcgtttttgagaggaatttgaaacatttttaattgtgtactctgaaactaaaggcaccttcccacaggtactggattttttgatactcttcctacattttatatgactattcgcatttttctttctctttggttgggaagtctttctgttgtgcagcatttggcaaaggataaaagaaatggttaactgagcatttttaacacatattatcttcatatgttcaatcgttttcatgactttcgtaatatggaccattttccctaaatcctt

SEQ ID NO: 44538 - DNA, 730 bp, Bovine  19866881275865
gctgtacttttaccactacactaccttctccctatgcctgctgcctctctactttcctctggggatatatacacctgggatctgcaaaaccacaaagataagcatcatacatctttttggagcaaaaattcaactcaacgtataggcaaaaaaatttggttaaaggcaacattgatgtgtttttagagtagaatagaaattttgcttggggttttaaagataaaactgtaaacttcaacgaaatctgtttttgatgactgcttcaggctatgcccgtctgaagtatgagttagcatgcttcagaagcagtgcttccaagggaaaaatggaaaatcactgtgttagatggactccacagggatgccagtttccatgtatgacagctgagtgattccttctcaggcttctctggcccactgaatcatacaacacaaagtcaaatcctgttaaaactcctcaaaattggataaaatatttaccttttaagtccaacaaaagatagcaaacttgccaacttgaaaggatgtttttcatcctgtggtttcttagagattcaggctgaagaggtgcctgaagtgaggcggatccagagatatgagctgctgtgttttatagatggccaaatacttacctgatgtccctctacaattttaggggattcaaactgatgacaaaggtcacatcatagtagatgaattccagaatactaacgtaaaaggtgtctatgcag

SEQ ID NO: 44539 - DNA, 1391 bp, Bovine  19866881289667
gaaaaaaatctgacaagttggtgattccctgagaataaaaaaaatatatatatatatatatagtcactttgtcattgttttcatctacaaaacgcaatgatatgctttcaaaagagattccataataatatttcctgaaaaaagtataaacccgaaaaataaggatgttcaatgaggactgtggttttttaaaaaacatttattattttatctatcacatatttatctagctgttctgggtcttacttgtggcaggcgggatctttgatctttactgtggcatgtgggaccgagctccctgaccagggatcgaacccaggccctctctgctgggagtgcagtcctagccactggaccatcagggagatgaggactccctgaagaggaggaattggagcacaaaaattatagttttagttccaactaaactaaattcaactaccagattcctcatcttttataccttagacttcattaacacatcagtgtgaaatacagcttcttagggtaaagaaaagacttggaagtactctagaaaggaataaccgactgggggtagatgtaatctgtgttgatagaaccagtgagatgcaggacagacggatgaccaagggtggtaagctcgcccagggctcggtcgtacctgggagtacttcagcacctcaatgccagcgttctccagctcttcggtacagttggaactgattattgaatcaaaagttctaagcacctgtatacagaggcagccgagggatgggtggcaggaaagaataaaacctgattaaagatacgctacaaacctgggaggaaatttcagtatcagtccccctttcttcttcattcatggccacactgtgagtttttttaaccattttaaaaaactaaaacacagttaatttacaacgttgtactaagtttcaggtgtacagtagagtgagtcagttatgcgcacacattcttcctaaatatttatttggctcttctgcatcttttaccatgccatgtgaactgagctgtagcatgtgggatccagctccctgaccagggactgaacccgggccccccacactgggagcccttagtcttagccactggaccaccagggaagtcccagtggcgaaaaacacagaacattaaatttaccatataaccatttctaaggacacagtttgattggtgttacgtatattcgcattgttgtgcgaccagaatcttcccccttgcaaaactgagactctgggggtggggggagcgataaattaggaggctgggattaacatatgccagtagtttatgcaaaacagataacccacaaagacccactgtataacacagggaactacacacagtatttgtgtaataacctatcagggaagaaaatttgaagaata

SEQ ID NO: 44540 - DNA, 720 bp, Bovine  19866881324711
catgagaaaccaaaaaccaaaataaatggtatctaaagtaaatatggctgaagacatatcaaaacttgagagaactgaagagaaaaccaaatcatcaacgaacaatattttgaaagtgtttcacaagatctacattacattcccagtatagtgctggtttagttaaatcttcacagtaaaacatgtatagatgaaattagttcatcgcggtaactcaccacaaatcttcttaaacatcttgggttttcttttggttttaaatgcacttacacatattagtttaaattttgaatgttgcctccaatactttaagaaatctgcaagggtgaaagtaatgaatgtttttacctatttaggttcatgtctgctggagcccaaagaacgtgacaagaactttgaagtccatctcggccagctctaccaatctcctggtaataggattccatttccttaggagcaccataatgaatgacttggcgaatgtcagccttattaatgcccattccaaaagctacggtagctatgacacactgagaataaataacaacatagttaaacatttagcagaattaaaacatgtttccctttggtaagtacaattagttcattcattacagtccctggcatgctactaaatttaatatgaaagtgaatttagaaagatggtaatgataaccctgtatgcaagacagcaaaagagacacagatttatagaacagt

SEQ ID NO: 44541 - DNA, 676 bp, Bovine  19866881613030
gggctgaggtgggaacaggagtgactccaattggcacaaggaatcttttgagggtgatggaaatgttcaaaaattcaatgcagtaacagctgcacaacactgtaaacttactaaaaatctctgaattatacacttaaaatgagcgaactataaggtacgtaatttaaacctcaatgttttttttttaaagataacctaaattctaattacaaaacaactattaacatcttaagagcaaaagaaactcatcattccagcccttatacttaacaaactaagaatcaatacgaatgttgaactaaaaaatgaacttaccatgactaagtggttccctgaaaaataaaactaaatagtcaattctactaaccagaattttgtttagagcctgatgatcctccatgttctagctttgcttttttcttctttgatgatgatgcctcagaagacacagaacgtttttctactacaggattggaaagagctcgttttttgaacagctcccgttctctcaaaaggcttggatccataatgctgcaaaggtaaaaataagttttaatacagattcaagtcactcaatctatatgccaaatccacaggtctcaacaaaagttacttcccaaacaaaactgccttttattactagttctctaggacttgtattcatttcacttactca

SEQ ID NO: 44542 - DNA, 1309 bp, Bovine  19866881633079
ccttccctggccttcaattcatctcttgctccacactccgttatcttcactcttgtttccaccgctagcacgtggcgcttcagagaagtgccagctacttgcttccacgcaccctggacttgagatgcactatgactatcctctctactgtaaagtacacagacgcacagccacgtggagaagatgcacgcacgtgacggtttactgcagacacgtgaccttacctgatgggacatcccaactggcagaagttcgagtataggggacttaaactgtatgtgaaatgacagccgcctcccatatacaaacccaaaattctagtccctttcctacagtcagatttatgcgagtctcacctattggtaagaaaagaagggattgggtagacgatagtaaaatgagtaagaggaggacacttaccaatgcagccttgttgcgtgcttagtcactcagtcgggtctgactctgcaaccctctggactgcagcctgccaggctcctcacggatagagattctccaggcaagaatactgaagtgggttgccatttcctcctccaggggtcttcctgacccagggatccaacccacatctctcatgtctcctgcactgacaggtgggttctttataagtgctacccaggaaatttggacacagaattgagacgtgtttaagaaactcctgggaccaaggtggggctctggcagaggcaaagtcttgttgattgtccaaaggcccttttttctgccacaaaaaacgagtgtttcctcgcaactgcaggggaaagacaaagataaatagaaattaagcacccactgtgaggccaccgaccctctagtgcagggtcttgctgtggagagggtcagtgagtgtattctgtgtttacacagacgagcacatggacaactctgaaggggagcagccagggggttctcagccgggacttctatccaccggtgcctccaaacagccctgaggctcagagaaaggattgtacgcggttatgagatcagctcctcttaaacaccttctttctgtttcaggcttgaaaaacacctcgcccagttttgagcccttcaagactttgccacagcctctatcacacatctgtttttctcgaagaaaaaaatatataataaaaaatgttttactcttttacactgtataattgtaagaaatagtgtgttatttgtgaacgcatggtctgccatttctgtacagtttggagatattttcaaatgaaacataaaagatgtcaacgataaaaccaagagagtgagtatttttataccaaacattttaagtgtgaca

SEQ ID NO: 44543 - DNA, 987 bp, Bovine  19866881858991
tacttattttctatttcctttgcctttctgcctgccgctaaatacacatactttccttcttgtctctgatagctatttttctccttacggttcctaaattattttaccacattcatatttcattctgattattccagaaatactgaaatgaaactcccctttaacatgacctactttaatgtagaatttggcccaagtcttatttctcataaaaaagcagttacatttaaattaccaaaagagtcttattactgtaatttaacccataaggaggatttgaagtgctatcatactcagcttcaaggatatatgttctacactatgaagatggttaaccacttttgaccagtatgcatgaattctctaagcagttcaccatttttttggttgtagtaattaattttaattaactgtcaatatgtttgttgccacgtggagaagtgaggatatagccctggctcccgttttggtatgcgcgaggacatgcttttaacgttcaaagtgtaaagtggtcttaggttgtgaaataaaaaatggtatgcctgatttcccagtgagtacatgcagtttaaagagttttggaagtcctagcttagcagaaattaaagttcatagtaaatcatctttcttccacccatgtatttatgttctggctaataaaaattagatttttgcttcctaattttggataagtaatgtttttgcttctctgtcaaattaattaatctagctattgtatagtgctgtttttattaacatgtacagcagcttagagattcatactcagtatgattatcatttgtgatttaaaaccaaaagtcttaatttttacaaaaaacaatttcgcctttctctccttgaaattgaacatgaggtcatgagtcgcacttagtgggtaagacctattcagagacattcatgtaaagttatggatgtaggagcaagctcttagctgccaattggctataatagtaagtattataatat

SEQ ID NO: 44544 - DNA, 2477 bp, Bovine  19866880406327
ctgctgatgttaagcacatcttatttttcttttgtatcagtaaagatttttaagtattaacctttcctacagtagtcagatgaaatgtttcttagttattctaagtagattagcaaagaaagacaagtgtgtgtgcctgtccaatttctaacttattttagtctgaaacaaatccaaatgtaaaccagatcctgacaaaaccaagagtttttaagtaagccaattcattcttagtgttcccccagggatctaccctcttcaccatataattcctaatctgtttgaaaaccacccaacctttagttcctagctgctatatttcattgctggagacagctgtagagtaaatcaagcatcaaatagaatgtaattcacccacctttacactggtgtgcctttactgcaaggttatatagatgtcatgaaattacttgattagcattctttgagggtgagcggtagttcagtgtaaactcatgaagctgaactgaatcaataaagtttggttgacataaaaatgaactttattgaaccctatagagtagtgcctatgacaaaattgagaaaaggaaagaaatggaaaatatattattttgtattttactgtgaataatgttgagattgaatttgtcatacctttctttactggaaaaaaaaaaaaaggtactgccatacattcttatacagccctggtatagacttcaggaggtagaggtgatgatatgcctgaagtgttggaaatatttgataagcaaaactcctggagattaagaaagccaaagtgtggtagaataattcagaatacctaattcatatctgggcttgccttgtggcttagctgttaaagaatccacctgcaatgcgggaggcctgggtttaatccctgggttgggaaaaccctttggggaagggaaaggctacccactccagtattctggcctggagaattccatggactttatagtccatatggttgcaaagagtaagacacaactgagaggctttcactttcctttcaatgtatatttatataaaattgcatcctcttggttttctttgcatattggctctgttcactcatttctaaccaaatttgtcaactgatggagctcaatgttccaaattatacatattagaaatccaagcagagaataggcaatctaagcttcagtttagaagtttccaggaaaatattcccacaccaaatcaataatcccatacctaatcaactgtctccaataaatagttgaatccgaaagtaacagatcatataggaaataattggacttccctggtatggggaaaagaatctgcctgcaatgtgggagacctagcttcagtcccggggttgggaaaatcccctggataagggaatggcaacccaattcagtattcttgcctggagaatccccatggacagaagagcctggtaggctacagtccatggggtcacagagtcagacatgactgagcgactaagcacagcacacatgggaaatattgatatatttggagcaagaagaaagcacaattaccagaatgaaaggaatactgctgcttcaggaaagaaggactgtagggtagaaaaaagaaaaagcatttgttctaaaaggggaaaataaatttaaatggtctatgtacactggtgctacaacaagttgaatccatagccacatgtacattacttgtggattctaataacagttgttttcagtcaaccttttcttttccattctcctcgaagtataaagtttaagtctttcctcatagttgttagtcattccattgttaccattctttttggagttttatttgaatcccactttatagaaattgaggaaacaagctagaactgtattaatcaaaggtgtaattgccatttgccacgggcattgtttttcttcttccagtatacctctcagtattaacctggtccttttcagttatagagattaatgaggagttaattttcttgaaccaatggaagtagtaaaatagactacacttcaccaaagataccttttgaatgcaatggtatgaacattctttggcattgcctttctttggaactggatcaaaactgacattttccagtcctgtggccactggtgagttttttaaaccagttggcatgttgaacactttaacatcatcatctttaggatttaaaatagctcgactggaattctattatctctactagctttgttcacagcaatgcttcctaaggcctgcttgacttcacagtccacaatgtctggttttaggggagtggccacatcattattgttttctgggtcatgaagatcattttttgtatatttctctgtattcttgccacctcttaatttcttttgcttctgttaggtgcttaccatttctgttctttattgtgcccacctttgaatgaaatgttcccttggtatcttccattttcttgaagagatatctagtttttcccattctattgttttctt

SEQ ID NO: 44545 - DNA, 1429 bp, Bovine  19866880631066
ccatcaagaaaaaaaaaaaaaaaattaaaaggcatcccacaaaacaaaacacaatttggagagagagagcaagcatcagcatcaggggtagcagagatgctggaatagtcagaccggagattcaagataatttaacagaagcccataccattacaaataaatcgaggaaaaaataaatggaatagattagacatatcttctgtgcaagcaaattccaaatatgaatgtagatattctgttcttatagaggtgaagaataactccctattccttaagtgaaggctgcacatcctgacttacttgtaaaaggtattaataatatatggaaagaggactgagttaactcggcagaacagaaatttgacaaacactacctcatccaggtgatcaaaaataaacatcaaaggtgaaaatatttatagtatgtacttcatatgatataataagaattacactttacttccctggccttccttccaaaaccattactacagtctaataacaagacaaaaatcagacagatcccaattgagaggcattctgcaaaatatttgaccaatattcgtcaaaactctcaatgtcataagatacaatgaatgtcccagaaattgtcagagcgaagagtagtttaaggagacctggtaactaaatgtggtatggtgtcctggatgagatcttggaacaaaaattagaactttaaggaaaaattataaaattctgaatgtagtctttaatttaaaacagtacaccaatattggttcattaattatgacaaatatagtatgctaatataagatattcataataaaagaaacaatgtggggtatacagaatgtttctctactatattctcaataattttgtaaatccccaagtgttctaaaattaagtttattacaaatatataatttgactaattttattaagaataaaatgatatgaatcaatactgtatgtatacaaatgtgcttttttcagtaatttaactctgtcatttcagcatttattttttacatttttttaattttatttttgaactttacaatattgtattggttttgccatatatcaacatgaatccaccacagcatttcagcatttaatgtcaaggaaatttgtaagccctcaccatctcccttcaccttgaattgttgatggtttttctctttgtttctattgcttactaaacaatcttgacctctgcttactaaatctaatatatccacaaaatgcagttattcagttattaatcatacccatcaatttatctaagagttagataaaacactaagtgaaaatagatttaataaggatagacagtgactcacagagttccaaatatgcctttaagataaaaaataatgcatgtctctttgaatagatgaaaggaaattattaaaacataaataacaggctatattagttttgg

SEQ ID NO: 44546 - DNA, 2337 bp, Bovine  19866880635079
tgttagaacagccaaaaaacggatagagacatgatgtaacacccattgcggtgactgatagctttgtccttcagttaggtggctcaaaacattgagaacagatagccatatggttaatatcagttataagacatgaagtgaagtgaaagtcacttggtcatgtccgactctttgtgaccccatggactatacagtccacggaattctccagaccagataactggagtgggtagcttttcctttctccaggggatcatcccaacccaaggatcgaacccaggtctcccacattgtaggcagattctttaccaccgagccaccaggggagcccaaagaaaaatgatggtgtagttataagaatggctggaatttggatacaaggtctagtggtattatggaaagtgaaagtgacagagaagaagcctagtacactaattttgtggatttatgagaggtattttcataagcacagaaaagaaggataaaggatttgagtagcagattttttttttttttttttgtgattaaggtattgagttgcaaacgcattttttgcttctattattatcattcaaataatcaccagatcacaactattgtatctatgttttgcaaaaggtcaaaccatatgtgatctattaaaatatttatctaaaattctgtacatgtaacctagttttattcctcactcataattataatcctcatagacaaaaaatctccagctaccaggaaattatttgtctaatatgcattgcagttaggtagtgctaaatatattaacactttagcagaggttagcaaagataataacacagtaagtaatagcctcaaagtttcaaaaagtaaaatttccatttaaactgtttcttaggatgagcagaattttttgaggaaaactgataggaaacgacagcatttgctgcagatattactccaaggaccaatatagcgatttagagaagagcactgcagttaaaggaactgatggtggcttggaaatggcagagatcatgtggtatgttgaagttttgtaagaaattcacttaatcatgtaagtataggcttatacttggcaggtggctcagtggtaaaagaatctgcctgccaagtaggagaccctggttgaatccctgagtggggaagatcctctggagaaggaaatggcaacccactccagtattcttgcctgggaaattccatgggcagaggagcctggtgggctacatttcatgcagtcacaaaagagtctgacacaaccaagtgactgactaaccaacaaaccaaccaataggcttatttagtacctttaaatgtctgaaacattgtgaatatttctgtaatgaggaagaatcagagaagcttgtaaaatatcaaaaataccccatgaaatatttagctaaaacaaaaataaaatttttatatttttataaaataaaattttgtgattttatatcagcttgtttaaagattatggaaactttattataataaatttcctactgttataatttcttattgttactatggtccaatggtctccctcactatataaataattactctgatatcattaggatttgttcacaatttctcaagttctgtggggaaaaacaagccagaataatgactgttcacccccaagttattcctttatactacagtagagcatgaatagcaataaaatcactccaggaagatgtcagcaagccacagttctaatatagttgactgaacctcttcaatgtggttgaaaataataatgaaacattgatccaaccatcctattctcatttccctattttcttcctctttgtagacaagtgtattatacatcatgatcaaggtactgaattatctatagaatttttcaaaatgattaataaataataacactaatttcttgccatgtaaagcaacgcctatttgggtaagggagcccatttttcttagtctgaatgagaacatctgtaattgaactatatctttggggtctgacatgatgcctatatttcaccttgtgtcttaagtctagtttattttttatccctttagagaatatattgtgtggatactgaccatcatcattataactttcagtttactcctctaaggaataataaacagccagaaaattgtcttactttgtgaacttgctatattatccaggtaactctgagtgagtaaaagtcactcaggtgtgtccaactctttgtgaccccataggttgtagcctgccaggctcctctgcccatgggattctacaggcaagaatactggagtggggtgtcactgccttatccaagagattcttctagccaaggaacaaacccaggt

SEQ ID NO: 44547 - DNA, 782 bp, Bovine  19866880692858
tcccagatttgttttattcctaaaagtatgagttttgtggtcacccatttaaatagatgttgaattttcttcatacttgatagtattttcgtttttcactcttcagacctttataaccttgttcttttttttttctttttctttttcacctttcatatcttggtctgtttatagaccatggaaaaagtccacaaatgatagtgaactcttcccttcaaaacttctgctatgtaatcccaggatttctgcttatcagaaatgacattttgtatatacatcttttttgtatatatctttcttctcagttatggtctgatgctattttctcccagataactttgtttccaattcactttacatataggcaatgctattttattacaatcccattctttagaatctcttcatgctgcctctattcagctacttcatcagttagcttcctttcagaacagtgaatatagaggaaaattactatagaaagcaattgcatataattttcatctgagcctctttgctagagtaaaatttagatgtgtgtgctccagtgatgaagtcatggatctcctgaacctagcccatcttcatctgaggaaattgggccccctcagttttacttgtcagctggttattaatttggtggtatccggatttatgcatactcaaagcatgtcctgtaggttcttttgttcctgtctcctgttcttgctcccatagctgtcttgtctctgggttttgtgagactgatgtgttgtcgtacccaaagagggtcacagggatat

SEQ ID NO: 44548 - DNA, 1950 bp, Bovine  19866880701809
ctataatttttataattatatatttttacagttagctttccctttgtcttgaatcatatattaaataggtataacaaaatgcatagaatatgtaataatttatgataaaaagacaaatgccaagttttatttatttaatcttaaccattacacagtttatgtcataagtaattctttcaggtatgcaatcatctacacttacattttttaacacaagttcagagccctcagaaaggtttctgctcagtttagtcattttatcctatttttacttacactatttattttattatcccattgttcttttggcctctatacccttattttacatttatgagttcctttcttccacaataagttttaaatattccactaccataaatagtctgttgtacctaatcgctctaaaccattgctgccttatttaacaacttttccattaccctttaggcatatcctcattgcttctaatctaaatggtactattgtttccatcaattttccacttaatttctaagcagtctatcctgaatagaagtcctccaatttgctgctgttttgtttttcatcctggagattaaatacaattttatgttaaatacagtaaaaagatataaaagataaataaaagataataattaatacttagagaaagccatgcaagtacaattattgtgtgggataaaatatttttctttagatattggccactttctttgtttgtattagtaaaacatcttcaaccaattaataagtatttgtgtgtcaagtcgtctgttatacgctgttggggaaatataattaaaaacaaaatttcctcccaacccagaaaaaatgtcccatgaaggcagaaagaagagaccgaaaacagttttgttttaaataagcactgaaacagtgctatgcacatcacaggcaatctgctaagatattgataaaaggaaaattctcacttttttatagagtcaggtagatggaaaagcattgaatacatgttctcaagataaataatcactggtcctcaagtaaggagaattgacacacttgttacatatagttgatcctaaattcttctggaaatcagatgatctttgtgttgggtaatttatccaaaaaaaaaaaagaaggaaaaaaaaaaaacacatatcattatggcaggcagaaattttggagcaaagagctcgctgaagttagtttactacccttccataggcactgagagataggaaatgattactttacagaaatggattctaggtccttgaaacaagacattactgttttataacactgacaagaagcttatttaggcttcaaaatgatttcatacatcttcaagggacagagaaagaatttacaactgtaacttttttgttgtttttaatgtaattctctaaaataaaaggggcagtgaaaggagtatcttttcctttcaataccagggattctatttttttcctctgatttatatttacctttacaacactctgggttgtaaagttgtattgttcttgaacatatgttagttaacttacgaggatgactttaaaaagattttcacacatacacacacacacatgcacacacacactcaagtagctaggtgctaggaggttttgatctccatttctgatttttttacctctttagatgtcatttatatattttacttagtgatgttttattgatataaaagcaatttaaaatgtactgttcttaatttttgcaattctgttcaacaaataattggagtgtttctttgtacaaaagattgttctagatggtataatcatgatacaattcttgctgctgttctctaaagtatcatacattcttctaaagcttaaaaaatatatattttaaatctcatacatgcacataaagcctattttaaagttagaaacctaaataaatgatcttctcaagaatctctgaataactgtaacatca

SEQ ID NO: 44549 - DNA, 1961 bp, Bovine  19866880757191
tttaaatccgttgacttatcaaagtagtttgtaaatgaggaaagaataactctacatgtaatcatcctagtttggaagtggaagaaaatgaacactctgtaaagtcatacttaaactatccatgtctgagaatcatgcagagaaacattgccaatggaaattcagtgaaaaagagctgtgcacaggggctaagctccactttagaaaacagcatttcctgattatgcatttaggaccacattttatagagtaaattatacaaatgagattattccatctaaggtttctgtataagttccctatttgaaatgtctgatattcactggttttcatacagcaataagcagtagaatgttgtatatttacatggttttaaataaaatttcaattttttataccttgataccctaattataaagtaagtctgataagatatataaaagtgaggtaggacttagtaggaagatatgtaagaaatgctgaaatatgtttgtaaaactgttatgctggatatcaaaaaaaaaaaaaaatcaatagattcctaaatgtcctcttggactcttgtcttcaatacagtcattatttaattaatagcaatgactgcttctctggttctatttttagattatcacggaaaaccacatatcactatattattccattgtaacatgatttacttgctaaattgtgcccgaatcttgcgaccccatggatatggggatctttctgaccaagggattgaacccatgtctcctgcactgcagacagattctttatcaactgagcttccagggaattcccaggttcaatccctgggttgggaagatcccctgcagtaggaaatgacaacacagtccaatatcctttgcctggaaaattacatgggaagctatagtctgacaaagatatgtggcaaagagtctgacacaactgagcacacatacagagtaaaatgaaggaaattgaaaagcattttaaagcaactttaaaataatattaagctaatgtgggatgccttaagaaaatttctgcctgatagcatggaaatcatataattgattttataatcaatcacattgaatgccaaataaacaattcagcttcagtattatgctacacgttgtattttctttatatattaatcttctttttaggtgtatctcttaacaagatttaaatagaagaatgttcaaaggggaaaaaaaaagaaagataaagcttataagaaaaaacaaaaaaagagatcaagaaatatgtcttaagttaccatttattttcatcatctactacatgtagtaagaaaagtaaaaacataattttcttttgagagattttcttatgaagatattaactgtttaaaacaaaggtgatgttatgtgaatttttagcatgtactgaatgtgtgtacagaaatgtgtgtacagaaaactacaagggattgaagagtgtaaatgagagtatgctttgaaacaaactaatattttatgaagataaaatttaattattaaataaggatatcttaaaatctatggcataattagttttaaaaagtgatataaatgataacccaacaatggagataataaaaatctttaaaaatactcagtgtaaagaagattgacatagagggaaagtaaagaaagatgaaatggaataaataggaaacagccaaaagatagatttaataaaactgtaataatacaattgactggttttattccttttgcagtccagggattttcaagagtcttctccagcaccatcaattctttggcactcagccttctttatggtccaattgtcatacccatacatgattactgagaaaaacatagctttgactacacagacatttggtagcaaaacgatgtctttacattttaatacactgtctagatttgtcataacattccttccaagaagcacacatcttttaattcaatggatgcagtcacagtgtg

SEQ ID NO: 44550 - DNA, 1726 bp, Bovine  19866880971277
tgcatacccatgttcattgcaacataattcttaatagccaagacataaaaccaatgtaaggatcaatatgtgaatggagaaagaaatgtggtatagatacacaagggaaagcttttcagccataaaaaggaaggaaattctgccatctgtttcagcatgcatagactgtgaataaaatgcaagtaaaataagttagagagagaaagacaaatgctgtatgatttcacctatacatggaatgtaaaaaaactgagctcatataaatagtgtataatggcaggggctgggggctagctattcagttatgcaacatgattaaattctacaaacatattgtatgagtttatgcctataattaacaatactgaaattgtgcacttaaataactattgaagtagatcttaagtgttcatatatatacaataggtagggtctgagatatgcatatgccttctcattttgtcttacctgtagaaatgaaaaacaaatgtttattttaaaataatgcattaaaacattatcgttaaataatataatacagtttggataaaatttaagactattcttattcaacatgttctaaacatacacacaatacaaggacttcatagtaattattgagacaaataaatgacattcctgccatggaattattagatcactaaaaggatcatgactacactgtgctcaaaggtcaattatagcactgggggaggttgcactgaatttatgtcaagctgtaataggcaatcaggaaggtcaacccttgatgaggactggcacagagagagattagcagtgacatttcaaatgggcttgattcaaacctctccctttgtctaagttcaatgttcttatgaatttgcataaacaggttagtataacaagtagaatttgtatacattaagcatatgtcttattagcaatatatttattgtatccatcttatttttatatcacatcaagcagtacatctcagatttgatgaagactaacttgataaacactgaaataaatgtatttaattcagaaaattgggcattttaacagatagaaataataaatttaataatgcctgctaaaatatatctatctgacaaatatgatgatttttcattaaaaaatatttgagatgatttgacatataacacatatgtgatgcatactcagtcacttagtcatgtccagctgtttgtgaccacatgaactgtagcctgccaggctcctcttgtccattgaatttttcaggcaagaatattggactgtgttgccattttcctactccagggggtcatcccaacccaggggttgaacctgcatctcctgagtctcctgcattggcaggcagattctttacccctagcgctaccaaggaggtccactcacatattatatcataacaaatattttaaaatataaaaaaattccccccatttgaaattcaaccaattaacttttggcaagaactgtacacaatagcataataatatcaaggatactagatagatatctttacaaaataattacataagtattgtaagtgtgcccagagtatcaatatgttaaaaagttcacacgtgattttcacatgtcacctaacatgagaatcaacattctgtaaaaatatagaaatcatgaggaatccagaataaacaattgtcattttttcttaagaatcattcttctcatcatttttgtactcaaagtgagactggtgggtttaata

SEQ ID NO: 44551 - DNA, 1705 bp, Bovine  19866881334078
aatgagtaaggctgagtagggtggggaaggtggggaaaggggggtcagaaggtgaaagacagttctgtttccagaagtagtgatttgaacctcactcactgtgacacagctatcttctatgtgctccccggtggctgaacaatttaggatccataaactctcacactatagctggcatattaagatactattaattttattatattttaaacattatctttcttagatgactttgcatctagttttttttaatctattctatttttctttaagtcaacaatttcaatcttaataagctatcgtaacttttttcttacttctgaaaacatattttctttagattaactgaacataaattaccattaaaaataaattgcaccttatatttttcaatggaaacaaaagacttcaccttatcttctttctcctctaaattttcagctggctcatagtaacatatgcatctaaaaaatttgtcaactcacatgtcttctgtgaaaagattgacagtatcaatagtgacaggttctgaaaaatccatataatactctaacagccatgtaacacagaaatctagtgagcaggtggtaacacacaacagctaaatgtgcatctcaaactcattaagaatgttaaggatgggagagaaatcaagagaaaaattatagataataaacaaaaataaatgaccattgggtgtaactcttctcaaaggccagaacaacttattgtattattgaaatattttgctatactcaaaaagacagtgttttcaaattattttaatagtgtattaatcacagattaatactatctaagttccccaactaaaagtagtagtttaagtagtgttcattatttttagaagtggcatctctagcttttagtaattcattatttaaagctattgaggttagtcacttttgcattttaattcaaaatagcaattgttaaaataattgtggcatcaattacctatacaatactgacaaatcacataatagcattgtcattttaggttaatttaagtcattgaaatttttcatatggtggtttccacacaataatggcaattaccattaagtattatggttaaagttgtttaggataaatttcactttgtgcagaacaagtgaattcaatattctaaaacataagttccttaaacaagggtactaatattttagagtatggttctagtgagcattacatggaaatgcatgcataaagcttaatagactgaatagcaaaaacagtgaaaatattgctcaaacaaattaatgcactgatccgctaagtgttgtatttaaagttgtcctcagattctgtacctgtaaatttccctaatttattacataatgcacaaaaatttttcctgaatattgaatttaacttaaattttcatttatatttatttttatacataaattttgattttattgaatacttatacatgaaatcttgcctaatttgaatactgttatctctgttttagctactgagttacttaaggtctgtcatttgatactacacaatccttgaaatgttctttttaaaaaacatatttttggcttatagttgacacattatttttttaattttattttaaaataatttcatacttactggaagaatgttacaggaatatacatatatatagctctcacatagtcagaattctgagatcccactcaggttttgcaag

SEQ ID NO: 44552 - DNA, 758 bp, Bovine  19866881615545
agatgctgaaaagtggaactagagaagattctgctagtgattttcattatagctaggtaatcattttcattacctagagtgaaagtcactcagtcgtgtccgactctttgagaccccatggactatacggtccatggcatcttccaggccagaatactggagcggatagctgttcccttctccaggtgatctttccgacccagggattgaacccaggtctcccacattgcaggtggattctttaccccagctgagccaccagggaagcccaagaacactggagtgggtagcctctcccttctccagcggatcatcccgacccaggaattgaaccagggtctcctgtactgcaggaggattctttactggtagctgagctaccagggaagccaaagagttaaacaggagccatatttgctggccatgttttatttgtcctttttcttcaaacaggataaccaaagatacagacagtattccataaagtaaaatagatgagacaaattctaagagactgcgatgccacatgctacatttaacctaattttattcatgcttgctttgggatggggaatagatcattcagtaaaaacatacagtaaaaacaaaatatgtcttatcatgtacaacttttaaactacaataatgatgtaccttaattacttccatgcacacaagtctaacattacagttttttaaaaaataaacacaattaagacttctaggagcattttataataaagtaattcctaattttt

SEQ ID NO: 44553 - DNA, 1373 bp, Bovine  19866880366363
ctgcagtcaccatctgcagtggttttggagcccaagaaaataaagtctgtcactgtttccattgttttcccatctatttgccatgaagttatgggactggatgccatgatctgttttttgaatgttgagttttaagtcaactttttcactctcctctttcactttaatcaagaggctctttagctcctcttcgctttctgccacaagagtggtgtcatctgcatatgtgaggttattgatatttctcccaaaatcttaattccagcttgtgctcttgcttcttcaatattcttgccttgagaaccccatgaacagtatgaaaaggcaccctctccagttgtgtcaatgaaaaatgtctctagacagtgccgatggtttaaagtcacgggaatagagtaatcaaaagttccctttggggctacttgtgaagtctacccctcctaaatatatagccatacagagccaaggcaatatctcaactaacaagtttctttcagaaaagagacttgtattagagaaaataaccttaagtaagcaattaacagtatttagttcagtaatcctgtaaaagggatatgtgtgttagtcgctcagtcacgttcaactctttgggaccccatagcctgaagcccaccaggcttctctgtccatggaattctcctggcaagaatactggagtgggtagccattcccttctccagagatcaaacctgggtctcctgcattgcaggcagattctttaccatctcagtcaccagggacataagcaaatgtaacacaaaattaaaatcttgtattatctgaaacaaaacagaggaaagatgaacgaagagctttagcaggcctgaggatgctagtaccttgtttactcatcaagcacacaaaatatcagtccctattagaagaactataatatgcaatttacttgccttaaagaaatttatctttgaatattaattttcattgtggatctgtatgtacaatatttagccctaagaaccgtgaccaagaactggctatgtgaaggggaagatcagctgtatccttttcagggaacacgcctcaattaattccttttgaagttatactcaaagatgtatacttcccctagaaacctaatttattgcttgtcttggtgctttcaccactgcagcttataaatataatttagattttacagatcaaaccataagctgtgaaactcttatttatcctattacaaacattatgtttgctgtcttaagacccttcgtcctgtaatctcatgataataaggccatatctgcactttctccagtttttcaaatgaagccagctctcctaatatgatccaagagctctgcccccatccaccccagacccattggttactt

SEQ ID NO: 44554 - DNA, 1143 bp, Bovine  19866880598153
aactttctattgggtggcatcgacctagaacgttattttgagaaggattgtgaggtcgtgtccagcagcaggaaagacgtccccagtccattagcaatgcctccaatgagtgctgagagaaccaggggatgcacatcccaagtgtattgaacattcttgagataatagtataaagcttaatctgctaagtcacttcagtcgtgtccgaccctgtgcaaccccataggcggcagcccactaggctcctctgtccctgggattctccaggcaagaacactggagtgggttgccatttccttctccaatgcatgaaagtgaaaagtgaaagtaaagtcactcagtcgtgcccgactcttagcgaccccatggactgcagcccaccaggctcctctgcccatgggattttccaggcaagagtactggagtgggttgccatcgccttctccaaagcttaacctattaagtcttaactttgggctacttaaaggcagatattctgcacaggtaatatcaccatgccttgtagaaaaggaatttaataaacattggaagagatctggattataatgaaagccatttcacgtacttttagaaaaaatttacaagattaccaactattcaccctatgataaaacagcacctattaaaataagaaatagaatactagagtttagggataaactataactattaatataattctgatgatgtgttgactcttgtaactttttcctctattagtgcttgacaacatgaagaaagctctcaagttgctgaagactgaactctagagaaaacacaaaatctacaagatcctccctctgtgttgggcctcgagactgagaaccagaggaggttttgaaaaactttggagaaggctgaagcactggtgaacctactgattagatgatggtttcatgttacaacagctttttttttaaattggttttacatatacatgtatgaaaataatatcatatgcttccatagtgagctgtgatttttaaaaaaaataaatccttttagggggtgtttaaactgttcatttttttcccaacctggtctttcacgaaaagctatttggtttactcaccaaataggatttttaaacacaaaatgttcaaaaaggggacaagacaaacc

SEQ ID NO: 44555 - DNA, 1965 bp, Bovine  19866880699092
tcttcccttggaaatttaataaactttatctaaaaggtcatgagtccttcctgaatagcactccaaaggtatttgtatagcatttaatatttagccaatcctttacgatcagactgtttattttcctcctagcaacctaaagtagttcattactatcacattctgtatagaaatgaagaagctgaggccccaaggcatatacactttattatacttactctatcagtcaagtgagaatcaagtcatcaagttgaataacacttttaatttcttttttattttatctcctaagtataattgaccatacaaagaagatttaatcctagcaggaggggaaaaaaatctgagataaaatacgaatctggtgctatacaataaaaaatattactgtgcttttttccttttctctcttcaataacctttccctttatcccaattatctgctaaattacccataaaatatgctatcagcttattttagactaataaaatattgcaaaaaaaaaaaaagaaaaacccacaggtgactaaaaccttaggttaaaaagaaagggtaaagtcactgagattgaattgcaactccagagcctctatcctgtgaacttctctagttcaaaagcaatttgtttttctaaagaaatagcataaacccctgactgtctgaggaaacttcaaaagtcatgttctccaacctcagctgggccgttactgtctgacgattctttcatacatctttattaagactcttgagagtcccttggactgcgaggagatccaaccagtccattctgaaggagatcagccctgggatttcttcagaaggattgatgctaaagctgaaactccagtactttggccaccttatgtgaagagctgactcattggaaaagactctgatgctgggagggattgggggcaggaggagaaggggacgacagaggatgagatggctggatagcaccactgactcgatggacgtgagtctgagtgaactccgggagttggtgatagacagggaggcctggtgtgctgagattaacggggtcgcaaagagtcggacacgactgagcaactgaactgaactgattgagtctcagcccattcacaactttagcttcatcttcaacacatagattccacaagttattttgatttttggtaaatggatctattaccatttatgaatgaatgaatgaatcttttcctttttcaattcccaacttcacttaagcaaacaaaactatcttctcctttaattcttctcacactttggggcccttttcctgttatctctaacaagcttagatggactccattctaaagtgaactttcatcagccctgttatttcctcaaattatctcctctcttgatcctaatttcttgagctatcagtatttggttttccatagcttattctctctccaaccataaccccaacccctaaaaactggcttttgctttcaattacctccttttatgtcatacacagggcacatttattcactcagcaaattcttttggagcatcattatacttggtgcaagaaacacaattgtaacttggattttacaatctagcagggaagacaattaagtaacaggtgaacaaaaaatacttggaaataacaaggtatgctacaaaggagatgaacaggtagactgctgggtgaaagcaagggaagattacctactggggtacccgtggtcaggaaggcttttctgacacggtggcaaaaaaatagcccggttgttccatagcctgtagaatgaccctttagaacagaccaatctataaaaatctgaagcaagaaagaacttggtgcctttaaaaatggagtcagttctacacagtaagtaggatgtaaagtaagggacgatgaatcctggaaacagactcaccggggtcaggagtcattgcaggctcagattctgaggctatttctagtaaaactccagtctgctagg

SEQ ID NO: 44556 - DNA, 2051 bp, Bovine  19866880796306
tttaatatactctgaggccgtggaagtaaaagcaagatggagctattttaggctctatgaatctgttcttgggaataattactttgtggaagaactactatgtgattgatgttttatttcttaataacctaacctgactcatcttagtttcacagataatcctttaaagtttgtttccttggcattagattcttttctaaagataaatactttgcattttctttctttctttttttaaggtactgtccaagaagctggaacgttgttaggcagcaagaatgttcgtgtcaactgcttggatgaggtaaaattttaaatgtttaataagatgttttacttcttatgagaatagataatgtataaaatctaataataagagttgttttctagcatttgtcctcaagttatattaagctctaaagcaaatatcagcaagacaggttgcaaaagacaaatagcatgtaaaaaatgtttaattttactggcaatcaaataagtgacaattaaaccaatactatatcatttcttatgaagtatgggaaacactggacttatatatgctaatagattaggtataaattgacatcacattctgaaaaaaatttttagaatatttctcgtttttaaacatgcataccttcgatccagcagttctcctagggaaggttaactgaatctaaactctacattatagaacagttgctgtccaaaataactttctgagatgatggtaatttctcttccaagctgtccagaatggcagccattagccatgtgtggctagtagctacacaattatgcagggcagttctagtactacagacagttaactgaatttctgtttctcacgcagaaaaggaagtgttttgttaaccctttacccacacatggatagcaaaattaatatcagacaaaataaagcaaaagcaaaaaacaaacaaaaagatgaagactctttgctatagatcattaagaatcctccaagaacatgacagccttaagccttcactaataagcctataagctttgaggttcaaaatgaaaaagacagaaatcaaaggagaaatttgtaagaccacaaaagcatcttctggttaagtagaagtattcaagagttggaaaattggataacctaacagtctctgcattgtgtataagacagaaatagtacatccccattttacatggaacactggtaaaaatttgcctgtgaatgatactaatttgtacaggaaaattgtagctaattttgaacaaggtcaccaaatgtaatataacactgaaaataaaaatttgatccaaataataaaacatataacctgaatgtgtgttaaaattctgaataattcttggctaaaggaagaaatagaagtagaatttacctactatttacagctgaaagcacaatatttatcaaaagctactgttgatcaaaaactggtgtcatgtggccaaaatcatattcagaggaaatttcgtagcatttattattgtactttaaatctttgtggtggtctgtgctttcagctcatgaaattagatgaaaaataatattctcagaaaatacaggaaatgaattaagaaaaaatcgaaataaaaaattttaaaagtcattaaacataagcaacaaaagaaaaaacaaaaatgaaaacctttgtacttcaaaccacaccatccaaaaaagtaaaaagaaaacccacagaatgaatggttttacagatcctatctggtaagggatttgtaaccgaaatgtgttaagaacccctacaactcaataataaaaattacaaatcaccctatttaaaaatgggcaaaggatctgaatagacattgttccaaagaaaacatacaaatggccattatgcacatgaaaaaaggctcaaaattagctgccaggggagtgcaaatcaaaaccacagtgagaggctactttatacccactgctactgctgctgctgctaagtcacttcagtcgtgtccgactctgtgtgaccccatagacggcagcccaccaggcttccccgtcccctgggattctccaggcaagaaca

SEQ ID NO: 44557 - DNA, 1023 bp, Bovine  19866880844628
ttggaacatgactgaagttttcagggattatttatccgaaattaaatattccaaagataaataatgtaaccctacttcattcatcactagcttcaagatcatctgagctttgtatggcctctcagctttcttttggtttctgtggttttctcttgtgttgtgtagtcgggagatgggttgtgtgtgtgtgtacctgctggtacctggtggtaaaggggaggaaaatgtgtccttttgcattagtttagactaagatagcaatttagaagccagtgtagcttgaaaatacttctaaacatctgttcttataaaaatatattaccacttggaagtgtctttttttcagaagataatgtatttacatttgtgttaaccagttactttgtagtatcatttacttttcgtacaaagtcatcagatctacttattctagtctgttttgaaataagcatacacttgcggacacatgtttctgcctcattctttgcttccatcagtagacaagttcagacttaggaggcaaaagtccagcggaaagtaccagaactgagggaagaatatttgtctaaccacccacgccacagaatgctttcttggaatccgctgtgtgtataagatggtatcctgtcccctcaatatgtgacctttgcctttctgacaatcaaatctgatccacaaggaaatcacaaaaacagaaatattgtttgctcaagttataccagatttgtttttttaaaaaatcagtctggttttaaaaattgaaaactgccccacaatcatttatggaagtttgctttgtgacctcagtttttagcaaaggtggtggagactttatttataaggaaaaacaattcaagggtgactaagagctatagaaattaaactggtttttgtttttttaatgtgtatggaccattctttattttcactccttaacagctttcctgagaatcttaagccgaaacttggtttgctgaggtagtctcgacctcggctgcccaaccaggattcttcatagggcat

SEQ ID NO: 44558 - DNA, 1904 bp, Bovine  19866880913254
tttctggttagaaatgttattccatggagctgaaaatgagagttagagaacaatatacttactacaaaaactatacataattatatgcacatatataaatttagttaagagctaacatttgctgtttttattaattatctgcaacttcttgcctgggctactgaattgcctttgaaggtacatgtgataaaaagagtgtgtgcccacaggactggaaaaggtcagttttcattccaatcccaaataaaggcaatgccaaagaatgctcaaactaccacacaattgcactcatctcacacgctagcaaagtaatgctcaaaattctccaagccaggcttcaacagtacatgaactgtgaaattccagatggtcaagctggatttagaaagggcagaggaaccaaagatcaaattgctaacatctgttggatcatcgaaaaagcaagagagttccagaaaagcatttgcttctgctttattgactatgccaaagcctttgactgtgtggatcacaacaaactgtggaaaattctgaaagagatgggaataccagaccacctgacctgccccctgagaaatctgtatgcaggtcaagaagcaacagttagaactggacgtggtactacagactggttccaaatcaggaaaggagtacatcaaggctgtatattgtcaccctgcttatttaacttacatgcagagtacatcatcagaaatgctggactggatgaagcaccagctggaatcaagattgcagggaaaaatatcaataacctcagatatgcagatgacaccacccttatggcagaaagcaaagaactaaagacccccttgatgaaagtgaaagaggagaatgaaaaggttggcttaaaactcaacattcagtaaactaagatcatgacatctggtcctcagttcatggcaaatagatagggaaactatggaaatagtgaaagactttatttttttggctccaaaatcactacagatgatgactatagccatgaaattaaaagacacttgctccttagaagaaaagctatgaccaacctagacagcatattaaaaaacagagacattacttggccaacaaaggtctgtctagtcaaagctatggtttttccagtagtcatgtatggatgtgagagttggactataaagaaagctgagtgccgaagagttgatgcttttgaattgtggtgttggagaagactcttgagagccccttggatggcaaggagagccaaacagtccatcctaaaggagatcagtcctgaatattcattggaaggactgatattgaagctgaaactccaatactttggccatctgatagtaagaactgacttcttggaaaagacccttaatgctgggaaagattgaaggcaggaggagaaggtgatgacagaggatgagatggttggatggaataaccaactcgatggacatgaatttgagtatgctccgggagttggtgatggacagggaagcctgacttgctgcagtccatggggtcgcaaagactcacaaatgactgagcaactgaactgaactgaaaggagaaaaaaaaagtcttagtccaatgagtctctttcaataagctcactgcttggtgcaggtctttagatgcctgagccagaatatggggccctatttaatatttcactaagtatcttcgatggttgacaaatctttctgttgctatgctcctgtcagtttgtgatgaaagttggtttctctgagtacataaaagacctccaagggggcagtgtgacctaatgccatgccagctttccagtatcagttctagccttatgaatatatattccaaggtttatgatgtcatcattactactgtaaatttttttttcacatatcctgctttctttttttttcttttttttt

SEQ ID NO: 44559 - DNA, 1119 bp, Bovine  19866880971961
aattatcacattactactgggaatctatgattcatctttatttttttatgtgtcattatatttatcaagtgttaaaataattcttgctggaggtatatcatcactattcctgcatttaaaaagccaaaatgatttggacaaataaaatacaaaaagaaacctactttttgagatactactactgttctgaaactattgctaaggagaatttaaacatgggtgtctttttatgctccaataatcatgagtatttcataatggcttttaaataatctcatcaaaacatgaaatagcattatgaaaacaagtcatctttcatatcctccagatgtaagtactttctgctcatacactgtgattcctggaatttgttatttagaaagattggtagattgcagctgtcaaaaaaacatcagatattatttgaacttgtacatcatcatggactgtatcagagattataagaaatgagtaatgatgataactgtaaagtgatgggcttgtctaaaagatcttatcttttccaaagctctcatcatttttagtatgaatttgatataagtttagtataaacatgtgagttagagtctgatgaccagacattttaattttatagttatagtaatgttttcttttttaaatgtttaggcttaacttttttttattacattgttaaacagttgtgagaaatcactaccctactttgtttaacaattgtttgtttatataccctgttttaaaatagtctataaagaaaaaacaagaatatacagattggaacaaaaggtagtcactgtcttttccagattggaggcttactttattggtacatctaacctgggtctacttaataaattaaatttttttttcagtcttcctgtttatgttcgttgtagttccttagctaagattaggtgaagtgaaatccttaacattctaaacatattaacttgtatataaacaggaagattcaaaagaggctagcctggatgaagggttagacctactaatgaattatagccatagattgtaaaagaaaacatcattagatcttggggtgtttgccagaaaaatctctacagctttatctttctcagtttttctctcatgaccatgcaa

SEQ ID NO: 44560 - DNA, 770 bp, Bovine  19866881334409
tttcttcagtctctgatccttcccatctctccattctcctaactacacggtgaagtgcgatcttactttcaagatgagattagaaatttcgtgtgctatatgaattggaaatagtcaaaagcactcttgataattcctctaatgaaccattagggtacgtaataggagtatttaactctgatctgaattcagaaatgtttgttaccctgcaaggagaatcccactactttaaagaaaaatattgattttataaccctgataaaatttgacagatttgagttatgaggatgagatatggtagagtcacagggtggggcagataagttctaaaagcagtgcttaagttaaatgtgaacaatgctcactttacagcttaatacaggatgtagcagggagaagaatctcatgaaacagttttgatcaagtgcttactggtttatatatacagaaataagtgctcatgattgtaaattagttttatatgtttattaaaatctatcacgggaaatactgtcatcagttaaataaaactgttttaacttttgatggattgatttaggtagacagatgccaacttatctgacttagtgaggatttattagaaattttactcatgccctctcataactcagaaaagctattttagacttatattctaagtttgaaaatgggtttccttagcaaatttaattttttcttatacttgcaacagtcccaaattatgaatctatgaaatgcacatgttctgctcaacctcattttctctcagt

SEQ ID NO: 44561 - DNA, 1167 bp, Bovine  19866881359973
ttgcctggaaaatcccatggatggaagagcctagtaggctgcagtccatggggtcgctaagagtcggacacgactgagagacttcactacagggaatttttgctgtatctcttaatgatggtggctctaaattaagttcatggtgagatctaatctaaacctgccctaccagctctttaattcattacataattcttttggaaatttttaaaaagcgcagtacaccatggctgctcttacatttttacctcatttccatttcaccttatacagcttggcaggggcttaggaacacttagtcatgttctaatcctgtgtgactcccagcactcaactaagaaagcaaggcagttttcaaagctctcacatttttcagactgttgaagagtctacaaaacagatccagacttttatgatggctagatttgcatatatatattggccaatggctgtatgggcttcagtaaaaatctctgaagaaagatctgtaatgagtttgccaccaagtatagggacgtggccagatggcttctgtcatgattcaaatttcaatattctgtgcaccatcatcccataacctgccttgagctgagtcatgagtttcaaaatgtcagaacagagttggtgggagcagcattaaaacatacatccatgttaggcaaacatttcaaaactgactgaagttctgtcattgatatttgtcaagaggtcttctgaatttgttgggggcaggggactaatttaatttttactttcttctatgaatccagatatgaggtattttgctaataattgtacacaacagaaaaataaactgaacctcaacaaggttaaacaactaattaggctgcatgactccaaagtcagtaactattcgtgccagcattctgtattcaatttaggaagaacgtgactgcaaagtctgatccgcaagttctgttcagagtaatacgtcatcaaaagtgattttctacttttatgaactataaccataatccttatgaatgacatgtaatatactaaattctctcttttgctgttcccaacatgccgtgcctcaaaggctttgcctgaaatactcttcctgaatatatctagatagttagcttcctcatgcacgtcaccttatgacaggccttcccacaccacagacacacctcactgttt

SEQ ID NO: 44562 - DNA, 1968 bp, Bovine  19866880276694
ctatttgtaaggcctcctcagaccgccattttgcttttttgcattctttttcttggggatggtcttgattcctgtctcctgtacagtgtcacaaacctccatccatagttcatcaggcactctatctatcagatctagtcccttaaatctatttctcacttccactgtataatcataagggatttgatttaggtcatacctgaatggtctagtggttttctccactttattcaatttcagtacgaatttggcaataaggagttcatgatccgagccacagtcagctcctggtcttgtttttggtgactgtatagagcttctccatctttggctgcaaagaatataatcaatctgattttggtggtcaaccatctggtgatgtccatgtgtagagtcttcttttgtgttgttggaagagggtgcacattaataatttttattcactgaaactcacttttctaattggcctcagagacatgtctttctctattaatgtaggttgggaggaaattcttgaaatagatattttttataaaatatctgggatttctagaaaatattgttatggtctatgatataccaaacatgatttacataacatttatcttcaagtattagagtgtacaaatatgcctaagctttagataattcttcacaatattttcatatctcagtttgtaatgatgattatctgtgtactggaaatatttagaaatgccagttaacagaggattctggttagtaaaatgctgggtagtattactagaaaatcagtataactatatttttcctttaaacattaatatttgcaacataatagaaatgtgctttcaataaaattgcctttatatcaagaaccaattaatattttcaccttgcttaattatttcatggtaaccaaagtctcttctatacaagtttcatgccaagatgattacatcttgttagtcagtttccattctgtaaaagtagttgctggatcttcatcttgttctgccttggaaaaggaaagtgatacctcatgttggtcagctgtttggatatgtatgttgtattcccttcccttataattagctctttttattacctcatttcaaaagattattaagggcctgggtgacagctactgtttctgaaagcatatacctgagattagcatttatagaaacatagcaagggatattaacaaagaaaacactaattttagatgagactctaagattctgatcttcagatttgctactctctgtgcaaatttttttcagagtgcttttaaaaataattatggttattatgataaacagttttagctggaagttgaacttgaaagaggactaatatttttccttctgtgtttatcacttctctatttggcctcaaaactcaaaataactattctccccacccagtaaaatggtaattctttagtcagttgtttgtattaaatattatcttggctccaagttaagcacagaatttttttcaacagaatcactgccattgctccattaggcctgtccttactcctaaaagacatttgattgtaagttcagtgagcctgaattctaaaattcaaagcagaattttaatagctgaaggcaaatttattgggggccaaaccccatccagccttctccagagtcaaggtgccagtgcccctcaggagtaaagcactactcctcttccttctcaggggcagttttggaatcagaagggccagtgaaactgattatcaagttttctgtcttcagatcatataactcccatcccgtggtggtgatgaatgatgtcccatttcctttgaaaggggaacacagaatttagtttttgcttaaaaggatgataaatttggatctgactctggagctatttgggagagggaaagtttatattaccagtaggcttttggaggctcctcttagtcattttttcaatttcctaagaaaaagccactcttattctcctcag

SEQ ID NO: 44563 - DNA, 1506 bp, Bovine  19866880440786
aataagttattacctcacactgttagaatgactatcatcaaaatgacaggagataacaagtagcaagcacttgccagctcccatgatagcatgagccaattccttaaaataactttctctctctctctgttttcctcttctctccctcctcttctccctccctctctctctctctctctctccctctccatatatatgcttccattgcccacctcacagggcacgcatccaagaattctcaaaaagggaagagagagggttggagaaaggagggctgggaaagaagagacaagagtgaaacctccccttccctcccttcccctccgaagaaaattaccagccagggaagtgaaaacattgtatctttaaatccagttcaggattgtatcctaacttggaactgaatatcttaatttctgaattgaaacaaattgtgattgtacaattatggtttattgttggtatgtaaaagaaaaccagggcagggaaacacttgctccaatgaatatatttgaaacagacaaaaaatacactttttgaatatatcccaagagccctgttcttcaaggtaccaattacacgagtatttctttctgtgattaaaacacagccaaaagggacttccctggtggtccagtcattacgaatctgctttgcaatgcaggggacacaggttccatccttggtcaggaaactattaataagatcctccctgctgcaggagcagccaagccctcaaactacaactactgagcccatgtgctctggagcctgtgggccacaacaaaaaattctgaatgacacaattaaggcctgatgcagccaaataaataaatatttttttaaaagagccaatattcaattttaacctcaatttaatgaatatttccacatttcttataaatctaactgcatatattattggttgcactgcctaaaaatgtcttttatatgagaacttacaggataaattctttaaagattccccctaaaagttagatttttcagtacacacaaaaaaatgtatatttcaacttataatgaaaattatactacctttatctcaactgacgtgtattaccaatgtaccatgtgctaatgatagccaagtggatactgcctctggcctctagagtcactggctggtaggagagacaatgactgcataagtaagtatgaagttaaaagttttgctaagcattatcaagaaaagtattgtgtgagactacaacagagggtgacaatttagatcaataaatttaggaactgtccctctgaggaagtgacatttaagcttagccccaaggagtgggagttaattagttctgcagagaacacgagaagtgcatcctggcaaagagcagcacgtccctcactggaggtaagatgccttgggtatatagaagaaaacgtagctggagtgtaaagaggaaaagggagagctcttggtaagggattctgggaatcagtgagatgataaagggctttggagggcacagtaagaat

SEQ ID NO: 44564 - DNA, 1481 bp, Bovine  19866880462295
catccatttagcacttgagttcagcaaagatggcatgaggcataagcacatctatccaccactctggagttgaaacatcccccatgaagggagtgaaaaactagagaaaaaccccagaccatggcactaaaaccatcaataaggaacatagccatttgacctatgactgatttgcaagtcatagtcacaggccctaatgacagccctcatcaatgtatggtctttctgacaattgcacttacagcaagaatctatcatctgaatgttaacataatatcaaactttaaataatatttaaaattttaagtggtaatgattctaatttatcacccaaatctgaagtaataatgagagcatttgtcttagaaacacagtggtctcttgctttaactatttttaaagttatgccactcattttatcaccactgtctggtccaaactcagatgatgccctggtgccagaaattgcacagatgcataaatcagacagaaaagtacaacagaatgtcttggtaattggctctgaagcatgccagagaaacctgtattatagctggaataaactttaaattgctgctttaaaagagaaaataaggggaagaatgactcctgaatttctgacatgagcaaccaggtagatggagttagcatatattaagacatcacaggcccaaacgggcagatgaaagaggatgagcaagttccaaacatgtagcatttaagatgcctgtgaggtacctgggtgaggtgatcagtttggcagttgtatgtggggaactgatgtttagaagaaagatccaagctagaaacagaaaaaaaggttacattgttggatcataaattataggcaaaactttgttaggagataagatttctcaacaaaataagtgtaaagtgaactgaaaagaaggtacaggactgaaagggagacaaacagtagaaccaggactgtaatgccatgaaatccaagaagaaaacaatttgttccctatttacttttaagaactagatctggttctcagcagtcagagctcactcaccccacatttggcatacactcaaccccacatctgggtacaaatacacatcactcatcccacatctgggtacaaacacttctctactctctgctctcctataaatcttcacatttcactaatttttcttgctctttcccccattgggttcaaactacacaagttatgttgggcatttgctcaagaaagcagataagacaccaggaggtctaccagttggcccaagacaaagctcattacttcaaatcacttccatacacagattcttaattttaactttgtaacttccttaagtgaggagttggtgcaagaaagaaactaaaagagagacgttggaaagcaaagattaaaagacaaagaaaaagagaaagagagagagaaaaacagagaaatactttagagagatgtctcttctaccagagaatcatcttaaaaatctttagc

SEQ ID NO: 44565 - DNA, 1117 bp, Bovine  19866880465773
agctgaggtcagaaaagtaatgaggagctgagtggtaattgaaaggtgaaattacatatttccaggttagtactctagtgggaatggagagaaaggctgaataatgtgcacactccccaaacacaccacatacactgttttctgccaggtattatgctcaggaagtctcatacattagttatgtgaggtgattatttcatttaatctttgtaacaactctataagataggtattattatctcagtttttcggatgataagtctcagagagctgaagtgatttgccaagatcctaattgttttaagcaacagagctagaattcaaacctaaatcagtctaactccaaatcatagccttatataaaatattgtacataatataaaaaagcatggagtaaaaggtaactctcaggttttgaatgtagactactatgcataaataagacatctggaagcacctatagtaaaagaagagaaaatatagatgaaaagctgctttaaaaagcacttcatgagttttaattcctttatagtagtttcttataagaacagtaccttctgtgtaattctggaccctcttctgtcctcatattttgactactgcattcgaattttgaggaataattctgaccagatggagtcccaaattatagggttctttttgctctaggagagatttgtctagtggagattcttttgaagaatgcatggtaaggctataactatttggaccaaatcacaattatttagaatatcctactttccttattcaacaaacaatgttggatcacttattgagtacataaggccttttggaatctttcctccttccttttgatccgctgttcccttcccatggaaagagccctattttctttttctgcccactctctgccctatatacacataaatagatgaaattcactgatcatttcagactcatctcaaaagaataccttcacttctgcctatttgagaactcttagagtcataaataattctctttcttttatatctaatcacttagccaatcattctaactctccttttaaattttatctaccatctaactacctcttaatactttcaaccattaccaccctgggtccacaccccat

SEQ ID NO: 44566 - DNA, 733 bp, Bovine  19866880595878
tggaggtgagaatgagcttagcaaatacatatgaaatcagggcaacagtcagactgaagtgaaaaatgtatgttgcagagtggtggaaatatagctgaataatagcagaaatggattagaaaaagcctggataaatcagaatttggactatagttagtcagtgatagaacatggaagttgaagcctggaggatgttatcactgattatcatgagaaaattgtaaaaaggagctgatttggaggagagataatatgttcagttgaagacatgttgtgtttgcagtgatgacataatacataaatcaaagtcctaacataatatcactcgggactgaaaataatttatggctagtggtgaaaatttaggacacagtaatgatgctaaagctgaaactccagtactttggccacctcttgtgaagagttaactcattagaaaagactctgatgctgggagggattgggagcaggaggagaaggggacaacagaggatgagatggctggatggcatcaccaactcaatggacatgagtttgggtgaactccagcagttggtgatggacagggaggccctggcgtgctgcaattcatggggttgcagagtcggacatgactgagcgactgaactgaactgaactgaactgagtgtgtgttaaccactatattcctagcctttttgaccactgtatacaccctgcatctttctaatcttattcaatagtaatagctatc

SEQ ID NO: 44567 - DNA, 1538 bp, Bovine  19866880597935
ctaggaaatataatacaggtggttccccaactattttatgtacatgcttacatattctcttacctaaataagtggaaatttgggggttcaaatcccaactttgccacttctgattcttatgacttttggcaagtcgctaatgtcaatgaatctggttctctctccactgtaaaacagaaacaacaatatctatctcaaaaagtaactatatagatgaaaatgaagtagtataggtaggatgcttagcacagagcttggcaataagatagtcttaatatagagttgtggttactgtttagtagctaagtcatgtctgactctttttgtgaccctgtggactatagcctgtcaagcttctctgcccatgggatctcctgggcaagaatactggagtgggttgttatttgcttctccaggggatctccccaacctagggattgaacctatgtcttctacactggcaggtggattcttcaccactgagccaccagggaagcccttatatagagtagttattgttataattattattaagcacataattgtttgggcaggaagctgacacatagcttaagcatgagtaaatgatggactatcattcaatggaagacaacatgtagccacagtggaagaattcttgagaggagtctagtctggccgtgtttgtgaatttaataaagacttcgtttttgtgcatgtgggtacgaggttttccaggcatgcaggaaagatgtggagcatcaaacaagttttgttagggaccttcacatgaactatctcctacattgcaaatgattataacatctttcatgagtcagctctcagaaggctcaaggttgtcctggtcctatttaaacctgtctagcagaaacctgggactttccactggcatttgcatttggtttataatctcaaagcaggtttaggtacaaataccacttgaagaatttatctcagtcttatttgcatcttaactgtttttttttccccctccaattctgacatgaattggaaaactagcattcttgtaggcattatttttcaaagacaaattcataagagggtagacaaattcataaaagggtttactaattcctgcaagtgagacagaaaaaaaaaagaaaaaagagaaaaagacaggtttggctgaaggaaaactgcaaaacagtcaaggtcagggattaacagagatttggatggaagacagggcttccctggtgctcagacagtaaagaatctgcctgcaatgcagaagacctgggttcaatctctgggtcaggaagatcccctggagaagtgaatggctacacaccccagtattcttgcctctagaattccatggactgatgagcctggtgggctacatgttgatcaacggatcaaaaagagtcagatacaactgagtgaccaccactttcacttggatggaagaaaggaccagtctcttaagttcatctatttgcccttggtcctctgtagtgtgctgattgttaccctaccccttggccagcttcagaaggggaaagtacagagctgat

SEQ ID NO: 44568 - DNA, 711 bp, Bovine  19866880678385
gagatggtgaaggatggcaaaggctggtgtactgtagtccatggggtgacaaagagtcggacatgactggatgactgaacagcaacaacaaattgtttcattctatcacagcaaacccaggacctgcaccctgcccaaagcatatattcaataaatatagattgaatgaatgaatgaggtttctgattagctgactatctgtaactaagaaccaatttattgtcaaccagagaaagaattttcttaatttgaagactttataaattgacttatattgtttctacatatccatattactaaatcaggctctgatttttcaaggcagggattttaaatgatgaaaccatataaggaaacactagatatcatagctttggttaaaattaatttttcttcttcttccatttcattttttcatatataagattcaaccaaaaagcaaaactctgtacagaaagtatttgataattcttattaagcaagccaattaaattataattaaaatctggacactaaaggtaagattgttgcaaggacgtaacaacagagcaaaaaaaataaaacactttggacttccgataattaactagataccaaggaaactgttatgactctaggaaatgtagatgagatagaatgcatgggttatgttctgccttgtgagacattaatgcaaatattataaaagttctatcacatttttataacaca

SEQ ID NO: 44569 - DNA, 2224 bp, Bovine  19866880703523
ttttattgtagaccttgcccttgagctgtgctctaaataaaataatgctctcaaagaccctcaagcaggcaggtgatggttcccctgcctgtatcactgtcacttacatttctggccgcatctcctcatcccagtctgttcttttctactgagaaagagaacttgcaagggaaagcagatcctagaattatattcatagaattttaatagttataaaactttaattctaattttttcattttacttatgaaaaaactatgccccaaagaggttaagtgtatgaaatctgtaagctttacctttcagatctttctaaatccgtacatttagtgcttctctcctatgaagtaaaccgcgtacattttatgaaaaatacttttctcaacttcattttgtcctagatttggtcaaagtttggttgccagttaaccttgacattgttgtaccttgcctgttttataattaatagttaatatattttaagtcttcacagttctacctcttcatgtgaattttaatgtttaaaataatttaatgacaacttgaaaatgtttgtgggttttttttttatgaggatataatgagaggaaaagtgacaaaaccaaaaagtataaaaagaaatatttttaaataatgaattttggaacattatagacaattcacaaaataattcaaatttaattagaggtttttaaagaatatttcagttggctgttcagatgattacttcttcttgtttattcttcatttaaatcaaactctgtgttttaaggaattgaaacatttggaaaaaatgttgttgtggctggaagatccaagaatgtagggatgcccattgccatgctcttacacacagatggagaacacgaacggccaggaggtaggtgccacttggagattctatgcactcttattaatacaatcttctcacttcctaagctcttcaaataaaaatgtatttggaaatgtgatttagcatatttgtgggtttagctgggagggattgagggcaggaagagaaggggatgacagaggatgagatggctggatggcatcatcgacttgatggatgtgagtttgagtgaactccgggagttgatgatggacagggaggcctggcgtgctgcaattcatggggtcgcgaggagtcggacataactgaggaactgaactgaactgaactgaatgcaataaaggtttcccttattcttttcccttattcttcatctaatgacatgtgtgcacacgtgctcagttgatcagtcatacctgatcctttgcgaccccatggactgtagccagctgggctcctctgtccatggaattttccaggcaagaatactggaatgggttgccacttcctactccaggggactttttccaacccagggattggaaactcttgtgtctctgcattggcaggcagattctttaccactagtgccacttagtaagccccaggtgctgctgctgctgctaagtcgcatcagtcgtgttcgactctgtacgacctcatagacgacagcctaccaggctccgacgtaactgggattctccaggcaagagtactggagtggcatatgacatcagttcagttcagttgcttaatcatgtccgactctccgtgaccccatgaaccgcagcacaccaggcctccctgtccatcaccagctcccggagttactcaaacccatgtccattgctttggtgatgccatccaaccacctcatcctctgtcatccccttctgccttcaatgtttcccaacatcagggtcttttcaaatgaatcagctctttgcatcaggtggccaaaatattggagtttcaacttcaaacatcagtccttccaatgaacatccaaggactgatatcctttaggatggactggttggatctccttgcagtccaagggactctcaagaatcttctcccaacaccacccattcaaaagcatcaaatcttcggtgctcagctttccttatagtccaactctcacatccatacaagaccactggaaaaaccatagccttgactagatgggcctttgttgacaaagtaatgtctctgcttttaatatgctgtctaggttagtgataactttccttccaaggagtaagctttttttaatttcatggctgcaatcaccatctgcagtgaatttcgagcccccaaaataaagtcagccactgtttccccatctatttcccagaaggataggaccag

SEQ ID NO: 44570 - DNA, 2313 bp, Bovine  19866880714935
tatactgaggtggagaaatccagtagaggcctgatatatgtggatttggggttaggaagagaactctaatcaaaattcacaatgtgatgtttaagagtttttaaataaagacattccatatcatcccgtgttagcctgatgtatttaaattttacatattaataatattaaggcatattttatgctttacacaagtgttatcaaacaacttttttatagcaaagttgtgtggattgcatagttatgtcacactcggtatagtagagacaaaattatactctaaaaacagaatgattatcttaaattcataaatgttgaatctttccacatagatacttaaaaatcattaataaatgtttctcacagcttatattttatgttcatgcttgtgtttctgttatgttcacagtaaatttgtcataattattctttatcattcaatgcatttgatttccattatatagtttggttaagtttcccagtggacctgctttttccagtcttaattctcacagcctattttactgtcaaataatttttttcatcagagacagcctaatttcagtacctgcatttctcatgcctatttattggttaaatgctttgtaaaaataggaacaaatgattttctcagtactttatggtctgattatctgttttctgagcctgatctgcttaatttttgcttgaataatctattgacttaaattcatcctttttttaaaaaaactaggatctgaaatgaaagttctacatactttaaatatactctgtaatttttcctatccatttaggctctttttctgttcatccagtatatttttcctatttataattctactcctatggtgtccattcaactctggagggtctgattaaggcagacatggtcatgacattcataaccatggtagtaactattaaaagtcctttatccctctgttgggtttccctggtagctcagtggtaagtaatccacttaccaatgccagtgcaggagacatggattcgatccctgggttgggaagatcccctggaatagcaaatggcaacccattccagtattctacctgggaaatcacatggatagaagaatcggactggctacagtccatggggttgcaaacagtcagacacaacttagtgactaaacaacaaacaaacaacagcaaattcctctcttaacaaattattgcctctgcattaaaagacaatagattctagggcatctaatccatatttagatggatttaggaatggtgcctaaaatcatgatattttccttgtatatcagtaaataatttaaaatctactctacagcttctgtgccattttgaatatggcccttgaatattatgactcacttcaacaactgactccagtaaactgactctggactacagaggaggtagaaggcagtttttaaaaccatgccttcagtgggcttatctctttctagtttattaattgtttagtaggcctaactttatatgaggctgtatcaagtctttgtttatagttgttaaaaaaaagctgtctagcaacacccatataaggcataaaatatgccttaatattatgtgaaatttaaatacatgatactaacatgggatgacagtggctgcctttatttaaagtagaaaagtctctttcaagcatcatgttgaaaattttgaagtgttaaccaaataataaaagaggagaaggagaatggaaatacagaggacctagatgagatgtgatgagtaaaaaacagtatgaattacaagtgggacagtactgacgttattcataccatctcgtgatctccagtagccgggaccatgtcttatttatctttatatttcttgtacctcgtgaagaaccttacattgggaactagaaaactcactgttaaatgaatacatttccttctttaaaagtcaggtgcttttcttggtttaagggttttttcccctaaaacttgaagagagctttcatcggggcagatgatctcttcaggatccattcagactctgattcttcttcaaaccttgtttggggctgttccacttcatgaagccttaatatggcattgcatcagcaccactgactcagagcttacacctgcagaattcaaaggtaagatagggaggaggccgagaaacatctgagaaatgatgactgtcttcaatgaaagaacgagaaaatgctatctctttgctctctattgtgggtagaagtatgagcccttctttggtgaagtcatcattcctgtggtatattcagatttgtggtactgctgaatatttatcccaaatgtattaggactgg

SEQ ID NO: 44571 - DNA, 1757 bp, Bovine  19866880716586
atgatctttctctaggtcaattgcaaatcttatatttgaatttttgatcttgaccatgggtccctgatgagaaaacataaccctatggtattatttggatatagagtttggataatgtcagcaaacagattggtggccagccctacattggtaactaccatacagaggaatttcacgctaaatggtaatttgtaaacacaaaaattagccattggaacttctatgtcaataatgttaagaaaacaaaaacctgtctttggagcccattatttctgtccaatttccaaatgggtttcagaaatttaaagctcgcctattcatctaccttcacctttcagagatttgtttcagtgaaatctcaaatgtgccagcaggaagtggcactggtgactcacaggatacaaatcacctctactctgtgagtcagggccgagcctacaccttacacaatactggggacagctcgtgggagaggttgagtgccctcgctccactggggggtggggggggcactaaatgtcctgggccctggggcattaagtgaaaagtgcgtgcctgacagtcagaaggaatgctaaaggtagaaaatgtccttttttttgcatacggtgtcttttgtccttgcttccttctggccacactgaggggccatctagatggagactgagatttggtgactggttaaccaagcctattctgcaatcatcaactgcaattctcagagataaaatgactctcctcaataacaatcaagtcaaatacaaatgacccaaaataaaatgagatgggttacagaatgaaaggaatgcaccttattttcctaatttaaccttttcggatatttagaccagaacagccaactcattatgaatcacagtaattgcccagcccaaacaggcagcaaaatcctctttgctcacactttctgcttggtcacatgcctacctactcacaaaactgttagttttctactttcttccagggcagtctgtaattttaggatttgtctttaacatactaggcttgttaggtcttgtatactttctttcaaggagtgaatatgccttcatcatttccagatgtctttttgtcttaaatgccactattagataaagttaaaataactgtaagctctgttatcacatcagacactgaaaagcactactgaaagactttctagtaacagcctatttctcagaaaatagcatatataatagtatatacatatcataatgtatatctatatagcataaaccttgcttcttgccagcaatcattttctttctacagcttttaatgttaactttaccactaagcatcatttaaaaataaatgtaaaagccaacagtaactatttagataaaaacaggataacagaatgaaaccagaggttgatataatgacaggttacaaataagtcttgaattttgaatttcaaatacagccataagatcttctttgtaaagtatcaggagaagatgtaataagccatagtttttcagttcagagacattaaataactcttcaaatctgtggcaataatttctaaatcatacttcaaaatgctcatatattttggttatcatacaatactatacttaaaactattcaaatcaagaagtgtgtgtcaaaatatgaaactagagcttattttatcataaaaatggattttaaagctgtctatcttattcataatgggaaatgttctcataatataggagaaggcatatccattactgtataaagtatacaatttt

SEQ ID NO: 44572 - DNA, 1633 bp, Bovine  19866880728851
tttgttgttagttgctagtcgtgtccaatcccatgaaccgcagcacaccaggcctcctgtcctccactgcctccttgagtttgagctttcatccccttctcctcccaccttccatcttttccagcatcagggtcttttccagtgaatcagctcttcacaccaggtggccaaaggactggagcttcagcttcagcatcagtccttccaatgaatattcaggattgatttcctttgggattgactggtgtaatctccttgtagtccaaggaaatcaaaaaaagtcaattatttagccctagagtccatcacgttttatgtaagtttgttaatagcttaaacaatacttttcttaaactataccgtgacacaaaaactttgaaagatagaaacaaaagtattttttattagtcacattaaaataatgaattttatttacaaaagatgcctgcactgtttctcctgtctttattttttatatacctcaactttgttaatcaagaaaatccttgttttttctctgagatagaatggcttagtacaatgctttagttttggaaactcatcaaattttttatcaggccagaactcccacacagcatgctaaaaaagcattttcttaaaatgctaccttcatgtcttgagaagcctcctgaactgtactttggactgtggttctcattacaggaaggtgttacaggagtcctttctttatagcattcttggtagaaaagcgttaacacaggctaccagctgtctagagagatgtttgtcccagctgtgccatcaaacacttttgagaacttggacaaacttcttaatctctttaaactttaattttattttctgtaaaatgagaggattaaactctcatttacaaataatctgtaggattccttctagctataaaattgatagatatttgtaacgttttacttcctttatggcaaaaaggaattttagaatgccaagtttggggcagagctgggaaatgctctattttattacattcattttgtatcatattttaagaaaactggactgcgctacagaatatctaatacgttttttgattaatttatctggaaacttaattaacatattcagagattaccctcattctcttagtcttatgttggcttccattttgtactatcttttatttacatactaaataatgcttatcagtctattttgtaaaatgacttggcctgaaaggttttcttgtgctcaacaagctctatccacaatcgagtactacgttccttctatgtagctaaagctacattctctctgtactttcgctattgtagctatttgagcctagagaaagggatggttaagagagaacctaaaaaaatttttttttcatgaacctgtacatttttaccagtctggaaataagatcttaggctttattgatgtttaattttgtgactgcagtaactaaaaggaccactctaatttctaacactttgttttccaagtcctcttcggaaacgtcggaaaagaagaaagaaggaagaagaaatggaaactctgggtaaagatataactcctataaatgatgatattcaagagactagtattgcttaatggtaagtgtgataaacttagtagatggggagctcttcag

SEQ ID NO: 44573 - DNA, 1870 bp, Bovine  19866880742708
aaatcaaagggctggcagcctgaccttttgtccttctgaaaaaccggactctgattcctcagaaaagtgtcaaaatcagtttaacatcccttctgactggtgataatgggtgatttttccatcttatacttttttgtacatcttgaaatttttgacaatgagtggtcttccctttcaaaatcagaaaacagtaagaataaagggggtgacttaaatcacattcaatttgtatttatgttctaaaatgaaaatctgggccctggtttcttctcttcagtgcttacttaccatcaaagattcctcctttacattgagtcctcgacttcatccaaggtttgctggtaaacagcttggtggcatagagttagttcctttaagtctgcatgactcttctctggagtcctgagggctgcgaagggcaccttacattatgacttattcaggtctccataacagtgaaactgagcaagacaattcctgatgtaacctgccatttatacagcagcatctttttagccgagactaatttaattcgtaatctccctttggcttgtgaaatgacccaaggaaccttgttttggctcaggatgaattctaaatcactataaatctttattattcttatcaagcccttgcacatgccctcctattcaggcagagactaatccacacagtttggaagcttacacatggtgaaatggcatttacctttctaaagtctttcagttttatcctgccaagcacccttatgtttaccactgaatataattaagttgaggctcacccagcagataattcaaaatccacagactcagccttgtgtcctttctagttctttcctctcacctccctagctagttgtgaaaaacaacgcaccttcccccccccaaaaaaaatcttcaaaatctgtcacagatcattgtcctccaaaaagtactgttgccatggagatagattcctatcatatctttcttttcaactaaaggcatgactggaatatttttagctgtggacagtaaagtctgtttattaaaagttgttattaatttgtgcaaacaagtttctgtaggcttaaagcaactgtgaatcacacatatcctgtgttggcttgatttttttttttttttttaatttgagcttctaaattttttcactatgtgagttacctccttccagagctaattagtaaaggaagtaagacaggacgagaatagagaattgagctaagtgagggggaaaaaggggggaaacgaaaagacaggttaagtatttttcttgggatcagagagatctcaatcacataacaatggttttttaccctgctctgagaaaaaccagcttcactgacttaagagagatgcttaagaagagaactgggtttctcagtaaatcatgactggtacccagtcctgcagctgtaaaaggggccttggaccagctcggtgaattccatgatgcacttggaggagtttggagggttctaagcatgggccttagaagcagcctgggttccccatcccccagtttttaactggtatatgcattcacccacataagattttgctatagagacataggatttggggcaggaggttattgtttgtttaaaaaaaaaaaattgaaaaatgagactggtttaatctcaaatgagattaaaatgagactgctttaataataaggtatattgtatatattatataaactgttgccctatcaagactttatttcaacattcattacttcatagtcctcacaacaattctgccggggagacaatgttatttcctttttacagatgagattaacagctatacatactttcccctcccttctccaggggatcttcccaactcagggatcaaaccccagt

SEQ ID NO: 44574 - DNA, 3457 bp, Bovine  19866880851990
aggagttggtgatggacgggaagcctggcaagttacagtccatggagcccaaagagttggacacgaccaaggaactggactgaactgaactgctctgtggagcttatattccaataagcaaaccagatgtgaacctgcaaatttaaaaattgctacattatctgcaatttattttaaattgcttatactgtgtggtatatagatagacattttaatttatatcctgggagtggctggttaatattcaaacaactctaatcagaaatacacacttcaggcatggtacttgaaaaactctaatcaaaatccaccctccagggacagttatcataaagtaacagttacattaatagttgatcaatagcagaaaatgtgttacttggtataatggatattggagataatttttcttttgtcaaataaaagattttccaattttaggaaatgactaagaatgttgtacaaactctaccaccatcacattaaaaactgtaggaatctagcaaatctagtagccttctatcatttgaaatgatgccttaggccttggtatctcttctggttgcatggtctaccatttaggcagtgtttgatactgattcaaatttagctgaatcctgctgctagaatattttcacatttgcctcaaatgaactctttaattaagagctggtctgggtgcatgaaaagacagagtgctaggatttcattgagcttaccgaacaggctgtgtgatgagttttgtgccttcctgatggtatttgttgtgcagaaaccattagatttgccttcagtgtaatatccctgctttttgtgagttctggagaagatataataattataaatggccaaatgagcctaggtcgttttacaacagtaattaatttcaaatgttataaatgccctaagggagaagtatgggtaatatggaagtatataatatctattcctgatttaatctaataaatcagaattaggggttacatgggaggcggggggaattaatcaactgtaggtaaaaggccaaaaatcaaggacggatggaatatttaaggctgaaagaaggccacctgagctatgtcaagaagagaggacactcgttaagacacgaaggagccaaattccatgagtcttgtagctaaagatttaactatcaatagatggaattaaaagaggcaaatgattgaaggaatgagtgagtgagtgaatgagactttccaaagcagagatcaaagaaagaacgctaggtccaaacacacaaatctttcctgtttgacagaaatcaaagactaagccaaaaggaagtgctacttgaagaagcgtgatcttgggcaatgtggtcagccttcaactttagcaaggaagagtagctattctgatcaaagctctgccctagtgttactccaaaaccaggtttgcctcttgatggatgtcaagccaatagacaacgaagccaaagatcagaagaaaggatttactacttgcagcaagtaagacaccagagagctttcccaaagtagtgtttctccaaacactacttggggaagtttaagctaagggaacatgcatattgagcagaggagaattcagcacagaattgagacaaaggttcacagtgtccaaactttagttgactgaagtcaggaggatcaacatcattatctcttgaggaagaactaggactctgctttatcactgcactgctgtttgactgcctttttctctgttcctatactcctttgttccctgagaccattaattactgagacctgttcgaggacaggcattaggattaaagaatttgcttaatttctgttagctttttagccatatttccttctttaaaatagcagtagtattggatcacaaagtggctagggcatggcagagactggtaagtccttttactcccagctacatttgcatctccttgccatgtgatatctaagcagtctctttcttctggttgcagtagactattccctcttacacacataatagtcagtttccaatccctcaggttgaatgtcccaattcctagaaggtgctatcagtcattccttgatgtgccaaattcccagatatttgaaagatcaggcttagatccaaaatggcctaggccaaaacgacttgtcttgtgtccagaaaaccatgcccagttctcttttcctggggacctgctaacctatctgtctatactaggtgagtttttctggcattttatctttgttcttggacaccaagtttatcttgtagatactgctgtgctgaaagagatctcagaggtagagattagtgggattctttctggcactgtgtttggcagtggtgtttttgtaccagtgtccaattagcccacaactccacagtgaacagcaaacctcattcatttgcataattatttcctttgctgtttcctttataaaaaataatgagccattatgcacataattaaaccacgcttaacaaatgagggccaggctgacaagaatcacatgagaaggccaagagaaattagcatcaaggcctgtatgctaagcataaggccaatctaatctgcactgtctcctgggagcagaaggactccttgggagtctctgcttttggattttcactgaggtcaagcttccgagagaaaacatgatttgatttcatccagcccttctcctctgcttctctctttctcctcctgtctttctcagtgagaagtatctggcttgcttgttattagggccctttgcaacaaatcctttgattcctttccccctctccctgaatgagacattttcccaatgaaccttactaaaaaactaatagaaataagtgaagttctttaatcctagaagtccagtgataagctttatggagaccaatatttccttctttaaaatagcattggatcacagagtggctagagcaaggcagagactggtgagtccctttcctcacagctacatgcgggtctccttgctatgtgacttctaagcagtttctttcttctagttccagtggattgtttcatcttacgctgatcctagtcagtttccaatcccttggactgaatgtcccaattaatagcaggcactatcagtcgttccttgatataccagaatcccagatactcggaaggtcattgatgagtgatgcagtgaacattccaggtctccctggtctggattctattttccttggggcttcattattcactggatggtctgaggagcagcagcatcacatgggagctttttacaaaggcaaaatcttaggctccactcaagaccttctccagacctactaaagcagaacagatatattaagaagatctccaggtcattgtttccatattaaagactgagaagcaatgatctagggtaaccagtgggactcattcggttcagtttcttctagggttttggactacctcgtattcactatgtggtaaaagaggaattccagt

SEQ ID NO: 44575 - DNA, 1352 bp, Bovine  19866880857279
aaactaacccaatactataagtcaactatacttgaattaaaaaaacagaaatacatgcaaaaaaagcatctaacagtgtatagtacatagtgaatattcaataaataacagttataattatgaaaatccctacttttcagtgattaaatttcattaaaagaaaataatcattaatacaaatcctccctttccccagtaaatagctacttacaaggaagcagtcaaatttatacccatagaattttaatgttgaagagataatcacctaacattcttattctataaagcaaaccttactcctttagtggcaatcataacaaagttgcatatttgaatatattttacagtttggattcttctttgaacctagtactcactaggcaaaaagatatgtttagagcatgaattctgctttcctgaaagatgaacttttggattcctctctgtttcagggattatgaaagttctagtcagcaaacattttgagtaaactggctctattctgcatccctcattttctgtggcattaccaggaattcatgcatgtcaggctgtgctcatgatggagtttaaatgagtaaggaccttggtttctcttgaagggaattcggtcctagaacacatgtgggaggctgatccaggatttcatttcactgggcttaatgacgttcattcaggaagcaatggtgctggacagttcccttccaaacaagctatgaatgaccaggaccatgtccaggatttggtggatcagaataattaaaagggtgatgttattatggtcttgtgcagtaactttcgcctttgattcattatccatttccacatgaagtgatgctttttcatttttatctgaaactgatctatttttgtaatcttgttgaataataaaacatttgaatgttgaagctaggactttggaaatagtgccagctgtttctggagtggccaggaaatgagatttcttaattcaagctcaagttgtcctaatgtccagaaaatgagatttttaattcaagttcaggcttagcccacatataccactagtcttctccagggcagtgattccaccattgctttgtgtttggcatagttgttccaggaccaccgtgtgtgtgtgtgtgtgtgtgtgtgtgtgtgtgtgtgtgtgtgtgtgtgcgcgcgcacgagcactcatgcgtgcctctagaaatttgaattttaacaagcatatcaagtgtttccaatgcaggtggtaactgagaaacagtgacatttaaagaatgagcttctattttgcatttgttctatcaaggaggctgttctagttacttcttgctgtgccatgtgtgtgctaagccacctcagttgtg

SEQ ID NO: 44576 - DNA, 1738 bp, Bovine  19866880971047
tgaatgtctgagggaagaagaaagaaggaaagaatgcagtgcaaataccaggaataataaaagcaaaggaactttggacctgacaacaaagccgatgcaatggaggagctcaaaaaagtgcattatgactgaagcacatggtgcaagcagagaagagacagagaagaggctaggaaggtggtcatgggctgcatgaccattaagtgaagggtcaggacagctgtagatactgtgttcaagatgaataagcttttgaaaaaatttcttttgcgaataaacctaggcatttatgtatttaagaataaccagcttttcaaagtgagaaattggagagaaaaatgtatggtggtttagtcactaagtcgtgtctgactcttgtgatcccatggacggtagcccaccaggctcctctgtccatggcattttccaggcaaggatactggagtggattgccatttccttctccaggggatcttcacccacggattgaaccccagtctcctgcattgcaggcagattctgtatactgctaaataattttcagaagaaaattaaaataaagaagaaatccaagttttattttcataaagttttaggttcttgaatgctattcaattatttttcaagaaatcccttttcagcatgaaatatgtatctaatctgctatgcttccttttctccaatatgtagacatctactctttatcatgttattgatttcaaatttctaaagggaagaattaacacaggtttggcttgacataatttccatcatttcttacttgaagtcaaccatctttcagtttgaaggtaagaagaacaggcatggcgcagaagtttaaaatttgaggtaatggagggatgatgaaagaaaccaggtgttcagattaggtgtgccttaaaaaccaggggtgacacatggtcacaaggtgtggaagtattgctaacgaaggatacttacagctacataagggattaacagttaccttttaacaattaaagtaagaataaagaagaagtgtgtgatcgttaaccttccggcaccagcaacccatgcttcatgacagggtatctctggcttgtgtgttgtgtgtcattatttcctctggaaactttactttcccaggttttcaggatctgggtttaataatccagactctcattttaaacacttcgttaggaagactcactaatttttaagcagatagggaatttctattgctgtatgatgtatgcgctcattcactcagttgtgtccgactctttgtgactctttgctcaccaggctccctgtccacgggactttccaggtaagactactggagagggttgccattcctactccaggggatcttcccaactcagggatatcaaacccatgtctcttgtgtctcctgcattggcaggcagattctttatcacggcgccacctaggaagcaccatagtatgtgatatactgactccaaagttcccgaataattgaatttacatatatacctaaacagaattaatttcgctaatacattttgaaaattgtatattctagttaagtcaaagaatgtatttgtgctttataaatctattcttgggtagaagagaaagaattgatatgttaaattcccacagtactgttttatttccatttgtattttgtccatttctctctcttgcaaaagaagtactctatggcccatatcagatttccagcaatggtacaactaacttttaaaccaactcc

SEQ ID NO: 44577 - DNA, 1453 bp, Bovine  19866880972803
acgtaaatcccctgttctagagaaagaagactgcgtctgtgtgtgatgctcaatggctcggtcgtatctttttgatcccacagactgtagcccaccaggctcctctgtccatgggatttcccaggcaataaaactggagtgggttgccatttcctcctccagggcatcttcccaacccagggattgaacatgcatctcctgaatctcctgcattagcgggtggattctttaccactgaactgcctgggaagcccaccccccgccccgcccccgccaaaagactatagatagttactgaaagagtgtgacgcatgtggtaagcatttaatactgaaaaacaggaaggatggatgactacaggttaatccactgcaggtctttggagttcctagatcctccaggtctactgacgctttcttccctgtttcttactatgtgtgagtcagtatcccccaaaatccagctgttccacctggtaaagtgagagctctggatgcaaaatgcttctgaaattgcccacaaagtttcttctattttttatgaagagatggtacagagatttcaatagcattttcagtgaaagtcactcagttatgtctgactctttgagaccccatgaactatacagtccatggaactctccaggcctgaattctggagtgggtggcctttcccttctccaggggatcttcctaacccagggattgaacccaggtctcctgcattgcaggaggattctttaccagctgagccaaaaaaccattttttaaattgttgaggaaatctttgtctgggctgatttccaagcctcctttccgtcttcttgactccctggagctctgccctgcctggtcagacttttccctggaggggttgcagggtttctggcattcctctgaagacagagatggataaggtgtgcaggtttgttgatgttcacttggtatttttagtccatggttagcaaaaggagagatagcagcagaatggcttttgttgactatgaaatctcacatctctcctgtaaaagtcccctttttttggagaatcctttttaactggctgcccctgccgccaggattgctgcctgaatcctgggcctcactgttgccaggaaactttctactccctaaaaggtttggtgtgtagtctgtcataagaatgggccttaaagactgtcatgataaacaatttagctacacgtgtctctaaaggtgtggatttttgtccatcttaggaagtctctgctagagtacttcttagctctgtttcttccctggtaggttcagagtccagtgtagaaagaagttcatctgcatcctcatgcaaataacacgtggctgcaaaattggtttaaagtctccttggctacagttaaaaagaaaaaaagaaaaactggataactgcattgcaaaagaatcaaatggacttgtttctcacactatatacagag

SEQ ID NO: 44578 - DNA, 588 bp, Bovine  19866881241855
ggatcaaactgggtctcctgcattgttggcagattccttaccaactgaaccactagggaagctcagcactgttataagggtttagaatatataagtgaatcaaacaaacaaaactcttatcctccggagctcacattttagtcaatcatttagctgtagcctcttgatgagctgggcttccctagtggtggctcagatggtaaagaatctgcctgcaatgcaggaaatctgggtttgatccctgggtcaggaagatcccctggagaaggaaatagcaacccactccagtattctggcctggtgattccatggacagagaagcccggtggggttacagtccatgagatcacaaaggatctgacatgacagagtgactaacacactttcacactcttgatgagttaattattttcccggagtaaatacagctttggaagctgtgttcatggttctcaaaccaatacataatattatttaagttacaccctctgggttctacgtcaatgtttcaagacacaaaatacgtatcaggtgcttacctcttgcccaatatcatttaagaattgttggatcatcaagcagtgacaa

SEQ ID NO: 44579 - DNA, 1363 bp, Bovine  19866881257539
agggagagaaaacccaactgctgctgcagctgtatgtgtgtgtgcctgtgtgtgtgtgtgtagtgcatgcagatgtgtgcttatgtctgtccatgtgtgtgtctgtgtgtgtctgtgtagtgcatgcacatgtgtgtttgtatatgtgtgtgcctgtgtgtgtgtagtacatgcagatgtgtgcttatgtctgtgcatgtgtgtgtctgtgtgtagtgcatgtagatgtctgtttgtgtatgtgtatgtctgtgtgtagtgcaggcagacatgtgtttatgtatgtgtctgtgcatgtgtgtgtgtacaaacatatgcatatgtatagcttgttattataaaaagataaataccatttttaactttcaatcatatgaacatagtctttaataaagattataaacattatgttgatgctgcaaaggatagccccctttcattctttcctcctcaagttcattgaactccaatttgcagtgtgggtgttggagatatcagttacaagccattctggatgaatccaagtgtaaagaaaataatctttgctcctacttctaaatgcaagtcttctaaattgagagtattaaatgggctactttctctgagttgaattttttatggaggaaaaagcttcaatgaatttaattggttgtttagtggagtgagaaatattaaactgctaactccatggagacctagcctttctatacagctttgggaagtgccttgaatataaaataaaactcagttatactggattgtccctgattcaaagtataagattatttgaataggtactaagtaaacctgtccctatttcatatcagttctagtgagatctagttaagcaactaaatattttaagtttttaagaaatatatgattgccttatggggagaatgtgtcttatctctcaagcaagtagctcaaaaatacagttgatacaaacaagcaatactcactccaggtttctgaatataaagtatgtgtatgtaaaatgcatttaataacaattgtgctcttaatttaaaagtttcacttaatgggtttctaaaatctttaacatcatcagctttatgaatactacctcaaaaagattatataataatttgatgaggctaccactcttttcttgcataggctacaattactgagactttcataactatgaattcagaaggggaaatgttttcaacatcaattgacttcatgcataagatcctagacattaatttatacattcactaaagttgaacaacaaaaacaaagtcttattgacagactactatttatgagactgagagtcataaaaagcagaccaaggttccactaatattttttagaagttcatcacctatgaaag

SEQ ID NO: 44580 - DNA, 1059 bp, Bovine  19866881314276
atatgtttaccacagctggggatttaatatttgggattaatatcccggtaatccttttgattgacttggaggtttgtccaagaagcttccatcctgcaggaatgacttggatgcaaatatcaaatgcaactgctgggtggagaaaccctcaagagccaaccgtagcctgattaattagaatcaagtctctagaatcacatctacttcagacaaaatacaagctgtatcataaagcaccaaaactaaccactaaacaatttatgactgttgatacctacttagaatcaggtttttaaaatgggattctaaatgccttttgcaaagttataaggagtcaagtatattacacaaccaccttcacccagcactttcataaatcaatgacttcaagtgggagcacaggactttaaattataagcaagaagataatgatagaattaaatcctgacctttcccataaaagcaaccatcctcttccccacccccactcttctctaatttacagtaatgtagtccatatggaagaagtcagtgtgtgtttgggaaccaagtcttacactttcttttccatcacaaaagccagttgttcttcagaaccatccatcaggatcatattacattctgaagcattaaaaaggaggcctgagctcagacctcctgctgaaaagttaagttgtcagttgttaggcagaaaatcaatcagaaatgcatttgggacaatggcctgctgcctggaattacaccaggctagacaaaaatcaacccagtggcagaaaaacactaatggttggagatatccatgctatcttagacaaggcagatcaatttatttagacacatttgctaaacggaattgtgccagtgccaagtctcggatttacatataattatagcagaacagttgcaagattttctcataagcatcaagatactctgtagctccaacatgtgccaggaacttcaaaattgttatagattgctttggctaattcacattcctatccccaggtcttgccgtagacacagagactttgccacagtttgggtaatcaatcatat

SEQ ID NO: 44581 - DNA, 774 bp, Bovine  19866881396535
cttcaatatcttaaggtacacaattatcaaagctgatatggaacacaaaccaaattgatacaattcagtactccggataaaattcattgtcaaataagttactttaaactgcatgtgatacaactttatgttctacagcatctttaatataaactgtataccaaaatggctcttcaaacgtaaaaagtgcaattacagagtgcaaaaaaagcagagagaaattcactatcttacatttaacctcatccaacttgaataacaggcatgtgttagataaaattattcttcagtcaaaacattaaaatttactcaagcaacactgtttatataaaggttgttactccccttttccccataggaataagagtagacaaaaatcagaaattattgggcagcaagttaaacacattttttcccaaaagtctacatactgactgttgcagcaaaaatagcaaaatggatcagacatgagtttttactgaattcaatagaaattagaagctaatatcatgtatttggtacatagaaattgatctgacacctcagggcagttgaatttaactaatcctcttctcaggactcagaaataaaaatctgtcctcccaatgcaccatctctctccttgctttgactttggcaaagagataagaacaaagaatgtccaaaagaacagtggcatttgattgtattttaaatatttaataaattacacaaatcttgatcatgaggttatctttagcatcaatcttagaccctcttggttatagagtatgt

SEQ ID NO: 44582 - DNA, 592 bp, Bovine  19866881526078
ttatgtaataaacctggaaaaacagaaactaaatgactactcatttcatttttaaggaaccttcctgggctatcaaaatagaccagttcctattttaaaagttggtgaaaattttgccaattattctgaacttcttcaatgctatccttgatctttcttgtaaattatataacaaaatagataactatgttagtcggatttctgactttctttcttggtacattgtcctaatctgagcaacgaagatttgggatgtagtctaaaataaacataaagaaatatatagtactgaaattctgcagtggttttaaaataagtataattgtctcacatagaaaatattagtgattaaaggtaaaatcattgtgatgcataataaactcattcacattagtgattcacgtgtcatttttgtatgtcttcaaaggcccagtgaacttttgcacaaaaagaatttttgcctttaactcacttctctagagttcattgatttcctgttaaccgagattttgaaataccaactgaggtttgctctagaataaacaatttgaggaggacccaagccagtattcagaatgctaaaggggtcaaa

SEQ ID NO: 44583 - DNA, 1133 bp, Bovine  19866881783767
cacgcttattataaatgaaaatataataactacaacaaaggaacaacctagcagacacctctataaccaagtgatgcacgttaacaagactggtcataggacaaaccaaacaatacctgtgccctctggggtgctgactatgaaggacactgtgtcctagtttgtgggattcttgccaatagggcatgatctgattctaaccatcaacaacattagacaaactaagtcagaggacccaagaaactggtctgtattttaaaaacgtcaacacactgggagacaaaggaaggctgaggaactgttccatattaaaatagtttaaagaggcatggcaacaaaatgccaagactgagtctgcctttgttttaagggacactactgggatgaaatctaaataagcctgtctaaataaggttagttatcaagtctcatactttctagcctcagatgcctccttactctcaaaaattgaggaccccaaagaatttttgttcatgtatcaatatgtaccatactagacttaaaactaagacatttaaagatatttgattcactaaaaatatacccactataccttaacataattaaaaatgactaaagtttctaaataaaaaaaatgagtagagtggttattttttcttttcttttacaatttctttaacgtctgataataaaaggcagctggattcgctcatctgctcctgcatacactatgttgtgatatattgttctggttgaagaaatacatgaaaacaaattttgccatatacagctacgtggttaaaagtgaagactatttaatggccttttaagataattgtggatattcttctttgatactataccaaaccttgacaagtggttgtttgttagaggttaactatcatgtggaatatgaactgcactctgtacatttgtgagaaaaagtccttatgttttaagaaacacatagaaatatttaaggataaaaaggcatatatctgaaacttactctcaagcagtttatgaaaaaatgtatacaacacatgtaagtatgtatatacatatataagtagaaaagtaaagcaaatatggcaaaatattaatatttgtgaaatctaggtgaaagatatataggaactcgtgttactgtt

SEQ ID NO: 44584 - DNA, 1088 bp, Bovine  19866881865126
agttttctaattccactcctggcttttcctacagtctcataatgcctcttgagtaaaatttctaattaacatccaaaggtattgtcttagctgtgttaagcctgagccataaattatttctggcttcatatacgggtcataacaatacctcttctgaaatcagttatggaaaacaatttcctttccattagctacttaaggtccacagatgagcaagggcagattctcatctcactcctctggggagtgaagagaaatcaaattcattatctcacaagcacatatccacatctccctaagtgcttacttctcaggtatatgaaagtttctatatttattagcatccaggatacatttgggaagccttgtttaagacaccatactgactagtatcaatgctgccaccttttggcagacttgtatctatatcttataatgaaatttctaaagaacagaatgataatcagtccacctccaccacctaatttattaatgtgtctagataatattaacctaacctttgtatatgtaacctgccaaaggaatgaatcaatagttcaagtggcagagcactcaaagaatattcttaaaatgaaaggcctttttgtatatgtgttacgaatctactatgaaagcgtgacccacttcatctgttaatatagtatctcctttttctagctgactacacagaaggacccatagccttgaagttctcacatccttgcctggaagatcaccacagttactgcatcaatggtgtctgtgcattccaccatgagttggagaaagccatctgcaggtagttgcaaagaacttcccaagtcctagagatgggagaaggagaatgtatggtgtttcacatggtacctttatatacacctctattttacccagtaaaaaaggtacatgctctgaacatgattcaccaattctctttgtatttgaatatctaaggagtctttttctaacctacctaattctcactgcttaaaagtatggttcctagattagcagcatccgtgtaacctgggagcttgttagaaatgcagaagctcatgccacacctcaaaactacgaatccaaaacaa

SEQ ID NO: 44585 - DNA, 1778 bp, Bovine  19866880415813
tttcattttcatcaagaggctctttagttcttctttgctttctgccataagggtggtgtcatctgcatacctgaggttattgatatttctcccggaaatcttgattccagcttgtgcttcatctagcccagcattcctcatgatgtactctgcatataagttaaataagcagtgtgacaatttacagcttaatgtactcctttccctatttggaaccagtctgttgttccatgtccagttctaactgttgcttcctgaccttcatacagatttctcaagaaaaaacttgcatacagatttttcaattaaaacttaaggttttaatgtgcaaatgttcttgcttctaacttcactgtgtgattcatgccatgtctcatttagtttttaagaaaaatcacagaaaatcatactaaaccccaaatcttctgatggagattttgtgagaagggatcactatggagaaaagagaactaagagtctgtgtaaagataattagtattactgaaggaaaaaggaaagaattagtaaaggaaaaaaaaaactttcaaaaatttaataaaatattcttgaaacattagaacacctgaacattcagatatcagttactcaatatataagaaaaatgacagggtataatgattaagaagtatcctgatgaaagtactatcctatgttaattagcaaaagaattttatagggagttaccgtgtccatggaattaaagaaggaaaataaacaaaaaatagattacctatctagttttgatagaaaacaatattcctcatattatatgactaaaacataagaaatatattctctaatactcaggaattatgaaaagatagcaagcatatattttacatataatatgtatatgtattatacatataattatacatataattttatatataatctagccaatgacctgttgaatcaaaattaagaaattacaataaggtagttgcatcataaaaaaacctgatggcacttattaaattttttttaacttcttataattgtgtatgaagtaaagtgaagtgaaatggtagttgcatagtcgtgtccaatgctttgtgactccatggactgtagcctgccaggctcctctgtccataggattttccaggtaagaatactggagtgggctgccatttccttctccagagtcctcccagcccagggattgaatctgggtttcctgcattgcaggcagattctttactatttgagccaccagggaagtcaatcacgtatcagtctctttaataatatgacctttgtgttttttccattatatgtgatgaagctacagtagtctgcagaatttttcataaggatatgtttttgttaagttgaaccatatgaagctgtaatttttgtaggtcaaaaatggttgacataagcaatttcataagattcaatttcacagaaagaatttttagttacaatgatggtaaaataattctaagcatcgttttctttgatgatttaggtcaaaagtttttaaagtttatgtttgtaagtctattcatatgctatcatatttctcttaaatccatgaatttttattagatttcctagtaagctccttttttcagattaaaaaataaatcttgccagaacagactaattagtttaatctttatttgatcaaaagttcacttgtaaaagtccttgtgataatgacatcagtgtaccttctcaatgtttaacaataaatttattttccttatattgtacttaaaattgatcattttcagtattccaagaaaaga

SEQ ID NO: 44586 - DNA, 1490 bp, Bovine  19866880458485
attttatgttctttgattgagataacataagacattaaagaaactttcaaatttggcaaaacatgaagatagaaaattactttactttttgaatgatttacaaggaatttatttcatcctcactataactgctgattttactctaatttttttttaatattgacctattttttgttaaaaaataaattatgtatttccttctatgggtcctaaatttttctatcaaagaaccactgaaacttgtttcatagttgagtttacttgagaaactattttatcttgaagcatttaaataaatttgtattttctcatccataatataatagcatttcttttgttacaatcttggtgaaggaaatgacaacccactccagtaatcgtgcctggagaattccatggacagaagagcttagtgggctacactccatggggttgcaaagaatcagataccactgagagactaacactttattacattccataatgcatactgatattttaaagatattccatggattaaaattgacacttttggataaaacggtacagatttatcctctggcttcttatatccatggacaaatatctatatgtctgagataagatatattgagtttttatagaacaatctgtttagagatctttatacttattgcagtaatattcaggaaaaaaacaaccaaaattgcatacctctatagatgtcaggctcaagagtatttttcctgctttaattttatgacttaatctttatcaaaagaatatttttgctatttttgtgttaaaatttgtgttagagcccatgtaaagtggaaagtagtattaattaatcatctctctagtttcagtaacttgaatctatttttgtgtttgttgtcacctctgtcaactcaaaaatgttcaaatcattgacgcagaccttatgtggacaaatgttgaaagtaaagcagagagcacaaaatcatttattaaaagagaaaagaaaagggttgacaatattttcctttcaggaccttaatttaagacatcagacagtccttggttttcacaatcatgaagtttgtaacaaatttattatatcattatgatacagaaggaagcacataaaaagatctttaaaaagtttagggggttagagtaagtctaatctgaaatgtttgtcagtttctaagcagtgcgtctcttctacattttcctcatatcctttgttgtctccagagagggacctgctagaagagatcagctgggggagccgcaggcatcacagtttggtcagcgtgacttgtttggtattcatggcttttgtaggttattgctctgtaacctatcaaggctctgcagggttcaatatctgacccaggtccacctgaaagcttctttttgctctctgatttgaaaaaattgacacagcaagctcttactttttatctacttcaaattcacacctatagaatctgggaaattgattgagtttcatggtccaacttttt

SEQ ID NO: 44587 - DNA, 2156 bp, Bovine  19866880463944
acactacctttgcttttctcctcaaaattacctgaaaactctctactttgtatagaccagtctgttttctaataacaatagagaatgatattttagaaatacttgaaggagcttcggatccgccatctgtggtggaaccaccgccaaggtgcagattttcgtggagacgctgatggggaagaccatcactctcaggtcgagccctcagataccatagaaaatgtaaaggtcaaggtccaggataaggaaggaattcctcctgaccagaaaagactgatctttgctgggaggcaactgaaagatggatgtactttgactacaacattcaaaaggagtccactcttcatcttgtactgagactttgtggtggtgctaagaaaaggaagaagtcttagaccgctcccaagaagaacaagcataagagaaagaaggttaagctggctattctgaaatactataaggtagatgagaatggcaaaatcaatcgccttcgctggggagtgtccctcagatgaatgtggtgctggaatttttatggccagtcatttcggcagacattattgtggcaaatgttgtctgacctattgtttcaacaaaccagaaaacaagtaattgtatattggttaataaagatatgagctaacatttaaatgttggggttttattgcactgcctttaaaagtggactttaagcatcagattttctaaagtaacctgtactttgcagaattatgttgtatttagtatcagttgtttagatttaagccagttattttggccttagcaggattgacatttagactgataattcttggttgtaggggccttggtgtgcatcagtaggataatgaacagcattcctggcctctacccacttgatgccatgagcataccacccctccccacagccaaaagtatccacattgccagatgacccgagggtgggcaagaactatatatgctcttcctcacccctgcagattgggaaacacaggtttgtgtgaattggtattacaaccttgccttaaaaagcaacaaaatacttgtttcctacaaatgaagtttaaaggctgagctcatgagttgccaattcatccatcccaagtctctgggtggtttggctcaatatttgctgttggcaatgcaaagggtacatgctattattcagtgctaagtgtgtaaattctaatgtttacttactggtagtgttgatgctaaaaaatatggtttcctagtattggtacctcattttgtctctagagcacagttcaggatcactgaactaaagcacctgaaacttaaaacagattttaagattcagtcatacaccagtaatagtttcctttagccatattttcccatacgaggatttctagttgtatgcattcttaaataaggtttcctaggactgtagtattttaacagttaaacatcagttaaagcttggtagagcttcttgaccagtagtgagtggtgaactatactttcagtaaaacaaaactagttgctctataataagacaaaaacatttaatcatttatatatttttaaataattttaaaatcctggatcccaagaagtcttggctggaacttctttttcttcgtaacaaataatagcatctcccactttaaattctatcttttcttcatccaaactaagaccacagtccattccagttttgacaactgcagtatcatctttatggtgtttcagtgagattaatgagcctttaggggaaaaaagaaaataaagggttcatatagtcaacaaataagtgtccagcaagtactgttgtctgctacaacagcagactacaaggaaaattacacaggttttacacttcttccacgttacatgatggggctaaataccaaggaaaagggtagaaaagttacgtggcttgtagtaatcttcctttttaaaggtaacactgcaagggatgggggtggttctcaggacttggatgagctaaaccaggatgacactgcaggcaaaggtggttagaggatggaaataagtagacatggctcaaagggcttcccaggtggccctagttaagaacctgcctgcctggtacaggatataaaacatgggttcagtccctgggtctgggagatcccctggagaagggcatggcaacccactccagtatt

SEQ ID NO: 44588 - DNA, 836 bp, Bovine  19866880780166
tacagattcagggaatttctcactggtagcacttgtataattttttaaaaaaagcaacttgtgaacttggttctttgttcctattctgccattggtccaataaaactcagatttataatacactacatgagcaaattaatcatcaaatatggcaacagtaatttattgctcccctcagggtcagagacaacacagataaatgaaatatataataatgtttaaatatcactttaataattccattaacattgctggtagtactaataatactatcactgtgaatgtcatcattgatatgatgacacacacatatatatatgaacacactcagtgtgttctaggtagtcaataaatgtcaacatgtgaattctcccagcagtactcatacacaggtactattatttgtccccaatttaaagaaacagcctcagagaaatcaagattcctgtctaaagatacacaactatcaatggaagaccaattttaaactcatgccaagatttttagatgttttttttttttttcctcttctatttcagggctaagacattggttctctcaatgcttgatccatttaatatgtgttttaggtactgtctgtgggaagaagagcttctaaggtaacaacttccatgaccaaataaatatgcaaaacactgtgtactattactctttgcttagggaattcaaaatgtatcttaccagagtaaaggcttagtaaagttttgcagtaaacaaacaaaaaaattaaaactaactctctaaacaagcaggattatttaatattgttaaatatagtgttttctagagttagaatattctatcagttaggacac

SEQ ID NO: 44589 - DNA, 3514 bp, Bovine  19866880928085
ttgttttcttctacttttttagtttaaaacttttaattcctttctgtatagtactcaacaactctgaagtagcagaaaatttaaagttagttctccttagagagaacattaagcacagctttctgacttcacagatagcaagttcctaactaaaccaatattttaattcaccattaagagagtgcactgctctacaggaaggtatgctgaatcagttctctagactataatatttatctgtttctgctgtgcatttgtaacccgttcttggcagcaattccaagataaaagttctaaataagtccttgaacaagtcatttgatgaagtttatggaaaaatcttccccaactaccaaattagaaccaggttacacagttagagctccactggtcaaaagctaaatgtggatgataaatgtatgcatgtgtccctatgcaaatgtgtttctctgggtgtacatagctcgatggaaaagacaaggaaagaggatctccaggaaacataagattcagtattattcagtgtctattgtatgttaggcactgtgaaatgctccatatttattatataatttgatttttctacaacacttaggaattattattattattaatttacagataagagaactgagttgaagttaattaaacaatgcccaatctcagcaacacaatggagtaagagaattgaatgccggtaacctaactttggagtccatttccttagctttttttttttactgcatttcaaaactaaagatgaacatttttagttaatagtatctcaacactattttctctcacttctcctacttagtggaaagaaaaataaaaacacctctgtacacaattttgaataatactgaaacttaaaaatactatttatgagactaactaatattttattattcagttcagttcagtcactcagtcatgtctgactctatgcgaccccatgaattgcagcatgccaggcctccctgtccatcactaactcccggagttcacccaaactcatgtccattgagtcggtgatgccatccagccatctcatcctctgtcatccccttctcctgccctaaatccatcccagcatcagagtcttttccaatgagtcaactcttcgcatgacatggccaaagtattagagtttcagctttagccatcagtccttccaatgaacacccagaactgatctcctttaggactggttggatctccttgcagtccaagggattctcaagagtcttctccaacaccacagttcaaaagcatcaattctttggcactcagctttgttcacagtccaactctcacatctatacatgaccactggaaaaaccatagccttgactagacagacctttgttggcaaagtaatgtctctgcttttgaatatgctatctaggttggtcataactttccttccaaggagtaagcgtcttttaattttattattaatattatggaaataataaatattcatataacaaatgtagaggcagaaaagttctaaatctgtgtctttatttatatcatcaatacctatatctgtatcatgtcaagggatatctggctagaatacaactcaagactatgtaatagctcattttaataaaataacaagaatgatatttacaacactaaaagtacatctgcactaagcccagagaagttctgcatccaaattagtagctttactccaaagaaaacattcctcatttgtgcaaattgaaacaacttggggagtcaggaaagtcaatagatatttaactcagggttttacatttgttggggaaacaaaagaacagaaaacacaaagacttttgagacatgtttccttgtataccaatttctacaagattttggattttaaatacacagcttcatttattaagaaaaggaagccaaaatatcagctatacccccaaacaatggaatgcagaagtctaagcaatgcttcataatgaaatcacaaaaatcctgtcatctgcaattgttcttcagtcgctgagtcatgtccaactctttgcaatcccatggactgcagcacaccagccctccctgttcttcaccatctcccagagcttgttcaaattcatgttcattgagtcagtgatgccatccaaccatctcatcctctgttgtccctttctcctcctgccttcaatctttcccagcatcacagtctttactaatgagtcagctcttcgcatcaggtgaccaaagtattggagcttcagtttcagcatcacttgttccaataaatattcaggatttatttcctttaggattgactggtttgatgcccctgctgtccaagggactcgcaaaagtcttgtccaacaccacagttcaaaagcatcaatgcttcgatgctcagccttctttatgttccaactctcacatccatacatgactactgaaaaaccgtagcttgctatacagacctatttctgcaaagtgatgtctctgctttttaatatgctgtctaggttagtcacagcttttcttccaggaacaagtgtcttttaatttcatggcggcagttaccatctgcagtgatttgggagcccaagaaaataaagtctgtcactgtttccattgtttccccatctatttgccatgaagagatgggattcaatgccatgatcttagtttcttgattgttgggttttaagccagctttttcactctcctctttcactttaatcaagaggctctttagttcctctttgctttctgccataaaggtggtgtcatctgcataactgaggttattcatatttctccctgcaatcttaattccagtttatgcttcatccagcctgacatttcacatgaaggattctgcatataaattaaaagagcaagattacaatatatatccttgatgtactcctttcccaatctgcaaccagtccattgttccatgtccagttctaactattgcttcttgacctgtatatagatttctcaggagacatgtcaggtggtctgatattccatctctttaagaatttttcacgttttgttgtgatccacacagtcaaaggctttagcatactcaatgaggaagaagtagatattcttctggaattctcttactttttctatgatccagtggatgtgggcaacttatctctggttcctctgccttttctaaatccagcttgaacatctagaagtcttggttcacatactgttgaagcctggcttagagaattttgagcattactttactagtgtgagagatgaatgcaattgtgccgtagtttgaacattcttcggcattgcctttctttgggattggaacaaaaactgacctccagtcctgtggcccctgctgagttttccaaatttgctggcatattgagtgcagcactttcacagcatcatattttaggatttgaaataggtcaactggaattccatcacctccactagctttgttcgtagtgatgcttcctaaggtccacttgacttcacattccaggatgtcggctctaggaga

SEQ ID NO: 44590 - DNA, 2269 bp, Bovine  19866880973216
ttatttttatttttaaagagagttgaatgctgtggggtaattctctgggcctttaactttcctcaatgtataatagcctttttgacttttaagaaccatgtgctgtaaaatgataagacaccacatacatttttctcagcatcattctgacacaagatcaagaaaaaggtgtaatcccagtggagaatgatgcctccttacctatcctttgagaagtcctttgccttctgttattgtctcatgacttgagagttcaggaaaagctgacatcatttaaggtctctgggaacgtggcctactcattaatagcagtgtctggaggtacagtgcaagaaggatgggagtgaggaagcaggacggaacttaagaataagacttcacttttcatcctgatggaaagtaaaaccaatatttttaatttttaataaaatacattcatattgtgacaccagcagcagaaagaatgtgctgcatataaatgaagatgactccctagtttgccttgagctgtggaagacaggagacataaagatgaagagggccttttacaagtagtcagtaggaagaagaataagtgcttggtgtcttagaaagcaaagctttcatgattccagagcatatttgagaaatggcatgatggcttgccccgctttaagtttggcatcagcgagattttcgattgtgctaaaatcatccttaatgtcctttctgcctcatcagtggggggccattcaagtaacaaagtgccaatcaggggctcctgttcctctttagcttggagatattactgtagagatctttataagagcgtgatctctccgcttgagatgccctttattataactagagttaaaggtctgctgacttagcccattataaagccctaatgttctccactacaaaattttactctaaaataaagcttagcatactaagttggagcccagggaagctctgatctttccaaatttgaagggaatagagtagtcatttgaggtaaaatgagagtaacaaaaatataaatatcaaactacgtgagttgtgtgtcactactgtcttcaaaaatagcattgttaattaaaatgaagttggaaaataattacctcataatgtaccataatcatttttgtaagtttagaatataaaaaatgtaattaggaaaaagaaaaatgagttatagacaggatacatttcttgatccagaaaactgttaaaatcaagtattttctgaaaatgtgggacccatattgctattatagaatacttgcaatcctttaatcaatgagtcagatactcctcatgcttaagcctctgcctgtaagtttcttagccatcatatatatgtatatacatatacatatatatatgcacatatatatgcataaacagcagcctagaggcagcctgttagaagtaaatagatctctacatttttattttaaaactattattaaaaacataaatttctaatgtctttttaaaaattaagtaatttattttaattggaggataataacttcacaatattgtggtggttttgtcatacatcaacatgaattttaagagaaaaactaaaatgtacttttctagtgatgcagaaacttttcagaattaaaaaaaatcaaaacatgttaattataagttcccagcacatcaatgtttctgcagataatgattataaacttaagacaagattaaaaccaaactaccttaagtctctggagagtaaacagtggcaggcagactctggagaggcactggtactggaaagaggagattttcacagattgcatttgcaaagaatttatatggaaataaacaaagtaataaagagtgaaaggatgcctctttttagatagtgtggtcaggaaagaccattctgaggattcatattggagctaagaaggaatatataagacagccaactaataaaatttctggcaagaaatactggagtcaaaagaaagaatgattgctgaggtactggggcaatgcttggcatgttccagaagcaaaatggagacccacggagctgaatgctagagattaagcggcaaactggtgagaaatgaagttggagaggaagacaggagccatatcatacatcaaaatgaaaattacccagggcttacattacaccagggattacatatagaaatacaaataagaaatgattcttgctctaaggtatctcccaatctagtggtaaaatgaagtttctgtatttgctgtcaaagcaacttgttgtggatggatcctagtcaggttt

SEQ ID NO: 44591 - DNA, 923 bp, Bovine  19866881073893
ttttgtgttgattatgacctagtcttggaagttatcctctgtgatttccactatattctctttgttagaaagagtcataaagtacagcccactctgaaggaaaggggatctaaacacaatctttggaaggaggagtgctaaagtatttgatttgtggctatataataaaacactacagggaggaaaaaaaacaggaataagacacaccattttaaagcttttataactagtaaaagtaacaaatacataaaagaagcatgatagaacataaaatatacttgaatagatttatgggaaatattttttaagatacagaggaaggaataatatatgtagcttgaatgagtttgtaaactttaaagatgaatagcaattcacaattcagagaaatgggaaatggtattttatgcaaagagaacagcatgagatttcagagatgaactctgggaagtttgaacatgggaatgttgaacatggaaacatgggaagtttggggaatggtactagtggtccgtcagagatagctcagagaatgaaagtggtaaggagttgcaggatatggtgttagctggtgtccaattgttaaaagaattatacactatgataaggagattgaacacaaaatccaaagaagattgattttacaagcatgacatttctttgaggcttcttctcttaatgtgaaaatcatatggcatttcacgctattctataataaatcagtatttttttgtttaaagagtttatccaacttttaagtaaaattaccattcccggaataggtgcaattgtttatgatctggcttcacatactgttcacatattacagggaaatcttaatttccctggaacatcttaatttccctggaaaagccacagtaaagctgctacccaggcacagacagccagcaaggctaaaacat

SEQ ID NO: 44592 - DNA, 1753 bp, Bovine  19866881297291
atttgcctgttctcatccattttagttactgattcctgagatgttgatgttcactcttaccagttcctgtttgaccacatccagtttaccctgattcgtggacctaacattcccagttcatatgcaatatttttctttacagcatcagactttattttcaccatcagacatatccacaactgagcttcatttttgcctttgcccagtcacttaattcattttggagctattagtagttgccttctactcttccccaggagcatactggacaccttctgactttgggagctcatattccagtgtcatatctttttttccttttcatactgtgcttgggtttctccaagaaagaatgctggagtcagttcccacttccttctccagtggaccacattttgtcagaactctttcctatgacatgtgtgcctagagttgccctgcatgacatggctccataacttcattgagttatacaagcctcttcaccatgacaaggctgtgatccatgaatgggtatttctctataccctgtatatttgtcctagtatatttcttgacataaagtagatataaaacatatttataaaatgaatactatcacaaattattcaaaaccatcattcacttaaacacgattgtactattttagcaagtgtaatatttacaaataaaaataccacgcacacaagttatctaattttgatatcataattttgaccaaacttgaaaaaaattatttatttgttaatttatagttgctttctcttttttcctctgtcacagacacaatatatgtgttgttgagaaaattctgattttttaataattgaggatactggtctctgtttcatcatcaactaaataatatttgatcaagctccttctactttagaaagtatatactaaatttctaacttatgaaaaatggactattaagtcatatatatgtctttacatctcaaagtttgaattaacattcaacagcctacctcaccttttactttttcctcagtgccttatttttgtaactttattgccattcattatgtatctctttggattttaatcctcttacagcctactcatttctaaatttgtcattgcctaaatatcataatttttttcttcttaactctttatccctataaataatatttcaatccattttattatgctatattcaaatgcatcttattaatcttcctcactgtaattctgtggtgatgtaatataataatctgatgaggaaaaatgtagtagaacatagacaggacaagcttaaaaattgttattgacttgtaggagaacttaacaaaatgattcctttgctttatctcccttgtttgtcaaccctcttcatttgtatcttagggagatgattttcagatttgatatgaatccaggtcagtctagatacttgacaatttttcatactgcatgattgcagcctgagagactctccttgaagaaggctagaatgagtcccaccaatatatatatattttcatctctggtgatactgttcttataaaaacactgacaacatttgaaaagtgaagcttaagagaaaattatggattatagttcacaacttaggaaaattcttgctgctcattgttaattgattttaccccaaaacaagatgttatacattttttcttattccccagaacatggaggcagttctaaccagaggtctttccttggttaaaaattattgggaaatgaatttcactctattttgcatatataa

SEQ ID NO: 44593 - DNA, 2205 bp, Bovine  19866881372984
attgaatggttttatctccttgctgtccaacagactcccagaagtcttctccagcaccacagttcgaagccatcaattcttggttccaaagtagggtttcttattctctgataccctgaacagaaaataagttaaagtgcagagcaagaccaaactgattatccattcatttccacgtttcaaagctagcataaaaatagtgtgactatttcataagactagactgtgaatgagatgtccacctaatttaaggatgttcctaactatggtgaaagggagagagagagagaaagaaaataaatgtcttccaagtagaggtataacctccacagaggatctctgttttgcccactgctgtatttcaagttccttaaacacagaggatgcttggtgaatagttacagagtgaacttcataaaattatcaccgccatatgtaaatacacctcaagtttgtaaggacagggtctgttaagatttgttagttaaataagaaaagactgttcctcaactgaacatcaaagaatattctgcaagtttccattttaataatgagcagcaaccctctgctgctgctgctgctaagttgcttcagtcatgtccaactctgtgcaaccccatagacggcagcccaccaggctcccccatccctgggattctccaggcaagaacactggagtgggttgccatttccttctctgatgcgtgaaagtgaagtcgctcagtcgtgtccgactcccagtgaccccgtggactgcagcctaccaggcccctccatccatgagattttccaggcaagagtactggcgtgggttgccattgccttctccagcagcaaccctcactgagggttaattctctttctagttaactccaacttacagagtgtgtcctctggcagcagaaatccacaattctgagctagcccagaataaggattgctacacctggaaacaattaagctccaaggccatttgacaagcacaggtgttctggcaagcagaatactcccattctctgtaaccagctgaagctcctgattaattgacttgattttaacctcaagtaatgtccactgagttgctgaagagaaatgagatgacaatgaaccttagtcacaggggagaagtaagagcttttacatgtttgtgtgaaaaataaacctaattcatctcaacaggacaggtaaaaagacattagtattaataattatttagattttatggatatgcttctctccaattctcagtatatgtaaatgaaaataatggctcttatagtggagtggtgaaaatttcatttattggagggaaatataataatttcaaaaatctcctcttgaggaaactatatttcactataccctggattcaagtttctgcttttctcttgtaaactatggaaaggaattgaggataatatttctagatacaggagattaatgcagatctgtgatattagttcatcattatttccctttctagacaacattatgtttagattacatatgcacatgctaaaaagagtgacattccaaaattgtggctgctggtagatgcaaagtctactaacgtaacccatgatggctgattatttgaatgatacaacatttgaatttttcatttgtgtttaatttttttttttcttgttaacaggtctggatatgatagctttccagagctattgagactactaagaaccagttcctgcaaattaattggcaagcttttgttcacatgcaacatacttttaaaatgtatctatggaccactttctatttttctccttttctttttcctccaatggtcaactacttttgtaatattataataatattcaagtcttatttttgaataatctagatgctaccaactaacaaggagacaaggttatgccataaaaatgtttcagagcacaaaaacaaaattattcaaaggttgtctgttacttgaaataaaaaatgtaatttctatggaaaaaaaaacaacaactctgtctctatcagcgcagagatgtattctaatgaccaatatatttcctgtgacttcatctctgaaatcataaagtatatacacgttgctttctgtctatatcatgtaagtagggtagtgacagtaaggaaatgttctaaatataaataaatcaatatgaaagatacaaggtattaattttaaaagttccctattctttatagggctctgtgtgt

SEQ ID NO: 44594 - DNA, 1157 bp, Bovine  19866881417933
caatgaaatagttaaaagcttccctgcttgagttttcatttttatcctgttgtacagtacagactgtatgcagtagtccatattttcatttagtgatgttcataacgttgacacataaatgaaaggagttagaacccatatcttgtgtgtatttgacaagctctaacagaattgtttgcaaaattttattgcaattcctgctttcatttatctttgttagcacaagcttcagaaatcagtggtatggaattcttgtataatttaactctaagagaattaagtgtgcaggtgttcagagaatagcctatttttctaagtaaataaaatcttttggaagaaaatacattatttgtattaccttatgaaagaatatttaattggtttgattcatttctaaaagaacaagcaaaaaatgtattgcaaggaagggattgagaaacccagaaacaaaaatgcaattagttgccagtaatctcaagaacttaaattcgtaagcaagataaaattacttgaatagctacaccaagaagttttagagttgcagttcttaagtttgctatattaaacaagggtgtgtgcacacttaagctatatgtaccataatgaatccataatgcaaatattcaccatttagagtggcaggaagcttggaaaaaacagtccttgtgaagacttcctgtgtttctttttactcctcacccactgggctgggcctcatgtaaactttccgagacaaataagtttcaagtgcattttgaaaggtctatacagaaagaaatttagtactttccattttaatggcttgcagtcctgatggaagttctttcttttagccaacctaaatcactttatacaacatttcaagctcacttattcttgttctgccctctgtggcatcagagtacgatcagcaccttctatgtaataatccttcatgtaattgaaaaccaacttgtttccccagcctattttccaacttaaataatattagttcccttaacctttcctctgagattctattttccaagctattaatcatgtttattgcttgtccttaaaccttcttcaagttttccaaggtctttttaacttagtgagtgcaggcctgtacagagcccctggattatgctaggagaattacttttcactgttgtacg

SEQ ID NO: 44595 - DNA, 892 bp, Bovine  19866881643874
gagtttagctttagcatcattccttccaataaatcccagggctgatctccttcagaatggactggttggatctccttgcagtccaagggactctcaagagtcttctccaacaccacagttcaaaagcatcaattcttcggcgctcagccttcttcacagtccaactctcacatccgtacatgaccacagggaaaaccatagccttgactagacggacctttgttgacaaagtaatgtctctgcatttaacaccattagaagttatctattcaaaattgttaatttgagaatgaagtgttttttacagtaaggagcccaatgggaagagtgactgacaatttctgcgaagtatttactatgaaatgtggtatctcaagaattggtgagaaggatgaaatatgatatctgtgctcttggcaatcagaatgaagtcccaaaatctctaaactaggcttttctgaggtcacatctgagtacttttcaaaaagcacctttttgtttgacttaaaaatcaaaacattcatatccctgtttcactgattcctgaaataccaagataatatctgggaaattttccattttgttaagtcagctaagaattataaaactccagtatatctcttagaagcacattattaaagggcaactaaaatgaggttttccttttgagttcttattaccttatctttggaaatcagtttaagtaatatgaaaaagttgtaagatgcttttttcaaaaagagttgaaaattatgggagaacatgaattgataagaagaggtaatataactttaaattactaaatttttaaatgaaaggaggcatttattctaaaatatccaatagataaaagagatcaaatttatccttcagctatgagtagtaaatcaaa

SEQ ID NO: 44596 - DNA, 1650 bp, Bovine  19866881701139
gactgaagtgacttagcatagcatagcatagcatagcatatatgcattcttgatatgaatggattctttgttagatatatggttcgtaaatattacctcccacatataattatactcatatattatgtgatatacataatcttctatcttgaattttaatattaaatatgcatttttgcttctatcttgtaggaatgcaaattcttaaaagtagaaccaaaggtatttaaccttccacctatcccccaacaagcgtttatcacacaaagacatctaataacacattactgataaagtagtgaacacagaaataaaaaataaaatagacattcccaaaacaaactacctcatgagactattatagtaaattgatataaagtaaaatcatactttccaggtgactaaatattttaatatccaagttttaggtctcctatcttctatacaaccacactttcttcaagttgaagcttttttctcaacatatagaaatgtggtctcttttaccatataaacctttaggatgatgcaattctttagtttatcctggtgtgaattttcctaacttctgttcaggacttttttttaagcataatttgacagattaaggtatggcatctccatatgtctatatagctacattacagtttcttctttggtatctaatatttagatggtgatgtaagtctctgttttactgcctttatactgttagccttttattgattcacttagggtgtaattgcttgctctctgtaagcattctaataagaacagcaagatcacttcagtattcccaattcgagtgaggtcacagaaattagagatgcaaataacttgctaagtcacccttttaatttttcctctgggtaaggttattccctatggtatatttttttcttgtttctccttttttttttttggtcaatctgagcattaaagagattcaataagtatgttttttcctagtgcttccattccaagactaagcttgaaatctctctggaaggaatgaaaatcatatattctttgatagcagtatcagtatccagtatctggatatccagatactggatatcagtatacagtatcttccatgcatgaaccgtgatggttcctcttgccattattcaataagacttttctcagttcttggttgcaagttcaatgatgagagaacctactgcttctgtgaagtctgcctttccttgctactaactggtaatttcatcagaaacatgattaacagaactgttatagcagttataatggtgatgaagtcatgccactatgaagaaaaggaaaatgaaataattatgtcaattatattcatcatgaattccccatcatgagtcacttttcttaaaacataggcctaattttcctatgaaagtagaaatgtaggaagtcaagattgaagtaatttgacttgaaatacctcacttgggaatggtataacattattgtttgcaagattctgtcaaatattttattatacttagagtgatgaggtgaaatggaatgggttattacccacattttatacctcattatattgagggtctgatctagttgatttaaggtacacaattcaacatgttctcaaactcagtactttttacaatacatgaaactcacaatcacatacag

SEQ ID NO: 44597 - DNA, 2156 bp, Bovine  19866880877281
tggcatttgggacaacttaagttctttcacagatcactgctttctcaatgtccttctcaattttgctgaggcaagagaagctgctttgtaattctaccagtctctttgacgcccccaaccccacacatgcaccctcatgtatcacccaggacgatgacaccttttttgtttattcttttttttttcagggaagctgaagattctctctcaatcacggttgttcgctgcacatcggtaaagctctttctatgtcttgtgtgttagttgtgcccttcttggccccaagaccctgtaccaccagcagaatattcctcagagaataaacggggaaggcaaagggcatcagagaagctgtcaggcagtcagtgttgcttgacgaccacatatgtgctcgtattatggagaactcgtatgtgggtccaggcttcgagaactcatggtcttgcgaaggagacaggcctgtgattatgcaggtgaaagggcaccaagctcagagtttcaagacaaatctgagtggcatcactgtgcagaggtcccttagtttcagttttgaattctgtaaaacagagatgaggacaataactgccctatctatctagtggggtgttatgaggacccagtgaggtgttggatgtgaaacgtgttctgtcagccacaaggcaaggcacaggacaagaaacagatgatgcccagggcagcaacagccatcctaaaccaccgcacatccaagagcctttcgtatgtggtagagggaaaagtgtataatcaaactgtaagagaaaattaccaaggaggaaaagttgacagaaaattctcattctgagagaccttagtacatacttcttagcccttggtcactaatagagaaaaaaatataaataggggcatagagaattttaataatgcatttaataatctaatctaattgatcccatatcaggctacccaaaagctaaatttctcaaagcaactgtgtaagtgtcttctctaaaatacaataaagcacaaattgataactatcaaaagcttaacaccacccagtcatttggaataaaaatgcaatttcctaagtaaagatggaatcaaatggaaaattaaaaattatcattatatactagctagaaaataattaaaatttagagctctacttcttagaacttattatatacagttgagctatactcagagtaaaatttgtaaccttaaaagtgatttcattatttaacaagaaaaaagaaaacaggtcaggagaatactcagtgccagaagcataaagaaagactaataaaataagcataaagcacattaaagaaaatgataaaaatttaaatctaaatgatgctttgggaaaacagaaaaattagaaagttggtaaatccaagggctagttctttacaggaaaaagtaaaaaaattgaagaacttgaaggaaaagaactatgtgggccttatgtgaaggaaactagagtaatactggaggaaataaaatattttctttaataaagaggagatacatattatattctttgataggaagactattaatacatcagattttctcatattaatgtatatgcttaaagcaagttcaaactccctgtaggaattttatttggattttgacaatgtcaaggtgagacttatcaagaaaatcttttttttgaaaaggataatgaggatggccttgagatacaagattttaaaactaataaagctgcaataattaaaacagtatgatattgatgaaatgttggatgtatcaatctaatcaaatagaaagtccaagaatagatactagtataagaatttggtatatgctaaatatggcatcccaaatcaatgggagaaaagatgatcattcaagaaattgtactgggacatttctttaggtatttggaaaaaataagtctaatcccacactatttggtgttaaaaatttaaatataaaaaacaaatcatagaaatgtcaacaatatggaagggcatctatttggccataagttgcagaaggaattcctaagcacatagggagtgggaggaagtacagtagaacagacagctctttgattatgtgcaaagaaattgtctcttctccttatttaaccagtgttatcttttttgtgttgtttcctggaaatagaacaggaaataaactca

SEQ ID NO: 44598 - DNA, 676 bp, Bovine  19866880949816
agtaatatttgtatttattttagtgattctttgtgttttattataccttttctacttttcttccctttccctttcttgtcttctagaatatgttttcctcattctaaaattttttcttcttctagtcctgaaataatacacttgtcttttggtggttaccttgtacatttcagtatgtacacattaaagcctaaagtgaatatatcacaattctccctcaaaaaaataaggaacttcgaacatccgttcataatttatatgctattgttgtcttctattttagctacatctttgttaatcccaaaaaacaaaatcagattgttttacatacaaatttcccaccttctttgatcttcattccttctaatatctcaagaccttacagctgaaaacactttcttctctctgaacttagaattccattactgaaggtctggtggcaaatttacagagctttgattggatgcttatgtatttatttcatctttgttctcgacaagaacaaagaacccatatttgctgggtatagacattcaggttggcagtttttcccagcatactgaattgtaatcaccactatcctctaatttacactattactgatgactgattggctttcacttgcatagttactcctttgaaggccttttttcctctggcttttactattttatat

SEQ ID NO: 44599 - DNA, 1450 bp, Bovine  19866880952080
aactgtagcttttttattgtctctggtgctaaaagaacactttaaccttattttcctgaccatgtaaattattcttaggtattaaattcaatacttggaggagagtgttgactctttcaaaccacaaaatgttgcttggttaataacatgcttctttaaatgtcctgaactaattctgcaaatctgcaaaataagtagcaaagagagatatggaagatagctgcgaacctcagctttaggagtaaagccctttaacagggcatagctttgggtaggtgaagatctaaacctaacaaagagaatctgcctctgggaactattaaaagaacagtaaagcaggagccttttgtaaatgtctgcataagtctgagggtcaccatcactctagcttaatttggctcccattataagagaaatatgattttgtattaataaaatacagataataaattgcatctgtattcaagtaacttagaagggggaacgccagttttcacatttggtctgagtatatataaggaacaactggcctatcagcagagaagtccagattccatatcaatacagaaactataatgacaaataggtctgaattttatctattcacattgagaggatggggctaaatgcaaatgcaagagtttacaactgtgctaaaatggatactgattttaactttgaagagataacagccattgttatagccaaagattagtcagctttctaagaaggtataatataaaagacaacaggcaagctggaaagcatcagacttactttctaattaagcccaaagtgactttaaaaagcagaccatcctgtccaatcacacccattccattggctcgtccacagctgtcaatacagaccatctctggttccatgtctttattagcaaccacaaattggccatagatgagatctccgacctacaatgataattaaaaaacatcgtttcttctcagcaaactatgctacaggtgctgctattggctgttttcaataggcgtcaatgccagtcatctgcaattctgtggctaaataacagactacactccaggattctcacagtcctgctggagttgtgtcctaaaagaaggcaaattaaagcgtgtaccctcacccttcccttcccagaaaatccccagactgggagcctcagcaaagccagagtgcccactggggttacactgtcaactacagtagccactactcacatgtaattatttaaacttacatttaattaaaacgatgtacttaaaatgcagtttttcagttgcattagccacatttcaaatgctcaatagccatgtgtgacttagtggctcccataatactcagtgcatatgtaaaacactagcatcaccacagagttttattgcacagcactgctttagggaactacacaagcaacaaccccggcatgcaaatgttcaaagcaaacagaaca

SEQ ID NO: 44600 - DNA, 1941 bp, Bovine  19866881132302
aacgctatgtggcagcctaggtgggaagggttttgggggagaatggatacatgtatatgtatggctgagttgctttgctctcccatctgaaaccactataacattgttaatccactatactccaacacaaaataaaaaggttttaaataaaaggaatgcacaccgaatgcatattataacatggatgaacctcaaacacattacactaagtgaaagaaggcagtcacaaagacaatatattgtatgattctattcacaggaaatatccagaacagacaaatctagagaaacagaaagtagatgagtggttgtctagagctgggggaggggcaaatacggaatgactgttaatgggtatgggatttcttttgggggcatcgaaagtattctaaaattagattgtggtagattgttgcaaaattttatatatacactaaatatatactgtatatacactaaataaatctgtacatttttaaatgggtaaattttatgttatgtgaaacatatctcaaaatagatgagggaaaaaaaacttcctagatgttgccttttatttacactctgagagaagctagatattagagagttacgtgggaaaatattcaggtaaggccaagtcaaagttacacaggtctttttctgcaggacttctcagagcctttactgtgccaaaacacactatgaattaccaagagtgggtgggtaggaatcggatataggttgcatcacacacacaccacaattaggttttgcagaacccacttcagaaaacaatgtacctaggacttttcccatttattcaccaagcactacctgagtccttgcagtctcctggaactcaatcggggctatgaggtgaggctgactactttccctgccttccactgagcttgtatagaagctcagaagaaagaaaagggatgtgctcaaatttaagctgaacacatcgggagaagcacaatgctgatgctacaaactaaatactatgggaccccttgggagagatgaattctggctgtggactgtggaacacttcatggaagacccagcatttcagccagaccctgaactgtgagtggggtctagacacatggagatgggaggaagggatgtggcacaggaacccaggtctaggtggtggaaggggaagttgggtgcttgggtcggggaacagcgagtaggtcatttcagctggagtatgatgtgaatgaagcagaagagtaagacagacagctgtaacagattgtgggttgatcatagagagccttgaatatccaaccaaaaatgtttgaactcgtcctataggagatgacgacccagcgaacatttcagagcagagcgggtgcggatggctgtgaacgagatactccctgaacctcaggttttcatctgtgaaatggggctagtcctcccaacctcatcctattgcagtgtgcgaggacccgagcacttggacacagggcagtgcagctctgagcaagtttactgctcggcaacaggacagctgttcccagttcctttggaagagtatgtgtatcagaaacacctgacacgtgatatttcatctccatgtcagggccagacaggaaatctgagatggaaaatgagcgctttcaaacagaacatattttaagttctcttgtagcagtcaaatcagatctgtatttgatttcatttcattttgtttagaatgaaatagggactgcaaggaaggaacagctgctggaaacaaagacggggaaagagtataaacagcagattgcctgacatcaagtactaagacaaggggtgtgtgtgaaacagacagaaacagtgagcatgtgtgagtgtgtattcaaaactgtgtgtgtgggtgtgtgtttcagagcatataggcacatggctgcaagtatgtgggtatgagtgtacatatgtctctgtgtggcaatgtgtgtctct

SEQ ID NO: 44601 - DNA, 1121 bp, Bovine  19866881286392
aatttacctttaacttttttttattacaattttgtgcattccttttctttctttactagctcctattatttggaagctgaatatcctcaacctgattctagctctgacagtttcacttgaattggtatctgaagttcaatttagtgtaagtgatttttagctcttcactttatcttctaccattgctgcctcctttgatgtttttcattactcattagcagttaatggtttcttgaagttctttattatcaccccttatatcccttttgaagggtttatatccttgtctgtttgctttataagatgattatcaccctagtgtgtttggtcttttccatttgcaaaatattttgagagagtttgtcgcttcacagtgctttgttccagacaaccagaagtgtgttccgtttggagattcatgctctttttgcgaagctggcgtgtgcccctaggaggacgatctaaagtgatcctgttgtgtgacgaccttttgaatgaactgagtatgcttggtctgggacagagggggcaagattgctctgttcaagtccagagagactgatgtatagaagagggagctgctttattctggttggtgtgctggtgtggggtgtggaattcagctttatgtaaagcaattttctggcagtaagatagttctaacaataaatgacagaacaattagaggctggatgacttcttagcaatgcggttgcagagaagattcaagtgtatggaaattatctgggctcttattttcttctattggctcagcattcccaaggcaaatgttaaaaccattagcaggtcattttcttgactttaaactttcctgctcaggctttgctgagtcagggagcacttttaatggcttgattgatgtcatttgtttggtctttggggatccctagatgaaggcatgtgcctatccacagtccagatatatacttcaaattaattactttaattagagctatatatgtttatagaaatcaattagctagactatatttggcagcatttgtaacagtctcctgtaagttaccattgcagtcagatgaccttgaaagaaatggagcatcattaggatgagtcgagatccttagcaactctgcggtcat

SEQ ID NO: 44602 - DNA, 1681 bp, Bovine  19866881306496
tttatatattctagataccaggtccttatctgactctttttaacctcatggactgtagcccgccagacttcccatggaattctccaggcaagaagactggagtgggtagtcagtgccttcaccagccgatcttcccaacccagggattgaagctgtctcctgcatcacagacagtttcttttactgtctgagccaccgggtttgcaaatattttctcctattttgggcattgccttttcactttttcattggtgtcctttgaagcacaaaattttcaattgtgaagttcagtttatttatgttttcatttgttgcttgtgcttttagtgtcatatctaaaatgacactgaagtcacaaaggaatattcttatattttctactaagagttgtataattttagctctcgtatttagatctgtgatcccttttgagttaatttttgtttataagaagttaaaattttttcacttaaatttctctttgtgcttttctatgtagttatccaattttttatttatttgaatttatgtattggttattgaaatttcacattcaaaccatcccccttatatcttatgcctatctttaattcttcaatccttagaaatgtatctcctctccagagctggcacaaagggtccgcatttatttccagtttttgtaattctctcttttgacctttttgaaatttaatactttgtataatgcttagtaccacagtgtgatgattttgtcaccatgttgaattatttctggctgctgctgctgctgctaagtcgcttcagtcgtgtctgactctgtgcgaccccatagacggcagcccaccaggcttccccatccctgggattctccaggccagaacactggagtgggttgccatttccttctccaatgcatgaaagtgaaaagcgaaagtgaagttgctcagttgtatccaactccagcgaccccatggaccacagcctaccaggctcctccgcccatggcattttccaggcaaaagtactggagtggggtgccattgccttctccgtatttctggctagccacaaaatattttaaaagactttctggaatttctattcactttcattggtaaagaccaggcagttttgatcattgctggcctctgataggagcataaaaataaattagctcactgcctggtacatagttagtgctcaatggatgttgcaagtgattattgttgttgttactgctactcttactgtcatcaatttattagattttttttttttaatctggaaggattttgaaccagtgttccatcaagtttatattttcatccagtacttatgttcattgttgaatctgtaatcttcccaaccaggactccagcatcagtattatttgtgtcttctgttattacatcaactttttaagaaaacctagttcctgatacacattcagctgttctgtctttaatggattataggatggtttttgtggctgtgttttatgtatttatcctgcaactccactaaacttattttttaagtactagcaattcttttttgtggatcattttctcagtgtacattggcatttgtttgagaaaaaaaaaaaggtatgcttattactcctcttatcatttttctttctccaataactattccaggcatttctcctgccacttaaataggagtagtgtctagggtg

SEQ ID NO: 44603 - DNA, 1436 bp, Bovine  19866881350390
taggttggaggagataatagtaagttttttaactttttccatattttgatgtaaaaaaattttatataatttatatattttcactattacagtcttaaaaaatttagaacctctccatcggttcttatatttaaaaattttcatccttcccactgcattggaaaactagtattaccagtatctagggctgtattttgtatctggtgtattttatactagactgcattccaggaatgttttagggaaatgccatgactccttgttcttaaagtgcagaatttggaaacatgagttttgaggggaagagagaatccttatggaagtaatatggatttaagatgagttttagggagtattaagttattttcagtactttccttaggatctcttaaatgtagacattggtatacaggtaggaatctagatcagtgcctaagaagtgactctaaaagtgcccttgtgtgtttgcatcgtgtagctgagactgagtagtgtgacctttcccagggaggtcctcggaggccccaggtgtgaaaagtgccgtttgcattgctgcccaattagtcatggtgctgttaccttcatatccctcctgtaacgcgccattcccagctttatttctctgtacatgttttgtgattcctgcatatgagccaaacagatccactctaaggcccgtgtagttcagccctcttgctttcctgtcttcgtgcttttcttagatgattctctccagtttgaataccttttccttttgtctgtgtcagtctcacctcttttcagaaacccagttccagcattcccttcactacaaggtcgttgctggtgctgtcattctctctctgtagtcccagggcgtgctccctgtgtgtcagggcctcattaccactttctgtctcattttgtaaggttgaatgtctgtgcctttctacttctgctccccaactgagccctttctgagaacaggttgtcagacatgtatccccttggagcacctggagccaggcctgatagaaaccactgcgtgctctgtaagtgactgggtgctgcagtgtgggctgtgtcttaatctagttaacgctacattggattgtttacatttttcagctagacagaacagaagaagactgctttagtttatttcctctggaaacccttgtgtacctgactccggactcagaccatggtatgttctttatgcagtcattgcttcttagccctttatttcattattcctggtgtcagaatttgttaaagccacccatggtgtatccaaggtaaaaaaggaatgaacgttaattgcacacctcttatggatagagacctcactggatacattgtatttgtcctgccatgtgtacaaagctgcacagatttagggtctccatcctcagttggaccttgtaagctacttggtaatcctccgagttttccgg

SEQ ID NO: 44604 - DNA, 2960 bp, Bovine  19866880470104
tgttattctaagaattaaatgtagcgactttcctggcagtccagtagttgggacttggccttccaatgtggggagtgtgagttccatcctagggttccacatgccttgcagccaaataaaaaaataagaaacatagaacagaaacaatattgtaacaaattcaataaaaactttaaaaaaataattaaatgtattgatacatatagtgtggttggaagcaaacctcgcagatatgaagtgctgcactgatgccgtgtttgagctatcaatgttcctcaattctttaattaaatagagtgatctgaaaataccttatgaaaaaggatattgaaaattaattgtcctcctattaaaagatttatctttaaactactgtatttcaaattttagagcttctttcctaactcttctttattcaggaacttaaaaaagcataagaacttaggaaagaaataatattagaagacaacgatcaacatttaaacaatacaaatgcaaaaatataacccaattaaagaagtattcactgttcaggcaaagctaaggcaaaatgaaatggtatctaaaaataaaaatgttgggtaagttttggctcttgataaatatttcattgagtacatttaaattaactgtggtataaactgatgaggagatctctcagttttaaagtaattatcaacagttgctaagcaatatagaaaatagacaacaatgtaaatttgctattaaaaatgtcatcattgtgtgggaaaaactacttttttacaatttcttgctatgtttctatataggagaatatgaagtcattattatttctcataaatataacatacggttatttatttttaaaataaatttgctcagcttctaagtagcaccaacttatttgttgacttaggtccttaacattcttgtgtttgggtaaaatgtcttttttctttatttgtttttagaaacaagtaaaaagtatattttaaattaactaaataatattaaatagatgtttactgctaattagtgtatggtttgaattgtaattatgtcatccaaagggactttataaatacagtctagttaaagcatgattcaatcttcaatgattcacagaggcatacattcattattattcatttagtgctctctgatttgagctctaaatgtaatccaagaaaagatggagggattttacttttattgtcatgatttaatatagcaggtcccttagttatcatcctgtactaatccagggattgttacaacttcttagagtctgttatttgatttttaactcagtctgtttatcatactagcagagcagcatgtaaattcaagaggttagaggaagataacccatctcattacaagacaataaccatatatttttctactgtccaagttttagtttaactttgctctttgatatattactatgttaaaactcttaaccatggcttctattcatctaaactataaagaaactaccaacttcatttatccaacactctttattaagtcctgagtccatgttgtgtgacaggcatttgctaagtgctctgaataggatacaattatgatctgccctgagagatcttacagactagaataaaacactaaaacactgaaaaagtactgtttattgtgaaactgttgacttttacaaaagtttttttaagatttatcaatttagttattattactattttttggctgtggtcggtctttgtagctgcgagagggcgctctctagttgcagcgagctgggactattctttcttggtgtgtgtgggcttctttgtggtggcttctcttgttgcagagcacaggctctagactcaggcttcagcagttgcagcacgtggactcagtagtagtggcacataggctttcttgctctgtgtcatgcaggatcttcccgaaccagggatcaagctggtgtcccttgcgttgcaaggcggattcttcaatcctgaaccaccagggaagctcccaaagttttaactgcacagagtgctcaagagaaaaggcagccagagaaacccatctcactcccaaatcctcgaagtcatagaacagcattttctaaagctcagaagggagagaaagaacagtgaaatcaaggaactgcaaggtgagaaacatggaagagcagagagaattgtgaaccagcagttaatagggaccagcctggggaggcccttgcaagcttgtttgaaactgttggacttttcttagacttgtggtggttatgggaaatttgatgtgattggatttgcatttttactagatgagtttaggtgtaaggtagaagatatgttggagaggaaccagactagagacagagagatatgaatagcctatgacagtgatctggagagagatattagtcacttaaaagcagagccaatttctaatactgggggacttgagggcaagaaggaaactttggtggaagagtgggcgcataaagaaggggtttccgtatgaggacctctgtatgtcccagtcttgctttcccattgccatccttatgacttttcatcttggtcttaaaaaataccatgttatactaccttcagataaccacttgaataacctttacagaaaggacactgcttttggaaatcatgttgaagggaagttgctgctgctgctgctgagttgcttcagtcgtgtctgactcttagtgaccccatggactgcagcccaccaggctcctccgtccatggaattttccaggcaagagtactggagtgggttcccattgccttctccatgaagggaagttatcattcatcaatttctattttatcttatcttgctctttctcttatcttgctctgctcaaagtagagttatagaggacaatagagtcagacttgagagatatttaggacagattaatgtgacataatcttttgctggatttggggattattcctaaatttctagctttggagttt

SEQ ID NO: 44605 - DNA, 1336 bp, Bovine  19866880633272
gaaccgtgtgcctccgggacctgactggtcaggcagcacgcctgggctgcagagaagaagtattcttctgtctgagaaagcaggagcctggattatgatgattaaaagagagcaagaaagggggacaaccagacaatactggtttttgcactttgctgtgactaaattaattacatgggcttgattaaccattaatttttagcagttcttaagtgaaccactaattgtcgcagtgccatagagaaggcaggccagaggtactgcgtaagctgggggaggccgccgcacagaccagcagccagtgccacacacactggagctgcgcagaatccgagaaaccatgagatctgcatggaaatgaaggaggaatattcagggtgctttggtggtgtgtgtgtgtgagagagagagggggaaagagagagaatatttctgcaaagaaaggaaaatgccagtactatatagctctacgcagccagcttgcagggttgagttggcatttggcaacttggtagcggctgccagtgtgtgtgtggtgggagaagagggaatagacaacaagaaaaacacatagagcttaaaaaaagatgtaaaatgattcacttcatgccatatggacaaaaatgttgtcacaaaaataaggccaaaaaatagtgccaggttagacttttagttcaaaaacatatgtataatcatccccatgaacatgaattttaattagtattttgatagagagaaaccagatatttttttaacctgctctgttcttgttttctgttcctctcccagttttagcctccattaaacattcatatactgtatgttttgtgtctgtatgaggaaaatgccttatccctggattggtgggaatgcaaacatcttggttttctgtggcatacaaaatatcttcccagtggcgctcgcaagcagacacttatcacagggaaatctagagcgctctctgagccctgggtacaccaggaaggaaggaagccatatgccttttccctttgtcaatggaggcatctgcacccatttggttccccagatccgttcttcacacccgtccacatctcgtctctctgggatgccttttaaaaaagaaataaattcagtgtatgtacatatcacgatgtgacagggcagttccagagaaaaacggatgagatggtgactttagaacccttgaaaaatgggacatgttacgttattgatgaataaacttaataaatgttcacactttattattagttacatctccacctattcctaaaagggattggagatgacagtactcatcggaagagactgtgttgaatcatcttcccttagcaaa

SEQ ID NO: 44606 - DNA, 4542 bp, Bovine  19866880696299
cagtgttttgcagttgctcttatcaattttaaactaatatatactgagcccttgaaaattcaaatagagattaaagatacagatttttttgagttacccacaataatccttaaacctgattgagttcaccatggaagatagaagagctatgaggccaaggatactttgtcccacagttagatgaccagaaaagagcctgcaaggattgcagattttttaaaaagaagttagtaagatagaacttcttatttagtgctcctgaacaaagaagaggagaacgttcccaggagtatcaggaaggaggtctataggaaggtcaagaagaataagaaccaagaaaagaccattagaagttcacaatttcaatagaaaaattaaggctgtagaacagctgagtgtagaatagccagtttttaaatggagacttttgagaatcccaattgaaaatggaatgaaaagtagagttactcgaatcaatagtctttttaaggttgactaaacctgaaagtaaaatgagtattgtggtggaaaaaagatgaaaactcttaagagagatgggaataactggattggacatcagaagaaagattatccttcaaaaagagtgatactgtacatttattctgaaactggagctttggaaaactagtatcttacgtggctaaatgatagaggtcatgcagaattaacattgctctctgttaaaagcttgaagttatttttaaatgggtaatataagaatagtatacatcatgtaatacagtatacagtagtgtacatatactactggaactagcaaacagtagtatacatcatggaatcagactccatcacttcagaattctacttgttggagttgggatccagctgaaaccttagacctgcctgtggatattagatttattaaaatactaaaactgaagacctgcaaaatttagcggtatcattttctaaatagtcattaaaattgtccttatccacttaaaaaaggatgggcccaaggaccttttcctttctttttttttttttaatttttgaaaatttttattgaagaatagttgatttacaatgttgttttggtttcaggtggattgcaaagtaaatcagttataggtatacttatatacactcttttttagattctttccttatagaggccattacagagtactgagtggagttccctgtgctatacagtacgtgctttttagttacccgttttatatatagtagtatgtatgtgttagtcccagtctcccaatttaatcccttctcctccttaccccctcaaatcagttcagttgctcagtcgtgtcctactctttgcgaccccacagaccacagcacaccaaacccttctgttcatcactaactctcggagtttacccagactcgtgtctattgagtcagtgatgccatccaaccatctcatcctctgtcatccccttcttctcctgccctcaatttttcccagtatcaaggtcttttcaaatgaatcaactcttcatgtcaggtgcccaaagtattggagttttagcttcaacatcagtccttccaaagaacacccaggactgatctcctttaggatggactgattggatttccttgcagtccaagggactctcaagagtcttctccaacaccacagttcaaaagcatcaattcttccgccctcagctttctttatagtccaactctcacatccatacatgaccactggaaaaaccatagccttgactagatggacctttgcagtgcaagagggttcccttttctctacatcttctgcactaacaatgaaagatcagaaagagaaattaaggaaataatcccatttactatagcaacaaaaagaataaaatacccaggaataaacctctataaggagacaaaagacctgtacttagtttagaaaactataagacactgatgaaagaaataaaagatgacacaaacggagaaataaactgtgttcttggattggaaaacctatattgtgaaaatgactatactacccaaagaaatctagagatttaattcaatccctaacaaattaccagttaccagtggcatttttcacagaactagaacaaaaaattgtacaatttatatggaaacacaagagattttgactagcaaaagcaatattgagaaaaacaaaaccaaaaatggagctggaggaatcaggctccctgacctcagactatacttcagggctacaggaatcaagacagtatggcagtggcacaaagacagaaatataaatctgcagaacaggacagaaagcgcagagataaacccacacccctctggccaccgagtctatgacaaaggaggccagaatatacattggagcaaagccacagcctcttcaataagtggttctgggaaaactggacagccatatgtaagagaatgaaattagaacattctctaacaccatacacaaaaataaaatggattaaagacctaaatgtaaggccaaatactataaaactcttagaggaaaacataggcagaacactctgacataaatcacagcaagatgttgtttgacctacctcccagagtggtgagaataaaaccaaaaataaacaaatgagacctaattaaacttaaaagcttttgcacaacaaagaaaaccataaacaagatgaaaagacaaccctcaaaatgggagagaatatttgcaaataaagcaactgacaaaggattaatctccaaaatatacaaacagccatgtatgggggggtcaaaaaaacaaacaaccaaatcaaaacaaaggcagaagacctaaacagacatttcttcagagaagacatatagatggccaataaacacatgaaaagatgcttcacatcactcattattagagaaatgcaaatcaaaactacaatgaggtatcgcctcccaccagtcagaatggccattatcacaaaatctacagacaataaaggccaagctctcatacctcaagtgagatcaactctaagggcccaagtgtcactaatggtaaagaacctgtctgcagatgcaggagacataagagaagcaggtttgatccctgggttggaggaggaaatgggaacccactccagtattctcgcctggagaatatcatggacagagaagccttgtgggctgtagtacatggggctgcaaagagttggacacaactgaagtgacttagcacaccccctaagggccacgcagtgcccaggctccctgcaggatgagctgaggccttagccaaggttgtatctcagcctacctcctcaccctgcctactgctggggccttttttccctcgtaggtgttgatccagaacacactcccaatctctgacccagcacctcaggaaacctgacgtaccaaacagtataaaaggagcaggagggcaacaaaaaaatattacagttcaaccttacttcttttgtgcaagtaaagaaacttcagccaagaacaattatatcatttgcattgaattaaatatctagctagtcccagggccagatcctctatctcttgacttaaaagtgggcattctttattagaaattattttccttaacagactctaactatacttcacctaagaaaaccacatctgagcttaaatctggcaaagtaacagttaatagttcatctcttttcagcattcaacatgccatattacatttctagaaactctaccaaaggaggagaaaggtctcaatgagttggaggggttcagaggaccagggtgattaaggtggaaactaacttttttctaaatatctaccagcaccatgggcttctcaagtggtgctagtgataaagaacctgcctgccaatccaaaagatataagcagaagtaggtttgatgcctggatcaggaagatcccctggaggagagtacggcaacccactccagtattcttgcctggagaaccccatggatagaggagcctggtgggctactctgtagggttgcaaagagttggacacaactgaagtgactgagtgagtgagccagctgccagcaccatgctaggagctttccatgttaccttactaatcttcacaataactcaatgatagaatattctctttctcattttagaaatgaatgaacctgctaaaaggaggttcagttggctcacatgagatttgactatgacgctgttgatgtgtccctttacccaaggcctcaccaggactgcaaataaacaaggtctgtcctcccttgattcaccatgtttgcaagtgtgaagctttcattatcatttgtctttcagattctcactaattaggtagagcttcactacataatatacctgttaacttgactcactacaaataaaaatcaacaacgccacaagtttcagaatgttgattagcatttatgatttccgagtgccaaaataaatcaattattttgaaggactagtaaagctaaggcacattcttatggtgttttcatcagtacaaaaaatttacaatgacatctcttaactaggcacttaagaaatcatttggcagtttactttggccaaatgccata

SEQ ID NO: 44607 - DNA, 1977 bp, Bovine  19866880973361
ttatgggcttgtagtgcatgggaaaaactgttaatttattaaacaccaaaaataagtacagtcattgacaactataggtggcctatgtgatctagtaaaataaaataacatgtcttttgccagtcacctcctctcctgaaattctgctatcaggtggaggagagcctggaggagtctgtattcaagctcccttcagtgagtctcatactctgttccagaactttttaccattaaccttgacatactatcatgcatacatttccaacctgtgaaagtcatgtttcttgatcttccatcacaatgtgagaatatgtgagagctgacctgtaagaatcagtgacaagggaatatgtgaagcccagagttgtcctcatccaggatcatgatgttgtttgtgccttttaactagataaaatcaaatacgccacagctggtgaggtggagcatctcttagattggaggggtccactgttgaggggttttgaatggaaactaaaaacaaactggtagctaatggcacttgtaaggaaacaagtgcacggtacaaagcaattccctggctagaaatctagccttgatacgcacaaggcatcattgctattttggaggccactggtaggtagaactgtgctttacatctcattgttcaagatcaacttttaactaaaccttgccacttaaaacagtatcaaagtttcagtacaccaactgagaaaacagaagcacgtcacttgtttatccttgtgtttcatagcagaagcaccaaagcaaaaaaggaaatgtgcttgcttttgacaattgaatttttctcatgttcatctgctaacactttcttacattgtaagtttgcatttattttgcaaggactatattgatcctacacacagagatgacaccactcccctccaggctggcctgtcaatcagcataccatctcttcacatacaacatgttccatattttctttgctaacatagccagtggtgtttgggtttagttgtgcattaaattaatcctacattttcatgaacacttaagtaccaaatctaaagattagatggagaatgggcatttaaaatcaaaacccaacctttgtagatagtgaggggtcgggatgggaaaacatggtcatgggacaggtaagaaaacacagtttcattttaaacatatttactcttaaaaatactagtctaaaattctcctcatataacacggccttctggtctcagtacatgcaggtgaaggagcagataataatggatacacttaagagacataaaaatttatcccatcaattgcaactatgtacaggatgatccgagagatatttcccacatttaaaaaattgctgtagatgtttcagctattggaactgtgtgtgtcccaggcaacataatagattatacctcgactccttaaagagcaccctgataatatgcaaggctaaaatgtcagaagctattagaaactctcagatgcacaatatatctccattcctgagttttccccttacactgcgaaacaccagacaacaggcatgcaaactgctcagctgcaactgttccaagtcgaataattacaacttgtcagaaagaattaattttcccatttctcataaagatgtgtaaaaattaccatgttattatacactgacactctctggaggcagacacaaaatttaattttgaattctttccgcatattaaattaaatccataaataagagtttaggcattcactcggaagcatatgttcattgggagcgaaagccaacacgagcccggctgaatggctgttgtaatgttttaatagctcgcttcttctaagcaccaataaatttacatgatcataacagtcgtgggcatacaagaagcccattactgtctgggcacaggcagcagcgttaacaggatgggaaaaatgggaaaaagggaaaaaaactcttaaataaaattaggcaactgcacttgtcagctg

SEQ ID NO: 44608 - DNA, 820 bp, Bovine  19866881000064
gaccctgcttggccatgaatgcgtcccatcggccagacccaaccccaaaagtcagcatcgtgattctgcagcagctgttgccgcagaaggtaaatgccgtgcagatattgatgagcttgctaatttgtttagtagacagaatttagaatggggaacaggatttgtctgctagctgtcatcatccgtcagccccaggctgccccaggcaatgggtttgctttttgccagcttctaattttgctttatttttccttagcttcaatctactttattcatttattataattgggagagtggtggctgagataggggaaaaaaatacttatggaccacactggagattgaaggctcttgtgtgctgcggttccctgatatcggcggcttcagaccagacctgttggtctcttgattgatggagtttgtgaacgaggactgtgctctcatgtgggtatcttgtagcatagtgtgatgggaagatttaccaaaactgctctcagccctgcgtgtttctcctggtttctaccaagatcagaatttatattattagatttgttccttggggattcttattcaatttatttaaaaaatgtgttttgggggcacactaggtgttggttattattacaggcagctgattgtggattggtgaacaagatagaaaaagccctgcttcaaaagtacttagattctaaaggtggagatagaaataaacaaataaatgtacaatacttcaagacagtgataaactgaatgaaggaaatacagtagagtagagagtaagactgaaagtgttattgtagataaagagagcaggcagagt

SEQ ID NO: 44609 - DNA, 1915 bp, Bovine  19866881007483
agcttctgatgaatagtgaaaaatgtacttataattctctgaatttttcctattggaataaaacaaatggtactccacattatcatcaaaatacaggctagtgttgagaagctacagcccttggaagaacaggagcaactgtttggatccttcagcagatctcagaaaccaaaccaaaccagatgacaaaagcgctaagaaactcctgaatgctcacaaaatccaacagaagagcttcaccatgatgccaggcaaaaaatgtagcagttaagaaatattttctttaaagaaggcttgcctccgttaagtcattttgtgtaaagtaacagttcatttcttcagattctttcagttacaaaagagagagcatcaggaaatttctaaagtccaggcatttagttgcttcatgttgctctttagaaggaatatattttgctgcttagaagctcatctatgctccctgaacttgctgaggttctagtaaacaagtcttcaacaaagacaccatccatttaactaagttcaagccttctctaccagtttggcccctgacaggctctgtgtcaggataaaggtgaatcaggattggttagagttacataaaggattggggagcagggtcacatccactcccacatggtaccaagaacagtgcccaagtgatcaacactgctgctgctactggctaagtcgcttcagtcgtgtccaactctgttcgaccccatggactgcagcccaccaggcttctccgtccatgggattctccaggcaagaacactggagtgggttgccatttccttctccaatgcatgaaagtggaaagtgaaaatgaagtcgctcagtcgtgtctgactcttagaaatcccatggactgcagcctaccaggctcctccatccatgggattttccgggcaacagtactggagtggggtgccattgccttctccaagtaatcaacacacatcgacataattaacaccagcaggggaagtgggtaggatagttaagaacttattaaaaatgaagcatcaccaaacgaaaatctaagttcattcaactcaacacaagcaggtttttttgccaagccacaagagaaaactgaagtagattaattattagtttgattatataactgagatatgggatcagtttctgtaatgtgtcctacttttatacaaactgatcccgtgtctcagttatataatcaactataacttaacctacttcagttttttcttgcctagagaactccatggacagaggagcctggcaggctccagtccatgggatcacaaagagttggacatgactgagcaactatcaccagccattagttaattatagttgatgattttttaaaaaaatatttttttctcaggtttttctcttttgagataagaaccattctatactcagaacatctaatacagagttggaggaattctttacatgttaaaattatgttatcttctgtagtccaggaagtatcattggaaccttcagtcccatgattaccctgtcaaaatcatttcctttaggaagcaactgccaaggctaactttagttttcctttgcttttttgtttcctgtggcaacccactccagtattcttgcctggagaatcccatggacggaggagcctggtgggctgcagtccacggggtcgcaaagagtcggacacgactgagcaacttcgcttgtttaccctaattatatgaggcatttttcttttttacaatttttaaagtaagactgtaagcctatagctatgttgaatctggttattaaaaaaaaagttaagccatcttattggatatattcagattctaaggttttatttacatatgataatccagtctattaatgggatgggattagaaagaaaatcggtctccaggagctaatgtttagtata

SEQ ID NO: 44610 - DNA, 1232 bp, Bovine  19866881149050
ccaaaaaaagctcatgcgtctctcttgtgtttagtaataaattgccactaacccatcaggtaaaagttcattttacaggattccagatggtgcatttaacaccatttttaaggcttcctgtaactagctaacgtgtacagtcaatgaagatatatctgaattcctggatactttaattcttatatgtagggtctccccttcatctttcttcaggtttttcccttttttggcgtgtttttctatttttctgaacccagaacttaccactggcaggatttcagtctcagaattctgtcaacctttaaagatacagcattgtggctattgtgaaagttattttaaaataagtttaaaattgttgatgacagcagtgtttgacttggtgctcgggtattccctgaaggctaacgttgtttctttctcactgaagcacttaaggaaaagtttgtactaacctttgttcctttaggaaagcgcctctggatttttatttacctttgagattgtcttcggaaaatgaagggtttttatgccctctttagtcttagcaaattaaatactgtgtggaaaggagaagaaggagtcataaaatcaagggaggcaaagatgataagcatcaaatcagaggagataaatttttgctgctaataataaacctttgtttgaagcaggactttggaagcatttagttgacacagtaaaaaacaatgacattcactagggataggtttgttttctttttctgaaattaatttattaaatgaattcatgttcatgagtcagttggaaaggcatatcaggaaaatcaaaagtgtgaccacataaactgtctaggatttgtttattttgaatttatatagcctcttttctccagagatttgaagacgctgtggagaaaattttaaatcttttaaacaatagacaataagtcgtaaaatgtgaactcctgcctggataggctataatctctaaggttttttaatgtacccagatataagcacttccagttatgaaggaaaaatacttaaaatatgagattctcatctggctggataccaaaaatgagagatactttgtgtaaaccttcattcttttagatttaggtctgttttttcctacttattctgacatttgaagttaggggtttaacctcaaatatgaagcatgttgtaaattactaatatgaaattactctttcatgttcggaggaatgagagtcaaagcactcaggc

SEQ ID NO: 44611 - DNA, 1805 bp, Bovine  19866881152135
ccacatttaatctcttgtggaacataccagtgagtaggaataaatccaaaatttccagggaacttgtccgtaagtactgcaaaataaaatatttaatttcaaggtctttaatcagtaattttactgccaaaagtagcacaatttgtttgaaagaagacataatgccacactcactgatagctcagttggtaaagaatcctcctgcaatgcagaagactggtttgatccctgggtcgggagatccactggagaagggaaagactacccacgccagtattctggcctgaataattccatggactacagtccatggggttggaaagagtcggatacgactgagtgactttcactttcacactttcactccatgcctgacttggatcaaggttaggaataggtgagaagaaccttgttcgcctgttttcaataactctcagttggaattgctatctgaatacaacagtttttacatgtcatttacatttttataagtctctctattcaaagacccccaatttagaagtatcaatctcagccatgagaaaaacatgactcctttgataatccaggtacttttcatttctgatggagaaagtaaaacattcccaatccactgatggtcacagaaagttttgatctttggaagaagacaaaaaaatttccattcagcttccagagaatgagtgaataaggaggcgtttcatcttcccaaactcccttctctccaatttctctaacacaatgcacttgggaaacaaaaggcagattattaagttttcaaatgaagctacttgtttctctcttctccctggatgtctcagccccggtctccctggccttgcctttcggcacatctggtaaccatgtgtggtggtgctaatgaagactttcctgagtgagttacaattagttccgactgccgtgcagttttcctgggcaggaccaaagtaaaagacaggaatgggggtgaggggaagccaataactctttcacttcacaaacccacattctcccttgctcctgggacgctcatcaccaccactccggaggaatttttgaaaaaaggtgtaagcaaatactttcagagtttccttctcccttttctccaaagcagcattttccccaagttgattgaatgcgacaggcaggcaacagtacttctgtgatcctctgaacaatagggaattgttaaacggatgccattcctccttctggtctacgtattctacttacctaacaattttatctactttaatagaagaaacttgtgtattttactatttgatggattagaaggaactgcggaagcaaatgtactgtatacaattaggctgtcttgaaaatgcacacttttgtttactctagccttcttctcccacttctcaatcaagctcctaatagagctgttttaagtttcaacaaggaccatattaactgcgggtctccacatgaaacagaatgctaaaccccagcgtctcctgacgatgtaagctcaaagtctcccaaatcctgttttacatttctgtctgaaatcatggttctgtctttccaatgcttttttctgtacctcgcaaactgtgacttctcaataaatactatatggtggcagaactggccgttgtgagaagattctaagtgactccgagggtagaaaagttaatataattacttttggcaacttgtacctatatcttatcctaatgccatctactttttaatttcaccaactccggacttagaatatgcagttactcagtaaatactaaccactgataacaaccacagcttacactgcagccctgtcg

SEQ ID NO: 44612 - DNA, 1076 bp, Bovine  19866881152616
gaatattgatagaaaatattgaagcagaatgttcctaagtgtggtataaatccaaagagaataaaattgttctaactactgtgggtttggtgactttaacacatttagaaagaatcttcagatttatgcgatgagcattgctgttcaaaatgctgcttttctactttggcaagcaagcaggatgctactcctagggataaggttctagcggtgatgcaattggacacttcctcccagcaactctaaattgtatgtttgcatctatcagttattgtgttgattccgatcatttgttctgtctatggaagaatgactcaactctaccagtaaagaggagctgaacaacgtttgaacacagcttttctctgaaatccttaaatggccatgaatgtagtaaaggttgcatgtattgactagttgactccataggttggaattggtggttcacataggagagttgtggcactcactgttttcccaaggcagtgtctaatctcactgtagggcatctactccaagcaacgagggcctggtgggattttaacagcattaaaagcctgcctactcacacaccatttattgttctaaatcccacaattaaattcattcctttgggttatatataaaaaaaaacacacgacaattttcttgatataatcaaattgcgtagactagttaatagactactattaattagcaaccatttattcatttatttatctaatgtttatttctgttaactctattcctttgtaaaatacacttcataaaatgtaacaaaatccatcagttcaggactgctcattatttcatttcacaaaattctttgcataaaatatagatatatctgcttttacatagcagtttttttgcttttcttgactgaatgcctgctttcttcaccagatcaattccatacattgtcttcataatttcagtgaagaacagaactcacactcatatccaatccatttgcaaatcctatctctaaaaaatatgtattctaatttaccactctcactttagctcaagatgacataaagtatggaatattaaaacagactctccactaccat

SEQ ID NO: 44613 - DNA, 2638 bp, Bovine  19866881165939
atcctctcttactttagtgttaaaatccttggcagttctttttactctaccattttctgtgggctgcagcttaaaacacccagccacattaaaactcgcagtagagttggcagtgtgtcttttctggatactctgagaaaattctcttaaccacaccggtggcctaggaccttgtagtgcttagtatgtgcttagtctctcggtcatgtctgactctttgtaactccatggactgtggctcaccaggctctctgtccatgggctttttcaggcacaaatactggagtgggttgccatttcctctcccaggagatcttcccaacccagggatcaaacccacgtctcctgtgtctcctgtattgcaggaggattctttacctgatgagccatcagcgaagccccaaagcctcatatgacttatatttatgcaagcatcaccttgaagttctttgaaaacattttccaagtcctttcttacaaagtgattttagtacaaattatagtgaaaaatacttgtataaaattattctctatgggtctttgcagatatattcagcagtccaagaaatcaagatatttgtgaataaataaacaatgaagctaaatttacatatgcattttgttattttgttgtatcttcttttagttgaatgaaccctacagaggcgcatatgtaggagtgtgtgtgtgtgtgtgtatgagggagagagacagagagaaagagaggtgtgggagagaatgggaatgcatatatacgatatagaaatacctgaggggatattttaggacatgtctgaactctcttgcatctgactggaagatgtaagagacagctgacatgtcaaaaagatgagaactttcaaccagttggattttcatattttattttggggcttaaataacaaagacttaacagaggaaaaaattattatactaaatttactgagcttttatgaagaccttatgaatgtatatttgtatatgtggatatgactaactgtatatatataaattacagcaaaaactactcttgcttctggttttgctgaaactgatccagttgacatatattgcccaaagaacagcactgaagaaaaacattttcgatgtgttaaaatcagctttgattgcagtcattttatccctcatatctatagagttattgacttcttgtagagacaggaaaatgcctctttctccatcctctacccaagactgcatgagcatacatttgctcattcacactggtttaaaaaaataataggaacttccctggtggtccagggttaagaatttgcctgccaatgcaggggacacgggttctacccctggtctgggaagatcccacatgccgtggagcaaggagcctgcgtgccacaactactgatcctgtgctctagagcccgtgctctgcagtaagagaaatgaccctgcaataagcctgcacaccacagcagagagcagcccctgcgtgcagcaactagagaaagcctgtgtgcagcaacaaagacccagggcagccacaaataaataaaatgaatagttttttaataacagagaaaggataactttggaaataaatatgtttaggtcagaaccactcattgttagagggactgaggaatttgaatgttttttgtttgtttgctttgctttagaacagtattttattaactagctagtcaattgttctatcattgctggaaactttctagagagttacattttggcccttgctcttttacttaattgtggagatgtggcatgtgcataattcatggttagcataatatatcttaccatgtattcatcattatcattagaaatttcatggttattataagatagagccactgagactgatgctttcagtgaataatccagacacttagggcattttgagcaacttttttaagacagctgtcatggcatctcagtacaaagtggactatatctcagtgaattaaattgcctcttgaagtgaaatacttttttcaataactgatattggcattagactgtcaggatcagcagtgacttcatgctttcatttgggggtgaattaggaagccaagcctgcaggttccttgtgtatccatcttccacgtggcagaaggtgacagttgctgctggctcatgacaggaagtactgaggcaacctctaggttgggctaaaagtctggagaccctgggcttttgttacttttggcatttgtagtggcagggctgaggaggaacatttttctgtataaaactttgccaggatcatttgaaagacggaggtcaacatgctgataaactttcagctaatgtacgcatatataaaatatgcataggcacaggatggtatagcagaaagaaattttcaactgagtgcctgattcccatcccctcctgccccagcattaaaatcatatctctgggttctcacaacttgtgggggacatgtagactctcggttacccaggaatttaggactatatgaataggcagtatattgattttaagacccaaaatatgaaagttgaaagttttggaagaactattactggatggcttcctggaagaaagaagttgtaaggagagattaacagaaggaataaaaagtctctcggttcacagactgaaatccattatg

SEQ ID NO: 44614 - DNA, 1089 bp, Bovine  19866881218691
tagatatttaagtgcttaaattaaaaaaaaaaataagctcttattttggtactacatgtaaggcggtcatactttccaaattgataactagcttgactcaggatctgaaggtgatgctgagtattcaaaactgaaacttctataaagaaagtttgttaccatgactctgaaccatagccagttaatgctgttgactgattaccaaggattttcgaagtagtggtcagttttatcgcccttgtctggatgccctggagtctggtggcaactatgttccatttgtaaaattgaagtgctacattcatccttgaaacaaatggcaaagctatttaggattggttttaatctaatggctctggcagggatcccattgggacacacaaattaaaacatagtcttgggtcaattatagcagtgtatcttttgaacaagaaagactcaatgacttttttgacaagagtctggtaacctgctgagtgttattaattttactgtcccgagagaataatgaaaatagaacctattgtttagccctccagctacaattgtacaccattgtatatatgaataatatcttaagtaaaccccacagaatatacttatgggggagggagataagcacagtcattcttttaatatagaaacaatcattaaatacagaaatagtgacatggctataaatcccaattgtagaatctgtggaagagaatattctggagacagaaaccttgaattttatttcaagattatcctgacactcgctgtccccataatcttctatttaggaaataaccataaagtatcacagtgaatatgacaaaatatcacatttgtatttttccagggtttttatgatgatttttctgagtgtgctctctagaaaggcataacagtgcaaggttcagagaggtttttagaatcagattgcctggatttgaagtcaggcgccaacatttattagccagttatgggagcttaagcaacttacttaacctctaggttacctcactttcctcagctaaaaaaaatgggataataataaaacctttgggcaccccactccagtactcttgcctggaaaatcccatg

SEQ ID NO: 44615 - DNA, 1780 bp, Bovine  19866881356554
taccttggctcatgcttatgttggagacaagactctaactcctactaaagccaaatgatggcaattcaattcctgcctgccagttgcaaatccctacactaccactgcagtgctatcaaaagacatttgcaatccagggcacctctcaggagagaagtgatttctcaggttagtcacttaatggattagcagttcaagtgctagcaactcaaaggtatgcatatattcgttctgagacaagaaaggattttccaatcctatgggcagaccatcaaaaaaaaaaaaaaaacacacacactaatagaaccttatctatctaaggtaggcagagaatattattcatttattaattgcagtgttaaacaaaaaataatcaaggagggaataaactcactctattcacaaaacatcaacaaaagacccgcaacacttttcatgcattgcaacaaatataattttgctctaatctcatacatgtcataaggcaccacgccgtagtgcaaagaaagctgggcctgaaatcaagaaatctgggttcattttctggctctgtcgcttattaactgtgtaaaatgataaaacatttaactttgctgagcctcattccttgtctagaaaatcagtgacttattaataggtaagcatcatccagcacttagattcagtattaatctctaaatcagtgattagactaaagtttacattttatatggtctttataaatctcttaagtctttaataaatcctagatttgggaagtcaaatatatgtaacagacaaggaactcttcagaaaatatgttagtcactcagtagtgtctgactctttgtgattcccctagactgtagcctatcaggctcctttgtccatggaattatccaggcaagaatactggagtgggtagccactcccttctctagaaggaactcttgatctaacagtaaagaactaaatagggttttgttttgttttttaatctactctgtcatggcaatacacaaattcctaaataggaacaatatttgtgtgtcttagtagataccatcatctttttggcaaatgtcagtcatataaagcagagaaggcaaaggcaccccactccagtactcttgcctggaaaatcccatggacagaggagcctggaaggctgcagtccatggggtcccacagagtcggacacaactgaagtgacttagcagcagcagcggcagcagtcatataaagactctgacatcactcaaagtattcttcaaagggaagagagaggaacttcttcaatgtcccagagtactttaggaagctaaaactctcaggggctggatgagataacacactcagaatattcatcccaaggtctctatcagatttcaactgcttttcattctacataggtaagaatgcttttcattctacataggtactattgcttctaactctactcccaggattctcaagcaaccctacagaattttattcaaattaccataatgctcaaaatgctaattaacgtcacaacagagcatcagaactccactgcttgctgttcaggctcctttggacccatcctcttccagtgagtgttacctagcctcggaagcagatatctagtctccttggttggtgctggactatcaaagaaccatcttcactgaagacaattcataatctggccaaaggataatctctatcaggactactggcaacaaagttcacattttattttcagcacttactcttgggattctgggcaagtactacaatctctgtgttaaatgctatt

SEQ ID NO: 44616 - DNA, 888 bp, Bovine  19866881366298
ataagaccactgccaagtatgcattggtatatttctatacactgaactgctttagataatagataaagttagctttatctacttcatggtcttacccattcagggccctctgcttcaactaacataaaaataccttcactgcagggtcccagtccagagggctaatacacagcacaccttctgtaaaatacaccattctaaaacttgaaaaatggtcagctaattaaagaccagtgaacggttttgagacaggaagaattctcctattcaaaactgaaacagaacctgaatggaatcaaaaagttccaaagtaggctgatattctccatgacttgtaagactatctattatcatttttcaaatgtctcacactgtacctgagtttttttgtttgtttgttttggtcacaactacaaatgaaacttcaaaagccaatgctgttttacgtgtgtgcctctggagagatgtgtatgagagagatcccttagaaataatacaaaaagtctgtccttctgcaaagttcagcacagatttcacaccagagtattttgattaatttcacttcagaaatgcataagtggagtgtatgctcaaaataacacccccaaatacactcagaaattctgaagcttagcacgcttcccaaaacatctctgaaaaagacagcactccaataaagactggttttctgctggatctgagtccatgatcctgggatgctaggaaaccagtctaacctcagagagtagaggctaggtcagtgcccctccaggactgaaaactgaatctagctgccaggaagtctggttgctgtgacctcccaagtgactcctcctcaggacctgctctaagaagaagaaggggggctgcctgcccaaagttgtgccc

SEQ ID NO: 44617 - DNA, 1302 bp, Bovine  19866881430934
cctttctttatttttaccactgtatgtatatgtttgtgctgtcccttccgctcccgcccccgccatttccactccatcctacagacccgatcctaaataaagcctgatgggaagaagtcataagttagtcctcatctcagataaatacatgaagaaagaggccagaggattgatcaggtccttttgaccaggccctcataaaaataatactcaatgatgcacagttttgtctgcaccaggggaaagaatagatttgagaagtaagcaggcaataaatatcctaaaatatggtgtgccaaattgaaacaactgggtggtgaaatgcatagaaccactgagtgttgctccaacaacttccaggcaccaggggcttcaaggaatcatggtgctctttttcacttttatgtattgttgaaaaaagtattgtatgagagtaacatgttagctatggcattagtaaaatatgattattaactgatattttcctagctataaaaattaatatagtatttatgtgttgggataaaatgaatatttttaggtataatttacattcaggacaatgaaatgtcttaatacagctaaaagaatttttacctatgtacttatctatgtaataacattcaggttaagagataacttatttctgttgccccagatggtttatttccgctcattctcaagtcaattctccaccacaggtaatgaatacatggatacattttgtctagagcaaaactagactaattttgcctaattgccacaggtggtagttgttgggttagtccttcagttgtgtctgactctttgtgaccccagggcctgtagcccaccaggctcccctttccatgggatttcccaggcatgaatgctagagtggttagcctttttccttctccgggggatcttcctggtccaggggtcaaaccagggtccccagcattgtaggcagattcttcactgcctgagccaccagagaagttttgcctaaaacaaacatcttcaagtgttacatgccaaatactatgttgcaaattttcttgccttatctcattttaacttcagttaatcctaagtacaagaggagacaagtatttctgtaccaggtttccaaaagaaaggataagaaactcaatcaacataaaattgcatctgaaattctaaatctattacactcaagtgatgttctactatatttatattgtatagaccattaaatatgccctgtgattaatggtttaaaattaaatgcacagcataaggcacggtaataagaatatcaatcccattctattggcagga

SEQ ID NO: 44618 - DNA, 1554 bp, Bovine  19866880462228
tgagttagtttgacctcagaaatattggtgttggaaatattctggtaagattgaggggaaaaatgttcaggtaaaattatgtttacagccatcatttaaagtgttgatcctgttattgttttaaacgtcttgacctcattgtcgcttataagctgagtctcatttttagaaggtgaagggatgaccagcttatttctcccctctattactaatcatcataatatgcttgcatgcgtgcatagtcagccacgtccgactctttgcgaccccacggaccaccctgccaggctcctctgtccatgggattactggagtggcttgccattttctcctccagggaaatcttcctgatccaggatagaacccacatctcctatggctcctgcattggattctttaccactgagccattatgacctgtagcactcattaaagtttataatatttaccttccatagtgcatttccaatccctgcatttctgaatcttagtttcatatgaagattgtcctgcttcttccatccctgactttggattcatctgctttccaccttccagaggagttttcaagtgttttcttaatctattgtgactcctcagccaatccccttcaattaacttacagagagagatttcctcatttcatcctttcaccatttttacgtggcaaaaaggagatcaaactgtatgttcaaaacattgttttgggttggaaaactcaaaaagctttttcaaaagatactatgtagttataagggattcctattcaacatctgtttaataaccactgattggtgtcctgtgtgccaggctgtgtgcctagtaccatgtttattgctctgttgttggcatctgcgagctcaccgagaagtgtttcctgcccgctaacaggcttctccttctttctggtggaaatttctctaatgagaaatgaaggattatttcataattaaagtctgagcctaaaacactgatgcccccagggcaagtaaccgccctcatttattcagcatttattcactgctggagaagttctgcattctttccaaaaggcagaaagaaggaaggatgagggatatttagaaaaagaagaaaaccatgtattgtatgaacctcagggccgatttcctaatctgttcaatctccccagaaacatatctgcttctgaaaaatatttacctttggtaggtgagtcaccatttgtacattgtacaaccctcgtggttgccagcagggagggtttgggggaagggaggggagggaggttggggttagcagatgtaagcttttatgtatagacaaggtcccactgtagagcacaaagaactacattcaatagtgataaaccataatggaacagaatataaaaaaagaaatatatattatatacatatatattaatatgcatatttatttatacacataactgattgcatatatatttatacacataactgaatcactttgctctacagagataattaacacaacattgtaaatcaactatacttcaatcaaaaaaaaaaatgctattatctttccaggggagggaag

SEQ ID NO: 44619 - DNA, 1747 bp, Bovine  19866880864471
ggctctgtgccatgtgaaattgtaaatagcactgacaatgtaatttgtactcatttatgacacagtagctcattatggctccaattttcatccccttcattaacaagctcatctgtttctctgatagaagcctgttttgtgtgagatgtggttctttgctcagagagaggtgagtggactgatgagaagtgggcatttgtgttgctgatggaggggggcacaacacagtggtacctcaaagtatgtcttcatggcagctaaagagcagagggtatagtgagattgggtgtaaatctttaacgtgcattttgcttgcttggatccccaggaattcttacattaaataaatgattaaaatagactccaccagggtcttctctggtggttcagtggttaagacttcaccttccaatgcaaggggtgcaggttcaatcccccggttggggagctaagatccaacatgccttgtggccaataaaccaaagtataaaacagaagcagtgttataacaaattcaataaagactttaaaaatgaaaaaaaaaaatctttctaaaaaatacaacatgctaggctgaggagccaatggggccaagctaccaactgtgggattatgactgaatgcctctaaatcagaatcgcgcccaggcccctggagcctcggttggcctcagatagcctgtccccagccatcctcgctgcccctgtccagggtctggcgtggagagcccttcgtcctgggacactgggcatggcaggaaaggcgtccgcccccttgcctgtcacacaccgcacattcgtggggaacctggtgctaaaccgttagtagatgacctgcttctgggtcggggtttagtaggtagcagagcagctccctcactgccatctattgaaagtcagccctcggacacaagggtttgcaaagaaaataaaaagtaaaacagagcacacaaaggaaaaaacaaagtactagaaaagaaaatgaaaagcaaaaaaaaaaaaagggaaagaaaaagaaaattaaattaaaaaaaatatagactctaccaccaacaaaataataatagtaataataatgaggaggaggaagatgaggaggagaaacatacagtcaagtaccatattccttgtggacctgatcatagatcaatttcagtttcattgtaattcctcagaatcctctgctgtatcactttgctgttgttgttcagttgctaagtcatgaccaactctgcgaccccatggactggatgccaggcttctctgtccatgagtatctccctgagtttactcaaactcatgtccattgagttggtgatgccatccaaccatctcatcttctgtcacccccttctccttctgccctcagtctttcccagcatcagggtctttttcagtgagtcagctcttcgcatcaggtggccaaattattggagcttcagcttcagcatcagtccttccaatgaatattcacttactgcactgttttaaatcttggatcctattgttgttcatctttcgaaaggcatcacttccactctttgtttgcccgcagcatccctagcctattcctgctggaccatgaaatagtaacttccctcctccaaggactgttgagatggtagttgtccttcctttcctgcatccctgtgggagtcctctctgaaagggagcttgttaaagacaaattgctgcctttctggtgcatcttgattagataaagttctccctgctccatgttgggcagt

SEQ ID NO: 44620 - DNA, 1863 bp, Bovine  19866880973603
tttctggagagtgatactgcttaatgtggataaagcctagtaattaatcttcttctagcactagagtaattagtttcaaataccttccattgaagagtacaacaccatgaacaattttcccttaaagaccataaattaaaatgttgatctgtgttttctttggtggccagcattcagtgcaatccactgggataaaattggttgttaagaaggcacagtgaatccaggctggatacctgaactcaatgacaaacaaacaaacataaattattttagaaagttcttcaatattccataactggatttcttttattccccctcctgttagccagaaagtattagttttcatagcatttctttttgccatgacataactataaagctggaatattacatttgtgcatataattttatgtgtaactaaaatactttcactagagctggtatacttactacattttgttattggaaaagtcgaggtttacttttcattctatttcttctcttatatatcttctatctgtggtctttgttttttctttattccacttgttagattctttatctattaaagacatcaaccaagagtttatagtctaaaccatatttgaaagcacgtaaaattccatcttaacacagatttcatatttaaccatatggacataatatgtcttacaatgattttcccctcgttgtaaatgctccacattttgaaatatatgacattccattccaaaacacgagcacactatttgagaatcaggccatctgcgtacgatcaaggatgttcccattcacataccagattgctatttgcacagggtgtatccatcatgtctcaaggatgaggaaaaaaataagacgcgaagcataaagacaaagcactaggagagtacaaaatcagattacagtcttgcttccaccagggagtagctcaatcttctttattctgaaattagcctgtgcgtcctgaagagggcgcacgcacattccccgggagtgctgcctcttcacacaacagctgttaccaagttgtctaaagtctgggataagttcttccatcagggcttctcctccctctgtgagggggtacaactttctctttctctgcctccttatactttcgtgtccttggttaatcgctctgactccccgtttggagacctgatccaagtgttctcacctcaccagctcagtatttctcatcaattaactacctagccctttcccataggaatacactgttaaaaaaaaaaaaaaaaaaaaaaaatatatatatatatatatatatatatatatatatatatatatttatttatttatttgtggcggctcagcaagtcatgtaggatcttggttctctgatcaggggtggaattcaagatccctgcagtagaagtgcagagtcttaatcgctggactgccagggaagtcccaagagtccattcttcaccttcagctgaaacatattgtgaaagtgtcagttgctcagtcatgtccgactctttgtgaccctaccaggctcctctgtccatgggattctccaggcaagaatactggagtgggttgccttttccttctccaggggatcttcccaacccagggatcaaaccagggtctcctgtattgctaaggcaccagggaagccatctttagctgaaactcttccccaaatccacctcagcccttctcccaaaggggagcctacgacagcattgcatcactggtttctatttattccaggtgacttggtttctgtgcaagacgtcattagcatcaggaggagctcttttcaccggggcccctccagagagatgtctccttgatagccaaggcatctacactcaccagactcaagtccaa

SEQ ID NO: 44621 - DNA, 3053 bp, Bovine  19866881095103
agagagagagtgggggagggagagaggtaggaaataaggaagaaaggaaggaaaaagggaaggaaggaaggaaagaagaaagaaatgaaggaatgaataagggaagaaagaaaggaccttcccctatgacattttgctctcataggggattttgtcaataaaaagcatataattctttaatcatttaatattaatattgcaaatcttaataaaatatctttatcctgtagagattgtatcatttgctttgaagttagtgacagttaataagatggaaagagtaataaagagaaaaatgtgaagagagtcaaggtatacagacattattttaatttacaagctacaatggtgctttcactcactgggtgagctgaatatcaaaagcactctcttatttccctgttgggttggtggtatatagaaaatgaaaacctcacttatatttgcaaactcattaatcatggtatagtgttaacatgttacaatctagggattaggcctagttatcattgttcggcataaaataaattcaagaaatatatctttagaataaaaagtgtacattatgaatatattttgaccttttgcctgtgttccataggacttcagggaggaaagttatagaggtgtcttgattaaaatggatttttagtgaggtcagagctttgaaaggcatgaagaattttacatcaagcaagtctaggcagaaaaaatatcttaatatatttttacattcttttcctccctccttctctataaaagcttgttttacaaactactaggagaaaatattgatttttgtcatcataaaccttcagtgctgaatttttatgcattttattggcaattagaaagcactaaaagctgagaatgcaccataatgggataatcaaggagttgacagtaatcacagggggcagaaaataaattaaaagcttgcattgtgcaacccattataacatggtctgcacaatattaaattattcagctaaaaatgtttaacactcagtgaattagctttcagtaaaatgtgaaaattgacagttttttttcctctactccttcccaaacaccactaaaacaagagtattggttttatctttaaggcaaaatccaggggacaaatgggaagggagacgatgtaataaaaaaaaccacaacaataatggaaagttcgtgataataagaaaacaaaatcctatcctaacgaggaaagagaagggagccacacagaaatctgatttatttcacagagttctacctcctcccaagtcccattcttttgggtacttggccctcgatgatgctggaatcttctctgctgacagtcaaacagagtcttggaaacaatgagcatcccataaggaacacaagcttgggtatctgcatgccaagtggagtcataaaaaaggtgcacttaattcctccagcaatatgtaacatcacttctgaaatgctgtctactagggaagctcattagaaaatcattgctcaggtgtttttaaggggttggggggagttggtcacataggcatcctctgcttggcacataccaaaatcccagactcccagaaggaaagcaaattgtcaacaaactgtattgtatacataaataattttgacagtgaactattcttatcagggaatggtgagaaccctcctgaaatccaagtttcaacatactagcccagggtcaagcttgtaaactactgacctttcaaaggtcggcactctcaggactatgatgttaatttttttcttcatccaagatacgttcaaattcagggaagaaaaataattttcatttccactaaacatgtgacctgaggaatgtgagtctggaacgttaggcagtcaatgttgccttcactgaaaagtgtatttccttggaattgacacaacagaagaaaaaaattgagagatggcaaagagaaaccatattcttctgagcccctagatacagccataccttcagcttgaagcttctctggatatttattttgtgagccaataaattcccttgttttgtctagattgaatgagtttttttcactggcaaaagagacataatttgtttatcccatatagtcaggacctactattgttaatcgtgtgtgtgtgtgtctgtgctcagttgtgtccaactctgtgacctcatggactttagcccactaggctcctatgtccatggaatttttcagacaagaatactggagtgggttgacatttcctactccagggaatcttcctgaccctgggatcgaatctgcatctcctgccctggcaggtagattctttaccactgtgccacctttttaatcatgggatactgttttcttagaaaacagcagaagacattgaagacagatttgaaggaaaggaggcaggaataagatgagtggtagagatgagagtgagaataaagtttaagtttgagttgaatagccaatctgacaaaccaggatggtttaaaggggaagcctaaaattctccatggaaatcttactcttctgcaccaaaagatgccacccattaaataaaatgcatcatcaaatgcattgatatatctgaaaccaaaacaatacctgtacagtatcattagtatgaaaaaagtaaattttaattggattgtgactaatacaaagcagtaggctttggcaaagaagcttgttctagggaaataatttctaaaaaaaaaaaaaccaataaattagatttcctgcttcaggataactcttattcaaagtctcatattcagtctgagatggtggatatttataaccctaatacaaataatctattcattagacattggttctgaatttttttttctgtcttgccatgcaagacaggaaaaaaagaagagttaggggcctggttttaaacaaaacttcttttaaggaaaaaaatcaaatggttaagccatcccttgcttttgaaagaagctaatgttcagaaatgcagtcttggaaagattaagaaaactactgtgtcctaaagttgagaaacatttagactccttttaaagggtagaatagaatttgatatcagaa

SEQ ID NO: 44622 - DNA, 2196 bp, Bovine  19866881372021
agcccaagggaagagtctaaggagaaacctttgtgagccatgcacagaaagtcatcgcataagagagactttggcagctgttgtgacatattgtgtatcattgtgggtctttaaaaacatgcttgctgtgataacaagcagtctgttggaacagctgccaagaaatgttaaggttaatctcctttattaatgaagatgaatgtgtctctgtgtgcctgtctttctgtctctatggcatcagaggcaaggaagtttgtagttgtgtgcccacctgaacggagactggtcttcctttcacaccctggtggctgtgcgtgttaaggatttattcgtcacattacttatgtgcagcatttaggcgggagggttagggttttctgccccattgaagagagaagttgcaaaaggatggtagcaatccccttcttcattcatattcttcgtgctccgggggaaaatagtacaaagcttcagaatcttccatagacattgatcactcatcaccgttatctaaaggatgttgagaaaggccgacgggatggaggacattaagctctgtcctgggaaacacattttatgtttctctccttggctgaactggtgtatgtttgggggcatattccttaacctcatagttttcacttcctctgtaagaaactgaatttctaccaagtttagcagttttcaccagttagcaaatgctgtcacacagagcagagttctatcaattagaggctaagaatccacagaatggggagcagcccacagacctactggtgcctaaagattgataatgttaactcctattatctcatcatcacttcatcagagaattgtgcactgatcacataccctgggactccacctccctcacatggcttttaaaaatgctttcctgggacttcccttgtgttccagtggttaggactctgcactttcaatgcaggggtgatgggtttagtccctgatcagggaactaagatgctgcatgcttgcatgaaatgtggaagtgttagttgctcaggcatgtctgactctttgcatccccatggactgtatgtagctcatcaaactcctttgtccatggaattctccaggcaagaatactagagtgggtagctattctcttctccagggatcttactgacccagggatcaaatctgggtttccctcgtttacagttaaaaaaaaaaaaaaaaaatctttcctgaaacccactggggaattcagctattttgacaactagctgactgaactccttatttggtgcctgcaataaatacctacttcccttccattcaccacaacgcatcaggaaattggctttagtgtgtgcaggcaagtggatccaaattttattcagtaacttcaacgttgcttcatattgcaatctaatttttttgtaaaattgatggcttaaaaacaactaaaatcttagacccttagcagcttcagttttcattgacttgctatgaaaaacttatactttataattccaaattagggttcattgatttccattacagaagaactgtttcctttgaaacagactcagccttagatccttaaataatagcaatacacagttcttatgcactcagctcttagagtttgaagcatttagtgtttcatctaaatgaaggaaaagggggcaaagaaatgtgcatttaaagcatgaaaagctgataagaaatataggagaccagcagtatttttattagaaaaagtaagagtttctttaatgaacacacgtttatcacatgagtcttacaaaccatgcacagtgcattttgtattaagagttttttccttttattttttagtttatttctttcatttaaaaggtttgctgctgaggtagttgggtagttttttgttgtactttgaaagagaattagatcattagtggaaactagtgcctaaaatctgagactagtgaagacatctgatactgataaatatgctgaaggaaaaaaaaaaaagagtcatgtcttgcaaatgacagttttctaagagaagtcaggtgagtggtcagttacaacttctctggcaggtgacctttaaatcaaaactaaaaataaagaagacagtcatgccataacctgagagagaattttgcagagtggaaacagccaaggcaaataagctgctcatgtatactcccattacaagaggaccatagaaaatcaacacgg

SEQ ID NO: 44623 - DNA, 1959 bp, Bovine  19866881488023
gaaccgtttgaaaagtgaagtttggaatccgatcccaaataatcaatcgagcctggaattattttggccttttctgattgtttcaagataagcacctggctccatttatccaatcaaaatggggaatgggattctcattctaacaggaaagaataagtctgatccatattggatggattccttcagctgtaacccttgtgttctgtggcctgtgctgagtcatgctggttctgcacattttgtaagagaatgttgcctgaaacctgaaatatacaagaaagcccattctcaaggctctgactcccaggcttgactgtcaaagttatagcatttcccattcatacagagagaaaaagttgcagaacagagaataacaactgtcttgttgaaaatgtgggggaacattatgaccagataggcagatagctgcaaaaacaaaggattatttattacatcttctctgagtctggctggcaccaagaagtttgcaagaaccaggcacactccttccccttttaatataagagaagcctgaattctaactcagggaagatggttctttgggacgttagtacgatgtcttctctgtgtctcctggttccaaattaagtaccattattcctttccccaacacctcatctcttgatatactggcctgtcacgcagtgagcagtaccagcttggacttggtaacaccatcatttgccatccaagccttcctgcccaaggaatagaccttgaacagacactgcatcctccctacatgccccgccagagatcccactgtttttctatgatagaatgctgaagatagaccttgctgcccaaggccatagagtcagagagtggcagggctggaattcactctcagagattctgattggctccaaagtgctgtcgattgtttcaaataccagcagaaccaaatatgtcagcctctgatccaatttgccagcaaacacagggaaacagccttaacaagtactggcaccaattcagtcactgcctaatttaaaatagaatcttcatttagaaagtcagtttcatttagaggcaagagcacttctcttggtttgctgtgagtccataccactggagctgcatgcacaaacagctaccacccattccctgacctagttacatcgtcacacctcccaccttctgcaaagaccatgccttcagttgcacatgtcagacttgtctaaacaccttcccatctatggatcccacaacaacaaccctgggaggcaggtaggaaaagtgctattgtaatttactaggcgacaacactgaggatcagagaggttgcttggtttactcagagtcacacagcgggttcagtgcaattttgccaagacaagagcatccttatatgcacccctctgcaaccatctgggactctttatcccatcactttcttctatcacttgtttatctttggcaagtcctctcccaccatacccactgtgagcaggacttcgtgttagcatctaaaacatggaattcagagccctgaggtcaaatctgtcctcctgtttcctgtgacccaggaaatgagtttatgtagcacctcactcttcgaagacaggcttatccagggctggtcttgttgatcacaacagagatcaattgtgctctgcggtctcaaccaggggtaaactgataggagctgaaaacatcatagattttaataagaacagaagatgttttattcagggttgaaatacgtgctcactaaatattttcacttctacccctgtgaattagtcctagcatcattactatagtcctaggcaggtgacactctatgaacacaccttgataccactatttgttctactgaacatgtcgaagggtgaagggacttttagctctccataaggctgcttcccacatgttccttttgcctagagtaaacctgagttcatgaccacaacccacaaagttctctctcatcta

SEQ ID NO: 44624 - DNA, 1028 bp, Bovine  19866881562249
aaatgaatttctcctggggtaagacaatatgacatacttggcagaacaatcttagcatagcaattattagtaaaactcattatcaaataaaacatattgagacgtttgttgttttttagtcactcagttgtgtccaactcttttgcgacaccatggattgtagccagccaggctcctctgtccatgggatttcccaggcaagaatactggagcggcttgtcatttccttctcgtttttgaagggacagataactttatagagggcatggggttgtgatcattttcaatctaatagaacgttaaggagtcttcccaaatttaattgaacaaagtagattatcacaattggattggacagaatgattgaaagataatcttccttttaaccaggagaatcatcatcacgttacatcattgcattaaaggtgagaaatctccatgagtaatatgaaaggaagattctccaatcaaatggaaagtttggcaaaagaacctatcaactggctccccttaaaatgagctcatcatgttttctgaaggagaattgatgcagaaagtagacaggataaaaggccagactttggactaacttgcaaaaaaatctgcaggcaggaagtaacatctgggccaataaattacccagacaaaataagtggcttggttgatgtggagagatttaaatggaagtaaacaaacataaataaaccaggagggcactcaaagagtttggagtagggcaaggaaattaaagtcaaatggagtaagaaaaatatgcaagaggcaatgagtgttcagatctctcggagcatcccttccctgatagctcagttggtaaagaatcagcctgcaatgcaggagaccccagttcgattcgtgggtcaggaagatcccctggagaagggataggatatctactccagtattcttgggcttcccttgtggctcagctggtaaagaatctgcccacaatgtgggggacctgggttcaatctctgggttgggaagatccccggagaaggaaaaggcta

SEQ ID NO: 44625 - DNA, 1970 bp, Bovine  19866880352657
aaaatgtgaaaatggtggcttggcttccagggtacatatcataatcacaaaacttcactcatttgtataacattacagagtgttcacaaatccatttggcttactgaccaattggctcatctgctaattaacaaacatgtaccagatacaaggataaggtagagctccatgctccccaactctcagttttttggagagggaccaaggcagaaaatttcagataatgatttgttagctaaggaagctaacataatgacatggagagcagaggaaggaaagagaagccagtctcttttataattgcttacagttttattgcttacagtcttatttaattcttacaacagctttatagaataggaaatgcagataagtctaaattttacagatgaggacagcgggtttaaacagatacctgaatggtgtacaatcacacaattatggctggaagctaggacatgaaataaactgccttttccagtggattcacttcttctggttattattcctgtgtatagttccttcttttgaaggtcaaagaaaagctaattcttttttctcttgtggccattgtacttccttctgctcactacacctaatctcatttcatttcaatgcagctgcacgttcagtggagctttagatcgaatgtaattctcatagcacattgacgtggcagcgcagtcagtgctcactgagtaatactgtaaagtcaaagtaacagagctcttatatattcgttcacctagatgaaatgcctgttcggaatacaaacttgcctttccaacccaggactgcagcaaatttgttgttgcctgactgtgtcctggttttgcttcactgcatttgattagtacacaacagaaacatacctaaggacacaggtaactgcaagaatattacagaggagatgtgcagaacggattacgtttgatagaggaataaaaaatccagggcagttagcttcttctaaagaggcctagtccctctattataggagtaaatataatcacctagttgtcaaagtaagagctgtaatcacaaatacaagagactttcactttccattaataagtcatgaaaatttaagtattttaaaatttgcttttttattcaagttatacatgtttttgctgttcagttgctaagttgtgtctgactctctgtgaccccatggactgtagcatgccatgcttccctgtccttcactatctcccagagtctgcataaattcatgtctactcagttctgatactatccaaccatctcatcctctgttgcccttctcctcctactctcaatctttcccagcatcagcgtcttttccagtgaattggctcttcacataggtggtcaaagtactggagcttcagctttagcatcagtccttatgaatattcagaattcgtttcctttaggattgactggtatgatctccttggtgtctaacggactctcaagagtctttttctccagcaccacaattcaaaagcatcaattttttgggcagttttctttatggtccaattctcacatccatatatgtctactggcaaagtcacagctttgactctatggatctttgtcggcaaagtgatgtctctgctttttaatacactgtctaggtttgtcattgcttttcttccaaggagcaagcatcttttaattttgtggctacagtcaccatctgcagtgattttacagctcaagaagataaaatctgccctgtttccactttttccccatctatttacatgaaatgatgggaccgaatgccatgatcttagtttttttaatgttgagtctcaagccagttttttcactctcctctttcaccctcatcaagtgactctttttagttcctcttcaatttctgtcgagtggaatcatctgcatatctgaggttgtcgataattctcctggcaatcttgatctcagcttgtgagtcttccagcctggcatttgcacgg

SEQ ID NO: 44626 - DNA, 946 bp, Bovine  19866880376176
cctactaattctgaccctttctttaactttagatccatcaggcttgatacttaactgctaatatttaattctgctttaactgtatgcctaaatgtaaaaagaaaaaaaaaaagaggggaaaagagcttgggaatcaataaataagaagtatagatgaatgtgccacaaactgcaactataaggaacatacaatcaagaatgaccatcatgacaggcattcaatcaggaactacatataaaatggcatgtaataaatgccacaagtcctcctataaacaaagaattcaaaagacagggatcaattttcaaaggtggaaaatagtgagaaattacagagtattacagagggagaaattcaagtttttgtcttggaagtctgtccaaataggtaataaattgctggaaaaccaagactctaaacagctatttaagaaaaatctcccacaacattgggttttagtaggtatacagctttttgatgaattagtctccccactgctctttttcttatagcttagacacggattgagaagtgtggaaagaaaaagaagtgaaacactaaaccactgaatttcatagctgagcagtagattaaaaaagaagtatgactgaattctctaaagtacagaaggcataatcacaaatttctgaatcttataccatcatccatgatttattaccttctagtcaatcattacacacacaaactaaagtagatcccgttccagagaaatgaacttcactatgatgttcttagttaccttgtgaaaagttgggtgacacagcttgattgacagcaaatacactatttgaccttgggggtgtctgtaattgagatagtggaggttgagcagtcataggtgcagaatttccaggcaacaccacaacatttgactgactgacagttgttcctaaggctgtggatcagtacacaagagctatcaaa

SEQ ID NO: 44627 - DNA, 3226 bp, Bovine  19866880400813
tggaaaactcagcagtggccacaggactggaaaaggtgagttttcattccaatcccaaagaaaggcaatgccaaacaataaactactgcacaacctgcattcatctcacacctctagtagagtaatgctcaaaattctccaagccaggccttcaacaatacatgaaccatgaacttccagatgttcaagcctggatttagaaaaggcagaggaaccagagatcaaattgccaacatctgttggaacatccaaaaagcaagagagttctagaaaaacacctacttctgttttactaactacgccaaagcctttgactgtgtggatcacaacaaactatggaaaattcttaaagagatgggaataccagaccgttttacctgcctcctgagaaatctgtatgcaggtcaagaagcaacagttagaactggacttggaacaatagactggttccaaatcggacaaaggctgtatattgtcaccctgcttatttaacttctatgcagagtacatcgtgaaaaatgctgggctggaagaagcacaagctggaatcaagattgccagaagaaatatcaataacctcagatatgcagatgacaccacacttatggcagaaagtgaagaactaaagagcctcttgatcaaagtgaaagaggaaagtgaaaaagttggcttaaagctcaacattcagaaaactaagatcatggcatctggtcccattacttcatggcaaataaatggggaaacagtggaaacagtggcagacttcattttttggggctccaaaatcactgcagatggtgacttcagccatgaaataaaaagatgcttgcttcttggaagaaaagttatgaccaacctagacagcatattaaaaagcagagatattactttgccaacaaaggtctgtctagtcaaagctatggtttttccactagccatatgtgggatgtgagagttggactataaagaaagctgagcactgaagaactgatgcttttgactgtggtgttgggagaagactcttgagagtcccttggacagcaaggagatccaaccagtccatcctatacgaaatcagtcctgaatattcattggaaggactgatgctgaagctgaaactccaatattttggctacctgatacaagaactaactcattggaaaaggcccctgatgcagggaatgattgaaggcaggaggagacaggcatgacagaggatgagctggttggatggcatcactgatttgatggacagaagtttcagcaagctctgggagttggtgatagacagggaagcctgctgctactgctaagtcacttcagtcatgtccaactctgtgccacagatggcagcccaccaggctcccccgtccctgggattctccaggcaagaacactggagtgggttgccatttccttctccaatgcatgaaagtgaaagtgaagtcgctcagttgtatctgactcttagcgaccccatggactgccgcctaccaggctcctccatccatgggattttccaggcaagaatattagagtaggctgccatttccttctccaacagggaagcctggcatgctgcaagcttgcaaagagttacacacgattgatcgactgaactgaactgatctctgccttacagaagagacatgagctggttaaatatgatacgttatcgaaccatgttagtgacacatgactatactggataggaagagacaatgcatatatgtggcttacaaaagcgtgaaatagaataacaccttcatatataacagtgtcagctgtggtggaaactcagggctcccaaaacaggtcatttaccaggtttacaaattctcacttattctgaagaggaatatatattcctgtcactattcatggtatatatcatgcattaaatcaactccttcctttccccattctaagaaaaggcacaaaggtatgtaagatgcagtgcaaaatcctgccacctggcacgcagctgaaagggaaaggacagcaaaatcctagaggagctggaatggactggaaacaacaggcaccttaaaatcttctatatcagctaacagtagagaaattaggctttaaaggaagttgcaaagaaaaagctggatcttattcattcattaaagcaacatcaggcctcaagggttagttaaataaaagcaatctctcagacataacacactgtaattcatacctggttactcatgatttatatttagctccaggttgtcagtctttgacattctacccacccgcatatttgcatattcagaaggtgtacaaaccccaaaaaatattaaaatgaaatcctactatacattatagtagaatgacaggtaatttattcataactgagttaggccgtactcaaaattcacttaaaataagcaaatgattacacaaatgtctaataatactaaaattgatagtcagaaggtataaaataccatggggatgaaatgccatggtaaatactattcaacagactataatcataactctgaactaaatcatggtttttaaaatgactttaagcagtttcgaaatgatttgattttgttcccctgccaagcaatttacttcttccattgataaaagacagggccattagtttcataagtcaggttcttctcttgcaacacattttcttgcaaaaaatttttttaatattactttttgacatagacaacaaaccagccagcactcagtgccccaagcaaagatgcttggatcacaacagggcctgggtttaactctgagttcagcaagaggcaggcagtgaaaaagcttttgcagcatttgcagtatgcatacttcttttctgaggctgaagcatcataaatatatttaggcatccaagccagaaaaattatgagaataaaataatatgatgtccagatgacaatgccacaattacaactgggggtaaattataatataattctgtagtacttcagacaaaaacaacacctacctaaatttgcttcttgtaagccttgttacattttcatgaagtgcaggggtgtttgtaataatgatttatcttatcatgtgtctgtttgtatcattttaaagtcttatactttattggaatgaggtccaagcatgaacctggtctgaagagctagcagctgtagtcacaaaacatatcaataaattaaaaggctttcacagaacaaaattcagctaaatcttttacatataaaatacagctaga

SEQ ID NO: 44628 - DNA, 1038 bp, Bovine  19866880525847
accaggctcctctgtccatgggattctccaggcaagaatgctggaatgggctgccatttctttctccaagacatctttcccaacccagggatcaaacctaccttttctgtgtctcctgcattgcaggtggattattttccattgagctgtctgggaagccagtacctcttgtgcacatctctaattactccttaaggtaaatccctaggaatgacatttctggaacaaaggttatgcagtattttaatgctttggaaacatattgtcaaattgccctccagaaataatgtactaatttacactcacagcagcagtgggtgagagtgtctgtttcctgtacccttgctaccactggaaattgttattttaaaacatctttgccagttcccacttaatatataacgatgacgattaattcactgacaaaggtctccttggaacaaattcactgacttctagcacacattgcccttggtaatcaaatattaaatgtagttgattcttggttttgtgtgctagactagcaattgacaaactttttcttttgccagatggtaaatattttatacttgtggaccatatgatctctgtcacatccactcaattctgccattgtagtgcaaaggcagccacagataacacagaaatcaatgagcatggctgtgttccaacaaaaccttatttataaaacaagaggagggtagaatttgacatagaggctggagtttgtgggcccctgctctagacatactgaaaactcattacgggttagcagctactgtcctagaaaccatacgagaggctccagtgagcagagatgataacagcataccgcagtgagatgataaaaagatgcctaggtgccgagtcagagaacaggacaaagcagattcttgaatgccaggtcggtgttagtcaaatgaaagcagaaagatttggaaagtggggagtggaataaagagtaccaaagggagagaaaataatatgtgcaacagcccggaagaatgagaacaaattcaagaagctacatgtagtttc

SEQ ID NO: 44629 - DNA, 1025 bp, Bovine  19866880542546
acgtagggctcgtttttcttcttcttttaatttagcatctgcctgtccagaagcaaaatagcaatcattttaagaacatcaagaaaacagctcaaatgatcacatatactaggttctgacttacatatttcatataattctgtacaccattttgttgtaaatacgagggtgcctgtgttctataaaatctctctgttgaatccaagtatgccttctcaaaattgtccctataaatttggagcttatcctctggattagaacaaaggttaactgaaaaacagaaaataaaattttactctaattatgattgaaatcagtattttgagtacaataaatgaaaaacaaatattgaggagtcatgttcaagggactgtgaccatgcccataagaacacacagtcatataagacaaaatccttctctataaaaaacttgaaaaggtaaaaacacaaaggagtaaagtgacatatagtacagaaaatgtgaactgtttttgaataggaacaagactgatgaataactggatgatcaagaaaccattcacagaaaagatgggatctgaattcagtcttttggaacaaattagtatttacactggttagtaaatcctcagaagtagaacaatacaagatcaaaccaacataaaacaatgaggttatctgaatggattgtaaggttaatagaagataaggcagaatggcaagctgggaatgcttatggagaacctcaactctctggctaagtaacctaagatttagcatggcataccactaaatgggtaataccaatacaacagtacttaaaaattaatcttgtgaaagtatatgggttcaatgatagcaatagtatcactataagaagactgtttcaaaagtctagaagtagaaattaaagaagtctaagctggtggcaattgaaataaaaaggaagaaatttcagggacatggctaaagaaaatatagactttatatctaaagaaatacaaggacaacacagaaagcaagtcaaagataaccaaaggttcat

SEQ ID NO: 44630 - DNA, 1372 bp, Bovine  19866880556443
attctgcagctgttttatgatcctcttgcggaatttctctcgcacacgattaaattccattatgtccatagggtcctcttcaatccaaaacttatgaaactcgtgcatcagataacctgttagagataagataagtgacaagaatgcaagaggaaaaaaaaaatccttaatcttattcaaaatcaccctgaatgctgaaagagatgtcaaaccaagtatcagcaactatagagtgcaaatgcaataaacactagtgttaaaaattattctttaaaactagtgcaagtagaagctaccaatctacaagatttttgcacctggtcccagaattattctcactcttcgagagctgctgctaagtcgcttcagtcgtgttggactctgtgtgaccccataagacggcagcccaccaggttcctctgtccctgggattcccaggcaagaatactggaaaaaatcaattctgccatttctagaatatgaataacatctggaacatattctgaaaggtagacagtaactacttcattcttcccctcctagttaaattaacataatggtctgatttttcaaaagtactccacttagccttttttctcttgaaatttgatttgaatcaagttttaaattaccctgacaagtcaagcaattgcattttgactattatgagacaatgaaaactataaatcaactctgaacaatacagactggtcattaaactacatgaaattgttaataagacacttttgctttgaaccataatttcatattcaaatctttttgtctcaaaaacgttgtctagattggggacattttggaataaatgctaagtatttgacatgagaacttacttactgtattctgcttcccaactgtgacctccttctaccacatttaaaactgaaaggtgaatcagttcagttcagttactcagtagtatccaactctttgcgaccccatgaattgcagtacgccagacttccctgtccatcaccaactcctggagcttgctcaaactcatgtccattgagtcagtgatgccatccaaccagctcatcctctgtcatccccttttcctcctgccttcaatctttcccagcatcaggggcttttccaatgagtcagttcttcacatcaggtggccaaagtattggagttttagcttcagcatcagtccttccattgaatattcaggactgatttcctttagaactgactgggttgatctccttgcagcccaagggactctcaagagtcttctccaacaccacagctgagaagcatcaattcttcggcgctcagctttcttcacagtccaactctcacatctatacatgactagtggaaaaaccagagctttgactagacagac

SEQ ID NO: 44631 - DNA, 1889 bp, Bovine  19866880834522
aatttgaagttagaaaaaattacgtaccacttctttaagctttgcttcaatctcttccgaggttagctttttgcttaatggcgtttttcttagcaacatgtcacagtaattggcaagcagctcagggcattttgattcaggctgagtttttaatcctaccctaaaaaacacattaaaagcaggtgattaaaaatgattgaatctgcaaatattttttctaaagccaatttttcacagatttgttatgttctataaatccagtgggactagggtgaggaagtctacactgaggttgcatagctcaagaaggcactcactcttgggctcctgtaagtacacttacagaacactgacagagatctccttgaattttgtgagctacatgcttcctagcctcattctagaggcagctttgccaataatctttaaaagattttattcagatgctgctaaaatagtattgaaaactgtgtaaatccttgtatactcacagcaaaagtcgctcactcgtgtctgactttttgtgaccccatggactatacagtccatggaattctcaggccagaatactggagtgggtagcctttcccttctccaggggatcttcccaacccaggatcaaacccaggtctcccacattgcaggcagattctttaccagctgagccacaagggaagcccaagaagactggagtgggtagcctatcccttctccagcggatcttcctgacccaggaatagaccccggggtctcctgcattttaggtggattcttttaccaactgagctatcagggaagccttgtatacttataagttaacaattaaaacttttttgttttaaagcactcagtgttcagtttattagcaagatgtcacacaatatcctcttctgcttttcactgacctgactcagaacatcaattaaaaataggttaaaataaaactgttactttactctttgaaacatatcaaatgtaacctaaatttcacagtaatatatctatcattatccattaaaaaaaaaaaaactataaacaaactttccttaaacaatgaacttatatcactatttcactttcccaacaaaactttaaaaccagtgtattgtattttatgcttcaaagtcttttattctttaccctacttctctaagctatatatgtaaataaaattcaagatttaaagattgtatatatataaaatttaactgttatcagaaattataagtacacaacataacaaaacaatgtaattatattgtgtatgtgtataaaacatgcatgtgcaaaatttttttgtctaatgaagtagatgtaacgttttttccccttccaattataaactcaggaatgatcaattttacttctacttaaaaaaaaattatttatggctgtgctgggtctttgctgctgcacacagcctttctctgattgcaaggagtgggggctactacttagctgcagcatgagggcatctcattgtggtggcttctcttgttgcagagcatgggctctaacgcatgtgggctcagtagttgttttgcattggcttagttgccccatggcatgtggaaatcttcctggaccagggatcgaacctgtgctctctgcattggcaggcagattcttaaccaatggaccaccctggaagtcttgctgctgctgctgctgttaagtcagttcagtcatgtccgactctgtgcaatcccgtggacggcagcccatcaggctctgccggccctgggattctccaggcaagaacactggagtgggctgccatttccttctccaatgagtgaaagtgaagttgctcagtagtgtccaactctttgcaaccccatggactgcagcccaccaggctcctctgtccatgggatttgccaggcaag

SEQ ID NO: 44632 - DNA, 1612 bp, Bovine  19866880874043
tattggcagggttgatttcttctgaggcctgtccttggcttgcatatgaccatcttctccctgtgtcttcatatggtcttccttttgcatatgtttgtgtcctaatctcttcttctcataaggataacagtcatattggattaggacccatcttaattacctcattttaatttaacccattttcatttaacccatctgattacctcttgaaagaccctatctctacaaatataaccacattcctcaattaaaaaaatatatatatagttgcatcccaagatactggggattagagtttcaacatgtgaatttagagtgggggatacaattcagcctatcacacatttcccttccataatgcttctatttcttttgaggaaagaatgctcattaatttcttatgttttctttgttactttctaataggaggtaaggacaagcaggaggtctttggtgtgccctcagaagtttgccttcagttctcaccaagccactctgagaatggaacgatccacccgggagctgtgtctcaacttcaccgttgtcctgattacagtcatccttatatggctccttgtgaggtcctatcagtactgagatgccacagctcctggaattgactgcaatgctccagggctgtcttctgtatgccctgacatcccactgctgtcatgggatgccttttctggcaccccatggcacttctgaccagttcgcacaatatctggggtgcctccagagctgctctcaatggcttcaaaatgtttgccagtaagcattagattttttccccatttcttactgcaaatgtgttagacaagccgcaaggttaaaagtaaactggattcatgatgacatagaatgttaacaagctcctgatctgtctcaccacacatccctccaacccacactcagcaaccaaactctaaatcaacctgccagaagaaagaaatgttaaaggaagtctttgtcagcccctataactatcatgtgaataaagttaagtcaaccaaaaataagacttttagaatttattttagcttctatttgtgatactgcatttaatccttgactgagactgaagtgacaaatgttataatatttctagcatttgagataagccaagatcttccaactgctgaggatttgaaaccaagtcaattaagagtgtcatatttcaaacaattccattggttgagtgttcctcaaacttgccttctgaattagtcccaagggcaaagggaaaataaatccattttcactaggaggtctggaatacagcctgaactgttcactaaaagcacaaaatttctttgaagccttgttttatcattaaaattgacaaaggtatattttattctgtaatatctccatttgctttaatatatatatttacattatttccccttgagtaaaactgaaacatgagtcatgtccctatgaggtgcatattccagtttggttatactcattatgcaaatagagctagtcactaataaactacagttgtaacagagaaacattacaacattcatgtttgtaaatacatgaaatagacatttcttaagcctgttgctagaaaaccccacactagatagatcacatttgttct

SEQ ID NO: 44633 - DNA, 1697 bp, Bovine  19866880904329
cctgtgcagtgtaacatgtattttgtataagagaaatgtgataataataaatagatagatgccactcttaccaaataatttcatttttattcaattctcaggttaagtctcaaatcacaacattatcatgggaattaagtgagctacacaaagcatgtaacccagtcaggcacaaacatgttgcctaaaattttgaaaaaattaattaaccattctttttagtagctcaattttaaagttcctaagtaagggaatttaagaaagtaacacattattaataaaatatgactgaaaagtgaaggaagacagtgacatttctgtatttccctcaagtatgttcagtaagttataaaaagaagaataaagcaaatatccaacttaaaaagaaaatttaaaagcacttagttccctaaaatcataaatttcaaaaatttgactagtttacttagaagtagacaatactgttcttaagagtgctcagaactctcttcaaagaataaataagcagcattattgtcaaaagatgctacatccccatagcttaggaactgccaaaattacttgtaagaagttaaatatttagtaattattctccaaaagaacaaaatataagccttaccatatttcccatcatctctgccttgataattttggctcctaacttgttcttctcatcaacactcaagacgtggatagactcatcctctggactacttctgtttgaacaggacagacaaagagtatatgaaatataagtacatattaacaacaagtaagctgttgtaaataacaacaccaagattcaaatgttatttcaaatgaccttcacaaagcaatcaacacaaacagaaataataaatataaaagcctcaatgcttccctaaaaatcactacttaaagatactgtgttacaatgctatcatggccaatggcagtgaccaaagacctatacctgaccaaagacccagtagcagtgagaaaaataataaaagtaatattcatcataacttaatattcctgtgaagtgaagtaaaagtcactcagttgtgtccaaatctttgggatcccatggactatacagaccgtggaattctccaggccagaacactggaatggatagcctttcccttctccaggggatcttcccaacccagggatgaacccagatctctcacactgcaggcagattctttaccaactgagctattagggaagcccctaatattcccatacttattctaaaaaaagaaacaaaaattaacactataatcaggtcataattctacacatctagagaaattcttcttattcaatggataacttactgataatctaagaaactataatcagaaaattacatttacctacatttgaagaataaaaatagtgaccacgtgctcttttgcaatgacaacccacaattagacaacataaacctaatttacagctaagatgatgtatcgaacctatagtgtgcaagcctcaaagaagaaaagataaatttcctgcccaggtcagattcctggcatatacaaagttctcctaacaaactttgccttactgccacaagaaagattcgagactacaatacaagggagggtgaacctacgcagagcatgaagggactcctcaatgaaagagaaatagctaagagtccaaggcagctaaagagggggagagctgcacagtgaaagaat

SEQ ID NO: 44634 - DNA, 1251 bp, Bovine  19866880939215
tgctttgtacttcagcacaaattggtgtttctggcaaggctgcagaattccataatgttcatctgaagttgcatctctgatatgaaattgctatagtgtttaaaacagcagttttaatcaaaagttcagaatttactgatattactgaattccattttatttttcatttaggatacttacaacaggagaaccttacttctacctgccaggcttttattttggaaagttcagacttaaaagaatatgcagaacactgtacagatgaaggttttatcccagcctgcctactggtgagtgatttgttccttaaggaagtatttcatcattgaccaacataagacactataaacaccgtcttaacaaacattgaccataggatttttgcagaaactaattcctttggccagcgatttgttatgtaagtcaatattgaaacgctcctgtcaatagtattcaggtaacaaaatacatgttaatatgagtctgactgatattgtgttaaaaatcaactcattagcaaaaaccaaatgggcagaaatttgatagtttgtattcatgcgtaagtggaaagacccaaagaagactagcttcttttcccacatttatgtcaaagctgggaagtgaattacaactttgatttttgagaatcagttttaaagtgacaccctcatttctaattagtttcacaactgcttgtcctggggctcacttgtttattgcctgttaggggctaaatatttgtatccctgcataattcacatattaaaatcccatccctcagtgtgatggtacttagaggtaagacctttagaaagtattaagttttggattaggtcatgcagttgagaccctcatgatgtggtttgaaaagtgaaagagaaatctctgtttgcacacaccaaagaaaggccatgtgaacacatatcaagaaggggaataaggccaggaatttggtcctcaccaggaagcagatcatctggcaacttgatcttggattttccagccttcagaaagaacaatgagaaaaaaatgtctgttatttaagccacctgatctatgacgttatatagcagtccagtctttcctatatctggctttcctgtagttgcttacttcagaaaagtataaaacagatattttgatatctagtcacctgttttttaaacatcactagaccaatagagcattgtttgttggtattggtggatatatgctagaactacattatttgaaatggtattttgtcgtttt

SEQ ID NO: 44635 - DNA, 1333 bp, Bovine  19866880975974
cagtcccagtgaatgctggcaatatccttatattcccccaatcaatctgtgatgaaaacaagaggtcacagagacatctttatataaattttcactgttttataaacaagtaagttgcttcaagctttaagtacttcactttaagtgcttcagcttttaaggtgatgaattatgttgacttttggttttcataaaatattaaaaaaaaaaaactatctttaattaaatgacaaagaataaaactcaaaggagtccataaacacatgtttgacacccctagaagcactgtttagtggtagtcagctacaggagggaaacatgatattatgaataggaagttaatattttccaggaataactgaaaaagaaagtcttcactggtaatataaagtctaatgatattataagcagtaatcttaagcatcaaacgtgtaaaaaaaaatgaggcataattactgacatttcaacaatcttctaatagatatttagcaagttactgatttcaaatatgaatttaggccaaataaacaatgaatgttagtagctggaaactaatcatctatgacatatttgctgattttgtttttaaggatatgtttagaatcttacagctgtatgccactgataattgttccaaataagcccaccattcctaaaaactcctttctgctcagcttcttcacgatgtattcttcacacacattagaaacagcatagagggaagctccaagaaggaccaagatgtcaccaatcagtacattattacctatagagagataagccataaaaagggatacattgtcactagggaaaactctccagcttgcttccagaagtttatctggctcataatcatctaaataagattttacagaagaagaaaccctgatttttaaaagtttaaagactcttactcttctcattttctggcacaattctgctttcatttttcttgttttggatcttcaggagactaacaggttggaagatggtggtgtataccataatgtaaggccccagaaaatgattctatgacatgggaaattaatggaatttattaataggaattcactgataactacagggaagcaaggtgattttctcaattaaaggagacactgaagtcgcttgcagattggggaaattcatagaccttatttggattttataatatgaactatctcaaccttgacataaagaatatcaaaatgttctcatctacagagtaactgaaatagaagtcatttagtgaacacaacatctcctttttgacggaaacaaaatctacagtagggtttccggcaactaatctaaatgtatgggccaaaagaag

SEQ ID NO: 44636 - DNA, 875 bp, Bovine  19866881094647
ctacagagcgaagggtagtaaattacttaaattaatctttctttgaaatgaatgtgtgattggtaactcattattttgttctttttcattttcagagagagattgagaaatttaagcgcctgattcaggatcctgaaactgttcgacatttagatcacccattcagattccaaacaagggaaatatttgaattgggatgctgtttttaggtattcgattctaattttttttttctgtcttacttttctctttcctttttatttctgttgtgatatttttgtgtgtatagaggtcaacttatctttgctccttgtatatcgttgtgccttgcataggaaattgatgctcgatatttatctgaaacataatttttaaaggatgttcatataaaaaagttaagatttttgaattatttgttcaataaaatgtctttgacatatctcactcaagatgagaatttctttcatatcactttttttataagactttatttcaaattatagaataaaattaagttatattaagtcctttataactttgacatctttaaatattgctctaagtaactgccatatataaacataataaaaaagtaaaaaggaattttagaaaaattccatatgatttcagttaacaaacaaaactcatgctttggaaagacacaattcattacttgactggagtggcaaacagaattgatgcttttatataaaggcataattttcagttatgaaatccattcataactagaaataggtggtaagacttaggaaagataaagtattttaaagtaacgtagaatactgataaacttgaaagaacattttcagtctagtgaaatatgagtatatattcattcttgagtgtttagaata

SEQ ID NO: 44637 - DNA, 907 bp, Bovine  19866881095611
aattagtgataataaagtttcatgccaagacttgagatatatagagagaagcagaatggccagaccccatcaccatataaaccttgtgtggaagcttaatttagacagggttcccagaatataaatagttaagacactaatacctctggggaatgcctccggggataaagctactatgaaaagaagaaaagcattcatagttaaaaaaagcttcaggacttacttcccttgaaatagctgacagtgcctttccagaatttacttaaacaaaaggttacttatttataatctctttaaagcctttgagattttgaaggaggcttgagtgtcaaggctgaaagggctcttagaaataatctaatgtatcttttcttcctttaacagatgagaaaactggaaatgttgtctggagtggaagaagtatttgaagcttacatgtgaaatttcaggcttattaacatgctttgaaaaataaatgtgttgcagaaatgaacgaagaattataaaatatctttaagatttggattcagatttttaaaaagaaaaagcacaatgaaattgaagatgctatgttaccttctcttatcttattcctgttctttcctagtggaaaccattattatgaatttggtattcatcccatccatactttcacattttgcttatacatgtgtatcaaatattatcaaaatgtaagcatagtacataatattcagaaatttgctttttaaatttttgagtgaacctccttgtacatacctctgtgagtatagaaataaaccctcattattccaatgtccctgtggctattggggaatgagtaatttagcacaaatgttcttgtaattgggacatactgtaataattagcagtgatcagtccatatcaggtgtcaggacactcttgc

SEQ ID NO: 44638 - DNA, 821 bp, Bovine  19866881161981
ctgtatctcaatcatctcccttcactactagtcccatacctatacaatactaggcgtttaaagaatgttaaaaaaaagaggggtttgcttaaccccaaaatgggatgtcctattttgtttcacaataactaaaactttcgacttagatatgaaagaaaactcacacaaaagcaaaaacatttttaaaaagatacctgtctgatatacctttttccacaaaattcaagtacaggatgatcttttgtcctaaatcatctactatttctttaccattgagagtatcataggctttcttggattcttctacagttttgtatcttacacatgagtagggtttattaggtggcattaagagagcatccaccaatccacatttctctaaaaccggaagcagttggttcctactcacttgattacccaaaccaccattggcaacaatcagactctaaaaagacaaaaaaagaaagtaatatgagcagttgatatcaacctgttatttttaaataacattttaaaataaaatattgtaaatgatactgatttttaaatagccttttagtgaccataaacacaaattaaaagataactttcactgttcataaatttaacataatgaaacagaaagaagaggtagagaggagaagaaacgaggatttacataaatcttgctttttggctagacactgtgctatatatttttatactcaatcttcattaaaacaatcttcacaacaatctttgtatgtgctcagtcacatcgacttctttgtggccccacagactgtagcccaccaagctcttctgtccatgggagttttcca

SEQ ID NO: 44639 - DNA, 1494 bp, Bovine  19866881201578
ctaattactttacaatattgtagtggtttttgccatacattgaccatgaatcaggcatagacaccattccattgaagggacatgaagaagatggtttagaaaaagagaaaacttttcttctctcattttgagatctgtagaatgttaggaaaatactgttctatatattttactctagagaggattataatagtgactttttaatagtacaccaggttctctgcttttaataaaactaaaggagcaatctttttcagtaattccatgaatgtattattaaagaatataggctacattctggttgcctattcctaaaatgaaatgctgcttgatagaaaatttagcaaaagctaaatcatttcccccaagcatttagctctgatgaggtgaataggtcctgaatactctttggtagacttcccagaaataactggcatctgaaaaggcttagccttggaagagagccaattctttctccttcttctccctcaataatattgatttctgagcattgtaaagcaaaattttctaaatgtttcaggtttgggattaaagcaaaatatatttctattttcaaaacagttcaaaaattccaacaaaattgctttctctaatgatcttgaaattttttgtgatggtttataccctgacctttgggtcctttaatttccaatgatggggaaagaaccagagtgattgatcatcaagttagtcactctcagtaaaattgtcaatatgaagataaaaattgcatatcatcgatttaatttgcatctctttgattacaagtgagatagggcatttttttttcagtgcttaacagccaattatatctcttcatttttaaggtacccattcattagtagaactggtctcttgataaaacagataacaatttccagtacagtagacaaaatatgttctggcccctctccttttttaatttgtattttaatgctatactgcacttagatgtcaataacaccccactccagtactcttgcctggaaatcccatggacggaggagcctggtaggctgcagtccatggggtcgctgagggtcagacacgactgagcaacttcactttcacttttcactttcatgcattagaggaggaaatggcaacccactccagtgttcttgcctggagaatcccagggacaggggaacctggtgggctgcctcctatggggtcacacagagtcggacacgactgaagtgacttagagcagcagcagcacttagatgagtagattacaggcctcagctataaaacaaaatgaaacaaaaaaagttaacctttatcttaaatgtgaatcgcttttagctatttctgctgtaactgttctattttctattttcagacaagaaatgtttctaaaaagtcaactgttctaaatatatatttttacccttaaaagacagatatcagtgtttaacttgcttatcaattgtaaatttatacaagttaactcactgaattgcctccatg

SEQ ID NO: 44640 - DNA, 1369 bp, Bovine  19866881243777
gtaggacccagactctgtctctactgctctactgccatcctctacatttggctttcaccttcaaaacagctgcttaagtaccagccatcatatctaagctgtagcaagccataagagggaggagtggaatgtgcatcctccaaatgactttcagtgagtcccaggacttcattgaaagctattaataaagacagtctctgtttcagttagatgtggatttttgaagctaattactgcagccttcttgccatcaagaggagagatcctgcctgagagtaggaaccaatcttgaggaaacagagcctcttaaactcagaaaagaaacagctcttttgtcaatctgatccccaacatcaagctatagctaaaacaagatataccattgggtttttaaatgacatgaatgattattaatctaggggcttccctggtggctcagctgttaaagaatctgcctgcaatgtagaagacctcagtttgattaatgggttgggaaggttccctggagaagggatgggttacctgctccagtattcttgggcttccctggtggctccagacagtaaagaaactgcctgcaatgcagagacctgagttcaatctctgggttgggaagattcccctgcagaaaggcatggcaaccgactccagtattagtgggcttcccttgtggctcaggaattaaagaatctacctgcaatgtgggaggcctgggttcagtccttggtttgggaagacccctggagaaggaaatggaaactcactccagtattcctgcttgggaaatccccaaaacagagaagcctggagggctacagtgcatggggtctcaaagagttggatgtgactgggtgactaacactgtaaatttcggccatggtacctaagatggataaggaagaaagtgaagattagaaaaccttgacagattgaaaattgtggtggtggtggtggtgtcaatggataggtgctcttaatgagatgaagagtggcagtgtgcaacttgacaaaaggagctgggtgtatagcaaagggattgagatacttgatttatgagtttggaagcagtgcagtttcttctgtgagacatctaggatgtaactttggaaagtgggtacctcagttgattgtgtagatgagaaatgtcagtggagatgagaaggtcagtgaactgaaagcgccagtgagtttaattgttttatataaatatctcttagagtaggataatgacatcatgtctgggcttaattaagcaagaacagatgataagaggctgagatctagctctcttctggtttggtctttcctaaggatagaccttagtataaactagaggaatagagcattcagtcaatcttccatttatatt

SEQ ID NO: 44641 - DNA, 1710 bp, Bovine  19866881341167
gttttttcctcttggcgagatgggtcgactgctttccgccccgctgtggctcctctgaagttcacggttcgctctgtctcttctgcccagatccccgccgccacagaagccttcgcagggtagccctgcagccaggtcccactccctaccttcaggggaccgcgtcccaggccccaccctagccagagccccagagtcccactctttcgcctccggcaggccccaagccaggtggggacgaacccaggccgggcgtttgctcccagttccgcgtctgcgcagcggacgtggggctggagcggggccggccggggaggcgcaggatgcgcgggagccaatgggcaagctcggggaagccgggctggcggcgacggccggaccggcgcgcactctcgggatggagggcgagtgccgggcgtctcaggcgcgctcctggggcctcccggctgggggcgccggcggggacagcccgggggggtgacgcccccctccccggcagcatcagctcctcctccctgctgcaggccgaggtgctggatctggacgaggacgaggacgacctggaggtgttcagtaaggtgagggctgcgcggcggcgcgtcccgggaaagttccaagtcaactcccagagttggccccgccgtgcggcggccgccctagcgcgctcacccggccccgccggaggcttggagccgagggtgggtgggtcttcccaggccgcctgatcctgcctggctgctcgccgcccccgtggctgactcccagcacgtcccgaattgcagcagttcactcttctgcactttgaccttgcgttcggcagggccatggcttcgtggaatctgcaaagttgtgccatttcccacttttctcttctttccttctctgacgcggatatttccagggacagtgctggaaccgggtaggctgtggcccgaaagtgcccccgcccctggcagcttcttttagggcgcagccagtcctgaaccctgggagcgaaatcacccgagtctagggaaattattcttgatttagtgttgttgctggttttggattggagacttgggtggcgccggaggttagtcttaagtctagtgggaagaggcgttagggaatccctcttcaggagaaaacagttggtgtgtccaactaggaagctcctgcgctgcggagctcaggattttttagatagctcctaccacccaactcagcaccggcgctttcatttttaaacctaacccagggaaacctagagaccaaaggggccctctgaactttcaggattgttggagagaaattgactcggtcactggcagacttgtggtgcccgtaggctgatggttgtaattttgttatggaaaagaaaaataccattcttgggaggccattcaatgccactgcagcttctctcagttgctgctggtagaagagttgagatgggaacattgtattttcattactaagaagcctgttcagtaggtgtgttaccttgaggtgttaagtaaagcaacagacttcaccactgctttattctgggagagaagttataaagtggacaagcatactcagaccacaaagaggaatatgcaaaactccccgccttttttccctataggattaagtgaagtggtaggcacaggtgtattggggaagttcagacagagtatctggtttatacacttgagaaatcacatgacctttcagtgtgtttaa

SEQ ID NO: 44642 - DNA, 1383 bp, Bovine  19866881496974
tctaataccatctatcaataatttcagcagagaatactgtaatgttgccccagatttcttggaaagctgatattcagagtcattatcaatactatttctgaattaagtccttgcatttatgtattaataatgaaaaattttttgaaattttaagtttgaaaacacaatatgagaaatatatgtctttcattcggggattccttttcttcatcaagcacagtgagacatactgtcctcactaacaggctggggagaagcagacccggaggcggaggtggagcctgtgatgtaactgcagtggggctttgctagaaaagtcttctctaaatgagaaatatctgtacaccgaattgtttagcgtcaatgtgcatggtcttacaagagaaaagacttgtctctttcagcataatgtaaatcttagaggcttgaaatcttggtcaacagaggaattcctcacattgtttagagacatactaagagtctcactaagggaggaaaaagcaggtttcttcagcaaaggagtaccactgtagcgcattaatggtgtgtgtgttatagtggaagttataacccaaagtgtgaggaaagatgccctacagcttcttccaatcctgaaagtttcctacattactgtgttgtttccttattcttgacagtgattatggaaaagaccttcatttcttattcccacggaagaattcaggagagagaaatgtctcccagttgtagagggatacaaattttgcctttcttaaaatttcaactagatctcagattcaacttctagggagacaatgactaattctgtgtaactacttggtgtcttaagatgataatgaattaagacgtttattccaacataagcatattacctgctttccaccatattggaagctccggtttgtcaagctccaggctcaacacgcacactgcagagatgcagaacaacgcttggatatctgcccaagactggtctctccgaacgacagactcaaatttacggtaccaatctaaagctcaccgtggggttggcagtatctttttcctagttggtataggaaagggatgagatctggcaaactgaggcacggggcttctacctgcctgtgcggagcataaaggctgacaaacatattcattaaacttgatctgaagcaaccgagcctacgaggtcgttcctgaaatatttataaggtgtgttaccggactctgccacttacaggtggggaggaaacacggtgaatagaagcacccacacttgaggggcgggggcggggacggggtcggggggcggcgaaaggcactcacaatcgcacagctcaccaccacacttaactgttttgcttttaatagctctgtcagccgtcgctccccagtcgcctg

SEQ ID NO: 44643 - DNA, 2233 bp, Bovine  19866881520653
agggggagattttggaaagtttaaatcagagaatgttggagaaccaaagggtcaacatgcttgttcagtgagctgataaggaggcattctggcacatccaagaagtattgggattggtcagcagaaaagacaggtggccacacaatcgagccttaaagaggacaatagtaccaagacaaaagcagaggaaaggagaaaaatgggagcaagggaagaaataaacagtagccaaaaaaggcaccaaggaaaaactggaaatttacgagggtgagctgagaggctattcatggaggcagaagatgagagttgctatagcatgttcttcccatggctataggagagacagcttctaaaacacaaggattctgtattcaaggtactgattggttttaaaaatatttttagccaaaggtaggaaaagaaaggattcccatgcttcaccctctgttggtgtatcaaatttactagaataggcattctggagcttgctgtcatagtaggtatgtccttacagacctagggcttcactcctgatgatggattttgtagctacctcaaataaagtaacatgggattgaaataaggaaatatgcgtgtgaacccaagaagtctaatggttggttttcttctgggcttgttgcttgctggtggtggctgctttctattctcttccagagttctgttggaagagtgctgtcttttatttttgacagaatgctgatccaggtgtgcctgtttttttattgtaaatttttgtggcgttgcctgaaatttgtaatgagaaaactgactggaagatgtgaactgcaacgaatctgttataataccaagcctggagcttctagaaccatgaaaattggtaagcatgaaacaaagaagtaagcacaatgtagactttctgtaattgaagatacagtgttatatttcagtacaataattgtaaaccacttgtaaaagataatatttgaatagcttttaaaattatctcttttccagaaacatcactgagagattcaaaaagtaaggtaggtaaaattgtttctgtatttttcagcaacttctcacttggaggcttacctccaatcatccaaaagtaaaaattttcagaaacaaaatatacctctggctatgggcttccctggtggctcagatggtagagagtctgcctgcaatgcaggagacccaggttcaatccctgggtcaggaatattccctggagaaagaaatagcaaccccctccagtattcttgcctgggaaatcccatggacagaggagcctggcaggctacagtccatgcggtcacgaagaggtggacacaactgagcgactgagcacatgtatactaaggcaaactgagaagaaagaattttttcccatcacaaaccactgtgctttttatctaaaagcaggtactcatgaatttccagacagatttatgctgcacttattacttcattgttgaattcatccctttttatatctcattccaaatcataaatattccatggaaataagagaagtgttatctctctgctacttcctcaatatccaaatcatttaactttatactcaagattttccaaggccactatgctagcatttctagcacgtagttaagcacccgcataagaaagaaaaatttgtttcttaagattcttgaatatttaactttgacatccttaagactgtatctcctatgtacttcacacagtcatagacatatactcattaacaatgggaaaccatgtgtattcagtgagaaaaagaaaatataatatttctatgtgagtaacttgaaacagatggaagtggtaaaaaaaacaagcttatgtatttttgttttatgtttattaccttattcagaaaaacaccaaatttactagaatttaaagactacatgaatttttgtttttaagctttaaacaaatatttgaagccccaatttaattagaccccacttaagatactagtgttcatgacaagggaactgatttaaacttgttttctagctattacagacttcagtgagtgttcatcctgatgctattgaaaaaactatagacgacatcatggaactgaaaaaaattaaccccgacataaatccacagtaagaatatgttcatcatgttataaatataaaacagaagtcacatgccacatacttagtatttctaaatatgctgtttctaaatactttctcacacacgctttctctctctctctctcctttct

SEQ ID NO: 44644 - DNA, 1117 bp, Bovine  19866881662546
tgactgtaatagataccagattagaagtcatggaactttagagtggccaggtaccatgagatcatttggtctgacttcttgatttcagattttgactcaagagttgactagctggagatcacacagctggtcaatggcagggctggagcctgaggccttgggagctcttaccaagatgtaggtgcctcctttatatggccagtcattgcccaccaaaaatggtaaaaatagaggaggtttaagtttgattttaagacacagtttgaggatagagagtcttctgtgatagtttttagagtgatgtttgtctactttttttgtctaagaaatatagtttctattttattacctcactatggctagattcttttggtatcttccaggacaagctattatcatttgcatcgtttaatggtttgttattcaggcaggctcaataaagcacttaagagattagagttctatagatggaataaataacagaaggcaaagtgcccattcctatacttgacattgcaatgaaaggcaatcagtaaacaactgtggacaggatcaaacaagctgctgagatttaggggcctgccttgtcctagactaaatagatacagagcacatcagggacaaggttaaaaaaagaacaggatgagcaatcaaatagcaacatcaggaacattattagtaaaaggaatatattttatccttgaatgcagtctacaaatgtgtgcctttgagaatcgaatgaatgaaatctctttttcctttatcttgcaaagattttggatttactataattttggcactcttaatccccctgcctttcagactggcaatatcaggggtgtagcaagtattttctggacccaggatcaacaggtggtggaggagtatatgatgaagatgagcgagagtatttgctgtgagcaagtatctgtcttacatggtggggttggacactttgtcagggaaacggtgtctgtttgctttctcataataacctgctctttctgttgttcttaagcccaactgcaattaaacattggttatgctatttttctctgtctagtttctaaatcctccactttgtacctctctgttctctacattccacctcctccat

SEQ ID NO: 44645 - DNA, 944 bp, Bovine  19866881706863
catttatagaattgaaacctgtgcgatgtgtgaggatatttatgaccctgtttctcttgccatggactggaaagtatgttggcacatcatcctaactggatgctcaggactccctatttaatatccagctttataattgaacagttacctgaaaagagtgggctcagaggtgcttgaatcagaagtttgttgaatctctcactctttttttatggttgcttaataataaacactttaaccttcattatggctggaaatagaacaaaaattttagcaagggttgaaattttagctgtgcagaggaataaatagccctgtgacctctgagatttccaacaatatcattggatggtttccctgagaactttctttacaactctcagatgctaaaaccagttgcttacagatctctttccctactctcaaggaacatgatctaaatatgaatcatcataggatcttggctagacaatcttcctagtgacacaatatccttttccttgagatatgccaaaggaattctttccacagtttcttcctcagaagagaacatagtgggaaaacatgggctttgatgacaattagactgaagttttaatcctgactcagacacttactagcaatttgttctatgacaagtaaattaattccctaacccacagtttggcagattaattccaatgaatgaatggcagattcattccaatcccaaaggaaggtaatgctaaaaaaatgttcaaactaccttacaatagcactcatctcacatgctaaaaagtaatgctcaaagttctccaagccgggcttcaacagtatgtgaactgagaacttccagctgttcaagctagatttagaaaaggcagaggaatcaaagatcaaattgccaacattcattgtatcatctaaaaagcaagagagttccagaaaaacatctacttctgctt

SEQ ID NO: 44646 - DNA, 1386 bp, Bovine  19866882110470
cacgctttctctctctctctctcctttctctgccccagtataattatctgcatgttttgactttcaggtgaaaaataaagaaaaaagatgcctttttcatttttgtaaatagcagcaactttgtaattctgttgtgatttatgtttatgctttgaggtgcaatgaatgtaagaaatctgatggacgcccttgatatcagaagatgaaataaagggtgcccatccatcaacagtcactccatatgctgcctatgttttacattaacagtaaatgtacaaattgtaaatgtgcctgagctgactctgctctatgaagaatatttcttcagttcatgacagactgttaatcttggagacagttattacctgcttgtgaagaagacagacatgtgtgggaggagagatgacttttatatgaagactttagaattttgtaattagttgtcttatcttggaagtattaaaatgcatttggcaatgtacatgatatttaaaattagctttatattttccattgggtacaggaatttttctgtaaaattttagtctaaggatattgggtagaaataaattctgtatgcagatacagtcagatacagtttaggtaggtaacagtcaaattgtcttttagatgtgcatacttaagaacttcagatgttacattcagggtgcacttagcataggtctcttatgttggagggattccaggtactagctaattgctcatcacaaaactccatttccacatggtatccatagcattcttctgcagatgcttcagctaattagctgctttcccttattcagctttattaaatatgatttaattatatagtaaatgtctttttgaaacctactgacttatttctctgaaatggtggtaagaatgcaattcatttaaaatttaagattacaattaggcatgagagatatattagacctatagaggttgggttagatttaatagcaaatcttttctgtctcttttatgaaagttatatatttcattcagaagtgtttccttaccatctattcttttgatttcctttaggaagaaaaaacttttataggtagtatttaattgtggttttggaccgtgaattttaaatcattataactgggctcaaacacagcttcattaatcaaaataggaaccattacaatcaacacatttttgccaatgagaaatgtttgtttattcctgtagcatacaaacccatgctttgggatttgacaaacccttggaaagcattttctgcctcctgctgattgtagaagtgttttccttgcaaaaagttgttgagttgcttgagaaagtagtagttgtactttgagaggtcaggtgaacatagtggatacgcagaacttcgtagcccagtttgttcaa

SEQ ID NO: 44647 - DNA, 1992 bp, Bovine  19866880922651
gaatggcccgtaattgctggtttgctaagaataaatggctggttttactttgtgtctatgttgtaaaaagcaaagctgatttcagaacaaataaggtaaaatcaattcaagaaagggaatcagctccttcttattgttcttttttgttccccattagcataaacaccactattcaagtaggctctatattactgaaaataaagccctggattggggtacgggactagacagattaggtgacttctaaattactttctaatcctaaaattttattccttcaacaagtatttactaattgcatggtatggatgccaggcactataccaggagacaagggcccagcagtgaacaagacacacaatgctgatactgtggagaaactaacactcaagctaaagagacagagaataaataaataaatagagaggatacagctaagttccaaagaaaataagaaagataaatgatagcgaataatagaaatgacctactattcttatctggggcttcccaggtggctcagtggtaaagaatctgcctgccaatgcagaagattgatacaggtttgatacctgggttgggaagatcctttgaaggaggaaatggcaacctgctccagtattcttgtctgggaaatcccatggacagaggagtctggcaggctacagtccatgggcttgcaaagagtcggacatgactgagtgattaaacaacaactattcttccctattattattaattatactacttcttccctgggggctcagcagtcaagaatttgcctgcaacgcaggagctgcaggagacttggatttgatccctgggtcgggaagatcccctggaggagggcatggctacccacgccagtattcttgcctggagaatcccatgaacagaggagcttggcaggctatagtccatagggtcgcaaagagtcagacatgacttagcaactgagcacacacacaaactatgatccataacattcagggcactcactcttcccagctaacacattgatttgtatttatccagttaggtctatctttaactacaagtgaatgagtgcaagcatcagccagatacattaaaacatcatcagaacctatcattaattagtcctaattgaatcaattgattaatggaattttccagtggaccacttgttacagataatagattagttaactgctttatcaattgatttaattaattggattcattgcttttgactgtctaatctcaccaaacacaaaacagcctgattataggacaaaaaaaatgaggcactaaaatggaaagcattacccaacagctccattgagaaatggggagtttcattttctttttttttggtgttcttttcagttcatattaagcttcaatttcctttgttgtagaaatcctggctcagacacatgttattacattatacatgggcctgaagcccatccactcatactccctgggtgtagtcatgtgtaaactggtgatgtcataatttaaaactcatgtggaaataagtaatataggattaatagctcatattatatcccccaatgatttctgtgtggactaaagacttaagcatgaatatcatactttagtattttcagggaaatgatatgggagacaatctttatgatttctaggcaggaaatgactttaacatagatataataagtacaaaccatgaagtatgtttataaatttaaatggtctcatcaaaaagtatattaagcaaaaagtaattaaaattaaaagattcaaagactgggagaagatattagcaatacaaatgataaatgtccagaataaaaatggcatcaacatattgataacaaaaatacagtagcttgatcacaagaagaacaagtgttagcaaagaaatgtagaggaggaaaaaacttggattccaaataaatatgagcaaatgtagtccacctcactagtaataaataaatatagttaaattcaattagattctatgta

SEQ ID NO: 44648 - DNA, 1848 bp, Bovine  19866880643675
cacacactgactgtgtggttattccgttactcccttctctgagcctgtttcttcttctgtaaaatggagatgatagcagagcccatctcaggcttcttgtcagaatcaaatggaaaacaggcgagagcagtggtatctgtcatcgtgaggagtgtttctggagttggggctggtgttgttcatgtccaggcagacagtgagacaggtagagcgctccctcctgccaccagcctgctgaccccctccagatatgcaaaaattcatcaggtcctttgcggctctgggtctcaggttgggtagatagagaccacataattgagggtgctacgagagaccagaaaggccttgagagctgcctccatctggtagctgaggctgtgaggatcactcttagcagcagaatgtgcccaggccaagacccatggtgggcgagtgcacttcgtgggtgtgatggggtgcctggggccggggtggggcactgctctcttctctgtcctgaccttctctcctctcccctctcatctcctagggcccgggagacaccagcgggggctgccgctgccgggtgaatgggattccatgccaccccagctgtcagaattgccactaagctgaggatggtctggtccccctgctgacccagccccacatctacaagcttctgtgggacaggcctggtgctttggctctgatttctttgcgctcggccgagacaggggccctgaagtggccaaggcctctgagctgcgtggatggccttgtttactgtgggcattgcaagggccctgcctgagctggccgttgtccatggctgcatctgccccggtgcctttgtccttcccctggggctcaccaaccagacctttcatctctctgcggctcccatctgtctgacccagccttaaatagagccccagccagaggccttgctggatggagcctctgagagccctggatgagtccatacatccctcatccaccacgctcgtctgctgagcactcagcctgcggcctctcccattggctttctgggggtgacttttctctggctttgctgtttggaggcctgagggcctcttagaattgctgctaattccacttagagccaggagggagacctggcatcctgaagcccagccagttctgcttctgcactccctcttcgctgcctgtgtacactgattaaaatggttttccaggaaggcctgagtgtgatgtcatgagagagagcggaggggtcatgggctgggactctgcacagagacaggcaggggcccaagctctgggaattgcagtcacaagttgatgtgtcgcccctgtcagtgtagaacgagggtgcgaacagagcacagggatccttgctccggacttggcacccctgcacccacttgagggcagcatgctctgggtcaaccttgacctggacaggcagcttgcagtgtgttgagagtctgccagctggtgtttgcaggtgtgtgtgggcttcaggcggggagggaggggctggggcagcagctacaggctggcaggaaattcttgctctgaatttctagcctctcagtgggcatccactgtcagggaacagagatatttcaggaagaggtgaacgtgccgctgctgcagggtgatgctgtgagcacttttaacatctgagataagatggcatattattattggtccagtgctgtttactagacctattctgtgctggtcagatgaataaaatacggttctgggtgttcattctagaagtttttacctcctactcggacccctcctactcccccctgcccccaatgaaggccagcacactgtctgagccaggatgtggacatcattacaacaggt

SEQ ID NO: 44649 - DNA, 1416 bp, Bovine  19866880694383
cagcttaataaagtttaatagctattagaaactataagtaacaggatatatatagctaacaattcaattattagtctagagaaaaaaggaaaggacagccgactccagtactcttgcctggaaaatcccatggaaagaggagcctggtgggctatagtccatggggtcacaagagtcagataaggcttgatgactaaaccaccacggagctgttaaaaggaccctggctccttatgttcattctgtcttggctctgttgtcccaggtaactgtcacctaagacacacccatgaccacaggaaggaggagggtggtacctgagaactcattactctagagtcaggctgcctggaattaaatcctggttccaacactcactagctgtttgacccttgacaagtttcttcaccactctatactgcagagacttcatctataaaatgagagataatagtacttaacccaagaaagttgaatgggttattttatttaaagcacttagaattaacagtgcctggcagtggcaagtggagaaggcaatggcaacccactccagtactcttgccgggaaaatcccatggacggaggtgcctggtaggctgcagtccatagggtctctaagagttgacacgactgagcagcttcactttcacttttcactttcaggcattggagaaggaaatggcaacccactctagtgttcttgcctggagaatcccagggatgggggagcctggtgggctgccatctctgggatcgcacagagttagacacaactgaagtgacttagcagcagcagcaggcataacaagccctcaaagttaggtatttctctccatagcttttccatgggatgaggaaagctttcctaggagcattctgaacagacttgcccacattcctcactggccagacctgggtgtgccttctcctgaccaatcaccagcaaaggaaatgcagttatgttaattatcatgtcaagtctccagcagtttccctgaggctcatgctacatattgggagttgggatggtgggggaaagatacctgcacaaaatcaaattctgagagggaggtgtagtggggaaaagtgcagaggaagagaactgcagaagctccctcaatagcttgctaactgcagacaggtgagggtggctatcctagattgcccagccatcagttgaccctccagctgactgaaaatgcagagttcagttaggttgacccagaccagaaaatttccccaactgacccacaggatcaggggctaaataaaaggattgttttaagccattgagttttagtgttttgttacacagcaaatgctgatatagacagggacaagtcagcctcctctctgtgcacccagcatgacccagaagagggcccagctgtatctagggtctcatggagctgc

SEQ ID NO: 44650 - DNA, 850 bp, Bovine  19866880977014
tagaagctcccacaactttgctccaaatgccccccttccatggagacctgcctgctcacatgttcctgaagccctcagagctgtgtcttcatacttggtcctgagtggggatcatgggaagtagttctggggactgactcatgacatatccctggaatgtgagaaataagtcagatcaacacaggtcaggttatctctcacctgtaaccctggacttggctcacactaatgttctctgcagagaagttattctgtcttctgttcattggactcctcatcctttgagtataaatgatgccctatcttggttttaagaaaaattattctccttccttattgtctcaatagcctatttttcaaacccaaagagtagtgttccctcctctctctgtgatggaaagagtagtctttctatcattttgcatccttcccaaccctgttgctcatgataaatacactatttccagaagcctggagtcatccttgatttctctttcttttatatcacatattcagttctgtctttaaagtgattatgtccagtagcgtgatggtaaatctttaacaactgactgttaagaaagaaaaaataagcctgattggtagtacatgtcaaattcttgatgtaaaatgctttcaatgtggtcaatttcaagttcacaaccatttagcaacttaaataattcctgaaaatgtaaatgttgtctctcttgagccagtccaagcttctcacagctcaccactgaacataatctgcacactctcttccccatcaccactccctggtcccagacaccatcatcccttcctgcaccactgctagagtctctaacggctttcctgtttcagg

SEQ ID NO: 44651 - DNA, 1376 bp, Bovine  19866881929644
aaattgtacatataacttatttgtttttactgctgtaaattttttattgttgatatttgttttaaatattgttttaaatattgttaaaaataaacaatatttaattgagcttaacttgggtttcgatatatggaggctgaaacatgaaggcatctgacatatcacttgttgattgacaggtctgctttcttcatgtttttatttaactagagtccaaaatacagaattatttagagaaactaaccctgggcatagcctacctgtcatggacctgtatgtgattttctcttcaaatcatactataaacaaagttaatctaagtcacccaagactaatctatgatctttctctttactctggcaactttcatcagccagtaaatgtcaggcagacatgggcagacacacacacacccccctcatctcattttgagaaaattcgtactttgttacgctatggaattctgcatcaaggccaaggtgctatcttttctattttagatccacctatcatggtattacttaactatcaatacataagaaaaacaaatcaaacctttgattcattttgatttaatgaaataacctgaaacccactgtagcgtggagacaaaaccatgacattgtgtatttaaaatagtttaatccttcaatagctctggatgaaaggagaacaatagttaaatggggtgtggtgtgtgcacagtcacttcagtcgtgtccgactctgtgtgaccctatggactagagcctgccagcctcctctgtgtgcacagtcacttcagtcgtgtccgactctgtgtgaccctatggactagagcctgccagcctcctctgtttggaaagataacatcttaagtaggattcagagaatatctctgagtaatgaaacacattaaaggtcatttataagtaaggtattaaaagcaatttgtactgctacggattacaatgggagctacagtaaatgtgaatgggtgattttttttaactgatcatgactagaaagcaacgtttcattatccattccagcctactcaaagggaaagtctattgtttagccacaaaggaccttgaaaatgaggagactatgggctttttgtgcctagccaagattgcataaagcctcttggatattaaagagttgacacagctgaacagatcaacagacttagaaatctgttgaagtaggtaggtgataccattttcaggaaatagtaatgtcatctttggaaatcataaatgttaattctctcaatacagatttttctctaaagataggttcctctctgagttgtgagtaggatataaggagacggatgggggaaggatgtcccgccaagtgcattaccaataaatttcggaacaaagcaacat

SEQ ID NO: 44652 - DNA, 1178 bp, Bovine  19866880115602
tgttgagtttaagccactttttactctcctctttactttatcaagaggcttttgagttcctcttcactttctgccataagggtggtgtcatctgcatatctgaggctattgatatttctcccagcaatcttgattccagcttgtgcttcttccagcccagcgtttctcatgatgtactttgcatagaagttaaataagcagggtgacaatacacagccttgacgtactccttttcctattggaaccagtctgttgttccatgtccagttctaactgttgcttcctgacctgcatacagatttctcaagaggcaggtcaggtggtctggtattcccatctctttcagaattttccacagtttattgtgatccacaccgtcaaaggctttggcatagtcaaaaaagcagaaatagatgtttttctggaactctcttgcttttttgatgatccagtggatgttggcgatttggtctctggttcctctgccttttctaaaaccagcttgaacatctggaagttcacagttcacgtataggagagcaaatggattaaaaaatcttggagggtcttccctggtgatcaaatggttgagaatctgccttctaatgcagagaacttgggtttgatccctggttgaggtattaagatcccacacgtcctggagcaactactgagcccccacacataattagagattccctgcatgctacaactaagaccagatgcagccaaataaataactttaaaaaaaagaaaaaggagtcttggagaatctttcatcctgattttaagatgagaaatcaaacatttgctggtggagactagattccatcctaggtttgcaaacttccggtgtaatgctcattcagaaacatcaaacttgccccctaaaaactgaaacagagcagggacctgtggcactcctgggcatagaagcctttctatgtcccccatttcttgtttgcagggtatagactcctgtccccatgactttccctgagttctaaagggcagagtccaacagctgctaatcagggaaaggaggagatgcagagaggagggagcagcagtcaggaaacaagagcgcagcttgggggccagggcctgactccatgtcaagggatgcacagagcaatgcctttgagctcttgacagaactaaaactcccaacaaacgga

SEQ ID NO: 44653 - DNA, 921 bp, Bovine  19866880344151
gtagactttcttgtcgtttaagaaaccattgtttccttaactggacctgattttcctcctgattatgtgtctaatgactgttacatagaaattcttctccaaaactctgttgtaatattaggttttctgccttccttaatggcaagcaacgtgtcataggtaaatttccgtggtaagagtgtccttatcaattctgataaacagttcagactccaaattccactgccgcgtttcccctgccgtcctgttggccaattataagcctccccgtggagccacaggcttctctctccctggtctccttcatcctcaccaagtccatatttttctagtctctcataagccttgcacagctttcaatcttagatcacaggtgagccccccgagctgtagatgcacccaacagagaaccagcagatcctatcacatggccggtgtctaatttagtaacagtcaagtactgagaagctttgaacgaagaataagtatgtgcagacaatttcccactgtcttaggaggatgtgaaataactgagatctttcttaatcttagtgtcacaaacccttatctggaacagtgacagccccgaaaggtcaaagtcgaggtgaactgttacagcaggggaaagacactgttctcagggaagatgaaataatgaggaaaggcctgttcttcgtgctcttgagcaacactgggctgtgtcctctagttttcaggggcttttgcccgcctcaagaggattgtgttatttggtgttccctgaaagtaaaggcagtgagggatgcactgcaaaagtgtgcactcagtagaccctgctgagtatgctctgctactctgcatagactctgagctgctgtgaaactacaggcaaactcggggctgagccagggtcccagggctctgtgcatcccattctgtccc

SEQ ID NO: 44654 - DNA, 2318 bp, Bovine  19866880513237
tcctcaggaatgtctttagtgtggttttagcttcctcataaactcacccattattcagcttatggcagtagtaaccagctggattctgaattatgaaatttatataacagaatagtttccaaaggcatactcaagtataaagtggatttaaaaaattctaaccagttttactggcttccctggtagctcagctgctaaagaatctgcctgcaatgcaggagacgccgattcaattcctaggttgggaagataccttggagaagggataggttacccatttcagtattcttgggcttccctggtggatgagatggtaaagaatctgcctgtaatatgggagacctgggttcagtccctaggttgggaagatcccctggaggagggcatggcaacacaccccagtattctcaactagagaaccccatggacagaggagcctggcgggctacagtccatggggtgactaagagtcagacaatgactgagcgactaactacatccagttttacacttcagaatgcttttgagatgggaacaggggtagatttgcttcattaagtttatttttgttgagattatattaacactcatatatttttaagattaataaataccagctggctgaaggagtttagatgtggcagttaaggatctaatttgggaatttataaataactactttaaacaagtcacaatgtatgtcagttacctacagaatttagagttgactttgttttttcccctcagaagaatcttgtctaatacattcgtgtggaagaaaatggttcgtcctaaagtcaattccatttcaactctagaaaaatttcccattctaattgcattttaatatttacatagagcttactcactcaaatttttcagtagattatttttctacaacaaaatcaagcatcatttcttatagtcactgatgtaaatctaccccagtttattcattactgtaggatctccttgctctaattggagttgcctcctaggatcatctgacatgtagctcatccttacttttttgcttttgataatggtgcctcattcacttaggatgatctcttatcttcatccatccattgatgtttatcacttctttcaagatacagatgatgtctgacttttgccaagaaatttttccctactgatttctgtatcttgttcagtcactcagtcacgtctgactctttgtggaccacctggctcctctgtccatggaattttccagacaaaaatactggagcaggttgccatttcctagttcaggggatcttcttgatagaggatcaaaccctcatctcttgtgtctcctgcactggcaggtggattctttaccatgaacaccacctgggtattttgtgacaaatcagaaactatgtactagcttcaggggtaaagaaggaggatgtaaaattgaattgaaagacagaagctttcacttctgctctaaaaaatatgttccggaatattatctgagctatattctaaacttcagtttctgtaaaatttaatttaaggggaagattgtgttcttgagcctggaaacactttactgattgataaaaatcctttttttatgggtaacttacacaattaatcctttattgtttaaaaacatcaataagtcatttcatgaaaattaagaaacagtaatactgaattcataatactcaagtgtttttcaatttatatctatataatctcttccaagaaaaataaaaaatatttcttttcttaagctatgctcccatctataatttctctgcaagctgcatttaatatacctcaccaggatttcactaaaagggcaaggaaacctaatcttgatttaaagaagagttttcattatgtggttttaacagtccattgattattaccgcttcatagatactattatgataatttatcttttaaaattacaaccctttgttcaggaaaattttcaataaaaatcataatctaacagagatcatcacatgatagattatttttgctcttttattcaatgaagaaaaaagaaataatgcactcttctttaaagtctattgtcacattatgcactcattgagagagatattgaaaaaaataacaggaaaaaggaattaaatgtacatttacctgtattagacatatctgaagggcctgttgtctgaagaagtaattggaatctggttctgttttcttgtatccagtttttatctaaagaaaatgaggaatatgaaatgtcattttctaaagtaggtcaaagaccagactaggagtttcatgttaacataaaaagaatgattaatgagattaaagcaatagtc

SEQ ID NO: 44655 - DNA, 2172 bp, Bovine  19866880597802
cagagcggcttgagtgtatcttagtagggaagaaggctgctcaagagaaagatgaaagccaaggactgtactttatcaaatgaatgaccattcattttagatgcgattgcagtctgcttaaacaagctatagatgagcagaagatgctgctgtttgccttggaacctataacctgattgcttggtgagatgcagacggctgatttccgaggttaatccaggtcgatttaagtgtagttcatgtgtacagataaggattctgtttgtgcagagctgctttgttgtctggaaaatcaggagacttagggggcatttgcagggatggttttagctgtcatcagagtaacatccaaaccttttcgtttttttcctctgttgacagaacaacacggatggacttcacgaacttgcctgcgggggcttaatttattgcctgggagttgtgttcttcaagagcgatggcatcattccatttgcgcatgccatctggcacctgtttgtggccacggcagctgcagtgcattactatgccatttggaaatatctttaccgaagtcctacagattttatgcgacatttatgaccaatctgtactaggtctccaaaccagtattatttcagttatggcacttaagagtgggataagagctgaaaattgcacagaggaagaaaagaagacaactgcactgactttcttgatatcttttgaatataattactgtgaaagttatgaaagctgtgttctgggattttccccctcacagcaagtaaataaggtagtgagttaattattcattccattccactatcatgaaggactctggagagacttggccaactgatgtttacaaaccaggattttgtattttaattttacagattttactacatgatttttctaaattactaggtcagattgtaaaagtcagtgcaataacaaaacttcctttttaagagaaaatgatttctatcactttcccattagctgttaaaagaatcatgactagaaattacactactttttaccatgtttcatcttggcatacgtagttattttttaaatagaaacttcagttttttgtaaattttttaaaaaatacttcattgaagcacatctgtgcggttcttcattcatgtgaatttttgcagcagtctgtcaacattccacaaatgaacaaacattatacctcttctctgatagttttattaagcatggagagattgccaatttttaaaagctgcaacttttccaaaactttcctgccaacctctgactctgaattccatgctgctttgggccacatatttgacctagtttggtttcccagcgatagaaaagcattttgatatcactaactttttcaaaaggttgaactttttctctatgcctttgccgtgacttcttcggggtcttttcccacagaggagtatccagtctgtattaagacaggattgctggcttggccgtccaccgaacactcctgaagagcgctgtgaattacagtgaatagtggtcatacctgtctggtgcccagtggttaagttattgtcacttagctttatattatcggtttgatagtcattttaagttgtggaactcaatgcataaattcacatttctccctttcttttgcatctcctgatacactttttatcttagaaaagtatctaaagcactgtttgacaaactcacgtgtctattgtccatcagttacagcctggctcagtggagtgatatttaatatattgtttttggcttttcttcaatgtcttatattaagattaacatattagttgctttttggttaatctcctgttggtgttttaataaataaccttgcatttagatcgggtgctgatattgcctgttttctagtgattgggtaagatcactggaattgttagtttgacagtatattgaattcagttcattgaaattttgtactgatgtagccttaaaggagggtttattttgtgtgtgtgtgtatgcttagaactctgactttgataagttatatgggaatgaggagcagaagaactgccttttgctgatgaattctgaaacaggcaaaagtgaaagttatagttgctcagtcatgtccgactctctgcaaccccaaataggcgaggtacccagtgaaaacgccaaccagaccatcccttctgcatggct

SEQ ID NO: 44656 - DNA, 911 bp, Bovine  19866880691573
ctgagaaaataaaggtgtgcgagggtccaagcgggctgtggttgacacaggaaggcttcctgggagaggtaattcttgagcccaaacccaggacaccgatagcggacctgccaccaagggcccgcgcgggacacggccgcgggcagccgccagggcgagacaaagcctgctgggggctggaaatttcagggacacaagccatgtgatgatggagtgcacgcggaggagcgcgaggcgttttcctgaaagtaagttaaacaaatactggaggaaagcgaagtgggaggaacagttattaacaaaatcgcgaacttacccggccaccgggcctccgtagcccgaccgcaaaagcggctacctgagagccgtagcctaggcagcggcgggctcaacccagagctcgcgagaccgaggaggcctcgcgagatccgcccccttgcccctgaccggcggacgcgctttccgggcgtcatgggagggctctggcgtccggcttggagacgcgtcgttttctgcgggtggtcttggagccaccttgggcgcccaacccgggctgctgagagggcagagccgtgtctccggccggggaggagcgggccggcgggtactgagcaggggctgaggcggcttgggacatggaggcgcccgagcccggcggagcagccggctcggcggccgaagagcacgaacccctacacgcgctcgcaggaggaggactggcggcggcggaacaagacggtcctcacctacatggccgcggcggcggtgggcatgctgggcgcgtcctacgccgccgtgcccctttaccggctctactgccaggtagggctggcgcggcccgccgggcggcccttctggaggggcggagggccggggaggctccctagacctcgaggctccgcgggccccgg

SEQ ID NO: 44657 - DNA, 1396 bp, Bovine  19866880708820
aaaattgaatttgccggataatttttttaaaaatcttaaatacgtttaatacagctaaacacataggaatgtgaaagacaaaccattgacacttgacccctacaaatgttaaaaggaaacaggccaaaatactaagtatctagatcattatgactggagaaggcaatggcaccccactccagtactcttgcctggaaaatcccatggatggaggagcctggtaggctgcagtccatggggtcgctaagagttggacacaattgagcgacttcattttcacttttcattttcctgcattggagaaggaaatggcaacccactccagtattcttgcctggagaatcccagggacggggtagcctgttgggctgccgtctatggggtcgcacagagtcggacacaactgaagcgacttagcagcagatcattatgagaaagttaacaagtatattttttaaggctttcataatggcatgtatgagttaaagcccatgttaatgtttccatagctagttttcaccttgaactcaaagattatgtgatctaatcaaatgataaggctcatcatgcagagacatgtaatatataacccttcaagaatcattgttcttctgaataaaacattcggaggcagttaatggaaaggtagtaagtccattgactttgttattattaccataattaaggcaaaatatagctagctaaaaaggtcttgccaagttaatgaagatttcttaattacccgagtctttgtagcaagccaactttatgttaaactaaatttccccttgtcacactaaacacttaatcagagagaagctcaaagtgggaccctggaattggataagtggaagaaaatacagaaatcacagaatcagactaaacccttcatttcacaagcatgaagcatagcatcctaccttgtagaatggaatacagaatttaagctcttataatgatgatagatggtttcaggctagaatatgaagtgcaaaatatctgtatatgacataggcagagggaaattaccttaataatcttaaaatatatgaatctagctcctttgagaatgcatgtggattttgttggagggtttataattagttctggctttgtagattgactgagaaataccctgaaaatagacacatctaaaagtctcactcaaatatctcaggaagtagagggtgagcattaagacaggttaatactttccttcttaaacagacagagaaataacatttaagaatctatcatgtgcaaagtgctgcattacacacttcatatttgatacatttattttctattacaattctgtgtgtctctgttagtatattttccaggtaatgaaattgaacctgggctgaaaatcaacagcagttcagtagtggaggca

SEQ ID NO: 44658 - DNA, 778 bp, Bovine  19866880723739
cttgaatgtagagagctctttactcagaattggtttttgaccttttcaagaaggtgtggacccttggctgctctgacatgcaaccaagttgttgctgaagttgtgatctaagctcaggttggaggctggcccacgtgcacttgctgcaggtacgagggcactgcagcagtcttaggggagtgagtcatgagccaggaccagagacggttgtgcagagcgttgtggcctgtggcgtcaggtttcctttacatttatttctttacatgcatctcttgtgggacccagagtgtgtcaggtctaacgtgtatctaggctgcctaacggaccaagccccactgaccttctgcttgacatggaatccacatagaccctgatgatttcaccaaatgatactgactcgccaaaatattagagtaaaaagagtctgtgtacctctagccagtctctgtattcattacggtttcagattacaatgcattaaggagtattctccagccaggcttccctccagttactcccaaaattgcaactgttattcagcagagatagaacaagacagacctttgttcttctcttctatgtggttctagttgtcctatactgacaagcctttgggatttgcctgtacctgctagtgctgttaaagacttcccccatttttacattccgtttaccatttccatgggaaggaaggtagaagcctgtgcttatgctgtcgatttaccaggaagtcaacaacttctctttttataaaagacctcctatggacacccagcca

SEQ ID NO: 44659 - DNA, 3797 bp, Bovine  19866880735702
accaacatgaactcaatctgcatttgtcaaactataagtatggtcataggtgcttcacccacaaggctcccaacaccctaaaaggctggcatctctacctgcaacaggtgatggaactggctggccctaaatcccgtagctgataaaggcaagcaagcccttaaacgcagagcttctgaccagccccactgttctttctgcccgctgaaccatcttcagtgacacggccgcaggaggcgggcagatatgagaaggaacgctgtgaaagtacagtatttgtctttggctcgtgaggactggggagtaggtttttgttttagatttttgttttttaagacttaaattggtcagtgtggtcagttgcagttcctccctttgctgtctcagaacactcaggggtatctccctgatgacctcatttcccgcttttgttgctgtgcattctcatgcaggagagctagtaatcgtaactaattagcttgagaattgccttgagataaaaacaaaagtgcttacattacagaattcagtggcttggatgtaggcagaacttgtctcttaaggaaatccctgaactttggcttccagccattgcacctctgacatcatcaagactgtgatctcaagactattgcttttcacttgagcagatctgtggatgcttcctctactaccttgaagaactacctatgtgaaagtcctcactttctttccacataccaaggatgcaaagatgccttaaaaacgtatcacggatctatcaccacacattgtccaactgatggtagctcagaaatgaagaaaatacaaagtgatgagtcaagctataggttccaagatggtgaactccaagaggaatgaaatacagcatctggaactgcctttcttcacccttctagaatgagggatttttgcaacttcctttgtgtcacatttctcacagaaccctgcctgatacaacctcaagcttccatacctcacacctaaaactctccacacactggccctaacttcactccaactagactccaaccacccatctacatgaaacatccgttcgaccccaatactgcaaggtatgtttggcactttttttttttaatcttcctgtctccttgctctcaggagcttgccacaagtaatcccatcacagtctaatgtagatgcaaagggacccatcctccagtccaaagggtctaaattgcctgtgtaggtactgactttatcagaaacacctgaagtacttaagagatccctgagccctgatcccagatgattctgagacacagccaagtttgagaacctaaaagcccaaactcattcactcaatataggactcccttctgtaccatcctaaggcatggaagtcagcacctgcctgaacattctggtatgatcttgaattgcattttttaacagtgctatttgttaaaattttctgccatatgtttaagacagtatcatcttcttctctgcaaatcctactatttgacctaattctgtcatgagaatcacccaaaagaaatccaataactcttcctaatagcagttgttcaaatgtctaaaaatagatctcacctccctttcacttccctcttcctttccccatcaagtcttcaattttctggctaaacaattctaattccttcaaatatagatcatagtttatcatcatcctcatcattcttgccatagctcaatgagacaggtaccgttaattatttccattgcctgcatgaagaaactgagcttatgagagattcagtaactttcccaaagtcgcacagtgggtgtcagagcttggacctgagcaggtctgtctgattgcaaagtggatggccttaactgataggcagccaccaacttgttcattattctttggacagtctccaactttaatgtctctcattaaatgtgatatccagaatgggatgcaatgtttgtgaacgtgtctgcctagcacagaatacagagttctcttactgcccactgcaaacttctgttaatacaggccaagatgatcttagtatttcctggcagttctatcacacgattcactgatatcaaaatccacatggactattgtaaaatcaggcattattttactgcattaattgcctaaaatgggattcctctcctcatctactgcatctagggagggctcggagtggggccctcattccgtttctcagtgcccccgtcccctgggctggagggctgcacctcctttggtacccaaataaggagcaaattttctctggaaaaaataaaaaattgcctgttataagtaaatcaaggaactatggaccagaaatgcaggtgtggatacagtgttagataaggcacaccctgctgtcaaaggagcaaagaaaagaaaggggatggaagtagaagagatgatagaattggtgcccggccacatcgctggtgttataaaactatcaagcacagagatccttcagttcagttcagttcagtcactcagtctgactctttgcaaccccatgaatcgcagcacgccaggcctccctgtccatcaccagctcccggagttcactcaaactcacgtccatcgagtcggtgatgccatccagccatctgatcctctgtgggccccgtctcctcctgcccccaatccctcccagggactcaattcttctccaacgttgtgactaatgttactttgtgactctttaacctttggaggctgagcagaaaagtgtatcagatgcttaaagctaccaccccaatacgtcttatcctgtacctgcaaatctgatttattttaaaccttagttaaggattttctatctgtacttaaattgtaccttatatatttatcttgtgagttttggtccatcttcctaaattttaaaagtgattacttttttgttgagcctgatacttgaagaatcagattctaccatgtcaatactcccaactctgaactctccacaaatggaatgaacatgccctagaagtcattgattaaagtgttaaacagaaattgaccccagacatgaagcattgtgacagagatacaagctcaggctgggagtgggctggcctggcttgttcctccctgtctgcccggaacacagcacaggcctccacatagagtggatgctctcaagctttgcattgggttggctaaaatattcattcaggtttttctataatattttataattatttatttatttataataatttatttattataaatttctatattatttatttatttataataatttggttattttatatattttataatgttataataaattataatattttttatgaaaaactctaaagaactttttggccaactcagtagaaatcaaccaattaagatcctcctccagtttcaaactatagaatattagaatatctttaactggaaaggaccttaaaagtcatttaattcaacattctcccttcatacagtaagaaaatgaaacccaaagaacaattatttacctcaaatcatctccttaaaggaaaaaaacagataaacaaaaacagctcaatagctcaggcttcttattttctaaggcagaacacctcccaacacgccaaccagcagacttaccaatcgacactcccctgttatgtgtgttgaccccataactgcactactgtcaagcctgaggggatccttggaagcccccattaaggcagaagagagatcctttccttttgacttagagatcaaatgctcctgggtgaattcaaataaaaccccagttctttgggtactaaatttgtcatcataaggggaagacttttaa

SEQ ID NO: 44660 - DNA, 1804 bp, Bovine  19866880738073
atatatgaaaaaatagtcattttcactatttgtcaactcagttacatgtcttatttatgttgaatggaggacctgttaatattaaatagggttttactctcagacaacttgtgttctactttcatcagtcaagatcttttttgtcattagaaagtttgggagtaaaatattattttcatgacagtttaacagagcagtaggaaatgctaaatagcctgtggagtaattacagacaacagatattattaaggataaaaggaagggaggacttccctggtggctcagaggtaaagaatctgcctgccaatgcagcagatacgggtttgatgcctgctctaggaagttttcacttgctgtggagcaatgaagcctgtgtgccgcaactactgagcctgtggtctggagcccgggagccacgactactgagcccacataccacagcttctgaagcctgcgcaccctagagcctgtgtgccgcaccaagaggagaacccgtgcaccacaaatggggagtagcccgctcttgctgcaactagagaagaacccgctccacagctaagaccattttaagcttaagtggtctggaaagatgagaaaagataaaatctaaagtagattttgaagaatagatggcagctggatgaaggagaaaaagaggaaaaatatattcacctagtggaaggaataatgtgctcaaaagtattttggaggtgagagagtttagtctgggaaattggtaagtgaacgcacttggatatgttaatccataagagagtcagtgtgctaaaactggaaagactgatttggaacaaatagtggagaaccttcaagtgtagagactgagaatatatttatcgtgtaccatgttcttagcaacattttatctaggtttgtttcctaggcaatatttcaggaaaattgatccttcagaagtatgcagagtacattatagtgaagaacagagtatgcagtgtgcacctatgtgtgaggtgttaaagacatgaataatagcttgatggtaagaatggatattaaggagtggtgcaaacatcaccagtgaagaattcacagtgcctgataactggttaggtatggaggcggaagagagggatggatgtacacccagagaaggcaaaaggaaaggaaggggaagaacacacatcagagacatacataaagttctgtgaattcattttctcctccaacaatgtcatggttaagggatgagttgtagattccttttttgaaccactagcaaattatttgagatcatcccttgagaggaacattaagcatattttaataaaatcaatacttaaggaaactaaatgtagcttgcttttaaacatttttccttcaacatccctcttcctgcagtaacccttaatctttttcacaggctgtaatgggaccaagaccaagaagggttttccaatgagtggatgtaggaagctgataagagaagtattcttttgggcttggtagcataagttacaatacactaaaacatatatctcttggaggcctcctttttctcctgtcagcagttgacattgtgaaagatttactgattagcttaaaaattacagaactttctcagtttagtgatgtggatgtgctgcctaattacaaatgagcaactgcagttagtgctttttccttctactttggggagccgttaaaactcacaactagagaaggggaaggttttacataactgttgctaacgttaaaaaagacgtgcacgttttacttccaaagaactgcttgagtgcctcagtcatttcatccagtctagccctct

SEQ ID NO: 44661 - DNA, 1385 bp, Bovine  19866880751754
tgcaggtgggctagaatcatttaaaagctcagccatatggggaggccatttgtgtagcgccagtcatatgccagaatgcatgaactaggcacttctggggtatcatttcatcctggggctgcagcccgagggaggtcctggaccccttctgcaggtgggcatggaggctccaaggtcacgagggatttactgaagctcatcttcactggcaatctgtcccaggctggctgatccatgccaactcagtatgcagcttgcagatgagatcagaaaacactcatgttttaaaagaaccaaatcttcttgatggatagcatttcctgaccttttcggtggctgacattgtttgggtgtcgtaaatttgatctggcacggaatagcagcggtagatgcaacctctcccaggtggggctgacagcacgtttcccaaggccctcctgaagcctggccagttgtttggccttggcttccgagtgcaggcaaagtctgagcgacagtgaattgtgtagaagaacgagagagctgttgtgttggacaggctcctgatggcaatagttttgactcgctttgcaagcggctagactgcacagtggcactgcttcttggaaaaatcaccccgctgatacatcacagggaagcatgtagggggaagaggcgcagaatgtaagaggttggcactgtctgttccaactagcaaaagcagcagaaagactcgaatgcagtaattctaaccttgttaaactaaaaacatttctcaggtcctcttgggaaactttattttgcttcccaaggaagggagtgaatcggcttcttcgaggtcagtttcatttggaaattttcctttttcactttccatctaattggcacacaagaagagtagacataacctgaaaatgtcaagcaaaaatctggaggtttggaatgagtctcatttttaaaaggtcttcctttgggcttcgctagtagctcagtgggtaaagaatctgcctgcagtgcaggagaccccggttcgatatctgggttgggaagatcccctggagaagggaacggctgcccactctagtattctggcctggagaattccctggactgtatagtctgtggggtctaaaagagtcagacaggacacagcgaactttcactttcactttgggtaaacccattaagaaaactttgacccagggattgcactcttgagaatgaaaactctaagactccaggatccctgggtttaatctggctctgacacttatcttgagcaaggaaattcatttatctgtgcttgttttctaatctgtaaaatggagataaaactgtctacgcataaggttttttgtaaagagtgagatagtcccatgtaactagcacagtaccagtcccccaga

SEQ ID NO: 44662 - DNA, 914 bp, Bovine  19866880763052
tttttgaccggcaaaccctttaagaagaaagggaatgctggttgtccctgcagtgtgggattttagggaaggatgaaggcactaccctgaagagaaaaaggtaaagaagtcagttggataccttttctctttaagttgaagagttactatagttcatcccaattctgtctaaacattctcaccttcaaagctccctagataataaataaatcgcatgatgtgaagtacaaaactaaccttgtcattcttttctaagaatgctaatggattccttaccattcagctatgaggaaaagtgttcaaattgtacaaaatgcattctctatttagtatttcaaccaagaatttcaactgtccattgcctagttttttataatatgaacattcaagtcttaaggttggatactccttcatctagaagtgtgggggaaaatggaagcagtgacagatatcattttcttgggatccaaaatcactgtggacagtgactgcagccatgaaattaaaagacacttgctccttggagggaaagctatgacaaacctagatagcgtgtaaaagcaaagacatcattttgacgaaaggtccatatagtcaaagctatggtttctccagtagtcatgtacagatgtgagaattggatcaaaaagatggctgagtgctgaagaattgatgcttttgaattgtgatgctggagaagactcttgagagtctcttggcccataaggagataaaatcagtcagtcctaaaggaaatcaaccctgattattcattggaaggactgatgctgaagctccaatactttggccctctgatatgaagagctgactcactggaaaagaccctgatgctggaaaagtttgaaggcaaaaggagaagggattgagcggttagacagcatcaccaactcaat

SEQ ID NO: 44663 - DNA, 943 bp, Bovine  19866880766454
agaagcaacatttaaacacttttgaagtacttgtttttgttataaatatttaacatttttagttaaaggtattacaaacaatcattaaaatacatcattaaagatcattatgtcaaatcaaagtgtaaatgaaagtgggaaaataaattttcttaattagaaaatctctttgaaagatttcactagttcctccttttttcattcaaatttgagagtttttaattccttaagtttgttatccatcttcttttctgttattaattaaaacagatacataattttagaaaggtttgctgaagctccagtcctaaaaccccagattccaacatagtatttggcacgtctccaacctaagcacttttgttatcaggatccccaaatataacagcttttctttttgttcagtaatttagtatagttaaatgaaggggaaagaaatgcttgggggcctaaagctggatatgttggtataaagctaaggggagatttgcagaattgacatctgatttactgggtatggttgtctatatcagtcaaaccaaatcaatatatagaaataaaaattgactgtttataattgcaggtgtttttatactgaattatcagaaattatcatcatccctgatcaaatgagagacaattctcatatttcttagcttcttttgatactgatgatcctttactaagttctgttcgattgaaaaatgcaaataaggaatatgtgttcaggccttactttttacatgacacctgtttacctgctgttttagaaagtatgactctataaggcattttcagaatagactctgattcattttaatagatagatatagatgcacttaaaaagaagctaggaaaaacaataggataaattgtcttagaaacactttttgccctcccatctcacagaagatttacctaaagtgagggtttagcactcaaa

SEQ ID NO: 44664 - DNA, 1493 bp, Bovine  19866880778159
tatacagattcttaggtatagcacaagtctgttgcatcttaagttctatggaactatggaatttctatggtagatgtgtgaaacatcatctagtcatataaaagacactgatgtttcttctcacatattacctatggtgccttaatgttctttgtgtataatgtgatatttgtactagattacaagactgcttagggctcaggacaaatctttgtctctgtatgccttccatttctcaacacagttatttgcacatactagatgcttaatagggcttccctgatagctcagtggtaaagaaatgcctgcaacacaggagaccctggttcgattcctgggttgggaagatctgctggagaagcaataacctacccactccagtattcttgggcttcccttgtggatcatctggtaaagaatctgcctgcaatgtgggagacctgggttcaatccctgggttgggaagatttcctggagaagggaaaggcttaataagtatagatagaataagtatagattaaatagcatagatgcttaaggagtatagattgaataagtaaataatatagttcccagaaatgacagtaattattaaaaaaaattatcagaaacattctagccaaacctaatccgttcttgactttaccatctttttctaaaaatgtctttttatcatatgctgatctctctttttggctgacaaaacctgtatttccaggtttagtcacaggttacaattaatcttgtgtcaatatcttttatttctgggaaaccctatgcctgaatcaatacaggtacactatgtttgatggaggaaggagaatattattcagtctaaaagaactgtgagcctagagtatggtatgaaaatcatgactataaaattatcttccccatatgtgtgaagacagaagatatcgaaaaggcctgtgtagttcttacaattgctcatgggtgatttattctacttcaaaatcccttctaagtttttctgaagaaagataaggccaaattacctgctggtgcctaatcttttagtatgattacttaagagaacactttggggcagttttgtgctttgatgatattatggctcattcaccatttaacaatggtgagatgattgtcatttacaggacccatcctccctacacaatggtttctgattaggataaggctgaaattgttgctgattagagtaacacactgtggttggctgtttgtgctccatatctccttctaaaaaggtggcacctgtaaaaatcaataatgcatgagttgagaagctgagatggcatttctgttaagtccagaaggaatgacagaatccaactttctcagcctccaagtttctcattttattcatatcagagggtttatatggagcacccgtgctgggcttttcactctgccagctgttgtggattagacaagagaaatgtaagtcattattcctgccctcaagtagtttagattttattgggtagacaaga

SEQ ID NO: 44665 - DNA, 791 bp, Bovine  19866880824703
cttctgacggggtgaggactccccacccaccgcctctgaggtccgattaatatctgaagccgaaaccagggctggttgatttcctttgagatgggactgcctttcctaaacgtgcgtcttcccacctcgatcctactgcttgccctctccctaacttttctgctcacagctgaaggccggagcagggccctttgatgggcctctccgacagcacagggccccctcccggtctccggcgcaccccctcctcccgggcaggcggcagaacgcgggtcccccttcctgcaggtgccctgccgcctgctgcctccctggaactacagaggcaggcagacgcgcacagaggcctcatgaaacggtaccttaaaagaccaaagggcctttctttcttttgacagaagatgaatctcagaaatagaagagtgattttagaaggcgatggggggtgggtgagcagaaagggggagctggggtctgcgcgtctgcgccctgggcccttcccctcctcggccctccccctgctccgacccgtggtctctcctcccctccgtcgctgaccctctgccctccccactccctcgtctctgccgcgtttctcccttcccacccgcttctctcctcctctctggtgtgctgggtcgagaggggacgtgaatgagcagaggggatggctacagggaatcggggccagagactcaaggcccccagcagacggatggcacggggaacgcccggactccccgacccacctctgcgaccccatagaccccgcagctggtgctctggagcca

SEQ ID NO: 44666 - DNA, 1484 bp, Bovine  19866880934202
atttcagattgaagtaaatgtcttgatggagacaaatagggcgaggtgatagggagcagtgaggtggacgcacttggggtaggtggtcagggaaggcctctctgaagagatgatatatgagatgggccatgaatgatgggaaggaagcagatataaacaaactaaggttcaaatccctaaggtcatacaggctcaagatagtccaagtatttagagaccagtgtggctggagtctcctgactgagtcaaagggataggaggaacagaaacctggtgggcctggtggggagactcaagagttttcagctggagttggcattatctaagttttaaaaacgccactccgggaattcccagtggtccagtggttaggactcagtgctttcactgccatggcccaggttcaatccctggtcaggaactaagatctcacatgtcacaagccacagtcaaaaaaaaaacaaaaaccactctgatatttttatatcaaactgggtgaaaacttgggtaatgatggaaaacaaatgaagcaaagacactgttaggtgttaatagtgtaatttgaggtgactaatggcagggaaataggctaggatgtgtaagaaaaataagtcacattgatttttgaatcagaaatatcataattctttattctaaaactgatggatgctgggaaaaaaaaaaaacaacagagactgaactagtttccctccactcagaaacttctggagataacatatgtttggaagaagaaaggaagcaaaaagtggagggaaattacatcaatgtcatttgcaacatagaaaaagaagagcaatagtttaggaatcaacaccttttctatgttttatgattccacctactcttctcaagaagagatcaaaggttacaatgcaaatgcttaaaggcaaactcacataaaaagaatttgacaataaaacttgatttatgagagatgaaagaaaatcttaaaagaggaaatctaccatttgggacaagaagaaaaacagataaatctagtcttattgggacccactctcaacttgaataattggatactaagaacttccgtgtagttctgctttcttatcagatcaaagtaaagtctttcatgaacagcacctcaactgtataaacaaaattgccccagaattttctttcagtgaaggattctttgttttacacattcccttttcaatcaagttgggcaaagaacacaaaattcttactgcggcttgaattccacaagtgtgaacagtgatgatgtgaaggggatagattcagaacacatacaagtgatgagatggtagtaatgagattttgctactggattagatataaagggtaaagaaatgggaagaatcaaggtaaatgcctcaactttgggcctgagcagtaatggtagatctttatgaaagtaagagccttagaaatgtactgctaaactccttagaaaataagggaatcttaacagttgaacttta

SEQ ID NO: 44667 - DNA, 1302 bp, Bovine  19866880964347
atgaggatgtgatgtgaatgtgtgttaagaatatgataatgcttatgaatgtgtctacagctaagcaataattatatttctgatcatttttcctttttatatagactttatgagctatgtgacttgaatagacctggtgtaagtagaaaccaaagacagatcatttatctgggagagaggaagatggaggtcttaaaaatccaaatacatttacatcagagcttactctgaacctaaaccccattcctatcactggatgaaaggatcaccaacaagcatctacgagaagcaggctgaccatcactgccctagatctaagaaagataaaacaagtccatggtcaagttacaggtcccagctggaagtagaaagcttaatgtggaagagtgaaggctgagttatgaagtggttctgaaaataaatctatacaaggaattaaattcagaatctctctcttctcaaacattgatgagatctgtagcccctattcagacaaagctgctgcctcaaggcagttctatgtaggcagcgtgattcgatacaagactgactgtaaatttagctctataaccttggtcataccacttactctctgagcattatttttgtcagtagaggtaataccacttatcattacatgttgttgaaagtaggaatttaataaatattactttccttctctccaggtaattggagagacagtatttggccactagagaaaaagaactgagagggaaacttcctaaactggggagtaattgcccaaatttccaactggggaacatgcactgttgaaataagctgactgtaaaaaggatcataaaaagtgggaatcctctttttatgccaaaaattggcatctatatcaaatcactcactttaattccatagatattttgttgcatacctactatgtgacagatattgttctgagccctccggatatggggaggataggagagacaatccttgctgtcagaggtcacatagtgaaagtgaaaaagtgaaagtgaagtcactcagtcatgtctgactctttgagaccccatggactgtagcctactaggcttttccatccatgggattttccaggcaagagtactggagtgggttgccatttccttctccaggggatcttcccaccccagggatcgaacctaggtctcccacattgtaggcagatgctttaccatctgagccaccagggaagacataagctatcaggaaagatacttgttcaagaggtacacacatatgagggactttcctggcagtctactggttaagactgctcttccagtt

SEQ ID NO: 44668 - DNA, 2323 bp, Bovine  19866880977992
gctggtgatggacagggaaggcttggcgtgctgcagtcctggggtcgcaaagagttggacatgactgaggggctgaactgaactgaaccatcaataaaatgagtgtaattattctcatcatcaattccacaactagatttaaagcatcttagaaagaaatagggcttccaggtggcgctagtggtaaataacccatctgccaatgcaggttagacgtgagactcaggctcgaaccctgggttaggaagatcccctggaggagggcacagcaacccactccagtattcttgcctagagaatcccgtggacagaggagcctggtgggctgtggtccgtagggtctcaaagagtcaggcacgactgaagtgacgagaaataactatgtcttacacttttcccccatattttatagcattgaacatattttctttctattcttacttccaagaacacagtttgacttagtctaagtatccccttatcttattcctgatgctatgttatccttgtcctaaaccatcttgggtcttatctctaggcaggtcattttgaagcttaatatgtccgagtaccttggagcagttagtgaacaggtattgattgattaattataaggatgattgccattgtcaattatactgaatattttcttatgtcaatactttctatgtcagtcttaagggaaatcaatcctgaatactcattggaaagactgatgctgaagctgaagttccagtattttggtcatctgatgcgaacagccaactcattggaaaagtctctgatgctggaaagattgagggcagaaggagaagagggcatcagaggatgagatggctggatggcaatgccgaggcaatggacacaaacttggtgagggacagggaggcctggcatgctgcagcccatggggtcgcaaagagtcagacatgactgggtgactgaacaaccacaacgacaacattatactgaaaggcagcagagtgagttagcctttgtttagaacacaggacacaatggagatgtgagccattactcgtcactgtaattcaagaatatggattgatggtcaagcaagagagagagggtcctatatagtcagaatcagagactgagatagacccagcaagagactagaaaagacccagacaagggtgagaagtgagacagatgtactttaacagaagtcttcccatgacccacgaacatcaaagggaaaaagctgacacaggtgaaagttgttgagggactgctacttggtattttgagaaagtaagaaggatcacccactgtcataaccatttgaaataatttcttctgggagacacagctatgactatggtttcttgtgaagactgcctttctccagcagcagcagcatgaagtcagctggaaatacagactctcaagccttgccccacattatgactccaactctgcatttgtgactcccaggtggctcgtgtgcacattatagttgagaactgcctgaggacatccaaagatcgggaaagggaaaatcagaagccttgagcgctgatattcccttcacccctttctggcacgtgactccagaaatggcttcttctgagtctcagcttccccatctgtatagtgggaatgacaacacatcccactctttgttttcagaacttgttgggcagaaccaataaaatctgtatgtaaagttattttgaaaactgcaaagggccccccaaaagtaagcttttccattacttagtacatgaggctcaggaggaaacactggtacttcccctggctatcacttgtgggtcaaatttcgcttctgcagtctttctttctagccctgagtaaacttcaccctgtgtgaaggagatgtgaacaagtcagcagatgatgcgtttgtttttgaacacgttaatttctttatcagctctatttattttccgagggcatcactgtattacattaatgcctcaagttgttaacaataccagctggcactgcaggcatcacttatccttatagtgtaaaagctcagagggtagaatggaaattgccagccaaagcccaatgctgaatgtccttcttggtgggcttttaatctccccttgggaacagatccaccattccctgctatgtttccaaagcctttgattcatgatatcaattggcatctctgccatttattttgttttttctctgatagcttttgaggtttgagggagcagagactgttcacagcttcttttttatttctgtctccttggggtttagcacatagtaagaatgcaagaaatatctaggtaatgtgagggggaggaaaataaaaaatcaccaa

SEQ ID NO: 44669 - DNA, 1236 bp, Bovine  19866880980310
aatgccacggatctagcagttcaaataaggaactggaaatacaaaacaaaaaatccaaaaacctttttgatagctattccaaaaatatcatgaagccctgactgtcaaccttgctgattgctcttttgcatgataagaattttattcattcagtaaggtgtgacattctgcagataccctcaatttggagacagtaaatttcttcttttgacgcttttatttcaggggctgtaatagtatttacttaagtatttatccccataattttgcaggtccttctttttcatccaggaaatgaccagcacatcatttctgtctctaaatgggaagagttaaccttgctatactttctggatttactgttggaggccccagcatcagtcccctctgtttccagatttgcaaatgagacagagctgagcattatctcacaactcatgcaaattagatgccagaaaggctattgaaaaggaaagatggtatcatctgtcttgcaaggacattgctcagattgatagccccacatttaacctcctcttttccttcccatgaattaatagctcagctcaccctccctaagaagtcatctgctttattgaaattaaattccagctacattgggagagccactagataaaatctgtcacttatttcctttgttctcctcgactggaaaggtccacagcctgagggagagattgtgctaaagaatgtttaaggaagacttttgatgtgagtggtgaaaggggtgggggctaaaagggtagtaaatactcttccctgattttcaggcacttacgaatctgtggccaggtagtaaagcactggtctcataaactgaaggtcatgggttcaaaccctgtctgtacctggttcttgagcctggatttagtagtgggggctttgctcttcccatgtatactgcccatttcctctgcagtgtggcattttttttcagggcttcccacatggtattaagagtaaataacccatctgcaaatgcaagagaagagacgtgggttcgatccctagatcgagaagatcccctggaggagggcatggcaacccacgccagtactcttccctggagaatcccatggacagaggagcctggtgagctacagtccatagggttgcaaagagtcagacacgactgaagcaacttagcacagcacacatgtatgggcttttagtcaatgatatccctgcggtctctgccatctttactgcgtttcc

SEQ ID NO: 44670 - DNA, 1319 bp, Bovine  19866880991330
cttatggagacactcctttcatgtgagcctgaccccctgttacttaggacatacaggggcgttctcccagcaacagactacagaataaataatcgtcagagcgagaagagagtcaggaggaagggcacagaggcccggtgagaaggcttagctgtctctctgtcatctgctcacagcagtgggactttacaaagtgctgcagcctttctgggcctcggtttcccttttgtgcaggagggtatcatttctgttcgattgggtcattgtgaaaattagagataatgtgtctaagaggtcagatgactagcgctagatatttcttaatgagagcagttatgatcattattctgttcgtgtcagcttccatcatttcttccaatgcttgtcttctgaaataccttcatagagtaactaggtacagtgtataaccctttgttatgtagagaaatgttaggagattttgaccaatagtttttggcttgcagtgttctaagcctaacacttgcactcagttgacaagttatttctcagtcctctgttcatgtataggatgtgtgtcatgtcagaaatactacatttttccccccaaaaggcatgctgattgtcgggtccccacccttaggttcctactgaaaaatcaagaattgggattttggagcttgaaagtcatttgaatcagtattgatcaatgagtttcagaaacttgtgatgccctcctcaaacttgcagtccataataaaggactcctgctttcggttggctgtcattttgttaggttgtggagttaaagatgcttggatcaaagggtgccctgggcatgtaagttcttcacttacatgccttttctcataatggaagcacacttcataaataatactcttcagttcatttaaactcaatgatattcctgacaacaaatggaaaataagttagagctcttcttgaaatacccagggcagataaaataacactgctgttcttacagaggtgataatgcaaggtgaattctagggaatgtggaactgatggatggtaaatcacaggcaaacctgaaaaaggagaaagtccttcctgattctgtgtaatcacagtggtgacccgaatagaaataccaagtaaaccttgaggaaaacaaatcctgagaagggaagagcacagaggtggctgtgaacattctgggaactacagaatctcagtctggagcacgatttctcagctttggcactcttacttttcaggtcagtctttactgtaagggctgccctgtgactttgtgggatgtttaagggcatccctgccctctcttccatagaagccag

SEQ ID NO: 44671 - DNA, 810 bp, Bovine  19866880997764
atagcaatttatatctctggcagcccaaactaaaaatagtcaggctataacagagacagggatagactttaaaagcaaggaagctgagtggccatgtgtgtaacatgtttgtgcccacctggaatcactcaggttaaaaatgaactcagaagttgcagagaaaaagattccttccatgtgacttaaagtagtttctctctaagggcagggtcaagattctggcaataaggaaagggaacagcaagtatgtcaggcaccgtctggggccccatgggatggcacatggttctgccaggaaatttacattttccatttctctctgatacaatcatgcctcccattgcctcctgaagaaatcattatgaagaaattagtcacccaagacctacatgaaaagcagatgtaaaatgcaaataaaccccccaacactgaggctattctcttcgccccaaaagaatgaggaaggttctcaagagttatgggaaacagcacccacttaggccagacacctccacttaaagcaaagccattctgatggtcatccaatgctagaaaacattctaacactgggtgtgtcgcccatgctgcaacaacagaagccccccaaacaagtgccacaactagaggaagcccacgcgtgtgggctaggtcacttcagttgtctggactctttgcgactctatagaccgtagcctgccaggctcctctgtccatgggattctccaggcaagaatctggagtgggtcgccatgccctccagggcatcttcctgacccagagactgaacccgtgtctctttaggtttcctgc

SEQ ID NO: 44672 - DNA, 1681 bp, Bovine  19866881006962
tgtaaatcagggattttttattccatattgcagcacagattccctgtgtggggtgggaagccatggatcccctctacagaaaactgtttatgtacaaaaaggttgcatgcaattccaggtcattacagaagttttgaagcttctacatggattcccccaaggtcatgaactcagatgaaggtcaagtctgtaaatccttgggctccagttacttggccacacatgcaagttagctgggagtctttaagcagttcagatttccaggctctatcccagatgtactgattcagaatcactgagtctgtggtctagtaatatgtttccagatgattctcaaatatatgaccagaaaacagcctttggattggttttaggggaacaccactctaaataatgcccatctaatgaaccagaactcattgctgtcacttctaccagctacataacctctccaagcttctaccttctcttccatagacggagataacaattgtccctatctcatgaggttaatgtgggattaaatattccttgcaagtgtttagcactgggtctgacatgtaagtacccaataaatgttaatttctcactaattatattattaatcatctatgtaattaatctgtcaatggcttcttggtgatagaattgggaatagaatccgatatccagcagactatcaacaaaaatacatgaaagacaggaaacaattcaaattttattaaacattaagaataacagacaaagttttggacttaacagcataaacagcaaccaaaaccatggtgtacaaacacactgacatcaagtgaacttgtacctgtttaacagatgcaatctttgtggtgttgccaaaaggataatggtgattattgttacgtttggtaaggtgctccacatgaaagattttatgccttaactactctcacacacacatacacacacacacacacatacactcctctacatacacttagccctcagcaaaatgtactgcctttagttgccaaatccaatgcatcatgattaaaaacatggctttgctcatttaaaaaatggcattaattgtagagaaaacctagaggagatcttagcctcctcagtgggggcctaggagcccttagaaggaagctggcagactgagagcaggtgtctatcaccttctggaactgctctgattaacacgaattaagttttcctaaaaggaactttaggaataagggaggcaaactcctttgcattttacagaatgacctttgttttaatttgggatgggggtgggagtgactctacttaaaattcttattgactcttctccaaacagactcaagacctttcaaacatatatttagaattgagttcctcacaaaaccggtaagttggaaggaacctctgggctttctagcactgcttcctctccacccagtgctagaattccatctgcatgctcatgaagcaaacggtctttctgcttcaaacgatggtttcacagcggcctgtcatatgtgaagatgaaaggcctgtcactatcctgctcactgtgggttttggaatggtcaaaagcgtccactttctcaagaggaggaagtgattgcttacagccctcccattccctacctatgtcctccaggtgtcacaagcagaaccataggctgatcaatttttgcctttctttgcaagt

SEQ ID NO: 44673 - DNA, 994 bp, Bovine  19866881126859
cagagcaagaagaattcctaatgaaggaaccaatatctccccctctccttaaagaataagggatttgagcctcacagagacaaaatttgaaattattaaggaaaaggcaaagagaagaattataatggattctcagatattccacatgctgaaaaaaacagccatcctaatatttcaacctgacatgtcttcaaaaggcagtgggtgcttaaaaggtgatggaaacactatttcaacaagaaaaccaaagtctgcaagagaaaactcaagtttgcaggagaaaacacactatagttctgatgcttcttacgagacaaaccacatgaaccacactctgaactcaccccatcctgggtggtgttaattatgtcacagatgtgcatgaactggccccagtcttccgtctgcactccaagcaaatgtagccttttctgcaaagaaaaagttaggttgagtttgagctataacagaataaaacatgtctcaaaaaaaagtaaaagtgttcatcagacactcagtcacgtctgactgtttgtgaccccatggactatagcctgccaggctcctctgttcgtgcaattctccaggcaagaatactggagtgggctgccattcctttctccaagggatcttcccaacccagggattgaacctgggtgtcctgcattgcaggcagattctttactgtctaaagcaccagagaagccccaaacatgtctggttttctagaaacaatctgcctggggttccctagcaagcaccattaagtttacatcaccaaaagacagacagtttttttttttttcttcgcacaattcccagtaattcaagaatcagtcaagatccaggttcagagtgctgctgttgccacagtaataaatgacctattaataaaggcttcagggccagaacagcccacctaaatctccatctgcctgcctgtctttcagagaaggcatactgctaagtattttatgcaatttcatttaaccca

SEQ ID NO: 44674 - DNA, 790 bp, Bovine  19866881241333
ttgattcagaaatctagacagcaaagccaagtcagacaaggcaatcacaggcactgcactatgcccaaaagataatgaagagctctggcctctgcgacagtgtgtcctgaagagtcaggacaggtacttttgaggcatgcttctgagtatgtccctgggctccttcatgattcaatgctgtggttttattttaagctcagggaactgtcagcttctgggtgaaggtagcagactacaaactataagcaataatgtgaagggtgtggtggaagtaaacctcaggaccggagtcagaggacctgggatgatcagattctgctgcaatcgatgactcgggcaagtcagggagcttctctgggtctcagtttccccaggtgaaaatgatgggtcttggattagatgttccttaagaatccttcttggagaaggcaatggcaccccactgcagtactcttgcctggaaaatcccatggacggagaagcctggaaggctgcagtccatgggatccctgagggtcggacacgactgagcgacttcactttcacttttcactttcatgcattggagaaggaaatggcaacccactccagtgttcttgcctggagaatcccagggatggcagagcctggtgggctgccatctatggggtcgcaaggagtcagacatgactgaagtgactcagcagcagaaaggatccttctggttctaaaactctgatctttaaatgtgaggaaactagtaatcatctcatcactagcagaatcccaaatcctgcttttaaataaagca

SEQ ID NO: 44675 - DNA, 1753 bp, Bovine  19866881247617
aaggaaatgttcacagggaggactgagataagtagcactgggagatctgctctgtttgtatttgcttcctcagcagttttccttctctttcaaaattttgagcagagagccagctgcaaggctgagcatgcataaacacagttaactgttgtctccaaatgcaacttgcaacatatttcatctgaagcatttcataacgttcagaattattatgctacagaatagttagcataaatggtaaacaattcacatcaagtgtggaattacatttacattgttaaatcaagatgttttcttttttctcttgttcttgagtcttcagtatcatttgtatttgtatcaataatttatatttaactcattcaaaataatcaagacacccagatatagacatgcacacacacacacacacacacacacattatacacacacacggtgacggagtcagttcaaaagctaagacacccaatgcttcagatccaaatcctcttcatgacgactcaagtcctgctcctctcccaccaactcagcccttttcacagtctgcctttgaggtccttcaatcttgggaatacctgatctgtatatacacaattagacagcatattactgtctaataaagcagacattactttgccaacaaaagtccatctagtcaaagctatggtttttccagtagtcatgaatggatgtgagaattgaactataaagaaagctgagcgccaaagagttgatgcttttgaactgtggtgttggagaagaatcttgagagtcccttggactgcaaggagatccaaccagtccatcctaaaggaaatcagtcctgaatattcattggaaggactgatgttgaagcagaaactccaatatctttggtcacctgatatgaagagctgactcatttgaaaaaaccctgatgctgggaaaagttgaaggctggaggagaaggggatgacagaggatgagatggttggatggcatcatggactcaacaggcatgaatttgggtaaactctgggagttggtgatggacagggaggcctggtgtgctgcagtccatggggtcacaaagagtcagacacgactgagcgactgaactgaactgaactgatatacacaattcttaccttcaggcccgatctcttagatacttgagagtccaagggaaaaacaaaggaaatctaaataggtattgagtataagaagtcatggcaggtgtttatctatggatgatttgatttaaatctttcaagagtctagccagtctgatactgtacatacttgtataaacacagtaacatccatttctggaaaacgataaatagaccataggtaaaaacttctttccaatgagtttgctgagctgggacaatgtaattctggacctgctggaacttatatttcctagctacaggaagaagttcctctgctgtagttgtggataaggcagaaaggccagctggcatgctttcccttctgtatgcttttgcacgtgttgttctctacatctagaacacctcttttgcttttccatacaaaaagaatcatatagctaattcctatctcatttcagatatcagctcctgcaggaactccgtcctctttccccatgttggggttacatgtccctgctctgtactctataagcatcttttacttacacgtataattgaaatcatcaacagcactgcaattaccatctactgtttttcccatcctctacttgatgggatgtcatacagaggagcatat

SEQ ID NO: 44676 - DNA, 3003 bp, Bovine  19866881364767
aggctgatcatttttgcctttctttgcagtctagtcaaaggaggatgtgaccttgtcagaagtcctaggctgctcattccaaatcatgtctaaatgatgttggcataatatgatttggattcatttttaatggccaagtaattaatctctgaaagatgcttatgatgaaaaggtgaaaaatgacaacaggactcttttaatagctgcagtctgcggaactcatctgaccctggatgatccaagtcattccaaatcgggccatgccttctcatgtcatttagcaggactgctttatttactagctgactgccctggacagaaggcagtgagttcaggggttgagtgcttgtgtgtggtgacaatgacctacatataaggcacctgtacagactccaaagctttaaaaaatttaaaacgaggtaggtttctgaaacctcccctggcacgccaaagaataagttttattatgatctttaaatttcttctgcagaaaacatctgtgatgctcatcagatacaagcaacctaatttcagaaagactagtactcaaatacagttttttcagttaccattttaaacttcaatgaatttggattgtcttcagtacaatccttcaatacttctccagctttcttgctagacattgaactatttaacaattctgctgcagttagtctctttacctataaaaaggccaactccatgcttacttgtgtctctgaataccattaaattcagttctgcttaagtttgatagaggttttgtttattttattagttatttacccgaacaaggttatttcaattccaatatgcgtccatctcccatcataacctgtagcttcagataaaaagggatatctgtaggaatattccactattcagattccccaagactataacagtaagagagaagcattgctaacagattgataaggagatcaccattaaagaaccaataaaggtcattaaagaatcacatactctggacacaggaaactacaaaatcccactgataaaagggtattttaatcttgcagaaaatgtttctttataacaacagcaaaatctcttaacacaagttagtgaaacaaaagaacaatcacctttaaagtcaagacagcgatcaaattataaatcatacacatagcaccgatattaaccttatactgtgtaagatgcatgtgcccacagagaagaacagaattttgggggatgcttgcagtgatattcatttttagaaactcataattttgaagtgaacatttctgtggcagatgcttttcctaaaaatcactgtatcatccaataaatatttgactaacatccattttgtggttttgggttttctttctgagacctaataggaaataagaaaactccttagatattttagagcagaattcgtcacagcaagcttcgatactgttgtaaaattttaatttaaagcagaaaacatgctgatgtgtcagtgacaaaattaaaatatttaagacttcaaaaacccccaagcacttctctgtacaacattgatgaatatatatctttgctatataattttaaaacatggaatagttttccttttctctttgctatatataatatatgtcttccaaaatacatcgtcagtatttatatctgaaaaatactgtacaaaaagaacttcctataattactctgtataaacattaaacaatttaataatctctccttttggtctacagtaaacacttaaattgatcggattaaccacagtttgtgacaacaccatcccctttggagatacaccagtgtcttttacattcatttttcagaagtccacttaataagagcacatacgttcaaaagaaaacagagaataagaaacataagctccagaatcattaatttatgaagcattcaaatatgacaccactaagaaaaaggggttttacgaaacatcaacttattaacttaactgattttttaaaacaacaaggtataattcacaaaaatatatacattaccaaaaaatggggaaaactgaatcttaagtaattgaattgtattgaatatcaagagggatgtcgaaaaagttaactagaaaattggggttgggagcatgggaaaagagagaaaacaaaagcaaacacatcaatgtcaaaagctgttccaagatgcattttttggctgtacactgataagttaaccccttgttcttagacctggcgtttccctctgcttcccggtcctggggatgttctgggcatgctcaaatacattactgtaatttttgctttttaaaagacagtgaaattctcaggtagggaaaatatcctacttccactagtaatactcaggcagcatgctctagcgtacaataggattattgctttaggtacagacagtgcaaaaacacactctgtgttctataagagtactcttactcgctggagttggtagagttaaaaggaaacttagtagagagcagttaagtaaatatgggatctagtaaatctaaacagcactttgaatttgaagacgattatcaccaaaacttaagaagagaggaaagcaacctataactgaatggagctgcagtgtagtgctaaattactctgtgcaccttattagcatggtaacttacagattaaacagaaacaagagcctgtggtcttgaaaaccgagatctactatttcagcagggccctttttagtgaacccgagaaggtcctgaaagagtgggcaggagcacacatgaagccacaggaaaggagtggggtgagggggcggggaccaggaaacccgcgcggtctcctcagtccagtaaaaacatggcacctttcgtttcaaaatggcgggcgcaaagggatgtacaagcgcgcacacacactcgctgaccacacaggggcacaaacacacacacacacacaccgcgctgaccacacaagagcacaaacacacacacacacacacacacacacacaccccccccccaaaacgtgagtccgtcgtgttgctgcg

SEQ ID NO: 44677 - DNA, 871 bp, Bovine  19866881369415
ttggcagttttaccatcagcaaattctgccttttattcagttgaaaaatttctctaactgcagtgggccctttacagcattggggaatccctttgtccctggctctgcctcttctcctagtgttctgaaaacctgttctgaatcttcacaattctcttcaagtcctccattccacttgtatttcccacactcagaagatgaccttccttgggacattctaacttctcaggaagcgtctgctgggtgaatatctcttcctctaccaaatagttgacatgaatgccctaaggattccagattctatcctaccaatgatttttaattttagtcacatgtcagaatcacctgggagctttaaataaagatgctcagaccagtgaagtcagaacttcagagggtaaatgtgggaaccagattttggtatcattcctcttgggcactggtatttttaaagctcttcaggtgattctgagataggaggggggtagggcacaaccttcaaaagaatgacatagctgttgagggcactacagaaactggttagaaccaactaggtccaagatggtgaaagattcaacttcccgtaaaacttaatcctcattgtactcattataatattgatccattagctaaatgacataaccacatagccacaggccctgtggctagccatagaagaccaaaaagtggttggtggctcaattcttggaaattcccactccttctccaaaatagttggaatgaactgttgaaattacccagcccatataaaccaaacaccccatatttgggggcgactctcactttctgggatggacagcattctgtctgtggaatgtgtatctctctaaatgctgggctaactcttaaa

SEQ ID NO: 44678 - DNA, 1155 bp, Bovine  19866881529154
ccaattacgacccttaatagtactcgggtggagccaagggatggaaaccttgtgttctaaaggagtacctcccatgtatgagcagtaaaccctttgcaaccccatggactgtagcccaccaggctcctgtgtccatggaattttccaggtaagaatactgaagcaggttgccatttccttctcctggggatcttcccgacccagaaagagatcaaatgtctcttgcaccttttatattggcaggcagactctttaccactggcggcacccgagaaggccgacctacccgtaactggaatgtaagagaaggggctgcctcaacctgaacctgttctgttggcatgatgaggataaaaatgtactcatttatagaaatatggtcaaataattgcttgcttacttcaacctgcatttctttacatctgactaattattctcaaccccattacagaaatggaagctaagtttagcaaattatttggccatttatgtttagtccacaaaattcttaacaaaataaaataccacaatccaaggtaaatcaatttactaagctttcaaaattcataaggtattttgttttgtgcaagagctacttgcaaacccctgctgatctggcactcatatagcaattccctgtagaactgagcgaaagaatgtaaagggagccaattaatgaaactttgagcccaaatagataagcagaggccatcttgtccatccttctacctccaggcaaaaaccatccgctgcaccacaagttttggcgtgaatcctgctgacaaaaatgctcaccacatgtaaatgacaagtcataatccatttaatgcaactaaagcagattgttagctgaagacttatttattgtgttctaagatgttgaatatgaaagctcatctgaattgttttaatttcctccttctcgacaattattttatacaagaaacatgctcaaataattgtaaagcagtgggaattctatgcccaggaaataaagttatctttaccatcttattaaatgtattttttgtttcctttcactgtaggtctaccttacgggtgggaggcagcttacacagcagatggaatcaagtacttcatcaagtaagtacaagcctcccaaccaagtaagcatttttcttcacatctggagag

SEQ ID NO: 44679 - DNA, 1025 bp, Bovine  19866881629263
ctattacttaaatagtccacatttaacctagtcttagaaacattgctgtcacaacagtctgcacataacatgactgtgatgtggtgcccgaagggacatcttactttaacagcccagccaggcacttgattatcactgtatggtaaatggcttcagaataataactctgatacagacaatcaaatgctttcattagtttactgtccttttttatttagagcagagtcaggccatattttactttaacatgggggtgcagtgcaactttaaggccattgtagacaactataatcctcaactgggttcctcagtttctcatattagcttagtatctaggagaggtggctcccaacctagattttatttggaaacagtatttgcaccttaaaaccaaggacaaaagtacaaaacatcagaaagtgatgagaagtcttgcaatgagtgccagtggagggggaaaatacaacaagtaagtttggaaagaaaggtggaaagagtatgggatcaactctgttttatatgccaggtatcaggacaaattggcttataaaagaattatttgttcctgtactttataggtgaagagactgaggtgcagactggttatgaaactcatcaagatcatgttgctgataagaggcagagatgggatttgaacccaagtaatctgattctcaagctcttgcttttagctactatattcctccttctattacgtaagaaataacataaaagtgttagaagttttaagaagctgaataaaagactgaaagtgaaaatgtaaacaatgatggcctcttggtggtggattatgagcaatttctcctacttattccttcttttcaaaataacaaaaataaaagttcaacacatttttatgtcagcagacaataacataaaaatcttgctgtcctaactaacattttccctttgatcttagaactttgtaatgtaaaaaaccgcacgtgctacatcgacactttgttgacagctcacagagcacgctgcatcccgcaccagaaagg

SEQ ID NO: 44680 - DNA, 3862 bp, Bovine  19866880394578
tgggctttaacaagatgggatgaagggtactggctgccttaggaagcagtgagcttcctgtcattaggaatactcacaaataggctatttttgtctcttagccacgacattgtaagaagtgagtcaaacatcagaaaggtggttcaactaggtgacttttatgatccctcccaaccctgagagtgtaggagtttgtgagtgagacagatgtttaacttcttgaaaggcaaactactgcatgggtgaaaaacaagtgaggaattatttttctgtctcacacacacacacacacacacacacaccacacacaccacacacacacacaaacaccctgtgggagtggaatggcctaagctcagatgccaacaaaaggcaagtgtgtgtgtgcgcgcgcctctatgtgtttttatatatgtgaatgtgaggaatggagataaaggaaaggtacgtgaatgactaaatagttacacttcagtgtgttgtaacattttttaaactgggggtataattacttcacagtgttgtgtgagtttctgccatccagtgaagtgaatcagttataacacacacatatcccctcttttttagatttccttcccacttaggtcactggtgagcactgaatagagttccctgtgttatatagcaggttctcattagttatctatttgatacatattactgtatatattaacattttttttcagtgtaaagagcattctagggtggaaagtcaaaagaagtctattaacaaggcaaaaagggagatagatgtacttccagaaaaaggaaaaacagaagaaaagacaaagacagtaaaacaagtgaacactgttctcacatctttctcctcttccttatctgtaatttttgaatcattgggtaattgttcaggtctcctttgtctagtttcagagagacagcagttataatggaaataaaattgttaataggtactgtttatagaaattgacccaagtgtacacacaaatacatatatacacataaacattttatttccccaactctatgaaatagaggctataattaagcccactttacagataaagaatgaggcacagagaaattaaataacttaacctaaatcacacagctagtgtgtagcagggtcaagattcaaactcaggtagccaggttctacaagccagcatccagccaccacgtgccccctgcctcttagcaagcacactgtgggaagctggctttgaacacctgccttcaaatttatgtgtcagcgcctaaaagctgtgtgattttggaggaaccatttccctgccctgagccacagattcctcatatataagacggcagggctctctttcttacagggcacttatgaagatgaaatgaggtcttgttggagtctgaaacgtaggaaaccctggtgaaatcacagcgattggtacttacttgcttcagacttaaaggccatagaattttgaggcaagaagcctgctaactgcaattaagctgtgttataaagctgggccttttagaaaagttgagagccgatcaggaaaaataccagggtggaaatgaaacctcccccaagccttcaagtgctgtgaaggtgataagaccacttgctaccagaaggtcctgttatcctcctcagagatccctaagctctggtaggactgggtaatcttaggtgataagagagatgtaaggaattacaactcctgataaagcactgtggtttcgtttgcccatgcttgggtgagatatgggtgacagagataaagagctggcagaagccccaggtgggctgaaaatgactcctcatgcctgggagggttggcggggggtgagggggcggcgggcggcctgctactgtatttattctgcttatctcagagtgtgggcagagccttccagggcccgcttaggtggatgctcttgaaagactggagggggagcttgagggcgtgttagtcagctaggctctctgcagggagctccgctcccctctggtctcaaatgccaaaccaagtcatcatttgacggcattcctatatggaggctttacaagatatgaccttcttccaacagacaaggatcagatagtcacgtggaagggtcaggcatactcccaactggccggacctcaacgcagggtaaatcagaccagatagggtgactggtgacgtgtggtgggaatgctgaaaagagtggttaatcctgcctgggtgagatgcaggctggggaagagagatggggaaagccttctgaaggaaaatggcctctgagcagatccttgagtgaagaataggtggggtgttgataggagaggaggaggaggaattctctaggctccagggacagccatcacacaagtgtggtggcattaaatgcccggatcccttcagtatttcctggagaattcattcagtagcaaggaagtttgtaattttaccagattttttctagtctcctttatcttcctccttccaaactacatacaacagaaaactacccctgcataccagtatatatgttacttaaagaagtgcagataatacaatttgctgaaaattgaaaaatatttctaaaaatgatgctggcaagagcgagaggaaacaggaatgttcatgggaatatgttattgtttagttgctaagttgtctctgactgttttgtgaccccatggactgtacagcccaccaggttccttctgtccatggaattttctgggcaagaatattggagtgggttgccatttccttctccaggtcatcttcttgatgcaaggatcaaaccgtcatttcctacattggcagaagagttctttgctgctgagccaccagggaagccacatcagtcagtttagttgctcagtcgtgttccaccttttgccaccccatggactgcagcacgccatgcttccctgtccatccccaactcccggagcttgcccaaattcatgtccatcaagtcggtgatgccatccaaccatctcatcctccgttgtccccttctcttcctgccttcagtctttcccagcatcagggtcttttccaatgagtcagttctttgcatcaggtggccaaagtattggagcttcagcttcagcatcagtccttccagtgaatattcaggactgatttcctttaggattgactggttggatcttcttgcagtccaagggactctcaagagttcaagagttcaaaagttcaaaagcatcaattgcatttgctttaatgctctgttgtcctcttgaaattcttaatattttgaatgagaaacgtttgcgttttgcattgctgctgctgctgctgctgtcgattcagtcgtgtctggctctgtgtgaccccatagatggaagcccaccaggctcccctgtccctgggattctctaggcaagagtactggagtgggttgccattgccttctccaatgcatgaaagtgaaaagtgaaagtgaagtcgctcagttgtatctgactttgcgaccccatggactgcagcctaccaggctcctctgtctatgggattttccaggcaagagtactggagtgggatgccattgccttctccagcattttgcattggggccctgcaattatgtagctgggtttacttggggcactgggccatctttggagacctgagggttgggataaacttcactgattattcctgacccaggagcacttgtgaatagctgtaatcagcagtcacacagtctggaaagattagtagagagctgctaccctacctgagcaggagtgcccctccccacacatgataaggttggagtaaacagttgggctcaagttttgaatcttgaggtggtctagtggtaaagaatctgcctgctgatgcaggagacacagaga

SEQ ID NO: 44681 - DNA, 1164 bp, Bovine  19866880415790
actaaaatcctgctattaattttataatgcacaaattttaattatggagatgacatatttattgggcaataacttcaaaaatggatctctaacgaagacctggggtttctagcagtgcatttggaataacttgagaatcagggtatggctcaaaactcaaaatgctgagcgtctagtggaaatggaagaaaggaatggggtatgccattgagtttaagactgtggttttgcatctattctcggagtttattaattccatctttgctttctgctcaaataaaacttttctaagacatgaacaacatcttttagaaactttagttaggcagaaatttattatttcattcatcttccaggacagttttgttatatgagtctacaacacgtatgtgacaagccgtgacgttgtatgtgatgccgctggcaaaactgagtagattagaaatgactgtagctactggcagagtaaactcagagctgtgggagcctattttctgtcatggttctgaaggacaggctggctgtctcaactacttttccatgtattaatagcattgctctatttttacatacggagtgaaacatccttctagaccagaggctacaaaatagtgacagacagacaggcagattcacacaaagtcatactttgatggccagcacagtgtttatcttttcaaaattgaattggttattttaatggaaacttgacatgctctttatcatccattcctttgaatcctcctcttgttttgttttctgccttgtaagttcttatttctccaggatagaagacatataatccttcccccaggatgccttgaagcaatagtatgggttcacccggtcagatacactagagtgaggcttcagttcaaaagtaagcgctgcaagccgtccgctccgaggaaggcacaacagcagcgacagcccttctcgcgtagtagttagcatggatggcgggagttttcgcatcagcgcttattggtagctacagtagtctcttcactagcccagcggcagcccttctcgcgtagtagttagcatcgatggcgggagtttccgcatcaacgcttattggtagctacagtagtctcttcactagcccagcggcagcccttctcgcgtagtagttagttagcatcgatgggcggggagtttcag

SEQ ID NO: 44682 - DNA, 2507 bp, Bovine  19866880419811
atctatgaaccgagcagaaggctctcaccagataccgcttctgctggcaccttgaccttggacttctcagcctctgaaactgtaagaaataaatttctgttgtttatataagtcacctggtctacgatattttgttaaagaagcccaaacagactaagacatgggggttagtcaacatagttttggatcaccctattcaacccacaagtgccttaatatctttttcctttcttgagaagaattgaccaggtgtggagaagccacgatccattccagttctaaggacggcgtctgaaatgataccatatgacagtgctttttggtgttattattggggtttggcacatgcccgttatatacttttgaccgactgtgtggacaagtaacgtggcttcgaagagccttgccacctttatctcatctgggcatcattgaggtgtgaaagctggatttgtgagctgaagccagaaacagcctccttcagggttatgtcacctctgaactgtgtaccaaagagcacagcaaagcaggggaggctcgaggtgggagaatgtggacaagataccttttgatgacatcatatgtcttattagtgaatttatacaggattcagaatctttgatgccagtgctctgggagagttgggaggagcattaatgatccatctactggtttatgtttctctgcccaagttcccaagttttcccactttttagccttttctggtccctgagatgaacatcatgtgtgcctgacccactgtctacccaggcgagcctgcctgtctcccctgcccacccacttctctgtccattctaattcctcccaccaccaagctctaccctcattcatttccacagtaggaattcctcctcttatgatatttttgcagttctggtaaagaatctttcaagacatccatgtgttccacctcctgataaacttattttattattgcataacccctgaacatttttggcattatatgtgatatctccccaaccagattttgagcttctggtggccagggacagtgtctttctctggttccataaagactgagtcacagcgggtactcagtgtaactgaccaatgaaattgcaaaaggctacttacttccaaacaggaattttctttgtgattagcttcactaatacatgcgttcattaaaatggaaatgtggtcttcaaataaaaagtcacgtgagaatctcatctcgtattacttctgttaatcatatcaaatgaatccttagaacattctgccaacccaggaagagggcatgtctacctccctgatttttataaaggacaatcttgtgggttgtgattccttgccaagatcctatgatacttaaataagtacaaaagtaaaaccatagcatactggatgcggttggatgtcttgtgggaaccagtgaaaaggctggtttcatatcaagattgcgtttagggctaaaacagaacagtgcaagcggacaagtgacctgcaacatctggatgagacaccccataaagctgtcaagatggttaaaggtagtaatgtatataaagctctagggctacattgatagtgatcatcatcgtggaggaagtgccatttactgactgtgtatatacctatatgcatacatctacacagtggaattagacactattgaaatagatttttaaatttccttaagtgtgcctatctggagactcacagaacaggtaatgttggcttgatggtcctcaggaaattgaaagaatagaatcttttggtagcatataagtggacctggtgtgtagagggctgaacctaaatgccaaaatgaagaataaattctaattctttgattataaaagccttctttctgagcacagcaccttgccatctgtctttttaatctctgcagggaaaacctgagcccgattccaaactctctctctccataatgggaaatctctctgtgtttgatgaacctaagtgaaaaatgcagtctcatatccatgtatttattaaatctctggtttcataaaggcctcactccgaagtaatgttcaaaataaattgcttccatgattgtattgttagaatgcacatgtatgatttcttctccctgcattctaagatgacaatgtatcttgaggaacgttaatgatgcaaattcaaactacctgggcaatcagcaacagacagatcagaaaattgtagtgattggcctaaagactctttctgggtccttcttagtgccaggagagctcagaggcctcctcaaggagattcagctcatcactttttttctcctgtatggagactttaagtcagaagaaaatgatttttgttcagggtacagcagttcttccctgtgcttggagaggggttcacccaagtgcttctgcaagatgttaaatctgccatcacagccaacaaaactgcctgtggatctcacagatataccacatccctgacactcttctcttttgccaggggttcatgggggagtgtggctctctggttgctca

SEQ ID NO: 44683 - DNA, 1518 bp, Bovine  19866880437826
ggatgagggtcccttttgctgtaatcacaacagaatcataaccaaacacgctaatttctgtcttctcctctgacatcagacctgacttgagtgtcaagatattcaccaacgtgttacaaatcacagtttgaactatcagtctgcccgctactaagatacaggtaccgtgttttcaagtgctgtggaatattgacactaccaacaggctcctgcttatttccagagcggctcagctcccccagcagcaggaattactgtttgaatcaaagacggtaatgatacttctcattcttgctcatgcaaagcagcgaggcctgagcccttctgttttacactgcacactgatttggaagcaaatatttttccaacaacatcaccaaattgaaagcacttagaaaaatctgaagccttcacaaaattctgttttggaaaaaccaactctcggggatctgtcactgacataagccattcccctcagtttagcttgaaaacgagaacgtgctctgtcaaacagctctaaataatatatgtatttgcagatgtaagctgagcacagggcattccaagatccagtagaaaggtggggagtgagggcaggaaaaaaaggtgtactttccattattctcttcttaggtaccaataagaacaatgatatgttccagctttcaatgtggtttggagcacacttactgtgaataaggtatacaattgggagtctaaaatgtttgatcagatatgcatgtttaaagttataattcacccaatgggcttccctggtggctcagatggtaaagaatctgcctgcaatgcaggagacctaggtttgatccctggagaaggaaatggcagtccactccagtgttcttgcctggagaattccatggacagaggagcctggcgggctacagtctacagggtcacaaggggttggacacaactgagtgactaacacacacacacacattcctaaactttgctcactaaagctgtgctgattcacactcccaaccagtagtttatgagcacgtacccttcctcacactttccaaaactagaggttaaaagatttcattttcatctatttagtaagtaaaatctgatatctatctaattttctatttccctgagcactggggagttttaataatttttcatatatgtattggccatttgtatttcttctcctttgatttgccccttatgttctttgcttggttttgttcatttttttttcctgattatttataggagatttttatatatcctgcatgttaatctttaatctgttcaaaatactgccaatattttaattgtgaagcttctttttaaacttagtagtgtctttcatgagagaagtttaatgcaaagtcaaatcagtttctttcattatgtctagtagatttgcctaagaaagcttttcttatttaaaaagtattaaatttctaaatcatattttcttctattatgtttataatactttttggtggtttgaatcttcaaatcatcttacattagttt

SEQ ID NO: 44684 - DNA, 1492 bp, Bovine  19866880512199
tctggactccaggtgctcagagcacgacctggagggggcagggctccaggtggccacgccccctagtcctctctgcctgcccctggggagggtgcaaccacaggaggacagagcagggactctaaaccggcgattctctgactctactgtgagcaggactcacctgggatccagagatcctgagtcagtgggtctggggtagagacaaaattccaactgcctcccaggccagcctatgctgccagtccacatgccacacttagaatagcagagctctggggcagagtgggcagaggtttcctatagaggaccaggaaatacatttccaggattttcacatcggatgatctctgcaacccctcagctctcctgttgctgctgctgctgctaagtcacttcagtcgtgtccgactctgtgtgaccccatagatggcagcccaccaggctcccccatccctgggattctccaggcaagagtgctggagtggggtgccattgtcttctcccctcagctctcctagtggagcacaaaggcagccacagacaaatattagtgaatgaggatggctatgctccaataaaaccttatttctgaacactgaaatttgaatttcatataattttcctatgagaaaatattcttctttggattctttcaaccatttaaaaatattaatataaaaactgttcttagtttacaggccataaggaacagatagtgggacagacttagccccaaatctctaaaaccaaaggatgttttaaaataaccacagcatcaatgtccaacctaaaaacaattagcaataatttttaacatcatcaaatacccttgtcgtcttaatatataatcactgtttaatctgtccttttatcttttccctgtcccacagtagttcagtatcctgcactctgtaaatgttgtcatactacttaacaccagtagatggcactgataatcttgacattagctaacagtttacacaacggagaaggcaatggcaccccactccagtactcttgcctggaaaatcccatggccggagggcctggtgggctgtagtccatggagtcgttaagagtcggacacgactgagtgacttcacttcatttgtatgcaatttgcaattataaataaatatattaacgcaaaaattgaaaatagcctgttgactcaatttttttttaaagaggtaacatgggaagctcctgtcatctttactaggtcaacaatttttagtgttaaataatggaggcccttatgtttttataattttctgtttaagaaaaaaagcaaattgaatctatttgcacaaatgatctaagttaaaactcattataaatgtactatctgaataaaaacttattttccaaacttgctccagtctgttgtgaagaatgaagacttaggatgtgaaatttggatggaatctttaagcccatctagttgacccttcctcagctaacagcagacttatatcacattatgaaa

SEQ ID NO: 44685 - DNA, 1016 bp, Bovine  19866880591040
ttttcttttacaatggaaggagggcttaagaatggagtgatatccaaggagaaccagacccgttcttagaacagtcggcttcagaaaagaatggatacagaaagctgatgatctgcaggatgcttcccactctgtaagcccccattcctacgccccaggccccctgacaaacctttgctggctcccaggaagagatatctaagtgtgacaaaattaagcacagtattgtcggagaaaggagagaaaaaggtcaccccttgaacaaatcattcagattgacatggttctactttgcctcagacatgacttctttgtcaaagctgctaacaccaaatagccaaagaagcctgagatacagttcagaacatgaaactggatcttttgtatattctaagattgagtctacacaagagcgaagtgtcggatgttttgtctccacgttgccagacatatggattgaatgaagattcaactaaatggacttaatgatcgtcttgttccctgtcttgaggtttgctgtgactcctcctggctgtgaaagcaccctttgatattaggagcagatctgagcatgaaatcaacagtctgcacagaagaaaagcaagcaagctttgctcactctttccatgagtgtcctttcttctttcctttcttcatctaagccctctcagagactgaggcacaggccgcgttgctccaaattaatctatgcgaaaaggacaaagaaggtggcccctacgtccaccgcctgacataggtcttcaggtcccatgtgggcgcatcctctttcctgctcactctccctcctcaagacggctgagccccgctccgggtaatgtctcgacccctgtggtctctccccgagttaaaggaaagcaggctctatctgagcgacaaagcaacataatgagctgcgtcttgttgagggctctccaggtcccctaaaatctttctcaaatgtgattgtttataaaatgtttataaaaataaatagctttcaattaaacaaaatttca

SEQ ID NO: 44686 - DNA, 2359 bp, Bovine  19866880601667
ctagggtattttccgtgagttggctctttgcacgtatatataggcgctagtggtaaagaacctgcctgccaatgcaggagctataagagacacaggtttgatccctgggttgggaagatcctctggaggagggcatggtaacccactctagcattcttgcctggaaaatgctatggacaaaggatccttgtggcctatagtccgtagggtcacacagagtcagacacaactgagcaacttagcacacacacacacacacacacatatattcatgacggccacttgggttgtttgtgtatgtacacacacacacacacatatgggttttgtgtatatatatatatatggattatttatttataaatacattcagtggaatattacttatccataaaaaatgaaataatgccatttgcagatggatggacctagagattatcatactaagtgaagtaagtcaaagacaaatatcatataatatcacttatacgtgagatctaaaatatgatacctatgaatttatttacaaaataaaaacagattcacagatatagaaaacagactaatggttaccaaatgggaaaatggggcgggggtgggataaattaggaattcggtattaacggcccggctatacataaaataagcaataaagtcctactgtatagccctgggaactatatttaagatattgtaataacctataatggaagagaatctgaataagaatatgtatgtgcatatgtatatggataaccacctcacttggctgttcacctgaaatgccaaaaatgaactatacttcaatttaaaaatatggctaaaaaaagcagccattagatggtctccttggtcgttcatcatccgcacttcctgacaggaaggaacagatgccgcgtgaagatcacgctgtcgtgcaggtcgtgggacgattgcgcttgatggatgtcacccctcatggaggctccaggcagacaactggccatggcaggtgcggggatgtctcttaacgtggcctcgtcaatctagacgtcgcagactttccaggagtttagccacctctgaggaaatgctttcagtggtaatgccgtgtttgggaaaatttggggagtgatttttttgggggggtgtaaaaatgaatgccacagttctggaagcaccgcaacattatttatctatcaacctgatgaaactcttcatgggcgagcattttctcttcttggaaatgaagagccatttgtttgatgaagacattggctacagcctctgctctctctgtggtgactcaaagggagacagtctgtgtgggaagcagtgaatactcaacagtcttcctggaagagcctgggacccccatcacggagctcctctgaaattcgagagttcacggttggtgtggtcattggagaagaaagcggtttccttttctatataatttgaagagtgcttcaggccctctgtgtccccactctctagccaactaggcttacaaggtatttactctgcctgccattggagctctgaccctttgggttaagacatcacaacttcaggagtcccctcctttataatgaggctcacttgggagcctgttaggtgcatgtgtgtgtaatataatagtacgtgagctattgtgacattactatcacttactaattctaaagagaaatcatgaaaatggagttctatcgaatgacactgaaaaccttgtgttatctacaaagtggactcatgctagaacaagggtcattctaatacgcagggatctgaaggaacgtgggagtgagacccaccccgggagagaagggaaagtctgtctgtgtgaaggagagctcgcttgagaaggatgacctcccaccatggcattttctatggagacttgaaatatagtgaccccagaaaacagagaattagaaagcactgtcgtgtctgaaagtgttccccatgggagacgggacatctgttcatatgattacaaactcagtttgggtctgtgcagggggtgtatattgtagtgtgtaggcatgataacttaaccttgtttattaagggtgtgataactacctcagttgtgtgcctggtaaatatgccttagtgaatagtgaaagtcactcagttgtgtccaactctttgcgattccacggaattctccaggccaaaatacgggagtgggtagcctgtcctttctccagaggatcttctcaacccaggcatcaaacccaggtctcctgcattacaggcagattttttttaaccaactgagctatcaggcaagccccaaatatgccttaaatgaacataactgaattcgtgttttagttcagactagaagacactacaccgttccccaggaggctcc

SEQ ID NO: 44687 - DNA, 1635 bp, Bovine  19866880627872
aaaacaggcctccctgggcagaatcattggcacctagtgacttataaaactgagatgacaaaaagaggctagacagttataagacacacttaccagtcacccatgtgtgatcccaaaataaagcttctaaaaataaatcacaatgctttcccatgaaaaataatttgattaataatagatattaccactagtcattcaagtctttaaacaccatgagccatgtgaaaggtctaagacgttggatccactcctagctcagtggactcgatctaaatggtaaatgtgagatattattatctgagcctccaggactgccttggcactgggaggaatggtattgcaatctctgatttaatcctcccctattttttttttttttttgcagatatttataacagctgtggaaaggtattcctagcagcaagctggcatgcaatttctcaggctgagagcaaataaatagaaaaaaaaaatctaagtggatgaatttgttcaagttttagagctgaaaaaaaaaaaatcacagaagagttgaagctcagatctagagagcattaagtgatgtcagggaagaggtaattatctgaataatccaagctccaagcccttttttcttcaattttctaaaaaacataggccaaatctaatttgctctcatgtatggggttgccaatcactccatttgaagacactgcatacaagattaccaagcgtggacttggctttccagaatcagatgtatctgattacagaagcctttggtatttaaatagaaaaccttcatttgtaataaatttagctcttttcttttcagggggagatgaggggaggggaattatgtactgtgtgtttttcataatttgaaaacatattgtaagaatgtaattaaaggactttaggaaagatagtgaaggtacttatgcgtcatgggagacaacctgacctggaggggaaacggtgcattaagactggaagacttcaccattcatttccacatgcaacgtcagatactcaggaaatagcgattaatgggaaagcttgaaatggaaggcagtccttgaaacatgcattctggccagctgaagagttactagcaatgacagcatcttccactcaagccacgtagctgggacagtgactgcatccacccagcagtgctatgcaatgccctacaattatccctgggttgggaagatcccctggagaaggaaatggcaacccaccccagtattcttgcctggaggaatcccatggacagaggagcctggagggctacagtcgccagagtcggacatgactgaagcgaatacacttcacttcacttcgcttcatgtctacagttgccaagccactctaatagaccccgtctcatctgattgtcatgttttccttttgagaggaacagacagaatttacttctctggagcatagaaccagctttcacacctgacctgtgaatatcttcaaataaaccaaaccagtcagtcatatgggccagggtaagaatcaaggctggaaagtctcagaatttcaaaatccttatggtcatatgagtgttgtatggatacacttccatagccttcactgcgtctacatttatattttaagaataagtcattagttgctactctgcta

SEQ ID NO: 44688 - DNA, 1749 bp, Bovine  19866880660006
ggttttattatgctgtatttgttctttatgttgttgtttttattgtttagtcgctaagccgtgttcacctttttgcgaccccttggattgtagtccaccagactcttatgtccgtgggatttcccaggcaagaatactggagtgggctgccatttcctccgccaattgttctttatacattgatgatattaacagttggttagtgtttgtttccaatgtttccccagtttgtcatgcatcttttacatttggatgcttttattgacatacataaattgtgccaaattgattgagttttcttttgttgtttcttccattgcttttaagttttgaaagtcatcactccaagatcaataaaacactcacctaactgttgcttactcttttgaaaaagactatggagaaatacaaaataaaaacagaggtgcttttctttcccatcccctcccttctatcaatctgaatccacagatgcacctccaatttttgatgatttttactttttacatttcattacttagtatcagctggaatttattttgttgtgtggtctgaggtgaaaatctaacttgaggatttattttcttccagataatgagccaattttcccaacaccattgttgaataattcattccttcctgctcggcttgtgaagacccatattttttgagttacaaagacaggaaactcacagtgacattatgcaacagaaataagctgccttcagtgcttgaatacatgactagctaagctcgcggtggcttatacacctacactctgtacagagcagagcatgtcgctgtagggcaagcgattggattgtccatttttaacagaatgttctaatttgttgaagcacacaagtctttaatttttcagttcagttcagttcaattcaactgacttaatttccaccagtgtttattaaatgcttattatatgcattcactgtagtatgtgaattatggttgatgcagttttggatttcaacccagcctatgagtaacatgtctaataactcaggcaaaagccaaataaaattccccaaacaattctgaaagaagaggaggagcctttgccgaaatcattttaaatgacaatccctcgggtttaactgatgtgcttttacggctgcagagtgtctttgtgttctcatctcaaaagccgacaatgacaaatagttcaagtcatttggattatgccatgggagcagacagaaagctcataagcacatgactgagcaaaataaataaataaaacaacatgtgtaagtcaaggagacacgttcctgtcccagtataaaaacagaggaagacatagatgcccgctattctcagataactacccatagttcaccaagtacagaggagtgggtagaggcaacattcttatcacagatgccatatgaagatctaaaataatcgtgtccacaaatattctatgttacttgtatttctgttgcttatcttttcttttcatcatgttagcgttcatcttttcatagagtaatataaaaacaacctgatggggattgtgtattttttcggggcggggggggtgggttcctatcggagaaaacaaaattattcatatgatcccagtagagtatgactgaaaagtgctgacaggatggaaaggtaccaaacgtgtgtttcttctgtttgtagttaccctgctatttttctctatgactcctgacatactgcctgtcacaccaggcacagtacaggagactgggggagtgttat

SEQ ID NO: 44689 - DNA, 1531 bp, Bovine  19866880726958
cctttgcacacactttggactggctggtccccttccttgggggctgctcttagcattgggtcatatcttcttctcccttcctcctggcagctacccccgtttcacgtaatatcttgtttcaaggtctgccagcaagattcaggtcaaagtcggctcaagacagccccacccgccatgctctactacaggccctgtacggccatgatgcttgtgaatacctctttcggcagaaaaacttcctttggatgtgcttcagaagggaggaaggagttcttgcttctgctggggctagcccagatcctggacctactactgtatggccattttcagatttcaccctgagaactaaaggaagtccagtgggataagacgtgacacggaccgattcattaaagaagctgaaagctctgtgcctgcttcaagggaaagtataaaactgtggattcagtgacttgatagaatatatatagtgttagtggatgagttggaaaaggaaatcagtatttctccatctcttatgttaatccccagatcatgttaataaatcctgacatagtagactttctggtgtgagaagatatttcatttgaaatatgacaaggtttaaaaaaatgttctttatgtaatatcaccccttaatttaacaaagctttttggacgactttgttgttaaactgattcgtcaatttgcctcataagattgtatttctctctctaagaataactaaaatatgtagagatatcattcttgcctggagaatcccagggatgggggagcccggtgggctgccatctatggggtcacacagagtcggacacgactgaagcgacttagcagcagcaagccagggggaacccttcaaacttatattttggataaaaatagtgagcttttctgaaatcagagtactgcagtcttcatttccagtcttcaagtctgttaaaaaaatttgaatatatgtatatatatatatattaaagtagggaaaaataacttatttattgtaaacagagtatcattgaaaatgcaaatttttgagctgatagaaaaaaagagttgcaaatcatcagtttgtcaaacatcaacatcagctcaaacctgggttgacttttcaataggtttctgcaagccggagcagtggttgctaagaggggaggagccggcaaagatgcgttcccagttcaggatagcagggataacagcatctcgctgctgaaacaagcttcacacgttagccggcaatcattaggttggtgactttcctgatacccaggagatgcttgctcgaggaataaatttctatgttgaagcatttgacaagccccagttcctgatgtctcacactcaagccttactttataggcacatctgttagtttaaagcatttttagtttattgaagaaggcttcacaaagaaaaaacagatgatgaaaatctcatctgtcaaaactgttattaaaaccagtaacagtgtgaaattttgtttaaatgaaagcatcatttatttttatcaaacattttataaacaat

SEQ ID NO: 44690 - DNA, 1626 bp, Bovine  19866880768416
ggactgaaaggcacacaaccccaagggccaggccctctcccctgaaaccaccccaacagccagcctaactcttctagatgtctttacataactgtttgcacaactgcggaaagaatatcaacaaccccatctgtcctacaccgaggcattaacttcccaccgtttcaaaaaacgaacgtttgtgagtgatgtgctttacatttttgccgtctccttggctgtttaccaaatctatcttctcccctccttctttcctgaggacgagatgagtgacagaggacatagggtcataactcaacaaagaagcttcccctcttttcagggacttctgactgagcctgggccccatgtgctgtgatgtgtgagtttcacacaccaggtgctctgcagcttctggaccatatgagactcctgtgactcaagagcgtttttcaatcctggatacatttctgctatggcagcagtcctaaagacatggcttaaggtttatcccgggatgtgacctcatccttttttttcacattgtatttgtaaacatttcaggatgacagttgacaacaaggtcgtgcacaggaggaagaccgttgtgcaaggagactcagaaacaggaaagactaattcaagttcactggcctttcccagatgtacatcttctggtcctcaggcataaaaagctggattagcttactctttttccaaagaaattgaggaaaacaaatgtactgaagacatctactaggcttagtagaagtcaggaaacaaaaaaaaaaaaacacgctttttttttttttttggtagggtcatgtagaaatccccaatataaggggatttatattgtctaaaatatccccaatataaggatactttttaattcaacagatgtggaaatattacatagctttttcaatataggtgaagggaagtctgcaggggtgatttcaggaaacagtgtcttaaattttaaaaacagatgcaaggaagagattgtctcccctactcctccagcatttctagctattggcgggtaaagatgtgatgcatggagctatagcagtcatcatgtgataataaggagaactaatgaacatacatacagatggtagagcagaaagaactttgatcttcattatactttgagtgactgaaataatccagccttaaacttcttcgcttctgcaattcatgtgaaattacagggatttttaaaagaaaaatatgtttggcataagatcaaacttatatgtgcttgagaaaagcattttccaactttttatgaagtagagttgatttgcaatattttatccgtttgaggtatatagcatggtaattaaatattttttataaatcacactccatgcacagttattaaaatattgactgtgctgcctgtgctgtagtattagtgtcctcagtaactcgcttagttgatacccagtagtccctaccttagtcccctagtagtttctgcctctcctaccaccatctctcctcaggtaaaccaccaattctctgcatctgtggatctgtctctatttcattatgtttttattcatttgttgtattttttagattctacatataagtgaaaacttacagtatttggctttctctgtctgacttttttca

SEQ ID NO: 44691 - DNA, 876 bp, Bovine  19866880790021
aaaaagtgggcattggttgggtcccatccactcagtagagctggcaggcgtggagggtcttaagactgcctgtgtactcggagcctgccagttctgtgactcatgacatggcagaggctgagttggcagtgcaagcctgtccccaccaaatgcctcctgcttgcacaatcgaagccgctacccgctgctgagggagggaggtctctggaagcacgcgcagtctcttccccacttggttacctttgtttgcttgcagctgtttatgcttgtggatgtataggatgcattttaaacagcatatgccacgtgcgagtttgatgagagagccttcttctcatgcgtgatcgtagtgttgtttcacacttggaaaattctttactgagctttctcttcaacgccggctctgatgttggaatataagcaaagctaaagttcgatctgaattctaggatacttctcttgaacccaaccactttcggacacaaatgctctgatcacggtagagtgacccctgagccttcctgcccattcctagccttgtacttatgctcacgctattctcgcccggagtcccctgaaagtgaaaagtgggggtcactcagtcatgtctgactctttgcaaccccatggactatacagtccatggaattctccaggccggaatactagattagttaacctttcccttctccaggggatcttcccaacccagggatcaaacccaggtgtcccacattgctggcatattctttaccagctgagccgcaaaggaagcccaagaatactggagtgggtaggctatcacttctccaggggatctttctgacccaggaatcgaaccggggtctcctgcagtgcaggcagattcctacctcc

SEQ ID NO: 44692 - DNA, 1023 bp, Bovine  19866880798355
tgtcgagacttaacggacagtattgagctcgtgaggttctgtccgtcttaaatatattcactaagttattaacacatgccagacatggcagttgagtacagattacatttttacatcctaaacattgattactaagaaaagcttgtcttatcaccacacttggagctcaccagtcagcttccatctggttaaaaaaagattgatttagctttagggcaaaaagctcaataatgcatatgctgagcgtaccaaattttcagtcttaaactacacatttctttccattttctgctttcttcaaggcccatttcctgctttgtctgtcgataaagttttgtcttgtaactaatcccatgacactatgccctagtactgaatatcctgataccgaatatctgcctatgtcaagttacaccattctacaccagtttatacaatgcttctcatatgggatatcctggctccacaagcaaattatatgattatttattggcagaagcatgtcttatgtttattacaaattcatcttggtgcctggcttaatgctgagcacatagaaaatacccaatacattctgttttaacatctaagcaaaataattgctgaaaattttttatcacttgagaatgaaatgcagcaattgaaagaagaatgaaatgtagtcttctctactataccaagcagagaacttatgaaccttgtcactagtcaatgaatattgagtccctttggtatacagttgtctgcttgggagttgtaagacagtgttgctctcatgacggctgagatagctatttcccttttgcttcactgtaagggcatccagtttgttgtacatttataaaacacgcagaggccatgaagcagccatacatttaaactctggtaacattttgatctggagaaggaaatggcaacccactccagtattcttgcctggagaatctcatggacagaggatcctggcaggctacagtccatgggtctgaggtggcgacagaggatgagatggttagataggat

SEQ ID NO: 44693 - DNA, 2377 bp, Bovine  19866880802022
acttgaaatttctaactgtgagttggatatcatatttgtatgtatctcattagctcactaaaatgccctttgttctatgctgtatagcaaatgaacccccaaatttagtgacttaaaaaatgacaatgttcattttgcttaaaaatcggcagtttgtataggactcaggcaggttggtttgtatctggggcagctcaaaggttaggagataaaaccatctctctgggagttgagccatgacagggaaactaccttacagtatggtgaccaggtacccagggtgggcatacctatagaggaaaagagagccagaaagagaaccaagatggaaacataccacattgttcgctatgacttggcctcctaagtcacacagtatcacaatccccatattctgtccatggaggcagtgacagggtcttactcaggggcaagagataaacttcaccactcagtggaaggaatgtcagtcatactatgagaagagcatgtggtatgtatgtatgtatgtatgtatttttctgatattttttattggcatatagttgatgtacaatattgtatattacaggtgtacaatatagtgagtcacaatttttaaattatgcttcatttatagatcttccaacccagagatccaacccaggtctcccacattgcaggcagattctttaccagctgagctaccagggaagtcatagttatgataaaatatcggctatattccccacgttgtacatatatgcatctatttttctatttctgcatctatttttggaaaacacaatctgcagtgcattcttagaaagtcacttaaacacggtatccatgtgcagagggtggccaaccaatcattaagatttttgcacacattctgaggtgctgagcatgtgtgcagaggtaggtagggaaaattgcgaaagaaatagatgtggtccctggcttaagaaagtatccagtttaaataaaaggtaagaaacacaatcattatccttttcaccacaaaataaagaagcaggaggaaaataagaaatcacatttacggtagtgtaaatgctttatcagtcacaaagaatttttatatagattgcccaattataccttcataaaaattttgtgagaggtatgttaatatatgtatcatattcctaacatttagagctttagggaactttagattggagataatagaattgggaatggttaacatagaaagattttatcagagatgtttatttagcaggatctccaagaaataagaaatgacttaaagtagaggcatttgtaagacctttagagggaaataagtgacatgagtggaaattagaattgaggcaaatagttcagttttagggagaagcagggagatgaaaaatgtaggttggtctgagcagaaaatacggaccccagagagtaaagtgggaaggcatttaaacagcagcccacactcctcctgaggcttccccacgaactcctgaggtggttggacatctttgtaggctcgctcggaggcccatggtgtgaccagagtcgcagctgagggactgaggatctttcctggcagggacagggcaggttgaaatggggggctcagaatccttggggttcagtcttgctggggagttctgagggacacacagagaaggggtggggtgttacgtaccctcagcctttcatcattggtgagagttgctcctgaggcattaactctccatattcgtaatctatctctctgctgtgaccagaataaagccctaaggtaaaaccaaggagcagacctcaaggtgtgtagaagtgaatgccgctcagtggccttggtaagcgtcaacgctgtctgccacagtaaagatggaaagaatcgcgacttccctggtggcccaggggttatgacttggccttccaacgcaagctcgggtttgacctctgactggagagctaccatcccacatacctcaaggccaaaaaaacaaaacgtaaaacagaaacagtattgtaacaaattcaataaaaactttaaatacggtccacattaaaaaaaaacttaaaatataaactgaagagaaaaaaaaggtggaaagaataaaagaaagaaaaagagaaccaccccccccccaaaaaaaaaaaaaaacaaaacatgccaggggtttatacggcttcctgcccactgtttccttctaaaatatatgcgtacttttgacttcttctattcaggcctctccctccagcctctcaaggtgccttcctgttacttctctgtccttgagcatgtttacaacatctcccaatttagtctcatttgcaaatttaattaacaggctatttacccctcttccggatcattaatggagatattaaataaaaccggatcaaacatcaa

SEQ ID NO: 44694 - DNA, 1635 bp, Bovine  19866880805666
aatgatgaaatgcattatggagctcatttttgtaacgtggctccgtcatttctttgaagaattgtaaatttctagaagttaagatactccaaaaataaacatgactgagaaatcgcccactctttatattatctgcatccccagacaatcgtatgcgtaactaagagatggccaattagtatcaggaattcactggtgcctaagcagagagttcattcttgtactttaacattttaaatgtcactctttcaagtacagcttatgactagtttgttatgagaatctgagggcataaaaagttcaggtttatttgaaaaaaatgatttttgaatggagggaattccgaaagctgaggaagttaaaaaaaaaaaagtcagaaatattgcattttcatgaccttttctttcatgagtaactcagaaaatttgattcaaactttccaaaataaatgtttttttggcttgagactaaagcttaatcattttcggttcaaaaggagctgttgttggacttctttttgacaacatgagaaaggaaagaaattaggacccccaaaagagtactagtttttgccttaattagtgaacagagacagtggcaccataattactggaaatgaggcatccacctcactcatgttattttgccagtaaatttttgactttctcttccaaggaaaaatgtgtattctgaaacaaaaaatcccttttgatgtcattaaacctaccatccatctacgctttgtctacagggaggaaagggacatggctgagtgagatagaatatatgttttaaagcatgagatggaaatccagacagaaaggttggaaggaagcggagggtctttggaagattaggagaaatcgtgaagagacaagagaacttgggaggtcacggccactttgcagacacctctccacactctccagttccaaaagtaagacacaactcctgagatctcatggatggatgagagcataggaagaggacccaagaggaaggagttttctggaagctctgcaaagaagggggagggaaaaggggctggaaaatgttaccagtgttcattggtggtgtgtcatttagtggcgtccagtctccccagcccaccagtctggaacaaaagtcagcctccagcgtaacagcagacaccggtgagcgctccagcagatcacctccctgagaacagcatggcgcgaggcctgaacgccggccccgggagtcagaaacgctgcagggcctgccagggcccacgggtggctcctcactgcctctgaatgaactgcgaaagagaccaaggatgagctgagagaccagaggccggagaactgggctgcagtggggctgggaagccccaggcacgtctctggccgcccggggctgcgtcctggcaggaggggcagtccaccctcggcgccatcctggagagagcggggccgcgactcagacccgcaggcggctggtgggtggtgggcctctggtttcctcctgggctgggggaaggctgaagcagtctgtcaactcttcagctttgcaccgtttcctcaaaactgcccccaaccgtgggcagctgggatggtggctaggtctccactaactacacaatatgagttataaaaggttcagttcagttca

SEQ ID NO: 44695 - DNA, 910 bp, Bovine  19866880806441
atgtttcctcttaggcaatttattctggtgatgtggaatctttgaataaatagtgacgctagtatttttaatagctgtttcccatcacatattgcaaaggaaacattaacaagggctgaattcataactcagcattgtacatgtcccagatttcacaacatttatggtgaactataaattattttatatgcgaatgttctgccacttggctaatttcacttggctacatgttctccaccttatcattttgaacagaaatgatatcctgtctatgaaacatcctcgaaaactacagggtattctaatagaaccgcttcagaggataggatggcacatgtctgtaatcattttaccaagcttttttttccctttgataaaatgtgtttctgagataacagtgacaatgaggctctagtaaatattcattttcccccttcttccctttctagtccctttgatctgcttggattccagtctagcaagaacccattcttgtttcatgcttttctccaaatattttttaatactctgaaggagtatttgtccttctgattatctttttttttgatagtctgatctcaacaaagtcttccaacaaaagagatcattaaattttaccgtttttctttcaacggtggaaataaattgtactttataaaatctctttacattagttttgaagtcctgaactgcaaacataaattttcttaaattaatgcctgtagtgcatgttttccctcacaaaatgtttgttactttcctatttgagaatatcaatacagtagagactatcaagacccagtgagtctcaggcagggaaatctttttaaaatacacgtgctaagtttcttgcccctagactcaggcttaacagtgtgtgtgtgtgtgtgtgtgtgtatgtgtgtgtgtg

SEQ ID NO: 44696 - DNA, 1441 bp, Bovine  19866880978036
cttcctgaaaagagtttgcctgcaatgttttgcagattgggcaatctcttttttttttttaaattattcttaaattattttatcagcttataaagtaatcttcagggatttctcttagtagagatttttaagtgtcctttgcatgtaagtatatgcagaaaatatttatttattatttttaaaattaatttttactggagtatagttgctttagagtgttgtgttagtttctactgtacagcaaagtgaatcaactattaagtgtccttttttcacaattttatttacttgcctattgactgtggtgggtcttcatcactatgcgggctttttctccagttgcagcgagtggggcttctctctagctgcagtgtgtgggcttctcagtgtgttggcttctctcgttgcagagcaccggctccaggcgcttgggctttgggagttgcagacgtgggctcagtagctgtggctcccgggctctaggacatgggctcagtagctgtggtgcatgggcttagtttctctgcggcttgtgggatcttccctgaccaggaactgaactcgagtctcctgtattggcaggcagactctttaccactgagccagcaaggaggcccaagggacctttttaacaagcagtcatccgtaaaacatggcaaacaattcttggtcaaagtttcctcctgattattataatataaaattatgatggtggagaatttgaagcttagagggatttgaattccatgacattttgtctccttaaggaaaaaacagtccagccctcatttaacaatgtctcctcgttgctctgagccagttcctcctcggcattatctgattttggcagattcaccaggaagacaagattccagtgcccacactcctcaatctttctggagccttatttatatctctatatcaacagagtgaagagaagatgatgtttcatttggagtcgcccacagctactggcaggctccttaattagtgtctgtgaccagttagcattgtttagattttgctcaacacgcttacccagaaactccctccttctcggctgctgtggtgggcgccagctgtctttaatctcccaggacccaattcacagatcaaaaactctgttatgagcacaaatgtctgagagtgggtatttgtttattttctgctgaagagacaacctttatacatctctgccattaaaaataaataagtcgataaataaatacccagacccaacacgacagacaaaatccggaacagctcacttccatctaaaccagactaaaagtttggttcatgtggaaatggcacctcttattggttaagaaaatactcctcttctcttggaaataataagctcattgcagaatcctgttctgaagactaaaacgtatccttgacaaagaaggaggacaaagaagcttacagtttcagacaa

SEQ ID NO: 44697 - DNA, 989 bp, Bovine  19866880991345
gaagaaatgactgaatgcaaatagcagggcatgagttagtactgaaagcttcatatattgccaggcctccaatgaatgtctcttttgaaaagcagtcaagttcacagcaagaccaccatctactctacattctccatgatggattgtacgtgctgggaaaatgtagagatgctctcctcaaggctattttaagaactgttcttataacatggttcatcaggtattaaactaggtagaataaatataaggaatttttctttcttggagctttttctccaccggctgtcagtttgctgaagaacatcataaatcaccatgacagctctagtggctggtctagagttggtctgacaaaatgaagagttagaaatttgtttgtaattcacaaaagattgtctcatttctactccctgtggtaattgtactcagatttgcaaatgacacgtatatccaagaagtggggaaggaagagggaggttgtgttggcaaggatacacatccttctctgaacgttgacggggctaggcaagttaatagaataggaggtgccgacatgatcaaaaacaattcccactaaacagtactgatactattactattattagtaattgatattacattacattttggatgttagagcatagaatgtttttatacatcacaactcagaattctcatatcaaatccattctgcacagatttggaccacatcacagctattgcttccttgtctgtgtgtaaaaaggatgttcactggttcacactggtgttgccagtgtgtgtgttgtggcccttcctgttttcaaagactaataatagttcacttgagaatttaagatgtaccaggctctactctaagctctttacattaaatctatgtgggaagaactattataatcttcatattagagatgagaaatctgaaacattgaactttccaaaagtcatatacctagtaggtggtgggagtaatagattggacacacgcc

SEQ ID NO: 44698 - DNA, 756 bp, Bovine  19866881055988
atggaactgaattgatgaggtgatggatgctaactaaacttaactgcagtaatgtttgcaatatatacatatgccattgtgctgtagatttaaacttacagtatcaaatgtaattttatttcaggaacactggaaaagaaaatgaactaaagatgttcaggcaaaagatctcttgggaggacagatagaccgccatcaaatattagaactgtgctgtgtggaagagattagatgacgcccaaacagttccagagaaggataaatgaaagttacaggtagattaatttcaaaatttaagagaaagaattttttctaagtatcctttgtccaccagtggaatgggttatgttgggagcaccagtcaacaagctcagtagaggctggaagacacaaagatagaaagggggactgagacaccaggacagaaatttgtgtataatttaagatggctgcaaagcccagattacgatgtcccagactgaggacttttaaaaaagaaactctagggtggcgccatgtagtctgttttaagaagccctccaggtgctgctgatatgtatattgtcagaaataacaagagaggagaaaagagtttggggaatggtaaaggggggtatgcctggaagttctctgctgaggcttcagttttgtcagtgaataaggaactgaagttacctgctgaaagttgacatggaggggaaggttcaagaagagccgatgaaagttttatgtaggaaaaataagatcagattttca

SEQ ID NO: 44699 - DNA, 1315 bp, Bovine  19866881112493
tttgcggcataaaaacaacttgtgacttcccgtaagtctgagtgaccttatcaccattctctaacattgaaaaacgttaccctcatcccctccgcaccaccccacctttgctctgtagccctgtaaagtccatagcccttgactctgtttttcagaatacatggcattggttttaagaaatgaataaactacttgtcctagatctttagagggggttctgaagctggagcacgtactgctgtctggggaagaagacatactctgctttgtgattaaaaaaacaaaacaaaaacccaactctttaaaaactccggtactcagaggggctttaaaaaaatgtgtatgactctttgttgctgtgtttgttatatgttgtaagtcacaacagcttggactttatcttctaaattcttctgtgatttcctaaagatttgacccaggacaggaagcaatctacaaagccgacacatgtaataaataatatcttatgagttttcaggcctttatatgtgttttctttcttagccacagcagatttccttttttcagctgcagtagattcaaaagtgttcccttcagcaagttcttctcgtgccgtggaagctggttgggtacatccaaagggatgatggatttctcctctcacttctaacacaaataatgcggtttacctcttttaagattttatttctgaagataagatgggagggacttccctggaagtacactggttaagaccccatgcttgctgtgcagggggcacatgtttgatccctgtttggggagagaagacccccatatgccacacagcacaaccaaaaaaatctgtaacaataaaaattaaaaaaagataatatgtgaaatgatgggaaaagagaatccagaacacttttacacattgcttctgctcctgctaagtcacttcagtcgtgtccgactctgtgcgaccccatagatggcagcccaccaggctcccccgtccctgggattctccaggcaagaacactggagtgggttgccatttccttctccagtgcatgtaagtgaaaagtgaaagtgaagtcactcagtcatgtctgactgttagctaccccatggactgcagcccaccaggctcctccgtccgtgggattttccaggcaagagtactggagtgggctgccattgccttctccattttacacattatgggatttgatatgtgtacagggactctttcatagcttaatactcaatagattagacagttgggacttcacaggtgacccagtggtaaagaatcgacctgccagtgcaggagatgcaggagatgtgg

SEQ ID NO: 44700 - DNA, 973 bp, Bovine  19866881113968
ctctctctctccccctttctgtctgcctgtttatctacaatctgtctatttaaattctttttaaacaagaagggaatatctttatgcctgtttgtaggaatattctacatccatctgttatttacatcattcgttttcctgaggtgtctccaacaaatcctggctggatgcactgtatgtgttattaataaaacagctgtaaaaatattaactgtacggcctaattgtcagccctgattaggagccaagtttatccctggacggatgcagagactcagaatttgggcttcaatccagatctgaccctcgcagctcactttacatttgattctttgaccatttaagctgctctggcttcttctctccctcccccgcagggatctgtgcacatccggccactgatctcctgactccttcaggtgggcgctgttccagcttctggaatgttcttccccactccactccctcccctgcccttgcctctccctgccacctcctaccaccaccactttagttaaagttagcagccctatgctatataaacacctttcagggacttaaaagatgagcagaaatactatcggcattgtgttaccacatgcactgataggaaatcgcgtttggacagtctgcattggaaagcatgtctctaaaaccactggaccctggacactggagagcttagacactagagagcctctatggattggccacagagagatagtccatgagtatcaggaattagatcaatctttcagacaacccttctggatacgtaagataaacgaagagttgataacacattttctgtctaataaagtgtgcaaaagaaatcaaatgagggcagaagtgagcaaagtgaaacacttgtgttgctgtcccctttcttagtctagttggagtgagcccagagtgctaatatctaagtgaggccaaggtgtttaccgggaggataaaaccattcagaaaaaaa

SEQ ID NO: 44701 - DNA, 669 bp, Bovine  19866881146731
aaataaattaaagggatggatcacaatgtttaccaaggatgaaaactccaaatcgagaatggtaagaagaatgaactggtgataaaaaaactgagcattgagaaaagtacaagtcttagtccagactggctcctgtctagagacgttactttcattctctggattttgtattcttatctgtaaggtaaactgagcgtgatttcatactgccaaataccataatgcaggatttccaggattatcaggttaaaataatcttccagtctcactccaaggtcagcagaaagctctgcttaatctccagccagcggacaatgttcacttgccctttgtaagaatctggtaagacatgagctagaatatttccttaaggaattataaatgtctacatatagagtaagaccctctatgtgcttggggctcttgcatcttgagaaggagccaccccatcctacaatttagaatcttagccttagtcacacacacacacacacacacacacagcccgaaattaagtatttaaaatattatagttgcaataacaactcttaaaatgcatgaaatataaaaatgaataaatgcctggtgtgagctgttttacaatttcttttccaaatgaaagacacctcctgtttcttttcattggtaactggcttacactttcaattt

SEQ ID NO: 44702 - DNA, 2372 bp, Bovine  19866881228461
tgctatttcaaaacaagctagagaccatttttaaaatgatactcactatgaaagaacaccacagataagaattagaaaaatcagaaatgaaatgactgaattcaagaaagaattaaaaataaaacatcactttgacaaagaaacctaaacagaaagaaacacgagaataaataaacacaactgatcacacctaagagaagcagaaggtggagagtaaaaacatactaagaatcagaaagaaaaggcttctcctttctgggaggtaagctgttggtcagcacgcctgagaggagacttggggtgggcaggaaattgtctacatgaagggggagctgagcaaatcaatacactgaaagttctgggtgaggcttctcacaggtgagaggagagttgtaacaggccaacgcggggggcctggaacaagcactgtggtatctgcttagaactggaggtcatggggttagcccaaggtatttcatatatttaggaagacagaaatactgaaaagatacctttgtttgcatcactgtatatgccttgtaaacatactgtccagctctgttttctgagagggactggatgcaatgtcatcgcaggagccatgagcgtacaaagcatccaggttcggtttctaattattattctccactaaggggaagcaccggtcacgcaggcactgaataaatcttctcctacagtgagacactcactcccttgttcccttaaggttcagctgcttagctaggtctccctaactttatttattaacaattagacagtaattagtgtaatataaaaattttaccttaataaccacttagaagaacccaaagctgaactcatatataagtatataataaatatacaattaacatattcatatttttctgttaagatattcattaaagtttggggacagaatgttaagcatgtttaattgattctccaaaggtcagatatatcataagaatttttctaaggctgaaaacagttcatcagaaaggcctggtatctgtacataacgtcatttgacttgtccctgtctgtactggacaagtgcccttttcacaatgaatcataaagtcaattcgatcagtacaaattttttttgttttacagaatgaattctgcaagcaaaagacacagagtatgttctcagtaggttatatttgacttctaaatcccattctatggcctagttacacagaatacaaagctactgacctttgcaaatatagcccattcattttttcagggttttgacaacagagagagacatgcagagagagacaacagagaaatgcaaggtaaaagataaatcattctggccacttttcaatttcttaaacttcattctttttcaacataaatagggtgattctgattgatacaatgcctaagatgtgaaaagtgaaagtgaagttgctcagtcgtgtctgactctttgcaaccccacgggctgtagcctaccttgctcttccatccatgagattttccaggcaagagtactggagtgggttgccatttccttctctagcctaagatgtaaggaggcccaataaaaagttacacagagtaggcctatgaaatgaattccatggccacaagggttttctagcttcacggataaaattctactggcccaaggcatccatcaagatcgcctcaccaagaaccagtgtctgacaaatgctttatgggaaaacttgtcaaaaaaatcaccagatatgcccagacgtgcttcttgacatattcatttatgcattcttcaaatatcactacacgccagttacggcctcctatttatttatatcgtacaagtcctctaactcctaacccagcagagcacctgttctgagttgaatgacggattaaaaaaaaaagaagatgagactaccttcaagggattattaccacttccttttttttttttaacaaatatcactcttcttccactgaaaatgctgctgctgaaaataacttgttatattcacctccctcttttcatcattacagtttgtaagggaagagtttttcagaagggtgaactcttcaactctattctcagcaccatgtcctcttccacggccccaccgataactccctccaccagcaaaagggtcagtgagctcccaaagcataaactctgatcttaaccctgcaaccaccgacaaagctaactctactctcttcttttcctctaacagcaaacttcttccacgcactgcacctccacttgatctcatgctcattcctaactcatcgtatcctgacttctgacccaattatctctaccaaaacagctcttaatgatgagcaaggactttattaattattaactccatatgctcttttttattccacagtcttgg

SEQ ID NO: 44703 - DNA, 871 bp, Bovine  19866881250368
aaattgtttatagatttgaaaactgtttggggtttgtgattgcttctgttgtttgcctctttgtatcgtctcgtttttcaaaatttaataaacactttgcagaggagcaaaataattggtcacacacttgtgagttcccagatttgttttacatgtgtatgcaatacagcgtaactcataaacatgttcaagcctagtacatcacaccatctctgatgctgtggtcgagaccaaaacagaactccgggtgagcacccacggccccggaccacgtcccctccccaggacttttgaccacagtcctcgggggccggaccctggcctcagtgacacgtgtggtcactatcagggcccgcggccggaagctgctgtgacaggcttgcacagagggcagaggcctcggttcgggtccattagtgttggaggctctgcccaggttgtgccgcagaagggcgcagcagcctcttcaggatgccagcaggggcagtgacctgtctgccgtgttcctttcacctggccacgctcctgcgccacagtgggctgcgaggcggggtttgtcttggacccacttgtaagataagttcgggctctttatctctttatctggggcctccaagaccttcttctttcccctgtgaaccatgttgctgttgttctgttgctagattgtgtccacctctttgcgaccccatggatggcagcacaccaggcctccctgtccatcaccaactcctggagctcactcaaagtcaggctccatagctatttgtaaaacggaagaatgaatgaataacttaatgaatgaatgtctctctgagccaggagggggggtctcctaggagaggaggcaaggactggcaggaagccctat

SEQ ID NO: 44704 - DNA, 1811 bp, Bovine  19866881270650
taccaaaaatagcctgcatgtattttagttttaatttctagaggctgggaggggagggagtgtcacggtttgcttcaacagtgaagatacactgcatgccaaagaaatgcaaatacaaaaattaatataggttttaaaaatgataacagtagtattttgaaaataactcgtatgtctaaatcaataagaggtatatataaagttatttttgttcttcctaggtagttggaaaaaaaggagaaagccactaaaggtacagaagacactggaagaccatgttgcaatcagagctacagctcctggataattgcttgattctcgccagagactttcaatatttcattcatttccattaccaataaatcattgcttttgttcagatggtatcactagtgtttctcttgtaaccttaatacatgcagttgtaaataaaaataactacttttgccaagcttaatttttgttgttctaaataagtattttctctttccatttatgtgaaaattggacaccttctgattttagcagacttcagtgtctgatagtgtgttgatcaaaagcctgtttccctccttagaggagcagaagtgctttaggaactgaggcgtgtgtgtgcgttcatgtgcgcacagcacgtgattctgacaggtggacttggaaaggctaactgtgttagactcatagtttgttcaacagcagttgggcatctgggctatagaaaacacccacattataaactaccagaaatagattagtttaacgagacttaactgttcccgcctaagactgtcagagggagtacagatttgatacccttttggatagacttaaaacttgagtcatctttatcaacgtatgttgaaaggtatgttgaaaatatatgttgaaatccaacagtaggaaaaaataaaagtactgtgcattcatgaagcagcaggaattgatatcttttaatgaagtatttattattttaactaccaaatgatgcagtgtaaatatacagagaacttggtttaaggttgaaaatgaattggccacgtgtatgtttaaaaggtcttttacaaaaggctggcaagaccatctgttccgtatgacttaagaatcttaaactgtaatctagaaaggattaattttttaatttttctatttttaaaactaaaatttgatttttaaatttctctgagtattttaaaaattcagtgtttgaaaagaatatataagacttaattttgattcagttaatagtaaatttgagggcctatttgtctaggactatgatcaagatactgatttgcctttgagacaccaatgtatttatacgtgtttctgaaaaataaaaattatgtccaagtttttgtggtaatcactttgtgaaaccctagtgtcgctaagtaatgtttagtttctttgtatggaagcacatgagctggtctgtggtgatgtctacgtagtatctgtatttcctgattatgttgccttggatcaaatggaaacagaaaggcaagaagtaaaataaataaaagtttataaaacactgcttagtagagaccatctcagattaatcatgtctggaattaagggcgagattaatatcagaagttttgttttacagtttgtacatttaacaaaacctcttcgggtaattgttgaaactgcctcaccttaagtattgctgacctcattttatttatacttaccaatttgaaagtccagtgaaaataatttcatatttgtacaggattggacatcagatttatattgttcatgtgaatttcctataactcagttgattgcataatacaaacatttca

SEQ ID NO: 44705 - DNA, 820 bp, Bovine  19866881323785
attttggtgtttacatagattgttgtgtgtttgagcccctcagtctaatgacctcttgtttaattaatttaacaacttataatctcttgggaatgaagcagcgatgtttgcattgtttcatatcctcatagcacccagtaaaagccttatctacaacagttactcagtaagaaaaagcactgaagtgtctctaagttcagaaaatacaactgtatagtataaatgtcttcaacaaggtttttctagcagtcaccagaggctaatcctacacctaaaccttaggttgatacagctttaaaatattgaccctaatcctcctatatataaatagtattttccaaatggtgggttggtgtttttttcccactttttctgccttagtgaggttcccagctggcagtagtggtaaagaatctgcttgccaatgcaggagacacaagagacttgggtttgatccctgggtcgggaacatcactcggagtaggaaatggcaacccattcctgtatacttacctggaaaattccatggacagaggagcccagttagagtccatgggattgcaaagagtcagacatgcctgagcaaatgagcgcacctgagctccataataaatacatacctgcttccgttcttgcgcaaacggaatgaccttggaccagattaagtccctttgggactcagtttccttatttgccaaattaaaccattgaattaattcatctctactgtctctttcaacttgaaaatgccagttatttatttatttagagtactcttttttttttggctttaatcacaacaggagtggggtatacaaaa

SEQ ID NO: 44706 - DNA, 1541 bp, Bovine  19866881416624
tgctcctaagggaactctttcttcaatttcattcatgataacagctttcttcactctcctctctctcctaatcatccatttcattggtctctctctctctctttcacacacacacacacacacacacacacacgaactctgcaacacctttagtccttgaagctttgaagttactaacatgttctgaaaggaaagtaatttttttctgttttaccacccagcctcacaggtgactggcctaaagggagtttgttctccatcccctgcttaatgtggctggcttaccacagcccgagcttctcagaattgaaatcacatatggacatttgggagggatgagagcttttatgaccagaaagaattgaagccattgtttcgtcttcctcctctctctctcaaagtggggtcagaattgattgtttcctctcacctgtagtcactgtcttattttagtgcattgataatatctagacccatgttgtgttcaagttttctcaaccttaatccctagaaatcccgtagagtgtgtcaaattagaactccattcccacaaacacttcttcacgttgctgtgcagtgaattcaatacattccttagaatttaaggctcttaagcatttttgctgaagtggatcgatgtcctccttgccccctgcttttggctttcctctgcttcttccttcccaccgtactctcctgatatatttcaaatccttatactctacatccccccaaattctattggtttcaatttatgaacgatctctgtaacatggctcccctggagaaggaagtggcaacccactccagtattcttgcctgggaaatcccacgaacagaggagcctggcgggctatagtccatggagtcacaaagagttggatacgactcagcgactaaaacaacaatgacaacaataacatggccatcccctcttttatacaaaacctgatgttttggctttggatgctgtaaaacttggacaccaagaaatatgcagaaatccaaagtctaacaacaaaaaaagttactagatgcggatatatagtatgctcttctgttggttatgaaagtaaattatttccttttctttgcagattctacccaaatagcacagacagcaaacaatgtgaaatgatcaaatttatcaaatatacataggtacgtttctgactgcatgcaggcaaattaagtcagaatttcttaattgatgctttgttttttgaaatctccaaaaacagcaagcagcttttcttaccaaagtgcatttgagccagtcctaagacggtctagaacccttattcacagaaaccccaaaatctctaaataattggcaaacatttcatacgtatgcatgcctactggtttatgacaactgacactccttgaggatatgggaggcatgtaataaatatggttgtataatcatcaaagccacagttctaagaatctcctaccgacatgatggataacatggattttcaaagatttgggtaaaaaactgtatgtattttctttctgtaggaacaaacatctacatg

SEQ ID NO: 44707 - DNA, 936 bp, Bovine  19866881466039
cttgagaacagcaatatgccccagtttgcccatctcgaaactttcttagatggatttgtcaggttgacaaatggcccccactcagggcagacccggcagacgacaagcacaggcagggctcctgcccgcacctcccgtaagccaactgtggaatgcagggagcctacactgggcagaaccagcggactaaaaataccgcccggcccatctctctggggattcgcttccaggccacaggggccctgagccctggccctgcctgggggaagcgcaggggcctccatccgccccagagctaattgccaaggacccggccaggcagttgctgggccccggctctcggtttgtaagaaccttgcaaaggcagtggttctaacttcagatcttctctccaaactttgatcttccagcgctgcttggctttaggcaaaacataaacttgagagctgcaacatgtttttcaaattttattctcctggcagttttagaataaggacaggaattattttcaaatgagaatttttgactgcataacacaggcttccaaaattaagcagaagcacatggtggctcttattattaaatttcccctggaaaacaatggttcagattatgggagggggaagcagtttgataaaactttgaaatgtgaagcctaaagtttaaaataaaataaaaaatagctctggcctttttttttttcaaagatcatcacagagtttttccagccctgccattattattctgtatctgccaatggctcaaaaattgaatgcttggggtttaaaatataaatgacagtttgtcaagctgaaaaccgggtgctaaaggggttcctgaagtacagagaataatttgggctgcccgattagagtgtctccccagaaagcatgcttttaagaaagtaaagctagagcttaactgtattcctgtctg

SEQ ID NO: 44708 - DNA, 1492 bp, Bovine  19866881598475
tatcgtttactctgactcctccctcccccaaccttttctctcttataacaaacgatgaaagtgaatttccttgacttagtgccaaataaagtgttgctgaaggcattactgcctgacttaacactttgtcactgaaaagtcctctttcttccaggcggcttctttgcctccagaaccgaagtctagtgttggcctttcaactcaggtaagattgaaaacaatccttatgtggcacagtctgtgtcatctccatgttaccatttggtgtcacgcatcacgggtcacatcactaatttgatatgtagttgttgtttccaccccttttgcgtcctaagttgtgtccacctcttttgtgaccccatggactgtagcccgcaaggctctgctgtccatgggatttcccagacaagaatataggagtgagttgccatttccttctccaggggatcttcctgacctatggattgaacatgcatctcctacattgcaagtggattctttaccaactgagccaccagggaagctctttccttacttttattaatgtccatattcatgctttgagatgagtgtatttctcatgagattgtcagctctacacaaataaggcttttattagcccttttgtaccgtgctttgtatatacaattagaaataatataatagaattataagaactctattttctgagacatgcacactttcagactttggtttactgagtgagcatggaccataacatattaacaatgtgatgtgtatatgattttagctagtgctcagtatgtgtgaaattataatacaaaatttgaatggaaaaatgctaaggtctcactgttacctgcttcatgttagaaaataatatcagaatattagttccaatatgtatagcctacatctgatagagatcctttaatttttgtttctcaaattaaaagcattcaattttctctagaaaatgcttgtttctctcaacctcattatgaaaacattttctgcatactttgcctaaaattaccttgttttttgttttaattacacaactccaaatcacttttcctcattagtatttgataattataagcaaagaagcaaatataaaaacaagaagtccatgagcagtgcagtcatgcattttctccttctctctgttgatagcactgatgaagtgtatttaatttcaatctgctgaatgaccacattcataattcgtgttcatttccattccaggatgatttctttccagtttgattcaatatacataatttttccttaagcatacatgtccacattcctttgaacttgtttttgtctggggaaggaggaaagaaattaaccctcattttgtatctccttttgacacagcctgtttttggcacttgccacatattatctcatttgattctgtgtgcaatcttgggaagctggaattattattcttattctaaagatgaaaaactgatggctagaaaccaacgtgccaaagattgtt

SEQ ID NO: 44709 - DNA, 1347 bp, Bovine  19866881631801
ctgaatgaagtgatgagcatggatttgacaactgtttgcgaaagacatgaccttcttggaatctgattgtgatgaacaggtaactgaatgcttagggcttgtagagattatcagtatttgtgtccacacacgtttccatctcatggtttcatgtctctcctttccagatgatcacttttttcttactttttataaccacctctgtcctctgaccctgtcacctcaccccctttcttcgtttgtttatgccagctgcgctgcagagaatcacagaagtcttggactgtccggaagcctgggttgagccttcactattcttaagtccttttgttcattcttgagctgccttcatactttctacccacctaaatgagtacattccttttatgtctagccctcactcccagtgtaaacctgttgtgtttccctgtattttcctgcagtgttgtcacagaggaagtggggtagtgtagttctgccttgatcacgctttctctgtcttagctgttatttaaaattttattgtcttaaaaatttttttcttatttaattactgtaccattgcctctgctttgtccccattccagtatatcttttatatgttcacaaaagttacttctctaaaatataaattgtatttatattctgatttcttaaaagagtcagatgattcttcagtggcttcaggaagaggatgtaatatgcttactaactttatctacttccagctttctactctcatatcctcttcacctatggttcaggtccctaaatgggtcatgtttatctcctgacacccaaatacaggtcaagtattaaaagtacttacataactaaagagagtagtctaagtattttcttaagcaaatagaccacagtgatttgaaataaatctaaatgccatcttcctttgctccaagcagaactatcttattttattgcttgaaaataccgccatgttgtgcaccttgtaaatggtgccctaaacgtaatgtgatgatgtgtatcagaagggctggctacagcttccctgaaatcttcctgctgaggaaaccttcttcccagggtggaaacgtagaggtatcttcatcagacagttttggtggaaggaagattgagtgaatgaatcagagagaggcgtctcagcagttttgtatttcagttccctcgggtggctttccagattcagtgagtcagattcatttaggatggcagtttagaggtgactgatagagctgtgagtcctgttgtcttgagttttgaatcaaatagagtccatttgagatctggtctttccacataacctgtgtgcatcgtctccagattgtcaagtgacatgggtagata

SEQ ID NO: 44710 - DNA, 1290 bp, Bovine  19866881639347
actgagcgactgaactgaactgatatatccttaaaatccatatatatatatatacacatgtgtatatatctatatttaaagtatacagcttccctggtggctcagatggtaaagtatatatatggatttatatatacttaaaaattgttccctaagtggtaaaccccaaacctgcacaatgatttatttctaattaacttgctaataaagagacattctctgtcttttggcaaattttgacccaacaatcggctggatattgtgtctggacttgactccagcttctacccaaaaaagtcagtgccgagtctcctgatctgacattttgcctgggaacagaaagactaaacataactgcagttctgttgactcctggagtgaatcaagaaaatggtggcaatccattcaactttctgccatagattcatttgttgattcatttataataaatttggagggacttccctggaaattcagtggtttgatctccttgccatccaagggactctcaagaattttctctagctccacagttcaaaagcatcaattcgtcagtgctcagccttctttgtggtccaactctcacatccatacatgactactgaaaaaaccacaactttgactctacggacctttgtcggcaaagtaacatctctgctttctaatacgctgtctaggtttgtcatgacttttcttccaaggagcaagcatctttcaatttcatgtctgcagttactgtctccagtgacagaactttagctaaactcaaaggaaagtgatttctcccggaggaaacagggatggctttgtatggctagcttcacattttgggccctggcagaggagttgccccaggaatctgggatgtggggcctttacttagagatgtaacagtgctcctgccacactccactcgcttagctagtgccctggcccggagccctgcctgcttgaaggactggacatggaactgtgcaaccccaaggtttgtacaccgactcttccctctgggcaactctccctgatgcacacaaagataacctatgccctcctggagctgtggtgtgtgttacaaaggagacagatgagggctttcctggtggtccagtggttagagctaatgcagggacacatgttcaatccctggtccaagactgttcaacatgccatggggcacctaaacccatggggcaaataagcccatggagcacctaaacccacggggcacctaaacccatggggcaccaaaacccacggggcaactaagcccaggagcacctaacccacggg

SEQ ID NO: 44711 - DNA, 787 bp, Bovine  19866881770203
tgcttcggtcacctcatcttgcgtgtctgtaaacgtggaagcagatcagaaagcctgtctgctctcaaagcagagggttccaggctgggagctaaaccccagatgtctgttagcatctacaagctctgtgggtgaagctctgtgaagctcttctgcaatccaggttgaacagaatcgtgggaggcaacgcaacctccttccttgcccaagggagagatggagcaacctctgatgaggaacactgccgctccacccctgtgtgatcactcccaacttcgcttcctgttccctcctgccctctgcttacagaagggtgtggtggggctggggtctgattgctctttcccttgttaacacctattgtttttggctgggggcctggtgctgatcccatggcaaaagttgaagccccactccatgttctggtatgctaatttttacttctacttccttgcttaacagtgagattggacatgtttcttgtgtttcttaatagtcttatttctctttttatgaattgcctgttggcagcttctttcttattcttctgcctcttctcttggtctgttgaagctttctccttgtgaagtagtctgaccagagttctctagcttatatcacatcacagccccactggctctgaatgtaacacaactgctttccagttgcagtatctgcctttaggggggtcagtattaatattcaagacacaatgagctaagaaacaggatacacagatccactatttgatattcatcagctggtttatgaatttatgctaaatatg

SEQ ID NO: 44712 - DNA, 1160 bp, Bovine  19866881989803
tctggcaggtgacagtccgtggggtcacaaacatagaagtgacttagcactcaatcacacgtaaaggtctaaatgattgacagaggttgtcctggccgaacttcacactaaaggttttatgactgatggcaagtgggttcctgttagaaccttttctgaaagtgcagaaaagatgaactgagaaagatgaagataaacgtatgtcaaagggaagctgtgtggccctatgtggagaagagggctgagaaaggggagacttggcacagaaacagtaatcaacagagagcgtcacctacctcgttccaggcctgccctctctcacttactgatttgactaagttgaaaagactgttttgggagggctgttagaatcccctttccattctctcttctcatattcctgtgatggctccccatgaaccctagaaataattgacactttcaccaacttccagcagcctggtgtgaatttctcttttctcaagtgctcttaccttcccgaacttattttattcatctgcacttattttcttcatccttccctcttgtcaacctgtgcaacccaggaaccagagagtggtttcaggcagcaaaccctatgcttgacatagagttcaccaaacgcaatataaatataatgtgtaaggataaaatgcattacctctctatataagacaaatattaacttgatattacaccactgtcttcaggatgctttataggaattaattacatgatgtctgcaaagcagtttgagaacctccggggaaaggtgctatataaatacaaggtatgattatttttaggagcttccactgctgacattcagcatagcatgaaagaatgaaaaattatctccatgttccccgtcgtggtaacaacttcagcttgaggtttagaaaacccatttatagaaactgctaaaattaaaataacgcattccttacatgagctcatccatggagcttcatctatgagagaagagatctttctaggcacagactttttaactttaaagacgatgactctgtagacctaagtcagaaatttagaagtttacaatctttcacccaggttctcgggcctcctggctccagtccaattcccggcctccacgaagagactctgtttggatgaatgtagacttcaccactcctaaa

SEQ ID NO: 44713 - DNA, 715 bp, Bovine  19866882176402
aatctccccagaaggatattgccttaggacttgggatcccccaaggctgtcctttcaagcattctcttcctttaccagtggtctctctgctttgcttggcaactcaattctctcctcgttaacaagctacgtgatgaaggctggaggtacctctgtttatttgagaaaaccaaattagttcacctttcctaaataactatcttctggacaacttagctcaacacttcttgactttaatccacagaattagaacatctgctttaaattgaagatgtacagagggaattatacctactccatctagaaattgtttgcttctgatgtcattcttgattagatgattttggaattttgattgcttcacattagatcattatgatttcaaaatgcagcttgtaaatgtattcagttcatcaagggctataaatataaactacaggcctttcctttgcgtgggtcctcttagaagcttgtaggttcatgggaaaccaaaagaaatatcttcaagaaaaggtgagaaactcctacattaaaaataattttctgaacatctggcctcagattcaagagtttgataatcgtgtgctttctctggttttaaatttaaattaatgactacagggtaatgaaggctgactctttggaaaaaaagatgtaaaaaatttgaggactactcatgttcagttcagtaaaacaattacatgattaggtaata

SEQ ID NO: 44714 - DNA, 2441 bp, Bovine  19866880355641
cttgtccctttgtgggataccacgttttcatagctggttaacacaaaatccgcatatggcccttagaattctcactgtgatgtcggatgagtctctgggtctgagcgccctccttggcagagaggccagggtcagagactgtcaacatttacgactacagcaatgttaaaaatgttttcaaccacattttttgtttggtgggtgttcttgctttgttagattttatctggttgattgctttggtaaactgtgtgtgtgtgtttggcataaatgtggcattttgacatagcatatgttcctaagatatttctcacttgtgttgacattaaccactttataggaattgcctgaggcaccccgcccgtacacaagtttatctttcagaaaagtttacaaaatatgttaataagggtagaggaagggaaggatagtctaaattgaaagtcatctatttaacaagtgggaggataaagggcctaactgacaaaacagtctaaccagcatcatggaccagaaatagcaattatcaagtacattcgatagccacaaacacactgctgacacagagcaaaatctaaaacctgagcttttcagaataaactgcagtttctgaaaagagaccaaatttgtgaaactgttaaaacctagattagaatagctctctacagagaaggcaatggcacctcactccagtactcttgcctggaaactcccatgcacggaggagcctggtaggctgcaatccatgggatttcaaagagttggacacaactgagtgacttcactttcactttcaccatcaattttgtcaaaagtaataaaaatcctcaagcatctttaacttgaggtaaataatccattctcaaatggtggaaatattgacatgcaaatcaatgctattaaagattgggctacgaaagtcctagctgaaaacgtacaggcatagtaaaacttaaagaataaaggccattactttctaagccagaaataatctgtgactgccagctagtctaatgtattgcatttggataactgtggcttcatcgaagcttttcaaacactgcccattaagttgggcaacaaatgtaaacataacctcagtcaagcagacttcttgccttcctgatttaaggacttatctcagaagttattgcagaagtatggcaaaattaagttgaaaatagggatgtaagttgaagaggaaatattcttttagtaagtggtatgaggattccctttgaggggagagccatctttgttgggaaaatctctaatttgaagagaggcagaaacagtaatacccaccaactatgctagggtttcctggtatttctcagactctcaacgttagtggagccatgtgggacgttttctggcccgtgggccatagacctcagcagtgaccacagcactgtgtgaggctttgaggtagtagcttgcaggagtgcttgatgtcttgaaatggctgtgctcctgtcacctggggtccctgagtgattgtggagtaggtttccttgataacccatattggacatccaccaagagttggaggtaatcttttgttgtgatagcctctaagattttataattagatttgttacgggagctttctctcacctatcctgttatatacagatcttgaaaagcctgggggtgcacagaactaatgtgcatgaagaacttggaccttgttctaagaaaagaaaagaaagagagtaatataggcaagaagtgaagggaggctgtgaattatacaagggaatccctaccctataacttccaaatctcgagtaaatgctacaaaaactcattaatacttgttgtgagtagatgatcagtaaagctttgcaccaggatgatgcaggaatagaagaagaggcaatacacttgctctcagaagcaatatcacaatagcatggggaagcagcagaaatcttgggcaggcttgtgagatcttcaacccatgaaataggcgggctgaggccctcctgtgtccaactcaagggtcaagggaagcctgagctttcttgtttttgtttgggccattaaaccatttcttatagtcacaggaaaaggtttttttactattaaaaaattactttcattctattcagtaaaatccaggcagtcttattacataatcaaagaatttcaagatctcaagcttacaaaaaaatcagtggtcacctactctaatccttccctttccctctttctggtctaatcccagaaggtggcttctgctctctgcttggacacctccactggcagagaatgcactctcccccaaagtagctcattccatctctgtgtggctctgacagtccctaaattctcccttacattgaactgcagtccttctctctgccactttaacccagcgacatacaaaacaagtctaatctctcttccacaaaatagggcttcaactactctgacag

SEQ ID NO: 44715 - DNA, 922 bp, Bovine  19866880376750
tggatctgaatccactgggctgtcttttacattcctcaatgttagggtgagtcaaaggcatattcagtaaacacataattttcagggttgtatgaactcttggactgtcacacttcacaatatatacatgcataaggaagcacgacactatcaaagaactaggatagtttgcgggcagatgatgacaaaaatccttctccctctgtgcagattgtctggaaactgcagccttcagggagctctatggccatgccttatggtcaaccttgtgagctacattatcttcacccttttggaatacctaagttgttaactgtcatggtcccacacccatacaaaccctctccaggcaggcctcaatgcagaagctccgtgaaatcttttgctcatcttaagctatttttaaatgacttataatgaaaagttttaaaatcccgactgttagcattaaaaagtaccagggcatgctgggaatcaggggcatttagtgctgctgccttgtataaaatgaaatcctaaatggtttgtcctaatggtattggcagatgtggttttatatttttaaatttcttggagttgctggaaaggaaaagagaacatatagatatgcctatgcagatgaaatgacatcataaaatacctgactgggaaggaaggggacttgctgtggctggattacttgttactaaaatagggaccaagagcaaagagaaagtgtatcatctgcaactgaatgttttcaattactttttactgtgctcgatcattctcactgtaacacatacattgggatgaaagattattttacatcctaagtaaaagaaatgcacatgtagtttttcctctgcaaatggagaccctgttgcctctcaccactttgaaatctgacaaatttgcagccgtacctgtatggtcaccaaaa

SEQ ID NO: 44716 - DNA, 1293 bp, Bovine  19866880433649
attttgttttaagactggctctaagtgaatcataattgctgacaaacaccaaattcacctttgtttaccaatgctgccaattatacattctcaagtaaaacaattaaaatcccaagagactttcctggtggtccagtggctaagactccatgcttatactgcagggggcatgggtctaacccctgatcagggaactaagatccagtatgctgcagggtgtggccaaaaataaaaacaaaattccagaattattgttacttcttccactccccttcactcagcaattttgtctctttctgatattgccaattgtctgttcatgtaatctttctatgatattagtttcttcaactccattctttgggtcaggctctgatcatctcccccctggatgattacaatgttccaccaccaaggttctagttattttctctggttttccctgacttaatctttgcaattattcaaaagctacagacacctcctctggaatcatcaggtgactcttctgctggttggaaggaagatggaggccccctccaagcacagcttcttctcattaccccctgtgtatttcctggactaccatagaaaagctgtgttgttccactgaaaccagaacactaaaactaactttcaggaaaaatgtttttgttttcagaattttccaatatggaaatggagcaacttttatccagacaagagtacacgaataacctttaactcaatactgccctgaatctgtcacttctcaaatgatatccagccatttgtattttgggaaagactgtgagttcacagcctcccttgtctattttaacttcttagaaaaactaatcttttcactagccctttcattctacatcaactagttctttcactgttaccattctctgtccttctcagcacaagctctattatttgattgccatgtaggaaacatacctcccagatggtcagatatggtaattcccaatggtcaatgtgaaataaaacacgtggctcccaaatcttctttttgttaaaaacttccactgaaatatcgaagcaactgcaccgtcgacagtagagactacaaatgggatcagtcgctttttaaagatcagtaagtctctttctcttccatgtctcaaaaactcccattgaagtagacggtaaaatccacttagatgttttgagacacacgtaaagggtcacttcgctttgcaaagagaggacatgcatgcagtatctggctacgtgaaaaacttacatgaaaagtccattagttgtccatctttcttatttttctcc

SEQ ID NO: 44717 - DNA, 2642 bp, Bovine  19866880437016
tggaagacagggtatacccccataaaaaaacttaagaaggaatgccctccttcttaccctcctcatcccttcattccaccacacaagcacacccagagcaaggacatttgacccaggatcagccaaacagacaccctcacccagactttgaatcatggaaacaagagatccaaggacaaagggatagctgattggtggcccaaccagggacgatgtggtcaacagccttgacagtgtgcggcaggcccaatgataaggagcacactcacccctgcccctgccaagtttagataaaaatgtctttgataaggtgggggaaagtggctcttttagcattaagatgttctacaattatgcaaaaaggtagacaatcttaggaatatttgataaggttcagcaaagagacaaagactcagctagcatattaacacaccaagattatgctccgcgcggtcagtcaatttttgcaggagggaggtttgcttgtcttgaagatgtgaagatgtttcacatctagtatgggcaatgccactgtttttgacccccttctacttgtaaaacctgaaaacaattctcagctcctactctaggtctatcaaggtaaaatcagatagaaataaatgcctggacttaataagaagaaaaagaagcagaacatggggtagtaaaagaaaagactataggaattagaagaaagacaaaggccaccgaggcctctggaggtggacatgggtggatgcagaggctgctcagtgtaaggaggggctgtccattcccaactctgattctcgtgggagacactgagctagaaacaagctcctttctttccctgccctcccacattttttgtcctcaggagcaggaaggacttcagtgactgggagcttttctggcccactcttctacaatgcagaatttttgtgggactcacacgggatcttgcccttcaaaggaaagatcaacagattttggagataagttccattgagaggtatgcgttaatacttttggctaagatagtgacaccaaggctcatgctctcaaagtactaggagagagcaaggctttgatgatctttatagtctggggcttgtctggtcggtcagacagtaaagcgtctgcctacaatgcgggagacccgggttcaatccctgggtcaagaagatcccctggagaaggaaatggcaaaccactccagtactcttgcctggaaaatcccacagactgaggaacctggtaggctacagtccatggggttgcaaagaatcagagatgactgagcgaattcactttcactttcacagtctcttctagctagaacattctctgttctgtgaatattcgtacacacccttcataacacagcttttatccaccgtggctctgccgcttcttaggcaatcccttaacctgtgtgtttgtctcagtgtgtatctgtatctgcaactatgtattttttttctacctatctatatggtatagcggacactatgagttactacactgtgtctgttccccttcttttaaacatacctcattccgttctggtattctccatctacacagccatgtacctcagggcaccctgaccccagatccagaaacagacctgattagcgtaaaagtaatcctatccctcttgtcaatgaccagttcaagaaatgcatgcaatgtaattctatcctatgaggtatgaagggaagtctgcaggagggcttttggaaaaaaaaatttcacactcctaagacagagagtcacgggggagaaataaccttccattttcctctgaaaatattggagttttgcctagaactactatagtcatcttcttaccagcttgaggtaagacaccaatgacagcatttggtagaaataattgcaggtcttgatgacaatgttgagctactgaaaaaccaaccctgaaatctgtccctagctccgacccaaaagaatgtatttgcttgttgttaaagacatttttgagttgaggtttctgttactatagcctaatgcaatcaaccaaaagagataacactatcatattttaagggcccagagaagtaaaatacattaaaatgtattgtaaaatatttagtataaaaatcaaacatgatttttatcatgaataaatgcttaattctgtcttccacaacttcatgaagttttttcaatatccttaaaacaatttccaaatataattcaccttatttcaacataaatgagggtgagaagatggaaaatgggaaacagatgtgaggtgctctgtgacaaccgcaggactgggtaggaacggtctggtactcctgttgctctacttgataggggttctaccctggcccttcaacccaaactcatcaaactagcctagcttttctcaagcagtttactactttctttgtgtttctctgtgctattttctttccgtgctccctttaactccctgttgtcatcccattgactggaatgacactcaatagcaaaggcaggcataatcaatgtcaaaatatagtctgaaatcggccctggactcttgcagctgcgccactttctaattcacttggaactttatggatggctttctctctcccatcacagagcaaataacaatgctgaggagacagagacaggactgcactctgctc

SEQ ID NO: 44718 - DNA, 2810 bp, Bovine  19866880519581
tcagactccctaaccagaggccggttgccgctggcagctcgctgggcccacgtgctctgcgtctgcaatgtcctaccatcaccctggccagtgaggcttcaggcctaggacctcatcaccagcccacctcctactccaagaggaaaggccctccggctaagtgcccacagttctgggccagcactactcttatagccagattttattctttatttgtgtgtgtgtatgggggtgatcttttgagatggttttgagctgtcataggtgcttcactcaaagaaatacggagcaagtgaggagagcaataatgagggttcatttgggagtggatcaggtgttgggaggcagtgaaggtggctgaaatctggatgggatgccacaaggtccctactgtgtcgctctcactactcagcaacgttaaagagcatcacacaacgttgagcattttggagttcttaggtcagtgcagaagggctggagcttcaccctgggtctgatccacactcaaaccaaggagactgggactcaggagcacagaaggcagtggaagaacacagcggaagtagtggggaggctttcaaattcaactcctggaatttgggttctgtccaagtttcatcaagatttccagagaaacacagaggccccaagcaatgaagagtccaaggacatttcttgtagtggcctccaaaattagcagaagtcttggatcacagagacccagcaggaaaaagacagtacacttgggttatgtgaggagcgtttaataaagagactatgtaataatacaaagagcagcacggagatcctacaagttcagtaacgggtgagagttgctgcgagagcaaggacagtgagaagttgctaaaactcagagaaatagagagagctgtgtcacggtgaggctacctgggggaacctgggaaattcagttgagagctgcagccagcccccagtgaccccacaggaagggagctagacgaacaaatatcccaacctttctccaccctccctccaatctcctgtccactgtccaaactcagcgagaagccagaggataaagaaacctgtccatccagtcaacacaagtcaaccccctggggcacaatacaagatgaagacttgtattcttcttgggtggacactgggcctcggggggaggaagagagagcggaagatgtgctacacaactctagcacattggttttcaggcagaaataacaatgaatcggaaaggatgcacttgtacttaatctctcctatttatcaagcattctgtaccccaaacttcacaaaatttttttaaaaaagcttctgttcaccataacaactctagcggtgggggcggggcagatattggtattacagagtgaaaaagccaaggttcagagaggttaagaggctggcccaaagtcacagagctggtaagcatcaagtttagtgttcaaacccagaatgcacacagagggaaagggaggctttgggttgatacataaaatcctattttaccacttctgatgagaaagaaaaaaatgtacttcttttacttaaatagttgttctactggcttagagtaccttcataagagattaaccatttcagttttcaacagagcgcttttagtaatgaatttacagaagacccggtatgtctagcatagaagtgacaggcactattaaatggaactacaagggccactaagcatctttggtttaaaaggcaatgtgattttttttaatatgaaattttatttctttttttggccacaccctctgcagtggaagcgcagtcttcaccactggaccaccagggaagtcccaaaattttaatttttttaaaaggtttaagaattgcaaatacaaagtgatttctcaatcacgcatacattcatatttctttctcagatgagacctgcctcctgcatcactcccttcaccaggtcctttgaaggggacaaaaagaaggaccccctcatctccatttcctttaaagacaagcaggaccgtgcgtaacacttgagaaaagcaaagttctcctttataccacagctggtctagaaaactggaatgagttggaaagtaaatattagcactgaactgcagctggcagcgtgtttacttttcagtgcatttccttctgaatcaaaagaaattttacttttgaatgaattgaacaaagcaccacctagtggtagtcggaaatatttaaaagtgaagagttcagggaacacaagaaaatacggaacgaattcactatcggtttactttaccaggtaactttcaatattaaaatattgaagggtttacatagttggggttggggtggggggctataactgtaaaaagtcaggcagataaactcctgttgaaccaagtatccctgaatactcctttcttaatgcacatgctgtgtcatgtacacagccaatggcacacagattctacttgtgtagagaaatacaccctccccacatttcaaaattttcatttcaaaactagcaggctacctgaatgggaaggaagtccaaaagggaggggatatacgtctatgtatggccaattcatttcgttgtacagtacaaacttacacacagttgtaaagcaactatactccaataaaaattaatttaaaaagaaaaactagcaggctatgatcgcttgcttcactagatgtgtcaataagcctggcagtgtcccttctgtgcgtagcctccagtcacctccactcttctcaaatcttgatccattcacccgtctctctgaaggagctgctgtggcctggacttcacacagaagaggggagccgtcaca

SEQ ID NO: 44719 - DNA, 2243 bp, Bovine  19866880521909
ctgccgtctatgaggttgcacagtagttggacactactgaagcgacttagcagcagcagcagctaaaatttaaatccaaacgtttccagaatttatgtttttaacagctattctgtatcattactttaaactttgttttcttccttttgtttatcataaaatagtagtttttgatctcattttgattctctttgattcattttgaatttaaaattgggctttccaagtggtgctagtggtaaagaacctgcctgctaatgcaggaaacattaagagatgctggttcaatccctggttcaggaagatcccctggaggagggcatggcaacccactccaatattcttacctagagaatcccatggacagtggggcctagcaggctacagtccatagggtctcagagagtcagacatggctgaagcgaatgtcttcatacttagtgtgatttttattgaattattgattggtcattgataaggatatcctctagtcaagaggtgactttatgggatagtccttgtacctaacgagacttatgtagagtgcttggaaaatgttgttaggggatggtattttacgtttgaatgtgggaaatgttcaatatatccaatatgactattttgttgagtgagagaaactttttaagagatttaataatacaaagcatttgtaaatggcacatagctaaaagtagataaatcttagctatttttcattgagactaccagaatattttatagtactttaccaaatatagatttggtattgtattgctagctgttttcaaccatagtcattgtaactctttgttaccttcttttcctttgtaaatactgaaactgtgttttctccctttcctgactctcttatatcagttttcccttttgtctgcctagttttagatttagaaataatatgaagccaagtctcttttatggaatgctggatatggtgttccttttagttatagaccttacctttcagtagcgtatgagtgacgttaaaagtgtgctttagttagttttcgctgggtaaatgcatgctcagaggaaacggtctcaaatctttgttcaaaaagttaaagactaaggtagtctaataaatgttaagcatttatctggaagaaaaatacatttttgagttgaaagtgaagtgaaagtcgcatagtcgtatcctactctttgtgatgccatggactgtatcctgcccagctcctctgtccatggaattctccaggcaaggataccctcctccagggaattttcccgacccagggatggaagctgggtctcctgtattgcaggcagattctttaccaactgagccactagggaagccctttggagttatgttttacctaaaaatctgctaaagaaataatttaaaatgttgatgccttgttttttaaattaattccagtaatcagatccttatatgatttcactgatttcagtaccttttgtagaatttaatggctttcctaatgtgtaaccatcttttaagaagttccttgtgaataaaagataattaagtgaccagttaatttgctggaattaattaggatataattaatctaggtaaaattcaaaattttctataaactgtaaggaaaatagccaaatataaggacatatccatttatatagtgatgacatgcttgtaatttattatcgcagtggctaggttagagactcggagaaggcaatggcaccctactccagtagtcttgcctggaaaatcccatggaccaaggagcctggtgggcttcagtccatggggtctctaagagtcggacatgactgagcgacttccctttcacttttcactttcacgcattggagaaggaaatggcaacccactccagtgttcctgcctggagaatcccagggacgggggagcttccatctgtgggatcgcacagagtcggacatgactgtagtgacttagcagcttagcagcaggttagagactaaattaacaaccaatggaaaatttgttggtcccagtaattacagctaaatggtgatttgaaaatacttaattgtatgaaagcactgtcatctgaaatctgtattcaataaatgtgatctgtcaacttacagacattatcttatttaattcttttaacaattctgagttaggatattattatcctaattttgcaaataaatagaggcttaacaaagttaacccatctggggtcatggagctgtagctgggattctaaccaaacctttttgac

SEQ ID NO: 44720 - DNA, 1023 bp, Bovine  19866880534939
tgtccctaaaatatctgtcctcagcacaggtgggacactataccttcctgctggataccagcagggttcttctgctctccatgtcaccgctcactcttgtctcctgttcttcatgagccaagcgacagaagacctgtcctgggtaactgcctggtccctcttgtgtttcttgttcttacatgcttcatccagctcctggcctttgtcccaaagctgtctacagttttcaccagcgctgagttggggtactcactggcattgacttcacctgtccaattcccctcgtttgcacctgtgctaacgtggccaggcccagttttcactgtgacactgcctgccttgtttattgatatcaggaactggatcaggatgttcatatatcagatgaatgacatgtttggtaggaaaacagttacaaaatgagaaatatatagatttaaaaccacatgtcaaatacattgatatttgttcttaatctttattcaccagggagcagtgattgaggacccaagcagcagaatattaccccctgaaaaacaagggttccaatttttgactggttcaaatttaatcctctgaaactgtatggcatctttcagattcctgtagagtgcctaacaggcaggctgtttgggcaggagacccaaagtcttgaaatttcagaagaggatatgctgaaatccaggcctccctccttctgtggaaatgttcctccctgtatattgcaacactcttgcaacagtcctctagaaatgtctcctttaggcaactctggtttagagcttcctcatgtttgtgattttctttggaatcctgtacttccacctctttgggacgcttattgtcttgtatacaggcaactcatttttctcttgaatattattatcacctattagagtgggggtttggtattttcagctctgatgtcctttgcctgggacctgccaatttactgactaggttccagcatgtaactgaatctctactaccagctgtggaaacctaatatggagacagaggatc

SEQ ID NO: 44721 - DNA, 976 bp, Bovine  19866880560444
tactcttgcctggaaaatcccatggtacagagaagcctggtactacagtacctggtactacagtccatgggattgcagagtcagacacaactgagcgattgcttgcttgcttgggctaagtaaataagcagccatcatctcagagactaatggtattagcatcacacaaagacaataagcacagttaaataaaagaatgaatctaagtccataaaagttttgtgcccccctcaaagaggtgccacaaccacctatctgaaagacttcaaattagactttttaaggcatatccatatcaagtgtactcaagggatgaagcttggcagacaagatgatgccctgttctttgggtagaaagtacctcagttgcactcaacagccctagaggaaaaagaacaagacaggaagtgagttcatccaggaaagtgtcctaatgagtggttgtctcctctccattctctaatccatctcccgcttcaacttggctggcatgtcagggggggtgggagaggtaccaccgctgtaagagtggtatctggagagctctcttcacacttcacattatcatcaatggtcctttcacaagattcccgtctcataaggctaactgtctcttgactcctattgaaccctgggtaagctgccttcctgcagcacgcccatctatgtaaaatgctgcaaagaggatataagcagtataaaatcttgatagaacaaaataaaatgtgcaccaatgtgcatctgatagatgtagcaattgatttgtggattaggtttttattttcagcccattgaaaagaaataatgtatggaggcaatctagtactaagcattttagaaaatctatttgagatcatttcagcagaagctctggcagtttgtcataagaggggaggagagcaaaggataattgtctgcagtctagtaaaacacagaataactgccatcacacttgagtgagcttatagccagccgg

SEQ ID NO: 44722 - DNA, 3206 bp, Bovine  19866880582640
ctgtgctttaataagttccccaggtcattctgacaccactgaagcctgagaaccactgacacttgtttttaaagtagttgcccagagtcagtgctagataaagtttcgctaagattatcactaagaataatgtttactcaatctgtattctgtgggcttgtcctgaaaatcagccataaattcataagctcttagtaggaagagtagtatttgacattgcttttatatccatcatgtgccaagcacaagttaggtgctccgtcagcattatttgaccggccgaacaatttctaaaaatggagttgttttcttgggatctgtgaagccactcccagtggctcggagtatgtgggtgcaccacaatgaatacttgagtccttgaaattaggtgcaaatgtttgtatttttagttatatatctctctctgtagatgctctaatattttcaccacattctcaaagactccccaaatttagacactactgctccagagctcaggcacccacgggttaaggtgaaggatggcaagtgccatcacactggagtggggccagatgggtggatcctcacccattggtggtgcaggatgggagcctgaacagaaatatggcctcctctgtttcccctcctctgcccctggccatctctgccctgctcctccccgattcttcttctcccagaaaaactgcttctctaattccagctgctgaagaaagtggggtcgacaaccctgcatcacatcatggagatggctgtttaatttgagatgagtgttacattactcattgcccggggccccctttgatccaccagcatttgcttcttttatccccgtgtagtgcatacattagtgccctgaatgctccgtggtcttgttgtctttcagatgttgtcagagattatttacttgggaaagcagatggatatcttgtttaatgtcaaaataattactgttttgttggcctgatagcttatttactctttcaatgtttttgtgtttacatcaaaagagcattgccaaaattatattttatctgttaaagtaaacaggatatgacaaccttttttaaacctgatttttctgtttgaggagttgggttattaaaatggttaaaagataaccggaaccaagtgggaatggtcactccagctgcaatgcaaatgcatatctgcctgctttttatttgtaaaaaagctgggaaaagtccgtaaacaatgctttaaatgaggagccgtataatgcagtggttgaaaacagacttcagttcgtttcaaatcccagctctgctgacgatgacttgtatgaacattaatttttcaaccaatctgtgtgcctcagtttcccaaccagcaaaagagatgtagtgatggttgtgaaagttaaaggagttcatgtacataatttctaggcatatataaaatgctgtttaaatattggctattacttaataaacttaagttgaaagtagttctatgagtttgaagtggagagaggaacaagctatataatcctacgagagattaaaagacctggaatgagtctccatgagttaccaccttccagctcctcagactggtgatcgccttgtctccatactgtaaagcagggaaccttttaagttctgaagcctgtcctgatgctgttcctagttcttaactgagctgagctagaaaggtgttaaaaatgaggctccttggagaaaatgtaccctccgtttctctcttcaataaatcactgtaagataattcatctacttctaagagtttctccagccacacccttttactcattttcactgagcaacttttatttcagcttgctagtttaccaaggaagtacaaggaagcaaagttctctggaaggttgctcccgccgaaccacctgggaagagccataggggctaggaattctgtaactcaacctctggtggaagttaggttattttgacctaactcttgtgtgctgtgttacttctttatttttcatatgatcagccttctattacaataaatatacactgctgctaagtcgcttcagtcgtgtccgactctgtgcgaccccatagacggcagcccaccaggctcccccatccccgggattctccaggcaagaacactggagtgggttgccatttccttctccaatgcataaaagtgaaaagtgaaaagtgaaagtgaagtcgctcagtcgtgtccgactcccagcgaccccatggactgcagcccaccaggctcctccatccatgggactctccaggcaagagtactggagtggggtgccattgccttctccgaaatatacgttactagatgctaattcattcagtcagtccaaacacattgtttctagttgcaaaacagtagttttgctagctgtttgataaaataaatgtgttggtttaacctcaggtctgctttctcaagttcaccatcttttctcaagtttattatggtgtattagagacttgtctttctttcggatgtcacttcatagagcaccagtctcccatcctgggaggaatgaattcagaaattgttgcattcatgtggtaagttagtaggtttggtgtctgttccaagtctgtaaaacccttgaagttccctttttgtcctgtagtgatgggtaagatgactagattcagggccagaagagaaggctgccagagcccactatattcccagaaagtaaagagattgtggctggctccttaacttcccccaagtcctctcacaacagtccagggaccccatgaaaaatatgtcttgtcttgcactagatggtgtacctatttcttggcccatgtagcaggggttattcatacttactgtactgtaaattccctgagtgtacctggccttaaaagttggcaatgataatttcttacttttgtaacacccggaatttcaggaatatcagcactgagaagtctgagatgggcacagtactaggcaacaatataagttaatcactaatgaaacagcaatttcatcaagaagagtcatagtgggatataattctgtgttgggaataaataattcttagacctaaaagaggggtttccctgatagctcagttggtaaagaatctgcctgcaatgcaggagaccccagttcaattcctggtcaggaagatctgcggagaagggataggctacccactcccatattgttgggcttcccttgtggctcagctggtaaagaatccg

SEQ ID NO: 44723 - DNA, 1238 bp, Bovine  19866880633193
ttaaattttattcttttcatttctctgattagaactaatttactaattacataggacagcagctaaagtaaaaagagacacactgaaatctgttagcattaactgttatagccattctctagataacatagtgttgccatatatagtttagatatgagtaatgagaatgtgattgcaagccaatatttagggaaaagctaggcctaagggggccacaattctgatggaatgtcttgatgacggatttagtcttgtcctttctcaatttatttttctctgggatgcgtttctatttggggcattaaatgacttacatttcatggacagaggacacttactaattgtgaaatattgggtgagttatttaacctttctaagactccttatctttgaaatggggataataatagcatctacctctcaacagttatttatgagaattaaatgaaacatattcaaagaattcagaataatgcctgatacagtgtaggcactcaataaagtggtatgttttattcttgctagaaaagaagctaagaaataaaagatcatctcaattgtcagccaaaagtaatcttatttgaacatttcctctcataaatcacagctgatactagatccaggagaagttaatggtgccaacagaggaatcactgaaagtaggaagaataatttatataacagaaggattaatggtattcacggcaaatatagaggtcttcacactctggaatccaagaacttccgctcctccaagaccaatggagatgatagtcataaatttaagcaacttcaaatgggaaaaaaattacctaaagaacattaaatgggagaatcatcctgagaaaagtaagagttgttggaacctgatcctcaaaaccttgatatttcacatgagtgggtcttcttctcagaaatgggaaaatgggagagctactggaaaagagggagacatctgaacccaaccagcatgaagcaaaggacagagagccaagaagagagagagagaaatggttgctagggaaaatcgagaacagcttcctctcattgacttggagaagatcctgtacccttccttcagcgtcagagtatcctgctttggcctgtgatgtgggtgaagctgaaggtgtgactccatgtaaagaattgtgcaaatgtacacattctctagagagaaatgtaaactcacaggggaccatgttgctaaaggtggtaacagctgactacaagacattact

SEQ ID NO: 44724 - DNA, 682 bp, Bovine  19866880638309
tttggtggtttctttcttgattttttttttttgccttgcaacagaaactactgcttaaaatgttttaaatttgtattaataacacatgtaactgtgtagcttactgtgactctgaaaactgtagtgttggtgttgtggaaatgtatgttatttccaaagtcattttattgaaggtaaaaacaaaagacaaatgaaggagaaatgaggatattcccagataaacaaaaaccaagagaattagttattagtagacatgccccataagaaatgataatgaaagtccttcaggatgaaatgaaagagctgctgctgctgctgctgctaagtcgcttcagtcgtgtccgactctgtgcaatgccatagacgacagcccagcaggcttcactgtccctgggattctccaggcaagaacactggagtgggttgccatttccttctccaatgcatgaaagtgaaaaatgaaaatgaaagagcactagacagtaactcaaaactatatgaagaaataaagaaaaatagtagaagtattgacaaaggtaaatgtaaaagtcaatattattgcaagtttggtttgtaaccttttcttcctatatgatttaaaaagtaaacctatggtgtaaagtaataactataaatctatattaatcggcatgcattgtataaagatgttccgttcatttca

SEQ ID NO: 44725 - DNA, 2107 bp, Bovine  19866880705710
tcagattggcaggaagccactcttctttttctgaaattctcctattttttgttatgttgaatccaaactcattaaggtaactgatatcttctgttaaatacagaacacttggttactcctttttttttaagtacatgccaaactctccctatccctactaagtctcccccttgaccccccaacctctcacccctccccagcacctccctcccacacaaatacagaaattaccatatttaggaaaggtggggaaagtactgtattttcaaaaaatgggattttctggttaattctctgatgaactaaaattgagcctctgtgtttcatgctatcttcattccttaacaagttcagcatagtgcacacacatttgttatatgacttgaggttatggggacatagggccgtctttccaaatggcaggtctcaccgggcaggattttggacacaaacaaagaacatataggatattggggtcaatgtgatctgagaacacaccctaggaggtagtttggagaaccaaaattctctttggttgtcattttatcatttgacttatgttcagttaaaagcaaggagaataaatctggctgtctgaggattgctcttagttgaacctgggatggattctagaaacttagctaattttatctccattgttgtttatctgcataaacataagaaaatcaagacaatataatttcagctaacttcatacaaaatttattctcccccatctctcttttctagtttctagaaaactgaaccaaattttagaacattaaaaggaaaaaagtagaccatatcagccattctgcttacattagtgtttccatccttaagcttcttgctctctttggatgtgataatcatctttctctctctgcattttccatgggaccaattcttgggaaacacaaacctcagtattacccatggctgcaaacctcttaccagttttatgaccttaagcaagttactaaacatctgtctgcttacctgtgaaacagttattacaataatctgctagcgttgggcttccctggtgagtccatggggtcgtaaagagttggacaggactgaatgactaacacacacacacacacacacacacacacacctggtagagttactgtgaggttgaaatgagataatcaggtcaatgcttaatagagaaagctctacatacttaaatttagctatatttattgttttgctgaccacttctctcagtccacacatagcagtgtttcttagaggagctctcagaccaaatacatcgtaattatccagggagtttatgaatatcgctgattcctggtccccaggagagtctcattcaacaggtctgtggtgaggtttagaaatggggtatttttactaagtactcttcaattatgcaacacccaaaagtttgggaaccactgctatagttgttttaagtaacaatttgtcaccagcaaagcccacaattcccagggaagaaaaacagaatctgagtaataagataaagtctaacctttttctccctttgtgcttagtctgttttacttgctcatgggggctgagtgcagaggccttgcccccagcccttcagaccagagatcctcacaaaacatgcaacacctcagctgcatggaccctgtgctgaaagctcctcacacgatactcaactcaagatggcggtgggccatgtgcacgtgccgacgctgcgcctgcgctgctctctggagcctggacagcacagtcacacctgtcccgcaagaacaccaacccctcctgctaacatatccctgtaaagcagccccacccacagcctgaggcaggtgggaagcatgtgtcctagagcttgcacctctccattccttgataaaagataaagctttgctttgcttcagaaccaaacttttcttattctattggtgtgagttacaccaggcagaaggacccttgttggggaccaattcaggaggactgataacaatttgattattcgatttgttctgctaactagtaggttttctttaatttgatcattctgttctgattgggtctgagctctactctagaaacccatgcagttcacacccctatatcatagactctg

SEQ ID NO: 44726 - DNA, 2597 bp, Bovine  19866880726436
atgaaagggaataagagaatcttggaatttgaggccttgtaggtaggcttgcccataacatttttgaggtctgaggccagagcacaaaaatttatattcagttgtctagatatgtgaaagtataaatggagataaaatattaaataaaatatgttccaccttcctgccttaacaaatatagttccataatgaaaaaataaaaactagtttaaatctattttttatgactgagagtcaacaaaatgtcacagataattattgcacatattttaggtggtctttgttgggtcaataatattacatgagcaagaatattaagaaataaaatttatgacatttgatataattcttttatgaaatcactaattatagatatagtaagattttatattcctgttcttttgacagtagtgatataaagggttaaaagcaaagtaattattcaaagtataaaagtttaagtagaattttatcaaaatggaaaattatatagatgcaaagtcaaaatcaaaaattaaaattattttgttttcaaaaacattttctcccataaatagcaaaattttcaatctatgaaaaggtaaaataatatataattttattgtaatatatggatattaagcttataaatcaagttaataagtgtaaataactttaatattttgaaatgttaatcttattgctattttataatttttattgcaattttagtgttcagtgtctatccagttgccaatataaaggaaactggcatcactttatgcatgcatctagatctgatatttacaaatttaagagtaacatgaaaaaaaaaagagtaacatgaattattaatattgcacaatgtttctctggcactatgtacatcttttgacaatactacagattggaacaggaaaagaaaatgagcatttgacattactgggaagtcgtactttgtgcatgaatttattgcattcatgttcagagaagagatttgacaaattagtcttttttctttcacttccataacttgaatcttcatccactacaaattagtgttcatctctgatatcagcagtgacagcccacaaaggtacatgtcactctgatgtagttactttgttttgatgatacatgaaagagatgtagagaagtgtattcgtggggcctgaatggtgtaagttgtgaacagctgttggtgctgtgccagggctgactgtcagatcttgagtgacacagagactcgctgaagtatggagccgagggcagtagtccctcttgtctaggtctgaggggacagagtggcagatttgagaagctgctgctgctgcttgctaagtcgcttcagtcgtgtccaactctgtgagaccccagagacggcagcccaccaggctcccctgtccctgggattctccaggcaagaacactggagtgggttgccatttccttttccaatgcaggaaagaagaaagtgaaaagtgaaagtgaagtcgctcagtcgtgtctgactcctagcgaccccatggagtgcagcctaccaggctcctccatccatgggattttccaggcaagagtactacctactcctaaactccaaagaataagagacctgaagaaaaagtttgaatatcaaaggccaatcagtaataaacccagcaacaaaggattgagtcttctcactgaagtctgatggcatcaaactgccagtgattagagagagagagaggcctgggagtgagacagtaatgtagtaaagtgatgtttttggaaagctaagaattggaatgaaagttgggtgtgcctactggactcatgacactaacttgaaacaaaaagatcataagccagttgagattttgagaaagttatattgcagaagaatctctgagcctagactaaaaagcttttcacagattgaaacactctctggccccaaaacttgcagaggcaggaagtaggctgtgaaatcaacaacacccaccatgatgtggccaaagaggatacagaacatggaagaacctccagaaaggtgatctggggccacagaaaaaagggaaattccatcaacaagtggcatcaggcctcatccaggaaattccccaactgccagcaaaaaaaatcctcacaatgcctgtcccatcagactctgtagttgctgcggaccagtgattgctgtgtattctccagtggtcctttttctggagggaagtatctgtagtagttgtcctctcctgaatttgcagtggtttagtaagagtactaaacccactccagtactcttgcctggaaaatcccatggacagaggagcctggtaggctgcagtccatggggtctcgaagagtcagacacgacttccctttcacttttcactttcctgcattggagaaggaaatggcaacccactccagtcttcttgcctggagaatcccagggacgaaggagcctgatgggctgccgtctctggggtcgcacagagtcggacacgactgaagcaacttagcagcagtagcagtaagagtactggggggtctgagggaagatagcatgtccactagttcatgtgttgtgaggtcacacagagccaaatccagatctcagagatacgggtgtgctg

SEQ ID NO: 44727 - DNA, 847 bp, Bovine  19866880748919
atagtcaaggcttcttaagcttattggaccttgtttcctgctttgtatcctctttacagccattacagggatgggagtggcagttccctttgagggtaacgagacacttggaaggtttaagcagagcctgagtgaccagttgacccagagttgtgcaggggattcatgcatcaggtagaaagaagcttgacaaataggcctccaggccctttaaacaagtttctattacttgggggagaacttaaaactttcaagaaaagttaaaaatattccaaatgtctgtggctgattctaaagaatgtacatctagccctttccccagctccagttaatctgttccagtttatgctagttatgctctcattatttgggaggaagggaaggagacttggaccctgtccaaggagtgggggtgttgagctgcttttgcagtacactggcaggaggcagcatgtggcatgatgggggacctccaagtgtccacaggactgaaagggacttttctggtctgtattcaggtcccatggcaatgtgggcaggttctgaaaccacattacaccagtttgcagaggtttagatttggatggctggagaagaaccccaacctctaagatccacagggtttcttctgtaggtcagaactatgggtcaaagaactctagggcttcaggaattaggggagagagaggcaagggtgtgattgcataggtaagggcacagtcacagtttttcctaacaatctatcattttctttctctgttgttgaaaagttcttaaatattggtgtgaggtagggatcaattcacttgtattgcaactcaaaagtgcacagaaaagcattttaaga

SEQ ID NO: 44728 - DNA, 1192 bp, Bovine  19866880786348
tttattgggtgcttaccctgtgtcgggatcctcttaagatctttatatatagtaattcctttaacccacacatttcccatgtgataagtacttgtattatcattctcattttataactgaagacaaagagactcagagaaagtaactgactgaagttcaccctgctagtaagaggcagagccagtttttgaacccagactcactccagagtctgtatatgaaaccatcttcaatgtcatttctgatcttggcacaaaatgataaggacttgattcagggcttgtatgttcgctagggaagtggaaaagagggggagatggaaatgcaaagaactctgcagagaaagactctaagaccaagatggtggcatcattgtgggaatgaaaggcaacagagaatctggagacagtcatactataaggagtcctagaggtcagtctagccttgtgactagatgctccagacatggctgatcatcagaatcaaacaggaagttattaaaatacagatgctaggaccctccagaaaatgatcaaatcaggcctattcaatcaatgtctttagagctaaagaacttctaataagccctccagataattttgtatctagcctggcaaaaacttaagtctgatactaccgacttttgacaaagatgtataacaaacatcaggtatgcttacacactgtcagtgtaatttgggataactattttttgggaaaatacatatacataccctatgacttaggacctatagtccagagtatataaccaagagaaactcttacatatatacacaagaaaataaaaacaaacaagaatggataaaagagcactttttgtgttagcaataaaaatggaaacaaatgtctatcagcagggggaaagataaatagtggtgtattcatacaatgggctactactatacatgagtgaaacgtaaaatgcagtcacatgcattcagcatgaataaatctcataaagtatggcacaaaagataaagtcacagaagcatacatacaatatgacttcattgatatacttgtatgaaaatgagcaaaaccaaataatttttaagagtatatttatctgtagtaaaattatgaagaaaagcaaagggatgataaaattcaagaaaatggatttggaaagaaggagaggtatgttatgtgttaatagttcagggggttttaa

SEQ ID NO: 44729 - DNA, 3522 bp, Bovine  19866880790666
tttctatgatatactctgcatataagtaaataagcagggtgacaactatacagccttgacgtactcctttccctatttggaaccagtctgttgttccatgtccagttctaactgttggttcctgacctgcatacagatttctcaggaggcaggtaaggtgatattcacatctctttaagaattttccacagtatgttgtgatctgcacaaaggctttggcatagtcaaaacagaaatagatgtttttctggaactctcttgctttttcgatgatccagcggatgttggcaatttgatctctggttcctctgcctttgctaaatctagcttagattctggaagttcatagttcatgtgctgttgaagcctggcttggagaattttgagcattactttgctagcatgtgagatgagtgctgtgaaagtgctacactcaatatgccagcaaatttggaaaactcagcagtggccacaggactggaaaaggtcatttttcattccaatcccaaagaaaggcaatgccaaagaatgctcaaactactgcacaattgcactcatctctcaaagagtcggacacaactgagggactgaactgaactgaactgacacttacaggtgacttctctgaactttcctgcaaccagtaaaaatgttttttggtgtcaagaatatagtttgcttaacacgcaatgaagctcttttctaaacccttttcagttacaaaataattctgtgttttccaagtgggatttttatttccatctccccgcccccagccctcccctgcactcaggcctcttgctctgtcctgtgatgtgttcactcattactaactgggcaggtcacatggacatgatctcatggatgctatttcagttcaataagcatatattgaacacctaatggcaccccactccagtgctcttgcttggaaaatcccatggacggaggagcctgttgggctgcaatccatggggtcactaagagtcggacacgactgagtgacttcactttcacttttcactttcatgcattggagaaggaaatggcaactcactccagtgttcttgcctggagaatcccagggacgggggagcctggtgggctgccgtctatggggtcgcacagagacggacacgactgaagtgacttagcatagcatagcatatgacatgtagggcattctgctaaggagtttctgttaagtctcccagatcagaaattggttatcttagagaccttctaaaaggcaattccttaacccaagacagcaaccagatgaaatagggcctcaagtattcctaaaacatctccttaaatctcttcagggacccaccctggtattttcctggatgacctattcggtatagtgtctgcaaacaagctaggagccaagaaaagtggggagcgatgggcatccatacttcagaagctattcctttattcaataactggtttcatccatgacattaatttaatgatttgtgtgtgctgggcaggtatatgttcaattattccacaaaggaccatgaaaatttcagtgtcccaacaactaaaattctctgtgttgcaaagccaccaagctggcctggaataatgaaattcccatgaaattgaattgatcctcaaattattgcttaaatgatgagacagtagaacttgagggaatattaatgctaatgagagttcttcagcgaatgctatgagaccagttgcaaagtggattaggcatactatgaaaaaagccattatgctcatcttttcatagatgcatgatttgttttactcttaaaacatttgaggtttaaagtttttataccatgctctatgaatagaagtgtaatgaggttgaaaaccaaaaatagtactcaccactattagaaaaagaaaaagaaagaagctctggttgaatgctgcccatttgaatcccattttctaaaaatctaatttttttattacttgtctcattaaccccaagatttagaaaattgaatggtgtccgagtaaaatgagtgacagtgtgaaatatttttaaagggcccgtctttctgttgatcttctgttaaacattttaaaattaaaatgttcttacatgataaaactatttggatatgtaagtgatttatcccaaagtttgaatccacctgtcttaaagtgtatactgagcttttatttatgctttgaaaatatagtagataaaaagcataagtgtttctgatattatgttttgccatctccagcgaagaagattgaaatcttgagaaacaattttctgaagaaatgaaatcgtatgccctcctgaacccttgggggaaaatagcctctctgtttgctcagaatatgaaacagtaaaacagtgcaagtaaaacagacagccatgccacgcgtgtcacatttccatttgtattgtttgaaatgatgttttaaaaagattttctggggttttatttatttatttaagaagtaactggtacaaataatatttgcacaatcttgctggtgtaagaatttccaaatcaaatgtatttattttctgggaccagaagggattggtttgtaacccttgtgatctatgactaagcagagaacatgtagaaaaagtttcaaaagtgctctataatagtaacatttctgaaaagataaagagaagcttccaacatccttgtctcctagactgttaggggagtcctcagtagactcagtgacctcatagggtaggcagaaagaataacttacagaggaaggaaactttttaaaaaggcaaaaaatgaaaaaaaaaatttaactgctatgcttctcaaagagaagattatcacatttagagggaataatttagagtgaagaattgtcctttctcatccctcaaagtcataaatgtcccccttgggcctgatgataatctagataattcagtacagttgaggctggaatggaagattctgtaaaagtctaaagtaatattttttgctttttaaacaagttaacataatacatccaaacacttctggggacacatcccttgttatcagatcttggacttagggggaggagatgttcttctccttataaatttaaaagattaaaaaattttactttgcagttaaactgtattataaaattataacagtacgtaactgaggaagatcacttgtcagaagtggtttgtcaataattaaagaagaaatctatctccatatttatattcaaatattatttctggtgccaagtagttttttaagctgggtcactcaccttaatcaacaatcttggctccagatattttgatcattccgaaactccagatctacctccagtgattaatgtttggtaccattaggaatatttagaggataggtggtaagctgtgaaggccatctccctaatggagttccaatgctgcgttgagacagcctcgcagactaagtgtgtggtcctaggttgatggctttaaatgaaaaagcacacatttgggctttatactctggtatatttatttaaaaatcagtgctttactgggagtca

SEQ ID NO: 44730 - DNA, 1598 bp, Bovine  19866880813263
aactctggccacagtgtggaaactggacaggaaggagagaaggggagccaacatataccagtgctggggaagacaggggctggggagcatttaagaggttgggttttggatttgggaatttagataaaactgagcatgtgggcaaatgtaatgccatttacatgctaggcaacaagagaaataaatactcatggtggactttcatttcttgtaatatattttcaattatgaaaaagtcataggcttatgtatctatgaaatcacactggagccaatatagttgtgtgtgtatgtgcgtgtgctcagtcatgtttaactctttgtgatccccctgaactgtagccaaccatggaattttccagggaagaatactggaatgggttgccatttcctcctccaagggatcttcctaatccagggatcaaacctatgtctcttatgtctcctgcattggcaggcaggttctttaccactgccctacctgggaagccagaggctatatagggtagtggctaagagtttaggccctgggtttgaatcttaattcttaattagtgcagagatcttgggtaattatttttatcactttaagttctaatgtcttcccaaggtcatggtgaggattaaataaaatgttgcatattaaaggacatatcatagggtttaataatcagcaagctatagattaaggtcagctactatgaccatagtgtttgggttaggtccagctgcaatctcaagctttcagctgttttcattccagaaagaaacatttagaagactcagactcctctgccagaactggattttttaaaactctagatgactaaaaatgcttaaaaccactattctaacatgcgtttaatccttgaaacccagaaacaattcaatgagctatttggttaagttaaatgcagttctttgaaatctgcttaaatgcatggctcactacccaaaggttccagagaactccacttgcctgcttgggaagcagcaaacaaggtcagtattgatagcttacgcttcagtgagtgtatcaatttaaagcttcatcagtgattctcactcatctgcacccctgcatggctgttgtcttgcaagaacggggtgacttacgaacctattaagtaacttcttcacttgtgctctaatgagcctattgtttccctggaagaacacaaacacctgagtacaagccacaaacaagaggctgaaaatttcagccctgcttttaccgagagacactttttgttttgattctctgtgcttttgctttgccaacctagccaggtacaattttatgccaagtcctgagtagggctattggggtcccgctgtccaaaagagctctggtcacagctgactcctctgctgtgcaggacgcatgtgtgtgatcttttggaatttaaacttcagacacttgttcatctactgttcctcctgccaccagaaagtgcatctgcagtgaagatgaccacttttcaaggagcatgcatctgctgcagtagggagggggcaccaagcccacccataaagagggcatccatggttgtcacagccaaggaagttctcctcgtgctctaccctgcaaaagaagg

SEQ ID NO: 44731 - DNA, 834 bp, Bovine  19866880813499
ttctcagtcataaattacagaaattgcctatggctgactgaccaggaaaggtatttattaaaaaggtactggggagctccttgacatatctcaataaatacactttattttgcaaatatatgcaaatattgtttcatatacatacataactatttttgtttacaaacaaaaataatatttactgagcacttctaatgtgtcagacactgtccatattacaaaacatgacctataagataaatgctctttcaaatactcctgaatcccatttttaaaatgagacgattatgattagggggattaagtagcttgcccaaggtcatacaagtaataagggactgagtgttcaaagtcaagttgtgtctgacattaaagtccatcatcttcacttccacactcttatatggctataacttgaaacctttcccataagatattagctagaagataaatgatctgtgataacctgaagtattaaatattatttcagtaaatactagattataagaggtgcatgctgaaaaacatacacaaaatatagcttttttccatcttaaaaaacgttccacagacatgacctaatgctagagttgctggccagaaaatcctcagcgtgcacatcaaaatgtacccacttgggggcacccacaatgcagcttttcggcttgttttgctgtccagaagctgtaagccttgcagagctgcagctgagccagctgatgagctcaggctgctctacaggacgcagacagccacatctgatgtctcaaggaagcgcctcctgtatctccaactgggaggaatattttccttagcatgttgcccgcacaataa

SEQ ID NO: 44732 - DNA, 1669 bp, Bovine  19866880978364
caagctaatacccgccctctatctaactccaaaagataaatcaatgtctgaaaagtgctttgagcttctcgatacaaaggcgagtgttccttaccgtcattaattagcatgtattaatagaaagagtagtacagaaaacccaaaggtgatccaaaatagtgatgaacaaacctgtcatattgtattagcagctgtcacagagcaggcagtggaaatgaacagctttctctccctaatactgcagagtttttctcctgcaaactgattcctatgaaattcaatttaggggaaaaaaaccttgtatgccaagttatattcacttggaaatttcttagcaagtaatatagttttctgaaaaggttgtgggtgggaaggcttacctctttcctaatttaatgactaccaagtgtacatgatcctatgatagagaaaggaacatccattgaccaccattacaaccaagatttaaatataaggacacattaatttttttaatgcagtacctattttctccttcatcgggctattttggctgaaataatttgacagcaaagcaacctttggtcttgtttgagaggttttgctgcttctctccacgcacctgtgtctgtctgtgcaataaacctgactgtaggactctcatcacaaatgaactgtcagatcattactacagttgatgcaatataatctgtcttgaaattagaatcagtctggccaagctaggcgttcacttgccatagaggctaattcacttcttgaatatgcattcatggagatatgcctcgatttggaatccagagggagtacacgttaagagcagattttctgaattagcatggcaagagggaagggtccttcatttagacggctgcagatgccgctccctcttgttcattacaattgcatttcatcagctttatgatgtccacatgtcaattgagtgtgaggatttttcacacaaaagagcctcagggaaaacgactccactagctaatcagctgattatcatacctcaaatgggctgcagtacttgctactcccaacctgtaatgggcaagagcagaattgaagattaagactgcaaagaaagagagctcttcagcctgtttaaggaaattaaagaggaatttgtcagcaaggagaagaaagaactacaggagcagaagagaaagcctatgaaatagatgggttttcaaaataaaatgactgatgttttcctttaaaatagcattggtgggagagggtgaaaggttaattaactatattatctgcccatatatgcccagctatataaagctctgtctgcccctgccctagattttaaaaccaatattcaagaacccagcccagtgtcgagaagaatgtttcagagtaactgagttaatttccaacaagtcaactattcacaactgcccctggacacctccttatggatttccttggatcgtttggaaattagttgattaatatcaagaaagtgatgatagtaagagaagaaaaacatacccacacgacctcgtaaagaatgctagcttggggaacatttatgaaagtcactaattgagatttttattaccagagatgtatttttatattctttgaggaaaggaaattaacgggggccttttttctgttttgtctaaatttaccaaagttttctcccagctcc

SEQ ID NO: 44733 - DNA, 1594 bp, Bovine  19866880997592
ttgtctctgaaataaaaaagggcaaggatctaatcctgttttattataggaatatgattcctgccatcactgtgcactctcacttgggtgaggcatatttttatgtgtataatttgtttttaacccctttattccacatgtattgtgtccttatcataagaaaggtactgagataggtcctggggatagcccagtagtaagggagtgcttacttagtgcttaaaatccaggtctggtggctaatgttcagcttcttgttatcactaccatcattctagatgttcatatttgaactacttctataatgatccctaggttgggaagatcccctggagacgagcatggaaacctactccagtattcttgcctggagaatcccatggacagaggagcctggtgggctacagtccatggggtcacaaagagttggacacaactaaagcaacttagcacatacatactgacaaataactccttctctgagcccccgaaagtagatccccatctgcttcctcattgatttccctgatccctacctcatgagtccttcaaattcaccatgatccagcaacaaaagagtaaatgaatccctgaaatatcagggtccctgggatcctggcccagcattctatgcagtatcatgtctgatttttcttctagattttcatgtctaccagttgcaaaagagtttaaataccactgttgatggagcctatagttgaaaaatttatccccaaatttcaaactctctttctagttatctacatttactctttcaaaagtcttctcaagaagtttacttctaacagttatcccacatagaacttctttgggagtcggatacataatttgaattgatgtttgagtgtgcacaggtaattaagaatccttaaaatttcactgggacgacccagagggatggtgtggggagggaggagggaggagggttcaggatggggaacacatgtatacctgtggcggattcattttaatatttagcaaaactaatacaattatgtaaagtttaaaaataaaataaaattaaaaaaaaataaaataaaaaaatcattaaacacaaatatttgactatttaaaaaaaataataataatccttaaaatttataacaaggcaaaacttcagctccaccaacaagaaaccagaatttgcttttagaaatttggatttgtctatatgacttccatttaaaatggcttcatgtctgatgtggcttctctcaactcatctctaagattattcataaagataccaaaaaagaactaaaatttataatagctccctaattttagcaaagatggtatgtgaaaataataacctcaaaactgtagctcccccagtggtgctacaatgaaaaacaaaacggaggaccttgcagtggaatgcagctgaaaaccaatgacacctattgtcagaaaggtaaatgggggaataacatattctcctccatccgtctgctccatgattgaaaaacataaaaactccaccaatcaaaacactcaacagccatcccttcattaaatgaatgccactttgtaagttgtatcgttctaacatgctgtactcttatccttctgt

SEQ ID NO: 44734 - DNA, 1125 bp, Bovine  19866881004142
taggtattatgctgtcactccagtataaatgaatcgtaactttggactgcacctaggaattactacacatttggagaaaatttatggtgcaccaagctttgaatcatgatgtgatatcaaaactaaagtcaaaggaggaaaaaagctgggcataaattattatcctcaatcccatatgtatcttctgatgcaacaggtaaaagtttgaggatttagtaatactgccaataattatcatgggtgctgaagcaaatttatccttctgaaagcaatttgtagtaaaaaacaaaaaaacaaaacttccagcagaaggtcagtcttgcatgcatggcaggggtatttaatttctcttttgtgtgtgtgttctctgtccagctagactccctcctagagagtaggagcgtttctgcaatctcgggtacctctcaggggccacacatttctatttcccatgaaaggactggtctttggaccaattcattcactgaatagattagtaaccattatcagtcaagcttattgtctctaatgacatagacaaaattctgtacctcttgatttttcaatgaataattggcatggtcttaaacattgccttgaagtctgtgactagtcatagaaggaagacagccaaaggatatgccactttgaaaagagaaaattgtgaatggttaacttgatattctgagatttcaaatgtatcaacagaaaattgttaaatgttcatgtgtttatttggttgaaatatccgattttaaagagaacagtgcctataggtatcagattcagacaccaggagaaaatttttatgaagtgcttctactgcaaaatagatataataatactgtacatttgtatggcatttggcatttttcaaagctttttcatcaataatactttattctgtcttctataaagcagtaggactggcatattatgccattttacgtagaaatggagacagaaaggttaactcagtcagtgagaaagcagatacctagagtgctggtctttgcttgttggaccagtagactttctagaagttgttttttttgtttgtttggtttgtttaacttgggataactagaataaaatctaatatttgcataattctgtacagttggg

SEQ ID NO: 44735 - DNA, 1161 bp, Bovine  19866881015332
aagtaggaaatgtggagaaggcacatccgtaattgacagagctgaaagagacacacatcccttccaccgcttcctactggtaagaactcgtcacatggtgccaccaagatgcaggggaggctgagaaacagtccgtggctgtgcaggttgattctttcgaagggggagcataaatgttggtgaaagttagctattcttgtcacacttaggccagatagttcaacactgtacctcagttcagttccctcatctataatgcagagacaatagcagtacctactttatagagttgatgtatgaattaaattagataacatatataaaatggtacacaggaagtacttcataaaagttggtaattatttcaacagttgttattgctgttaatttttccttgagtcacttttaccactcaaagactctcataattaatatctcacatttctctaattaaaatagctagccaaacaggatatgataaggctcgtggctatttcatgaacaaagagaatctatttgatggaatataaaactaagcagtgtgacagttagacagtccctgaaagatatgaagcctgcctgtaaaatcattgcccctgttcccctcctgctgtatgttctacacacgaaaggaaaaaaaagttagaatttctcagaggggatgacagaacagttcatcatttcattgagtacatgttatttttcagtatttatttccacactattttcattagaaattataggaagccttttctttgaatttatatttacttaaatataaatatatatacttaaatatgtgtgcttaaaagactcaaaaagggcatttttcaacctctggtatgatccatttctattttgacaaatcttcttgaagagcaactaatttagtaaagtcaattttcctagctactaaattcctctttcagagtgcagaaaaagtctgtggtcaccagcaagaatcctgggaaagtaaaatgaaatgaatgaagagataatctagacacagatttatacacagagtggggaagacatgctgttgatgagactgttatacttcctgaagggctacttacttttattcagtgtcataaaccaagccaggtcaaatcacagcacacttgacccaacctgccctggcagtggttggaaagctgaaag

SEQ ID NO: 44736 - DNA, 1668 bp, Bovine  19866881037421
tgcgaagagttgactcattggaaaagactctgatgctgggagggattgagggtaggaggagaaggggacgacagaggatgagatggctggatggcatcactgactcgatggatgtgagtctgagtgaactccgggagttggtgatggacagggaggcctggtgtgttgcgattcatgaggtctcaaagagtcggacatgactgagcgactgaactgaactgaactgaattatcatcttgtacaccttaagcttgtgtgtgttgcatgtcaataatatctcaattaagctagaggaaaaaagaaactatggagatgaggcctggcaatctgtgttttaaccagccctccagatgattctgatgtatgctaatgtaaaaatacaactattctggaaaacaagcaggaagacttcaggtcaaaggtgaggtttaattttctggcaggatgttaacaccagcatgggccatctcaaaagtctagcctgggatctccttgtttggctctgatggatgggagggatcctgtgtctctagaaagctttccacctttatggttcatctctcaagcatagagcaccacacacggaatcttaagagcgacagctcagcattctttaaccacactaaaaaaaaaaaacaaaaacgacccacacttaaagtgtaaactaataaagaacaggatattctgttcccacgtgtaggtgctgggaaagcaatcgggacgaacagggagggtgccatggtcgctttctcccctcgcactcaccctctgcaggggcatgccatatattagcgggcacttcacatcagctaattcagattcccctgtcagacaaatcccacccgtgagcactgctgtctacaccacataacaccacatagatcaagagtggggagaggccgaagtcatgaacaccatagctttccataaaagttaattaatgacagaagcatattgctgggaatggcaacacggctgttatttatggctcaggaaaccccaactgtagggatttgccttttcctttctcccagtcccagctctacccacgagtttactcaccccattacagtaacttcgtgactcatttgccaagttaacaagactatagcatggaatctataaaaattaatacaacagttggacatccaacacgcatcccaggagaaacagaccaccctatggatgccgccctgttcttctctatccccacacctcaacacttcttcacacttcacatttctactgttggcaacagttcccacctgtcacccccaagaaaaggatttccccgaggaatccttggtgctgaaaggcttctagacacctcctttccccacttcccagccataccgccccacacaggcatgggccaacccgttaggtgttaggaaaacggctcaccactgacagaccattaccgctttgagaggctgtgtagcaccatggtgaaaactgtctctggctgcaaattccagtaaactgttcatggtgtcctcatctataaagtgggtccaacaatacttgcctttgaaggttgctgtgaggttcgaaccaacctgatgagaactgagtgactccaggtgctactggggcccagcaaaccttcatggtacaagggcttctccttcactctttccccttctcaggccacgtgcccctacaaac

SEQ ID NO: 44737 - DNA, 2044 bp, Bovine  19866881049156
ttctttcatcactaatgataacctaaacgtgtttttggaattcttaccattgctgaaattaaagcctagttataatatgtcgccagaaaaaattggactatatgggcaacatgcactaagcattgtaatcatattataaatattaaaaccaatgttcttgtcaggattaaaacaaatatttaaactggctacgtgttctacttatgctatcctcttaatcttgaagtgttctggaaaaggaatgtatgagtccatttcctgagctgtgaaaaggatcgtttctaatcttatataagacttcatgcttttattttgctgtagcgaagatcaattaagcaattggaacaattgtttttctccactgcaagcatgtctttcaagatcttttttaatggtgcaaggtgtttagtttaggtagatgcattttaattaaatcatggtaaaaccccagttgttcaggcggaatggagatactaacttagttatgataaactgggattttagtataaaggatgcctatacagagggataactttattatggatagcagagtgaaggtgtcaataaagtgtttattaacagaggttttactctgatcttgcaatattagtggctgtttttggaaaagagagagctttttaattccttaaacataatctgctgtttcttcaacataaactaaacagaatagaaaataaagctatttaatagacccttaataggagcattgtaaagatgccagtagagattcatgagcagtttttaaagctcaacacccagaagtcaggatgctctttgaaaagcatgaaggattggtaaatgaagcttacaataattaaatacataaataagatactattttttaatggattttagcagaagccaatggaggcaggggccaaaggttaaagttataaaagacacacagtctttttcttctattttacttatttgtttaatatttatcgatttatttgtctgcagcaggccttagttgaggcgcatgggctccttgatcttcactgcagcatacgggatctcttagttgcagcatgtgagatctgttccctggccagggatcaaacctaggccccctgctctgggagcacagagtcttagccactggatcaccagggaagtccctagcactgatagaacagaatctggggatctttggatacgttgtgccttgctgagagactgacgcaacctttccctgcccctggtaggcctggcaaaccaaatggctgctctaattttaagaacctctccttggcacctctccatatcagcagtattatattctcctctggttgccacccaggtggggagggatcaaggaggcggtgagttgctggaataggaagtaggtaaaagggaaacccaaggagagaagggaatccattgggtttggacttggccacctcactcatgcgtatggaagcttctcaatctggatgaataagggcttttagagttcacaataaatggatagtgaatctttattcctttcctgtaataacatgagttgccttaataggtcataaaacagataacttagtttaatctgatatttcaatcttagcactgtgtgatgccatacaggagaaagtcatctctcctctcccaaactccagcatttccatggaaagaaaaattgcaccaataccagcccctcccataaggcccccaactaggaaagctaatcactatgtaaaggaaagagaaaaggaaaggtattcccatcagattgcagagttcaaacaatggcaaggagagataagaaagccttcctaagtggacaatgcaaagaaatagaagaaaacaatagaatgggaaagactagagatctttttaagaaaattagagatacccaagggaacatttcatgcaaagatgggctcaataaaggacagaaacggtatggctctaacaagcagaaaatattagaagaggtggcaagaatacacagaagaactatacaaaaaagatcctaatgatacagataaccacgatagtgtgatcactcacctagagccagata

SEQ ID NO: 44738 - DNA, 1748 bp, Bovine  19866881085063
aacaagcgtcttgtaatttcatacagatggtagtctgatttggcctgtggctgtggtttgccatctattgatttaggatctagagcataacttctcccgttttaggaaactctccaggaatcagtttggtgttgaacatacactgggtagtcaataaatattaactaacactccagggtacctcataggcatgtggtagagggaacaccatgacctggaaatagcatgatactagggattagaagaccaacctggagtcccagatcttaagttacttatcttaagtaaacttaagatagttaataacctccaaccaggccttggtttcctgctcatttatcattgccaaagacaggccatggtatccctataagagctctatttacttgtattgtacttataagtatggcactttgcatatgttaacttaatatttaccacagtaatatgagatatgtacttaaaatgttcccattttgcagatgaggattagagagactaagtaatctgcccaagaacacacagcaggtaagtggcagggatagaacttgaccccattatggcttcagaatctagctcttgaccccaggctataatactttcactttataaatgaggaagatacattcctcaacaaaaaaaaagtatactgctacaagccccattctacctttggagtggggtatgagggatatcagcaatgaatttgagacacataagctcaaatataaagtatggaaataaattttttagtcctacctggcatttagtgaacacttgctatagatccagatcaaatattttactctgtcttgtttcatttaatcctattaataacaagtttatgaagtactattatcaacccctcacatagatagaaaattgaggcttagagagatgaaatacttgttcagggtcccaggatggtaaatagcagagcagagatttgaacacatggcacccgatctcagagttcaaagggaacagtgacactttcagccatacttgtgtgtgttactattagtagtgcattcagccacatggtaggttaaatatggctttgacagctggcctgagaacctaaccatcacttagaactcagtttccatagaaaaatgaattgtgagtttgaaacaactcatttacaagcagatttgggaaaacactcggtgaactgggagatgagtctgtgccttcgtccgtggctcagcggtaaagaatccgtctacaatgcaggagacatgagtttgaaccctgggtcaggaagatcccctggaggaggaaatggcaacccacttcagtattcttgcctggagaatcccatggacacaggagctcagtgggctgcagtctatggggttgcaacagagttagcaactcaacgacaatctctttattgtacgtgaatgttcagaacttttgcctttggcaatgaacttgcctcattctccttacttccctgaagtgtctgcactgctttgcccacactggacagccagtgatctcctgagtaactcttgatctctacaagaggagctatgcagtgacagctctcatcagacaccccaaattttgcctccaaacatactggagggaattattgtatccacagagacgtggtgccccattcctgggttaccctgaattgaaaggctatagatgaaggtcagtatgagttcagaagagaagcatagagagactgagaagtggctctgtaatttcggaaatgcagctccttggacagggac

SEQ ID NO: 44739 - DNA, 964 bp, Bovine  19866881090600
ttttctgtgtccttactggtatttcctttaaaatatgcagctcttctgaactccattgtctcttgggataatgccttactgggtcttcagtcttactttgatccccaggatccttgagagctggtggggacctcagctataagctgatacatcttattttacagaagatgatctattaattcaagttgaatagaaattattttatagaaaattaattttaagaaattaatctggaaaagactaaagatgactacctcctaactgattaacccagctagttagggtcacataaatggattgcaaccactactctccccaaacctgaaaagaagcagattggctacagttaaacgtggaaaagtgaaacaggtggtgctgtgacacggggttttattaaatcagcctttacacagccatgtacttcttgccagtggggtcacttttgacagtcccctaagtttcctgactctgattctgggaaattaatattctatatttacctggttttctttccatcccatcacaaccttgaattctgaattcaattcaccttcaccaaagctgtctttatcctttataatttcacctatcttccgttgtctggaagagaaagccaacacatctcttactgtttactccttttctgtacttacttgtcattgcatgaatagcctccaagtctttgcacatgaaattatcttctctcccgcactggccaccacagtcctaaactccatccacaacttatctcaaaggccaactcattttttaaccacacacaacccccctctctcagaattaatcatttaatcctcctttctctctcactgtcttacttttgcctcaatgctagctccttcctcagtctgtttttctattaggatttcttttttatttatcatttactagactgcactccctaaagggagagattttcctttagacacgaggacttcacaacaca

SEQ ID NO: 44740 - DNA, 796 bp, Bovine  19866881120460
aatgagcttgttgagatattcagtatagacacatcagctgttggtgatttcccccaaagttgaaggttataatttttctacccttcctaagaaataatggtctcttggaatgtgcaactaaattagtcatactgtgtcctgagaattggtctctgtaatacatcctggcctttgaaaaagagctgcagttgtataatggattttagaagtctccaaagctggttcaactaacatatttgttagtctaataaatgatattgctcttgtcaagatttttccatatagcacaatttaatagaggaatcaatagtttctcagacatgacaaaagggcctgggtgtgttttgatgggagacacaaagtctcttgttgttctaataaagccaaaatggaaaaaaagttttttccccttcactttcaagtgtatgtttatgaagctaaaatatacataccactttctctaggaaaatatttgtttatcaatattttctcctacagtgtctttttactctgttattacacatgaatatgcattttgtttccatcttacttcctctggtttgatgagctgtcactggtacactcttcttcaggaaaaactcaagtctgagggtattttaatccactgaacataaggaattttctttagaaatcttttaagaaacattttgggcaaacattggcatctacctacatttcttctcatcatagcttttttaaagtcctcagagtggtttcgtacagtcaggagccatcttctctagtggctcctgccttcactgaacagagattttaa

SEQ ID NO: 44741 - DNA, 1210 bp, Bovine  19866881140112
atatatgtttatgtgctgtttatttcagacattgatttagattttctgtgttttttatgttgttcaaatgttttaaaaaatcagtcctgacctaaagcttttcactgagtccacacattattaccatttctaaactgtaggcttggctttctttgaccttttctgaagggcatactctttgaataccgtgttgattcttctgtatgtatcatagacagttttgatagcatatggattctttctaatacatacacaaactaggcagaacacagttttgatttcatattctatttttccccagtttttattcattttcattttgttgttgtaccaaccacaggtattaaagaaagaattccaggtattaaagaaagaagaaaataattgacaggttactatataactattttagaatataggaatttgacatgaaaagcacccttttaaattgctatcaactgatcattagtttctcatcatttcttctgggtactcagaaaaatatggccagatgtaggagaggaattttagcacacagtaccgagtttgtgttctttattctacaatatgattttcacccagtcacagtaacactccagtgaagtcctgtgacttgaagaacaaaaggactcatgccctagcacagcacaatccttaaataggggactcccaaaggtgttattaagcctggttccccaccctcatttctctgcccaaccctaacaaaaccaacccaattatgttcccagaaaggtggagagagaagcgaccttccagaactgaggctttcatggtcatctcccaaggtgttatctgagaccccaatgaaacaccagaacatgcctcaaagttggggcaaatcaaagatgaggatcaaaagctttggagaaattccctggcgtagtgaacaaaccatgaaaagctgccacttactgagagcttgaaatacacaagcaggcatggcagttgtcacaacaagcccacatggtagataaggaagcaaagatataggtatttacctggagctaacaagtttctggagctagaattcataccctgtgtcagctgaattccagttttggacagtgttgcagagagcccatgcttttaaccactattaatatagcaccttgcccagcagatgccaaaatgtcacactatctctgaaacctaaattatgattctataaaataaaaattttaatctataa

SEQ ID NO: 44742 - DNA, 1000 bp, Bovine  19866881164870
aacaaatgttgtatcttcccaaatggaaagtctattagcaaaattacatttagaaggaaagtcaatagttaggagttttttataaagcttttttttttcccctgatcttaagatcagacgtgagggtgaaggagagggagggatgaattgagagagcagcattgaaaatacacattaccaaatgcaaaattagatagccaatggaaatttactgtatgatgcagacagctcaaattcagtgcccagtgatgacctagaggggtgggagattgaagagagaggggacatgcatatgcctgtggctgattcatgttgctgtatggcagaaaccaacacaatattgtaaagcaattgtccttcaatcaaaattaagtgaaaaaaaactatacttcaataaattttttaaaaatgtatctaaatgtaaactggtatatttatgttgtacttaatgactagcaagcagaagccactaagaaattcactacaaaaatactgtatggaacctgataaatattatgaaaatattaaaatcatgatttacatgctaattacaactgtgcaaagagatgcataggataagatgaagtaaacattttaaaaggaaaatgtttctgttttcccagtgatttaacttttatttatttatttttttttggaattttgcattttctttttggatgtttgctgttttgggagaacttaaggatggagataatgcggaatgtaaccctacctcctccaaacacataaaaatgctatatataatatttgaaatatttcaatgtacagctgagctataaagcaagaggagtgccataaataaggaggacacccacagcagagagttggatttgaagttaggtgtcctttcgcagtgagagactgccctgggctcccattgtaaagccagagccaggaaaacatgacaccaataaaactaatccccggcagaagaactgattatatgtctttccagcaatgtctctacactatagggaag

SEQ ID NO: 44743 - DNA, 1285 bp, Bovine  19866881166785
ttgggggagtacaggttatgtacattgcagactgttaggtaaaatgatgacaaaaagtccttcagtaattttgataatactactactgtctgaggtaggcctatattatatctaatgtgtatgacaaatagatcattttagtgtaaaatatttatatgtagtaatactctgtgtgtacgttgggttgagggtgatgataaaacagtaagtaatgcccactctaggaacccagtagttaacaaatatatattttaatttcacagaaggttttatgagtattatatcttaagccaggagtcatccttatacttttatttagtttaggctagatccttgatgtaacttatgaagttgatgccctaaagtatataaaatgtgaatagaattgaatgtgctattaatcctaatcaatgtgagcaaatagccttgaaaataataaaacaggcaaaattcataacttggctgtttttcattcagtgtagaccttaactagctattgttttgtaattaatatgtgctcacatgtacacccagtttgtgttttagtgcagcattgtttcatcttaagcttgctttcataatagattatgaatactagtggaagggccaagttcaagcaaatatacatgttctggtcctagttttccccaaattgcatgtattttaagcattagtaagttttaatactataaattttttttaatttgtgttagataatgataatagtttatctctgaatagaggatgcttatgtcactctactcagaacctgtggaataaggaacaagaagaaattcttttcatacttttattgttcataaagttggaggaactaccttaaactgcaacaagaacttaaccaaattttgtttgctttaaaggaagaggtctttccaaagagaattaacagctgactgaaccagtcttgctaattcattagtttactagctaaaatactttagagtcctgtatgatacttaaatctgtgtaattgcttattgacatttatttcagatcagaccccaacaccaacaagattcttgaaaaactgtgaagaagtgggtttgtttaatgagttggcaagtccatttgagaatgagttcaagaaagcctcagaagatgacattaaaaaagtatgttattaaccatgaaattaaaagagtgcttctgacagaacagttttcacttgttgctttcttattttagataaactgattggctgtttttaaactaacactttctctaatttgcattttagatgcctctagatttatctcctcttgca

SEQ ID NO: 44744 - DNA, 869 bp, Bovine  19866881177495
gagtggggtgccttgccttctccttgcttaattctaccaggtttctagcatcatcccctccctgctccaggaaaatccaatttaattcttctgtatttactgcaccagatgagcctttcatccaagacagataaaatgcctgtaaacccattttcaaatggcatccccagatagactattcatgaaaatgcatgtgtacacatatatgtacacactcaacaatctagaccacatttccctgtttgcttatagccccggggagggcagaaacacaatttccaagggtgatgtcaactccatacatcatgctgaggagaacataactagggtataaagcagcttcctcttgcccagaagctgctcccacagaatactccatgtgagttctgctgaagcaccacaggggtggttgagacaactcagtttctggcattgcaagccaatgaaattcctgtcctctcactctcaaataaataaagctttgaaaactatcattattactgttctttaaatgagtctgcattgcctccgcactacctccacccactgatttccatttgttttcctgtctgagccgagtgtttgcatctagtgtctccccgagcagggcgaaagatgtagcaccccttctctgctgggctgaccctccctggagagcccagtgggggtgaggtactacctggtgggaattttctcattagccctacaagcagcatgtattccagcccagtcagcctgaggctctgagcagagaactgcaaatattttactgagagaggagctcaagagtgtgacaactagtgtattaccactgaatctgttctgtatgaaactggcagaaatgggaatgcggagactgctcccctcag

SEQ ID NO: 44745 - DNA, 1560 bp, Bovine  19866881275930
ctgaaaagtgaaaattttcactgtatattttaatttgcatttctcttattaatgaagttgaacatcttttcatatattatcatgtcatatatatgtatctcttttggtgaactgtctatgacttttgctttttaaaatcatgatttaaatcttctattgatggaaaaattacttccataatgttacaatgatgccttcaaactttgttttaagaagtaaagaataaaacagtaagaaatggaagaatgtataaattcactgaaaagaatactaacatcacttaaagctatattgtcttattctatcctgtttcaaacagcctattaaaaagtgagaagaatgttaagaaaaatgcattcaagttacaattttatgatgttaagtagcattaacagttaatcccacaaacaaccacaccactgaaaaagttcaaagtttgggaaacaaatgattgagagacatttcataatggtttcattgcacccacctcattagtacaggtaattctccgaggatgaggggcttcttgttgcagttgatatactgggaagttagaaaataaaagatgtcagtttcccttatgcagaacatctgaatatattaggaatcaaaacctgcctgctttttaactttcataagaaaactgtggtacagtcctatttgctattaaattaaattttgttatgaaaaaaataaagtaagccaaagtatatttagtgaaagcccagaagcaaacaaataaaaaaattataagccacagagtgttacaacaactcaatactggatatttggctctgctctccataatctggtaatttattttcctcaatttttatggatatattacataaagaatgtctctgttataaacaaataatatttgtgtattttaacagcacattattaagtgtcaaacttgaaactaaaattaggatttataggctagatgtaacacatacactgttccctcccccccatttatcttgtgaacatatatcttcaaagataatctctcctagaaacagtttctaagccaaagttaccaccacttatttaactaaggtaaatgcagcaagagagaattccaacaccaaatagctagccagaggataattttctggacatctgaaaatggactcatgaaaaactttatcaataccatgaccttctaagggcttcccaggtgtctcaatggtaaagaatctgcctgccaatgcaggaggtgcaggttcaatccgtgggtcaggaagatcccctggagaaggaaaggcaacccactcgtgttcttgccaggataatcccatggatagaggaacctgaccggctgtagtccatggggttgcaatgagtcagacaagactgagcacacacacacacgtcctctaagcctcacttcaggctttttgacttgaaacaaagaaaaaatcaaaagaatgtatggttatcagagaaagtgtgtttatgtaggtctaagtttatctcttggagaacatctgttttctatttctacacatataatcaacatataactgaatttaatagtgtatttatatacataga

SEQ ID NO: 44746 - DNA, 761 bp, Bovine  19866881308235
attaagctagtgtaggcagagctggggagggggaaagactgccggaaaccctcagcccggaggtgagtgcctgaccctgtgatgttgccttgtctatataatttgctgcgtgttgcatcatacagaatatgccaacctttttccgcctgctcaaaaaaaggtgatgctaattagatcaggcaaatagctgctgttgttgattcatttgaaaatgattattccaaggcaatgtgttattacccagcaagccacagctttgcctattaatgctctgaggtggctgccagacttcaaagtcagaggtggaatctgaggctagcagtgcctgctgggtcactatcagagccttcatctgaggacaaggaacagtctattgacatttaagaatttaatcccttctggttagtatgaacactactatcaattcagtgctaataaatatcagttgggacacttcccatgtgcaaagcgtaatacagtagattacacaaaagcaaatatgaagttaaggttcttacattctagtgaaagagctaagatgctgagtcaagtaataatacagaatcttgcaagtagtataattaagcgaaataagtaaaaatacatttgataaagtggcaagttctccacatgctgtttatttatttagtatattagaaatataaagtgctgtgggaacactaaggacgtaaagcttcattttgtagagggtagacttaaaggaatcaagatgaggaaaaacttcaggaagcaagcagcat

SEQ ID NO: 44747 - DNA, 994 bp, Bovine  19866881401033
tcattagctacaagtggattttccagattgtggattttgagacaaattccttctgtgattccctctgttactcagctcagactaatttggatgtgcctgagcaaaacacaattaggtaggagaagctgctaaaaaactaaaaagaaagaaaaagaaaaaaagtgtagcctaggatatctttagagttagtgtgcatatttatcttcagaaactctatgttcgttttctaggtaaatatccatggctatttccaaaaccattcctaggattatatatctatgtgaatttgaaaacttttcaaagattcctggctacctgagaatggatgttcagaaagtgggggttttatttagatcccaatatttcatatgtggtgttcttggtatggggactatacttgaatcagtcagtaagtttgccttctaattctgaactcaatgaaaagagatccaagaaacaggacacttggggtagccgaaaagaaagggaacaaaaaggattttaatgactcacgtaaccatgatggtgtgatcactcacctagaaaccagacattctggaatgcaaagtcaagtgagccttaggaagcatcactacaaacaaagctagtggaggtgatggtataccagttgagctatttcaaatcctaaaagatgatactcttaaagtgctgcactcaatatgccagcaaatttggaaaattcagcagtggccacaggactgaaaaaggtcagttttcattccaatcccaaacaaaagcaatgccaaagaatgctcaaactactgaacaattgcaatcatctcacatactaccaaagtaatgctcaaaattctctaaactagcagtaggtgaactgagaacttccagatattcaggatggatttagaaaaggcagaggaaccagagatcagattgctaacatctgttagatcatagaaaaagcaagagaatcccagaaaaatacctgcttctgcttcattgactacgctgaagc

SEQ ID NO: 44748 - DNA, 1029 bp, Bovine  19866881408010
atttgtaaaataaggaatgggactagttatccctaatgttccttctaggtttggttgtcattctgtgatattttaaaatatttaaatcaactggattatggataaaacagaagacgacttttatttgaatgttcgatatattcaaagtgttggtatatctagtaaatttaagtatcttatgttacagtttcataaatatctagtgtgactaagaagtcatacttggttaaagcattgatatgtgatttcatctgcagtatgctatactggtgtatttatcgtatagagagcaacctttttttcagatttaacaagactgaaattaagagtgcactgaacaatccatttcaactgtactaaaaaccgttttctcatttttatttgttctgttgactaaacaaaactcagaaaaccctttgagtttttttcctacgttttaaactaatgacttatcacaagtgttttgggttttcattttgttactcatttagcttcattcccattggtaaacattgattcgtttctcagtttgaatgaagcagaaattaatgaggcagtttctgcctcacaatcacaagttaaaattatagcactttatcatgtcagcacagctctaaacactaggagtaccagtggtattagcacagttcccaaaatagtgcagaatgtttgccgttgaacaaaaatatcacagggtgtatttctgcgaatgtgatagaaaattcgattcttcagttatactgataaaggttcaaattatttatttaaaatattcacaatatgtaacattctctcctatgttcgttaccagttgaagtatttttttccacagtgtgaatttacttcaagtatatttggtctgtttttaataatgttttcctaaatacttaatctagatgagtctccccaccctccttttctctgaggcttacctgatgtttgtgtggcattttatgattcataaatagcactttcactggacaaagccgtttgctttataatggaggcagcatttactttgaacttagg

SEQ ID NO: 44749 - DNA, 1228 bp, Bovine  19866881414789
tgatgcaggaatagcacaggacatggtttgtccttaggaagatgtaagagaagaggaaatgggcctggtacaggactaaggaaaacaaaagaagggcaattagaaaaaagaaatccgtatcaatgatgtctaaaaaaatataaaagtatttttactattataatttaaaaataaattttccagagacatctaaaaaattaataaacataacagaagagaaacagagaacagacaggtggttgccagagggaagggaatggagggatgagagacattaagaggtacaaacttccagttgcaaaataaatgagtcacaggaatgaaatccacagtgtgaggaatataatcattaataatgtaatatcatctctgtatggtaacaaaggtggtcagaagatacaaacttatagttagaagatatataagtactagggatgtaatgtggtgtgctcagtcatgtctgattctttgcaaccccatggattatagctgcttgccaggctcctctgtccatggaattttccagacaagaatcctggagtgggttgccatttccttctccagaggatcttcctggcccaaggattgaaccagcatctcttatgtctcctgcactggcaggtgggttctctaccactagcgccacttgggaagccctaagcgttcactgtacatctcaataaaactgaagaaaaaaaacgaacaagaggtcagcccaaggaaaatgcccatgtgacagatgcaaacttgataccatttctcataaaatgaacaaaatacccacaaaaaatcatacatggtatatatacactgctcaagtaattaaacaaaaatttctgaaccactgcaaagcacactgtaaaatttaattagttttaattgcatcttaaatgtacaatgtatgtaagcagtgtagaaaaaaagaaaaaaaatgggaaaagctacgaatttacttagagaacaatctgcaatatattaactgagaaaaattcttgtcagaaaactcttgagaactccctgtaaaaactgaaagaaatgttttgtgttagtcgcttagttgtgtcttactctttgcaacaccatggacaatagcctgccaggctccactgtccatgggattcctccaggcaagaatactggagtgggtagccattcccttctccagcggatcttcctgacccaaggatcaaagccgggtctcctgcattgcaggcagattctttaccgt

SEQ ID NO: 44750 - DNA, 638 bp, Bovine  19866881444407
gtttgcttatacctaacggggagcaccagtgtaacctctagagaggagtttgcaaagttctgcctatggacacttttctctaaagtctagactccaagctccaaaagtagactggaatctgaccagccactggagaaaagcaagtcactggattccagtctttattctctgagatttgccaacttgtcaaaagtgagagcaagaattttatagtaaaggtggagtacatgattcaggaaaatctttgatttcaagaaataagagtttccaaatttgccacaatcccagtgggacacgatttttatgagctaggaggagagagagaaaaaagacgtacaaagatttttgtacctttgttctgtctaaaataattaataccaataataatacaattccaaaatgactcactcctggagagtcaacaactaccatgtccaatgaagaataaaagtctgttactaccatgttttctatgacaaggaaaattagcctctacattacattttttaaaatgaagcctcttacaactttttttttttttttttgcgattgaagtgttgaaaatccaatacactctttcaagagggaaatctaaacagttttctgtgtaacagcaacatacagtagtctggaacctc

SEQ ID NO: 44751 - DNA, 1333 bp, Bovine  19866881607430
tgtaaatggcattattggtaaatgtagaaatctatttgaattcagagcacactgagtgaactaaacccatatttcaaagacttcttttatgttgaatattttctcctgtggtcaagagtctctggaatcaagaattacactggagagggagtggggtcactggaaaactctgcattattttcagttccatgttatacactatgacttaataagccaataaacattcatactagatagaatcaaagatagtattaacctcctggcatgtgtgagagagaagctttggccccagagttaacgacctttgcattattttattaagctcttacagatctttgacgattctaaatcacagtattggagagttatattaaaagtatattaattatattatattaaaagtattatattaccattatattaaaagtaaaaattgtatatacagaatagtgacagatgaacccaaaaagggtagattggatgccttatttggtgtttggcttaattggtaatattcataatattaaatgtttaggatattacaaacaatgcaagacttagctatacttttagagatccaccccagatatataaagaaaaacaagagtgaactaatataactatcttaaaattctccaaaaggctttaagtttttaactccaagcagggatcctaatgaaaaatataccaatgccagatttagttcatcagaatgcctccaaaattaattgagtaaggagggacctaatgggtttttaacagttatgaagttgtgcaaggcacacttcatatttctttatttaatcctcccaataatcacaggaaataggtactattgttatgctcattttatatgaagaaatataggcacagaaggctttcatggattgcatcaaattatactgcctacatgtaaccatcaaagtcaagttctgattgtctctaaaagtgctcagttaagttgtacctaatatcctcctccatctttgctcttcctctctccccttctcccttcaaatacttctccatcaggattaaggggtcatccacaatccacactattaagtcttaatgacagagaaaagtttctaggtgcatgtggcttccctgacattcctattctagtgtctcaaaggaaatatctgctgaaatgttaatggctggtcttttatcacatggtaggaaatctgtacccatccctaccactattgcaggttccctgaggccagagtcttactaattctgaatctccttaggacctgacaaagggcctcactagcagacacttggcaaatgtgttgaactggatgactgatacaagggacaggcaaac

SEQ ID NO: 44752 - DNA, 889 bp, Bovine  19866881608439
ttcatgtatattcatcctcaaagtaagcaggaattcataatctgtcctttgcatcctcagtcactcagtgtgtctgactttttgtgaccctattggactgtagcccactaggctcctctgtccatggatttttccagataagaatactggagtgggttgccatttcctgctccaaatctatccctttggaatcataaaaaaataatgtgaaaatcaccctagcttatcttcacttctgacaggagtttgtttgtaatatctttattttccatattcattttgccttggattttgacattattcagtctttacacttaatgtcttcccagccaccatccattccaccttctttcaacactttactgacctgtggacggcgatgttaccttgacttattctcgacgtgatcttcaatatgtggtccacaggcaggattttctgctaaaagcattttctccgaactgctgaaaagaaagctaactctagtttcctgtgggccaagtcccctgtgaattccaacagggagaaaaaagttaattgctaacaggtctgtgcatgtgtcacttacaactcgccactggatcccttcagtctcacaccctttcagcagtagcgtttagcgcaatgagaccagacggagttgttcgttttattttattttttttttttttgctttcttcaataagatacagaatgagtttaaagaaagctatctttaagctttatctctgtgttctggcgtaagaattcaataattcctttaatccatgttgtcatctcccttggccttttcctttactttagtcttttaacatctcaccttattttaatagcaattatcagaatccatatactaattcaacctaacaagaacactagtagtctgaac

SEQ ID NO: 44753 - DNA, 1183 bp, Bovine  19866881912870
atgttgcaactttactataatttccacctttgaaaattttaaaagttttacttgactacataaaatggtttgacttgatatttcagatgtaatatattttacttattccattttgtcctttccctatacagaggtggatttattcagataattagaaattgttccaagggaagatttccctaaggttgcaatggaatagtaatttagcctatgaacggcgtaacatctcatctgagaagtgtatgaaaagtatacctaatgtgctgatttcctgctcaaaaactcttgtgtgcagatgattctccacttttgaacagattgtcttaaggtttttgttcgtttctaggctgtgtagtcctctcttgggtcatactttctcaaaggagagatgttttacaagctggacttgtccataggctcattcccttaatcctatttgagaatagtgacaaattcaaccttgaaaataaaaaggaataaaaaaatttttccttgaaaaaagagctaaataataaagacaatagcattgaattataataaggtttcttctttaatttgtctttagaacttgcccttgagagaaagaacttgtatacagaatttggaaggatggtcaatggagacctcagtggaaattctgaaggaaacttcgagacacttccaagggctttaaaggctaataaggaactgttatttctaaatctattttcctcattcaatcaagtagagagaggtgataaaaatgattttctatagtcacaattcattattctgctttgctttaggtcttatggccagaggttcctttccctggaagttgaggtaaataatgcttcagattctgacacctctttcaagtccacttaatcaaatataaaatcgaaaccacaggaaagaaagagggctatttcttttcacttttccctgacccttcattctcccagcaccagtttcccttgtaccatcccagcataatctgtatgatttcttaaaagattttgcagcccttataaattaatggggttcttcctaaaaattaataggtttctttttttattgttttactttgtatttattttcaagagctagcatactcaaaagcagagacgttactttgccaacaaaggtccatctagtcaaggctttccagtagtcatgtgtggatgtgagagttggactgtga

SEQ ID NO: 44754 - DNA, 1105 bp, Bovine  19866882178852
atggctgaactaggctcttaaaatagaaatcagccagagctctgaagatggactcctcaaagttaatctgaggacaaggaggaaaggagggggcaggagagcagaatgagcctttctcagttagcctaatagctggatcaagtccaggtacaaaaattggcttgtgtgacaactcagaccagaacaattctctctgctcacaatgggaaaaataaggttatctttactgtgggtttttgtgcttcttttaaaatgaagtatcatttttgtgaggctaatagacttttcaaatagtgcattcttaaactagaaagtcaaagttcaatcacagcctattcatttgtcttattttacttgaataggaaacataaaagccctaatgagagaacacttgaaaagacaggtaaactcttgttaataattcaagcaagtgagaggatttacccgagcatcctttctcccttgcttgatttcttctggtgcttttagaccaacggtacagtttagtagtgtttcccatcttcctaagcacctttcattcggcatatgccaaaaatagttgttactatgcaccgacatttttgttctccacactaagcctacagagcagaggtgaattatgattaaaaaggaactgttttgcctgtcagaccattttacataaaacagcctttgagttctgaaggattttaagactgagctctaaaatcctacaatatgcatctaaaataatcttttacctaaaagcaaaagtactggccaactgacctccagcttttactatgtggaaatattccttagtgcataacagaattcaatgtaagtgcatttatttttaaccgtgttcatttttaaatcatcactctaggtcaggtaagtggattcaataaaaatgaacataccattcattattttttgtgaacctgcagtagctgaacacaataatattcagtagtaattaggctgtctaatatttgcttgaaatgtgtgtcatacattatcatatgctaattgtgcataattaatgttaactattcatgagcatgagatcagttaatgagttttaaagtaaaactcatatacaaaaaagatgaaaaaaacctcc

SEQ ID NO: 44755 - DNA, 1107 bp, Bovine  19866880446235
atgttcactggaaggcaaagttaccgctcctgttgagagccactgatctgtttgtcggtggggaaactgaggcacagagaggttaagtaagctgatcaagccccatggccatggccagtgtgagctgagccaggccttgaaggtaggtctgatccactcccaagcctggggctcctctcccatgtcagctgccctgaccaggcagagtggaccacaccatgatgtaaacacctgtcttctttatcttgaaggggcgataacccggaagataacccgccccctgcagctgcttctagaaagtgatcttttctccttctcctccttcccctcctgtgcaggatgcccgagttgatgtctttcgcgacgtcaccttctacatttactttagccttgtgctgatccagctcgtgttgtcctgcttctccgaccgctcgcccctgttctccgaaaccatcaacgaccccgtaagtgtgatcacagatgagcacagagacacgcatgtgtgcatgtgggtgtgtgcagaagacacagtatagcttacactgatatgagccagtaccgtccacctgggagctcatcctctcttccccaaacacttggccataggtaacgtcttcctccctgctttaccaatggaaaaaccaagccgcagacgtggctggagggtacttaaggagggtgtcccattcctagttgtaaacagctgtgtcttccggcccatttggtgggcatagtggttttagacagtacgaatgaacatttaaatatcaggaaattccacaggcgttcttaactgtccaggttttctagaaaagtgttgtggcagcgtcaatgccattagggtggccgctcttctgttggtgggaggaacgtggctgttcatcaccctggtcctcctcctttcttcctccccgcttccctccatgccatttcccttcctcctcccccgcactcccttcttccatccaggctgagtgccaggctctgacctgggcacagggctgtagcagtgaataaagcagaattcttgccacttggagctcatgttttcatgggcaggggcacaaacagtagcccaggacccaagtatatatatcctaccagtta

SEQ ID NO: 44756 - DNA, 2010 bp, Bovine  19866880515351
agacactgctataagaacacggaggagacttgagagaaattggtggaactttgtacctgtaaatatatatcgtatgtaatatatacaaacacgtaagtaaacatacattttaatagtggtaagactctgggtgatctttttcttgtatttttaaaatttgctcttattctaaaactataaataattaaaagtagtgaaaataagtatttttaaaagtaaaaaactgaatttcacactttaaatgagtgaactgcatggcatatgaattatacctcaaaagctgatataaataaatcaaggtagggtgggaacctgctggtgtaatgtgctcttatgtccacagggggcactcacaccattctgaagaatgctctctgatgaggtgggccctggttcaccgaatgcaaggacttggcacaggtcacttcagtgaatccctaagtcagactctaaccagggtccctttagtttcattcctggggggcatttttttggaatgcagtgatagtcactcatgtccaactctttgagactctgtggactgtagcacactaggctcctctgtccatgggattctccaggcaagaacactggagtgggttgccattcccttatccaagggatcttccccgacccttgggaaggggatcatacccctggtctcctacattgcatgcagattctttaccgtctgagctacagggaagcaagcccatgtgatcttatcctctctgtgtctgtttactcacctgcgaaatgggggtgatagtagaaggtgagttgcaaggttgtataaaggacaaatggattattctacacagagtgtctagcacagggcctgacaccacacaagggcacaatgtgtgtccctattactcttggtggtggtgggatggagttatcgccaggcattactgctactgtcattaacacagctcctgctattcagagatggtgtgcagacagaataaggcagttattaggggcaatgtgacaccagagccttgggtcctactcccagctgtcctactgaccacggacttgacctcagaccagccgtcgtccctcactacgtgcccttttcctccaaccataaaatgaggacttgggttaaataactgcagggtttcccaaacttcagtgaactccttgccaataatagcatgatttgtgcaatatccatatcctgactctcttgttactgatacctggtatttttaaatgactcacttgtacttaacttttaaatctaaagagaaaattagtatgattcattttgcgtaatggaagtccccattcaaaacatgtaacaaataacagaggggtttttttttggtcaggtggaggctgcctgcaggaggcacatgctgcggttcagaggattcttctgcgtcaagttacactgaagatcatggtcaagacgtcaggccagggggcttacgttacctccttctcagtttccgaatattccttgagtctctccacggccacaatgttggtctccatctcggacgacatccgaacgagccagttcaaatatgtggtgacctgtgaggggaagagtcatccgatggagcgtctagagtgagcatgagttgttttcttctcacgaaggcagcatgaattatgaaatgtttcagataatgaaggcccagaagacagctacctcagataccatggccagacctgctactgtgcgtctcttatcccagcgccacatttcaaaataacccgcggggctacacaagcaatcagaaaggaaacgagatggtattcccaaccaggtgatagttaagaaaacacaccacgacgaaatttgggagatgcagctaaagcagggcctcgagggaaatttatagtattgagtgcattcttctggtagctggaggcatcctctcaggccgtcagggacgctccttggctgatggggggagttctggctgcacctctgatttctcccctgcttcagtcagtcactgggctctagagctgcacctcaactccacttag

SEQ ID NO: 44757 - DNA, 1514 bp, Bovine  19866880544206
ctgaaaggtacattgtaggtgctcaataaacgtttggtccctcctccttgctttgcctaatgccagcttccgattagcccgaaggcagcagggaacagcgggacagtctgaaatgacccgctcttcacgactcctaggagcagcaacaagggccacttcccagccagagtgacaccaacgcaacgtgggaactagtccagggccccccaggggcagtcgccctgcaaacaccactccccacacggctgcattccagatgaaacacacagagagcagacctgctcggctgtcaccactgacagaggctcaaagtatggtgtgcatctgcctgctgctcctgcccctgacagaggcacagacaaatggggcttggaggaaagaagattctagaactaaggttgcatggggggaagggaaatccccagggaagaagctggacccatgtggtagccattctctggttcccaaggaaatgcatggtttccatgcgagaaaccatggaacagaaggaacaggcatctcccgggcactgctaaaggaagacatggaacgaggtcacacttacctcttttaaggcagtcatgattttggatctcaggatggcaagggcacacagtagggctataagccagaaagtgagcatgatccctgaggactggactcccctccttctctcgatctgaattaaaaaggtagcaagcagctggaagagaaaagcatgcgacaagagttgtcaggagaaggtcgggtccccacggcctccccagtctggggcctggcagatgcagggcccagaggagggctgcccccaggacggtggtagcagaatggcctggctccagtcccagctctgctctcgcctcgctgggtgaccttgggcgtgtcaccaaacctctctgagcctctgctgcctcatctgcaaaacagagttgacaacagtattcatctcgaaagccatgagaatgtaacaagatccaggaagggatggaaaagttgggagcgggaggagagagggtggcacgggcagggagctcagtttatcacagaaatcagcacgctttttcttaaaggaccagagagtaaatattttaggatttgtgggccatggagattctttcacaaccactcccatctgcagtgtagcatgaaagcagcctcccatgagacagggaagagtggttatggtcacctgccaataaaactttatttacaaaaacaggctgtgcgccaccccctgctttagagaaggaagtccagcctgatgcagtgggctcgtctgcctcgggcagcagtggtaaccgctctcctttactgagcctctctttgctctgcctctaggacgcactcacctgcactgactcagtgcaacctgttttcagccccagtttgcagatcaggaaacttactcaacctgctacagacagatacatagttgtcttcacggaacttcattagaatgacggtgagggggggattcatttcctggtaccctgagctagacttccgttttacat

SEQ ID NO: 44758 - DNA, 925 bp, Bovine  19866880561272
tggacaggtcacacacccatgaatccagcccagcttggggctgagggattaagcagccattgggtagcctccttccaactgctgagcctggactgattaaaaggacttggcagtaaggtaattacaaggccaggaggccgtatgtggtcatgaggccgagtcttcctcaaggatgagggagctggacacaaagtcccctaagaaacaggactgagagacttccctagtggaccagtggttgagaatctgcctgccaaagcagggaacacgggttcaatccctggtccgggaagatcccacatgcctcagggcaattaagcccgtgcaccacagcaactgaagcttgcctgcagcaatgaagacccagtgcagcctaaaattaaaaaaaaaaaaaaaagtaggactgaagtttagggtgcactgaccgagaaggcatctttattcttagagtctggggtcagaaaagcaaagatattgatgtttctgaagcagccctgagcacatcaatcttcagatgcccatgagcctggagcttgggttgtttactttggcagaacctcccaggacaatttatttttatcaataaaacttggagactgttgagccaagcagccacgtggggagaagcaggttcccagagtctgtatgtcacttcctcgcccttgcgaggttaaagaccaggaaatcatggcgggaaaaggaggggctgtagtgatccagggtcaatgtgtgcacagctgtcctgactcttgtcttggatatgaatggactcaggaccagctacataggcggtttcccacactgagattttctttccttcttcttgctctgatcagaacctagccccctcagtttggggtgatgtctatcagaggttctgacattatcctaatagaagtaattcatactaaggtgtaaatgactg

SEQ ID NO: 44759 - DNA, 1272 bp, Bovine  19866880748313
ttctgttacttacactactctgtataacgggctctaggttcatccacctcattagaactgactcaaatgcgttccttcttatagatgagtaatattctaagtgatgggtatttttaaatcgaggtgtatacactgttgttcttagatataacactgttgcacacttagcagactacagtatagtgtcaacataactttgatatgtactgagaaaccaaaaaatttgcatgatttgctttactctaatatttgctttattgcaatagtctggactaagtccatgctgtctctgaggaacacctgtatcctgcccaccccaagagagattttcctgaatactgaaaatcctctgagtgattctaaactgaatgtcttctgactatgtatccaggtcttcaaaaaaataatgatacctaccaccaaatacggcacaatgtggctacttgtgaaattttagggtaaagtttaacacaagccaagacttcctcactgatggatatgccttctattttcacagagctattacagaattacatgcaattctgtctgtaaattatttagttcagggcctggaacacagtgaatgctcaataaatggtagttttaaagaggggggcagtgcagaacaagatggcaccaggtaccacctgcagtttaggggtgctggcctcagcatcagagcgtttgtacaacaaatgaccatctgcgttgtgctggggatacggtggtacatggaatatcaaacaaatcaaaaggtccccatggacctttttcttcaataagttgggtcttaactcagaaaagcagaagaaaaagcagctccacttacgtgcagagaatggactggtcctcccgatctgagaacaaaaacaaacaagagccacgagttagaatcagctctgagttgagggtcaggacatgctgccgcccagggctcccatttaagctcacacaccctggcccctctgggggtgacaaggggccagctgagctcattgcccagggcataggggacaaggccaaagacaagagggcaacaaagccctggaggcagccccagaaagatgctggaatctgacccattcaggaggcagtgagcatcccgggcccacccgctcggagtggaggggggttcccaggagacccactctgtacagatgaagtcacagacagaacaccgactttggatccagacagactgggtttcctcttggccacttcccagctctgtggccttgggcgaatattcttaacctctccaagcctcagttt

SEQ ID NO: 44760 - DNA, 1715 bp, Bovine  19866880779179
gcgcttcagctgccgggaggaggccacgtagaacctctgcgggagagaacggaccagaggtgggcgaggggcccctcatcccatccttccagggccatgctggagaaagtctggacgtaaatgacccctctgggggcggaatgctggaccggggctgctttcacccgaggaacggcaggtgtactgactacaagaataaccagggcggcagcagtgatgataatagctcacgctccagtggagcccggatctctggtagctcagctggtaaagaatctgcctacaatgcaggagaccctggttcaattcctgggttgggaagatccgctggagaagggctaggctacccactccagtattcttgggctttcccttgtggctcagctggcaaagaatcgcctgcaatgcaggagacctgggtttgatctctgggttgggaagatcccctggagaagggaaaggctacccactccagtattttggcctggagaattccatggactgtacagtccacggggtcgcagaaagtcggacacgactgagtgactttcactacactacacgtggagcccagcatcccaggactgctttaagcaccttcacagccatcagctctttaatcttcatcaaaaacctataaggcgctcaatcctgtttcacaaggagtaaactgaggtcaacctcttccctacggccatgtggctaggaagtggcagagctgggattcaaacaccagcagtccagcctcaaagtgttgacctcaaacacggcatggcctctctgatgccacggacctcgagagtttatggaccccacagcgttgctttaggacaagcagagctcagcataaaccctgcctctgcctatccccatggacagagaccacatccaactctattcctgccctaacccgggtgttcagctcgttaagagacagaacaagagcccactgggagcactgaggagctgtgacagaggctggactggccatctgaagacacctctattctcctggcttcagtttctgcatctgtacaaaaggacccgctgagaccgaagttccctctcccggatgtgctgaagatgtaacatgtctgcactggcttcaacagcagagcagggcaaatgaacacaggtgctgagggacatgtcttctgcctcctgggctgttctgggtgccctgggccatctttaggggcagagacctttcatggagaacactgaacagagtgggtggctcttacgggttctccaaacttttttctggatgtcagctcacatgagaatttgaaccacatgttggggagccctctgggggccccataaactctgagaactaacccaggggtcacaccaacccgggccacctcagatcaggggttctgccaatccctgcacatggtcagatgccacctgtcctccggcggctctcactgccttgggacacagtccagaccccgtggtctggctcaaggaccctggcatctgcccccattaccctctcctgggatcacctcctctcccgactttctttcctcctgggtggaaactgctctaaaatgtctgacctgctcaacttactccaattgtcatgtcctctgaattttatttcctctaaaaagtgaacccaagacttatttttgttatggaatagtctcatttttaaaaaataattattagctttccttttaagctctattcctggagagaatcca

SEQ ID NO: 44761 - DNA, 1161 bp, Bovine  19866880978451
ttaaagagctcagagcccaaaccttggtgtccttgattctgcctttttcttacacccatgtctaatccatcagcaaatcctgctggatccccctttgaggtagacccagactgttccacgccccaccccaacatcagctctccccacataatagccaggcagtaaatatgagtggaatgatgaatgaatgaaaataaggactgaaaagttcccactggattaggcaacaggggagtgaccagtgtccatgaggaaggctttatcagtggagaaatgggaatagaatccggactcaaggggagggagaggcagatgcaggaagcttggctggaaaggggagaggccaggcaggtggaggctgggggcatgttgtcttgagagcaagtgcttcaggtcggaggtggccatggaggacaggcactgtgagccatagctcgctctggtgagcaggcgtgtcccccatcacactggcattgtagatgtagacccaggttcctgtccgtcccttgtcaccacagggcatgaatctctctgggggccagaagcagcggctgagcctggccagggccgtctacaggaaggctgctgtgtacctgctggatgaccccttggcagctctggatgcccaagttggccagcatgttttcaaccgggtcattgggcctgatgggctgctccaggggacggtaagtttggaaaaatgtctcagaggccatagtgcaaaggtagagaaagttctatcctacatctgctcaccaccaccctcctggaattcagttttcctctttgtaatggtcagcctttgctgtgaccacgctgcgtaacaaacagtccccaaatctcagtggcttacatcttcagtcaattcttgcctacgggcctgtggttaaactaccacagctctgcgtcaggtcactggccaggttcaggtgaactgtgtcttctggtttcatgacaggttgaaggagctcctttacttctctgttgggacatgccattttcaagaaacagggcagtagcacaagaaggggaagtcttcccactctgagccccaggacattcccccagccagccccctcccccagctctggaacagtggtcaagtgcgtgagtgtaacttccatcccttcctgccagactcggattctcgtcacccatgca

SEQ ID NO: 44762 - DNA, 3195 bp, Bovine  19866881311602
ctttctgtttgtttattgtttatgttttctcaaatatttattttgagtgttgtgacatgactttgtccctgcccataaagactttgaggtcaggtagcaaaaacttgtaattgcaggagctcagagattcttcagcctagcctagggtccatggctgttttcagaggagctgcgaacttgcgtggggagagaattacctctttattttcactaacctctcagtatattcagcagagtacgcaaaccacagctgcattagcaatgcttgtgttctgtcttagtagaaatcagggattttcacatcatagcagtcgttggatgttgtattgtttcggttcccaggtggcgctagtggtaaagaaccggcctgccaacgcaggagacataagagatgcgtgttcgatccctggatagggaagatccactggagaagggactggcaacccactccagtattcttgcctggagaatcctacggacagaggagcctggtggctacagtccgtggggtcgcaaagagtcggacacgactgagcgacttggcacacacgcatactgtttgcattcacctctgcttcaaactctaggtgttacgaagccgacggcttggacttgtgcttgttaattaagaagcactgtagatttctatgttaccacgtttgataattacatttccagataacttctttctcttttgatcaattttatgcatttgaaaacatcatcttgatacaggggctccaccagactgctggcgggatccatgggccccagcagtgcagccactgctgcgggtgtgatgagggaaggcccacgggggtggcacagtggggccccaggagattctgcctaagtacccctccggtccttcctgggggctcgccggcaacaacagggatctgtctgaccccatctccctcttgcagctgaactccttcgagcagctctgcatcaactacaccaacgagaagctgcagcagctcttcaaccacacgatgttcatcctggagcaggaggagtaccagcgcgagggcatcgagtggaacttcatcgacttcggcctcgacctgcagccttgcatcgacctcatcgagaagccggtaagagcctcgaggctgcgcctcgccccacctgttgctccacccctctggggacggaacccatcagtgatcctaataccgaatggtttactttgatgatgagttttttgtttaaatcagttttgttttccaacaaacaagttggtgtttggttcccaggcctgtcagccagtcccacagtgcccgagtctgctctcttataaactcagagtttgaaaggctttggggctccggggcgcttcctcttcctcaggagccttatcctcaatgtccccgctcaccacatagttgtgtggacacactgtgtgtcgagtggggtcccagagggactcgaggggccaggacccctgctgaggggcagcctctggacgtgggtcaggggtctgcatggcccatcaagccaccacgtgatttccagtgttctcatgggagaatcttgcaatggatcatcggattaaggtgtgttggacatagcctagacctcagaaatttctttttcagctagaacttgtaattggagtgctttcagtcatgctccttatttttttcttgtgtgaggaaagcactgcccaccttctggtgagattcttgagtttctgaaaaccaggctgtgacttctttacaagggtgagagtcggtgggtttccaggtcaagctgacctgcgcgatgctatgctccctccaggcaggccctcctggcatcctggccctgctggacgaggagtgctggttccccaaagccacggacaagagtttcgtggagaaggtgatgcaggagcagggcacccaccccaagttccagaagcccaagcagctgaaggacaaggcagatttctgcatcatccactacgctggcaaggtgaggcgtgcacaccctggtgtcatgcggtgttattattaagcgtgttttcagggtgtagatgtgctgtttgtgctaaagtcatggactttgcagtctgaattagggctccgctcctatgtgactttgggccagttacttcacctctctgaggcttagttgcctcatctggaaaatgtgggtgaccaccactgtactggggaatgtgtattaacggagctcacaaagcccagtgctgggcagtcagtgctcttgggcagggcctctcagcctccacactgcccacctcagtggccagatcagtctttattgtcagggaccctcctgcacgttgtaggatatttagcagcagacctggcttctccccaccagaggtcagtagcaccctccctacctgcgacaaccagaaatgtctccagacatcctggaacatctgctgggtgggattgaggggtaacattgtccccaggatgagagtcatgcctgtaggtgttgttggctttgttattgccaagaccaccggccaggaagtagcagagctgtcttcataccagctgtcagacatcctccagtgggcttgatcccagggcttggacctgaacaggtgtgtcctgagtctgcagaggtccaagcttagactataagctggttcttctcaggaagttgtgtcgcctgcacagaatgtctaacacttggacgtgtgatgagctggtcggtcctcagccttcccgtcagtgaggatcggcgatgagtgaggatcggtgatgagagacttgctgtcacagtggtgctcccaagccacccctggtcctcccccacccttctgcacgtggccctgcgctgttcggcctcccctgcttagctcctttgtctcctaaggctgttgaagccactcttgattttaaactacgtgttaaggagatctcttttttctagttacctgaggccatgccctcttccgaaagcccacgttctcccgccacctttgttagaaacgcaggcaggcttctgttgcactgttgtaggtgatgccaaacttgggcacgcctgaaagcccaggaagggctgaatggtgaaactggcatcgccgtccggcctgcactgcagcagctcaaaggacaaggattctggccgtgcccagggggacacatgccaagacacccaactctagggttcgtcctctcccaggaggtcattctgcctctagggagaaagacgccaccatctgcacctcat

SEQ ID NO: 44763 - DNA, 1280 bp, Bovine  19866881380883
gggacacacatcatcagatgcacctcacaggtctgcagcgagagtaagggtttcggcaccaccgagggcagcccccgcagcgccttaccagcatctgctgggccatcttcttccgttctgcctgcagctgctggctccggtcttcctcctcctccaggcgggcctccatctcgtgcaggatctcctccagctcctgcttcttggctgccagccggacccgcatctcctcggcctcggcgtacagctccgtctccgcctgcagctgctcctgcagcaggttcttctcctccgtcagctgcaggcagggggcggggagacaggtggtgagccccacgggggcaggcggcctgccctctgcagcgtcagccaggctcccgggccggtacctgcgagtgtttctgctccagctccttgagttcgctctcggccttctgctgccgctccttggttttctggagctcatcctccttggcttgcatctcctcctcctgccgagtcacctgcagcaggggcttcacctgcacacagagggtcagcccatcagttgtctccatggcacaagggatacactctcatagtaagtaaatcaatggttctcggccagggacaattttattccacctgcagcccctcaggatatttggcagtttctggggacggtgttagctgtcacaactaggtgggcagggggatgctactggcatctggtgcgtagaggccagggatactgctcaacattctagaattctcaggacagcctccgtgacacagaattacccgtcccaaaatatcaacatatgccaatatcaaccaatatgccgagactgaaaaatcctagagcaacaggaaagaggtgcaaagtgacaggagaagtctcgcctccccccatttagtcccatcctgagtgagaactgctgctgacaaactgctgtgtttccttccgaagagaaaaggagaggaaagtcccccacatcctgcctcccgttactggccctatcagcatctccttctagccctttgtcctgcacactaaaaaaatgcaccgagaccacactgcccagcgttacatgtacttaaaaaaaatgtttttttaaattaagaaagtttttttgccatgccatgaggcttgagggaccttagtttgcggaccagagatggaacccaggccctctgcagggaaagcatggagtcctaaccactggaccttcagggaattccctacgtgccgcttttattactaaaaacgacaggatactgtcacccctgcggtcacgtcagtg

SEQ ID NO: 44764 - DNA, 761 bp, Bovine  19866881381823
gagttggctcgactgagcactcatcgacaacatggtgaacgtgccactggcttctcacagcctcttgggagtcaggaggactgtaattatcactacctccatcttttgtcatgaaacccctgtaactccacaggcccagagatatattgcattaaagtaccgggacttgtgtcctgttctgctgacccagctctctaaagtattgggactccctctcaattcagccctgaaagtccttccagatggttcctgagaggccctggcctagccccccacctgatgccctcctgagcttccagggcagctggtgggaactttcaggggagacctggggccgaccgggcaccacccacaccgaaggcccacacaaccctaccgtcctccggctgcccctgctcctgctccgcgctggcataggtacgcaggaactcggcgaaggcgccgtcccgagccaatagctcctggtaggagcccatctcggagatcttgccgccactcatgactatgatgacatccatctggggcaggtagctgatggcgtgcgtgaccaggagccgtgtctgcagggagagcggagacacggccacattagcgcatgcgcacaaaaggaatctccccctaccccccgacctgtacatgcgcctgggatgcaggcacacagaagcattgcaatctgcaggctgggagctggggccggggtgggcaaggagtgagggaaacaatgatccttgctccagattctagggtccagacagatatga

SEQ ID NO: 44765 - DNA, 854 bp, Bovine  19866881469808
accccagggtcttagttccggtgatctgtccctggcaggctggacgacgaaatggctcagaagaacaatgccctgaagaagatccgggagctggaaggtcacatctcagacctccaggaggacctggactcagaacgggccgcgaggaacaaggcggagaagcagaagcgggacctgggggaggagctggaggcgctgaagacagagctggaagacacgctggacagcacagccacccagcaggagctcaggtgaggagcccccacccggccggccggccgctccgatgggtcaggacggctggtggaaaggggcaaacccacacagatcctgagtcacggggctcctcaggccctgcgtttattcgtgctgattgcattttgctttaactgatgtaagcatgcttaattttttttttaaattttgttgaaatatagttgatttacaacgtcatgttagtttcaggtatacagcaaactgattcagttctgttcttaacaaaaaggacatctcagaaaactgagtaataaatatttctgtctaattaagccacatggatacctaaaagggcccacatatcttcctaccctggagatgattagctacttggcatttgggagtttcctgttacccaaagagggtaattggaaaaactggattttttaattatttgaaaatactaataatttattatagatgttataaatactaacatcaaatctaaatataataaaacattttaatatgtcggaaccatgaaaatcaactggtaaattaagcatgcttattttttaaatttatttgtttttaattgaaagatgattgctttacaatattgtgttggcttctgccat

SEQ ID NO: 44766 - DNA, 2799 bp, Bovine  19866880370228
ggaggccccagtatacataaagcacaaaaagactatagccctaacagttattcctagagaaatttttccttcaccatttccattccttccaagttttattccagaaagagagggaaggatgattaatatgtccataaggagtaatcgccatcacaatattaacttggacaaaaacaataaggacccaatttagctggtaccatcttatttttcctgggcttcccttgtggttcagctggtaaggaatccacctgcaatgtgggagacctgtcttcagtccctgggttgggaagatcccctggagaagggaaaggctacccactccagtattctggcctagagaattccatggactgtacagtccatggggtcgcaaagagtcggacatgactgaacgactttcagtttcagttttcagtatcctattttcccaccagataagtttaaaaaaaagtcaaagttttctcagtgtggaagagtaggacagcttatacactgacatggtaccccagatgagttataaaatttctcaaaccatgcaaagtatactcatacaaaaacaatttcttgtcattaatgtccttttcaagtcctgttatttttctcctctctaacacaaacttatgggaagagctgtcagtactcacactgattccacttcttcaactttctctcactttatgatctaccacactcaggtttctgtcattaattgaactttgaaaatgctcttaccatcatttctcttgtttaaggtcttttccccccctaaatccaatagagattttcttggccctttatatatatatagctgctccatttttagtgaaaaattctctttcacttgctttcttgttctcccagtttttcttccatttgtcctgccatctcttcttacactttttttcaggctccttttcgttttgcttataacttcagatctagtgtccttcacttttggctcatttctctcattgttctaacatgttctttctgggtaatgttatcccctttggtggcttctatattccctggtggtctaggggtaagattctgaactcccaatgcagggaacccaggtctgataactggtcaaggaactacatcccacatggtgcaggtgagagttcacacactgcaactaagacccggcgtagccaaataaacaaatgaataaatacataaatatttttaaaaaatagacattataatgatttgcaaatctacagttttatctccattctatctcttgaacctcagccttctacttcactacatcaaaatatctttttattggcttccttgactgttctaaagataattaaaacccccaaagaacacaactaaatgcatttttttttctcttgatttgctacttcctgtgcatgcatgctcagtcactaagtagtgtctgactctttgcaaccctatggactgtggcccaccaggctcctctgtccatgggatttttcaggcaagaataccagagtgggttgccatttcctcctccaggggatcttcctgacccagggatcaagcccacatctcccatatctcctgcactgtaggcagatgcgttatcactgtgccaccactatgctgctgccgatgataagtcgcttcagtcgtgtccgactctgtgcaaccccatagacggcagcccaccaggctccctcgtccctgggattctccaggcaagaacactggagtgggttgccatttccttctccagtgcatgaaagtgaaaagtgaaagtgaagtcgctcagtcgtgtccaactcttagcgaccccatggactgcagccccccaggctcctccgtccatgggagtttccaggcaagagtagtgccaccactctactgaactgtatttcctcatgctctctcacctctgcttttctatatgttcctttctccattctttccacctctatccacccacttgcccaagctttatcacattctcttttctctactcatttagggtagtcagtgtgatatcaagagcagagatcatttattcactcatatctagtagagtagttttactcaataaatatttattaataaaaacaggtctgatttcagatatagaatacattgatcttctaatggaaatatttttctctgtgtagcagttttatgcatcattataaactagttgattagcaattttgatctctacatgttgttctcttgtgaacttgtttaataatgtatcttcaagaaatatatccatattcagagagctgaccaaatcaagttttttagtttgagagtctgaagtcaaatttcagaccgtgcagaatttgtggaaggaaatctgaccttcattggtttttgccaactagtcagttattcttctcattttggcaacattttgacctcacctcctaatggttattaaacttcagtagtaggcagaataactccccaattagtgtttgaaatgtcaccactagctaattattcccttgtgtttacactgtcatatccttgaaaccctcatttgtaattccaggtgtgggtgacatgcttaacgctaatttcttcttgtggcaagatggttttcactctatgagaaacatgatccagtgtcaatggaaggggaaaaaaattaataaaaatgatgataggatgggaaagttgatattgctggatttcaaaataatcaattaaattttttttcacatttgactttacttgtgcgcatgtatcccacagctttttagcacattgcactactggagagtttggagaattatgaaatgttagtgctacgattgctttcactaaacc

SEQ ID NO: 44767 - DNA, 1820 bp, Bovine  19866880470708
atgtaacgttaaggaaaactaagaagatgatggattcaagaacggtatttaactgtccattaatttctagaaggattctgaaacctatttattgccacatttatgtacgttttaattttagggggttgttttggaaattttttttggcgcaccacgcagcttgcaggatcttagttctccaaccaggaatcaaacccatgcccccggcagtggaagttcggagtgctaaccactagaccaccagggaattcccatcaaaacttttttttttacatattctaagaaaaaattagcaatcttaatttctaaaattacatttagggaattagcacctcaggaagccctggtggcgcgcagcggtaccatgcgccaccaggcatggtgcctgccctacaggcgatgtgggttcaatgcgcctgcccatacaggagatgtgggttcaatgtgcctgcccatacaggagatgtgggttcagtccctgggttggaagatcccctggaggaagaaatggcaacccactccagtattcttgcctggagaatcccatgaacagaggagcctggcaggctacaggccatgaggtcacagagtcagatacgactgaagtgatttagcagccacacagttggcacctcagaggacaggcctaatttaggttttctttgctcagactccacatgaagcctttagtgaccagtttgtggaatctgttctcagatagctgctccttgacacctctaagaatttccttaagagagtgataaacacattctgtggtcagacaagctgatggatttacaagccagcctgagttttcagggcctttctgctgtgggagacttagactttgcacccactccagtactcttgcctggaaaatcccatggacagagaaagcctggtgggctgccagtccatggggtcgataagagttggacatgactgagtgacttcactttcacttttcactttcacacactggagaaggaaatggcaacccactccagtgttcttgcctggagaatcccagggacgggggaagcctggtgggctgccgtctatggggtcgcacagagtcggacacgactgaagtgacttagcagcagcagcagtcctctggttacaatgagaaatgtgaattaagaatgagaaggaaatcctctatttttcacactttcatctaagatccatttaattcaaactgacttttcaccagtctaaccttggtcttcttgggaagattcccagaggatttaactcacttccccaagtactctttagaaatttggactgcaaaaagacttttacttttcaccttttttttaaacttttcatctttataaattctatttatttggtatgagataaaatgataagaaaagactgaaaagtacaacaaatgatgattattcttgaaagatactaaagtacaagtacaaagtatatcccccaaattctgacaatacttaacttctgccctgggttctttccaaaactctagcaactccacaccaacatcctagtcagtcctcagcagttgagtccagagggcacaaaacacctatgcagtctcttctgtagatcttcagttcagttcagttcagttcagttgctcagtcgtgtctgactctttgcgaccccgtgaaccgcagcacaccaggccttcctgtctgtcaccaattcccagagtttacccaaactcttgtccattgagtcaatgatgccatctaaccatctaatcctctgtcatccccttctcctcatgtattcaatctttcccagcatcagggtcttttccaagagtcagctgttcgaatcag

SEQ ID NO: 44768 - DNA, 1391 bp, Bovine  19866880494677
tgcctttttcatgtatggtgcacgtggaagagtgaccgcgggggagttccctcgtggtgcggcggccaagactccatgctcccagcacaggggcctgggctccctcccctggtcgggagctagatccaagaaaagcagaaggacaggatctgtacacaccctgacagaaactggaggccatgctttgggggcatctcaggccctctaaggactaaggcggtgtctgtctcatacacctggaaccctttcccagcccacaggtgtctgttggaaagctgctcacgatcctaccagctgtggtataagttgcatagaattgtgttgagtaggtggattcttaaccactggaccaccaagggaagtcccagtgatgggtttttaatcaagatatttccaagagtaacatcaaagaaggctctgtattcatacttgcccaaaatgcctcaaacctgagaaagagactagagttaagtatcaaattttctaggtcgttttataaacatttggactgacacatttcaaataaaaatatgtgtttttgttgtaaacagacatatcctggcaccaccacctaaatctatccatttagattttttatttattgctgaagtgaattatgaaaatagtgtaatgcctgaatcctgtgttctcgtttttattattataaaacaatggacctttcatagtgctttataattttgcaattaactggaacccaaacctgtattacctttcacttcaaagaaggaattaaagcaggaagagaagcatttaactgatttccaagtaaattattaagcatccctcacatactaattagtctttctcttgctctgattccttaaaaccaaaatacatcagctattagaagcagttccttaatgctgcctagggttcttgtagtagtcaagccagaagagaattactggattgtccttttgtttttgtcttttcaagaacttaagcatgaaattccgaggtctcatagagcattatagtttttgttttcaggtcatattgcattgctttaatttgaaagctgttgtataaagttcccatagcaaaaactaagtagaatgtgctctttcagtgtaaattatagaaacgatcattttctatgtattaaaatataggtatttcatgacacaaatcaacctatctaagacacagactcacagacgtagagaacagacttgtggttgccaagggggagaagggtgtctgggagggatggattggggagtttggggttagcagctgcaaactagtatatatagaatggataaacagcaaggtcctactgtgtagcacagggaaccggtaatatatacaatatcctgtgataaaccataatggaaaagaaaaagaatgtatgtataaccaaatcacat

SEQ ID NO: 44769 - DNA, 1533 bp, Bovine  19866880590857
actgaattctattagaagtctatttgcttctctcataagtgctggttcaaagaggggagaaaaatcagtctaactcattgttcgaaataaaacagagcagggacttccctggcagcccagtggttaagactctgctttccactgcagggtgcgtgggttcaattactaggtggggaactaagatcccacttgcctcatggtgaaaaactaaaaaacataaagcagaagcaatattgtaacagattcaataaagacttaaaaaatggttcaccatcgaaaaaaaaatccttaaaaaataaattaaaaaataaaacaggggagatttgtggagagattatgtgactgtgctttaaaattttttaagtgaagaaaactcagtgtgtttcattgtgattattttccttatagaacatgtctcattcaaactttcgtttctcccatgatgacacgatctcctggttcaagctctatggatttttactcaacttgtaagtttttttacacagtgcagaactgaaataatagtgtgttgtataatgatcctgagaggtcaattagtctatccctgtgttgtcagggacaatcattttaactgaggagagaaattaacatgtactttaattttaatctattcagagaaagctggactattcaattttgagtggagggttacataattctgtgtcaatgaccttcaccagcaggaagtggcaaacccatcatgtggtattttttacctgctgcttctgtttgtaaggctggaaaacaactggtcactttcccctgagaattacagaaactcttttcacaagacactgtcactgggaaaagcagaattgcttatgccaagttaaaaaaaaataattttttaaagttcaggtcaagggattgagaaataggaataagacttggtgctgaaagactgggctcttaagatgcaggcaatgtgaccacaaactatgaggtaaacctcaaaatgtcagagacctgtttatcccagtgccgcgagatacaggagtagttcaacttgatattattttttacgtgtgtctaatggactgtaagtaatgacaacattaaaatgagaatacatgcataaaatccagctgattaaaggttttggtagtgttgagaatgagatgcaaaaaacaagaagataagcaaatataacccatgtgacagatcatacttgttctgggatgtcataaggcatttgcctaagttaaggggatagtggtgaactcatatacacaaaccccagcagcatgaaatggagattttccttggaaattagagcttttccccatttcttcatgcacatcatgcttctgatcacgtggtgagtgacttgctggagccggaggaaaaggacagctagttttcatttcatcagcctaccagcaggacaggacaggctaatcacaccagcccagctctccttgcctcatgactcccttcggtgtaagtcttaattttagttctcaatagcatgatatcctaaccagatggtaaagaatctgcctgcaatgcagg

SEQ ID NO: 44770 - DNA, 1767 bp, Bovine  19866880699177
cttgggataccatgatcgcactgtcccctctttctctgtcttgcttcccaccaactcaaattgccaggaagtagtagctttttcttttgccacattctccttgcagtatgccacatccaccttcctacactcctgtttactctaccatggataggcgtattttctgtaaatactgtggaggacattaacatctgagccctccaagctcagttatagccctcttcttttgcattctggctgaaactaatccaaaactttccccaagaagatggatgcttcagaccatttggggcaagattatatactctgaaaggtaaaagagaaaatcacagaaataagtttcaaatctttatctccattgagttaaagttaaaagttaaactaaaagttaaacttctagcttgctaatatactgtgggcttccctggtcactcagacagtaaagaatctgcctgaaattctggagacccaggttccatctttgggtcaggaagatcccctggagaaaggaatggctatccatgcctggagaattccatggacagaggatccttgcgggctacaatccatggggtcacatacagtcagatgcgactgagcagctaacactttgacagtacttttgctaatgctggtattggctaatactggtccctggtattgttacgccaaaaaacaaacaaacaaaaactcaagttcttccagatgaggtgaggatagaagaaaaggataaaaatgactcgaaattcatcctgctaaaacaatattcttgggttatataaaaatatctgcacagtaatgcttaaaattatacttccttgtatactttctaatagtatcttttgatatgaaagctaaagaagccaagcctcaagaagctaagggtttagaaaactttatttggatttttttcctcttactttgcatatttgtccattaaatggcaaggtagaattctatattattttccaaagacttgcttaatgaattaaaattctatataaactttaatcttgttgactttaagttctacagttttaattttatgttaatcaaagactgttttcagatcagtagaacattttaatcaataatcttattcatatatacaagccaggtatagcttgttttttaattcctataagcctctgtgaatttggatgttattgaagctgttaaaaactatccatgaattcttcctgtctaaagtctttcctgtattcactctcatttactatggtaatttacaacataggtttaaatattcagaatatgaataatctttctacttatgcataaagaaacacttcctccatgaagtcccacaactactttgatctgcaaatcatatgctaatttaaatcttttctttctgtaaatttagagctcatatctttaaagatgcccaaggaatttagtcaccctatgaagcaaaaaaatattcctaagagttattaacatctttattaatttaaggcagtcataactccaagaatataaacttgagattcttagtcccatcttgtaatcagcattgttggaaattaagagtaaatcctacctgttagaaaccattgtggaaacagttttctcttgtggaaaataatgtaggtataccgtgcatgtggtataattagaaacgaaccattcatcagtatctagacttgtggaatatcctatttctcttttaactactgagtggagctactgaaatagctaattgtggtggttttttttttttttaatttataaatgatagtaccttcc

SEQ ID NO: 44771 - DNA, 2095 bp, Bovine  19866880728862
cttccatttctcctcttacatgtttctatagcatactttcttcagatataaaaatcagtccctttacattatttatgtaaagatttttttgtgaaacgacaatcccataaattattgctcttccagtgctacactctacgttttaatattctgatgcccatcttgtagtgctgttagattgatctttccatatttgaatttgatagtgggtctctataatgtgcgtagactgggatacaaaataatggatgtaggtggatactcatacttactttctattcatggcccacctatcatgtaaaatgcaatgattgtggagccagatcagcttccttttgtttatgaaaatagaagaacaggttgaggtcctactctggataggggtgggttgggaactggtgagtctagctgtattgtaaaactaagttagcatttacacacacatgtacatacagtagatagtagaaagggctatgtaggagtgtcagtacctggggctttgaattgcatcacctttactcactaactttattgttgcaatgaagaaattggctatttcgctacctggtattttgtaaagtttgtggtagtagtacattcattttctcttattctcttttcttccagccataatgaaaggaaagtgacctgtaaacatccagtcacaggacagccatcccaggacaattgtatttttgtagtgaatgaacagtaagtaaagcgtttcatggaacgcctctattcaaaacggggtcagcattccaattgctgttatccgtatttaatacagtacaattgaacagtttttttatctggacatttgcagtcaagggtagtaacagaataccatctatttaccatgtgtggtttagaaacatggcttagaatttttttcatgaggaatgtaatttcaaaagctatttttacaatagctcaaacacagagaataaactcaagatccctggatgcaaggtcagggggaactaaacttggtcaaattattagactaatttgaacttaggtttctcatccttaaatagagatactgggaattaccatttctcaggatttttataagcatcaagtgaaatttatttgaaaatagtttataaatctgttcttcaaaaattagttgttggtacccttgttattattttcttttagggggttgggagagggctgctgcactgcctgtcttatgggatctcggttcctcaaccaaggaacgaacccgtgctctcggcagtgaaagtgaggagtcctaaccacgtgaccacctgggaattccctatcatttttatggccttcagtattataatagcaaatcttgtaattaaaacgttccagttagatgaccaagtaacataactgtatgaaagcttattaaaataaacatgatattaacttaagttgtgcttagttatatttcaagtagttataaatattaagctggaactatagagcttattaagctcgaactaatacccagctgtttggaaaagtcagacagacaccagcattattagctccaggaaaatgtcattataaagtggtttacaaaagtagcacgttctgccactcttgacatgttatattttcaggactgttgcaaccatgacatctgaagaaaaaaaggaacgacctataagtatgataaatgaagcttcgaactataacatgagttcagactatgcggtgcatccaatgagccctgtagggagggtaagttattttgcttactcttaattattgataactgacatagttggtagtgtccattattattactcttaatgaacttagaattatagaacaatcatttcatttttgctattacatgaatctaattgcatttgaagtaattggcataagaagcaaggccttagaatataaagaactaagattatattttaataatttaatgagttatagtttttaaatattatagagttatgattttgaattgttttacaaatataatggatgttttgtgtgagacagtggcagtttattgaatctacttaagttttaaaggtgacgattaattcaatgacctagaaatcctattattaagtatgcctgggaatgatatatt

SEQ ID NO: 44772 - DNA, 850 bp, Bovine  19866880922831
ttcgaatttgatatcgtaattctactgcatataaacggtcttttttggctgttttattagaagtctttgaaatggtcaggcttgacataaggctgatccctgtaacaagcaagacctgttcctgactccccttactgctgactttcatgtatgttttgtgtacaggtgattccaatcctatttccctccctggaagttattaggaaaaacatttgtattgataaatgccaacagtatctcttatgtaaaaatctatgctatgaaacacaaaagtagccccaaacaaattctgttggtggtttgtgctatttgttttactgcctcctgtgtttccatctttaaacacttttttttttttttctttcttcattaagcaggctcagaaaccagctccctggtgtttttacaactatggataatgcagacagaatatctctctctagagaaccatcaaaatctactaaggtgctgttgacagtctcttttatctcctgcaacataataagctttgtccttaaaaaaggttctgcttagacctagttagctctgttgtctaggttactaatgaggccaggatcaaggaacagaaccttagcaaagttaatcaggtttgtatcattctgtagtcatccattgttcctaaaccttatacagtagttttataaatttgtgttgtcattcacaacaggaacctggcaagagaggaaatggatcaggaataatttaccattcaatggagtagccatgatggtcaacaaaagagtccgaaatgcagtacttggatgcaatctcaaatatgacagaatgatctctgttcgtttccaaggcaaaccattcaatatcacagtaa

SEQ ID NO: 44773 - DNA, 2650 bp, Bovine  19866880971456
ctggaaaatcccccatggacggaggggcctggtaggctgcagtccatggggtcacgaagagtcggacacgactgagtgacttcactttcacttttcactttcatgcattggagaagaaatggcaacccactccagtgttcttgcctggagaatcccagggacggtggagcctggtggacttctgtatatggggtcgcacagagtcggacacaactgaagcgacttagcagcagcagcagcagttgccgtacacttctcttcataacataaatacctaaaaatgaaagtctgtctcaattgttattgttccctgaaatgagtcataacactgaatatcccaaaactataaaacggggtgttgggacccaacaaatgcttgctacaggtgatcttaatcctaaaaaaatgaccgtttcacataaaatactataaaccactcttattctcttagatcatcctataagatgtatgacctctatccagaggatcagaaagaaagctcaacactttttctctttgattctcttccctcttccttaatagacttaatgaagacatctggctgacaataatgttgtcaaactagacaagaaacagccaaatttgccttgtcatctgcaaaaaaaaaaaaaaaggaaaacaaaaaggaagtcagaactatatcgactttatcttgccttcaacccattccttactaattataagaagaatgaaggatgctgaatgattttacaattcttttactatcgatgctccctcttgaaaaatgaaactttattactacttattataccataagcagcatgcataaaaccgggaaagaaattgccacagagaaaagtggatagtaaatacatgtggctaaaatgctttatccactgtgcagaaaactctacctgttagaatggaagaagaaagttgaatataaaaaaagggaaaggaggtttcccaagatctttagaatcagttccaagtttccacaaataagtagatctgcaaatgatgtatgtaaaatgctgatccattcatatctattccccatgtagctctcttgtctttatccttgattcagatttattctttctcttctctccttcttttctataacaccccaacagaagcccaacagataatgtccatatagacaaagctatggtttttctagcatcatgtacagatgtgagagttggcatgtacagatgtgagagttggaccataaagaagacagcactgaaaaactgatgcttttgaattgtggtgcaggagaagactctttagagttccttggacttcagggaaatcaagccagtcaatcataaaggaaatcaacccctgaatattcattgaaaggaccgatgctgaagctgaagctccaatattttggccacctgatgcaaagagccaacttattggaaaaaaaccctaatgcttggaaagattgaaggtgggaggagaaggggatgacagaggatgagatggttggatatcacccactcaatggacatgagtttgaatgaaatccaggagatagtaaaggacagggaagcctggagtactgcagtctgtgggattgcaaagagttggacatgacttagagactgaacaacaacaaactttttaatgatgggcattctaactggtgtgagtcagaatgtgagatggtactacactgtaatttcactttgctgtagtgtcactttgcttcactgtagtttcaatttacatttctctaataattagtaatgttgagcatcttttcacatgtatattggccatctgtatgtattctttgatgaaatgtctattaaggtcttctatttttcaattgggtttttgttgttgttgttgttgagttatatgagttgtttgtatattttggaaatcaaggccttgtcaattgcatcatttgcaaatatttactcactttctgtatgcggtctttttgtaagattattaatttcatgaattagacaaggaacatatatgtattaatataaccagtgttatagaatgtagaaattgactttcaggtgaaataccattagaacattatattccaagggaagttctagcacgtgttgcaaacctcaaaaaggagatggctaaaacttactaacacaactcttagcctctcatctgggtaagtatataaaatagtctagaggatttagaaggaagtagaggaaagctgttgtgtagtgcacctctctcttggtccataagaatctgaagtgtgatgtacttctgtggtaagctgaagtcaagattgcagtttggtcctgttggcttagagagcataatatgtgtttcctcacacgagtgggacacagtgtacaggtttctgactccaccacttaaaatggcaagaaataagccctttataagagcaagaaattaaaagggcaagaaattagtaggctaaacactttgggtagaggaacagacgtcactgaatgggcagcttttgcctctaaatttttagggcaagatgtgtgagtttttcttgtagactagacatgagttatacaacctttccaagatgttgttcactatggctttctttggggagaggggtcacagatctcagtggagagagactggtgatatcatcagatcagatcagatcagtcgctcagttgtgtccgactct

SEQ ID NO: 44774 - DNA, 722 bp, Bovine  19866880978527
tgagtcaccaataaactgagacttttcctcctcccccgtactttgttcccacagtggtcacagctgcctacaggttcctagagactggagttaccgaagagtgaccgaggcagtgacctctgaggtctcattgcttatcctcccccattatcccagaaatgaacaagctggcatccacaggaattagcaggatcataccgggacaaatagagatgtcaaactgattctgtctctggttctccccctcaaatctctttcccatcagtttcaatctcattcttggtttttctctgtccctttctattctcctttgatcagtgcttcctccctcgagctgttattttcctcctctttgttctcctgtgtgacatctaccatcgtcatcctatccccattctcctcctcatctcctcctccttcctgactccattcaaaaataatgataatgataaagataacaacaacagtaataaacagttgtctgctgactgtactgcaggaacacaaagtactttccgttagtgatcactggtggctcctcaagtcccgccagcctggtggtggaactgatggccatagtgaggtaggtaggggagtgtgggtggttcccagtaagcacccacttgactcattccattgccaatccttctgacaatgtctaaagcaggcaaatgcacagcagctaattaagtaccgcgttgttactgcactcccaatcacaa

SEQ ID NO: 44775 - DNA, 1166 bp, Bovine  19866880996548
ctataattttgttactgaggaaaaaaaaaaaaagtaaagtaattgatctcttacttcaggctgtcaagtttgaatggaaccttgagagtcctctagtgcaacttctgttacaccgctcactacaaagtgtccagattgcccatcgtctttactggtaagattaaccaaagtagggcaggatgccttttttttattgtcaacttctttttgtggggcagcttttccttataaacctgattcaaacttccacttaaaattcagccaaatgtgagtctttatcagggttatttttacttatgagtataatttaactgtcattgtcttcaaaatcttccttttgtactgttgctgctctttaaatccaactggaatttgaaatctaggtgatccttttccaatagctttaaatcgcaaggtctacatgtggtcacatccacttgttgaatatttcagtttaaaatctagttataagatcctgtatgttttggaagaatgtaagcttgaaaagtaacttctgtaacaatattagttacaaacagtgggatcgaggccaatatatactgtcttaagcttataattcctggagcactaaagttttccaaaaacattaactttgaatattattagtgaagaagttagatttgtttaagatatatcaggatttctcccatcactgcctgctcctgatcctactaaacaacatgttctttcgatgctattctccctactgttattactaaatttgcacaaaaaatttagcaattacaagtgtcagtaacctaaggatggaattgaatctatcttttatcctcacatatgtatgacaagcatcatttattggcttcaattgctagtgaagaactttaattaatgggaaaaaaaaagtcaatataatttttgaatatcatgtttttctacttcaaaaaacattgttcttgttgacatcactcttcccatgaaaatgactcaaggatttcatataaaaatagaaatacaaggaattgtcaagccctaatgtttgattagatgcagatttccatttcaagtgtctaatagaaaagccagatcattttcctctagtatgtcagtataattaggcatcagatacattggccaacagcaggccttccactaagtagactctcttcatcagactctgaattaag

SEQ ID NO: 44776 - DNA, 822 bp, Bovine  19866881113591
ttcattctccaggcgatcttcccaacccaagggttgaacccacgtctcctgcattggcaagtggattctttaccactgagctaccagggtgccccagatatgtattaaaaatatgttgattgcatccagttatttaaaaatttcatgtaaccaacatattttcaatcatcatgttactgcacgtgtctttgaaaatataattgcctgcaataatcactgacagatctcccccagcaaccaatcagtcttcaagttggtgattttctaaaataaactttcggggtgtaaaagttttttttgcgcatcaaaagtaataacacaatttgtgttctaaatacctttaatcctctgtatctggccaaattgttccccatctgtgtgctgccaatttaaaactcagttgctggattagtctacaaagcaaaccctcccgtgttttattattttttgtgtgaaagaccccaagtttagtatgccttgcacagagaatgacacccctcgtgggctgatggacgagctttctgctgggcttgcaaaacagtcttgagaatgaaaatgcccttgattactgtcaactgacctagtcttacagagtaaaaaaaattaaatcccaaaggtgatttaaaatctatattcagctgttaagcccttttggactcaaacagcagacacacataataaatctcaaggctgacagtgtgagatttgcctactacctgacactcccaagctcttaaaaaaaaaaaaaaaaaattggtatacagcactctagttacaaagcataaaactaagtataacattaattatagggagaagagggag

SEQ ID NO: 44777 - DNA, 1490 bp, Bovine  19866881203404
tttttctttgacttttgacttgtcttctgagcacttgtgctttattgtcgactaccttctggctatttccaactagaggtcctcttcatcagtgagaagagtgtttgagaaagatgatgggcacaggatcacaatgtataaaaatcctatctggtcgctgcagtatcttgtaaagtctccaacagaaatatgcacacaaagaaaatgtcatactcctatcagtaactggggatctgtatgaaaccccaatgtatgtagttctctgctggaagtggaggatgccttttacttttaaaatagtggaattggccaaatcccctcatcctggcccaaggtgtgcattggtaggtagccaaaagtcatgtctcagattgtatagaaatatggagctaagtgagtatcgtagaaactattctgaaaccagtgaaacttaaagacttcatcagcagaaattataaagttggtccatatgggtaaaactctgtaacctaggacacatgtgactgtctatgaaaatcatcataaataatgcaatgagataaagtcagcagactaaacaaatgtgaatatttatacatgaggggaataagacctatctaagaaaagctctgaaagaagtatgtctaaaatgttcagttatcttttgaaaaataagttaattgacaaaataatactgcattgaataacaacaggaagattgaaaataaccctccaaacattatagaaatagaaaatgaagttattgaaataaaatatttatagatgaattaacagtagactcaacaagattaaagagagaattatttaattgaacaacagctctgaggaaatcatccagaatatagtatagtgagataaaaataggaaatattttagagaagtttaaagatgtgaaagatagatctaaaagctccaacatgtgtttgatggggagggaggtgggaggaggattcaggacggggaacacatgtacacccatggctgattcatgtcaatgtattttttaaatataattttttaaaaaagaaaaaatatgcaatgcataagagaaaataaagaagtgaattaaaagacacaatagccaaaaattcttaaaattgaagaaagatttgagcagtcagatagtaaaagcacacagagttgtgagaaagataaaataaattcatagttagtttattctttcattcatttagcagaaaaaaaattttttttggatacctgttatgtaccagatactgtttgcagcccagcgaattgatcacagcaggcatactttgtgccctcatggagctgacattgtagcgtgtggcacttgtatgcaaattgcaagtgaagaagagaggaggtatccagcataactggggaacagcaagggtccattgtggctggaatggagaaataaccctgaagtcagggattgataaataaaactatgctaatattaagttcacttcctcagaagatgtcatttggtgaatgaaaaggcaagg

SEQ ID NO: 44778 - DNA, 1185 bp, Bovine  19866881249303
ctacacactcttatgaccccatttaatcttagttacttccttaaaggcctgtctccgaagacagtggcattgggagttagggcttccacataagaattcagggaacacagttcagtccataacagacacatagatctgatgacaggacactcattattatcattttagagatgggaagactaaggttggaacctctaagttacttgtgcatacagagagcatgagagatggaaaaggcttagtactcttcccgcaatcatacagtatggtggacaggacagttacccctgcctggcaaatacaatctgaaccacagcaacaaaacaacaagaacatcacctaaatcaacagaaaattaaccaggtaggttggatacctcctggaacacctctaaggctttattgaatttccaaaaggaacaggattaaactgcttgccgacttcagggaacacactctttcatgatgctgagcaagaatgtcccagaaattttctcaggacatcaaacacagctccaaatcttatagatagcctcccagggaacctttaataccttcacagaataaaccacgctatttgtgcctctgaaggatgaagggtgaagcaaccaccccagctgtgacttgaaactggggttctgatgcgtttgggttctggggaagcagggtatttcaaagccagctttgcctttagccttgtaaaccagcccctctggctgtgttcaaacacatgacttgctcactgcacagtgtaatgattatccaactttcaccagagggctatgcaagaacaaaagactgaatggtaaagaggatttttattattaggttgctgttcttatgaaacattcatatagcaaaggaattgctttgccgttaaaaaatttttgtgaaggaagctttatgaaaaatgtgcttacctggcctttaaagtaactatacatgtattcagaaaaaaaaaaatatatatatatatatatagaaaaagaaaacaaaaaggctgagtttagaaactcagttcagaaccatattttaaaatataagtaagggaaaatgtagacatctattggactagtttaaaactccacaggcatggatttgaacactaattatatgtcaagtagaatttattttattttagcacatgtgctattggtaatgactccccatttctcttctgccacag

SEQ ID NO: 44779 - DNA, 1620 bp, Bovine  19866881258515
atgtctctaggtcaattggtcatagtccatcctgttttaaaagtttgacactccagactgatctcgctggttaacataagcaatctttctacaacttgtaaacataaaatttgcctggaaatagactgtttgtttttcctttgtaaacgttaatcatttccaagttaacaacgtgaactttgaaattccggttcagtctggttagacatgaattaagttgactttaaatttttaaatgataagaaataatacaaatacaaaagaacgtaggcatactgttttatcagcatttaaaatggatttttgcaaatgtgtttattcccaaataaaacaagttgcaagggtttgatttaacggtatttaatagtttaatttagcaatctgttctatagctgctttatattggggaattacatacatagacaatttcagggccaaatgttttgcaatgtttttatatagttaaatggattcattaacaaaaagatatttatctttcttcttgagaatatgataatttagccaagggacttccctactggtccagtggttaagaatccaccttgcaatgcaggagctgcgggtttaatccttgctcagggaactaagattccatatgccttggaacaactaagtgcacacgcagcaactactgagccccagctctggagcacgtgtgccacaaatagagagtgtgtgtgttgcagctactgaagtccaaacctctggagcacacacaacacaaccaccgagcccatacaccacaactagagagtccaagagccgcaggattctgcatgacatgatgaagattccctgtgctgcaacaaagaccctactcggccaaatcaataaataaatcttttaaaagacaataataatttcgccagaccattatcaatccttttgatagttatttattggctgctgctgctgctgttcctggtaagtctcttcagtcgtgtccgactctgtgcaaccccagagacggcagcccaccaggctcccccatccctgggattctccaggcaagaacactggagtgggttgccatttccttctccaatgcatgaaagtgaaaagtgaaagtgaagtcgctcagtcgtgtccgactcttctcgaccccatggactgcagcctacgaggctcctccgtccatgggatttcccaggcaagagtactggagtaggggacctatgtatacggaacccccagctagggcctgaaaatcatccctctgtgtgtgtgtgtgtgcgagtgtgcactcagttgctcagttgtgtccagctctttgtgaccccatggactatagcccaccaggctcctctgtccatgagattttccaggcaagaatacaggagtaggctgacatttcctccttcaggggatcttcctgactgagggattgtacccgcatctcctgagactcctgcattggcaggcagattcttgaccactgagccgcctgggaagccctaatgatgaactgaaaatcaccatagacaagatcagtatgttccaaactcattacaaggaaaaaggagcttactgcagcagagacctttgctttcacacaagtctgctttttgccatttctcattttactatatcatggcttta

SEQ ID NO: 44780 - DNA, 927 bp, Bovine  19866881289567
atatatgtacattactaagtgcttaaaatcttaattataattgtacctgaacttttgctgaatacccagggacagcaaaagacatgtttaaacaggtatatcagtacataattaaatgacatctgtggcctgtgtattgcaatcttataaagctccaagtatgactggtttctattgcacaatttttagagcagtgattttttttaatgttgcacaaacatgataaggacacaaaagacttattttttcccccctctgaccactgaactttcatgagaatgttatgagaacttcatgtcttaccacaccagcccaacccttgtctgtattgcccaataaaggccagattttccgaatattatgttttagctgagcttgcagcaatcacaaatcagtcattaggaatcacatgcatataacaacgtttgtcttcatagtattttgaactaaatataagcaagcatatttaaaatggtaatatccaaagaatcatatctcaagacttccctggtcatccagtggttaagactcggccttacaatgcaggaggtgtgggttcaatccctggttggagaaataaggtcccacatgccatagagtgtggcgaaaaataaaaaagtgaatcagacctcagcaacttggttttatttgcacactccatagtgtctagtattagcaattaacttgcattgtccccccacagtccatctgggggtgaataagtcattctctaagaaaaagtttgtgggcaaaaaagaaaaaccttaattaccctctatgggaaattttttcttctgcttcaaattggacaaaagtggctcttagatataattttacataacctcagtggcatgttgaagtatgggaggcaaaagacatttatgcaattaccaagtctattgtttatgtgtgtaagcagaagataga

SEQ ID NO: 44781 - DNA, 1350 bp, Bovine  19866881291558
tttaaattataaaccatgagagaccccttttaataagacttcggtcctgcaataaaccagttcatcacatatctgaaaataaaaaccctggacaaacagtaaatatatcccaagtgttactgcataatgacacaagaaaccaagaaatttgagattctttctttgtcatttatctattaaagtaaccaccttatctttgttagacaacacaactcaagccacatcagatgggatacattgaaatgagaaggaggtccagctcagcggaataaaaccagcagaaatgagggaagaatgagatataaataaggacgttagtgatgtaaaacacgattaacagcaataacaaaaggatgcagtgacagaatttctcgaggttgacacttttctccagatgacagttttactttgtctctaatccttcataattttatatcagaaatactctttattttcatttaaatgatttctaaatttgttcaactgctaactatgggggtggggtgggaagaggacaaatcagggagtgagggatttaattgaatctaagtgcaaaagaagaaaatgttgtttatttgatgtcattttggagggcagaacaggaagaggaaatcttttttgtcacgctatttccagtgttttggcagagcgttgattatatattcatgctaatacttacatcaatatctacttcttcaggtctatatttgtataatgtgcctctgcattcatcctgtgacagctataaaagaaaatgtcacacaactttaaaaatgataaaaaatatacatttacttagtctatagttaatattttaatttaaagaacaataacagaaatgggttttttaatgattctatacttttaaaaagtttagttcaaacacagatcattacaaaaatagaaaattattgaacatcaatacaatcaatatgcaagatacgtaagaatgatgttaacttcagcttgtcagacaaaataagaagctggtcaaatgaaattatgcagaacctcatgttttccatttgcgagacacacattattttaatgaaaaaaactgacaaatacaatcagagcagctgtattgaatcaaatctcgaatcaggcattatttcagcagtcaaaaccgtgctttcaacggtatacacataaccacacaactgtgtatgtgtacattcagatgccaacacatctttgtacaattttattaacaaaacctagaacacattgtatacatatacgtaatatataaacacacatacacagtatagacttatcttgttcctctgtcttaagaactaaaagaatggaggaaaaggatgggtttaatcgaaaagaggaaaagcactc

SEQ ID NO: 44782 - DNA, 783 bp, Bovine  19866881326317
tgtaacttgttttaggatgagttggtatatatattacacaactactctaacatttttgttttgtgtattttttacatttgaaatgtgagcccaccagtaaatttttttagtaggataatgacaggctgaaacaaggaagaatcaccatagaagaatttagaacaatttatcgaattattacatacagagaagaaattattgagattttcaacacgtattctgaaaaccggaaaattcttttagaaaagaacctggtcgaatttttgatgcgagaacagtatacacttgacttcaataaaagtattgcttctgagatcattcagaaatatgagcctattgaagaaggtatgcttgtacttcaaagttttatcaaatatttatatgcaaactgttttttattaatagaagttttcaaattcaatcttgattgggccagctttcttctaggtaatattatatattgacagttataattttgtaacttacagacagtgtacataccttttagaaagctatgttgtgtaaccacgactttctttcattgtccagttccttccttttaactgtttctgtatctttcaagtgttcagagatgaacttaggcatggaaaacaagatgaggatcttattattataaataccataatggaagaaagggtcctgatattcattagtaagataaaaacccaggtgtaggcagttttccgtttttatatattattgacaaaatatagaatattaaattagctaaacgaaaacagttctagggaagagataaaacat

SEQ ID NO: 44783 - DNA, 2750 bp, Bovine  19866881499406
ttggtctttgtctttcctggtatctggcttctggtacttcatacatactggtaaattcagttaaacaagaaaaagttcacaaattattctatttctctattatcttgaatatccaaaaatgtggggagaggacttccctagtggttcagtggttaagactccatgcttccaatgcaagggacatgggtttgatccctggttgggagaagttcacatgagggaccatgcagccaaaaaataaaatgtggaaagaaaacaaaataaccatccaaaagtggtgttctaagttactactgtgttgcttttaaggaatagtataataagggatcaaatggaaaatgatgtggacctaatgaagacaagagtcattgaaaggctcagtgatttaaaaatagcttaaatattttctctgcagcaagttttatcatgtagatatatatattttaagtatacaaattaccccaggaaggctaatatattaaccaatcactaagagggggatttattcttttgtaatgtttagatgaaatgcttttctcctaataaacaattttttaaaaacctgttgtaatggaccattgctcttttattttcttgcttctttttttggtcattcataatactctttccatgatgattttttaatttaatttttaaaaatttatttatttttggctgtgctgggtctttgttgctgcgtgggctcttctctagttgcagtgagcagaggctactctttattgcattgcgaaggcttcttattgcagtggcttcttttgtttcagagcacgggcttgagggcaccgagcttcagtagttgtggcatgtgggctcgatagttgtggttcccgggctctagagcacaggctcaatagttgtggccaatgggctgagttgctctggggcatgtgggatcttcttggatcagggattgaacttgtgtctcctgcattggtgggcggattctttaccactgaaccaccagggaagtcccccatgatgatttaatattattttcatgttacttcatgcactgtgggagctagcgacttttaatttactacttatctcttttattatgctaagtaaacatggggtaaaatcatctttattatcaacatctataacactgatggctaaaagtcatggtactgatcaatccactcggggtcctaagacaggaggcaaaataaggaggagaggaaattgaacctggattacatgacctgggcgtgaagaaatgtggtctaggtttaaaacctactgctccctactatataccatgatgccttaggtgaatttcataacctctctaaggtttcagtttctttagagcagggataaatatgtctgtcctggccatctgccaggctgttaatcaaatgagataatgtatgtgaaggtatttgtaaactataaaacacttcacaaacataagattcttcttatttttgttatctggtaaaagatgcttataaatcacatccatagttgaagaaaatacctaagaaaaatgtcattgttctattgatggttactatgagctagaggtataagctataaagatagaatcaaagaaaaataatcatcctaaaatgaatattacttttgtgccatctttaagaacaaaactattctcagtatttattattatttataatgtataatttaagatgaatggaaaacacaaggcttgggagaaatatgagccatagtgtaaagtaacatggataacaaagctttcgtggtgaccacaatgtggtttgcttttatataaagtatttttgcttatttttaaaaataattttatttgtttattgaggctaccctgggtttttgttgcttccatgggatttctctcattgcagtgagcaagggctactctccagttgaggtgtttgggcttctcactgccaagacttctcttattgtggagcagtggctctagggcacacaggctcagtagttgtgacgaacttggcatgtgggatcttagctcccagatcagggatcgaaccttggtcctacacactccagggtggattcctaaccactgggccacgggggaaatctgcccacattgttaaaaggtagaatctttgaggctcccctgtttgattcccatcccatgccaccatctctcttgtccttatttggttggaatccccagagagaaggaagaacctagctgctagtaaatcccctgccccaggcagaaactttaacattgtatctgttctcttcttattctgttttcctccatgatcttaagccatgatatagtaaaatgagaaatggcaaaaagcagacttgtgtgaaagcaaaggtctctgctgcagtaagctcctttttccttgtaatgagtttggaacatactgatcttgtctatggtgattttcagttcatcattagggcttcccaggcggctcagtggtcaagaatctgcctgccaatgcaggagtctcaggagatgtgggtacaatccctcagtcaggaagatcccctgaaggaggaaatgtcagcctactcctgtattcttgcctggaaaatctcatggacagaggagcctggtgggctatagtccatggggtcacaaagagctggacacaactgagcaactgagtgcacactcgcacacacacacacacagagggatgattttcaggccctagctgggggttccgtatacataggtcccctactccagtactcttgcctgggaaatcccatggacggaggagcctcgtagg

SEQ ID NO: 44784 - DNA, 716 bp, Bovine  19866881511038
taagaaggcttctctggtagctcagtcaagaatctgcctgcagtgcaggagacccgagttcgatccctaggtggtgaagatcccctggagaaggaaatggtttcccactcgtatccttgcctggaaaatcctatggacagaggaccctggtgagctatagttcgtggagtcacaagattcggacacaacttagcaaataaaccaccaccaccacatcctaaggacgttgactggtgcgaattgagagaatcataggaaagtacaaagaatactgcactgaacaacaaaagcagaagtgtttactatgtacagaagccctgagctctacccacagcagaaatttgatcttgctgtgacatgtcatgaaagtccatgcaacaagttgtctatttccaacttaaacaggatactcacaaagacaaatgcctacctttttgtctcacttactgcaaatttctgttcacttgtccttccccttctcaaatcattctgactattattgacagccactgttcagaggtatgttgaatgttttgctgttgcaacaatttccatcattaggtgggagtttccaaccatgctgacagctggtatctaaacatcttttttagtcacagttgggtaacataatgtcttagagtcaaggtggtactttttatgcagtgccccagagaactctgtgatgaatgacgtgttcaaagcgtacagcacaaaca

SEQ ID NO: 44785 - DNA, 1129 bp, Bovine  19866881525091
tctattcctaatctcttactatccaataattatagtaattgtactgtcattgccaatcatttacgcataagaaagatggctcagtggtaaggaatctgcctgccagttcaggaggtacttgagatgcaggttcaatcctggattgggaagatcccctggaggaaggcatggcaacgcactccagtattcttgcctggaaaactccatggacagaggagtctggcaggctacagtccatggagtcacaaagaatcatcacgactgagcgactgagcacacaggcatgctagcacaggcataagaaagatccaaggattgttttaaaataggacagcaaagtttggatggaaaacattttagaatgtaatgacttcccctggccacccaagagctgtttatttacacagttgccacttctgcattcctcgttcatgaagcattatgtaactatgcagatattcacacccggcttgactcctattcctaactctcatatgttttttaatgtatttcctttgataagaaacaaataccagttatcatcttgtccatcagaaagtaccaaagcactattctcttacaaaatgaatacacaaatgaagtaatggatgtaaaagctctcccattctgataaaatctatacacctattctccaaatacattatgagccatcttccttctataacattatgtttgatcttcaattccactccctggaatgacctcttgaatcatgatctttacttcctgagtcatcctctttaacagttccacctattaatataaaaatattgtcatacttgaacaaccccaatctcgagaatttctaactctgctgaaatcctatatcacattttgtctttatcaatcatttgataatttatgtttcagtcttgtatatagacctgaatcttatgaatacttatggcctaatacatgtagcaaatactaatcaaaattttaactgtggtgatgtaagtggttctggtatttcctagatgtctaatcttaaattcccctgacctcaattttcacaaagtaaaatgggtataatgatggccaggtcctccatattatagtcaatacagggatatttctattgccactgctgatgatagtgacaaatgat

SEQ ID NO: 44786 - DNA, 1063 bp, Bovine  19866881929133
cttatttgtagaactcttttataaatgaaatcttatcagctcagttcagtcactcagtcgtgtctgactctttgccaccccatgaatcacagcacgccagggcctccctgtccattaccaactctcggagttcactcaaacttatgtccattgagtcagtgatgccatccagccaactcatcctctgttgtccccttctcctcctgcccccaatccctcccagcatcagagtttttccaatgagtcaacacttctcatgaggtggccaaagtattggagtttcagctttagcatcagtccttccaatgaacacacaggactgatctcctttaggatggactggttggatgtccttaaaatacatagttgtactgtgctgtgcttagtttctcagtcatgtctcactcctttgcgaccccatgggctgtagcctgccaggctcctctgtccatggggattctctaggcaagaatactggagtgggtaccatgccctcctccagggtatattcctaacccagggatcaaatccaggtcttccacattgcaagtggattctttaacatccgagccaccaggagaatactagttgtactggttgtagtttatttctataaatgttttacataaatccaagcttgtaacacttggaataaatttaatcaattaactaataaaaagctattttatgaagagaatagaaaaatgttagtaccttcatgaagcttaaacatttattggctgatgtgatgactgaatggatggatgaatttatttagagaagcttgaaatgttcaagaactagcacatggggaaaagtcaatagcaaaccactttactccaacacagaaaggagaaagctctgttaaaatgaccccagagtcagataatcaacattacccttccctaaccttcatctgttgcaaacttctaattcaatcacacatgaacaaagtattaacatttgacacaaatagaattaataacctcttttttccctttgtatgttcctatttaataaaaataatacaataaggaagaacacagctctcaaaaagaaaaca

SEQ ID NO: 44787 - DNA, 1001 bp, Bovine  19866882016451
ataattttggtatatatgatactgagcaaaaaagttccccagatcatttgctaaagataattatatgcaaatgacttagtaattcgattcataagaatgcacccaatagaaacatgtacatatttgcaccaaaagatatatactggttatttatagcagtgtagttttgtaaatagccccaaactggaaattatctaaatgcttgtcaagaacagaattgataaattgtggtatattcacacaatggagagctatacaaaaataggaataaaaaatatctgtgtaccactataagaataaattttataaataatgttgagcaaaacaaaccagtcataaaaaatacatattgtgtgagttcatttatgtaaaacgcaaaaactaaagaaaacttatctgcttctagaagccataccattgaatatacttggcagttgggggttggggtttggaggaaaactagaaagttggcaggcagcagtcttctggggtgctgtcatcttctgttctttgaccttggtgttggctacatggatggttcacttgtggaaattcatgaatctacgacacgtgtccttttcttgtatgtattttaattattaaaaaaatttttctaacaatagttccttgttggttattttaaatatagtagtcttgtatatgttttttaaacattaaaagaagagatgattaagtaatatttagtcttgaaagaactaaaaataaaaaccttagaaaaatttgtttccaaagaaacttagatcagtattaattctaaatgaatactttagaatcatgctctgctactatgtttaaagtgaaatgtaatttttatactatttatggtatttctgcattctttttattttttaaagttaaacaagcacaccagatgtcatttgaaggttttagaagatacatggattcatctgaatgtctgctatttgataataagtgtgatcatgtttaccaagatatgactcatccattgactgattatt

SEQ ID NO: 44788 - DNA, 1946 bp, Bovine  19866880168542
agtacatcacaagaaatgctgggctggaggaagcacaagctggaaccaagattgctgggagaaatatcaataacctcagatatgcaggtgacaccacccttatggcagaaagtgaagaactaaagagcctcttgatgaaagggaaagaagagagtgaaaaagttggcttaaagctcaacattcagaaaacgaagatcatggcatctggtcccatcacttcatggcaaacagatggggaaacagtgtcagactttatcttttggggctccaaaatcactgcagatggtgactgcagccatgaaattaaaagatgcttactccttggaagaaaagttatgaccaacctagatagcatattcaaaagcagagacattacttggcaacaaaggtccgtctagtcaaggctatggtttttcctgtggtcatgtatggatgcgagagttggactgtgaagaaagctgagcaccaaagaattgatactttagaactgtggtgttggaaaagactcttgagagtcccttggactgcaaggagatccaaccagtccattctaaaggagatcagctctgggtgttctttggaaggaataatgctaaagctgaaactccagtactttggccacctcacgtgaagagttgactgactggaaaagactctgatgctgggagggattgggggcaggaggagaagggggacaacggaggatgagatggctggatggcatcaccaacttgatggacatgagtttgagtgaactccgggagttggtgatggacacggaggcctggtgtgctgcagttcatgggatcgcaaagagtcagacacgactgagcaactgaactgaactgaactgagactcaatgtccttaactaccatgttatattatatatatcttgaatattctacttaaatattttctataaatcaagcctttaaaaattgcatttttcagttctaagaagcaataatttacatataaagatgtatagtctaacatacatgcatatacacccaacccctattttagaatagtgtaggccaccctccagtactgaaacttaagcatctcaaaaaagaaatgcttcatacatagcaagatgcaatttctacatggtatcagatacttcccagtatttcacaacaaatttggaggctcagagtcagatatcatgggaatattccatacatttaatgatccaacaatccttcacatacagtactttctgcatttgtaaaccttagagacctgctatgattaaggaaatccctccccattttctatctatacataaaaatcatttactgaggtaggctacttgcagataagctaattgaagctatcttcctattttcatataaacagtgaaaaatgagaacatttcaatagatttagtgcctcacttaacttttcagcataaaatatattcattaagcactcatttgtgtataatggctttgtcatatgctacactatcattggtttaatataaataccagattctgccaagtaaaaattgtgggatgtaactttaggagcttttcaactaagtctatttctggaagattttatgtgtcaattgaactcaaggttttatcatttgcaaatgattatgggtttcaaagtgataaggttctgatatcagaattgtcagttaccaagtccttgggatattataactaacccctaattgatacttcatttggaagtcttgttgcttctctggtgtttaacttgttcatacattaacttaagagacgtcttttaccctcaaatgtaatgactagttcagttgttttaaggatttttgtatgcttttttttttcctgataccttatttgaatcatttttccacacagtgtttgttctagtaaatttttctttgtttgtttgtttttaattactaaggaaaaaaaacatactcaagaacagacgaagcaaaaataa

SEQ ID NO: 44789 - DNA, 1730 bp, Bovine  19866880179732
tctaatgaggtgaatgaaactggagcctattatacagagtgaagtaagccagaaggaaaaacaccaatacagtatactaacgcatatatatggaatttagaaagatggtaacaataaccctgtgtacgagacagcaaaagagacactgatgtatagaacagtcttatggactctgtgggagagggagagggtgggaagatttgggagaatggcattgaaacatgtaaaatatcatgtatgaaacgagatgccagtccaggttcgatgcacgatactggatgcttggggctggtgcactgggacgacccagagggatggtatggggagggaggagggagggagagttcacgatggggaacacatgtatacctgtggcagattcattttgatatttggcaaaactaatacaattatgtaaagcttaaaaataaaataaaatttaaatttaaaaaacaaaaacaaacaaacaaaaaaaactaagcatccatactgcttacactgaaatccgcgaaagaatttgtaaccagagcaaaagccctctagtggaagatctgtttgtaactctattacatagtatgtgactattaactagagggattctaaatagttcttttaggaaccttttaatgtttttttttttttaattgctgagttccaaataatacttggtgggtagtctaaatatttaatgttaacataacaaaaaagaacaccgcttttattgttaaacaacacataccaactacatagaagggaacaacagaacaactgtatctgaatttccattttagaaaactatcactaaatgtgtaaacgtgccattctcacttaacttatagctgaaccagataacgtgaaagaacttagaggaaaacagcaaagaaaagctgaacttctgttttatcctttacatgggctcctattctatgcacagcagggtgatcatagttcataaagcaggaccaaaagcttactagggtttaaatatagcctgtgacctcagggaatttctggattttagttcttgttctgccagctcctgttagttctttgtcaattaccagagcttcaaattccttatctgaaattggaagggctattgcatgtaataataatacccattgctatattgagtacttgctatgtgccacacattgtgctaagcactttatatgtattatttcatttaatcttcacaacaacccatatgttagagatgtgacccaactgattctaccattagaatgttggtctgccggacagcaaatctatatacctgaaaacaatataaatcttaaaaaccaaatctaggtctaaaattttatgagaaattggccttggactaactaatgtcaattacacattgaattctctgtttctgatgaaaaccaccaatgagttaattaaccatactgttcctgggtcatttgatttaattctggtccttaggtttagtctcctccctcattcctctttctgtggctgcctattttgctttctcttattaagaaattttcattttcactgcatttaaactgtcagtattatcctttatctggttttatgtttagcaagttaaactatcctcataattttatcaaatttctagaaaagtcctgttggtatttgatctgcattgcattttaacatacactgtagtttgaagaaatttgacatctatagctattctttaaatattcagtctcatggcacaggagtgcaatatatct

SEQ ID NO: 44790 - DNA, 1312 bp, Bovine  19866880451790
tgtgataaatttatgcatgatgctaatatttgcccagttttctggaggtaggattagccatttgaattatagtttaatttatattaatatatatttttatgtataatgccatacattttatttgatgatttattcctcttttcttgggacaatttaaaagtatcctaggttaggaaatagtttgcttttttggtagctagcattttgagcctggattgtggatcatttgagtattatccttggttcctcacgaataatatgttaatattaactctgatttcttcctgctcaaattgtactatttatcattaaaaatccatatcaagctgcactccagtgaaatcttttctgtcaacaacaaattctaagtgggagctctttttccttaaattcctatttctttaaacgtaggttaataattaattgtttcttaatatctaaatatttatatgtactagtcttcaccactatacctaattataaatttcttaaggtgaggtaattttatttcatatcacttacccttagtacctagcttagggctaaaagaatataaagagcttaaaaatgcttattttatttaaaaaaaagagtgatttatactttcataacacacacatacatatctattactttcagctctagtggacacagctttcaaaaatcctcttgtatagggatatgtgcaattgaacttttaatttcccaaagtggaatttaatatccacatacacacaaccggccagattccttgcaaaaccatcagttacttccaaaacatagtggttcctgctggttttatagtaaattttatcctagtgcaggacaacttgctgcaacatctataactgggtgaactacagaggctactcaaggtcaagcctaattatccacatttgcacccacctgtgtgctgtgctcagagactctttgtgaccccatagactctagtccatcagccttccctgtccatggagtctcccaggcaagaatactggagtggataaccatttctttctccaggggaatcttcctgacccagggattgaacacatgtctcctgcattggcaggcagattctttaccactgccccataggggaagcctggcagatgtgaaagtctttaagatgagcatttgttcattaatggaggggcatgctgttctctgcagaattcggcaaaactccagctgaaatataagggtattcattttaaagtcaagttcccaggtcattaagcactttgagaatcgatagtctctgtagtggagaaggcaatggcaccccactccagtattcttgcctggaaaa

SEQ ID NO: 44791 - DNA, 1066 bp, Bovine  19866880477558
cataagatggtgttaagccagtggctagaatgtggtctactaacatctcactaatttatgtacttattattctttcttttttaatttcctgttttgtttgcccttaattcccatggttccatttcatcttcattactttttggtggactacttgattttccaagttaaaagaacagagaccaacttggaaaatttgggcaaattaatcacttcagatatgattcattttccttattaagaaaatcacagtgaaaatatttgcctgaagagttatgggatataaaagcatatctacaaagtactgtgtatggtagctcctcaatcacttcttattaattttgaaaaacgtcctaaacaactgctgctgaattcttaaggaggaaatgataggcctcccctctttgtttggggcactggttgtagagatctggcaaagtaggaataagtcagagaaatgagatgagttagtagagatccacttcccatgttcctaggagctcacgtaatcagattcagtgattggccatgaattttattttttgaaatagtataatttttgtgttaactttgggatgttcttgatttactagctctgtgatgttaagtaaattcttcaatacttgtggaccctagaaaattttaataaaaatgttagttaccttatgggcttggtaggtagggtaaatgagaaatgtgtgtaattcacatataactgtacataatatcccatatgtcatatgcatggcagcctgattgtgtcatgtctaccacataacaaatgctattattattatggtttcccagaatacatatctgagatcccaaaaggatgttttatttcagcgtttttccctcacctccccattcctcaaagagaacaatgactacagaacatcagttgggtaaatagtgcattatcataattacaatttccctgagaaaagtggcttgcagtttgaatattcagtgtcacaattgcaatttccataaggaatgtagaacagttattataaacaacacaatgaccacttggtccataagggagaacagattatcgggggaggag

SEQ ID NO: 44792 - DNA, 1221 bp, Bovine  19866880483475
ttgtatctcagtggaaggatttgggggtagtcattcatttattcattttttgccatttttcaattattacaccatgtatttcttatgtttttaaagaagaaacaaacagaaatgcaaagtaagctgaccaaaagacaattagtaaggttcatttatttttgtaatttgtacaactgaacaatatttttatatgttcaggaaatgtctcagaggttcccagggaaaataaaagagcttataggattcatacaagtcaagtagagatacacttacaaaggcattgccagtggtgagaaagtttttataaaaaaataataaaatagtctaatcaatgtaaagtctgaaaattattctcaataagaaagagtggatgaaattaggggtgtctgtgttcagtgaagtcagatacaattaacacagtgttaaatacagcaagttatcagtctaattttcacagtcacagaatttctgagaagttatttgcttgtaaaaaatgtccaataatatgtgacttgaatagtaaatggtttactcatttaataaaaatgaataatttacttttcatcaaggaaaataaatcagtgggataatatgttcctttctcctttgttgttagagaagagaattttatagaaagcatgttaactaaaaatgtgtgatgcaaatggacaaaatcaatgtccaatacctttgtaagggctctgtcttggctatgtttctcaatggtcaatgactaggcttgcatcagaaataacctgatcaatttgacctctgaccaccaaatcaagctctttggagtcacagaggagtctgaatttttaataagtgcccaaggtaaatttgacgttcatgaggtttgagaacattaaggtgaactccatcaatcattagcaaagatttcacatttctgtttaaaagcaaaaagcttctttatttaactgaacattgttttaatggtaaactttctgacgaggatggactaatatagcacaaaaggccaatgagtttataattctgtgcgtatatatggactttttgagatatgccctcgaggtcattttcattcaaattatttcatatattctgaattaatatgtgaactgggaaagccttaaaatacctggtcctcaatttgcataactgatagaaataaaatattctttaatcactgaggcatatgtaagtagggtttcagctgactaattttactttaatgtgatt

SEQ ID NO: 44793 - DNA, 2138 bp, Bovine  19866880506504
gattgaatctgggtctcctgcattgccaacagactctttaccaactgagcccaatagtgaagcctgttgatattctaagttcttcttaaattgactcacatctagttaaataatatggtttgccatctttccctaacttggaatccttcactccgttccttttggtcttcctggtgtccttttatgctcacgagctttccactacttataaaggctccccacttcttctttcaagccatacttccgggagtatacttctctgtgaagccttgctaatttcacttgagtttataccacttaattttttcatcaagtacacctttcctctttacagcttcctccatttctgaatttgtttctcagctaagtgataaactgagttaggatactgaaaatggaatttttttcccccttaactatttctagcatctaggccatattagatgcataatttgtgaaaaacattaatgttttatcatttccatgatgtaactaaatgcattttctttaggaaaaaatacagtaaaaatccagaagcaaaagaacaatgagactagaaacgagtgaaagaacactttacaaacaaccacattaaaactgtctcactgtaaatatgacacattagggacttattttttctcttcccagtttataagccttatgtactgcactggtaacttctatgcttcttttgaaataggcctcttgtgaaatattatgccataccatgtctcatatattataaaaagttttgttttcctaccaatattactatatatttgaaaattgcaatgtaagtatatgtaaattaaaaatactagtgagaatgggacagccatttggaaatctaacatgttttaaatgttaaaaaaaaatactatggagacgaaatacataagtatacaggaaaatatgggtaagaaatggaagaaataaattttttttacattattctatctagaacattttcttagctttttaaactcaagtaagaattatacagagtgaagtaagccagaaagaaaaacaccaatacagtatactaactatatatggaatttagaaagatggtaacaataaccctgtatgtgagacagcaaaagagacactgatgtatagaacagccttttggactctgcgggagagggagagtgtaagacgatttgggggaatggtactggaacatgtataatatcatgtaaaaaatgaatagccagtccaggttcaatacaggatgcttggggcctgtgcactgggatgacccggagggatggtatgtggagggaggtgggagggtggttcaggatggggaacacatgtatgcccgtggtggattcatgttgatgtgtggcagaaccaataaaatattgtaaagtaattagcctccaattaaaataaataaatttaaatttaaaaaataaaataaacctttaacatataaataaaataaaataaatcagaagaaaactttgacagcctagcaaacaaactgatccaaaaaatatctacattaaagacatgtttcaagtttaaattatttcaaatccaacttcagcattaaagaaaatatcaatgaaagaactgtaatcactgagtgggaaacagaaacttctaaatgtaagtacccagcacctaggaaaattatggatatgatttcctacactacttcaagacagacctacattttaacattaaataattcaacattttataaaagcagtaaatataaatataggtttataaatacaaacgttttgggtgccttctagcattttagttcacgtcactaattttaatcttttactacaaaaattttgaagttttcttaagaatttactctgtgtatgtgaacatttcaagggtatcagtggagtgtctaagggataactgaaatgtctagaatttagtgaaatatgcacctttgctttcatgttgatgaaaatgggaacccactctagtattcttacctggagaatcccatggatggaggagcctggtgggctatagtgcacagggttgcaaagattcggacacgactgagtgacttcactcactcactcactcagattagttaaccatgttagtgctcattatatagttctgagacatgtatattctatcttgggaaatgtatttta

SEQ ID NO: 44794 - DNA, 1610 bp, Bovine  19866880535837
tctggcttaaatgatgcttccatttattaatccgtcattattggcattttacagaaaccattaaatttcaatcatgggagactacacacacatgtatatacacacataggcccatacacgcaagcacacgcacacagaatgctttttaagctggtgagactgctgtattattcaaggtgtggtaactgtgtggtgtacaatggcctacaacgaaatgtgctaaggaaggtctgaagagaatgtggagcagatagctggtgacctcgtgcacattctcctgaaagtcaatttcattttattacagcggaaataagctgctgtgaaaagaacatcaaagtttacatgactgattatttcctcaattttgctctctcaagtaaaatgtggtgtgggagagtggtgtgggagaaaacaaacacaaataccatgttcgttgcccttctaccctctttccatcctcatactgaaaattcaggaagacacttatggtcaaaagagtcaaactcaagatttcatccaaaggaacttttctgggaaaagttagaaaaaaaaaaaaactatgaatacaaactcatatagggatatatgcacatttgaaacatggagaaatcgaaaaggaaaatgatttaaaatggtgaggcaatatttagaatttatagaatcaggaaccacaaaagaacttatcttaaaataaagtttgttctgttaaaaactgatatgttaattatatatgcattcattttttaaaatttatagtcatagaataatttcattaataatttcatttatcaaggttcctttttagcctgggcagcaaagaattcaacactaaatttcttgctaaatcacagccattattggtctatgtttctgaatacttcttttctcattttgtatattttcttctttaactgtcttttggtctatggtttaggtaataatctaacttaagtcttttggaaaagcaattggggcaagaataacaaataaacaagaaatgaaaaacaagtagatttatacatatcttcccaggtaattctgcttctcaaatcatgtatatatgtatgattttattctatctttgtgaaaacaatatacctgattataccactctattctgtctgatgtgtggtatgtagcaatcttttcaatcttttcacatgcaaagaaagacatgcaaatatgtcacttcttttaatgaagacaaatgttgcttgcatagatcatttatatcacagcacacccagggtttatctagcattttacgtactaatgcttattgtagcttaagtaaattaacacagttgtctctaaagttaccattctatcattacaatgatgaaatgaatgcaaagcaattctatagtgcaataatcagttttttctaatttttacttagtacattggtaatatgttgtgtttttttttttctaagtaagatacagtgattactgagtgttaagtgtgtgattgcctatttcctacatttgcaaagaacaaatggagtacttaaactctcatgctccactgactcttgatttcagaacaaaattaaggataactataaatgtatgtcagtgtctggccttcaatatcaaagctcacgcata

SEQ ID NO: 44795 - DNA, 3926 bp, Bovine  19866880545522
aaccctagttgacaaatacagtgtgttcatatgtgacagactagttatatcatggtgataatgatagtaataatagcttatcatatgtcagataatatgtcaaacctcatgtatacattatctgattaacaccttcttaaaacacacttggggatagtttttattatacaggtcaaacaggaaacttgccatctctaaacagtgaactcctgtcatcccactgtagtttggttccatgcaaccgtctgcaaagagcttaactcctctgagctttagtttcactgtccattaagtggtgaggatatgtctgctgccctcttcagaggattatttgcaggacttaactaaaatgacttaaagaaatccattatttgcagtctggtcatgaatatcagcatcactatcaaattttggtgacttttttctatactcactcaaatcactgacttttcacaagacatcttgacaccattgtcaattttttcctttggaattttcctatgtgtgtttttcttctgactactgacttgtcattcaaaaaaggatttgaacataaggcttttaaatgatgttcttttcagatggtgggggaagtttggtttcctaatgatttcattgaatttacacctgaaggatattaatagaaatattgtgaaagcttatttttattgactagttaaagggactaaaccatgaaagaaacttctaagtcttagtattaatcttattcctattgagcaccataccattttctccctcttgctttctgtttttttctaacaaagtctggctgtccctcttttcccatgtaatgatagatttagaaaaaaaggtacttcaggcggacctttatttcagcaggtttcctaactatagagtcaagatttcagtttctggcaaacgtctgaattgtaatcagaaagcttaacaataagaaataactttgaaagatgttaaaacaataatgaagattaaaaagtaaaaaaatcacacacacacacacacacacattgtaattaaccctgttttcctccagaacttaattttatttagctcacttaattttgatacatttgctgattgatttttgccaaataaatgtgaataaacttctcactatgcatattttgactcccattattatgtatatgaaaatattaatatttaagtgttctcagttattatataaatataaaaaaggagttcaagtgtttgtattcatcacggttatcatattgcattatttaacttttatattgcttctttcctactgtcccaatcaaaatctttttctaaatattaactataggaaagccacaaaatagaataagaaaaaaaaaaaaataggtcatataacaggagcaccaagagccctttttagcacaaaatgtttgacagttccatttttgagattaccagtaaggattaaaaaaaaaatgtgagagatgggatatgctgttatcacatttgatgttctcataattgtaaagctattggaacattcaaaaaatttaaatctttcatcatgtttaacatgttaatccgtttcttaatgtcagttgctgaaaatgtctcctaggaattttgaggtcataatatttagtatatcctcttttgtacttttttttttttttgcatttaatcttgggaaaatgtacttaaaaaaaaataaaactaaaaaccagatttggagaggtggtcatcccctcaaacttcttgaattcatatggctggactaataataagacttaacacaagacacattaatgggaaaagaaaaacaaattttaattcatgcattgaaacatgtctcataaaaatgggacctaaagaagtggccaaatcaggcagttcttatactttttagacaaagaaatgatgcatttgtgaggaatcgacaggacagaaacctagggttcagatgcttaattggtgaagaatataaagagtttggccttggggtagtaagttaaagaagtatcgaggtttcttcatatatattgtaaagtaaaaaaagaaacaagaattctagactcaaattccttgtctttggtgatacaagtgtccttctacctcagatgcaaagaatgtacctttcatatgagaaatgtatttcctgatttcagggagacaaagaggagggtcagagtgttcttcttgcactagccatttctaaattaacttgaattcaaaataagcaatgtgccattgaggcacattttggtgtggccagccctcggccctgataccagtagtgatgagtatcattctcttggatttttgtcacaatttctcttaaagaaagataattttaaagcaatggtagaattctttaccaaaatcaaagccagtatcaaatctcagattgcagaaaacagagaacattcccctttaaatgaacctcattgttatcgtgatgaatttattcagcagacaatagctctattagcaaggcaatctgaactaatctgaaattgaatcacccctcgaacaaacattgggaaaattgaagcaatttgagattaaacttataaatatcacgctgtaaactttaaattgaattcaaagcaaattgaagtctttgtcttacctttattgttttacctttttaaccctttgttacaaggagcaaagttacaggaagatttttttccttattttagtgtgtgaaactgtacactggaataccaaatacaaatatatggagtaaaaggtatctgtattttttaacaattaaaattatttccttctcctttaataaagaaaatattttttttttcatattcagcatgaaattgtttatagcttgtgacagaacggaagagacataagcccttgacctcaaagttttgaatcactgtgtcagtcaaaatcaattaaagaagatacagaaaagtaggcatttatctgatggacccttctggcttgcattagtcatttagagtctctttctaagagactcattagcttgtctatttgcaaatgactgctgctatctgggcatactgcctttaggttccattttgctgcaggatagtgttctcttgaaagacagccatgttgatcagcataaagtaatgtaataggagttgaaagttgtatgtgggccaaaaattattcaaagaaaaggcatgcttcagtaacctatttaaaaagctggcatcttcagagacctaaatatatttttctccccaaatcttcacattgcccagtaagaactattgtattccggtcagtcctccacttctctttgccccccaaatatttctacatctttgtaaaatcacgggtacctgtgtgtggatctactctataccatgtcagatttttgtccatgtagcatacactgtattgtcttctcctgctgccatcttgctgatgtctgaaagcagaaggaatagatttgttcacaccaagaaatatgtttagtgatagctagtgatgggctaataaagtattcttgtgcagtcagtggatgaagctagagactcaggggcttttaaatcttgcagaggagtttgggcttttaggaggaaccccgtgaaccagaggaatgtcatgttgagaattatcttttagggaaaatccctctgccagtaatgtggggaatagtttggaaagaaataaactaaaggcaaataaaccacatataggaaagttgtaattaggtgtgagagaagtaattagggtttaaactaaagctatagcaatgaaaatggagaataaataatattgttgagaagtatctttacatttgtaaagctaagttaaggatattaggcaggggatgagatgggagaacagagtaggtccctggttctttacttagcttaggatgctatggggaaaacaggcttagttagagaaaggtttcattggggcaggaggtttaaacaactagagaaaatactgggaactcaggaagt

SEQ ID NO: 44796 - DNA, 1873 bp, Bovine  19866880587447
atctttatctttgctgagaataactactttgtaaggacagtatatatgcccacaccatgttggattaaaacacccttgctcccatcagagctctggtccccgtgtctgtctttctttctctttctctttttcaggctgatcccctggaacgcagaggctctctgagttcactttcctgccccaggtttctaagaccgtcttgagaaggtgctgtgcgccttcacccccattcaagagggcgctcaaggccttcgtgaacagagcaagccctgtgcaggggctttattggctttctgtgtaaaccaaggaatatcagcttctttctctcctttactttcttatcgtcaactcccgaccaccaagttctagtccattaaaagacctcaacacaccacttccatgtaggatgtagttgccacccagaaattatagcaaaataatctaaagtctttattaaatcatttgtaaaagcacatgaacacagttggtgtccctgagcatttgaaaaattaaattattctttacaattagtctattgagctagaagaaaataaagaacactcatgaaagagggaaaaagtgacaaaaattccaatgacgaatggtttttaattataattgcataatagtctcttgatacaagtgccacttagtgctttgaggatttctgccactgatccattagtccccttcatacatgttcaggcacccagagtggagcacagaagaatatcagaatattatttaactgcactcaagtgccttgaattacatcaatttaatggcatgcctaaccatcctactgttagcaaaagctgggagaatgagaaatgataaagtcacttctaactaacattctagtgaatattctagttttatgctgggatagaaaagaagtagaatataacataggtaacatttactttatggtaatattttactttttaaagtttctgaggattatgaatgatgctgctacaaacatttgagtactagtttttatgtcaacataaattttcatttctctggatcgaacctggatctactgtattgtaggcagattctttaccatctgtgccaccagggaagcccataataaattcttagacattggattgttggatcacatggtaattgtatgtgttgagaaagtctgactgaaaaatccccatgacatacttttgtctgtgatggtagttgtatttgttgcatgtgttaatattcatagaactatgtgtacacttggaatccacaatttttaatggagaattatttaaatttttaattataaaagtatgtaagacaagtgaggcaataatgtattgaaaattttatactgaacaattttttgccaccagagatcataaccatgagagggcagagtagagtagctttgcttttaatcaacagagtaagtcagattaggcattttcacaaataatatgcaatttcacagcaataatcacaaaacttgagctgttttagtaccttttctattttcaagaggagctgtcatttagatgatgagcccaacttccaaaaatatgctaggatgagagaggagatgtgaagaaatcttgatcttttagttttcattcattcattacttccgttaacaaatatacattggatccaactacagagcacaaactgagtgtttgggattcaatggtgagcgaactgaactctgaagaagtccaataatcacaatagaataagccaaataatcacacaaatatttaagtagaaattgtgttagccattttcaagggaaaagaaaagaacccctccactacctccgccaaaagacatcagggatatttcaggggaatatatttttttctgaagttcagagaaggcttcctcagggaag

SEQ ID NO: 44797 - DNA, 1342 bp, Bovine  19866880611125
tttggggtttggtagaggatacagtcaacagaagggcttccctggtggctcagactgtaaagaatctgcctgcagttcaggagacctgggttcactccctgggttgggagattcccctggagaagggaatagcgacccactccaatattcttgcctggggaattccatggacagaggagcctggcgggctacagtcactggggtctcagagtcgtacatgactgagcgactaacactttcacagaaacagaattactgactttcaagggcatctagcatatgaaaatttgcattctgtgatccgcctctctctccctagtgtctcagaacaatctgaaattagcaagccttgacaacagctaatgaatatgaacagacttacacagattccccttttacagtattggattcagtctcttacaagacaggcaaatcagcccaagtaacctcttttttggatggatgaaaaaatttcctagccttgagcagttgtgtactcagaagagagtcagctgaaaaagttgggcctatagtaatgataataatatagtaagtcctttatatacatacaaacgagttctgtcctgagagcatgttcgttaagtccaatgaacttaggtatgcaactaacacaattagctatatagtactgtactctaataggtttgtaatttcacacaaataataaataaaaaatcaaacaccaaaaataaagaaaacatttttaactttacagtcgcttgaaaagttcactggtaaagtacaacagcgggcatccagggtctggcatcaagagaacaggtaagaagagttactgactagaggagggagaggaggtgggaaatggtagagctgaaggatcatcagcaataggagatggagggcaagctgcaacttcatgcatgcctgacgttgatggcacagggtctggttccttgctggaaccagatgcacgttcacagcagacttactgtacgtaggatccatagagtgtgtacttttgtaccagacatgtcttcttcacatcagtccagtggcatgggcatcaccaccaccaccaccttggtcagcatcttcctcaacttataaattaggaaactaacaggcagagaagttacattttctaccagtggcccgtgtccctgctccagggatatggttccccctgctgtatctctctcctgtccaggtatgaactgcaaggctcctttttgaattccaagttgcttcactgaagggttctcatcctgaaacccatgggaaaaggtttggttacatttcatcacacattgctatagtatctggtaactattctttccaggcatgactgagcagttaaaaa

SEQ ID NO: 44798 - DNA, 5971 bp, Bovine  19866880658793
ttagtatataaacaattacaatgtgatgggatgaatgtaatgatagaggcttgcaccaaattgcttgaggtatagaggaaggaatggtcaatatttttattgcttgaggtaagggacttaggagtttgacttaaggatgatacttagggcagttttaaaaaaattcttgggcttccctggttgctcagcagtaaagaatccacctgccaatacaggagatgcaggttcaatctctggatcaggaatattccctggaggaagaaatggcaacccactccagtattcttgcctggaaaatctcatacacagaggaatctggtgggctacagttcttggggtctcaaagagttggacacgacttagtgattgaataacaatgacctttccatgaaaaaagagcgaaagggcgtggaagatgcatagtgcaaaaccagacagatgtcaaagacgtgcccatctagcttttggtatgtagttgacagggacatgacagccacaaaacctgactaaaaatttaggaggctcatttgccttgctagtggtgattacctggaacctagagagggcttataaggccagaaatgcctttcagtcagtcctgagattaaattaatctcaataagacaaggtaccagcgcactggtttaaaatgaagtattggtacgacagtggggcgaagtgttggctataacaacaaagtgtcggatgtaacatgggttggttcagtcgctaagtcgtgtctgatactttgcaactccacagactgcagcacgccaggctttcttatccttcactgtctcccaaactcatgtctattgagtcagtggtgtcatccaaccatctcatcctctgtcacctggttctcctcctgccctcaatctttccagcatcagggtcttttctagtgagttggcttttcacatcaggtagccaaaatattggagcttcagtagtagtccactcaatgaatattcagggttgatttcccttaagattgactggtgtgatctccttgttatccaagggactcacatgagtcttctctagccccacaaatcgaaagcatcagttctttggtactcagccttctttatgtcccaactctcacatgcagacatggctactggaaaaaccatagctttctctatacaaagctttgtatacaaagctatacaaagctttgacctttgtgggcaaatagatgaatgctaggaaatatataaataattactgtaaatactgggtcaagccaaagggacttttacagaagacatgtttaaaaactgaagtagggatttggaacctttgaattcaatcctgcctatatcttttgatttgaataactactatactaaggtcattttcagtttcatgatttaaaaaaataaagtataatcatcgtttacaaaagaaaaatgtcaggattagagtatagtgtgtttaactattgggataaattctttctgttagtatctcaggccagagggaggtactcaaaatcatttgatactcaaatcattctttctagctattctccagtttttaatcacttgaccacctaattgcataacttatatcagagaatatgtgttttgccacccttattcaaaggcatctccctgtaacagctttaattaaaatttaagtttttttttttttttcctgttgggcttccctggtggctcaaaggttaaagcgtctgcctggaatgtgagagacctgggttcgatccctgggtctggaagatcccctggagaaggaaatggcaacccattccagcactcttccctggagaatcctatggagggaggagcctggtaggctacagtccatggggtcacaaagagtcggacactactgagtgacttcactttcactttagtttctgtgtttttaaaataataaacactgatctgctaaataaatagaaccagctttctataatataagcatcttcctatattcaagttataaaaacttatagatttttataattaatatattaatagtttcataaatcattaatagtttattaacttcaaatcatattgctgagaacacagaatatagactcatgactgtagaattatgtcagtaacagtaagattgtctcataaaggtatctggcaaaatgaataaggatgtaaagaaaagtttcaggaaaataaattaaaacaacctcaagatccctaagcaatatccttttttaataagaactatgtaaaaagcctaaagaatgacctataaaaattgaatctagacttagattataactctatcattagtagattactttgtaagaagtggagatttttagggaaggtttgacaggagcacagatgtgcaagaagacacaatccacgggatgtagaacaagttcaggaaaggccagggtacttgggtttcatgagtccctttccgcctacctttacatcatttccaaggctataatgatgccccagtgttctgggaactgagcagcatcactcagagaggctgtcatgagtccccaggcccgtttcttacaagggactacacctctcctttcctgagcagcacatatgttcagggatcagccgttctagaaaaggacaggaaaaactgactcaccatgcccaagcactggcaacagtgaaagagagtgaaataagtcagagaacatacactatagaatctggatacctaccatctgctcccagctctgctcgctgttggcaagccattcagtccctctacatctctacttcctggtttgttcagatatgacttgaagttagactattttatgggtccttctagactaaaattattttatgggtgagtaaatcataaactttatctgagaagagtctatttctctctagtctgcactctacttcctaatctctactagatttttctttcaaaattcttcagatggtgcttaggctaaactagtacaatttaaaggaattcattttggaaaggtatttgaatatgttgtggtccttcagcaagcatatgactgtggttcaggagttgattcatccaatgcaggttgaaccctctctgtgtgggtggtcagctccatcacctagacatgcctttctctatgcaaaaacatcccagccatgaccacatccctctcttcttcctgctttccatttcccccctccatttcccacttttctctcttctccattggtctctctaccacctctctgaggtggtggtgataagatacagagactttgcacggctggctgaaatgcctatcaccactggtggggggtgaatcctgctatgttgccccttttgcagaagaagtcattgaaatgaaccatcccctacaactgtatggttaccagcttttcatcttctttgttagaaaaagcagtgattacagagaaagagagactgagcacagcaagcttaggtttggagcagaaagcacaaggttcaaatcctgggtttgctccttattatctaaataatgtagggaggtttactttgaattctgagcccaggtgtctcctttttggtaacttttagtatcatgatatctacttaataggttcatcaataggcgaggtatagagtatctggttcacagctacacattagaacaagattgaaattctcccacatgcaacttacgtatgataaaggagactttctaatgcatctgaaacggctgagttggtgatctgtgaatttttccagggcagcagctttccctattttttttttttttccttcagtctcagtcccttcccaaggtatttgtttaataaatgtagagtgaataagtgaattgttgaacaacactgttcaatactttttcaaaatcttataaaaggaacacaattttttgcagaagaagctagaattgatccatgattcacattgtcttcaggggcttagttattaagttacacacaataatacctctgtcctggtattagagaaggaaactgaaggttcaacacaaacattgtcaacagagtgtttgccaagatgagtcaatatctccaagacattaaaagaccaaatgagtgtgtctaagaaagcaaaaaaagcagatcaacaggacttggcatatatacgttccttttatacttttatctgcaaatctatatcaaaatagaggttaccaggattgtgagctcgagggttgttttgtgttttttttaaagatatctagtcatattttcttttctgaggaggagggtagcaataattttctgaaaagcatctacatccttgttggttatattattagcaggtttaaaacaacttaaggagatcagaaccaaatgtggaagatgaattatgtgggaaagtgggctttaaggtttttgatgtactctagtcctcaagacggagaaggcaatggcactccactccagtactcttgcctggaaaatcccatggatggaggagcctggaaggctgcagtccatggggtcgctgagggtcagacacgactgagcgacttcactttcacttttcactttcatgcattggagaaggaaatggcaacccactccagtgttcttgcctggagaatcccagggacgggggagcctggtaggctgccgtctatggggttgcacagagttggacacgactgaagtgacttagcagtagcagcagtcctgaagaactgtattggaactttgacaatggtagagatttttgtttgtgtgtgtgtttgtttttaactcagaaatactgtatcagaattttattcctgagagtcatcaaatttcttgtatctgctaaaaagcaatcatgacagaaatgaaaggggatgaaacaacctccctttttttttttcaggtgttttaatcattcttcaatacatttgaattgtgaaagagttgtatagatataaataaggtttctttagatctagtcagctttccaaacaagtgaaaccatcacatattatcccaagtctatattgtataatttcatggacagcaaagtcccacctgcccaaagatgcttgatccatattctttcctttttaaaaattctttcttttgtgcatttatagattcgtgtatttattcaactgattcattcgatatgtatttgtattgagctctttctaagttaagcactgttagaagcaccaagtttatggtggtaagaatattaccatggttgctgatttcctcaggtttgtgtgtttatgagaaaataatcaaataagtacacagataattacaatttcactgaacaatgatagctcacatttattgggtacttaatgtgggcaatgttataataattattgggcactattctcagtgtttgcatgtattaactcagttctcatgactcactttaggtagataatattgcatctcattttataaataaagaaagtggagcatagaaaaaataagcagcttctccagtgtcatgcagactagcaactatgcattcaggattcagtcaaagagtctgggtataaatcttgtactcaaacccactacttattctgagaaatgacagggaagaagacttgaggaagccataatagagtatgaaagttttcccatttagcataaggcatacatttggaaatgacatttaagctgacctaaaaagcaaatggctagttagagtggggagaggacagctctaacagaggaacaggccatgtgcaggctttgcaactgcaaggggccaaactttcagcacagatatagcctggtgagtgctgaagttagactggagggttcaactgtggctagaaagataagaagacagagggcaggaggcaaagagagagactggaagaaaatgaaaaatataaaatctccaaagtgcaaagggaagtcatttatggagagatgtgatccagttgatcttttaagataattctgattgtgatatagagattacattgggagggcaagaggataagtaggaaaactgattaggaagccctgagagtaatccgagagatagataataa

SEQ ID NO: 44799 - DNA, 1577 bp, Bovine  19866880675352
tggggaattactggagctttttaaggaggggaataaaataatcagattgacaccttaagtaaaacagataaagtcagagcacttgggaggctattgcaataatccacaggatgatgttaccctgggtaaactggtgatggtaaaaatacagtgaagatgaaaatggatttaagaaacttacaggagattatttgataataggtttttggtgatgggagaagagggagagtggatcaagggttatctctaaattttcagcttatacatctgtacagttattagttgtcagaaagaaaaagatctctcttttggtttgtttatttggatgaagggcagaattcagtggaggtgattctgcactccagtatcaatatgttgatttagagataactttaagggcttcccttgtagctaagctggtgaagaattcgcctgcaatgcaggagaccccggtttgattcctgggtcaggtagatcccctggagaaggaataagctactcacttcagtattcttgggcttccctagtggctcacctggtaaagaatctgcttgcaatgcgggagacctgggttcgatccctggcttgggaagatcccttggagaagggaacggctacccactccagtattctggcctggagaattccatggactgtatatccatgaggttgcaaagagtcagacacgacagagcaactttcactttaagtcatctaaggagatctgtccaggattttattagatacttggatttgcaaaagagaagtctaagcctaagattaaaatctgtgtattactgtcatggaagtaggaactggagcccttgtcactgaaagaatttcccagagaaacttgaaaaaaatcaacggagcctagaactgaatcttgattaattctgacattcaaaagccaggttacaaccaccaaaagaatcaggaccagtaatttttgagctcttgttatgtgctactgaagcccttgctgtagcctatgtaatgttcataaaaaccttatgaggaaattgttatttttctattttacaggtgagaaaacagcagaacactgaggatatgtgagcagacaaaggacacacacagctactgagtggtaggaacaggcctcaaatctaggcagtttgatttgagaacacatctttctaactactataatctgccaggttcttttttttttcccactgctgttttaaattttgttgtcattttaaaattttgtatgtgcattcctctttttttattgcagaaaaattgctttacaatgttgtgttagtttctgctgtacaacaacatgaatcagctatatgtatacatatacccccttcctcttgagcctccgtctcactccacacccatcctgcccacttaggtcatcacagagcactgagctgagctcgctgtgctatgcttaggaaaactgacaagacagacttagctaggcatgtgagaatttcaactcacattcgcatttgtcctctatatccgaactatgcaatgccatagttactagctacatggtgactctctgagcacttgacatattgattccctggtgtctcaga

SEQ ID NO: 44800 - DNA, 1452 bp, Bovine  19866880700808
cttttctgctgttatagcctctttccttttctttgtcctttctgggtttgttcctgtatagctaaattaatgaagttttaagagggaggaaagataaatggatgtgttccatatgccaactttcttcttaatccatttatcacagagtgcaaaactcttaataagcttatgtaagcttgaaagcagttatgaaattgtgctgccaatctccacacactatactgacattttttaaagctttctctcatagatcttatatatccatcttctaaacatttcctgatgatgttgattttagttttaatacattagagattttcatatatcaaacatacattgaatacctgatatatgtgatacatggtttggtgctggaaacattctgttagactcactgtatatcttattctttctgtctcactctgttggtgtcatctgtctggagcttataaatctaaagaactctttctagtagctcttagcttcagcttcctttgggaatttctgttcatactgcaattggtctcatgacattgttggtacttcctggttatagtgctcatattttctgaactaaaagtcaggatgtattgcctgatggtcttacaaagaatttttgtgtcctgacttgtggatttattttaaagtataaaaatcaaatcactgttagtaatagttcagtttaataaaacttttgaattataggccaacattaagctaaaatgaaaaaataaagatatctttgtcttggagaaacttaaggtataagttcatagttaataaatttactgttcagaaagagtacatttatagagaatcagaacaattctagaacatttcaggagtatggtgaaataatggtgtggcttgattaataagtaatggaaatattttagtaaatgaacaccttggtgtattttatattttacttcaactgataagaaaacagattcatcctctcaggcttataatcatgggaagacaagctataaagctattcacattaaaaaaaaaaattccaacaacttatctacttagctttagggctataagcataaataattcaaaagaacttccagtgagcttactctaaagctattttaatcaaacaaaaagaaatcctgaatgaattttgttccttctataaagtcagaaacaatccatgttctgtatggcatgagatcacattaactttgtttgtactaaactcaaggcccaattattttcaatgttttttcaagttctaatggctttgggttctttggtggtggctacatctccagctgtgtttctcagtgactttaggcattgaatcagtagattataaataaacaaaaaagctgaagacaacaatttgaacaatttccctacactttagtagtcactggaccacagatttctaaagtagaacttaatagagtaattgggaattgggttattttctatccttga

SEQ ID NO: 44801 - DNA, 1168 bp, Bovine  19866880723501
atcttgatttgggattcataaaattttgatataagagctctgatagtcttaaaatcagaagataggaataatgtagttgccccaagtaactgttactaacaaattttaattatgttatagaggaggaagaatgttaaagagaaagatcagatctgatagttgaaaagaggttccagaatgaaacagacaaaagtcccagagacaagttgaataagagcatgtgttacattttaaattccaaaagccacaatggactaggtcattatgttaccatatcaaatcatacttagatgaacagaatttagaatgataaatactttcaaaaaataaaaggcaaaataatggtataccttctaaactggaataactttgaagcatatatgtaagatcatatgctgtaaactgcaacactttccctattcaaccttcaaaaagtacaactgcttattccattatagttcagagtagttccttaaagaggaaactgccttagcttgcaatttggggctattgcattaaaccatcatccatagtatcttgtgtctgctttacgttgtcttaactcctcccctcctcttgagaaaaaagaactcaatcattactatatccattctcctgaattcaagggagcaccattcttcaacaacctgttgagtggacttagaaagcaaacagagaagttacgcattattcaatacaccttggcagcactctaaagcccttagaaatgcctaaacaaatgataaatgatcagatgactccctcaaatcttacctggtttactctttttagaaatccgacccttgctgtctaccatgcaaagctcttgaccactggatgaaatccaaactgggtagtagatcatgataattccaacacgtcatgggcagcagcatctctcagaatcccacatgtcatctccttgaaacaaacctgcaacaaacaaggcatttttttcatctaactgaaaaatagggaaccatatccttggtccaggaggcatcactacttgatcaataagggaatcataaaggagtgtatgaggagcaataaatgccactcaagatgctgataaacattaaagccaatagaccaacatttatgtgctacagaaggtgttttggcaagagtgcatgttcctcttcatgttaccgtagatctatttaag

SEQ ID NO: 44802 - DNA, 1836 bp, Bovine  19866880754623
catggaaggtgtcatgtgccacactcagcaaggccattagggaccctttagagaacattcaccaggaaagaaaagaagatgaaaataacattaagaatccctaggccatcttattacaacattccaaattccattatagatgtgaagaagatgcaaccaacaaaatggattaaaaggcacatgtcatccagcgctacacactgacctctatcatgcaccagtcaaggtcagaaggctgggaaacagatctcagttccactggaacgatggggtccatttacataagtccacagcattgatgatttaaaaattgaggctggaccactttaaaaatgacttgcaaaaaaatggcaaatataaacaggagaatataattgatctctcatttaagattcagttgaaaatagcagtcctggggccattgttaggtcacccagtgggcacagaaagtgtgcctttggaagtctacccagtttttattccccgagacacagtgggggtcttggctaatagagctgtgaatattcagcgaaagccaataatcagtttaccacaaaaatagcagccatcacagctctgaccacgtataggcttgccaagaagggcagcccgtacccacgcacatacttggtaagacatggaggaaacaccatcccctaagcgagccttcagggtttgctttttgatgattctgtcacaggaaggattaacaatgcaggacttccttcactgctgttttcacggttcgtttttaatacgcctagaatctctaaggaagctgttagcatctaaccaaaatagaaggcaatgatttacatgtgttgttgggaaaaataaataaatccccccaaacagcacgttggttacatgcagagagccctgctgctcagagtgagcatcacatgggggcactgactaggggccaccttggagaggccatcagtcatactcaagtcttgttaggctcagacaaaatgctatgactcctaagaagtctactgaaactgtgcttctaatttcctggggactttctacccttgaggatcagggagtaaaggaaagaacaaaggctgaactgaaagattcttaagacaaacagggggagttgtaagaacagtctttctgatggaatgttcatcccattaagggccactgatgcagaagagtcacagggatccactgtgcgcgtgctcagtcctgtccgaccctttgcaaccccacggactgtcgcccgctaggctcctctgtccatggggtttttcaagcaagactcttggagtgggttgctatttcttcctccagggatcccaacttgggtcacatctacatctcctgcatctccttcagtggcaggcagattctctaccactgcaccacctgggaatcctgcatacaaaaccagggcagtttgcaaaaaggaaaaaaaaaaaatagagcaggtgaaaatctgaatcttggggttggatgcttgcagctgtagctgctacaggcccacctcaatactgccatcaaagcagaccatcgtgaaagagtgttagggaaagcctactgtgtttgccctggagttagggaacaatgggcctggcgccggcttcttaaccacatgttactgaagtggctgcacttgctatggcacactatgcaacagagtaaagggaaacatgggataagacatggtacaaagacagactggaatgaggtgcttgggaagcagagggtggaagggcatatccattctgtaccatgatccccttagtggttctttgggcttccctgatagctcagttggtaaagaatctgcaggagaccccaattcgattccgggtcaggaagatc

SEQ ID NO: 44803 - DNA, 1145 bp, Bovine  19866880765455
tgtgttaagagacagaggtctcagtaagtgtcaccttaactctctgatcctctgttgcgtgtaaagtggagatttgaaagcccaacatatctacctactagcattgttgaaatgatcaaagaagtttatgcattaataaatgacttttaaactatcaattgcccataaaacgagagatgctagcaatagtatcatgtcattaaagactcatggtttgtgccacatcctttgcttctcaaaattaaactttttacccaagatttgcttataatctaggaattcttagcatcctggcatttattgagagtgctaaggtttggatccacacaaacctgtaagccatattttgtaggaagaaagtggcccattaaggcaaagtgaattttccagggtcactggcttgttgatggcatgactggactcccaacacccattcagtaactccagatttgcaactttttccaagaaaggacaaaaatctgagcgctcttgttttcaaatactttttttttgtcaatgagacctaatagtccttagtatcacattgaatccagtaaaggtaacagctgagatttttgtggaattttctagtacctttaagttttggtaaatgtgcagtattcttaccggaaacttactttttcatggtgcaatttaatggtgaatccctagatatccgattggcagttgctgacatttaatttttcacaaagatttttaaatggcccggtactgtgaaaatattttatgcttgtaaatatttttttaagtgtatgatcctgaatattttaaaactgagtgctggcataaaataagatgactgaggtcatagtccatatctacagatattagttattaaacaagagacaagatgggtggagaggtctaagttgtatttaaacttctggaggaaggatgataacgaggtgcagaactttacaatagccttttgactctagcctgtaactaggcatatgataggagttaaaaagaaattgcttcactaagcaccattatcctgaagaatggtaagaatagcaagcaaagacactgatgacctcagagaaacatgaataacacattatggctcagattatattgacagcctagcctgactcccaggaatttagagcaaatttggcatt

SEQ ID NO: 44804 - DNA, 1408 bp, Bovine  19866880782863
aatttcatttttcccaataaattagatatgtggtgatttagattaaacttgcagtgtcaaataaactgccaccatgtccccagacatatacactatggtatggatgtcagatcctttttagtaagttttcgaaatgactctcaaatatgtaaggacatcattccagattaaatgacagttctgagcatgggaaaaccctaaacagcatttataggagttagcgacactaatataaaacagtgaataaccgtgccatgcttaatttgcagttctttcatttccctgcagacagctcggtgtctctttgctgtttagaagcttgttttacagcacctccatgagcacttctgcctccacctgggcaggtacaatccattttgtctgctactgagtttctcaccgtcacacaaatttgcaatgtaaggacagaccagttcgcctgatttctttctaataaaggtgtatggctgggatgtgggactgtactgtatatgactgtgcttaaccactcagtattttgtcaggggccacacagttcatagggtaaagtgaagaaaaatgactactcttgtcagaggcagggttcagtataaaatctcttttctatctgtgggcttcccaggtggctcagtggtaaagaattcgcttgctaagacaggagcctcaggagatgtgggttcagtccctgggttgggaagatcccctggaggaggaaatggcacttcactccagtattcttgtctggagaaccccatggtcagaggagtctggtgggctacagtcacggggtcacagagttggacacaacttagcgactaaacaacaagaagcttaggctgaggaaacacagggctagaatataacatattagcaagtatattattggtcaataatgtcaaatgcaaaacggttttaggctgacactgacaaataaagtcaatacaaaccaaataagtgctcaagaaaatacaaagcctggaggagaacctgtcaatataatggattttcatgaagcaagactgtatcatattcaagatatattttatgaacacccattcctttttctggcaatctcgaaatcatttttccttaatttctgatgtagcatagttcccagaacccatcattttaacatccttttctgtaccctaatctcttcctctctatagttcttgttcatctgagtcaatattggagacaaacttccactgtagatcaagcacaatattcagattctttattccatcactaggaataacagtcaccactgattgagtgcttaatgtatctaaaacactatgctaagcatgttagacattatttcacttcatattcagagaaattcaatgacatagggactttcagatctttacctctattcagaacttcctgagttccacagtatttt

SEQ ID NO: 44805 - DNA, 1129 bp, Bovine  19866880793494
ataggctggtggacttcagagcccactttcataatgatctcattattgcaaacatttatctgtgcttaaaatatgtcagagtctgtgctgagtatttatgtcatttcattgatcttgcatcaaagtatcgtatggaatatcattgtcctcattttatagacattaaagctgaggctcatagaggttcaacaactggccttgggtcacatacataatatgagatctgaattgaggttttctttctccacaggctgagttcctaacaactatattattatcctatcatatgcactctttactctttaaaaaaaaatcaaccactttaaaatcatctttaccaattcaatatacattctcaaactgatctgaaaagcaaggttgtcttccctgaatctaaatgaactccagaggaacttgcttattgtaccttccagggataacatttctcaaacattatacagcatgtcaagtcaagagattatttgaaactaagcagattaacaaatagattttatcttttaaagaatgattttacctaagggagagctataaaatgaaaatgaaaagtcctaaaatgtattgcttattttatttaacctgcttatgaaatagtaggaaaacttatctatttattgtcaagttcctctttaaaatagtctttagttagctacactcaatatttccccctataaagtcactctcagctaagtcttagagcgagattctactattgatcatcaataatgttgtcctaaatggcattctggtttggtttctctcatagtttgtaacttcttgaccttatgtttaacagagaaaatgaggcaattttgataatttgtttgttttaatattttaatgcctaaagggactttggaagttatttaatccaaatccatataggaggctgagccatgaagatgtctgggcaagtcaataaactgtacaactgatgctagtgtttctgattccctatccatttttttcttatcatgtagtagagtcagcactgcacctatgttgattgtaattcttaatttcatcctatcttcaggtgtatcatcatcatcatttactccgtggtgtggtgaggagagaatgggataaaaataggtgtaaagtactgtgt

SEQ ID NO: 44806 - DNA, 2824 bp, Bovine  19866880908620
aatatttaatgataagctcctaaagagaagtacgctgttcctgttttgttcgttactctacgttcagttgcaggaatagtgcttgagagtatcgcacagtagttactgaatgaatgaatgaatgaaccgattaccaggcaccatactgattgttggcttttggctgcacattcccattgatctgtcaggattccactatccttcctgattccctgactagcatcatgaacatccatgtccctgcacagtgtctgatattattcaatctttaagttcctttctttctagtgtctttaggtggggacttcccccaaccagccctggatccccaaaatcacagtcattacatctatagctagactaatgttctggacagagattaaaaacagagggcaagattagtaatataaatacataatacctttataaaatgaagtaatttctattaggctctaagttttataaatatatctttgtttttaattataacaattaactgttggtaccacttctctagtacagtcaattgtaccttagaataccagaaccacttgaaaaataatcttatagcaagtaagggaaaaagattggggtgcgtgatgttaagaatataattaagaagaaaaaaatgtttgcagtgcactttaatattattatctacagttatttttccaattaatgtacaaagtatataataaatataactatgatttttcaacaagtgacagaagtatatattttatacacaaactcactaaaaattacttagtaccagtataaactaaaagatagtatttgcctcatttttgttgattaaaaaataaaagacaaattgagtgaccttcctaaagctagaaaggaaaccagttattacaatttcccatctctattcatattgcaaatggagtgagaaggattcatatatacaggagccagctagtatagaggataagttatccagtgagatgcacttatatcttagtcaaagtctgtgagaatattaaaaatgataattcagaactttttatcactagctatttttgaccattttattacattcctataaagatttacatttaaaattgatttaataatactaaaatccattcttttcagttaactactggtcaacaagtagtaatggttttcccaaagtgcaataaaagcatttcactgaagtatgttagaatgtatcatcaaaacaacaaaagtaagtgttggcaaggtccctcaaaatttagaaaaataactgcctatgacccaataatctcacttctggaaaaacacctcaaggtaattagttcagtattttgaagtggtctctgtaccgccatgctcactgcattatcattcataacagacaaggtgtggaaacaacctcagtgtccatcggtgcatgaacggataaagaatgtgtgtaaatgtatgtgtgtttatccataggtacctatatgtatacacacgcagtggaatattgttcagccttaacaaaaagaaagaaatcttggaatgtacaacaacatggatgaacctggagaacatgatgctaagtgaaataagccagacacagaaaaacaaatacagaatggtctcactcatacgcagaatctacaaaagtctcacttataaaatcagagtacgatgatggttactatgtgaaataatggacatgttacttagcttgactgtggtaatatctcacagtgtacatgtacatccaaatatcacctgtataccttaaatacacacaactttgatttgtcaagtatactttaatatcagtggggtaaaaacatgctccaacaacatgagcagcaacaactatcctattctatttctattaatagttctatttctattctagtaatagaaaagtagtaaagttgaagtcatattctgagaaatctaggaagaaactgagtcatctgctgtgaattcaaaatttctttctagttttatctcagatcctacaatttcaaaaacagtttgaatctaattccacaatacatttatgcttttttcctgcacctttttttttgtgacatgatagaaaccaagatcaaactaattcagacaaaaagaaaatcttcattactatgcaggtgcttgaataaattaagtgcctcccttcccttctctgcatttatgtgcatacgtatctatcacgtatatttcaataccactggatgtatttcatataccagcacagttgaaaaatcataagaaaagactgactcacctggcttaggtgagatacatactaggccaaccacccgaagctaacgatgcagaaatacagtgtaatatggaaggcttctgagaaaaacactgcttccacaaagttgtaagcctttccccactcaagaaagaaatgctaacgagaccaaagagcaattctatgacactactgaaaaatatgtaaatgtatttactgcaggttaaaatttgtgttttaggaatgcactctgcatgtttttctgcattattttatcttcttgtgaactactctgttctggacaagactcaacagtggcagtcttgatggggttctcggatcccagtatacagcagtagaggcaatcacttacaggagtcttaattttgatgtgattgttcattcatgttagcacaaccataatgcattagagcatagtgaacactctcatggggatatggggggagtgcactggtaaacactggtgagaatgagaatgagaacggggcgggggggtgggggcgttgctcatgggaaaccaagagctgagagagactctgagtaaacaggttgaagcgtttagattttattccttggcaacaggaataa

SEQ ID NO: 44807 - DNA, 835 bp, Bovine  19866880928659
ctattaattctaactcaaagaatagttgcaaaaattaagtaagtagagctccagcagtcactgtagtgtcacagatctcgtaccaattactttttcttgactgagaatcttagaccacttgcgtcaggaagatcccctggaggaggaattggcaacctactccagtattcctcctggagaatcccatggacagaagagcctggcaggctacagtccatgggttcaaaagagtcagacacaaagtgttgttgttgttgtttcctaaaccttgttttttattaggcttgcataaactaacacatgccatctctccctataccctgtgatcccagatgtaagcattaataactaatccgcatgctgtgctaattcagaagatagggactatctttttggacaccagtgccaaatgttcaatactcattagagcaattgttttgcatattttgagaatacactattcctttctattatttttaagtttataattgtttttgaatctggagaaaaggctatatgcccagcctggtcatgagcactttatttgacataaaatgtgttactatctttgacagaataaatgaaaaaatttaggacgccctacacggctggaacatactatgttccagaagtcctccaaacaactgacgatgagggataaacgagtgggagagacattagattgtgaaaagagggcttgtgtagcacattaggctcctgctgaggtagatcaagaagtgtcttaccatctcgagattgtgtaatacatttcaaaatgcccatctggagcatcattttgatttgtattcctataagtcaacttcaatttccagta

SEQ ID NO: 44808 - DNA, 898 bp, Bovine  19866880979336
ccagatttcttgctaatgctagaatagatttattcaaacgtatgttgagtcctctattttactgatattcctgttactcaagatattttttgaactcctctttggtatctaacttcagagctcatggcacattatttaaataacttcctaattctgtgttgagcatcagtgagattagagggtttgtgtgtgtgtgtgcaccattttttttttaatccttcagatgacttttctgaccaatgcagatataaatattgaccaatgccttcaatctttactctagctatcccacagtctgcctgtattcatggcagcgtggataaaattagaggactgagaagactaagatggactaagagcttggaactaagctcttcataacacttgtagaaatcattcttgtgtacacacacacaatacttagtgtagatttctgatcatgaaacttcaagataaagacacttgtattgcatgagataaaatgaaagtgtgggaagcaatactgcaaaaggaatgaattcaaagcagtgaattatcatggctaattcctttaaataggtttatacacttgacagaaatcatagaaaatggattttttcccccataataaaggatcaaaaacatttctgaaactactcttttccctttgggacaattttaatacagatgaaggagctttagaagaatgagttaacaaaaaacactacttaaccatctgctagaacacaatgtggaatgttttcaatacctctcagcttgcttaactgaatttcagaatgcaagcattagtattaagaataagaactaaggatttcctgaaatcatttcgtttttatccttgctgcccctagtatactttccaaccccttcactaactctctctattgcttttccattc

SEQ ID NO: 44809 - DNA, 1779 bp, Bovine  19866881019368
cttcttgtcttgaagtttattggtctcccgcgtaaaccagctactcagcctcttttctccctgaatttcctcactgagctatcctcattctattgctctttatatctttgataaatatttaaataaataggtcgcctatgccgtctctccttcaaataccccggatcagccggggctggaccccggcagacacatgtatttatttcacatctagtacaaagaatatatcatcatgacactcaatgaagaaaaatcatagagtttgtagcaattgatgactttcagcaacactttaaatcccatgagagggctcacttccaatatacccaccttgtaacttatctataaaggttccaggatatctgcccttttactgaaggacaattttacttttggctagaagataacgttccctgaaggctgccactaaaacaacaactttacaaacaaccaataggaacaccaagtctaatacatacgttcatgtagaacctaacttctacagtttgccactgactacactccattatttgtcctggacaatgatacttcttcctctcaattttatgtcaaaatagttgtgaaaataggtttatatacagcctaaggaaactaatgaaattttttggtcttgttttagaggcactcgagattacttagctatttctagatttaaagtggcatctgtacaggtgttacagacaggaatctgttgcctccttaatgcaaggtagagttctaggacgtgggaacttaaagtaggcaagttttctcatgcagatttctttagtaatgtaataggctgaaattaacaaataaatagatgaaataataggttaataatgtaatttcaggtagtatcatgaagaaaaggaagcaacaataatgggataagaatgatgaaatatgggggaggggggctgtacatttaatggggtacttttggaaagtttcactgaggaaatgatgtttgagcataaatataaaatgatataaagcagccagccacaaggataggaaaagaacattccagacagaaggaagaacaagcatcaaagaacatgatacacttgagaaactaaaacaattcattaaaatgaaactaatagagtaaaaatcttaattcttttaggttaattaagcaatatgaaatttttattgtagaaaatttggaacatacagcaaaatataaaaataaacattttacataaactatttaaaaagttttcatatttgggtatatatctttcaagaatttttagatacatagaaaagggaaaagcataaaataccctactgtgtataatttttattctaccttttttcaaaacttaattgattaggaggacctaatctattcagtcattaaagtaattcatagacatagtttataggggctgcatgttattccctcacacaaaagcagtgtcttttatgtaatcaaccatccatgttggatctttaggttgtttttattttatttttctatttatttatttgctccataagaaattctgtaatcagtatttttatgaaaatatctttgtcacaattttatatagtttcttggaagttggaagtaagattcattttgatctttaacattaaaatactaaagagcctgtcttagtctcattagactcaatacacatttaatataaaacaaaatcttttaaagagactttttaaaacgtattattttggctatctggcatgtatatacatttgtatgcccactggtcttttaaagaattcatcaacacacaagaccattctaat

SEQ ID NO: 44810 - DNA, 1277 bp, Bovine  19866881030917
tttctttccaattagaacctgtacaatagccagccttgtatatttagaattccccagtatgtctatgctttcccatctttacattgattgatgtttcttccttatcttcttccgtcctgattgtcccacccatccctacctttctccatctctcctcataatgaagattaaaaaaagcaaaagagttttgctctctgttgccaattctagtaaattgacagagtttggggagattaatgtataggcaaagattttcaagtcactttcagattcagaaaaaaaaaaaaatccacgattgattagtgaccaaggtgtgaccttgagagtagtggtccagatgctctttattttgcccacactgttgtttaaggtctagaaaaagtaaccatctgcattcttcttcttctgaacattttcttccttaaaatttctaccgcattttctatttattttattcacttaatctcccatttgatacgcttgcagttggctcatcactgactaaatagactcatactccttcaaaagactatctcactcaatatctcttttttatctcccccaaatgctagcacagtaagtatagtaagtatatgcttaacaaatatttcatgaactaaatataatataggcaagaaggaggatctaaggctgaaaaagcaaatgacagatggattatacttatagaagcataaacaaaatagttcagctggtaattgttctaaaatggtttcatgtacattggtctgttcacataataatcagatgctggagggcagaagtccttaaacacaacctcattcacagattccagtgatagtcggtagatgacccaccctctgggggatgagtccttctattggaaagagtcaaaagcaacaaaatttgttaagtgaatcacacctccaagaggctttcagggaaatttgcatttggggagtgaaaaggaattgagcaaagaaagaaagatagacctaggatgaaaactcctcaaggaggagagaaagggcatagatttgagggacgaaggcttgaaatccaatatcagatcttagccctattactgagctctgccattcaatcattgtgtccttgggcgaactaggtaacttctctgaacttcagtctcaaccactgtaaaagaaacatggttatactagagccaaaaagctcaaaaataatcagtccaatgttagtaacttatttactaacattagactgcaaagataatattagattgcaaatataactgtaaagtttgcctgtgtatatatgat

SEQ ID NO: 44811 - DNA, 1003 bp, Bovine  19866881089249
taataagtaattctaggagagactcctttagaagtaaattctaacaggtagaacctgtttgtctatttttagccacatgctccatgtcgctccagagtatctgttgcattgaactgcagttcagctcaagactgctcatttagaggctcgagaagcctggaaagattttagaattcaggttggaatcaatgtcaaagctgaatctggagatgaggtgttcttacatgccatcccagaagcaaagggtacagagacaaaagagtgtagccaggtgggagaagctctttgatgagatgtcctttctgtagacactctccaggaagagagagctaaagaacagtcaagtacgcacttgacgcccactggggcttgtttgcagagcctgaatctggggcaaacagcttgccgcatctcttaatgcctagcctcagcacttatttaatttgagatgcatttatttcctgttaaaaactgttgcagtcactctttggcatcaactgtttgctggaaagcaaggtgagactgtcagatggttgtattggctggtgacatattcaggctctcatgtgatagggcagccgttcagataatcattttaaatatttcactaacacagtagtaaattttttaaaagtatacagtgatagtgcttctgttcgtcatattcacactgcctttttatttctaataaactttgtcttctgaggatatgttgttgagagctctccctagaatattatcatttgtaatagatgctcccgaatagtttatttttatttatactaatagccagggagtcatggtaacacctgggaaagtgcaaaagcaaaacggaattttctttggaggagataagaggaagccgcagagaaaaaactgttgggcgcccttagagtccttatctcctgaagtaatgaattagtcatccagaggggcaggaatattcccagaaggaagcttccctggttgtctgggaggtttaattctcactaaccattaggag

SEQ ID NO: 44812 - DNA, 726 bp, Bovine  19866881110258
aactgaactgaaccttgattccagcttgtgcttcataaagcccagcatttctcatgatatgctctgcatagaagttaaatcagcagggtgacaatacacagcattgttgtactcctttcccaattttgaaccagtcccttgttccgtgtccagttctaagtgttgcttcttgacccacatacagtttctcaggatacaggtaagatggtctggtatgatcatctctttaagactataaaaagtataaacacaaaattcataagaaaagccacgtatctaggctatgtttcatgatagctttttgaagcatgttaaacttatttgccaaaacagaaccataatataatcttgagaaaggtctatgtgacaggtttcctgtaggaaaattttaatttaaggaatatgttttcacattgcctccaacaagaaaaataaatatattgacaatttgacagtgataatatgaaattttacttggtactatttttcctattatgagaccttaaaaaaagaaactctaaaataaggaataaggcaagcctatttatcattttgaaatataaaggagtataacctgagccccaagttaaacatccattctttatgtaggctgaagaaagaggaagtgtgaggaaaacagctagtggttctgagtattaagcttcttgaaggcacagattatttattttctacttcccttctatatgcccagggcctacgaaggta

SEQ ID NO: 44813 - DNA, 1833 bp, Bovine  19866881110504
cattacattgagtagagttccatgtgctatacaacaagtccttgttggttttacattttgaagatagcagtgtgtacatggattgtcacataattataatgcccattggtgggcattataaaggagaaattatgtgtattctcaatggcagagtctattaaatatcagaatcctggtaccaagactagggggaccaggaaacaacactcacaggctagtacttggacaaagctttttctcaccaggacatgctgtgctttgcacatgtgtacagacaaattctaaaaaagcacaagcattttaaataataaaatgaaaacaaaacccattcatatatacccaaaagacaaataaaggtgatccgggaccaatcctcctgcgattttctttaaatttcttatcttatgaaatattcactgccttgtttgaaaagttaaagccatgcatgcctaaacttccaggcttcagaagaaaaaagtaattcctcttggatatgacttctacacatggtaaaagctttggtatggttggcaagtcagtgaacatacagatgagaggaggaaaaataaataccccaatggctgtgaaagatgttctgtggtatagttcacagcttccatcgtgctatggaattcagatttatttctaaacctctctgggagagttctctggtgggatagttgttagtctcaaaagactgggaagaaattcctagaagatatttttaatgaagcatgcataagaagcccaagttgaacagaatattaaaaaaaaaaaagagtcttggggtgtgtgtgtgtttgttttcaatgatttttaggtcgacacagttttctgtaatggtcttttaatatgtttatatgaaaataagttgtctaatttgtcttcagatgtatttatcctagtacctgtacatgtcttgctcagttctcacccttggcaaaaaacaagggcagagtgacagaggtagttctctctaaggatggaagtgagatatttttctcttacaacccttagttagaaatatatttttcaggaacatttttattccagtcagcatagcagccttactcagtatttttatagcctttgtatttgtgaagtgctttaaaatgagcttgattagacacatacttcatcatctaaggaaaaaatcaatacaaggcatcattcccacttgacagagaacatagatgcatcaccataagagtatatttcttaggaaggaggttaagttgcctattcaagttggtcttccaaatcaatggaagacaagtggatcaaatctggtgttctttaacttctagagtactgccttggttgcttagctatgtgtctgtttccatgcattaatcaataacaccataattatcaggaatgacaattgcacatcaatgattcatcctccactgtaagtacaaaaaaggattaatattacattggctctagaatatagagaaggaaaggtcactaaatgacgtattagaaccaccatgatagcagaccaacaaattaaacccaacaggaaaaatcaacatttgttggctaaacctaataaaatcttgcagtttattgatgttgttcctccagtgggcagaaatagctctaggataagttagaaagacaataaataagcatgtggatcagaaagagtcggtgaaacacatgtggagatcaaggtagctcaaaataaagctgtaagtacaaatttcaatagatccatcattgctaaaatgttatcttacctttagaattattttctgttactgaactgtaaagaaactaagatttttttctaaatccgagtcaaagacttctggtagccataatttt

SEQ ID NO: 44814 - DNA, 1235 bp, Bovine  19866881251998
ttttttatattctgctatggtttacctttgatggctatagccatttctttttcgcccaagatgtaaacatgactactctttgaaaggaataatttaaaaaaaagataagccacagactggataatttttgcaactatatatctgacaaaaggctttaatccaattttaatgaactgtaagtgattaatttttgagttttcccagagtgttttctgggctaaccactcgaggtgcctggtaaggtctacattagggccgacccttctgttcccctgaaagatgtagtcttggacagttcttgggctgtacaatggaggaaagagaaaagcaggcaggaaagaggagaatgaggggaagaaaaaacatgaactttaagttctcactggtttgagaagcacagtggattgggaagaacctaaaaagggattttaaaatttattgctagggggatttcctgtccccttcataatattgagtaatgctagtttgagttgttttaaaatttttcttggttgtggggactgtgttcatttaagcacaatattgctctgaaattgatttatgaaggtcacaggtttatgagccttgaacagctattgccttcatcttattagcagtggaaggctgcgtgtggaccttcccagcgcatctcgaatgtgagagccaaccaggctttaataggtgagcaatgagctgcaacacatctgctgaaatctaccaggggaaatggtgtcaggaaatggaatcgagtctttggaacaattgtcttgttaagtacaaatgttcctacttcaaaacttccttcaaagctctaagtacaaggaaaacacacaatttcactttcatgccacctggtggtagaaactaacagttcataggcctgcacttgggctctggcttaaggtctgggaggagtatataaagagcattgcttatttcatatgtagaaatttttctctctcaatccccctacctgtattaggtccccctctgctttccccaccaatgggctgttctctacgtaagctacaaggatatatgtacaatgtggggagtatagctgatcgtttataataacgatcaatgggatataatctttaaaaatggtgaatcactggggttgtacacctgaaacataacacattgcacatcagttatgcctcagtttaaaaaaagaaagagcattggtctcttctgggctaaggagacagaaatccactacagggcactgacaa

SEQ ID NO: 44815 - DNA, 1737 bp, Bovine  19866881270886
ggagccctagtatctgcagcttgatttcccccatggtttaataccctgaagtgtcaggctgatagccaatgctgtgccaatcagtttccacccagtaaagctcagagagtaaggcagagataaagtgatggaaggctgatagttgatgatgatttacaagtgggcttcatagctcttaggacttcagggtccctccagagggcattaaaaggaaaaaaacatctccatttgcatagttttttgcatgacttcaaaataacaggtggagagtgggaagtctaaaacagatgccccgtgtaaagaagactaaaaaggcaaagagtaagcagttgactgtacaatagtgaattactggcagtgtcacctatgagagataatagtgcctgagtaagactccaaattggggcttcccagttggctcagtggtaaagaacccacctgccaatgcaggagatgcaggagatgtggattcaatccctgggaaggaatccctggaaatggcaactcactccagtattcttgcctgggaaacccccataaacagagaagtctgcagatataatccatagggtcacaaagagtcagacataacttagagactaaacgataggaaagacctccaaatcacccactgtttagactggagtttccttgtctataaagtggagatgctatagaaactgacttcagagtttttgtaaaaaagaaatgatatgtcaagcagggtgcctggttccttggcattatgaacccattccctttatgctgctctctttatgttattttattcccactatagggtatcataacagtattaattggacattgaatatgtttcaggcactgtgctaagctttaccttctccatcatatggcattcatgaaagaaccctaggagaagagtacttcttttatttccgctttatggaggaagatgccagtgctcagagaggtgcataaagatcaatactggactggagatttgaacatgtgtccattaacctagaaggacttccttggtggcttagcagtaaagaatctgcctgcagtgcaggagtggcaggagacctggattcaattcctgggtcgggaagatttcccaggaagagggcatggcaatccactccagtattcttgcctggacaatcccatggacagagaagcctggtgagctacaatccataaggttgaaaagagttggacacaactgaagtgcattaacatacagagcacatgccattgatcaagaagttcctgacgcaactgacttgggaaactagaaggcataaatactaattcctctaggaatattcaacgtgtctgggctgcagagtgacagtcttttagaactcaggccagtttttattcacaacctttttgtatgccacatttcagcaaaatagtcatactcaaggttttctggcctgtctctattcatatgtatactcaaatattccatcctttaccaaaattataggcaaccaaagttgcctataattttatctaaataaacagcaaagtaggaaaatcttatcagatgacaacagagggaatctttcatgttgaaataagaaacacattctgtagctgcatccccatctttttacaatggcatttgcatttatacagcccctaaattttaagggatgcctaaaacttggtaaatgctatttcaatcttatcaggattcaggagacttgacaagtgcatcagtgttatgatactaactttacaggg

SEQ ID NO: 44816 - DNA, 933 bp, Bovine  19866881338350
atctactaattaaaaacaaataaattgtttaaaaatataaccaaaaaatggactatgatttggaaacaggtattcaatttttaataacttaaaatctagaattcttcacaacacattttggggaaaaaaaatctatgcagtaggttaaatgatcttttttcaaaacggatcttattgtgtgaagtaaaatcccattttcaaaagttgtactcagtgccctgattgtgaaaaatacctaacctattccaagaagacagactgaccagaaatgctagggtactatgacaagtgagtatagagaaggcaggtctaaatagaacaccaggaagaagaagaaataagggcagaactgggcatcattatcttatctcagtgtctctggttttaaattgaatttccactctacttgccttataagttcacatggagttctaatcagtccaggaataaaaagtgacttgaatagacagaaataaaatacatatatacatatatttataaaattttgaaagactatgacaccctacttctgaatcccagaagatgaagtttggaaattatgtgaatcattttttatatttccttgagaataaagccgaaataatagtaataaactcagggatgctgcagctgagagtaatagaagtaaactcaccatgacaagggatacattttagatcatgacacttttataatgcaaagtttatattgtttctgacaggaggaaatccaacctctttagctcatctcagtttcttttcaagctagacatttaattaattaaatggtttttggtttagcattaatgatgtctagcttcctgctacctatctagcatatttgaattccacttgcatgtaaaaatcattccctagtctgaatttccagtaatacctcatctctgcccataaatgaactcttaactcctcctat

SEQ ID NO: 44817 - DNA, 1587 bp, Bovine  19866881380900
aagttatgaaaacaaagctgcacaagtttggcatacactagtttgcttgggcacaaactgaataatgtgcctgtgtttttttgttttttttttcccagtgcctaaacataatctattcgcctcaggcttttctagacctaaaatctcctgctgtcaacattatctgtaaccacactgctttaaatggagacgcgtcactgcttccgggtgacatggtttcactcagggaaattgcccgaggaaggatgcaggtgtatttgctattcaaaagcccaaaaggtatgttcctcatttaaaaataaactcatttaaacaatgagaactaattaccacattaatttattgtcaacacagctaagtacaggcaggcatatataataacgtgtaaactaccaagtgagcagaataaaagggaaatgtagtggggttcacctccatgatactgttcatgtaactcactaaagctgtatttgaggttctgttttgtagtttaattaatatcattatgcaaaaatcggcgcccatacatttcccataatactttatctgcatctctttatcctattagttgatgttgatttctccgtgtgtataagggaccaactccagggtgcccacccttgatcctcatcagctagtgtttatgtccttgcaaactccccttctgttgactgtgaataagacttatgatttgagtcaaattgacaggatatgtcatgtctcttccacaattatataagcctggatcttgtagcggattgcctctaatctgcagtagtccttgctgcttgacaagtatgcagttctattagggaagcccacatggtaagaaactgtggacagtgtttaggaaataagaaacagacttcaggagccgaaggcagttgacagaggcttaggatggtctccagttacagccagcaaaaagccagggccctcagtccaacaactacaagaaaatgactctgtcagccaactgagtgagcatagatgtagatctaccccaactgagcctccagattaagagctcaggccagccaacacttttgctgcagtctttggggcttcccaggtggcacagtggtgaaaatattctcctgccaatgcagaagatgcaggggacaagggtttgatctctgggtcaggaagatcccctggaggaggaaatggcaacccactccagtattcttgcctggaaaatctcatggacagaagagcctggtggcctaccgtcaatgggatcacaaagagctggacatgactgagcgcacacacatacacaggtgaccctgagaagacccacctagactgagctgagactcctgactcacagaaactgtgagattaaaaatgtgctgtattgcttaaaactgttaaatttactttcctgtgtagcaacagaaaactaatacaacatatatcaagataagataggatcattcatggccagtgccatccactcactgttcaagatggactttctttccagccctcctccttcagtcaattagtcatcaaacccaattctctgacttgtcatttgtttatttttatccttccatctctacctactgccattgtctttgc

SEQ ID NO: 44818 - DNA, 1127 bp, Bovine  19866881405834
cctttgagagatgaaaatggtttttgtgtagctttgagatgtatctctttgaaattgatattattaaatgtagggtagttggctcaagatgcctgatggtctcagaaatatattatgaagtgcttcaaatctatacggcagtataagttaatggctaagaacctaggaatgcaataataaaaatgtgtttataccttagccctttcttagtctcagttttcttacctctaaaatgggaataattgtaactaaacttgggcttccctggtaacctagtaggttatcataacagtaaaatgtgagactgtatacgaagtcggcactccatacacgttaactaatattattgttattattcagagaaagagaaacattattaagtgatatctcctagacatgtaaactctcacctgaagagagtacttacaaacatttccccagtaaagagttgccttcagggacatgcaatctgaaagcactggattagtttattaaggtagacattcatgtctgttaagtatctcatattacaaatgagcaaactgagggtgaccacaatcttgggcaaaaattcctattaataaattacttcaacccctctgacaatagagttaggaagagctataaaataaatgcctccctatggaatgaaaaaacggttggctgcctttctgtggtaattatccctcaggatccacctaggccaatccctatgaaatatgtgaccacaggggcccatttcttattattaagaaattttacttgggaaaataacacaattcttctctatttgatcttaagatttaaggatctgaaggggaaactacttatctattgttccatgaaaaactggactctttgaagtgtgggtattcctggatgaagggactccctctggagattacctggttttaattagttggtgctgcagtcaccaagacctttttgaaagctcctcagacaagatagctgtctcaaatcccatatggaacactctggaaatgaacaaatataaatttcttctagctgttctaacacagtagtttaaaccagtagtttattagttctggttcaagaaaacactaagggacttgtaccgtttaagtccttgccatgctccattttca

SEQ ID NO: 44819 - DNA, 3959 bp, Bovine  19866881407125
tgaactctctatttccctcagtcttgtgggattccccaaattaagtaccactggccttccaagccaaatgctctgagggctcatcttcccagtgcaggactcctaggcaggggaacctgatgtgaggttcagaactctcacccctttgggagaaccactgtagcataattattctccagtttgtggttcatctagccattgccatggggcttgactatatggcaagttcacctctcctattatctcattgtagttccatgtttttagttttagaagattttttctggtagattctggcttccctggtggctcagacagtaaagaatctgcttgcaatgcaggagacctgggtttgatccctgagtcaggaagatcccctagagaagggaatggctatccactccagtattctcacccagagaatcccatggacagaggagcctggaaggctacaggcagtagggtctcaaagaattggacaacactgagtgactaacactttcacttttttttctggcctttttaactgaaggttgttctgcaaatagttgttttttggtgtgctctggagaggtgagcttagagtgttgctactctgccatcttggtcaatctctcaataagctgaattttaacactggatgatattgtcagggatgcatgcatttaaagacatgtttttatacagtttttcattctctaaagaggaattttagatccctttagactgaatgttcattcagtgaaggttaataaagttaccacctttctttatacttcctctaaatttccacttgccttttaattttggggtatctagggggattgttcatctgaggtagcaaagacactcttctcagtcaccatggaaatgctaattaaaactataattagatagcacaacacattcactagagtgctaaaataaaaatttcttgtaatttcaagtgttggtaaagaggtgaagcaagtaggactcttatacgctgtcggtgggaaagcaaattagcacaaccaagtttgggaaagttgcagtatctactaaaaatgaacatatatgcaacgtataattaataacatatccaagagaaatgtgcatatccatgttcccaaagacaagaatgtaagagcccaaagtggccatgataaaatagtatatagcattgaaaggtaaattattactgctacacatagaagtctcacataagtaatattgagaacaggccacacaaaaaaacatgtacaaattctatcattctgtttatgtaaaactcaaagaaaggtgaaataactaatggcatttgaatttaggaaaactgctatcttattgaggattgggatttataattttggaagaaaaagagcaccttcaactacactgatttagtactatttcttaatttgagtggttaacacacatgtctgttggttttgtgataatttattgagctgttcacctataatttgtgcactaagcatatttaacaaaaatctttaattaatcaattatatatgattataccatatgccagataacatatatgatattaaaatagaaaaataaaaagcacttcattattccactgatgcatagacttcaagtcttttttttctatatgaatattcatacattggcacttacttagcatttatagtttttctaacagaaattatcaaaattgtttaacaaaaataagaaaatctgagtagaccaagcttctatagtcctggaggcattaaacattaaaaaataatctaccagttccaataacctttcacattaatttaccactaaattttcctaacttttaaaaaatatggaatttccacacaatattaaaaatatctatcttagcaagtaaatttgagagggataagacatgcttttcattttttttttccttgagcaacacttctttcccttgtgatttgttgattaggacttcttttttatttatttgtttcctctcttttcatgaataattaccatgttttatttgtttgccatattggtcattatttttttcctcataattttcatcattgtccttatcttctgcattctaaaagtgcttcttcagtctgctttccataaatctaattatgttagttgttgcctacaaaagtgagtgaaagttgctcagtcatgtctgtttctttgcgaccccatggaattctccaggccagaagactggagtgggtagctgttcccttctccaagggattttcccaacccaggaatcaaacccagatctcccacattgcaggtggattctttaccaactgagccaccagggaagcccaagaatattggagtgggtagcttgttccttctccagagcagatctttctgacccaggaattgaactggggtctctggcattgcagtcagattctttaccagctgagctaccagggaagtcccttgcctatgaaggccaatttaattcttctattatattttctgtttcctttcaatcctttgcatttcaactttctcaatgttaatggcttgtatttctaagttaatcaatgcatatgttaaaaggataaaatataattttctaagatatcattctggttttcatattaactcattgatccacatatgctttacctcaggttttcattccccacattaaagtaatcattatcaagatcatggttgactttgattgtgttgttgctattgcttctgtatttgagaatgtgagaaaaatccattgaagggtagtatttctcaacagacaaggcgtaagactgaccattagcccttggtcctactgacaacttgatttttctgtataaagcctctaagcttcacagttgagtagactgtgaagaacctcaggcttaaattccaatgagtatcagacattcaaagcctctgttagaatgctagtgtaccatcctctctccacactctgtcgttctctgatcacacacatacacagtactattactgtcgtcactaatcccattatcaccacatctgcaaaacctatctttctctttggttacaatgtatttccataagtcattccttcctttctacccttttcagagggatcaggaaagataatcctaaaatggatacagatatgaaggcactgattgagggaggtgccaagatacggcagcttaactctttaagtcataccaatcatggatttctgagttagcaggcagaaagtaagtgaggaacacagagtctcgctctctattacttaaggccatgggcttcctctacttcagattgcaaattttttttttttaattaattttattttatttttaaactttacataattgtattagttttgccaaatggagtcttcccagaagctaaaaatagattggttgaaagtctcagttttgaattttgtcatgaatttttcatctttatctgtgcccttatagccagtttaagttgcattaaagactattaatctggtagaacttccaaccaacaactgacatcttaaactgtgattaaaaaaccaacccctcagcatcatttggagaaaaattcaatcttcctctaatatttactcacaaccaaaagttattcctgaacatctgtgcaatattactttgacacagatggcaaaatagttattaataacatagcacatgtaaatatttggatccatttcagtagaactgagaaagccacaaaactgtcttatgaagtaaattttcattgctgactcagtgttcattttactttgcccccaaagtgttgtaatcttctttggtactttttgaaataaacaagtaacatttattttcagacttttgtagtgtagtggggagaagaattcatttacatttcatagctggcccagatcgactttatttcttagaattatacaaggtctatacactgttcaggaagtgacaaggcccagccttctaaatacaacttaacttcacttttcaaagaataaataaaatgaa

SEQ ID NO: 44820 - DNA, 869 bp, Bovine  19866881502863
gaccctgacaggctacagtcccataaggttgtaaagagtcagacatgattgaagcgacttagcacacactcacatattgtttaagagcaacagatttaagatattaatggtcacagggtctgctcagctagttacggcacctgtgaaatttggcaaattggtttgacccttccgagccccagactccctagatgaaagtctagattatcatagtactttctctttgtgtcattaaataggcatgcatgtaaattgtaagcctagtgtctggtacgcagtaagttttcaatagacattaggcatcaatattagtaatatgatcactaattattatcttccccaccagaacaaacccaattcaggaaggaacggttggcagagccttcaaaacatgttcgtgatctgacgctcacgtaccagcctctaatttgcttgtttatttcacttggttttcctgagctgcacagaagggaggtgggtggcagaagcttaatttatttgttccttttttttttttctgaaaatgtgggttttggctctcacgctattttgaggcatggccttcccatggcattgtggagaggcacgcttgagagaggtaggaggattctgtagctcttctggtggtgatagcatctttctttccccaagtgatcagcataggtgctagattgccagtgctgccagccaaaggcctctcctcccacagacctggaagcacatgaaaagagccatgactcacgggctacaactttttcagctgcttgataagagcactcataggctcagctcccatgttgccatcaccctgcaggctggctgaaggggaaaggcctctcaggttttcaaataaagtgctccccagcgat

SEQ ID NO: 44821 - DNA, 636 bp, Bovine  19866881517995
gcatgaataaatatgtttattttctatgatgaatttattttatgcattcatcctttagaaggacatccacaagcatcctaaaaagagaaaagctataatgtttaaattatgtttttcctctgacagttcctataacttgattgctgtcatactttctcttatcatttatatgttgttactaatatttagatcattcattttgaaacagattgagtaaaaatactcagtttgatgtgaaagttgttttatatccctatttttattttctaatatctacttaagaatatctgttggcttacagaaacaaacagaatgaatttcattatccaaaaatgcaagcaatattgtcatatgggatagatacgtcagatgagattgtgaatctgcagtctagaaatatatatgtgatctttttcagaattggagcaaaagcagccagatggaaaatgacatgagaaatttgagatgaacactattggaaggagctaagttttatttttccatattcccaagtgtttttgtttcatttcatttagagaattcattggagaatgtttcaagatgtagagcccttgaatgtaagtatcccaaatgaagttggagcattcgtgctgaaattgtttcctgttgtggtaa

SEQ ID NO: 44822 - DNA, 1192 bp, Bovine  19866881693595
atgttatataacacaggggatatagtcaatacttcataataattataaatttaaaaattgtggatcacttctattgtatccctgtaacttgggcttccccagtggctcagtggtaaagaatctgcctgcaatgagaagctgtaggagacaagttcgatccctgggttgggaagatctcctggaggagggcatggaaacccactccactgttcttgcctggagaatcctgtggacagaggagcctggcaggcaacagtccatggggtcacaaagagtcagacacaactgaagtgacaacacccatgcacacatacctataacttatcatatagcaactatgcttcaataaaaagggagagtttgtaccttttcttttcaacaagaaacagcattttttctagttgttgcaaaaaacgactccaggtgaatgaggcgttgtcgtttaatgggtttaggagttcattccaagataaaaagagttctgcagatacacggtggtgatggcttcacagcaatgcgaatgtagttaatgccactagtgacttaaaaatgaactgtagacccaaatggttaagatgatcatgtttatttcatgggtattttttccacaattaagaataatagttaaaaaaagaaacaagcataattttatattgcagtttttcattgctggatggtcctctttttcccacttctctacattcttcctcctcccttttttataaacctgttttaagataaaagattaaaattttgacctctaggatattatttctaataacaattatctgctgatgaaaattgaacctatcaattttgcccaacttttaatttcccattagccaattaaaggattaccatctatccattttgtctggtttcattgggtacaaagcaatcttatgactgtagaatcacagctaaatcgtgctgtttagaatttattgcagaggaatgattgcactgtccatttctcagttgggaaaactatctgtccagccatttgaaactggggatggcagtgggtagtaggcatgagagtgatccaggagggcagcaggatttggacaaagtgcctacggctctcacccacgcagcctgtgtgaagctccatcactccaccagccatttcctctggtgggctgtgtcatggttcctttgcttccactagtattagtttccaaactgtgtg

SEQ ID NO: 44823 - DNA, 713 bp, Bovine  19866882021677
aaaactgaagtactaaagtctgattaggtatgcacttataacgcagactgaatcttcctggaacccaatctgacaataggggccaatcagcttcccagctggaaaatctgctctcccaaggtcatcaaaaccaaggctgttctgaactgagttgcacgtacaccgccatgaagaacagagataaataagaatgtcctctagttttctactatcatttcataccctgatacctttggccacaactctaccttctccaggaccttgggtgaggactataagatcctgatagattaatgtcctctctttcccttttgcaggctgaagtctgccttgagcctccatcacttcacaggtagatcatttatcattacagatacaggatcaggtttctacttctgattgttacttatttcaaatatcctttgactacactttgcacattggcttggacaacctgaaacttttcttcactggtgaccatttaccagagttctaatcatttacctctctgaatgccattggagtcaagcaggcagacactcaggtctcctggtggcatctacaatggattggcttttgcagagttaagatgacctgacccaagggctactggcaagtcagtggccccatcttattaagtaccccaggacaattcttgaaattccactgaagtataaaagtaatattttggatgactttatatgcaccaggta

SEQ ID NO: 44824 - DNA, 1368 bp, Bovine  19866880130610
tgtttctttcttatccatattttcccgtaaaatctattgttcttatcatcaactgcattttttcccttggcctattacactgttttcctcttatattgctgttcaaaacacagaagagaatcatatcctagaatctcctctgcttaggggtatttatcttttcttccttttttttttgggtgggggtgggggtcttgatgaaaatatggccactgcttataataagaatcagagttactctgcctttgatggttttttccaactgagcaccacattaaaatctataggacaataaacttacccaatcagatacagtccaagaaagaaaaacattcatattgctggggcctgggaaatgcagtatgtgatttgccatttcaatatgtcaatagggtgataatttgctttcaccagatttcttaggaggtgtgatatcttttatcttcagtggctgattcttcctggggttggggagatgtggggagagagatttttttttttttcctttagacaagcctcaaagaaaagtaaaagatgcatttctatactgctctctacaaatcaatgtaagaaggggtagacttacattttccatgataggaaatggcttttgaaatttaagattagatccatacaaacaaatggtccttgcaaactgtcagtcaaagtaaactcccccaaatatgattctgaagcagagggtgaggtgctaatggctgtcgattggaatatcggtttgacaaaacacacctagaaaagatattgacaagctcttcattgttctagcaggaaagagactcttgaaatcaaccccattgctcctctgcctgccttctgctgagaaaccaaggattgagcgaatttatcacccgggattgggggcaggaggagaaggggacaacagaggatgagatggctggatggcatcactgactcgatggacgtgagtctcagtgaactctgggagttggtgatggacagggaggcctggcgtgctgtgattcatggggtcgcaaagagtcggacacgactgagcgactgaactgaactgaagtgaaaaccgatgagtctgttggcttgatagaaaggtaatatcctgttcatggtgattaacagctcactacaatctatactgtcaccctgcttatttaacttatattcagagtacatcatgaaaaactctgggctggaagaaacacaagctggaatcaagattgctgggagaaatatcaataaccccagatatgcagatgacaccacccttatcacggaaagtgaagaggaactaaaaagcctcttgatgaaagtgaaagaggagaggggaaaagtggcttaaagctcaacattcagaaaactaagatcacggca

SEQ ID NO: 44825 - DNA, 4152 bp, Bovine  19866880373525
aaatctatctgctttctgcaatatttttctctctgtgtatctatctatcatccaacatttaatctgggtatctagcatctattaatcatgtctgccatccatccatctctgtgtctatctgcagtccattatcagccacaagttaatacagtgagtagtcctgtacttaagcctggaccatcttgttccaaggggaagggggtgggaacagtggtgatttcaggagggctctgtggtaagaacaaagatggataggaaagaaactgcagggttgatgaaaggggtgcctgggacctttctctcacagctgggctggcctgatggatggaggggagagaggcacaagagaggagagaaggagggagggaggcctcctaaacccgctaatccctcctcatcctaccttcctttgagtgtgtgttaagtcacttcagtcatgtctgactctttgcaaccctatggactgtagcccgccaggctcctcagtccatgggattctccaggcaagaatgctggagtgggtcgccatgctttcctaccaacccaggggatcttcccaacccaggggtcaaatctcttacatctcctgcattggcaggcgggttctttaccaccagtgccacctgggaaccttcccagattagaacaatgtcttttcaggataaccccatgagggatggcgggatgcccaggttcaggtcagggcagaggaagtgggtgctaccctcctccagcaccagcacacacagaaccctttattccaaagggctgacctcctgcaggcaggctgagagcagagatggggagccagaggagagatgagcaggagcagtctgaagaagacccatcccagcccttcccaaccctgagtttgtgctggtatcacctgcatagcttttgaaaaacaccataacaaaaatatggatgcatggaccaatttctgtctcaggggctgactgggaacatctgtgttttgaaaccccccaggtaaattttatagcagccagggctgagaactagcatcttgcaagatccaagactcctgctgttacccttggaaggctgtgctttaagcggttcttcaggggcaggacttgggctctgtctgggcagggactccagggagcaaaagagggaattttcttccaagctgcctcctgagcctgacatggggaggggtcagaggctggggtcttctgccagggtattcaagcagtgtcatccccacccagggtcaccagaagtccttgtcatagcacccaggagtgggggctgggtttgggggctgcagcctctgggttcagctgtgaccctgctgtactagactagcgaggttgaccctcaggtgagtgcacctgccggagaggacaggcagctcttcccacatcccaagagaagttaagccccaccctcagtgttgaaaaagtgccatgagtcagagagcgggaggtttgctgggcactgcacactgcattctgtctctggcagtggcaggggtaggggatgggggtggacccatgagcaccactctctccatgaggctgtgggaagatctgtgggcaatgggaggggcagcccgcagccaggcttagaggctgtggcctgctggtctgcaggcactggaccacggcacagttctcccactcagcagacacgagccccctccacagttaacagagtgagcgctccaagtgcacactgttacttcttccccaccatctgcagctgcgtctgattctctgccccgcaacaagatgttccttggtctctcctcctcttgtccctgctcccctgtggaccacccggcccctgcccaccccctgcagaagcctcccccctttgctggaataaagcccggctttgtctgtctccttgagagctgaggacaaactggccgtaatttatgctcccgcatgatataaaggaaaaaaggcgccattatgctataaattatcctgtgatgggtgaaatgctggagagcgcgccagacgccagcggaaaccccaccagacaacaggattcggctgcagaagtccccacagaacgcggggccgtctgtcgtgcgccgcgcctgggaaggataaggtagcagatcaaatgtataatcagctacctggagagctggccacgctgccgcccccatgaaaggtgacttctactcagcaccaccccgggccccaggctcctgctgggagggcctggcgcagactcacaagatacgggggtcaagggcggaggcccagagaaggaggcagcgagggatgtgggtatggcctccagaccttccacccatccccttgcagagggcaaaagaagagggtgcaggggccatttgtgccccctgggatggtgacggcccccacattccacagttctgcctcctcagatgtactgcaagcacacaagggcacagagccatccctctgtcccaggcagccaccagggcccagagggatgtggactgcaggccgaggggatcttgtcagcaggtctgattctctatgtgatgagggaagaggaccttgaggcctagatcctgggcagaggaaggcctgaggactcatcaggacagagctgacttcttttgtcacccaggagacttccagagggccctattctaggcggaggagtgagggaagccggggaggggctgtgagttgtgtctaagggtctctgggcagttgggactcaccagagcctgctccatctgagctgagcagcggcctctgagggccccaccccaccccacttcgggctccgatcagaagccctgatccacatagatcaatgggcttattaggcctttgcccattatctgggcagacccagaggtgtggagagtaaagagagacagagatctccaggtagcacttcctggtcttctaccaagaaggagggtgacctgagagcttggctcctttcagaccatctgggtcctggcttcccccagtgactggctgtgtgttcttgggaaagatatttaactttcctgagcctcagtttcttcatctgcacagtggaaataataaaacattcattatacctgcaaagggcttatttccgtgctggaggtacagtaaatgggcttcccaggcagcgctagtggtaaagaacctgcctaatgcaagagacctaacagacgtgggtttgatccctgggtcaggaagagcccctggagaagagaatggctacccagtccagtattcgtgcctggataatccccacggacagaggggcctggcgggctacagtccctggggtcacagagtcggacacaactgaagtgactgagcaaacacgcgcagtaaatacttgataaatgagaaccattctgttagtactgtggctcgtataaccatctcctggagtgagtcagagttgtggcctcccccggacaggggcactgaggagccccgagaggggggtggcagaggctctggtagagggagttggggccactggctcttgtcatgaagacacttgggtgaccattgaggtgggtggccctcagtgtccagcaggaccacagaagaacccctggtgctacaacttaggagctaggctgagccaagggaggacgtggtgggcagtgaggatggacacgggtgaggaggagcctgcgtgcagagtctgagtcccaggctaggcttcctgcggtcagtggtcagggtccaggctgaggtctcgggggaagtgttgagaatgcggtgggcgaggaaaaggaaggagggaggggatgtgtgtgtcgccccggctcttcagcctgtgcctgtcacactgcctgcctctgcacatgccttttccatgctgcaagccctgcgtgtgaatcctccagtgcccggctcaagccttgtaaaccccttcccactgccatgcccgcagagctcctcacgacaggctgtgtgcctgcaccatggctgctgcccactcatccccgcttttggaggattcctggagttcagtgtcctgcagatgccgagcgcacgatcttggggacaagaggaggacgggcagtgtcagtgtcctggggcagggcgtgcaaggagcatccctgagacttcacgagacctgtgtgtgtctgagcagagggatggagggattaggggagctggagtgcggggtgtccctaaacccctcacaagcttgttctcg

SEQ ID NO: 44826 - DNA, 1115 bp, Bovine  19866880468953
cctgggggtggagaacaagatgggcttctgcagggtttgggggtcagggaggctttgacatcagggccacctcactgccatgcttaccattcacttggtcatttttcaatatctgtgttttcacacctagaaaacagatcagctctgtgccagacagtgggcaaggggctggagagctgaaccaagcaagtcgatctggccctaggccccagggtgccatcctttaactccctgtttccctgacattaagtcccagtgaaccagcttatacattttcctggctggactggcctaatcttaaagcagaagtacccctcctcccagttcagggcttttcttctttactgattgagttgaataatttgattaataaatcaggagaatttgcagtgggttttgcactttcattagggaagatgtatgtggtgtggctgctgtttggccgtgtgtttaattaaattaatgaattaacatctttggtgctgtggactccaggtgcacagacccccctgttctttagtccccaggctttattcagtaagattcctaaatttaccataaatagatttagaggaaagagttggaacttacttgttcttacactaaaagaatggaacctagtgatcccaaagtgaagagttttcaccagtttgtgcatttgaggttaatcctacctagcccacccattcccaacctgtacctgatcctgaatcactcccccttcagagcccttactcactcctcctattcacagggggacactcagtcccacacactcattccccttgaggagaccctgcatgatcatagcttgaccatggagttcttctagtgagagggacacttcaatggggactaaagggatcccttaccagctattgttgctgttgttagctgctcagtcatgtctagctctttgagaccccatggacccagcacgccaggcttccctgtccttcaccatctcccagagcttggagatggacatcaacctcatgtccatcgagtgggtgatgccatccaagcatctaatacactgtcttccccttctcctcctgccctcaatctttcccaacatcagagtcttttataatgatttggctcttcacatcagg

SEQ ID NO: 44827 - DNA, 775 bp, Bovine  19866880480509
acttaccctccagggtgccctagcctctcccatgaccctttcctgggtcagagctttgaagcctcccaaaggcttcacgtgccaggaccccacctcactttgggcccccttgggagcaaagcagagtgagtaaggcagccgtgaaacacgaaatcagctgtgccagggcgtgtttgtagaattccgagaacactgccgtgatggactctaaatctcacaactgagagtgctcgttttctgaaggttctgaggaccgagggccgaggccgggcggcagggggcaggcccgcggcctccctcagcctctcggcgctcttagcggggaagcccttccctggggacggtggccactgcgggcccaggacagggtgggaggccgggttgtcgtgagtgtggaccgtcccgggcagctgagtgttttccagacggacccccagacacagcagtcaccttaggcagcctctgacccaccaggcaaatgggagccagccggtcaggctccccttgctgaccacaggctgcagccaggaaggctggggaggtgaggcacgctcagcccctgggggagaaagaaccaaggagggggtcaaagcagagagccctgttcccctgacctgctcgccggccagggtggtttgaggggctgttttctttttttctggccccctcgccaaactgcctgcgccctccctcctgttacccggagcgtgacggatgcccgtagtggccctgtgtgaggttctgctgttgttcacagtgtatcacctgtctgcat

SEQ ID NO: 44828 - DNA, 1770 bp, Bovine  19866880488392
tgcaggaagcctgggtctgcaagagacgggagaagggagaaagcccttaatgggatggggtcctccaggaaggaggctgggccagggagaagtttggggggcagagagaagcaagtggccagggaggagaaagacttgttgcatcagaaagtggtgaaaagcagaaaaaataaaaagactaaggggagccacaggggaggcgagaggagcgtgatctaaaccacaaatccgcctcctcccggctccggcaggcttcaccatactgtaagacccactgccgaacagcaagcctgctcgatgacaaagagagataattggttctcatgcagatttaagcccaaagttatcaaataataatggcacgcagaaagagacacaggcaaatgggcctggagtgcccgcttcttccaggggaagagatttgttcaaagtatctaaattatgctcctgcaatggaacagggaaatggcgcattttttttttttttttaagatttttctggtactgcttggatacatttttaaaagttcttttataattagggccgtaatttatataatttattttaaaaatatccttttcttaatttccacccggtccagttaaagttgaactgaaaagcccagagtaaataatttttttaataaaaccgtttaaaggagccccaacctgaagcgaaatagatatgtggattttcagaggagaaaggaaaaaaaatcacatattgaaaaaataaatttcctaacccattttacactccagattttattaccaccggaaggtttttaaaattctaattccctttgctttccttaagctgtttattcaccacagggcctcctggggcctgggcctggggcccagtgggtcaatgtcagatgagtggccaacacagtttcactaccccattcctcctacgatttgactgttgatgcatcagctttgctcttcaggtgaactctgagctccctgaggtcaataccatgcccaaggacaaatctccctctccctctctgtagcatctagcacagggctatgcatacagtaggtgctcaataaatgcttgtcactgatgtgccacgtgtagagaagctaggatcatgtgaacacaggcatggtggtggcaatgagcaggtatgactcaggagccaaatttcacagaataacctagtagatcaaataggagagagaagtttggtcctggttaagagtctgggtgagtgaatgtaagaacagagaaaatcagacacattgagtaagaacggtcatcacctagctcaatggttctgggagcctttttttggagggaggctgaaaatgtaggaatcccacaccacgacccgaccgtggacacatgtttgctgaacagccacgtgactgcagagaagcccatgaggacaaggctcggccccactcccagcctgctcccaccctgtctgggggtctccccacctcccagatgacggacaggccctgagtgagaaagcccggcaggcagaaggggaggatgggccgttagagttgactcagccagagaagacttcctggaggccagaagaccagagcttacctttggaagatgaagggatccacatggggggccaggcagggaggcctttggtccctctcagtccccattggaccacacgcagcctgtccactggttgggggatggcgaggaagatggacgttcccacctctccggtctggggaaggcacttttttcacttttgcttgggtccctgtgccagtgagctgtaccaatcccag

SEQ ID NO: 44829 - DNA, 1754 bp, Bovine  19866880489881
ggaaatgaggcctctgcaagggggatgggcagcggaactgacgccaggtgcaacaaagatggcggccggacagctgggaagaggcagcctgagcagacgggcgtgaggacttggtcttctatactgatgcgacagccctgggggtaaggagccctgagggactgtgaggaacagcagagaggcacgtcaaggtgttactggctgtctgggcagatgggtgcctacaatgatcctaactggcgccatcaattgaattttcttttaagcccagactagagcagttcggagacatttaaattagaaatgtattaaataaacgttattaattatattatttggaaccttccactctttgctggcaacatgatcagccaaaacctggtagaaatgcgtccaacttttctgtgattactgcgtggctctcaaagttctcattttcagagattctgctttacatttttaaaaatcttaatattttggttcatttttggctaagtcgggtcttggttgcatgcagcatgtgggatcttttcctgtggcacacgtacttctctctagttgtgggtacaagggctcttcggtagctgcaacgtgcgggctctgtacctgggggctctctggtggaggcagctgggatcggtagttgcagcctgtgggcttagttgccctgaggcatgtgagatcttagttcccggccagggatggaatctgcatcccctgcattggaaagcagattgttaatcactggaccaccggggaggcccttgctttatgttttatgatatgcaatgaagatacacatttgttgtatcctaatcgtaaacacctacaatcaatttaaaatgcccctcttggcctatttaatgctttgtttgcaatttctatccctgttccctttttgtgtacatatatcttggctaagcatttaacctttatttctgaccttgtttgagttgtatcttgtgtactgtgagcaaacataaaaagcttttgtctattaatgagggagttaattagattgatagcttttttccaaactgatacatgtagtggacattgctgtcctctgctcggtatctcttctctcttgctttgtcctaaaggacaccagatctttccaggaaatcacccgcggtttggggagaacctgactccaccctcaacgagatgggcttgactggtgtaaatgtaaccccatcccgtgccagtgattgactcaggaatcggtgggtaactcaattctggccaagactcggaaaaggaaatgagattgagggtttttctggagaaaatgtctttgtctctaagggagccacagcaaagggcaatctcttgtcttctgtgagtcttcatcacgtctggacgctgcacgtggagctgccatagggcatgggctgtcgtcttgctgtctgcttgacaacggagccctcacaggaattgcagaataaagagatgagaagaacctgggttcttaaagacaatcccaaacttctgactcaatggccccgtggctgtcttatgtcttgcattcctgtcacataaaattaggcagatcttttttgtttttgtgcttcaagccagtttacatcagagtttcaatatgtgtagctgagagcactttactgacacatgtgttcatttttcatctttttaccttttatgtttctatttctttctttctttctttttttttttttttggttttctgtcattgatctttatgttgtattttctttggttttgttttctcttga

SEQ ID NO: 44830 - DNA, 2044 bp, Bovine  19866880513019
ctgctggctcctgccccctcctggcagcccagttactcacctttctctgcacacagaggctcctcaaacagccagggccaggcctccagcaatgcccccgccatgcagcggggcctcatggaggcagcagagaccccggccctttgggggagagccatcaagtaagggagggagctcagacggcaggcggcacccacatgcccagaggaggggtccccaaggtgggggcagccagaggcctcagaggaggtggcacctgagctgattgaaggaagggacattccacacctagggaggtggagtggccggaataaggcccagtgcggggagggccttccaccacaccaccagctcagagtcccgccggttaacaccaggctcacagccaggtgtcgcgaggcctgccttgctgagctccaaacacaaaccatttctccctcacttgccttggaggcagccaccttccaactccaagttgctaacctcatctcctttctcccatatatctcccgcgttgacacttgccccaaaccagattaatcagcttttttatccttcctgtggtagcaagggggtgggggtgggcaggggaaagagagccaaacctaaacatctatctattaattgcacattcaatattagacagtgagatgatcctgagtcagcatcatcaccaagctctttggaaaaaaagaaagtttaaaataatttaatatccattaaatacttcttctgtggagggaggggaatgggggagaggtgggtgttaacaaagatgaaagaaatgggaacaggagacgggagatggaggcaggggtaggagggggaggggaggagaaatccaacaggaaaggaagagcccagaaaggagaaggggaaggggcagaaggcggaggggggcctggggggaaagcaaggaaggagggaagaaggccgggagccggggagacttgggggcataggtgtgggggcgagaggaaggggtcctgcagggagaggcaggtttatccccaccctggctctctgcatcccgggttacacaggctaggtgcttggccggggctccccaggaagagtacaggatggtggttcttgttctggtcctgggttctagccccatctttgtgcaaaatgagctctggcctggacaccgcttctctgggcctcctcgtcttcacccaaggacgagagagctcacttcccagggaagctggtgtttacagagcacccactgagggctggcatttatttcattttatttatttttcttttggaggcaccttgcagcttgtggaatcttagttccctggccagggattgaacccagacccttggcagtgagagcagacagtcttaaccactggactgccagggaattcccaaaggctgggattttaaacgcacacatttaacccatacaacaactttgggaggtggaagtttggccccgtttaaaggtataaacgaaggcccagagaggccacgtaacttgtttcagattacatagctatgtggtggccgagccaaaattcaaagccctgcctgtaagtcaccagaacccagatgctctgcattcctcagactcctaggataatctttcggactccggggacaatgggaaggtgccacgggcatttgtcttacctctgggctcattctcaaagtaaataaggggcaaggagcagggtcccaggtgagggaggcaggtcccggctggacaaggagctcccggacgtacccataagacgcgagcgaccaggactgcaggggtcagagataagagagctcattgaggagcaagcagggagggcttcccagaggtgaaaactggaccaagaggtgtagatgtggcaggagacagggagggcacgaagtgaaaatggagccccgagctcagggccagggtggggcgcgtgtctcggtcagaaacaggagccactaacgccgtgtggggaccaggcagagagagggcatcagagctctaatatccctgggcaggagaggagacagccccaataccaagagccagggttccagctgtgaa

SEQ ID NO: 44831 - DNA, 1035 bp, Bovine  19866880526529
cccaagacctgaccctgcccatatccttgtgttccagcaaagggaacatggatcccctgtggttgtttggagaaacaataaaattgaaaaccatctaaagatgtctcagtgccataatgcttttatgtttaaactgtggaataccctacaacagtcaataagacgaaatggttctaaacgtccaatgtggaaaggcgcgttgtcagttgggagaagcaagttgcacagtagcggacgccacgtgtgtatatcagagacatctcagagactcccacacgcacccaaatctgtgcctacgccatagcataagggctgtgaggattcccgccaagctgaaaacagggacgaagcgggtagcggggtgtctctcatgacttcaacattttttgttttgtttgacacatttagacccagaatgtattcataatgtcacttatataattaactttaaagaaaagaaactttgctgaaagaggaagatggagtgcaaaggaggtgggtagaaatgggtgagccagacaggatgcaggacctgttccgaggagatggacaaagtcctctggacattagcctcctggcaggttcttcacgagggacattattttggtgggtcctgcaatggccctgggtcaaagcctcctctcagctctgggactcgaagcggattctctccgcccagcaagctgtatgtggtattcgtttgggtcctgtggcccccgagtctcagaaggtatctgggttggggtgagaatagactccatgctagaatggagaggcctccctctccccatacctatcccactctccagtttatctgagacccaaccggatgtgtggcgctgatggcgggacctgaggtgaaaagttgcgggagtgactgggaacatcttgggtgaggtctgacctcctcacccctcagcccccgtcttctccatcccccggtcttctccatccctcggcgtgcgatgtttgtcccagctccagctcatcacctgagtctcccacccttcaggatcggcactttctagccaccgc

SEQ ID NO: 44832 - DNA, 1043 bp, Bovine  19866880546085
ttacaggggggcatgaagagagagaagaatgtgtgtgtgcttggggcaggggggctggggggccattattactcatccacagttttccacacgtgctaatttgtgtttgtgcctgaaacatcagaggggggacatccgcatattttaggcttggcacagacctcagaaatcagccatgccaactccttcgctgtgctgtgaggaagccaggggaaagacagggccacagtcactgggtgacttggtggcagaggtgggctagagccaggctttgtgatggccatccctgcctttctgcccactctgtgccctgggctccagaagtgggagagggtcattggtggaagccccagagctccctggtacactcccatcccatccccagcacccaaacccagtgtgggaggctgcctgggcaaatggtctcttaaactgtttcaaaggatcccaaaggtcccctgatcctatgaaggactcatccacatgacctggggcctgaagggctgtagaaatgtgattgtagatgggccaggaaagcccccaagtcccagtgctcactcacatgcatcccaacacctgacgccttggcattgaccctctacttgttcaaaccctggactgaacattcactagcgctgtggcagcatgatggggaccaagtgcccccaagaaatgtgtgatgtcataagactcttgcctccgagtgggaagggatgatcccaaagacgttgtaagattgggccgaagcctctgccctagcccaggtttgtgccagcagctctaggcagccccgagatatttgaaaagggtttttgggttccagggagccggccaggctagaaggtatgaacagagaggaccaatgacctctaggctcctgctctgctctcagttcctgtcaaccacctgcccacccaggcccagctcgcttcaattattcagggaaaaaatccaaagtccgtcaccctccacctgccaggtccataggtaacctagaggcgttctgtaccagagaaaccaggtccaaagccagatccaaagtt

SEQ ID NO: 44833 - DNA, 1285 bp, Bovine  19866880578588
tggtcgcctggctggagccccccccaagatgcaacaggggcagagaagagggtatgtgaacctctctcaggccacccagccctgccccctgaggcgagcccacacccacaggcggccggtctggctgccaagcgtggcaggccacaggaacacgaggctcctaaaatttatggctagactttatgacaatggaaatatttttttaattgaggtttgcaccaccattacactgctaatttaattattccctatatttcatccgtcaccatctgatcctcaggaagcaactagcttgtcttcttgacaagaaagcaccaaattgattaaaagcatgtgtgggagccgggggctgggctgtgatttgctccctgtggccggacctctgggtgcccaggggaggcagaaggcagtggaaagcagacagcagatgtctcctccccaccctgcccagcgcggtcacctccggtcaacccgcaccctgccgtcacggtcacacccacgcccacgcgcacacaggcgctcaccctcacgcacatgctcagacgtatttacagacatcgcctcaagtagaacagcaaaacactcggccccgcccacacccaatctgtctccctggccacgtgcagggaatccaccctggtcccaaacacacaggcgtgcactcgtgcacacacacacacacacacccctggagagtctcacatggctgccttgcagaggacactgtcaggacctcgtcaagagccctcatccaccctcaagccccatggatccctctgggcaggcccatggagcgttctggggatcggggttcgcttctgcacgggactcggggccttgagcctgccttatgccctgggtgaggggtggggtggaggtggaattggctgctctggtccaatcattaccccaggatatgccataagatgcctccgctgcccctacgggtgagctgggggcacttgtccacgctgcgtggctgggcgggtgcctgccgtgtggcaggtgaggtgcccagggcagtgtggcagtttctccaccagattctttctcttcttcattcatgacaccctgatgctcctggagccctgagaatgagagagtggccggtggccgccccacagctctggctggcatgcgcacacagcatctctgggccgtccctggccgggcttgattttccaacaaccttgtgcaggtgggtcttctcgccccacctggagggcaactgttcccaggctgttgccaggggcgggggcggggggtgcattattgccctcttttc

SEQ ID NO: 44834 - DNA, 3440 bp, Bovine  19866880633912
atatgggacatagaaactacctcggaaaacataagacctgtgattgccatgctcactgacacactgggggaaagacattttccaaaagttggctagatcattttcaaaaccgaagagaaggtaaggatatttgcaaaaattacagtttaatcacagggtaggaaagaggctgctgaggatgctagtatcttccagaggaggttgtattccttcagtgagaaatcaaaagtgccagagaagcatttggaatgagggagatagcttatccattgggcggtccattaacctcgttcttccagttccatgatgttaaatagcaattaaaacatcatgcacttattttctgccccaccctccaggacacttgaaatcactccatattttaatcataatgggacatgatgttagagccaagaattgcaaactcaacagattagggaattttggggggaactcacatgaaggacacatttttactgcaggatctgaaaattatcttcaaagaagtttcaaaaactatcctataaatgtaacaacccaatcacatccttattgcttaaaggaggactaggaaaattcagttaatgttgctgtcacttctaaggtattttcatttgaaatgggcactgaagacacctctaggagaaaagcctcctggaaacacacaacactctggtcttcatgagtctgaacctgagtgaatttctcgccagcactgcaccagcacgggtctggatcatcacacccctgctgttgctttgcccatgtggaacttcattccctgtttagttctgcaaaccctaacatctctcaatgtccagatgaatttgccctcattcaggaaaacatcccttgcttctttagcccattctcatctctctttcttgttttccttttctttctaaacccatttagggacttaccgggtggctcagtggtaaagaatcctactgccaatgtaggagatgcaggttcgatccctgagttgggaagaccccctggagaaggaaatggcaacccactccagtattattgtctgagaaattccataacagaggagcctggcaggctaccgtctatggggtcacaaagagttgaacatgacttagtgactaaatagcaaacagcagcaatggcatttagagcttaagcctcctaattaaactctgaattatagacctttctattgacattaataatatgattttaatgtaacatgttagacactattgctccaagtacacaaagctcatatcccaactagagagtgtaataaaaagagcctgataagaataactagtggtagacttttctgaaattgtattgggtcttcatgggtgatatttgggctacggttcccttaggtgacatttctgtctcaagaataacttgcacatctacgttagtgtgtgtgtgtgtgtatgagcatttatttagctaactactcattaccctggagaagcacattcgattaaaattaactttaaaatatgaattgaatgcatactaaatgtacactatggtgctaagtttgtgggagatgggtggtaagggactggagacagacacttaaaaaatgaagcagaaattccactggagattctgacttttctgcatacgcttcttgtgaattctggacatacaatcatcccctagtgggcacaggagttgtgagtgtagagacctcttagccatgcgggcatcagcacagaataactgtgatgttagatcaaatcacaaacttctttggtctttagatgtgacacactaaaaactgatacagagcaatcgtttccagagtggtgttcacaatcagaggatggataagatgattcattggggtgtggaaagagaatattaaaactgatactaacaaaaggataaaactactaacatttaattttctatttgacctgagagccctctctcggtggtttagtcacatgactcactgtggtcttgagatgtccagagggattggtgagaattccatacttcagagggtttggtggggtgccatcgcgtctttattctcttttggtttatatatggccaggtagtggatttgtgtattctgttatcttttcctagctaaatcacccttcattcactagagaagtgacaaaataatcttgtgaggatgctgtgcactaaaggcaaggctaacagtacaaacccagagacctgcacagtgagtgcttggtggagccaacacttctctttatgcctcaggctcccatggcacctttattaggggaagatgtaaaaatgggtcaggcaatgagtggcaaggtaagtcacttctgaaaatgggtgcttagaaaggtttccttccctgtgtgatgttgtcaccaaaagtgatgattaaagctctcatacaaccacattgaaaatatatatataaaattccctaacctgcttgacattagataagctagaaattgactagtgaaattccatagttttgctcactgggtatgtaggattgaaaggtgaactcatgacacattcgaaggctttggcatagtcaataaagcagaaatagatgtttttctggaactctctggctttttcaatgatccagcagatgttggcaatttgctctctggttcctctgccttttgtaaagccagcttgaacatctggaagttcatggttcacatattgctgaagcctggcttggagaattttgagcattactttactagcatgtgagatgagtgcaattgtgcagtagtttgagcattctttggcattgcctttctttgggattcccatcacttcatgggaaatagatggggaaacagtggaaacagtggctgactttatttttttggactccaaaatcactgcagaccgtgattgcagccatgaaattaaaagacgcttactccttggaaggaaagttatgatcaacctagatagcatattcaaaagcagagatattactttgccaaaaaaggcccatctagtcaaggctatggtttttccagtggtcatgtatggatgtgagagttggactgtgaagaaagctgagcacaaaagaattgatggttttgaactgtggtgctggagaaggctcttgagagtcccttggagtgcatggagatccaaccagtccatcctaaaggagattggtccctggggtgttcactggaaggactgatgctgaggctgaaactccaatactttggccacctgatgcaaagagttgactcactgggaaagaccctgaagatgggaaagactgaaggcaaaactcgattctgctgcttgatccaaccatccactctcaggtattcacccaagagaaaacaaaaacatgggcgcatacaaagactggaaatagcccaaacgtccaccaacaaatgaatacctaaacaaactgcggtatgtccatacaacggatatactagtcgggaataaaagtatactaacat

SEQ ID NO: 44835 - DNA, 1792 bp, Bovine  19866880645858
aagagaaatctttcaggctgggcaccagggaaaagtgatcttgatgccgtccgtggcgtgagccgaggcaattgatgacttggcattctgtctccgagtcatcaatcatacagaatcaatctcggctccctcaggagctggcccccggctcacataattctctctccctgccaccaacctgaacagtctgatcccagtggtgggaactgttttgttctgcgttcagcattgattcacttggccttcagtagtattttctacattccccagaaatgtcacttaatttattctctccaaggtggctaagttgcctgggtctcacggcatcaactggggcaggcaagcagagaaaagtgtctgcttttttgtgtcaaaggcacaggccttggacccctagcctgaaagtcaggactctgctcccaggctcctgtgttcttctctgaggatgggcaggggatcaagcccaggggatatggcctgttatgtcccacagccttgcgtggtttccgtgaattctaatacttccaagctctgtgatcttgaacatgttacctaatcacttaatgcctcagttgtctcttctgttaaatagtgataggaatagcatctacatagcatctacatggagttttaggattaaattagatccaggcaaagttgcttagtatggtatagggcagtatgatcagtgtctcttctgttaaatagtgataggaatagcatctacatcatggagttttaggattaacttagatccaggcaaagttgctttgtatggtatacggtagtatgatcagtgagtgtaagttattaatactgtgattattaggaaacaagatgtatagggttgattgtatttattataatgtcagtggccatgaggggaatgaccttgagaaagtgacctgtgcagaaagaactattcttcttttttttaatcacaaataagccttttcattatttagcttcttgcactattcacataacagaaactgataaacccatgttgctatttaatcactaagtcatgtctgactcttttgcaaccctatggactgtagccttacaggttcctctgtccatgggatttcctctgtccatgggatttcccaggcaagaatactggagtgggttgtcattgccttctccaggggatattccccacccaggggtcaaacccagatctcccatattggcaggctggttctttagaactgagtcaccagggacaataccaacatatgctttagggggaactcaatttcaacctagcacaatagacaatggcacaagttagagaaattatacagaaaagaagtatgacttaaaatcacggagctcaaatcatagaagctacttccataatccagtctatgataagaaagaggtgaggaggttatcagaccaaaaccttaacttcctttattgtattgttgctctttgtcaccatgtgcttggaaatgtgacttaagaaactgggtcttctgctcttaagtttcttgttggacctcacagaggccaggagtgcctactggtctgggggagcccatttacattcttttaagtcagtcaattcttgcttagatgatgcaggtgggaaaaatgatctggacctacaagttttagaaccaattccagtactgttgtgccaaaactcttggataggaggagggatacagagggaaagaaagaagaaaagtggagtcttctgaaattctaaacccttctaaccttggggaccccgaagccatttaaagatgcagcttgcagtgatgacaagcgttgctaagaa

SEQ ID NO: 44836 - DNA, 1370 bp, Bovine  19866880647596
ctcggtggccggtgagccagcacgagggactggcttgattttgcccttgtctgctttactggttcaaattgaaaaaaaaaaaaatttttttttattattattcttttgtaaagccaccatcaaaagaaataaagtccccgagtcgctctccgggctgcggccggactcagacacccgctgcgtgcgctgccccacacgggcttcgtttgcagcacttcccgctgcagaagtgcggggctgggcggcacgtgagggagagggccgagggtctggccgcccagctcggactccgccgggttccccatcgggcccgcggtggccgggacgtcggctgcgccggagagggagtggctggcgcgggagctgggttcgagcagccccgcctctgggggccaaggctggtagtgaacttgatttgggaaagcagattttcctttttaatgatatttacctgctccccatgctctcctatattggcgtttccaggacagcctcttctcggcttcagaaaccggacaaataagataacgcgccgctccctcgcgggttgcggggcagagctgatggtgtgaccctggactggtccccgtcggtccctttccggtgttttgcgtttctctctccttgccctcggcttacgtgacgttactagacgatatgtttaaaatttaaggttaaagaaatgagaccctagctgcctgaaaaccgagacccagcccgtttggtacagccacgacgccgccaagctctccagcgccggaggaggccccgaggttcgctgccccaggcccggagtccagccaggacacctctccctgacgatcccgagcccaaccctaacagcaagtacagttctgagaattgtggaacttcatcctttcattttaagacactcctgcctttgcttgatggaatcttgtgtaagtagagtgggttcataactcggttcagggcttacattatccagtgttatctgatggtctaaaaaacgcccaagttgaaggactgcaacagaaactcacacggagagcttccctgacatgtggctgtgggcttggtgtgcccatgaagtgctctaataaagccccgtgtcccttgtagccacacggagggcttgagctggtggctgggagatgggtgcgtatgtctgtcaggattatgggtgcttgtgtggaggcagtgtggttatgtacctagaccctgtttgtatctatactctgcgtgtgtgtgtgtgcatacacccactgggctaagacctccctgtcccctttcccacaggacacatcagcagaggccaataactttgttcaaaacctcacttccaacattatcctgtggcgctgatacttactcccagaatcacacaacag

SEQ ID NO: 44837 - DNA, 1148 bp, Bovine  19866880656419
gcaaatgcggtgccatggtttcttcttctatccagtaaatgctgatcaaatttaagagaaggagcaggcagcttccaataaagaaaaattaaaaagtttttctctcccggtaaattgtatcattggattttgtgataattagcacttcatactgtattatagtgatggtgtcagatcaacagccaaacagaattaatgagttaaatatctgtcagcaggaagcttcaggtctgattaagggtgctgcaggtgtgtgtatgcatccatttcttttctttttctttcatcagggtcagtatattgaattgtcagagagaccatcatactattagcatcaattatcaatgagtcaagaaattatgatcccttatcttgaccgtgggagagaataatcactgacataataagaagacatgcaaaaatgaaaacgtaaaacatctctttagtgtcaaagtgagtaattgaatgaatgatgcctcaaatcactcattctagtccaaacactgcttcaatatagccatatagttttatgacataaaaatttcagttagtgagttaattctggggaaagtgaaatttaccaagctatgcattttatgtacatcactcatttcatccttacatcagcagtgtgagtctatctttttgttctagtttcatctgaggaaatgcaacatcaaactgaactgcccatcttttattctaacaactaatatttatgaaacaccttctctgagtctaattacatactaagcacagattaagagaagatatagcagaagagggaaatgtcaccagtactatatggatgtttgagtgaagttacagttataaagaaaaatatgagaggaaatagataaaaaacgaaaaacagaagagggaaataacgaaatggcacaatgtaataccagagctgtcacaatgcattatatagttgattgtcaaatgagtggcagagatagaaactgctattagtttaaaaaaagaaagagaaaatcgtgggctaaagtggcctgagaagattgtaggataagagagttgacccttggtcaagaagaatggtcaggatttggatacaacaagaaggtcagtaggacatgacagggcatttcagatggggaatggaaaagaaatgtctgggggcagca

SEQ ID NO: 44838 - DNA, 2445 bp, Bovine  19866880669423
gagagggagcaggcggtcacatggctaaccatcaccaccaccaccttcccactgggcactccagtgcccaccctgggggaaatagagggataggttttgtcctgggcaaccccaggtgggaaggagcctgcatccttacccatctttagctcacccctctgagtgtgccctcccccaaggacctctggcccaggactttcccttgcccccctgacacccagtgctgttgttctagtgtgactttactgagaggttcaggggagggagctcagacaggaagtttgggcattctccctggtctactggccccagagcctggcatggccagttagcttggctagcttgggtcaccaggcagataaacctggatggtttcctttctatctccctgtgttctccagctggcctcaaaggtaatgaggctggatatgtcccccccccacgtccctgggcccccaaggccagcccactcccacttcagtcatcaccgacctgcatcaccaaaggcaagttcaccaccggtccatgcaccatccagccttttgcccaccacgtctgcagacaccacaaaggcaactgaagtgaaccgagcctgttccccggcccagcttccccgggttgcttgccaaagtatcagcctctggtcctctggcactgggtggtgaatacccagtcatgagatcaggtgtgataagacccttggtcttctggttccctggtgtctgtgggcactgtggggcagatctcatttgtgtggtcggtcctaccacgggcgtgcccgggaatggacgacctctgtgcctcgtgcaaactcctaaagaatttgggaggaggtccctctacttgagcaggcgtgggtggcccagagagaatggcagcatgaggcctccatgctctttcagcttctgcccccagttgtgctgggcactaggaataagtgaggaggagaccaccctcctgacagcctctggcctccttgcctgctctcaggcagcccttctccagggccaggtccctcgggtgtctccccacccagcccctcatggtcgagccctcctctgttgtctcctccccaccctccccagccttctgcatgagccccccaaaccagcggcagcctacatcccccaaccagggggagcagcctaccaccgtcctgagggccccagactggggaaagggcccccctcccagccattcagggggcctgcctcagatgtcctgccccaggacagggaccgcggtggccgggaaggcagtgtggccgcagcagcatctccaggggcgtggcgggggaggggctggtttgggcaggcattgctgacctctgtcctttggctcccctgcagcgcagagccccacagccgcggaccccctgcagcaggcctacgcccggagtgcagcagtatgcaggtcgttagtatccacgcgtccccacggtggtccccggctgcgtgcacctccccgtgcctgggcatcgccccacccaagcctgggcttagcagtgtggggggtttgggggattggggagggaccgacagggagccgtggtcctcctaccaggctgcctccttctctgcaggcgtcctttggtgatcaggcagagcttgcctcaccctaattcatcctggcagtggtggggggcgttcagaactccatttgagctggtgagctgggctaagctttagccttgctgtgaagcggcatctctgaggccagatgtcctgcccccatggtgctgccagggcgggtctgtccaggggcaccaaacctcccccagcaacaccacgtgagactggagctggggggccactggcccagaaagcacagatgccggtttgaaggaggagaagcagcttccattcccctacccccagctacacacaggcaacaggagtggggcccgagctaggaggtcaggggaggacagaccgccagaggcagaaaaaaggagaagcgggcaggtggccttgggtcactgaatggggaggtgatgagctactgtaggaagcccaaggccagctgtcagccacacttctgtctacctctgggctagacaacacacacatgtgtacgcacacacacacccacagtcatctctgccagccagggtcctgctgtctggccccatcagggtccctcctcattgtgttcagatgagctggcagtgtctccctggagggtaacggggctgcctggtacatgggggcccgcatgagctggctgtcacctagagtccaggggaagctctcttcctcacctgctgacccccctgaacccctttgggagtcaggccaggctgaggagggtctagccagtcctgtgcctcctctgaccctttttccatttgaatatagaaagcatcagatttgttcaactcagtcttcggcccttggggaaccagccactagcagggtcccagaggccaagctcacacctagggtg

SEQ ID NO: 44839 - DNA, 996 bp, Bovine  19866880697990
aactgcgcatgtgccgacataaaccctgagattagagtctctgttctccgggtgagaacagccatctctgcagtttgcagctctcctgccccagggggtcacctctcctgcttccccaacatctctgctgcctcctgcttacatttctcctgctctgatgtggtcttcccaccccagagccccgttttgtgttttctgggataccagtctccccctccttcctactggtggggcagaagggatcagccattgaaatggacttcagcttagctttccccaactcacttatacaaaaataaacttgatggaagaatgttatccatttcacatcctctcttccagttaaaaacaaattagcacctgtctatggaatctggaggatactgatttcatatagaatgaaatatttggacattttgagttctggagtgagcactgtgaagctgggacctctaggtactaggtactaggtggcagtgtggaagagccgtgtggagcagctgggaaatacaggaaacagtacctaagtgtctggcaccccacagacctgatctttgctgttgctcagttgctaagttgtgtccgactctttgtgaccccatggactacaccgcgccaggcttccctgtccttcactatctcccggagtttgctcaaattcatctccattgagtcgggtgatgttatctaactgtcttattctctgccacccccttctcagtttgccttcaatctttcccagcatcagggtcttttcagatgagtcagctctttgcatcaggtggccaaagtattggaacttcagcttcagtagcagtccttccaatgaatattcaggactgatctcctttaggatggactggttggatcttcttgctgtccaagggactctcaagagtctccttcaacaccacagttcaaaagcatcagttcttcagcgctcagccttcttgatggcccaactctcacattggtacatgattatcagaaaaacca

SEQ ID NO: 44840 - DNA, 2680 bp, Bovine  19866880738613
ccgaacaagatggcccagggctggcagggtcagtgtgctctcccggccccagcagccgtcagaggtcagggggctccctgccctggaagggaggccaggagggcatccaggctggctgtggctctgggcacgtgggttcctggcatctctggtcttccatcccccgttgcctgcttagaggttattttctctccctgaccctgtctgtgtatttctgtgtcaccaatatctgttttatgtattctcgggccctctttcctccatttcctccattaatacttctcgttcagggcaggataaatagggtcataatcacaccataaagtgagccatgggctgtgtgtcgcttattgcccaggggtctgctaattggaatttataaagttcaataaaaactataatccaataaggcctgaaactcttcttcatttatcttaggggtaatattcagcctacccgcccacccgcctgcctgcctgccagccagcagtgggaggccggggaacagccaccaaaaggaccttccccaggggccacagagtccccaggagtggccagcactgagtcaagagctcggtggccaagcaagggagagtgggagggcctgatggggccctgtgatggccatgctctagaggcctggggacccccacagtcctagcattgtctcttgcatcattacaaactctccctcagttacggcccccacctaagcttgtaattgccctcccccatgcaaacccccctgaaaagcctctgggagactcagggggtctgtttcaaggaggcctatgtaagggtgatggatctgaacctgggattgcaggtgccgtccctggccccagggtgtccacagagcaggaagtcatcacaccgtgtacatagagctatgttccgtcacccagttgtgctccatcaggcacccatgacaagccgtccctcactccctaccagtgagggaggcaagtgaaagtggagaggaggtgtcctcagccccgctggggagctggacccagagacacttaaaggagtgtgttggacaagagggtgaccagttgtcctggtttgcctcaaactgagaaggtccctgtacatgtgacattctgtgttcaaggtgcaacagaaaaatgtgactaaagaatgatccttgaagtgggctgagtggtggagaaacccagtggagctcacctctcctgggcagttcctgggaggatcctgccggtccctttctggcagccactctgagaacaatacccttttccccaaaacacctcctgcaaaaattgtggtttcccatcacctcccaggaagccctcatttaaaacctagagtgtattccctccagcaaaaacgcacatgagcctgaatcccaaatgcaaacagctggccccttgctggacattctgagtggtgagagggagcagggcactcagccagccaattccagccttccaacacggataaggggggagtcactcattttcagagcattcctggcttgctcacggataggtggaagacagagacctccaaaaccagctgccccgccctggtccccatgctgggatgagatgtgtatgcatgcgtgtgcaccccagtccccatgctgggatggggtgtgtgtgcatgtgtgtgcacatgcgtatgtgaggggtgtgtgctgggatgggtgtgtgtgcatgtgtgtgcacatgcgtatgtgaggggtgtgtgctgggatggggtgtgtatgcacacgcatgtgtgaggtggccgtgatgccaaaaggagaactcacagtccccacagcctctcaggcctccgcagtctcacatggagacgatacaggcctgtgattgtcctaacacatcccccgagggagggaaggttggtcaacaggtgaagttgctcaggtgccaagctctctgccaagggcggtaggaggatcccaccacccacgtcacggccactgcagcgtgagccgccctttccgagtcgaaggccttcatgaccagaagtttaacggaaagctttggagccagatctgcctaggttctaaatcagcttcctgccttgtctatgatgtttagccttgagtcagtcatttaccagctccacctctcagctcttacaaaatgctgactgcagtgcctggtccacgtgtagttaattctagctactcttgagggtcatttatgttttgtgtgaaatgccaagtgggataagggttcatctgtggccacagtcagggcagcccctgtcttcccctgggctctttactggccaggagccaggttagggtcagcatggggatagaatggaatgaggactggagtcatctaggtatctgacttggactttgagatcaagcaggaattccaagaattctccaagtgttggaagaaagatccagatgggtggagacagagtcctccagcaaaggaaatctgagtacacaggcctggaagggagtagaagggacggcctggtgcaccaggaaggcagggtctgggggccctgtgtttagggtaatgggaagtcagggaatgtttgtttgtttttgtggaagaggcagtttgccatttggaccaggaaaggtctaacacacccgaaccccaccaatccatcttcagcctccccgacctcttcccttcatagcctcaatcattcattcattcattcattcactccaccaaagtgt

SEQ ID NO: 44841 - DNA, 1182 bp, Bovine  19866880740927
gacagaggagactgtgggctatagtccatgaggtcacaaaagtgtcggaatgactttgcaactaaaacaacaacaataacaacacacacacatacattgatccagaaaataagatgaaattgatgtacagggttaaattgtagaggctaactttatgttcaataaagcattttaattttcagaaagaagaaagaaatgggaaaataacaaggaggcttccgtctgagatcccaaggcagaggtaaaaggctggaagagaagataaatgtgagctctctgcagagaaggagaattgctctccttaacccaggcaggggagaataggtcctaaggaaagaaaggtttagtaagactttctgaggcttcttagtcttctatgagttttctttccttttcttttttttttggaaaacatcgaccagaaagctttgttgtctaggaaagggtaaaaggatgtctggttgaattggaattgacaaaactaggcaactcagagagggcagtctcaggagcagcctttaaccacaaaagagatattgaagacgatgcgatcgatagaactggagcgggcacgggaggaagatgatgaaacccatcaaattcgatcactgggcagaagtggtcagcgtcagcttcctcttcaagggtcactcgatgtcagcctccattcaggggctttcgcctcccctgctgattgcattcttaggaccataaagttggaacgtcgagagggaaaaatgcatgctgcctgctccaaacttcttgaagtccctttcacagtggcctatctgggtaggttttctggattcctgggttacagagactcaactgcccagactacacaagaggcaggaccactctacctgaagacacattcatcattcattcatctgttcaggtttattcctatttgcagacgattttaagaaatatggctataaatcctttgcagcttcttccatcaagaggtggagtctatttcccctgttagatcaagcactcttcttgatctaacaaaacagggagagacacgtgactgccccagacattgccatcgtatctgagctgagacaattgtgcaaactccgctgaatgtgtgtacagaaatgggctcagctgggcccaattccaaatgctttcccacagggttcttagcaaacaaaggggctcaaaataagtatt

SEQ ID NO: 44842 - DNA, 1909 bp, Bovine  19866880812226
gcaaagtaatgtctctgcttttgaatatgctatctaggttggtcataactttccttccaggagtaagcgtcttttaatttcatggctgcagtcaccatctgtagtaattttggagcccagaaaattaaatcttactttcaaagaacactttggaatatactcctcacttgatgttttttaagcaaatcagctttaatagattctctaataataatgccctagaaagtttcttactgtaatctggatgtttgataaaccatttcatgcatatatgtgtgcttagtcactcagtcatgtctgactgtttgtgatcccatggaccgtagcccatcaggctcctctgtttaaggggattctccaggcaagaatactgggagtggtttaccatgccctcctccaggggttcctcccaacctaggtatcaaacctaggcctccctcattgcaggcagattctttaccttctgaaccacatgacagaagcaaattctcctacctagtgccactgcatgaactgtgaacttagctcttcatttttagttttttagtgactgaatcaacagcatttgtaagctgagtctacaaatctaaagttaacaataaatgacaaacacaggaatttgttaatgaatagatattggtcctttcattaacttgttctctggtttactcagttaaattttggagattggagtccttgaaatactgactcttctaggtattaattcctcatacactcccccctacccccgacacacacacacatctctcttaccatccccactagcttttacctgtatgaaggataaatatcgttacaatattagcaaaactttcttaaagcaagttgaccagcatttctctgtctccaaggaaataaaacatttaattagcctttgcctttcaatacaataagtacagagagcaataataccatttttctaactttgagacaatagcttgtgtctcttgtgtctcctgtgtctccagctgacagtgtcactcctgcaaaatgcatttccctggaagataaatgaaaagtcagtcttgttgtatactggaactatttgttaaagcaattatgatcatggtctaagacattgcccttgggattaatgagagtccaggaggagttgatggtccaaaatgcaaagaaaagtcattataccccagataactattaagccctgtggatggcgaggcaggcatatcatactgatgggcctgggagggacagcaaaagcctggtggtttagtgaagatgtgaattttccagttcctttgaaaaggactgcttttctacagctagttatttaaaggcatatctcacattcctgctcctcatcagcagtatgaagctgaatgctttttactttatagcattcaacagaaccattcctactttgatggaattgacactaacttctcttttttagggcttccctggtgattctgatggtaaagaatctggctgcaatgcaggagaccagggttcaattcctgggtcaagaagatcccctggataaggaaatagaaacccactccagaattcttgcctagtgaattccatggacagaggagcatggcgggctacagtccatggggtcacaaagagttggatatgactgagcaactttcactttctttttatttatcttcattcccttgcttactacttacttctattctgtaaatagccattagtatccagtacttgattgcttatacattggaagggtaaagcagaagcagcagacagtaaacacttgttctctagggtctctggcaagatctttgccacttcagctgaactttatgtgtatataaatatgtattattttctgagagaaaatataaataagtctattcatctaaagaagtatgtgccaacagagggttcaaatagaagg

SEQ ID NO: 44843 - DNA, 1345 bp, Bovine  19866880884207
ctaaagtcaagcagccgaaactcaatgattttgttacgtcttacacaaaaccttacaagacataattttatgaagctggtcacaaatcacccaaacataattcataacccttgccctttccctttctcccagttgcactccaaatcaaggggcttgaggaatttcctactcagataccattgaaatgagaggttgtgaatctgacgatgagtatatttcaaaatgatatactctccggagctcaattcacagaaggttccattactctgtcccctccctccctctggatatagtatgaaagtatgaggggctgaagtctctgaagctgtggctcccggactggcagcccctggggctgctagtggagtatagtttcctccatgcagttgaggaaaatctcaatgcagaagggttatccaggccacagatctgttctgactggttaacaagagggactgtgatgaggacttggctgtttagattaaaatgcatcgccggctctgggaacaagcacacatcagtagtaaaggccgtttaaacctttggggacagccttatgtttagattacattaattcataaatattatactaaataccacttaaattggacttaaatgacttcaaagataatgcattataatatggctatccagagagcactagtctttatgtctcccagtaactcagtctttgctgcctcctatcctgctagacaagaccaaagttatgaatggattgtggcttgttcatgtgtgatccactaactgcatgtgtgtgtgttaacggtcacgcctatgtgtgcatatgtattttcagtcctgcctctcttctccaggaaatacaaggaaaaaaagagaaataaataaaaagtgagcgagggaaagaattagactagtgggtgacctgtttcttcctccaaaggagaaaatttctacaggaagaggcaacattggtcctcagctcacttttgctgctaccctgggagtttacctctctcttctttaatcaatagcacaatgtctttctctttggagcctggaaaaacaatctttctcaaagtgcttctaacgggggagaaaaggagactctgagttggctgggagagtttgcattaaactggattgtcttccctaggtgttgtttcttcagattgttctgggctttttttcttcctttctctctctgcctggcacccagatctccctttgcccatttgctttcttgtctccagggggtgaatttacctttacagtaatcaccccagtccacaactgctatttgctgcctccccagcccaacagcctttctctgatacggctgagtttgctccacaacacccaccta

SEQ ID NO: 44844 - DNA, 738 bp, Bovine  19866880906938
ctatgctgggagcgcaaactaagggtgggggacaccagaagcactgttggggtcagagagatggcttgtttagcaggtacttggactctgttgctggtggaggcagttgaatggggactgtctgtccttatgtcatctgcctgagcatgttgtacaaacaagtggattatgtgacccaattctccccagaacctgttagcaatccactttccagtgatactgctaaaccatttctcagcccatgactcttcacaggcacatttcccttcgtaggagagctggtgcttcctcatcatatttactgcctgcaactggccttctacctaccttcttgagccaatgggatctcaggagccaaaccctggcttcctttgtttgaggaacaagtggaagccagcagaaatagggggcttgcccatctctctccatctgatgcaccagccctttgcaacagggagtggcccagatgtaccactgaaatgtggggtgaggtctgcaaaagtgggcatgagagaggaaacgtggcttctgtttcggctttgaggagccagcagtgtgatgaaacgcttgcctctgttccaccgaattcatttctctaaagttccactgtgcacagaaccatttgtttccacattgtttttattaaacaagaaaggcgagctttattactgcgcaaatgaaagcagccggcaaagacagatacttcccagattcttattaatctccaagagttatggg

SEQ ID NO: 44845 - DNA, 1594 bp, Bovine  19866880922790
caccactccctcaacaggcatctcctggtgctgacacccctggctcactgccctaatcctcttcaatattccttccatctgggcttcaatacccagaacactgaacttaagtcaggggtgggtctttaactttaagttgttcccccctccccaagcaggagaagaaaccatatttcaatgacaaatgtgtctatcccttgcttaggaattttaaaggggaaaaaacacacacagagaaaaaacaaaacaattcccacaaagcaggcaggattagctacttaatgactcagtggctgtcattggcacatgcctccctcccagctaattcttttacactaatggctgctttgggcaccataaattatatacctgttttgactgaaaggagtggcgtgacaagtggtaaggcttatcaaaatcaagtcaacattacaaacgctgtcagcacaatagacagagaggcaaggtgcatcctgatgactccctgatgaaacatatacagaggcttaacctaatccctgaaggaatgacaaggaaaataaggtgaaagaccaattagtctctttccatataatcttaaaccgactggttggctgtttccatttcctccactgcctgactcaccaagtaggagccaagaggtgacagaagccagttctttctcagcagagccaccacctgacatttcctggtggacgatccacctggctttcactggattttttaaaaaatgtgtcctatctacccacaccctgtcttttctttcagaaagctgaaaaatcagcacatttgtctccattttattctaagtgggagaaagtagtttttgaagagaagtattatttctctctaatgccatccatcagttacggagtgccccctatgtgttcacccctgttagggattgtggaaaatagaaggaaaagaaaagcaatattccttggcctctcagagttgagagtctagtgtaggggggacaactctactttaggaaaagaaagtctaaatattgctgctacttttcatatatgatcaaattaccttttgtattttagtagtaatgtctttggggtttatctagctctacatatggacatgaactagacattcatctccctagagtcttctatttagtatcctttgtaacaaatgggatatatttaaaaggatactggtcagggtttacagtagcatctgcagtaatatttagaggctgagaccagaaataagtaagtatatggcttgagtcatactgttctgctgcagggagattatgtgtccaaatggaaagttgacgaaaggtcaatgagactgaaactggtaaaagattatggccaagttggtagttttagaaaaaaaaatatttgttttctgcaatggcaatgatgtgcatgattctcaaatggacaatccacttttcctaaccaacttatccatataacccgctctgaaagagttaggaaaccaccagagattattcacccctgggatatagatcagtcaccaaaagtcctgggcattccagcaacctaagtcacttccctagaagtggagcaagtacatttaggagaagaaacccacattcatcatttta

SEQ ID NO: 44846 - DNA, 1821 bp, Bovine  19866880931990
ctagctgttggcaccagatgaccctgaagacccaggaggtctgatgtcacataaacctgtttaccctttccctctctctaaacagctagttagtgctgacctctggcctcctttccttacctgtgcctgatattcacgcttcataaatgagctatggaaattcccaagggctctgaaatttaggactgaaaagcaatgctctctgtacaaggtcagggaagtagaagcccactgccttgaagcaggtactaaaaatgctgcctcggggtgacctgactggtgactggtgactgaaggtgacctgactggacactgacttgacagatcatcacacgaggaccataactgggattctggatgcttcaaaaaagatgttggaaaaacctgagaggatgacagagaagacttactgacccgaaggtgggatctttcaagcagattgtatatagagagctgtgtctgcttgaatttgatccctctgctgggccactcacaaggttgctatccttgggcaaattactctttcttaagttttggttcttcgaggtaacttggggttataaaagcaacctcagaggattgttttacagatatacttagctgggtgcctgccatagaatgttttcaatacggtatgtctgtttaataaaaatagacgacagatagatagatagtaactcagcaaaagcagaagagaaaggagccgaggaccaggtgaccaagcatcagcacgcatgcataaagggcactcacatatgtacacaaacatgtacacaaacttaagcatgtacacgcatacaagcgtcatgtgtgtacatatacccagagcaaacactcaaacacacacatacatgtgcatacatgtccaaccttgttttgacattctgagtctccaaaaattagcatcagtctccaatatctatacctatagccaatagtttcctgctctaatacatcccccttctttatgacctcctggagtattgctgcctcctgtgtgcgctggctacaactttaggaaaggaaaaactgtgacttggctggaaaagaaaaaccataccctttctccactcagcggaggcatttgactctggctacacaatctcttaggaatggattttgccacttgtatatgaaatagtccatcccctctacagatagcatctagaggcccttagtagaaatggtaaattattgttggctgaaagacctgatgctctggagtcgtcaaattctccttcctcattcactcacttcagaagctgcatgaaccatgtggaattaatgccatgactggattcactgctacgtttattctcacaagtcaaggagggtgcaaaggggcctgtacctgaacagcagagcaggaggcaaggtgatccatcagaacgtgtaagaagaaacaagagaggcaatttgacaagaaatttctagactgatggtgtgttggctgccgtggggtccataagcaaaagagacatagaaaatccatgcaagtggaaaaataatgctgacaatacaataccactccaaataagcctactgatctgtattgagtggttacaaagtacctgactctgtgatgagttgtttggcatttacctaattgaatcctcacaacaaggtcagttaaatattaatatctcactttacagatgagaaatagggaattaaatcacttgccccacatcactcagctgaaagacatcattcagtgtcttaaaatggtaagaagtcaaaattccaactgagtgtgactgatttagagatgatatatttaacacctacagagcctgagcttggaatttctcctatgcgtat

SEQ ID NO: 44847 - DNA, 897 bp, Bovine  19866880939137
tcaagagaaattgctttggctcacatgatattttttcagccgtcagtcatttcttggcatttgatcacatcattgtctctgctcccatcatattgacttcgttgtctgttattaattgaaggatgacttttctttcaaaactacaacaaagtgcacaaactctggaagatggaaaaaaattcacttttacttttactacctccttgactgtctggtcctgtccagagtcacttaccttccttactgatctacttcgaatatcacaaatagatacgttctgcttttaaagacatacactatgaaaggacacttcccatgatgtgacttcagtcacgacgtcttcaaatgtccttatgaaaatacaaacttaacaacaaaattcccttaccatgaagtgagaatactccatggtacgagaaataaaaactgataacctgtcacagcctaggtgcatcccacaagcataatgttgagtgaaaaccagacttacaagatgcacactgtatgcatcaaattatatacagtccaaaatcagacaagactagtcaccaatcttagaagtcagaggactggttaccactggaagcagtgactgggaagtggcaggtagactactatgctggtgaagttctgttctttgatctgcatggtgattattcacttttttaaaaatcccatcatgctacacacttgtagaaaccttttgcatttttgttgtgttttaataaaaatggactaatttaatttttttttcttttttagccttcaccaattagatgttaaagtaagagacaaggagactgtagggtgatccccaagtttctctcaggcattgctggatgagtgtgaagaaggatgtaggggaccctttttgaggggagaaggggtttggtttag

SEQ ID NO: 44848 - DNA, 672 bp, Bovine  19866880957041
cagagagagagagagaggaaaaaaagagaaggaaagaagtcagcaggatttaaaaaaaaaaaaaaggctgataagaatctggtccaggtcttagaaccctgagttaccagtggtatctttcagctcaggagccggtgggggaggggagctggtgactgaggccctaggaccctcagcctcaggtcaggccaggttccagcctgaattttggcccaggaaggttctgagtcctgggttgcctgtcctgaacaccctcccaagttggcaaaaactcttctctcccagcagctagtccccgctgttcaggagccggatccccaagctgccatctcttgcgttcccaagatccctgaaggggtgtggaccctctggctgagcttagcaacctgcagccccagggtccaagctctttctcagtatttcaccaagcctaatggagactgcacatgtccccttgatgagtctgctcagggaaaacaaaaatagcacctcgctgcttttagcgagaattatatccactccgtggggctaaccctggttgccatgtgctgatccgcagctctgattagcctttgattaataaaaaatggggataggaatcaattatttatttaataacagcagtttgttttaaaggcaaaacctttaagaaagtggaagactctggggtgg

SEQ ID NO: 44849 - DNA, 1080 bp, Bovine  19866880974133
atgccagttacccagtaatctgttaatctagactctttctccaaaatcagtctcaggtctctaattcttgactaaagggttaaatgaatggcatcagttaagtatagtgctactcagttttcatgttatcagagaaatcttaagttataaaacaaaacatctagaggggaatcttagaccttcaactgaagtggactcatattgagagtgaaggactagaaaggccttgttaaacctcatcaggaatgtggtcccctgcctttcctgtgcagtcctaacaaccagcaaagggactaaaccattgcaacccatgtcacaatgtgctccttagcaatacacttgactgctgggtcttattcttttactttccctggactcaactttcccagatggacatcataacaatccctctttctcctgtcaagggtgtgtcctaggaacatttcatttattttcaaatcaagtgtcaaaatccttcagagaatagtaccatgtgaggttaatacgactgccttgtctcccaggaagtcacttctctgaataatacagtgaaattgactagacatttccaacggagaaagaggtgtctttgggttagatttaagcatacaggagaattaatataaagcagtgacggttcagaggccagctcacccctccttgaaatttcagtgactggaaaaattagcctcctgtttcttttctgttccctttttttaattataacttgctgaggcactagctaataccctttaatctcttttaataactaccctatcctcggtttctccaagcatccttctcaaggcatccacaaatccaagaatgctcttaagattgactgactgactgagctctcagccctgttgatttactgacatgaggtttatttctccagccctagctcagccgggatgaaatacagcaaggatgtgaactctttccagacccagcaaagggctagccctcaggaaatttgggagaaaggcaaagtgtagttttagctaccccttccctatatttccttaatgttctctctcttacagctctcccctctcctctttatcatcttccagcagc

SEQ ID NO: 44850 - DNA, 1342 bp, Bovine  19866880979489
gaggcggctccagttaggcgagggtccggcccaggtgtggcccctggcctggggcacttagcagaagcccatcgtgtatgtggggggagggggtcctgcacctgtgcaggtggggcctgtgcagggctggggctacggggacctcgagcccgaggtttccgtggggctgcagggggcacagagcagccccgcagtcaggctgtatgggtatctgtgaggctgggccgatgggctgcaggctgggagtgggccaggcgcctgctcctctgaacacacccctctgcacgcgggaggcggaggcacttgtactggctctgggacccccggttctcccctcaggcaagaaagaccaccttgggacgggtcacctgtgagaggcccggggaggaaggacccaggcctgggcactgcgactattttttgctgctcccttattaccttcttttttttttttttctggttgtcaaatgatccttttttttttttttcctttgcagttcttaactagcggggcactccactgcgccactgttgatatcatctatgatgtcatgagggtggcggccatcaacattgcagcccacagactgggcggtccccaggatctctttaatggttctagaaagttctctagctagagaccgattccgcatctgccaggcaatgttgacaatctcatcaaaagtaatgtttccactgtgcttaatgtttttctgcttctttctgtcccttggtggttccttgagggctttgatgatcagggcagaagcagaaggtaccacctcaatctgggcttgtctgttctggtcagtttcattgtaatcctcagacccttccaatcaccagttgccttggcgatatcatcaccaaccttttttgtagacagacccagagggccaatcttgggggccagggcagatgtggcaccgacttccccaccggtgcacctcgggtacacgactgttatctcgctggggtcgaacttaggcggcatggtggaggcggctggtgtcagacgaacccggattcgggacgaccaaagcaagttgcacctttgcctcctcccagcccaaagccgaaaaagctagcgtatcctttttaataacacaattaaatcttttagaaatacaagataagaaggaactacctcagaagtgaatcttagtgaacactagactttaattaacaaaactagaaacttgctttagcaatgaaaaaaagttaatattcagtgaaacataatttttccattatgagggcattaaccctgtagccaggggaaggctttaacccatcaaataaaaatgaaggtttgtcaggggagcccagaaaagccaggcag

SEQ ID NO: 44851 - DNA, 1981 bp, Bovine  19866880988197
acagtcttctgtgctctctttgcctctgtagtgtcataaaggataaatccctgtgtcccattcatcttagatcgataaaaagtaaagttgatccatttgagatgtccaaacaaagacagataaaaatctattggcaaaaaggtcttattaaagaaaaaaagaattattttcagctaatatggctttccatatggatgaatatggtctcaaggcatgaaagaggaaaaaacttctgtgttaacattggcctctggtcctatttcattattacagattatcttgactttactgattgaaacacaaggtatcctcaagtgtttaggtatcataaaaatcaggctggggccatgatctgtttttaaccagtcactgctggcaaagaaattaaaatttgaccttcacacaactgtttatttgaaagagagaaggaaacatagtagtagagaaagctgtcagtattaggaaatgtcgggaataagttaatagcaaccaaggtagaaacaaatcagaacttattatttaaattgactatttcattaaaacagaatctttaaaatgaaataaaaaccttacatatggaagtttgccatatcagaggcttaagatcaaagataacacagaattagagttaaagcttaatatcataaattgtttaacattaactactaagagatatattcatttaacctttacaaaaagtatgaaatactgtgtggcctataaatttaccttcttgccaccaccttcagcctgtggccccagtaagattgaactgccagatgagctcaattggctgtgatgcaggcatccagctctcactccctcatgataccacctgtcttccccagagggcagttgtgtaggggcagggaaagccatttgagaatctgtttgctaattaatttttaaaggaactgacaccagtgattggcagcagtcacttcaacatttatgcttagttgggacagttgtagtgataatatatattttttaaagtgacattttaaaccacctataatcctcccacccactgtacatgccactgtaaatattttagtctttcgtgtatttccttccaatccttttttttcttttacatcttatatacttctctttttttaaactaactttttctaaattgtgaaatatctggaagtttaaaagcaaaactcttctttgtgttgatcattcccatgagtaaataagaaacaggtaagtgaaaattagcagtgctaaataaaatcacctggatagacctatcagcagcgttgattgttggaatgagaacgtacatgtttctctcataagttatcttagagatgctatgatatgattgtttccaataaaatgtctcttcttttttcttctttattggatcaaaacacaaatttaatgcaaagtataaatcactactataaaatatatgcatattctaaacatgactcttaaatctgtccttaggatgaaaaaaatatgtattaaagttaaatcatacaattagaataaattgctttgtaaaggaaaaaagattgatcaagtgtaatctgcctggttaggagtactacaagacaaggtttgctggagtataccactcctatctgggcttccctggtggcgcaggtggtaaagaacctgccaatgcaggagacatgagatgtgggttcaatccctggatcaagaagatcccctggaggagtgcatggcaacccactcttgcctggagaatcccatggacagaggagactggcaggctgcagttcatagggtcacaaagagtcagacatgactgaagtgacatagcacacacacaccattcctatttgcccactaccgttctgctttgacagttttcagaattagaggcagctttgacaagccatattgctttaccttgtggccatctggagtttgacgtaagaaacttaagctaagctccaagcctctcttaagacaccaaaataaggtttgatttgcaccttag

SEQ ID NO: 44852 - DNA, 1470 bp, Bovine  19866881004663
cctctttgctgctatccctgggttaaagctttgctttaacccatcagtgcacgagtatctccgcctgcaaaggaggaggcagccctgggagtcctctggctctgatcgacggccacccctgctctccgattgtgtcatgtgtgtgagtcatgtctccccagccagacagtgacctggccgcctgccgcagcagccacgtgctcctttcctccagagccccatggcccgagcgcacagtggggactcagagggagccactgagtgataaatggattggagactcaagcatgagggtgattgaggtcaacctttggtctctgtgtagacagtgcgctcctggagcaaattaacaggctggcaaacctaggacagtcacgtgcagcccatggaacgtgaactgtcaacatccgatgtgaattcaagcctccctgggtctgtgtggatgagcgtggcctggttctctccatggaaagcaatgctcacgcctcccccacattccccggtcacccacgtcagtgtcttttgagaacctagcagagtgtgagcaaacagggagaggagatattcctggatccttgcccttaagagcttttcatttccaaaagctagtcctttgtgtctaattcaaagctctcttgctgtaagagatgccactatgccggggacaacaaattactatgcccattagataggtggggagactgagtctgggggcaagtgattccctcaagatcacagaaggggctggtgcctaagcagggaccagactctttagcacccctccctccatctgcaagtgcagggcagagcgcctggcaggctgcttcaccgggggatggccgggcagtggtgactcctgtggcccattaagaaaagagttgttttttccctgctgccgccagcccgcccgtgaaacaaacaggatatttaccagggagaaaggaggagccttggctcccagtggcccctacccttgcactcctagtagctttgactccaaagccctgccttatgaagggcaccattcaaaaggcaaagctgctcctgcaagtgtcaggaataagtggggaagccgggagtggagactgaagcctgggggagggagcagctgcagccaaagaacgtgagaccgaatgtgtattattgcacgtgggagcatgtgagtgaatgtgtgcgagtgtggatgtgcgtgttcccgcacgtggggaggggtggtgagggagagtctgtgactaggggatgctgtcttttacagctcccctggtgatgttcatggccacagagaagcctgtatcctgccatgttttgtcaaggagactgaccagagccacccgcatgcctgactctctcaatgggaaaggctcccttgctttacttctccagcagaaacgacccacacgtgcccctgctccttctcgcttctgcagtgagcacagccaccctgcaaacctcttctggcttttcacggga

SEQ ID NO: 44853 - DNA, 2225 bp, Bovine  19866881039747
tgcatacccggacaaaggagagcacagacaaggataattttttttttttgggggggggtgtctgcctccctgccaggctcccctgccccacctctgccctcgcccgtcctgctccagccttcaccctcctcacctttgcactggttattccctcacctggatgcccttcagcagactgcgggccccaagttcagacctcagctcctctggaggcctcccccgacaccctcaagccctcccctaaggctctcgctgggtcttgcacaaacctccatggtccccatgggtatttcaggccaaaaagacatcagaccacaaaagcacacggtttgacccagggggaccaatgactggagcacagggcaagtgggagaatagatgggagatgggctgggggcagacgggccgggggtccagcgagaggagcatggaggccagcaggaggggcagacgggggtcagaggacccgcgaggaggctgctgtagccactcaaatgacctgtgtggatgggccgaggccctggggtgcagagcagaagtgtggggtgtggatacccgtgcagagagcctggcacaggcccgggtgccagccggcggagaaacgagggtcagggtcggcaggagcaaagtcagaaggtggcttagctggagacctgagcgagtcgccaaaactccaggcctccacagttctcgcctagattgatgcctttcaggaccttggagaggtttctgccagaacaggcaggacatgcacagcctctgctgggcctcaggggccctcctgggtggggcccttccagactcgggggtctcccgatgtgctggggtccgggctctgtctcccccactcccttttctctctgtacctctgtcctgtccttgcctccttccacgtccatctatctgtctgtcgatcctctcccccggcccctgctccacacacctccctgcttttctcttcgctgcctccctaccctcttgtcactctcctttcaattaccataacccagaacagaagaatattttattatttggtgtctttattaaatcaagttttatgtcccctgtttttcatttttaaagtggatgagtaccacactatattttcccattaaaaagcaaaagctgaacagagtggtcaggatggccccaaggtggtttcacccacaggtcggttctccttgagaaggtggggggtgttctcctgggccacggggatgctgcctgaatcagaaaatccggagtctcagcacagccatggcaacatttccagagaggccctgggacgaggccctgtgcagagctgggcaccggtggccaatggagacggactgcagcataggggggaaggcctgggtgggccgccttcaccctggagccccggcctgggacctccaccaccatcacaagccacacaagtcagggattcagaagccaaatgattccttgcagcctcaaatctcagcacctggccccaaaaggcccaggggtttgctgggagagtaggtacatttttacctactcatggggaccaggatgttttctggtttaccttgtgtgttaccactcacaggcccatggaagaagcatcttcacggaggggtctcaaagttcccccagatgtaggtggaaatgtccaggtctgctgcacccccacgcagcccgatcacacacccctcagtctgcagtgacgcatctcccccactgtgaatgccaagccaggctgcatcctgtgagaccaggcttgttctctctactcctcaagaccttcagaggctaatcaccagactcagtttgactgtctgtaaaatggggcaagaacaccacgtctcctacagttatcgggaggggaattgagcgcttggtgtactgcctggaatgcaggaggtgctcagcaaagcttgggtcctcccctaagagtttgtcttaaaaaaaatctccaaacccacatccttcattccaatcaccatcctaaggaaggtccagtctccatcacccacctggtccatttgacatctgcaccttaaatcttagcaaaggtaaactcaagctcgtcacctccccctcctccctaatcctcagtatccaccctcctgataccctattactgtcaatgacatcactgccatcaagcctttgagtccccttagatgacccctggtccctcctgctcgtgacccatccccagtggtccttcccccgcccacctcattgctgtcagccgg

SEQ ID NO: 44854 - DNA, 594 bp, Bovine  19866881068883
acctcctcggctctcgctgtccgccggtttcacctggatcggccggttcatctgtaacagagcacaggagggcagcattagagcaggcgcgccggcaccccgaggtgcgccggtgttcaagggacacagcacactgctcactccacggacgccgacacccacggccccagcacccgcgcgggacaaacgtgagggtctcactaaagccccgccccctcccctccccagtgcggtccccacgaccctcctgatttcaggagggtgtctcaggactgaagaccctggggtgtcccctgccagccgttagcggctcttgctaactgtgatgtcggtccacccaggacacagctggctttgccgagctgctctctggccgaaactgactcccgcctaggttggggccctgcagcgagtggcaccccacccctgtgccatcgacgcttggcggttggtcccaggggtgcctgaggctccgggtctcgcagttcccggttggagcagagctcagggctggggctccagacggcagcctggctgtcgcctcggtggggtgggggcggtatgtgcggggtgggcagctactcgtctcctgtg

SEQ ID NO: 44855 - DNA, 1670 bp, Bovine  19866881130809
accctgctccttggcagtaaacccccgcttgcctgtgctatctttgggtctgagcccggttctaaaccgaagtcttttgtctcctattgcaacagtcctggaaataaaatctgtttttactgctttaagcactgtccagctccagttttattttgacagcccttctcaatcccaatcgggtttccacattgcaagatccaccttcaaccaacccctgaccttataaatgcctcccccttgtgagacagcattaaggccatgaggatgatgggcagtagacttggctttgcttgatcagtgggttattctgctagtcttttaaggagacaggctgaaatcacatggttttcaaggattctttgccatcttggagtccagaagatttggaatgtctggttctggggttgtaacatttctcatctgagactctaggattctgggatccccatttccagggttcatgctgtgtctgacctgagtcctgagggtcacccaggggtaggaggatgggtcaagattctactccagcaaggctgcaggccagatctttgatcttaaccacctcctccagggagcccccacccagagggctcctccctactgccttcaaggtgacctgagtcttcctgtcggtcacatccttacccatttccccccttcttctttcaatattttatttttggccaggtaattagcatagctcttctcattaatattatatttaaaaaagaaaaggtgacggtgggggagagaggaggttgggagggtggggcttgcacatgccagtaattgtcttgacagccggagatcccggtgcaatgaaagtctactttaagtggcccaattagcataagaaacggctcgccaaaagttctgaaggcatcgtgttgattaatgcaatttatcttgcaaaccagcggcagacagctgaatcgctgctaatgattattatatacatttatacacattatgtacatgtggttcctctccaagaagtggcgcctcccccctctccttctgcctgtgcccctggctcagtagacccctgcactcggctcccgctgccccaaacctccgcccaggtctccaaagtgtctcctgcgtcctcaactgccattgaccagttgccgaaatgtgattcgaagggactggttttaccctgagactgagcctgtgtctagaaaaagtattttcaagaagaactttcactgctcagggaaagctccaggtggccaaaggagtggtccccagattaagtcagactagcgaaaacagtctggacacaaagcaagattctaaaggcttggccggcggtgcagtctgaacaaggggcgtgtgctctctggtgctgccagtggccctcttccttcctgctcaaatgtccagctgtggactacgatcctgggttccacatcagggtcctgatagctgcaagggccaggccagggctctgtaggtggggggttgtgtctgggcaaggccagggcagaacaccaacgcaatccaccagacagaggggccatgacagctgtcagttctgagtgttcatctcattccaggaccgtcctcagagcttacacattccactgttcagtctcccaacacacctcctgctcgttctacagaaaagcagcgtggagcccaggcagcctggctccaaagctggtgcg

SEQ ID NO: 44856 - DNA, 1418 bp, Bovine  19866881143573
tatattatttttacgattttgcccattttcaagttgcaagtaaacacactgtgattaaatcttaatatttttgtttgtataaattctataaatatctagaaaatttccataagaaagcatattttcaaagcttaaaaattctacttagatatttttccttctcatatattcttcaactttcaagatttttgaaaaaagaaatttaaaaatgtactcactgtataattttcccatcctcacttgtatattgttatgctttagaacagcaactactaagagcaaaaaaaaaaaaaaaaaggttgttgttttagggagaataaattgttattcaatgatataagaattaaaatttaagactagtttactgttggttgatgataaaactgtccagattcacaaagtttccttattttttttcttctaccttccctaggtaggaggtacagggcaaattgtccttccaaaacacaagtaaccttgcttaaactgtcttggctgcttttagcaccaagtaagtgatagaggtataattatccattatgaaaactagattcagatagtgtctttgagttctatacaatacataaagtcacaggtattttctacatggcaaagaaagataacaaaaaactacaaaggatgttgataggctgaatccaggtgatggtattatacccacctatattttaaaagaaaatatcaggaaattgggagttatgcaggtatctataattatactttctaatatgcacaaaaattgtgtattatttaaatagaaatttctacatgtataaaggattaataccttcttataaaaaatagagagactagctactcatttatttatagaggatccagatttagggggaaaaaaggatgcccagttacatttttttgaaaaaatttatggttgcgctggatcttcattgctgcacatgagttttctctagttacaccaagtgggggctactcttcgttacagggcacaggcttctcattgcagcggcttctcttgctgcagagcacagactctaggcacacaggcttcactagttgcagcatccgggccagtagttgtggcttgcgggctttagagcacagtctcagtggtggtggcacatggtcttagctgctctgcagcatgtggaatcgtcccagaccagggatcaaatccatgtcccctgattggcaggaggtttcctaaccactgtaccaccagggaagtcagttgcatttaagttgcaatcaaattgttgagtgtaagtatattccaaacattgcatgggacatacttatactagaaattattcattatctgaaaatcaaattcaactagacatcctgtattttatttagcaatcttacttactcatcctaaaagccctatgaaattgggttcatctttccccagttacaaa

SEQ ID NO: 44857 - DNA, 1962 bp, Bovine  19866881157045
aggggagcattaagtaaaataagtatttccacaaaaaaatctgatatttttatttacttagttatagaagaatagatagaatgtttattactgatttggaagtgccatcaccacaccctggaaaacttagctgctataactatcgttaaaatgctaacatttgaaatatttcagttaaatatagttaaaatgctaacattttaactcataccagctgctcaccatttaaatgcaatctagccttattcctaaaattgtcattgcctaaaaattggtcatcaataaggacatgaatttagttttcccttcatccatctttcgggcagaagtctccgtggttggtcctacccaccttccttttctggcctgtagatgtgcctgagagcttgccttaacgcacaggtgcaggcggtctcttcatctaagtgtctgcaaggttttgttggtttttttttttttttctgtcaaactctttgagggcattgggctgacagttctgggtcggactgagcttaatcttttcctttcaaatcaaattatggggaaaatgccagggaaatggctccctaacagctggcattgttcagaaatcaccgagcttggtgaatttgtaagataagtgtctaaattgtggggaaaggcagacagcttcccctcttgggctgatatccaagggactaatggctaaatgaccccgttttgctctccacacaatggcttgtcccagaagatgtgagaggctctcggggttcagtggcctctccaaaaatcagcctgcctaaaagctggtttagggtctttcctgctgcctctgctcccaatttagtaatcttataacttttaaaactggtgaagagaggagagggtagattctagccttgagtaatgtgaaatcattgaaacctccctatctagacactaagaaaaatggccaagaaaatagaaagtactcaagtactcataggacaaaagccaaaaagggagaaacaaattttaaaatattattggagagccactacattcacattaaatactaaaatattaaaattgattgaggttgtgaaataagtgaattacttagtcttccatgcattaaaattaatttttcatctccttctccaggccacttcccactggctcttgttgagccctcttaatattttatttgctgaaaggaaaaggtttccttttgacatattggtattcctggggttggttgactatctcactgccaactccataagcggatttctcagcaacaataaaacataaaaagatattgtatacctcctaaacttaacaaatttttcaacctgtcctccccaaaatacctttatccatgaaaccacccactttgcactttacatttccacctttctaattccctttcagcctctccaaccaatagcctcttggcaattcattaaaaaaaaaaaaaggcttaagaaaagaggaaattcgaggtcattgcatttgagctgtcacagccagcttttactttcctttagttgtagttccgggggaggagttggcctctttggggaattagagcagccactgcttgatgggccctgatttctggagttcaggaattcacatggtggatcctcttagttaggaggtgaactcaaagctggtacatagacatcaaaacagacacttaaagcagacaaatggtgcaaagaagtgcctgaatcactagagatgggtttaccagaatgttaatctcaaaaacctccacatttcctatctgacattcacatgctaaatttggactcttcactgtaaggaaagttgatacatgtaaggacagaagtaagaaacagaaacactcagtatctcttcacaatgaaatgggatttcaaactttcctttacatcctaatgttcccttctacatgatcgcaagagcaatatttttgcacgctgagagaaatttgaccccggtctagtctaaaatcca

SEQ ID NO: 44858 - DNA, 891 bp, Bovine  19866881184004
cagggtaagaagttggaaaaaatatacaagttggataaatgctagtttgataagtgagaagaaacacaaacagaactgaaagccccatgctccaggtctaatctttaaataactagtcaggagagaaatcttgatttaaccagcctgggtttaccatgtgacttggataaagtacaagccagggggagtactggctaagtcagattcctagggaatctagaaagaggtttgaagtctatggatgatctttaaacactttgcatcagtcttaagaatgcatttttttattggtgagggtaaattttaggtatacaaataatgaagacatatttgcatgctacctcaatgaaatagatgtctatatacaatgtatacatctcagaaggaagcagaaaaaaaaagattagacaagtgtcagctaagccattggatctcaaagtttaaattactcaggtgactaggcgactcctcttctctggagctttatagtctcatctgtgaaaggaaggactagatgaaatcatctctgggctgtcttttttaacataagaatccatgatcatgaatatgtgcacatcatatacatgcatgtcaatgcactagctatgttatgaaaagtaatactataagacaatttcattagtaacaatattagttttaccagtgtgcaccacatttttcatccctaagactctagaagatgaaaatggtaaaagaagaaccttggtaaataccttgattcactaaagagattcacaacataagcttgatatttcttcagttttaaccatgctgagataatcccagtatctctattcttgcgttacagttgtaaagaaaacaatgaaaatcttcccaaagacttatttacatgtcttgaacacagaatca

SEQ ID NO: 44859 - DNA, 798 bp, Bovine  19866881198158
tggtggtgctcaaggagcagcctggggcaggggccctatgcctttggggaggactgaggatcagagatctcatcaccaggccaagtagcccacccaagggcttggcttctttggtggacaggaagttctaccacatatctaaccgtaatcttgcctacttttgtttaggaatttccaagctgtctagtcactcagtcgtgtctgactcttcgcgaccccatgaactgtagcacaccagggcctccctgtccctcaccagctcctggggattgctcaaattcatgtccatcgagtcggtgatgccatccaacaagcatctcgtcctctgtcttccccttcttctcctgccctcaatctttgctggtgtaaggtttctctgttctggggttttattctccataacccttgttccttctgacttaaaaggatctctgcctcctttctctcccaggctgcttttaaaaagaaaatttaaaactccagaaaggtcctcttgtttacacaactgaacccaacagcagctgcatgaagacaggtctttgtggctggagaaggaagagtggctgttgggaaaaagggtccctagagagggcccccgtggggcagaagcacattataaatacctcagtaactcctgccataggtgcgaaattataattaactgcaaacctgctgagcttaaatggactttaggtttgcagctgggggaaggggtgttgattgatctgcattttgttgttaaagttcttttaatccattcggcaagttaagggagagtcgggctcctcaccaaattcc

SEQ ID NO: 44860 - DNA, 1181 bp, Bovine  19866881333635
catcgcttttttagatggtgcttcctagtttctggagtttcttcacgtgtgccctcaaagtggtttccacatcccatgtgcctaccatgtgaccaggtagagagcagagggatcctcaaattgtccacaaagagcagcatggctgtttgcccttgcttgtttaggttagctgtaccgctgagcgtgtggacacagcacaggcttgtttggttggaggtagaggacaggtagagcctatggctttggccagagggactgtcaaaagagtaagatatctgtggccattctccagaagtgtcaaaggcagtgtattccaggcctaagtgactcactcatttatttttccttcattcatcagctgtttaccaaatgcctactacacgccaggcactgcatgctgtgtgagatggcatctctctgcctcctgaaactggcagtcgggctgggatgtcacgggcagacagagacagtgcatgttagcaaataaataatttttatacagattctagtaagaatgacagtcaatagagaaagcctccaactactcttcacactgtttggattccactcaaccctacctgggtcagtgggtgtggccacctgcatcccgacacactgcccataatgcctgggttttgctcagctctccatcctcctccatctccctcactttctctatgtaatttgcattttaacgtgtgctaatgctaaatattttacagatgaggcagctgaggtctgaagagcacatggccagtgagtggggtggtgggcttggcttcgggctttgaaccccaccttgtccttctctttcaagtctctacccacctctcttcagtccccagagtagattgcctcagttccttctctatttaattttctttattatagtcaagacttcaattaacttttctctgtagaacgactgtattaggcaaaagtttgtgtgggatccaataaaacgtcagatgatattgagcctacgtcaggcagagcctgcagcgtgataagttattatgtgtaaatgttacaactttattttgaggagaatacatgtgtactatcaagctgttttatggatacacagcgtgattgattacagcacgcagatctgtcgcaacaagataaactcagatagaatagtctggatagttaggcctcagcagtatgttatcagaaga

SEQ ID NO: 44861 - DNA, 1173 bp, Bovine  19866881570802
ggcccagacagaggggaactctgttcctccccacctaggatgccggaattgtgattattcccattttacagatgaggaggctgagccattgagcacatgaggaacctgtcttgtaaacactgggcttgagaacctagttcttaactctgtactgcacctcctccacgtggggtgtaccaccctagagcttcagttccctggaaaagcacaatttggggcttaaaaagtaaagggatgagctaagagcagatggattgtttgttgtttattacctgcttgaaactgggcttccctggtggctccaacagtaaagactctggagatcagggttcaatccctgggtcaggaaaaccccctggagaagggaatggctacccactccagtattcttgcctggagaattccatagacaaaggagcttggcaagctacagtctatggggtcgcaaagtgctagacatgactgaatgactaacataaacacacacctacttgaaattatgacacttaggctccaagttaccaatttacagagtaacagcaagagaggcagtttgctacagtgaagggaaacactgaactgggagattgcgatgttgaggttttaaatcattattattataagaataacacacgcacatcgtaaagactgcaggggatacacaatgcaatgacattcttcctcccactcgagaccccatcccacttgtcagaaggagccctttcctgtgtattcttccagaagtatgtcaagtacagtcaagtaacgcaaacacacccacagacactttctgttgtggagactgggatgtgttccccacaccgtggtgcaccttgatgtctgacttcacagtccatctcggctctttccagatggacactcatgtggatccactgtatcacatctagtagctgtgagtattcagttgggcttttcaggtggtgctagtggtaaagaacctgcctgccaatgcaggagtcaaaagagacatgaatttgatccctagttcaggaagatcccctggagaagggcatgacaacccactccagtattcttgtctggagaatcccatgggcagaggagcctagccagctatggtcacaaagagtcagacaggactgaagcaacttggcacgcatgccaagtattcagttatccagatattcactaatt

SEQ ID NO: 44862 - DNA, 697 bp, Bovine  19866881893165
gaactgtcctgggccacgcacagacgcacacccgcactcaacattcaaaggtgcccacacacgtacaccggggagcctggcatgtgtgtgtgtgcaggaagctccgtgcacatatgagatgtgtgtgtatgcataaacatacccagggaggtgtgcacactctggcacccaggcgcacaaacacacatgtgcatgcacgctctcctctggctccttttagaattaaaagggaaggttgctctacagggacagctgaagataaactcttgatttctgatttccagagtagtttggacaaggtcctctgaaatgcattaaaatgctaatcacagcatctgtctgaaccctggcagctgtgtgacttggggggaaatcaacgcagaatggattccgaagcctgtgatgactcctcgactctccttgcctcactccctcctttgtctcctgctccctgcccttgcctgtcgccccctcagccttcacccaacaccaacctccctgccatgtcatccccggcctgggccacaaggagattttgcctttgctggaatgtgggtcccagagtgtcacggctccgctgggctaacaaataaagcctccactaagatagccgggagccgaaagaaatggcctccctccacttgggcccacggctcccctgggtaccacctcatagctgccaggctccaggcctctg

SEQ ID NO: 44863 - DNA, 1869 bp, Bovine  19866880187904
attttggagcccaaaaaaaacagtctgacagtgtttccactgtttccccatctatttcccatgaagtgatgggaaccagatgccatgatcttcgttttctgaatgttgagttttaagccaactttttcattctcctctttcactttcatcaagaggctttttagttcctcctcactttctgccataagggtggtgtcatctgcatatctgaggttattgacatttctcccggcaatcttgattccagcttgtgtttctttcagtccagcgtttctcatgatgtactctgcatagaagttaaataagcagggtgacaaaatacagccttgatgtactccttttcctatttggaaccagtctgttgttccatgtccagttctaactgttgcttcctgacctgcatacagatttctcaagaggcaggtcgtggttggtgcaaaagtaactgctgtttggcatggttgaacgtcatcatttgatgtcagaatacattcttaaataaatgtagttgttatacatcattttaatccacatttcttgctttattgctttttgtttttcgctaatgacttattacttgctgtttatatttatttgatgtgtttgagccttgttacaatgatttaaattcatggtctaaaacatttgtaactgcatttggtgcagttacatttgcaccaacctaatatctaattttttaaaatgcaggtctactaaggggcctagaactgcagttgaataacagtgtctacttctctacccggctagggggaggggtggtctggcagcagtaccacacccccacatggtgtctctctgagcaaattctatcgtcctgctcctattcattctgctcctgcattatcagggttctttctccagagaaatagaaccaataggctctatacagagagagaaagggactgattataaagaactggttcttgtaactgtggagcctgacaagctccagtatctatagtcagcagtctggagacttgttgagagctgatgaggaggtcctgtctgaaggccagcagcctcgagaccaaggaagagccgacatctcagtctgagtcccaaagcaggaaaaagctgatgtcatggcaggctggaggagtcctttcttattagggaagggtcagcctttttgttctcttcaagcctttagtgaggggtgaggggtgaggggctcccatcctagagggggccatgtgctttcctccatccaccaacttggatggtaacctcattcagaaacagcctcacagacacacccagaaatgtccaggcacccgtatttagtcaagctgacacagaattaaccatcacaacacccctgtccccttccctaaataaggcaccaaccttagctcctacaagatccaatttaatttagccttcattggtagagaaatataagaaccaaaagagaaatggaatttcaagatgcctgtaaatgcctctctgaggcgtacaggtagatggaggcccaaagtcaacacactccgctgcgttctgtcctcagcaggtcagttggagaaagcacggacgaagttatagtagtcgatcttgtcttctccgtgagagcacattctgatgagctgcaggggagagacaggaggctgctttcagctctgcagcagagcctctttagtgaccgccccccacactctaacagctcaactgtttataccctcagctgatctgacatgatcttgggagccttccccaatcttaacgcttcatgaaaagaaagctcagatggtgtaaatggcctgcccgaggtttcaggtctaacatttataagaatactgtcattttcaaagcagtttgttcttatattcagttacaagactatccatcagg

SEQ ID NO: 44864 - DNA, 1241 bp, Bovine  19866880553541
tactggagtggggtgccatcgccttttccgagatgaagcacaaatacctttatttttggctttccctcccttaatccaatccaatggtttccaactgacctgtcaaagcatcaaggactcctcaggctcagcttgtgcaaagcggaggcccacttttcctgtcttataactgtttttttctctgttgttccatatacatttttttttaatggtcccactatcatttaggtcattgcctggaaaattccatggacagaggagcctggtgggctacagtccatagggtcgcaaagagtctgactcaactgagtgactgagcatgagcaccagagcctaaagttttgcttcctccaacttctatacatcatatattaaagcaaacaccaaatccaatgaattaacccttgaaatgtccctgaaatcatccactgccttttcactcttatcaccaccatcgagaagggttcctttttttttttcttgactaggctgttataatagtttttcaattggtcttccagataccactctttttaaataaaaatgatctttatattcctgatggtttctctaaagagagattcagttatgctaaaaaaaaattcccactgtttgcagagtaaagtcacaattctctcttttttaaaattttcagttttactaaggtataattgacaaataaaattataagatattcatggtgttttgataaatgtataccttgaaaggtacaattctttatcatggcatttgaaatgcattacaatctagttccatcttaagtctccaaaatttatctcacactgctcttctgcagtctctattaataaaatagagaatggacctactgaaggtccagcctgaacgtcctcttcccaataccccaaccagaactaagttgcctttcctttgtcctcatagggtacatattttaaactgttcttagagtcaccatcatcacactgaattgtaacgatgcctctgtctcttctaatagattgtaagctgcagcatacctcttgctgtataacaaataacaaccagattcactgacttaaaacagcagatgtttattatttcacagttgctgtgtgtcaggaatttgggagtggctaccttgctggttttggctagggatatctcatgaagttggagtcaagaggtcagccagggctgcagtcatctgaaggcttgatcagagctggaagatttgctctcaacagggctcatgcagaaggttg

SEQ ID NO: 44865 - DNA, 1975 bp, Bovine  19866880657258
tgcttttgaagacgttcctctgccagcttttatagttcctgacttacgcgtcttcctctcctgcctctgacgtggcccatcagtggtgttctaaagaaatgagtcaggggaagccgagaagggctgtctctggggtgcccttgttctgtgattggatttctacccgcatttcagtgatctgaacaacagaacagagatttggagctagagttcctcctggtctacctgaagtgtcaaaccctctcctgtgggacgtaagggttcctcagtgatccttacttattcccttggcaaaaatgtgacggccagaaaggaggtgttgatcagtgagtgagtttttaactctcaccacaggataatgtgtaaatgtctcgcactgggcctggcatgcaggcactcagttgatggtctcagcaaccacgctggtctctgttactggcgtcccagttgggcgtgtgagcacaccttccgccatcatgctggccccaatttccatttagatatgacctatttttccgtgagacatttcccccgagttctccagtgccagccgtctgccccaaaggggacaatcacaataccccaggtgcctctttccccggagaacatcagttgtccctcttccatccatcttattgaaaggtgggctgggggtactagagggtctcagatatgtggttgtcagctgccctgccagccctgaccttgccacttccctctcgcctgctttgtgtctgcaccctccggctgctgcttctccggaccactgtccagcccagtcacaacagagcgccttagtcctgcctgtttgcagagtcccatgtgttgctatggagaaaacttcagtctggcaggcatgagctccttttttgatctgcttcatcgtgggcaggggcaccagaaatcactctatggcagatgtatcccccgttcccaccctgataaatgcctaagctgaagggttgataagaggggattagagttcccaaactacagaagtgctttctaatcaaccagagtgcttttagcaggccgtggtgggaaacttcactgatatgatctcgtaacctttttatccagctctgtgtatctggtgtccattggtacctaatggttaaagaaaaaggagttaaaaaaaaaaaaaaaagctggggggagaaagcagtaaagctaccaccacgggtcctgacacagcccttctcatttcacgagcacacctttatctcatatacagcttcgacttgctccctcgtctcaggtgtctcgggtggaaagaaacccagcctagcttactcacagctgggtaacgttgggggttgactgtgaggtttaaagagctttgcaagcgggtctcctggaccgtgcaggttcacgtagctttcctgcacgaaggaacggagcccggtcatcatgagtgggggcctgggaggcccctggagggaatttggggacatgcagggttaggtgaggtgctgctctgtggttctccacccgagccacgttgcctctcgacagcttccctcatctgtctcgaggggttggcagcagtctccatctgtgaaatgctttactggcctcaccctgtaatctggatggtttatgggggttgtcatacccatccagagcctggcttctagagcagagacttggccaaggaccatcctctccgagtcagagccaagacaagaagtcagccccgtctggctcacacttagagctcagccctgatgcttccatgaatggggcgtctacggaatgtagccaagggctgctttatttttctttgtctgagtggaatccgtttattacctggaagtaatgtctggaggtcattgttccatgtggagacttttcttcctggaacagtcattgcaatttgcgaatccctgatagagactccagagagtaacccgaatatgtgtgtcatatgtgaccaagggtgagtgggcagaagctttacctcctgttaaagtca

SEQ ID NO: 44866 - DNA, 1567 bp, Bovine  19866880901658
tgggtggtagtcatgtatgatttttatcttatgtttacctgtattttataagtttcctgtgagagtcataaatgtactttggaaaccatttaaaactaaattgtaaccaatcacacacaaaaaaatactatacgactctacttataggaggccctagaagagtcaaatttatagcgacagaaagtagagtggtagggggcaggggtggggcaggggagaatggtgagtcacttaagagctacagagctccgttttgcaagatgaaacagtgctagagatggatggatggtggtgaaggaacttcataccactgaactggtacactttaaaataactaagatggtaaatgacatgtgtattttatcccaattttttaaaaaaccaaaaatacttttaaaaatgttaaatgcataaatcataagtatagctgggtccagagttgtcctagttattacaattttcaagagacataggtacataaggtcaaatttgaccctggaccacatggcaaggagcaagatggtccgtgagcccaccaggctggcatgtgccttgggacgacctggccgtgccatttcctgtctcttccgtcatgagtatggtgttttctccctctccaaccagctctgattctagatgaagggctgagtaagccgtccccagggtgtgacttcccctagagcctagctacagggactgcaggggcaggcgagtctgggagagacgccagccatgtcctgcagaggccacggtttaagagttttgcccccaaagcccttcaggtagcctctggtggagccaggccaagaaaggaatcttacctccatgtccagacaactcaccacctcactgcaggatgaggagggaggactagattcagggaagaacgtgtccccctttattcaccaggagggccccagagatgcccacccagttcctggaggtggacctcagaaccccaagcttgcagagcccctggctgagcactgcatgtggccgacaccttttcagcaacaggaagtgggatgctgagtctagatatccaaaatgatcatacatggcacaggaaaaggaagttttccaagaactttggggttaacagggcccgagaaagatagagaccagtactttccttacctgctgtaggcatgctaacattgtactgaggtaagataaataggaaggcagtcttggcggtgacctgtgaaacagagggaaaagttccaagttagcttcttggccacatttaaaaaaaaaaaacaaacaaaaaccaaccagcaaagcctgcgaccagccctggagtccatgcctttcacattctcagatccacaggcctctccaatgaagggtttcacctggagctgagttagcaacgtttgtttttcttccctattttctttaatggcatccctctcaatacctgtactgaaaacaaacgaaaccaccccaagtcctggatggtatctagactggtgctcgctgcagacagaatgcgacaaggtgtgctccacccaccggcagagagctcaaaggcaaaggatacacatttgtctgtgcatcattcatt

SEQ ID NO: 44867 - DNA, 1966 bp, Bovine  19866881302623
tcatggacaggggagcctggcaggttacagttcatggggtcacaaagagtcggacatgactaagctctcacgtacactgggcagagtaaaacttaaatcaactgtgctaagcaggagggctcaaagaaatctgtttataagagtggcattcaaacagcaaagaaagtcattcagtaaaagcaattcgtaaaatgcaaataccatattatttttaaaaatgctatgatgggctgtgcatggatgggctgtgcacggatgagctgtgctcgggtgcttagtcgctaagttgtgtctgactctttgggaccctatggacagctatcagtgggattctctaggcaaggatactggagtgggttgctatgtccccctccagggcatcttcccgacccagggatgaaactcaggtctcctgcactggcaggtagattaccacctgagaagctcatgacaggccacaccatagtataacatagttcaagcagcacatctccacttcattggaccacagagttttctttcgagggggagaaggagacagtagtctgaagtcatatgatctttgagaaggggaagaggtgagaggtaattctgaggcttgatcacttgagggagcccagtgaaccatgggctgagggctcagagcccaccaaggagaaaacctcagcaaacgtaccccatttccacatttcttagcagtcttggtggcccaggcagcaaatggtgtatctggtgtggcgtggatacatcaagactatatataaatatatatgaaaatgagagacaacagaaaagcagctgcctgatgatggcttgtgagggtcacagaattaattagtattcatgaataatgaacactgatggagtccttgatatcaagctctgtgaaaatgctgtatgtacacgcactattagctcacaaaaaactcaatgagataagcacaattattttcattcccattttactgagcttgtgtggggcacagttgaggatcttaaattagtgaagtggaggagccggtaaagaaccaggcagtgtgaaagcaacgtctgcactcccaagctgtacatgctctggggtatttacaagcccggcacgacctggcaacatgacgttgggaaacagggtgcccacccggatggcaagggcagccgagcctcacaccagcagtctgttttccaggagaaggagagcctgggagtgaaccatcccaataaacccgcacaagaacaccacaactgcctttcacttcccggaggtctccatggaaatgcacagaaccaattgcgccctggagccaggcctctccgatctgtttggttttatacatgcccctcatctgggactttggccacgtcaccatggtctttttttttttttttagcagtaaagtggagcgaaggcacttgggactaatcacagctgaaagatcgtctatttagcttcagcgtgctgggaggaagggcaaggagactatatttgggcaaaccgttgatggggggttcagtggagtgctggctttgggttggcagtgcccttctcccacccgcgcctgcccccacccaagccatgtggctcgagcacttggctctgacacaagcacatccctgaatcctccctggggctccgaggagcagaggcagcaccgccactccaggaagtgatgcagtgagaaaaccagcacggagccaacaggaagccagggagccctgcagcacgaggtggtaacgtggcccccgccccagctgcagaagccccccagcgatcaagctcagacagagcccctcacaactctggccacaaggaactgtgaccactggttttcctatccctcctccacatgaggcagagcactccacgtgagtctcaatcatctccaggtcccaggcaccttcaatcagcaggggctcaataaatatttgagcttccctggtgactcaacagtaaagaatctgtctgccaatg

SEQ ID NO: 44868 - DNA, 863 bp, Bovine  19866881349206
ctgggggcgctttcccttctggaatgtgataaaaccgccccacccgactggtactttttcttcagttactgctctggctgtgggtgtgggcagggaacatgaggagaaaggacagttacttgctcaagcccagttgccctggactgttttgaactggaagccgtctcagggccccaccctggcacggggcagagtccagttttcgcagaccttagttggagccttggctgtgccctggtctccaccctcaactagtttttatttgtttggccttctgtatgagcgagggaactaagacattgtcagacaggggaaagaatattgaagtctagttaccagctctattcaaagctcattagtagatgagcatattctttttattagcatcctcaccaccattctagaaccaattaaaagtaaagcctgggactagactccagcagtggcgtgctggagctagctcaaaccagttgtgaacctaattgttaagttttcaggaactttgcaagcctatggttaaacacaacaattactaaagattaatttatatacaattaaaatagaagcaactagatttaaaacaaattttaagaaatgatcaaaacttattcacttcttaaggattttactgtatttgctgttatccgtgttcttgaggttgaaaaaagagtgaaactgtcagttgctcagtcgtgtctgactctttgtgaccccatggagcccaccaggctcctctgtccatggaatcctccagggaagaatactggagtgggtatctgtgttcttgagattattcacatctattgtatctgtgggcttctctggggttcagatagtaaagaatctgcctgcaatgcaggaga

SEQ ID NO: 44869 - DNA, 1657 bp, Bovine  19866881545520
ttcccgtggcaggtggtccacgtggtagcacagtgttcatcccacttatctttgtagttttctctcctactcgtcggagaaaaagtccggtaaacataaagcaaccatccactgtccatgtaagtgttcccaggtgtcagcatggtgcttggcacaccgagtgtctgatcagtgcctcctgattgaatgacggtgtggagaggggcacaaacgtaaacgggcggggagacctggcccactctgggtcccactcactttaagaggtatgcgcctgctatgtggaccaagtacaggcagatgtactggagctgccgcgggatctcctcctgcaagagagagacacagatggcacatgtgccgactccctgagacgcaggagcaggggaagaaggcgcaggcggagctgcagagcaggcaggaggggtgcagagcgatgctgctctaacacaggcagacgggtgcccccagagacccgtgcaccaggctgtacaaagtccaaaggtaactcgacggtcagagggcgggcctgggttgaaaaaggagagacagggactggggaacaagggcttttggaaaaaagtcagagagagattacaaaaaaaaactctgtggaaaaggcaaagacctctccatcagctcccctgaagatgagtcaggtttcccccagagtcgcacatcctctggggggaggaagaggctgatctggcagtgcccccccgccaacaatcctggaggatgtcagggagactctgacaggcgcttgctcagcatctcacccaacacacacccatctccaccccccatgagagggtagccagagagaggaacagcaggaaggtagggggacaggtggtatcagagaggggcagcgagtactcaccttccgtaccttctggaagtagagctcgggaagtgcatgcagccagtaggccagctggcacaggtagaagaacttcacctggaagctggagacaagggggccagtcacccagagggatggagagaagtccctaccagggcgggcgggggcaggctgtgtgaggagctgggctgagggaggggcgggtgggggagagctgggttgctgggaggggcgggttggggagagctgggttgcagggagtgggggtgggcagctggcatgcactagatccctgggccaggacactgctccacatgtggagggacacaggaagcccatgaaaagacacaagaaggatgaaaagagcagaggacaggggtcttcagcccagaggaggaaaggctaaggagaggcctgattccagagccctgtcagggaggaggtagtgggcagcgggtatgtgccaaggaaggcaggggtctcagccacagagggtggatctaactctgctaagtctctggggttgccgttctaaggatcttaggagagtctgagagtcgtctcgggggcatgcgggcccagctttgccctcttggtatcccatcggagcaggagaggagggggtgctgctcagagaggcacaggtgtggatgtgagcaggtgccaggaggcgcagcccacggagctccaggcagtggctctgcttcccgctccctcccggcagtttaggaacccgctacagacccaacacttgcggcccctacccttgaaattcacatttaaatcctaaccccg

SEQ ID NO: 44870 - DNA, 1436 bp, Bovine  19866880385141
aaaacctgttttccttgaaatcgtctctatgctaagaaggttagggactgctgttttaaaggaagaggcgggagtaaggagggaggtaggcaggggcttagtagggtcgggaaattttaaaaatcgcaaaaagtgtgaaaaaggggggtggtgcatgtgaaacccatttggcctagtttgctggtgcttattgcttaccacttatgaaagttccactttatttctattattattacatcagctccacttcaaatcattaggcattaggtctgggaggttggggacccctgctttaaaacacccagccacctctgtacaaagtgaagttgagttcagtccatctaggactcttttccctaatgcctataatattactgctcagaatcttccccctaccagaggctggaagtcagggggccctatgttcagattggttggaacaaatagtaaattctttggcagccttgagttttcttaggcaggcactttaagggggactagggaagcagcttgagctgttagaaactaggtgagcgttttttcaaatatctgtaggctaaggttgaggccaagtcaggaagagggctcagaggagcctggctaaagtttgatcatagagatcatctttatcatgggagagagacagtaaatgaaataaatttaaaaataatagaggtgataataggaacttcccttggtggtccagtggttaagactccaagctcccaatgtagggagcgtaggtttgatccctcgtcagggaactagaacctgcatgctgtgtgttttgaattagagtccgcatgctgcaactatttggccagtgcagccaaatagatttttttttttaatccactctcttggggggaaaaaaaaagatggtgataataaagtgcaagagggacagggaatactagggtggaggtgtgcagattgcaaccttagatacgatagtcaagacgggcctcactgagaaggcaccatcggggaaagctctgagaagtgatggtgagatgttctgggcagagggaacggacaggatgaaggctcagaggtaaggatattttctgcgtctgaggaacagaaaagaggcctgaaggatagagtgagttgggaagagcgatagcagcccatgggcctctatagactatttcactgatgtcagctttttctctgagcaagatggtaagtcagcagaggactcagtcagaggggttccatattctctgatgaagtaaatgtggaaagcggacttggggagacagctgctttgtaccaatatctgatgaagagtgaggccacagatctgaccgggctggggtgtctgcctcttcttttccactccccttagttaatgggcagtgagaaatggaatatttcctgccatattagtaaacagagaatgccacagttatcagagtttgcagtcatcactg

SEQ ID NO: 44871 - DNA, 1588 bp, Bovine  19866880443358
cttttcaccttcatgcactggagaaggaaatggcaacccactccagtgttcttgcctggagaatcccagggacaggggagcctggtgggctgctgtctatggggtcgcacagagtcggacacgactgaagtgacttagcagcagcagcatagctcacttagcacagcaagacaatcaacaccaacaaaacaatctacatcctaaactagaaagtgggaaggcaagacactgaagattctaagcacccaccaagaagtagacatgtgaacaataatgttagaagccaaataaaagggacgccagagatgaccaaggtatctacctggagacgatgagaggtcctgcccctaggtctcaacagtttattctcttccctgctagatacaccatctgcttttctgttgttcacaagaagatggctggcaagaggggacacatagagaccttagaaggggaaactgcatgcacttatattggcaacttgttattaaaatagaggccctcagtggtttcaaatgatttgtcttctgtgattcaagcatttctgagcagtgtcattcagttctcctgactcctagtaagttatcaaacattaaaaacacaactcaaaaggtccaaagaaatttcctttgcatacacccacattcatacccacaagtgcctccccaacacatacttccacacattcaaaaatattccaactcatttagaggaataattcttttgcaggcaacacgttgaggagggaaaaagcacttagaatagcctggttattgcataaatatcttagcaaattaatttttgctaatatgtaaatgactaccacctgagtcttttcaaaagagtgctaaaaggatcctgacacagggtgtcacttgctgcagaaagggttgtagccaaagtggtttgaggatactgaagaccaaacacccttgccttgtaactgtgcagcaaatgagcctttaatatggagtgacacagggtagcttgctgttttcagaacttcttaggccacattccctggggccacttctacacctgcttggcactgacacccagggagctatacccaacaaagagaacctacagacaatgggttatgccttagcctcttcatccaatcactcaagagattattggcagagaagtgaagtccatcaagtttagcttctggcccccaattttcccctcctgattctcccagaatcctgccccactctggtgttttttcttcttgctctctgccatctggctcccagttcttgctgttatttccccttctctctgttaaaaccttctatcagggtggatttggtgtcagtcatttaccctgtgggacagtgcagattggcttgtcttaacatggctgtctagttgtagaatgaaaggttttgtttcctattgcaggtttcctagagcttaacctaggggtgaggttaggtgatgggaaatgtttctgcgagttcctgaaatcaaaccctgcgaactctttactcataaccagtccactaattgaagggtttgaatatcaaagggtttggaaatctgattagttggtttttccattctcttcagacgctgactttta

SEQ ID NO: 44872 - DNA, 4295 bp, Bovine  19866880474405
ccttgtaacccagtggactgtacctgccaggctcccctgtccatgggattctccaggtaagaatactggagtggtttgccataccctcttgctggggatcttcctgactcagggatcaaaccctcatctcttacatctcctgtattagcaggtggattctttactactagtgccacctgggaagctcgtgctccataggcatatgggtttaaatttcaatccttgtgctaccactcatgaagtgaatgtcttttctcttttttccattgacccaagctgtataatattttaagcctcaattttcttatctgaaaaatggggctaaaaaatactaatctttagggtagaatataacacacattgtgtatttggtttagggccaggcatagaggaagtccctgatgttttaatagctgccagtccttttctgtgctaaggggcattatgttgagggtttcatgtgctcccaggcccactctccatgttcttctaccttttctggaccccagaatctgtcctctttggacagtgacactgggctcccttgcctctggtcacctgttgggtttggtcagtgggaggcactggctgaagattggaaggagcaagaagagaggcatggcatttatttcctcctccacttcttctctgccagcttcagggagtgatgcttgaccaaggggataactcatctcaggctgcccgctctgtgagctacagcttcctgtgggccaaacacactcctccccatctcttcaggcccagcatggtgacagcacccaactgttgtgaacccttggggattgaatagtcctttgttggtttccctttgctctctttcttccctttgtaaatagtttattctttaagccctcttcaaccacccattttgaatataccgtctcctttttgctggctttttgaccaagtacacgttcattagctcatttagtctttacctcaactctcaaataaataggaactacaatcattgtttacaagtgaggagactgaagctcaaaacatcaaataacttgaggacacacagtggcaagaggtggcatatggaccttgggaaaggacatgacctttgaacattgctttctctccttggtcacgttgcatctgcactctcgctgcaatattagtttaccctgcctgtctttcccctcacctccaccgttgatgcctcttccttcccataaagatctgtggaagcccaggagaccaattcttaccagttctctgggcactcagtggaaggctgctggagactgagatctccggtcagaactctcccagtcacaggaacttgctgtcccagaatctcaagacgtggaaaagaaaaagggaatatggtccctcgggttttcgtcctgggggatgtacagtgattcactcaccagcttggaagagggccttcttccactctgaaagaaaggagacacaaaaaggaatgctccttaattctgatctttccctcacccattctcctcactgagcttttctgtgtccctttcttcagtctcttccttcatctacagcttgggtaaatcaggcataaaacctctcaaaaatggtggattttcttcactctattgtgctggggctgcaggtgacatggccaggctatactagggctgtgtgtgggtgtgtgggtgtgtgggggtgtgtatgtgtgtgggtgtgtatgtcggcagggcagggagtggttaaactgcccagacactatatctgaaggtcctctctgaggctgtagaaaagcagggatggtactccccacagaaaatgagcctctgggttagatctgagtattcctactgcaaatgccagtgggtcacgcagcagggaaaaggtttaaatgtttatctacctgtgccaggaaactcagagaacatccaggtcactcacctggataggtttgagacttctcccccacctacaatggaagaaaggtagagacattacctgaactctgtcatttctgagtcctttctttttacttttgcctcatctcaccttctttttgaccactccacccttcctaccttctgcctgtgcctgttcaactctcacctcccctctcttctttagggaaggagattgaaggcccctttctctattaaaaaagaaaacactctctattctccctaccaaatacttccccctctccagtcacccatatttcttctcctgggaaaaaggatccagaacatttctttatcccagtgaggaacctggctggaaaatatatgggcagagacagtcttatatgtgaattcagagaaaatgtcagagccacttacgagttatgtactggacctttctccactctgaaatggaagaaaaatggtgagtcattaagttgtaagtcataggaagatgagcataggtccctgggggaatcagaacttaccgagctcatactggagcatctctggaaaagaagcagaaaaaaaaaaaaaagtactgttatcggggtggaaggaggaggacctctagaaaataaatcttaaagatgaccaagtgctgggttgggtgcgagaggtagggatggggtgaggtgatccagctccctcctgcaaaacaggactccctctccaggtcagataccttttattctttgttcttgctccttttctgcccaagctgtttctttttcctttttcgctctttctttctccgtgaatagagtctctttttctttcctctgtagacacaggaagtaaccagctccagcaagaagcagcagagagaccgtcagggtccctgcaaaggcaatgatccagcgctgggccctgctgaagaaggggtctgcaatgggatccaggcttagcttctctccctcaggacagggttcatggcattcatctcctgatgttaaaatctttctcttcctaagttctcagagacctttaggtaagactttgggaagccccgcaaaggttttatagatacaataataacataataccagaacttgtcttgaaatgtctgtctctcacatgtaaatctgttatgtaagcatcataatcaagtttttttcttcttaaaatttataataagttacatccacatggttccactatcaaataaatgcacataaaacattatccgagtctcctgtccactcatacaagttttaatacacatttctctagtgagtgaggttggacactctttcatgtgttattccttttctgtgaactaataattcatcctttgctcttttttctactggtttgtactatattttaatgggattagcatttactctaaattatgagttgtacatggacccacctgcccccaactttgtcattcgtctttgcttaaggatccaatcttcgccatttctctccagttcccattgcctgtcaccattcctggcacataggaaatgctcagtaaatccttgtgaagtaaacaggagaaaacaaaaaaaaacctagttccattaaaggctctggaactcagctcagtgactcactttcactgtataccacagagacacacacatccccctttcatttcttttttcaaaatttattacatttttttgtttttatacttttctcttttttaatatggctatactagatttcaattggttaatgtttaaattgtcattttgtctaattttctatagattaaattttacatatgtctcttttaaggaatttttttaaactgaagtataattgacttccttatattatattagttccaggtgttcacatccttcttcttccaacagccatggctcctcacagtacacctgcaactaagcagggtactcacttgcaatggaaatccgggctgtcttttcctggttgaggaggggatttctgatgatacaggacaccccttccccagagccacctttcacaattacagatgatgtgactgcatacaggcccgctccatctgcagccggaggtgccgtcacagctggcatgttctggccctcggcatctcaccactgaatctggggctggggataccagctggtggacttgcacccctggtggatctctccattctcatggcccatcacttgaatgtgaaggtcagagcccagtgctgtggaaaggatgaatgagcctcagttcttgggagtgtcctgtggtgagggtctcaacaggagttgtatggcacactcagataattaaactcgagttttctaagaaactgtttgcaaaagggtggtcataatgaggagaaaactacgtggaatagagcagtactccagggccaggaacaatggagtgttaccacccacccctaaacccaaa

SEQ ID NO: 44873 - DNA, 1346 bp, Bovine  19866880736476
cattgggtggtcaaagtattggagttttagcttcaacatcagtccttccaatgaacacccaggactgatttcctttaggatgaactggttggatctccttgcagtccaagggattctcaagagtcttctccaacaccacagttcaaaagcatcaattctttggtgcccagctttctttatagtctaactcacatccatacatgactactggaaaaaccatagcttcgactagatagacctttgctggaaaagtaatgtcttcgctttttaatatgctgtctaggttggtcataacttttcttcttccaacgagcaagcgtcttttaatttcatggctgcaataatatttaggtcgtttttgaaaactatagatcaatgttggaaaaaatcactaagtctaagggtctcttatactttttcctaagaattttattctttttgatactattataagtggaatggtattcttgctttcttttttggttggccattactaatatatagaaaaactgaattttgcatatgaccttgtacctgcaatcttgctggagtttttaaatgtctacggtgactactaaatcctgtgaaagtctttcccttctttaatttttgtactgtataaattcctgttttccaagcacatatcctattctgcagaatataacttggaaattgcctgtcctttcctcacacttgaattatacattttacttctaattcagagctgaaagatcatcacatggattacattttttgtttttgggttttttcctgtttaggattctggctcttcaggaaaacttccttctccaatttaaaatggatgtaagtagtgacacttctccggatgggtttgtatcatttatgtttctccacagatttcagaggaagggaagatgggcatgtaattctcttaccttcagtttagagactgacaaagctcagtgctggaattaaaagagattaaggattgttgactcaaagtttataaaagttgcctaagaccctggaggaatggtaccacagaagtttcacattactgactgacatactactttctccatacataggcctgttcctctgaagaaagaaaaagggactttgagaaaatctttgctcactatgatgttgtaagtgtgcctttttgatatactatgctggccatctttaggtaggaagcttgtttagtccctatgtggtgtcatcctactcgcagaccctaaccttgtgtaatgaacagcaatcacacatgtgtgttgctacgtcaaggcacccttagcttctctatagtaaaactttgagaactaagtacaaacagacataagagtattaaggagaagagaata

SEQ ID NO: 44874 - DNA, 802 bp, Bovine  19866880790012
aaactaaagtggttgcccataggggcttccctggtgggttcagtggtaaagaacctgtctgccaatgcaggagacccaggtttaatccctggtctccgaagatcccctggagaaggaaatggcaactcactccagtactcttgccttggaaatcccatggaacctggcgggctgcagcctatggggacatgacttagtgactaaataacaatgaagttgcccatggaatcttgatctctagcctgcattctcagaaggcagcagttctctggacctcacagggctctgggcaggctggtattctctgggctccacgtccctcaccctcccctcccattacattcctcagatacctgccttcctctagcacatgctaaggagtctgttagctcaggagcagcctaggtcaacccactgagggagcacattgagactgggggccacagtccaggctcaacaccaagggcttctttgcgtggttttgtcccatgggcagctctccctgggggagtgggcaggggaggtggcagccatggcaggtgcctgggatcctggcctccatagagatacaaccaaatgctcacccgcataaactccacactgctgtccaagggggtttcctggcgaaagagcagaagaaagttttcatcctcagataagaacatgccggcaagctaaagaaaaggggagaaatagcagttggtgacactgaccagtgctccctgggtaaaaggcacagagccacatattagagagcagaacaacttagaactctcagggtggtgagcctcatgttgcagtt

SEQ ID NO: 44875 - DNA, 1629 bp, Bovine  19866880875518
ttgtctccatcatttatttgaaaaaccattctaattgggatcatctttaaagtacctcttgccaaacccattaataaattctcagaatcttacataatttgaccccttgatagcatttgccatggatactcattcccacctttttcacttttcttctgagataccacattctccaaccatccttcctactttatcaaaggcccttctcagttcccctttcaagaaaccacctctcttcctcacttttaaatgttagagaggcccatactcccaaatttctatctctagccgcaacatctctcaagaattctagagcagtacagccgctgggctgcatgccatttcatcaaggtgtcgaatagtttcagactttacttggccccctctaatcccctgaacctgcaccccttattttttaccatctcagtcagcaacaccacagtttgcttagaggccatttagcttctttctatcctgcatccagagtttcaaaatctgcccttaattgaatcacttcttaccttcagagataggtgttttgtctttctttagcccattcttgaacttctgctttagcaaatataaggtagaagattaggcttatcatgttattggctatcatcaggaggaagattttaagccagggagattctgcatcctgaggaattaaagtgcaaacaattataaactattgtgttttgtaacatttaaaatgtagtattaaaattaatataggcttgatgcaggtcacttaaacatggcaaaacattttaataaggaacaaaaagttaaatttcactctacaaagataatcaccatttgacttatggtttgtgtctatgtacatataacttttcatgtataaaattgcatgaatatagtgctaaaagccaagaatgcatatggttttatattccgaaatatcccataaacatgtttgtatattaggaaatatttgactgtatcatatctgttactgacttgtaatccagagtttagatttataaaatttataagagcaccccttatttgtttaaagttgtttttcactttttgttgctataggcttgaataagttggtgattaattacaaacacagcaatgcttttgaataagatttatcaaataccctttccttatttatgaaaatggttgatacattttctatttcagcctattaatatgatcagtttcattaatacattttattaataaatagagccactttactttcttagaaaagggcctacttaattatgatgttgtacatattttaatatattgatgaattctatacacaggtaatttatttttggcatccatactcaaagatgatattaaatttcagttatatttcagattttgatcagctgaggttaaattttataaagttaaatgtaaaatgcattgtgattgcattttggtctctggtgtcatgcttttgaaggatggatgtcctgtctgaagtttaaataattattaactcctattttactttagtatctttattatatcctttcttcatttacatttgttatcgtccataattaacataagggtaaatatgagaacagaatgtaattattttttttttcaagtgggctcaccactgtgtttttaaagaaatca

SEQ ID NO: 44876 - DNA, 1803 bp, Bovine  19866880912192
catggattttctaataatcagggctaatggtaggagacgaagataaggaatggtgaactttataacagggtgacccagcccacaagctggagtgtcggctacaattatagttagctgtccattggttacctgccccgaggcgcaggataatgctcttatcgagcttgctcaccagccccaagaggacattaagacggccactatgtacggggcccgagcccattctcagcgttacacaagggaacagagaagttgcctttagttacaaacccaaaactggcatgttctcaactacttggatctggtagctgtgaattacacaatgcagtttcctgaacagggtatttatactagctatgggtagcctagagtagtccctgtgattgggtcaaagcaaagtaacaaagcagccaatgaaaaggtagacctgttagaataatttacattcgtgtttatgacgccacaataaaattaatccaatcctgagcgaagtcttacgaacctcatttgaataccgcgtctataaataaatgtggcctcactggaagcaactattttctcagctgtcagtgtaactgttgcagtttttatcggtaagatgcctgaacccaccaagtcagctccagccccaaagaaaggctcgaagaaggcggtgaccaaggcgcagaagaaagatggcaagaagcgcaagcgcagccgcaaggagagctactccgtgtacgtgtacaaggtgctgaagcaggtccacccggacaccggcatctcgtccaaggccatgggcatcatgaattcatttgtcaacgacatcttcgagcgcatcgcgggggaggcgtcgcgtctggcgcattacaacaagcgctcgaccatcacatctagggagatccagacggccgtgcgcctgctgttgcccgggggagttggccaaacacgccgtgtccgagggcaccaaggctgtcaccaagtacaccagctccaagtaaacttgccaagtaagcgtccttacacctaaccccaaaggctcttttaagagccacgcatgttttcagcaaatgagttgtaatcctttcattacaaaggctatattccgatttctaccaaatttaaattttcactagcattctttaaggttgtattgcatctgcgtaagaattactgtgggcaagctagacaatacgttccattcattgcatgcccactacaagcaagtagttacatagaaccatgatactacgaaaccatttatcaatttgccctgaaaatgccgtttaaggtacagctttcttttccgtacgtaggtcttcaagttgatcctgacggtgatccggaatttggcgatgaacccttacccagaatgtaaaagagcatgctctaatcaacttcattctactcagagcttttccacccatttttattttccttttttttttttttccattttttaaaccacatatacatgtatttcggggagggggacaatgctgaagacaatgaattttcgcaaaaatgttacaaaggttttttctggtttccttgctttgtaattggtgcagtttctgtggtgaggaggagcctaggctctatcctgaaggcaccgaggaaaagaaaaaggaagccttcaaatcctgtcagctgctataatttctttcccagaaagtcctatttaatttgtagtcctctgggggcagcattcagctttaaagtattctgggtctcagatgtccggttatcattctccccatcggtaaagggagtctgtctactcggctcaggcccccttttgagcactcctgctttcccggatgt

SEQ ID NO: 44877 - DNA, 938 bp, Bovine  19866880964051
cagagtattggggaataaggaaagttctcctttcttgttttgaaatcagcataagccccatatccagacataacactcatgcatccagagtcaatgtcatataccagtaaagcagtagaagtcctgaagaaaccatcagtgaatcaaattctgtggtcttatcaaaagaatactcgagaaacagtttgctcaacattaagaactgtattaaggtacaatatttaataatcaaagagaagcagatcatctcattcaatagatatcaatatgatttttgagaaaagcaaattaatttacattaaatgttagaaatgaatattagaaaagaatcattaatgttagaaacaactctttgggatgggggagatggattagtgatgcttcctatcaaccacaatgcatctattctgaagaccttaggaaatgtggagggtaactgtttcagaccatcaaatggaaaaagataactgaagtgtctctgacacacatatgttatttttcagcaataatcaaagcaagtgctcagaaagcctagaaatgctgagcaattgttcttacctttacctccgaagacaaccgatgctttcagggatagggtttcttgggaagcctgagctcgctcattttgctgttcaagaacttagactttaatccagaatctgacaaaagagactgccctgctgcctcctgctctgatgctggtggattgggcaaagaaggaggaagcagaggatcagggagaatgggaaagtagagaccagggctccttcccaggtgtctgtttgtcagacctaagctgaagagagaagagaaacttttgaagtgggtgaaacatggagtttaagtaaatgttttattttttatacacataaaaatgtacaaatcataaatgtacccttttcacaaagtaaaaacacccaggtgactagcacccaagt

SEQ ID NO: 44878 - DNA, 1168 bp, Bovine  19866880980698
ctgagctggaaatctgaacttgtcattcaattctgcttgcatggtaagtcgcttcagtcatgtccaactctctgcaaccctatggactgtagcctgccaggcttatttgtccatgggattctccaggcaaggatactagaatgggttgcatgccctcctccaagaccattcaatcctacatgtaacttcttttctttttcatggagtgctgggaagcagaaaggccttaatcttcatgactgaagccatttttgctgtgtggactagtcactcatcagctacacagtgataacaggtctgagtttctctagtaatgggaacagatatgttacaatctatactttccatttagttccccttatgatcaatgcctgaatttcaatcctaagagtatattactatttgattctgaagcacatgccaaaagaatccagcaggactgcagacatatcgtccaagtgcactgccacttccagtgactttatggacaacatctgtgtgttatttgaaaattaatccttttccatctgtgtaccctatgttttggattccctttccttcacaaatatcctgaattcaaggtatctaaagtcctggagcagttgtccggaggaagagaagcaacagccccgcccccaacccttgggagcagaaaggaagagaattatcctaaggaattatttaaaaatccagacgcggcagacacaaataaaaccatggctgcataggttgatgtcccaggggtccaaaatttaacgtcacttgtgcaataatttgtttagcattaaactaaaccagtttgatgaactcaaatgccctcggctcaataggcaggactctccgaggagcctgtgttacttccctcacttaagcgcagatttataataaaaatcttaatgccagtgacatggtttttggacacataagaacctaagcacttggagaatcatatttgagaggtcagaaaactccacagttaaagatcagtgtataatttactaagaaaatagaaagttttgtttctctgagtcgaaatttgacgagcacggcgggaaatattgcaggtttttggcataaggttttgtgctttcctcataatttgagacctgcgtaaagcctgaggcttcggggatcactttctgagaaaaatcgggcaatttgatgcaga

SEQ ID NO: 44879 - DNA, 1043 bp, Bovine  19866881113480
atgaggatcctgtagtcccctccctccggtgagctttcctcttttgttctttaatattctgcttttgagatgatgagaatgggttttcccatagagagctgcttggtttgctgttttgggggtggggaagagacttttcctgagataattctgaaaagtgagaaagaaaccagggtcccagaactctagggagtaaaactctgggaataaaattatccaaaaggatggctacagagacctggaggcaaaccaataatttaaaattatactttttagagttaatatcacccatttattagaattagactagatagcctgtagtttaagattcctaaactgggcttgtttttatgggatgcattaattaaaaaaaaatcagtcatatctatagtgagacaataaatgtaaattctggcagagggagattttcataggggctaacagatcaaataaccaaaacagatttgacctttctaattaatttatgcatgagggaaaagtaaaacaaaatgaaatcccacaatgctttgggaagtaggtaatgagtgaagagtttggggctgagaactttaatttggggcctatgaataagagccatgaactgttcttatatataggaaatgctcagtgcggagaccagacaaagataacatttgtgctattaatagctctgcctggtaccttaaggaaaagtctcattctacagtgaactaatcaatggcagatgaccaggatatatttaatgcaaaggtaatagacacagaaacagtcttggccagagaaagtgataggaaattgatacaggaatgaatggcccaatttttttgctggttcttcctcatttcctggtctccaagtaaatagataaggcaaatttatatatctacttgagccctctgtcctgaactaccgactcatagacacaatgcctatttggcagtcttcccttctggatcaaacagtcaactcaaacccaacatgtccaaaatgaaactcctgtttttcttctggaaacttgctctcctcttgcttatctcccactg

SEQ ID NO: 44880 - DNA, 2575 bp, Bovine  19866881161001
ttctgaaaaccttttaaagttattagcatgcatgtgtatttctgagagtaattttgctcacataagtgtattttttaatgtgaattgtaatttaaagaagaaacccactctgctgcattgcttccctcgtggcttagctggtaaagaatctgcctgtaatgggggagacctgggttcgatccctgggttgggaagatcccctggagaagggaaaggctacccactccagtcttctggcctggagaattccatggacacagtccatggggtcacgaagagtcaggacttgactgattttcacttgcactttctactgcattggatgtacatttgtgtgtttgaattctatcagtgctgttgtcccagcttagctgttgtatgacagtactcacagcagtaggcagtttcccctgttttgtgtggtagactgtttagagcatgattgctcacttaacccctcagctcctcatgtacccacttaagtagaggtacttatttccacttcaggctttagcatcaagcctcatttttccttgtttcacctgattcttttatctttcaccccccattctctccaatttttccactgtccaattctggtggagtatgaattcttttcctaagtatttgctgtggctttctgaaattataaatgaaaaacagctatcacgtaccgaagaagcctgatttcattttactcattaaaaagcagtttgcacaaactgagattaacaccagcattttgaagtagttataggtaacattacactgaatataaatgacctatgaaatggtatttttttgaaacttgaccacagctccttctctgaaagatgacacctaattttattttccttcttttgctacagcagaattctcttaatatctctttaatgatttgtctaacatagtccagaataatattaaaatatagtgataagaaaaagtctgctaacagtaatcactagttttccactaagaaacaaaaactattcagttaaacatactagcaaatgttaagtgcctcctgagtttaacataagactttattttccctttgtttggttttattcagtgttgaaaacagacttacattcttgtttggtaagcttgttaatgtgttgccaaagttagttattcatatttaatggaggtttatgtattatttaaaatttatattgcactgcatttagtagcatgctttcttcattaaattttatcatatttcttcaaaaatataaaatgaaacttttttttcacaatttagaaccattttattagccatagatttatcttttccttaaatgtagaagaacacactcttggaagcctcatctttgaggatggtggctcattgatgacttgttttccccatttatcttagtcctcactgctttctaggtttaatttaagcaatttataatttttcataaactcttacatttcatcagaattttttaatatgttaacataggtttttaaaaactatattagaatttttaaacactgtaattctatgtataggtttgggtctacttttatagacaaaaataatgtttaaaacctttttaacttttgcagttgtttaaggaattttcaagttataaacacgtagatgtttgttttgtgttgtgtttggaaatttttaaaaatcatttcttaattttttaattggaggataactactttacaatgttgtgttagttatgctgtacaaaatgtgaatcagctgtaagtatacatgtatcccctctctcttgaccctccctccctgaaaattttttatatgagagatgaaatttttcctgccatttcagagaacaaaggatatcacagtcatcagcagttgcagtcaccacagatggttgatgagccctaggaggactcaggagaaggcaatggcaccccactccagtactcttgcctggaaaatcccatggatggaggagcctggaaggctgcagtccatggggtcgctgagggtcggacaccactgagcgacttcactttcacttttcactttcatgcattggagaaggaaatggcaacccactccagtgttcttgcctggagaatcccagggacgggggagcctggtgggctgccatctatggggtcacacagagtcggacacgactgaagtaactcagcagcagcagcaggaggactcaggaaggaaagaatacctgccatctaacagccatcatactgcagccacaccctacagtgagccctgaggaagcttaggatatggggggaaaatgggatactggccccagaaagctgaggtatatatcaaaggaatgatttcattgagcccagaccattgcaacttcccatgtatagaaaagggctaacttccttaacttgagatatctggtttcctttaataatttttaatgttcagattacatgccctttgttgcaaaactttatataacctggctcctccccatataacctggctcctcccctcctcctggagcagttctctcagggttacttgagatgctgtctccagggcatgaagtcctaaaaagtcccaccaaataaaacatactctcaacttttaggt

SEQ ID NO: 44881 - DNA, 1978 bp, Bovine  19866881180853
tttgggctttcctgccctggccttcactggactcttcccgttgtctttgcttcttttagctttccgcccgttcctagcagctttctgagccgccgtggccctaggcttcttagctcttttgttggctttaccattcttcggagactttgaatctctggataaggccagcttcctactcttcgcagcagcaggttttttgacttttcccttacaagctcaggaacagccttcttgctgagctttaaagagccggacgcaccgatacccctagtctgtaccaggattcccttgctcaccaggcctttgagacccagcttaatgcgactgttgtttttctccacatcgtaacctgcggctgatagtgcttttttcagcgcagtcaaggacatgccagctctctcctgggagaccgaaagtgcctcagtaatcaacttggacactgatgcgcttgctgtcttccgatttacacccgtcaagccaactggcttctttacccgcttcctcgcttgaggtttgtccatggaagccggaacctggacggctggagcggcaggcgccgtctcggacataacagcaaagaaaaacagaacacatcattcagccagtactagctaaagtgtcgctggttgtaggggaggagaccctcagggccttatatagggcagggcgcgctgtgattggttcatcgctcaggcaccgcccccgccccttgggggaggagcatttgtgtttgtttcacttccaaaaattgaatagttcaaaaatctcttgcacggaattgcccaggttctactgctgaataatccatagagatacagatttcagatgccttttcagtttttaatgaaaaatgactctgtatgccaaagctattcaataaagctcgcaattgtcaccacaatttaaagagaagaacaaaacttcctcttttccttataactataaaagtaattttaaacgaaagacttatctcatgtttcctgagtggttttccatatggttggcttccagtcggtggaaaaaataagttattcacacctttattctagttgaaaattatttatgtgcatgagggaagtaacacagatatcttagaagtctcactgcagacttgaaagatgcttttagaattgttgaaaaaacttcagggtaccaccttatttgggcaaacacaatctagtaaaccatgatctacaggcatgtggattgtgactaaaacaactttctcagtctctacagcttgatagcagaccctcaagcatgaagtaaataatatggatctcacgcatgatatctgcttggccaaaatcaggtccccttgtggcttggcgtcctaaactgagttttgtttctggtttcattagttgaaaccttacccctatgtccacccccatctccttgacacttcactgtaaaaaaaaacaaaaaaccctcaaggaaacagatacaatccctccccttaatataaaatgtgaggcaggaaccctgataagaagagctcattggaaaccacagacccagatctctaaaaggactggcctggcatgtgtgtctacagagctgtggggaaagaatgactacgataatgtaatacttcttcttctgaaatacttcagaagaaatcagatggtgagacttgcaaacttctaattgcaaagtaaaatagaaaaatctctttcactctctttgcttcacatccatgcacccacatgtgcacatacacacaaacatctgaaacaaaaactctgaaaacaatgctaccttaagggttctctgatatattttaatcgtttattttattttattttttaaaaatgctagttgtaaatcatgagattgatttcacagcctacataatacattctgaccctttgaaaattttttctccttagattacagcttactgaggactctcttttaacgtgtatttggtttccctgaactttggtgatcccttagaggttgtgccattaattgt

SEQ ID NO: 44882 - DNA, 2543 bp, Bovine  19866881280403
tctaagggcgttccaaactgagagcttccagtagtactcctccagcggagtcaccaactgttaacaataccttcctgcaatgatgtgtgaaacacaatatgtattgctaactagggaaactcaatcaagccttggtgtccagactggatctttacccactccctctggatctagtatagatacagcatgacccaaagaacccaacaaaaatgattctattagactacccagtgtagctcaaagcctcatggtacacaaagatattcttatcttttatccagcacagacataagaagcaatacattccaaaagccaacagatcacgttttagcaaagggaaaaggccatatctcttcaaataaggctacttctgcacacagtcacaagaaaaactatatttttacaattttgaattgataactcagttggtaaagaccacctgccatgcaggagaccccagttcaattcctgggtcaggaagatcccctggagaagggataggctacccactcctaaaaacttgggcttcctttgtggctcagttggtaaagaatccacccacaattcgggagacctgggttcgatccctaagttgggaagaagccaaaggctaccaactgcagtattctggcctagagaatggggtctcaaagagttggacacaactgagcaactttcacttcacttcatctatcactgactataactcgagttctacaactatttgcttcttatgtctgttctgtcatatacttttgcatgtttaaatcaactatgaatccagaaattgtctcatggaagactattttttgtactttattcagatgagcaacttcagcagtcttccccttgacttataccaactgctctccaaacacttccagcaagaataatagagtgggttgccatttcctgctccagaggatcttcccaacccagggatcgaacacgtatctcctgcttctcctgcactgacaggcagattctttactgcagagccacccgggaagccctatgttttgagtcattatctattaatgctaataatgacttatttatcctattaatgctaataaagtgtaggtaacattggagtagagattcctcatagcacattatagaagcatatgtaaacagaaccctcttttttgtatagcaaatattaatgctgacggtaaaatggcacctaacatataaaccatttttgtttcttcaatcaggggtgagataagagtacagagaagaaatgaatgcaaacagttaacagaaaatgaaaatctggccatagaagttatgaagtatgatgtctgatctgcctgaagtaattgattattgtgtatatcccattaaaatcctacccatcctgatttattgcacattgatttacctgcaaaggagaaggagatcattacctaggtgaaagagcctaaacaaggtgttttagctttgtcattttatttaaatcatgaagatagaatttatttctatcataggcctaattactggaaatttattatttaccatctactcacttaggtgggggaagtctaaaggagagaatggcaaaacatctgtgagattccacatttaataaaatctgtggataactggaattcaccttttgttaattcaaatccttctccttagataacccttttctatacaaacaattttttcatttttctaccattaagttttgagtgggtaaggcgtaagaactgttttggctttggtaacaatctcgaaggtaaacaacttagtttatctaagctgacaaatggtaagtcaccttcaacacctcaattaacgggaagacattactttgaagcactctgagttaagtgtgcgctacttgaagggctttgaaaagcagattgctaggccccacctcagtttcactagattgactagatctggagtaggggccaataatttgcatttctaaattatcaaagtgatgctaatgcatccggggatcacacttgggagaaaaaaaaaaaagtgaaaccccccttcagttgtgtcagactctttgcaacccaacggcagccatcccgttttctcctgggatcccaacccagggatctaacccgggtctacctgcattgcaggtgaattctttaccactgcgccacctgggatgatactaccagtcacacaaaactggaaaatcgccttgagtttcaactgagtgtcaagccctaaaaattagcacctccttctggtgtggccatacaaaatagcatgggccttccatgccccacctctgtctgtcccgcctcccatagccacggcccgccgcacagtctccctcactgggtcttcccaacccacttgatgctccgctgtttttcctggagccccacgttacgtgtacatcaccttcggctcccctacgaagtcgccagtaagttgtaggcttccggccaccactctggtttctcatgaccaccccctactgctgcgcaggtgcagcctacccccagcctcttattggatctgccagggaaatgagagaccctaacagtttaagggggcattca

SEQ ID NO: 44883 - DNA, 1269 bp, Bovine  19866881731892
caggtggcatcaggagtcaggatgtattagggtttatcctggctaggtatgcaagtggagcttgtgtgcgcagtcctgtctgactctttgtgaccccttggactgtacctcaccagaagcctctgtccatggaattttctaggcgaatactggagtgggttgccatgcccctcctccaggggatcttcccgacccagggactgcacctgcacctcttactgtctcctgcatcggcaggcaggttttttaccactagcaccacctgagtatcctggctacctgcgaagtgggggataatgaaagaataagctcataaattgttagggcattttagcaaaataatttatttagagacaatctcatttcttgttgctagtatgagaggctttgtccctaaaggcatttcagatttctgtcatcagttgaaagaataaatttggagaatctggcctttccaaattccccaaattggcagtgatcttctccacctcaggacaagaccagtcttgactgtgagacttgagacctgccctcatatccttccattgttgtcctctgttgcacagtgtcagcttaaataatgaggcagcctgacttcattctatcaaaaaataatgattattttctcctagacagtaaaacaaaattttatttctctagttatgtgaatgcagatggtaaaattgagtgagaatgttgttgtatatttaatgggggagggagaggatggctggcaatccttgcttgacacacacttttttgtcttatttataaaaatctgtgtcattctgagtcagcactgattaccatagccacaattatagtaatctgccgacaagcgctaatattgctaatgatattgctttgcagcataattatctgaaaaccactctcagctgttgcatcaggattacagcatttggataactccaaattaagccaggggtggaaaaggcagcacttgttcagtcaaaaagagctggtgaagaggacagcctgcaattagttcaaacaggctgtcaccagggggctggcaggcctggttcacatgccctaggataggtgatgacctttaacagatgtagattctcaatataaaaccctccttgagtctcaagcagataagtgaagaaagctttgtgcttgactgcctcatcttttcatctatccttggataagtaccctgtgttgaaaactcttcaggaactaaaccagcagccccacctgcagaacttgtgcttgggtattcccaaggtcaaatcaaccaaa

SEQ ID NO: 44884 - DNA, 931 bp, Bovine  19866881854441
cttcatttgttgataatgcctcaaataatcaggtagtcatgaattaaataatttcttttatatgtttctcacacctgttttgttccctccctcacacccaggctagaaggtcattaaggtatttctgtttgttttccagagaaactcctggaagagctcagtaagttctatatcctttgtcttttttcatccacaaagttgtctctctcttattataaaacatgtcaataacaccctttccctctccccaccctctctcactacagaatggaaaagggctacattgcatgcaggtcagtgactctgaatatcttaagggctctgaggtgctaccctgcaggtactgaaagtcctccaatacttggaaataaaaaccactaatatatagaggggaaagatgatgacaaatggccccaacattatccttgaggcacataaagggcccttggaagatggctagaaggcaagccccctctgacagggtcccatggggtactggggacagtcagttgatacatcaccctatggctgtggatggaagaggggaaaagagacagctgagcaggccaagcagttcccttcctgaggagatctgtcaactgctagagcaggtctccacttcttcagagaagaaaggatggttctttcaacctgtgacattcactgataatcagattcactttctctctgtctctagtggatgtgactctggatccagatactgcccacccccacctctttctgtacgaagattcaaaatctgtccgactggaagattcacgtcagaaacttcctgagaaaccagagagatttgactcctggccctgtgtgatgggtcgtgaggccttcacctcggggagacattactgggaggtggaggtgggagacaggacggactgggcaattggggtgtgtaggggagaatgtgatg

SEQ ID NO: 44885 - DNA, 1214 bp, Bovine  19866880369697
caaatttgtatctttcggggatggctgagtcactctggaatgccggatatgggtgaggctctaagaaagagggatgatctaggccattcaatctcaccaaccactccctcccagcttcacactcatggagcacgaagaaagaattccagatacatttagtcttaatcattgtttgaaaactttatgtctgggcaccaaaatatgaaattcacaactgtaataccctactgccatacctcttcagcattatgtgaaaaaaaaatgcctaatgtgattttcatttgccttttgatccttcctagcttcagactttgttcttcacagcttcggctgatactttgttttcatggcatttcttgctcttcgtcttctcgctgagtcagctgttcctgggacggttttcccaaggatgaccgttcaactgattcctgcttttccggtttcacgtctggctgtcttggtgatgactcttgtgactgctgtcctgttggtgggtctctctggtcttctttctcagctggggtgtctagtagtacaggtgtgtgtttttcctctagaatgtcatttggttccttttcttgttttcagtaaacaaaacaaaacaaaatcaccagtaaacatagtagccatctaaaccacgtgatctacatcataaaataacaagcactgatactatatcactgatttcaaaatgacagtgatgatattagaaagtagttttcacatatgacattacactgacaaattgcttttccgtgttttatcgcttttactctcatttagcaatgtgacccattcattgtttaaaagttgacaagccactgggaagacttgctttttctaagtcacagagagagggaaggcacattcatgaaaattaaaaagaaagcatcggtgcaggagaatccagagccactgttctccagaagaggcagcgacacatgaagaaccacccaagcagagcaggaagagtcctatgcacttatcaacctcccagcagccaaactgtgcttgccaacgccaagcaaatcctacagaaataaaagccctctgtcgtcagaaagcagaggatgttcctaaaacctgaaaacaccaccgctggaaacagcccgaggaaagacaccttcagctggagcttcgcagaacccaggaggagccaggcgcctcacagcccggaaccctgataccttccttcccccaaacctgctcccgct

SEQ ID NO: 44886 - DNA, 1215 bp, Bovine  19866880469313
aggcggccaagccagacaggggaggggcgggggcagggccaggccaggcgacgggcatccgagtcccggcaggtgaggcccgcggagctcggggccacggagggaggcacccgccacagtgtggggtgggaggccaagggtgccatgggccccaccgggaccctccccctgctcctccgcctcccgctctgccgagcagaggggagatggcggacaggaccatccagacaattaaagctggtcagaggatgtgccacgaaccatccagagcacgtgggaatccaggcgagcaggcgcagctggccgcgctgcctccaaagtgtaaccttcagaatgcaccttcgtgtgcagcaggagcgagtcaagggcctgggtgaccttgggaaggtcacttcctgttccaggtaaaggcaagccccgcctcttcaacccagacagagaatgcttctaggattatatttttccagtggctttgatgggcttcagcaaacttttcaggacagtagactacgtatgaagtgctaaagtacctctgaaggcacagaatacccgatgttataaaagtatcagtgtcttgtacaactgtttaaaaaagtaataaagaaaccctgctattgcacagccacagccaggctttgaactaccaagtgtcccacgagtgagtggtacccgactctgtggtcccatggactggggtccgccaggctcttgtgtccatggggtttcctaggcaagcatcctggagtgggttgccaggccctcctccaggggatcctcccaatccagggatccaactgccaagcactccattaaatgacattaaatgacactaaatgtcaccagtgtgtgagagtgaccactttattaaatcatcaggaattacattgaccttcaaaacactaattgctagaaacttaagtttcaggtgttgaaaatacttcagaagaagagtctgagtcactgtacaggttccatgtgggttagaggttcgccctgaaccccgccttcaccgagaacctcatcatgggcttctcgcggggccgcaagaggcagatggagctgggaaagcccttgagtcggaggcgactcacgcccccgtcgggggtgatggtgaacttggcatgggtgatgacgtcctgcagttcgggggtcaggctgtccagcacatgcatctcatcgggcttcagcggaaagagaggggaggcggaggtcctt

SEQ ID NO: 44887 - DNA, 3048 bp, Bovine  19866880551251
cccacgttgctgtgctgtgatttcctgagtgctctttcgacactgctttatttagtgggaacagtccgctcaaacaaaatgaatcatccaggtttattctttacttctcatgcttctcgtgtcttgtccctgggtaaagctcgggggacatcccttgctgtgtgcggtcctcattggagcgaccttgagcagaaggggactctctgggtttcagggctctcagccctcacgtcctcccactccagagtgaccccttccgccgcctcctcttgctaccgggtggccggtggataagcctctgctctcaggagctgtcatcagttactcaccgcacacagtgaggttaaagcgctgacttggctttccttgtgggtggagccaccttttctttgaagactctggctgttagtcagcagccgtgggggcccagtgagtgaagcaaaagccactcagtcgtgtctgactctttgcgacccatggacttagtccatggaattctccaggccacaatactggagtgggcactctttcccttcttcaggggatcttcccaacccaggggttgaacccagggattgaatcgtgcattgcaggcggacttttttaccagctgagccacagggaagcctgagttctaaattccgttgctctgtcttcccgcgtaggcttgtgagcacacccctgctctgtaggtaaggaggttagccgcacagacgattactccactgaatacacaccttgttttacccaagaacgaggacagctgaaaacaaaccaaccacttcctgttggctcggtggtccgggccccaaccttgtgctgtgaacgccgtgcatccaccatcacgtctccctgcccgttctcaccagtgcgcagtccaaagtcactaaccagctggtgcttccttctgttcatcaaagaccttggttcggtccccgggttgggaagatcccctggttacttgacagacctgcttagtgatattctgtgatcctttacttcgatgtaaagtgatgcttcggcttgctacatgggacagaggacagtaagcactgcccctgcatccagagtctgctaacagccctggaccacgggctaagctggtcccggaggcagggtgtagctactccagggaggggaagtgggcagtagagtctcaagatgtgaatggcaaagaggctgagattgttttaggggcgaggagggataaaggcctgggaatgcgcccgcttctaggagtgtggcagagtgagcagccctcactcaagaagagggctgctggagaccgggtccttgggagggtgtgacttgggtcgtctctcctgcagggcgctttgcagtatgcgcgcctctcagccagcagtctacatcgcggagtttatcttgaggccataaaatcagagataagtgcttattttgtatctccagacgtcatctaggttacaacttaaagcaacaagtggtgggtctatgacttaaatttactttcattttgcgggggcctattctctgttttccaagttttctgtgatgaccagcacgtgtgaatgtagaaaacagaattattttaggaataaaggccctcaccaattgcaggagagcgcaccatgttgatctgtgattctcggtctctggttgggtcttctgtcactgtcagagtctgtgaactcaaactactttctgatttgatttgtaaaagggcttggtgcttcctgggtggctcaatggtggacgcggctttgatccctgggttgggaagatccccactcccatgttcttgtctggaaaatcccatggacagaggaccctcatgggctacagtccatggggttgcgaaagagtcataaacaacttaacgactaaaacaacaacaaaacagaaagacttggtaaacgtctttgctgatttatttaaaaatgtggctcgctcacagagaaatcagatgcctacacaattgttaccaaatgcaaaaattaaatgccatctaacttagggtttctaactttcacaaagtaattaccgcttaaaccaaaacatcggattcattttcacaaatttgagcctgacatcttaattcataacaagcagctgcagtagactccggcagtctcaaaaatgagtgaagatgagacaaggttttgaagcaagtaatgaacacaggacgtaacagaacattcaaatcacacgactgtaacacgggcatcagggggcttcttcgtggacagaggcaatggtttttctgatttcctccagctgttgtggtttgtggtggcctctgacctcccacaactgtcaacgaaatcagccttctcttgaagatctcagttcttattccttttcctctctgctccaacgttcagattctctcaactgctgttgctggtagtttaatctctccaatcatctctcctaacagcttctccgatttcttcctttatgaccggcagctcccccagctgctctcatatgtctttttcctctcaatttgccaacatgtcaggtctgcagagcagccctccgtctagttctttttggcccctgagttcaatttaactggagtgcttattagcaaaaatatttccgtgttaattatgtcagcggaaacttggcatgccgatgtgttaaggagcacatatcagcaacagcatgaccgtttccatgccatgttggcagagatgctcatgaactttaaaatgcctgaaatcaaagcagaattgtcagatgagaggctcagcgggtggatcggcagaagttttattgcatttgtttgcgttgtgcttgtgtgtaccagcactttgtaacttgcaagtgttggtgtaaatctcgcatttctagttttagcatttttcactggacactgaatattgtaattttcctcccctttactgttgaggtttttgatgagcagctgccgtggaaacggagcgacgttttctgattgttggtgggtacatccaacatgtgcactttatggtttgctggtcggctggagagtcccggccccctgggatcccttgtgggagagaaggaaaccagcacgacccccca

SEQ ID NO: 44888 - DNA, 901 bp, Bovine  19866880622265
cttccctccagatcacaactcctgatgttcataataaagtgacaggagagttactgatgagtccttgagtgtaaaatgaatttatggacctgcctgtctgatcaagaattaatggactgaatttaacagaaggttttctctcccctccacttatagctggcaggatttttattgtattatctatcagccagtgtaaggagcacgtgaatgaaataaatgtggaagcctgtaatgaatgtgaaaatcttatgcatttaattgaagcaaggtcactggcttctgctggagagtctcaaggtcacttttcctgtattactataggtggcctgtagaaatactggtgaactgtcagtaggcagtaggtgattgctgagatattaatctctaaattatagaaatattaatacatttgacttttatcacaaactaattatttgcgcatcttcaatatatctcatcaaacgcaacatcattcttcccaggcatcttcatgaaacatgcacgagatgaaaagaactggtgcctttgcagacatgctgtgtatcgaccacactatgcacacggagtcagtggatattcacagcccctggacacagcagcatcatctccattttccaaagtgtataacagagactttaagcaactccccgaatttatacagcttggcagttgtgaggctggaatgttcagtcaacattgtgaacttcacagctcaggggcaggagagcagcagaactgggggattgagtcacaggaacacttcattacttctgccactcagccccaccccccaccccgaggcaaatatcccctggcagtatcttccgactctggtccagggctctgtaccttattgagaatgagccagtttttgcccagagtaagtaaagtcacacacttg

SEQ ID NO: 44889 - DNA, 1896 bp, Bovine  19866880682469
cataggatggaaacctttaaagtaggtgtattaatatctgggttttcctttctttcttttttcagcatctctcaagaacctcagcaagaataagaaagtggttccgtttcctggtaagagaatggttatcctgatgttttatggggcgcctgtgagacgggtccttggcagttacccgcgaaaatgtgtgcacagcgccccccgctggggcagcccggaacttccatttgggggcagcgcctggcttggaacaaaagctgaccctccccaggactgtgctctgacctctgcaagccctcttttctatggcaccatatttaggcggattgacaaaggaggattttcactcagcaacgtagtcacactgtctgtccgtcagccagcgattcagtccaggcagactttgcattgttgaactatgcagttattttaagatttcactgtatttatagcattttataagaaaaaaggaaagaagagaaaaaaaaagcttatacttggggtaagaaggtgcagttttcagacaggagactccagacaaatacggaaattcttgggggccctgaagtgacacgttttagccacatttaggggcctattggattatggattcaattctgaagggaaccaatatagaataagtgtgcaaggtcagagactcctcagcgatgattgcatctaagcagtgacgtgaactcaggggctttgaaatgtgttttatcacaaaccaatgcagcacatacattgctggacatgaatgtctcatgcagtttcatgttaaagagcgtggtggtctgttgttcacatctcactaccatttttaattttgcagagtctaagtttatctgtctttaggaatgctttatgtgtgggactgggcactgctggtccatttattatttattccctttttttcatttatcaagcattttccaagtaccttccatgtgccaggctgagctgagcacttggggaaaaaaggtacctaggacacaacccctgccctcaggcagctgccaggtggggactggacccagcagaagtcagcccgcccgtaggtgcaggagggagcctggagggcgctaggccggctgcgagtggtgcagaggtgccccttcctgggggtttgccaagcgcggtttcagctcctcctgcctctcaccgcctcggcctttcattttcatataatcgataattaccttgtgaaggtttttggtctttgttctctaataatcccctccttcgttttttctctttaaacttgtggtaacagtaagtgtcatgtgtccagtttgccttctacatccatggattcaaccaactgtggatcaaaaatattaggaaaaacattccagaaagttccccagagcaaaactttgccagtgccggtgaccgtcacgtagtttctaactgtactgcgtaacggctgtgacatagcgtctgcaccgtattaagcgttccgagaattgagacgtgatgtaaagaacacgggagagcgtgcctaggttgtgtgcagacaccgtgtcccgtcacgtgagggactggacatccgtggggtccttggaaccgcacacatggagagatcagtgtccacagttcactgtggcctttgaccccttatcgccatgatctgacatttctgaagacccacattcacctgtttttttcaagaaagaaataactgagacccaggaagagaaggcagtctgtccaagattattctgaaagtaggtagacgaaccagcactcgtgagtcacttaaaccatccttcataaaggagacagaacagtggggagctgcccaccccgagctgggcaccaggtgctgagagagtacaggtgagctcggagcggctctgccgctctctggaagctcattgctcccaggttgggact

SEQ ID NO: 44890 - DNA, 1351 bp, Bovine  19866880797369
cgttcgccccgtgtcatgttatgtgccggccagacaacacgcttgcaccataaggccttcctcaaagcacaggagaactttggagatgtaatcacttcattcaacataaagatcagcttctgaggcctcttcctcacagcacagctgcagggggcaacacagggcactcacaacacatacacaaataacagacctcgataacgcgggggaagagccctggccctggaatcgtaacacccgggttcaagacctccatctgtcacttactcgccccgtgaatttctgtaacacagtaactacacccaaaaatgagaatcccatctaactcacaggattgttacggggatatgaacactagttgacaagaatttctctttttaaaagcagaagatgagatcaggcgttgagctccattatgtgtcaccgtttggaaactctttccgtgcaacagaagggaagaagtgaagtgatgtcactcagtcgtgtccgactctttgtgaccccatggactgtagcctaccaggctcctccgtccatagtattttccaggcaacaatactggagtgggttgccatttccttctccaggagatctttccgacccagggactgaacccgggtctcccccattgtaggtaaacgctttaccgtctgagccaccaggaaggattaaatagaagcaagcctctggccatccgtgactgtaagcggcgtttctgatattcccagcaaacacgaagcggacccgaggcctacaacgtcaggacccccgcgcgcctaccccaaggtggccaagagggccgcgggctccggtccccaagcgaagccgcccacaccgccctggatcggcgcgacttgctcaccaggtcaggaagaccccggccttgcggcccctcctcacggcatagaacatggcaagactgcggcatcccacaaaggccaaagccactctgtgcaccacgcccagaagccgggtcatcgctcactccttgccaccgccgagccccttagctcccagccaagcgccgccatcacagagcccgaacttccggcggcggcgcagggagatgacgcagcccggcgccgagggtggggcccggagccaagtgctctcctgactcgtcagtatcccggatgtccgtgaggacgcggggcctgggcggaagtctcggagtccgggcccagggggcagaggcggggacagggactttccggggcggggccccgcggagacggtcccgggggggtggggccctgccccgggggctgtgccttccggctctcgcccgcctgcgctcctggaaaccgttcccgggggtctgcggggcttgtggtgggcgctggaggctgtg

SEQ ID NO: 44891 - DNA, 1382 bp, Bovine  19866880981002
ttcatcaggacagtggatgccagctcatgattttatgagcattctaaattgtagctgaaggaaacatttgattgtaaaacatgtttaacttatttttcacccaatacattgggattgtggtagaacctggatgaaaattgtgggtctggtgctgaattactttttctttggcctgattttcctgatatatattatgttggtaattccttgtttgtgaatgaaggggatgatttttttttttcttcaccctttcttagagagcagttttccagcctggtgaagtgaattaatgagggtctgacctccatcaaatctgaatttatgtgcactcaaatgtaaagatgttggaataagatgtaacagtgattctgcacaccaaggcatgccagaaaatcaaaggccttgagttattcttctaaaaaagatggatcaggactctgaaatttaatcccatacaaacagagcatgacgctaatttccactctctctgcttgtcccaacttggtggctccaaaagctacctgtcacaaacagattttaagttgatttttcttctatctctgcttccatcagattaaaatatggcaccttcactgccaacgttctagcttcttttgggaccaaatcacgtattgtcatcagggtctcagttgagagcaaagagcaggaacttcttgtaaagcgtgatgtggatcaagggtaaggttatttagcactagaaatctttttgtaatccaatcattccagttactggaagggtggaagaaaatgtgactgtgaagtgggtcacttcttaatatccaagcattaaaatgccagcttgaaaaattagtataaaaacttgttatatagtttaatttcctgcttgtaatggcgtgaaaaataaatcagtgagtggtcggtgatgcaactgcaggcggggtgcccggatgtagacacggcataaggtgctgtgttctttcccctccgtctctcaaatgtcccttcatattttgtttatggaattaaaagtgttagtctgcactagcgtctcctagtcttgcaaatgcaattaccaaggcaattagtgaaattttagagaaatggaaatatttgactagagcaagtgtatcctgcgatttgcttgtgtaggtgtgtgtgtgtctatagctttacagttataagtttctgaaagaggtttccatgcaactcttacaacaaatggcgcgattctgagaagaaaataagactttccccctttacacaattcttatcaccataggcccttaggggccttcacctttaattagaaatggccatgggcttgtgaatgcaggtgccactcatgatgacaaaatcacttcatacacccaaatccttgatggtttcaaattgtggtgttg

SEQ ID NO: 44892 - DNA, 798 bp, Bovine  19866881045373
tcatcagcctctgtggcagcgaggggggcctctggacgagactgtctgggcgcgaagtgagccatcaggggcccccacaaagctccccacaaaggtcccccaaggcaccttcttcgaagtttgccgcttgaatcgacactcgaggggcgtgatctcccgtgaagtaggacgtgtccacgtcgaagccccggataactccctggatgcccagctggaccacgcaccagtcgtgacctgcggacgtagacaacagggcccccgcggctgaatcccgccgccgagccgcagggctgagcacgccgacagcggaagtgaaacgccggaaacgaccttcgcgcatcggggaaaacggtgcgggctccttctcccgaggctgcaaggtctcttatgacgtggctacacccgaccgccactcgccacacggaccctcacttctaatctgaccagagcgtacataagccctgggtccagaggggccacatgtctgactccaaactggccacctcctgtgggcagcattggcagacgggcatctctgagcttcatttcttttacctgcaaatcagagatgagctcagcttccaaaaagttcagctgtaactctggtatagggaccaccagcccagctaggccagggctcagtactgagctgggtctcctggaacagcctaagctttgccttcagggccccagccaggactaccccaccctgcatcggatgacatagaagaactcccagtatgacactgtgtgattcttggtttccagcagtcagattcaaatccaccttaaaatgtc

SEQ ID NO: 44893 - DNA, 708 bp, Bovine  19866881154251
acacatatatatgtgtgtgtgtatatacatcaacaacctgttggttctgggtcttcctccatttgcagaaagaaggtgttagagaacttccctggtggtccaatagttaagaatctgcctttcaatgcaggggacacaggttcaattccgggtccaggaagattccacatgctgcagggcaacaatgtcggtgccccacgactactgaagactgagtgctctggggcctgtgctctgcagcaagagaagccaccgcaatgagaagcctgtgcactgcaactggagagtagcccctgctcaccacaactagagaaaacccatgggcagcaacgaaaatccagcaccgccaaaaattaaataaaaatttaagaattaaataaaaattaaattaaataaaaattaaataaaaatttaagaattaaataaaaatttaaaagaagatggtaaagcaggtatcacagagtccattgccctcaacagtcaccttatcaagtgtattttctggtatgacaatgaatctgactattgtaactgggtgatggatcttatgatctacgtggctctgaggagcaacagtccctggaccaccagccctaccaagagcacaagaagagagaggtgctcagctgctggggagtccctgcctcaactcaatcttccaccactctgagaatctctccttcttgacacactttccaccccagaccc

SEQ ID NO: 44894 - DNA, 774 bp, Bovine  19866881631331
catgccttttcctcccagctgctgctgctgctgctaagtcgcttcagtcgtgtccaactctgtgtgaccccatagatggaagcccaccaggctcccccgtccctgggattccccaggcaagaacactggagtgggttgcccatttccttctccaatgcaggaaagtgaaaagtgaaagggaagtcgctcagtcgtgtgcgactctttgccaccccatggactgcagcacgccaggcttccctctccatcaccatctcccagggcttactcaaactcatgtctttagagtcggtgatgccacccagccatctcatcctctgtcctccccttctcctcctgccttcaatctttcccagcatcagggtcttttccaatgaatcaggtcttcgcatcaggtggccacccggcaacagtaccccctctctctttaacctggtgcaagcggcgaccagtgactctaccaacacaagccctcactccagcgacccaacacgacgtgccccgcggacgcacctgggcgatgaagacgacgtgcttcccgctgaacttcttctccagctcgcgcaccaggcgcacctggattttctggaaagacttcagctgcgggacggggacgaagataataatagctttccggccaccgccaacttcgatctcctagagtcgaagcgggaagagaggcacagatgcagttaggcggggagggggaccccggcactaccggcggcccgagcacatgcccaagccccgccccgtacctgggggaacccgaag

SEQ ID NO: 44895 - DNA, 748 bp, Bovine  19866882079006
cctggtctgctgcagtccacggggtcacaaagagtcggacacgactgagcacttgaacaacaacaacaagggcttcagaagctcccaaggggcttccccggtggtgttagtggcaaaagaacctgcctgccaatgcaggagacacaagagatgtaagtttgatccctgggtcaggaagatcccctgggtcaggaaggaaatgacaacccactccagtattcttgcctgggaaatcccatagacagaggagcctggcgggctacagtccatggggttgcagagggtcggacacaacagagcaaccaggcacacgcaaaacctcccctcttcctggccagccctctggatgcactgttgcagtgcacacaggacaacctgatctgacagggatggagttcggatacatgccttttattcacagaagcaccgagtgagtcagcattcatgtgaaggaggatggtgcatctgttctgagaggcaggtcataaaccagcctgtgacaccacagcgcaggacctcagctctgacaagtgtgagtggggtgactgtttcagcgcagaggactcaggaagtgcccacggctggctccagaatgctagaacacaaacatcaaatttatgtagtgcatttaagggctttcataacagagattatttacgtgtcagggaccatcccatcatcagagtgcatatttacaaaactttaaaaatgcacattagctacctgagagcctggctgcaatagcaat

SEQ ID NO: 44896 - DNA, 968 bp, Bovine  19866880555391
ggaagtcattttaaactacttctaatttagttctcttaaataggaggaaaaagtaattcctaaattagagttatgtgtttgtatattgttaaaatatacttcccctctcctcaaattttcctttgttttatgaaggtcatcagcctctgaaattttgaaagacttgcttaggatagtttcagataagaaatataacattgtgaaactcttattttatgaccatgggttaaaaaaaatatattttcttattccaaaaatagttttcaaacctttaacagagatgaccatgagtctcagctactgcttttagttttaaaataagaaatgagttatttagaatacatttctctcagagaattatttctctagaagctaaatttttctttagatggaagatcaatgacataacttagtatcctttttactttctttatgcagattgccagaccagctctctttgaccagcatgttgtgaattctatggtatctgatattgaaaaggttgacttgaatagcatcggatctcaggcccttctcaccatttcgggcagcacagacactgaatctgatatctacactgaatgtaagccttctctctctatttagagcagggtctctcaatctcagtgctatccatgtcttagactgcataactgtttgatggggcagagactgtcttgtgtattgaaggatgtttaacagcatcctgggcactatcccctgcatgccagtagcagccaccccaagttgtgacaaccaaatatgtctccagacattcccaagtgtccccttggactacacaatcattgagaaaccttagtttatagaaatacttttaatttgaaaaaattgttctctattttaaaacagttgtacttactgattgggaaaaacctggaaaatatagaaaatgttaagaggaaaataaaagccatctataatctcattggctagaaataacccaaatg

SEQ ID NO: 44897 - DNA, 3570 bp, Bovine  19866880635948
cgcaagcaagcctgtcctactttctccgcaggtgggtggggtcaagtgactagttctagccagtgaaatgtgagcagaaaccatctgtgccatttctgggctgaggtggtagaaagcccactggtgtttctcctgtcttgtctgtctgctcctgcagcaccagaggagttgtgtggtccagatgatgcaaccacaatatgactgagttcctgtccactcagatcctttttccctctgattctggattcccttctctcacctgcatgtaaccataatcttgaatttggtaatgtcctccacacctgtttttataagtttacaccatttatatttgtccataaacacatcgtaatgttttgcatggatttaaactttaaacaaatggaatcttattgtataggtttatcaatatgtgtgttgcttttcaattaatattatgtgtttgacatttcccatgctgttacatgtaattcttttaagactgagtgaacacacccaatttacttatctattttcctcctactcatttggatagtttttgctgtaataaacaacactgcaataatattatataggccccctgagaacatgtacaagagtttcttaagaatttgcacttcaaaatgcagtcatcagattgaagtatttgaatgactgtttagatattagcatcgttagtttacttttagttctactttagatattgacaaataaaaatgcctaacacgtataaagtattaatgctggagaaggaactatttaaagcttttcatttaatcctcacaaaaactcagtgaggtcccttagaacagggcctggtttgatataagtaagcgctccttacatttggctctttctgtcatttgtggttcacagatgaagcagctgagatatgggtatttgaagtaacttgaccatgtcacatagccagcgagggagacaggcttcctcaaaagtccacccttttaaatactaagctctcctcccctggactgcaaaggtcctggaaaagagttcttatttctccaaagatttgcagaatttgctatattaagcatttccatttttgccagtcttaggtgtttaagatattatttgactattgttttttttttcaagtccctcactagaaattgagtggtttttcatatgttcactggccagtcaggtgttttctttggccagtgattggctattcacacatttcttttgcccatttttatgttgggttgttgccttttgcttattgattcattggtgctttgtatgtatcctagaatgaattctttgccaaatatatttatctcaaagatctttccagtctgtagattgtaattgagccctttaaacctcttatgatgaaaaagctttacaatgctaatataattaaattccatccagcctttttttggttgtgttttttcaagtcttttgttcagtcgctaagtcatgtcggactctttgtgaccccttggactgcagcatttcaggcttccatgtccttctctatctcctagagtttgctcagacttaagtccactgagtaggtgatgccatccaaccatctcattctctgtcaccctcttctcctcctgccttcaatcatgtttttgcatttacaagacccttccctatacagagataataaagatatttatctattttctcttctaatagttttaaaattctgtcctccacatttgtctaatcttcctggaatttatctttgactttatctagcattattatattatacagacattatttaataagacccatcctttctctgctgatttatgatggtatccctgtcatgtatcaagtgctcatattagtgtgggcttttgctgagctctattttctacctatctgttccattaatctttttgtttatctctggaaaaaagcaccaccttgtgttccctagctttatactttgcccttatatctgaatggcaagcctctccttcttgctttcttgaaaattgtcttagcttctcttgcccctttatacaaaaggcctcttagcctttttcatatgaatttcaggatcagtttgtcaagtttcattaaaaactctattgggattttattggaatgttattgagtttgtaagttctttcaggaaagaaataacataaactgcaatatcaagtctttccatctattaacagtatatacctctatccgttccattttttccttaggtccttcagtaatgtattttaatattctccatggataaattgcacatatttttctgttgctcttagaatgaaatttttttcctacttctactcttatttgcttattgctgatatggcaatataaattacttttgtatgttaatcttttacatagcaaatttgctgaactattttattatatctaataatttgtctttaaagtcatttggatttttaaatttataatagagtacaatttatacggtagcaccagtggttaaaaaaaaaaatcgacctgccagtgcaggagatatgagatgagagtttgagcccttggctggtaagatccactgaagtaggcaacccaccccagtattcttgcctggaaattccatggatagaggagcctggtgggttacggtccatgtggtcacaaagggttggatacgactgagtgactgagcatgcacatgctcaattcatatagaaaatgtctttttctcatgcttatactctgtcttttatgtcttataacattggctggaacttgcaataaagtcttaggctcacaaagagagagggacaacctcaaagttacccagttagataatgcaagctaacccaatgttgaatacccaagtcatgtttccttgtcactctttaagcttttttttctgaaggagatttttcccttggtcttctgttagattattagatcagttttagatgactttacacaatttttaattaggtaaggggggaagacgcaatcacacaaacatgaaaactagattgattatgaagtagtaaacttaagatagtacttttttacttttaagtagtcatgggaaagcttcattacatgcttcaagttacatcacttagcaacagctctttcagaaatttcagttatcagcatgatcactaaaaagagaataagctgcaaaacaaatctaaaaaatgagatacaattgcagctagaaataaatgagtaaatatctaattgtgtttcaaaatatggaatggtcctttccgaatctatcatttttgaggcattgcaatgctaattcttcccagcatgggtcatttgctttcattttctccattcgtatacagcattatatatggagacagtggctttaacgttgcggtcttcactttccaaatttggggaccgaccccttttccttgacttgaaaaacagcaggggagtccagtgttttgacgaggggaggccagtgcttcccttccggggagctgcttttggaataatgctggcataccattagtattcaacactggaatgaagagagcaagattgcatgtcttaatcttccgtggatgcagcctggggtgcatttggaagaaagagaaaaaagaaagc

SEQ ID NO: 44898 - DNA, 3018 bp, Bovine  19866880659867
aggcatgtaagtaatctgtggtcacagaatggactgtagtgcttgtcatacatttttttgacacttgtcaccaagagatggcatgtgagatccatggcccctctcccttgaatcttggctggttctagaatttttttgattgatacaatatcacagaaagtgacacaatgcaaatttccaggcccaagtctttagaaatgggcacttcttgattcttggaatagtctgggagctctgaggctccatgtaagactctccacaccaaatattaccctatatgtataattgttcttttcatggttgattctatggttcgatacaagcaccagatttcttaacaaagcgttttagcgtatctgttgaatatctagtttgaaatacattattaattatctttcttttaaatatgtgtgtacttatctctgaacttctctagtaaagtgagtattacaaaatatttcttataacaatgggatgtggaggtatgggttcatagggctgagagccactggtacaagtgtgtacaacacagaccctttactgctaggaggtctagcaagcttgctattgtattgataagactgtgaacctttaaatcaagccaggctggattcgatcctgattcctcatttactaaccatgagacctcaggcaagtaacttaaattctttgaatatcagttttttcacctgtaaaaaactcatgttttcctctatctcataggatcagtgaggataaaaccatgtaacaaagtacttaacacagtggtcaccacattcgtgtttggtatgcatgtttgtgtgtgctaagttgcttcattgggtccgactcttcgagactctatgcactgtagccccccagcatcctcagtccatgggattctctaggcaaggatactggagtgggttgccgtgtcctcttccagggaatcttcccgacccagggattgaatccagctttcctgagtcttctgcgtctcaggcagattcttcaccactgagccacaagggaagtcctggtatacaatgtagtattattaaaactcccaaagtttattaatccctataatgaatactgaataccaattataagcaaaatgctatgtactgttaatgatacagatattgacaaatgttttgtatttattctttcattcccgaggaacctgtgtctccattctggcttaaaggattcaacgtgctgtccttctactgtctgttttttttccaagtacaaacaattctacccctttcagtttatcctagttatttcttctggatcttgaatttgcattcaaatatatcttagtttggggatttttttgtatttccttttccctcattctccatagtctcattagcatctcttatttccctgctggacatcaggactacacacaggtgaatgtgaggttcagctctctatgtcattagtctgtgcacagaagagatcactctgttgtgtgaggctaggcagcctgcttcctcagcaagtctgggtgtgtcctcttaaggcaagaatcaaagtgcatccctgagaaggagggagccttgcttcctacaaaagggtagggtttttcacaaagctacccctacagagagggcttcatgcctgctgctcatagaatgaagcagggaaaacatcatatccttccattctctggcacaatgaatctgaaaacttcagaatgtcatgaatttgaaaaaaatgacttcacaatcttaacttttaagttaaactcaggattacattatccaggacatgtattcatatccctacagattttcattttctagcttaaaaatttgggctcattcccatcaaagtggatgataaaataattgaaagtctaacatatgcctgcagttggcaccatggaattactttttcactctataggcttgtaattatcaacataccggaacagggtcaaaacagaaatcatccttactatgaccctgactctactcaagtccatctttttaccttaatcacttcctgtctcaactattggtatttctttttttatttatggtcttatttgatccttttatttctaactaagtgaatgctgaaggcagctggtaattcatagattatttaatggaaactctttgcaggagaattttccattagtttaattctccttacgtgatcctccaccaagtcatataatgaccttgacgatttgcctagaatttctggagggaccaattgacttttatgtctcctatgtctcccttcagaattaactcatgattagaaacagataatcaaccacctttttagtagttacagtagctatgctgtgaggatgaagtggctatttattctgttcataaaagtgacgcttatttcacatttactctaagtttgtgactaggtttaatatacactttgcttttacgtcagattttatgttgccttacttgttaatgaattaagtttctagagatgtgaacaaacagaaattactgatagatcaacctaagatgtgtaatggtatgtaattgtgtgttttccatgttagtgtaaatgttactgtagtgtactttactactgtgccatttaattttttaagttgtattattttcaaagtggtagattttctgatttacttttatgcatacaatttatgttgaaagacatattgttaaaattcaacatagttgacttaccgtgtatatagatatacatttttagtactacagagtttaggaaaatgatccataaggctttgtatttgaaacattaatcacttgatgtttttagctgttttgattttataaagttaatatcaaagccacttttttgcttctctttctctgattaattcctcctccccttcacctttatttatttattttaacctgaaatgcatgattctttgtttgtttgccaacatgattagcagttttcatccaaggataaaaatgggttctatcacctttatatgtatcttgcatttttaacgctatagtttatacttctttattttatgtagaaagtaaaaattct

SEQ ID NO: 44899 - DNA, 734 bp, Bovine  19866880670883
ggctttcctgtggggcttgtgtcctgctccctggaggaggtgaggcccctctgcagccggtgtggccccaagactgtgaagggagggtcccagggacccacagcacctggaggggagtgcgcactgtggggaaggtggggtagaaacacgtgctctggaataccgcctgcaattccagtatactgggctctaacagtttcatgtgtggctgaaacagctaaaatagttttggtttatccagctcagttttttttcaattaattgctaaaacccattgccaagagattttaagactcgacactgtcagacttttaaatgtggagttaatgttttgaaaaagaattatgtcttctggcattcgtgtttggaagctctgccaagagtggacatagttggaatgtgattcattaaccgctgtgaataagctgaggttgtagtttttaatcattgtgcatttaatttgtaatggttctccctgcccaccccacacggattctgttttaaaggtttggtgcatatactttgattgctttcattcctggtagcaaaatatactgtaaacaggtgtgacccacatcagctttcacagtgatcaagcaaaatgtacacctgagctcactggttgttaagagacctgatacaaacaaggtggaatgatttttctgtttgtcctgtattataattatggccgatatttcagatccaacatcaattagaagagtgtacttatatac

SEQ ID NO: 44900 - DNA, 1736 bp, Bovine  19866880792264
ttcatactaataaatactaaggcattgtttgtcctgtgttgatacttacactgatggtacagaaccagtggtggtaaaaccgttggtgccttagtatgagtcaaggcaagtagcactgctttactagtgatcactgtgttcttccttgtcatctgctcagaataaaaaagaagcaaatgccagtttcttaagaatatcctctgtaaaatagtaaaaggtattcattttattaaatgttgagtatatgactttttaattattctgtgtgacgaaatgggaagtatgcatagcattgagtttatatgctggactaagatgctagtcttgaggaaaagtacgtaagtgattaatttgctagctgaatgagccattcttttcatggatgacaatttttacttgaaagaatgacaaattatggttgttcagactatttggtagctgttttctttaaaatgaacaaggtgaatccatcacttcaagaacaactgacagtatttattgccagtggtaaaatgtgaactttcaagtggaaatcagaattttgtaaaacacatatcaaccaccatgagcttgacagttaaagagcttttctaataagattggtggtgatattaatgagtatgatttttttgatacagtaaaatgaaatgtgtcagcttttgcaattgttgcataactcagggatctaatacttttgaaatgaccagcgtgtgatattactgaatcctgcttgggtgaaagagccattcaaaagtgcaaggcagacaaatgattttaatgcatccgagtgtgaaagttctttgatatagttttagattctatattgtaaattttggtataatatcaaagaagaatattgacagttatttgaaaaggctaagttactctcccctcttcagagttatacatctacgagaagtgaactttttcacgtgcttctaactgattgagtgaaagcagatatgagaatctagcagtcttatgtaaagccagacattgaagatacttgcaaaattgtgtcattcctctgactaagtttttagaaattagaattattttcactaaacagatacttatgttaacatttatggagtttattaccatttttaacaaagtaatttttttttagatttctcaattttaatcactaatgtgataaacggcattacatcacttactattaaaaacctacatgaaaaaaaactctttgcagttctcagttcttaagagcataaaggcatcctgaaatcaaaaagtttgagaacttgtggcacagagtgttacagcagactgatgaactgttgtcctttcggtgagcctatgtgttgtaaagtatctgtacaaagacagcagtcgcatttggtctccctgtgcttcttgaacaaaaccattgtgtcagtatgccaaaaccttgcactattgagctgcttttcttttgattttgttttcttttaccttctggttttttttttttttggtcaggattagaaggcttatcccttcctttttgcagcggagccttttttaaagggtttccctgtcacgtatataaattgcaaaccatttaaaatgtgacccaaataaccaaacatgtatactcttaggatacgttactattaactgatcacaaatcacaagaaatgtatccattggttatctttttagcatgtatccatgtttcatagctcactaagcagatttcatagtcaactttcatttatttgctagtctgttat

SEQ ID NO: 44901 - DNA, 1130 bp, Bovine  19866880981226
ttgtgtgaacttgcttacagggcttaacgcactaaacaactttctcatgtataaaatgggaacaataagactgattgtgctggatctgagatgagatatgtaatctggtgagacatactaggaacttaataaacagtagctgctctcataagtagtaattatgatagtttaattattggcccaatgtcacacaataatgtccatcatgagaatgggcttgttctccagataagccgcgtagaaactgtgagcaatcctctgtttcaaggtcacagattactcctctcatctaggagaaccagcacaaatgcatagttgagcctgtactagctgcaatgatttctacatgaaaaaagccagttggagtttttattaggaccatatggaaaaaattcaaagtcccttcctggaggctatattcatatgtctgttccttactatttccctgaaattaccctatttcaagcctttatcatccctatctgacgcttcccaaacttcccatgtctccagccccctgtgctttaattagcttactttgttgtgacccactgcctgcagaatctactagagacccctgagcacagcctccgtggaagccccaggctgcaccagcctttcctcatatctatttattttccatagattctcctcccacaatctgtgcttcggtcacactgggccatttgcagctccttatacctgctctgcatttctcaacctctgtacattattcctgctctcatttctggaaggccttccctatgcttgatttccatcaacatccttcactgagcatctcaaaggattcacaaccttgaaatcccttgattcctcatagacgggtgctcttaaatattgttccctctgccgcctctgataagctcatgtcttgtccccagagtaggaagaatcctgatgatctgggactcagtattgccatgatcccactcaaccacacctacatcttataactcgacccgattttactcccaagaatctgtctgtgcagccccttcatggtctaccacatgcctgtctcacagccttgtgtctgagtcctgctgggggtcctctcaggttcactggctcctcgacgaacagaactgctttactcctggcaaaaccta

SEQ ID NO: 44902 - DNA, 1133 bp, Bovine  19866881029296
atgaagtaaaaattaggcccattcccttattccttttctcaaatcatttgatttctcaaatcaaaagtagtattagtctgtcttttgagaattcagtgctttttttcttcatgatctatcttttccattttcttttctcttaactttctgaggtcagctcaacttaagtcttgtttgttttacaaagccttttcttaaccaaagagactgctttttatctttgaactactgatagacccatactcaaccaagttggcattatacagcatattcagcagattctgtgttactgtatatatatttatttattatgttctgtctcccagttgatctttgagctgttttgttaaagacagagctgactgagagtacagagaaggagcccttgataaaggtctaagaggcaatgaccactagaaagctggcctctctgaaaatagccaaattgttttttattagagctctctatgttagttaagtttgttaatagttccttgatctttctcagtgatagatagtaactgtagtttttacttttatgtgcatggttggaggatcagaaagagttttatgtagtatattttcatgctttacttgaatttactaaattttgatttcggcacttttgtctgttctctttgttgttgagtcgctaagttgcgtctgactcttttgcagccctgtgaactgtagccccccaggctctcagccccttctgtttttcttctttttacataattcatattattcttactgttaaaaaaaaactaatcaaattgaggtaacagtattgcatgcacagagtgaatccgtaaagagagtagtctgggagagaggaagatagaaactttagaccgctgctgcagtttctaaatgctctgacaaatcccgtaagggtctttctgagacttgggtcttagtttcttaacctgtaaatgaagatgtcaagtgaatggtctctgaaaagttctttataggtctgaatttttctcatatccatattgacacggaattgttactcctgtcctttttttgactttagtccgaggccagacttaaaataacagttttgttgtcatgttttccttttagattctagtttaggattagtcatcattgcttcatttgggaat

SEQ ID NO: 44903 - DNA, 1847 bp, Bovine  19866881153795
accttaaaaaaatttcctgctcacactagagaattatgtttgcttatttctaactgaaaacttcttgaaatgtctggtactttttaaaaacaaaatgcagagtgaagtacattctgacctgtagaactgtcttggtggtctatgactgtagttatgttcaccaaccaggccaaaccatagccttgctaggagcactgcagtgtattcccctaagtaacatgtttagtgcatagctccgtaaatactctgcatttccttgcccccaagtctctactctcaggagagggactgtagaataatataaagtgtcatctatctcagaagatctcatagtatctcagagtaacttcttcggtcaggacatttgtgtgtatttgctcatggtgtactggtggtcttagtgcaaagtgcatgcacttgggagctgagtagattgcatgagtttcccagggcagccagaacaaagtaccaccagctaggtggcttaaaacaacagatatatattctctcacagttctggagactggaagtcttaagtcaaggtcttggcaggatggattctagggaagcatccttccttgcctcttctcagctttcggtgatgggccacaatccttggctttccttggtttgtacatgcatcgctccagtctggctctgtggtctcatgtgttctccttgtgtgtgtctcttcttaagagggcactggtcattggatttagggcccaccctaaactaggaccatctcatcttggcttaattacatcggaaaagactctgtttccaagcaaggtcacattcacaaggtctgggtggcatgaattttgagggggattagccaacccagtacatagactatttaaaatccttgctctatttcttttttgaacttgagctttctcatctgtaaaacgagatgatgatatctacctcttcaggttgttgtgaagattcagtgaaatgatacagcataggaaaagcccctgtatgatgtgttgtgaatagaaggtactcaaccagtataaaaagtcttccttctcttccttagtggccaatgtctgtgaagagccactttatacgtttaaaaaatgtatttatttttaactgaaggataattgttttaccactttatacatgtttaaaggtctttcttttggatcagagttgtttgggttgaaaattgaaattgccagttcccaacatgaggcttcacatgatgcaggagaaacaatgtcccacagctttacttaggatggtcccaaggacacttagctgctggtcacagttgtaaccatcgctgctgtcttggtcctcctgatgtcctagctcatcctctgtcccttggaggctcagctcttgctgtccttggtactctttcaggacactcattcagttagtgggagcagaactggcttccattatttatcttcaagctgactgtgggttggtaccatgccctaaaactgctgtggtctgaaaagttttagaccttctcagacttgaaaaggtcattgtcagaaaagacataatgggaaggccttgagcttaccttcagtctatgattctgttaaaagtcattttagtatgtcttttgaacccagctctgttctcttcccatgtttcattagggagagtaatgaggactgatactgaggtagggtgtaggctaattggaagcaatgaggctcggaatctcagatacaatgataattttggtagccgaactattttattttctttttcaattttatgttctgtattttatccagatatggtatcagtaaatgataggtagcataagagactaaaattaagaaaaatttaaaaatttccagttaaaaagtata

SEQ ID NO: 44904 - DNA, 987 bp, Bovine  19866881258133
tctgtttaatctacttatctagttttctgatctccagggaagacgtaattccccatatttgcagaaatgtctttgtcttatatacacttgtatatggtcgttttaattttatatggctccatttcataactgagagtgtttcatgaatatacctagaggttgtgtgtaaatgatttttatggagcactctattcttgaaaaaaggaaaaaacaacacttttatttctgatgaacatcaagaccagtgaatgttaaaggttatgagttaagaagtccagttcagtttcgagtgccagtatataaaatttcctacagggaaaacattaaacatttctgtgggtctcacttaaattctaagtggctgagtaggttaatgcagctttcttattgcttttcacgaaagcaggttcacttcagattgaagtgtggttgatttcagtcccaaggaggaaactgttgagacataatagctcatgggcccactggaacgtgagatctgtttattagattgctcctgctctgagtttagaatggaggctgctcactgtgagaatcacatggaccacgatttgccttttcttccacttgcccctagaaagccactgctttgccaagagtctagaatagaaggtaactcaactcaacaaagaaatggccctgtacctgctgtcagtgctagctcagaagggtcgaaaaatctttgagaccctcttgccttttgggtaagaaattcctttttcttccccccaacccgtctttcttcttttcctttttcatcctctttgctatagttactgtgctatattattaagatcttaacaaacacactgcttttcccctgaggtattcaagtatattaaagacttcaaggcatttctcccctaaagatttaattcacatctattaacattttcttacatggccacaatggcttgagcacacctaaaaatactaatggtaatatcttaatatcatctaatactcaag

SEQ ID NO: 44905 - DNA, 937 bp, Bovine  19866881295281
ctacccctgactgcttacctttctctctcacagcatcttttctgtcacacagatcattccctcaggcccctgttctctgtatctagcaactcggagatcagacagtcatataaataaatgttcagtgaagaaggggctctggagggtaggagtcatctcttcattcttttttcccactgtggttaaaaaaaaaaaaaaaaaaaacctacaaaccctggtgttgactgtgactctccagaactgtctgatccacgtaggttgtctgacttgttggaccgactagaaatgacagctctggacagaaagcagggggtctcccctctcacacacactgaggcagctgcccacctcgcctgcacccacggctgcaacagtgctgtatagcacctctacattttggatccattgaaaactatctcaaagcagtgtgcaaccccaggataaataaaggagacaacttgtgcattttaaagccttcccttggttaacaactttgactaatgatggcaacaaaattattggagcctgcaataagccatccagtggtcaaataggtcagcttatgagcagtattaagatttaaatatcctttaaaattaaacactttggggttattaatgtttcctttcctctcaaaatttttctgttgagaggtggtatgggaggaaatgtattagcaacagtaggatgtggagaataactccgagtacattaaacatctgttgatggagctattagcacagtttgtagatactgccacctggcccttattccattttgctccaactttagtgcctgaaaatatactgcagcaatcatgttccgcttctattaaatcttttactactgcattaggtggaacgtaagcatcaatcagtcctcattgagataaaaaaaaaacacctacttaaggcaaaatcaaaatgccaataagaaa

SEQ ID NO: 44906 - DNA, 1258 bp, Bovine  19866881397572
aatattgatgaggttataaacacatggcttcctcccttgaaattatttatctatgcaaacacacctctcaatagcctagcaactcatctgccctctgctttcaaggatatatatgtcacatgttctgttatataaaagagatgattcagacacatcttctgaatgtctctgtgaagaaataaaatccagtttccgtccaagtcagtgtaagcaataatgttcaataatcaaggacttttctaagttatattatcatagttttattaatatgagtatatatatattggcaaaggaaatggcaacccactccagtattcttgctggggaaatcccatggacaggggagcctggcagattacagtccattgggttgcaaagagtcggacacgactgagtgactaacacacacacacacacacacacatatatataaaacttttgcctcagaagacagtcttctgaggcagatctgtgggtttctgggtctgctagagtaagggaacttatgggaggaagccccatgtgtcacataggagctgtgcctggaattccctggttactacaatctgggtaatcaatgaggaagatattacaatattccaggtttaaaaagatagctaaggcctcaactcttgtcattaattcattaggttgaaaacaagacaagacttgattaattagatatggaggatggaggtggcagtaagtgtgatgggagtgaaaaggtctgacgcagaagatttgatatgtggtgatgccattaaccaattaagaaatgtaggagtaaatgcagtgcttatgtgagggatatgaagttgaagtgtgacaagaaacataatcatcttatgcacattagttttgaggtgcttttggagtatgtctaggttggcttatttctggtctaaaactcagggcaacaggaaagcctggaaatatgcccttgatggtttaagataaggtgttagttaaaactgtgtcaggatgattgcccagggagaatttatagactaagcagagcagtgggcccaaaagaaggtcctcaagaaaatcctgtgcttaaagcggagacacagagaaggcaagcatgaagaagactgacagtcagagctgagggcagagaaaggggaaagtcaggaagtggagagtttcaagactatgtaatgatcaataggggaaacagagcataaacgtatgaacacatcatgaacatgcaaacactgcataaatgctctactaagaaaaggttggataatatcta

SEQ ID NO: 44907 - DNA, 1685 bp, Bovine  19866881463282
tttctcatacttttcctgggtgacttaatcaatcccatggcttcaacagatgatttacctagtaatcttcaactcaagagttctctctagaattctagagtcatatatataattggatataaactggctgtccactggcacctcaaacactacatgtctaaaactgatatcatctttctaccaaaaccttcctttccctatatttggtttatcaatgcatgccatcatctcactcgattgcccaaaccaaaactgagactttccttcttactcacctacttaaccaaaagcaactagtcactaactccttttgattctaattctctcaaacctgttcttcttctgatccctttctcctcattatctttctacatgtatttctctgatttcaactaggccctcttccaatatatcctcctcactacccaaagcaactgtcaaacaaatgctaactcttattaagtccactattttattttaaaatcctgaccatcaggttaagattcaaatgcctttatttagcataagataacatttaccatctggccactgcctagaagttaatgggaaccaagagaaccccaagaagacaatggcgcgagcgcttactgcagtcaccactcctctcccatggacgccacatacatatcaattcttcttacaattatcttttcaaaggcaacaaataattttactattcgaggccaggctttacctgatactaaaatatgtgatccactggacaggaattagatacgattttattatattaaggcttataccattaggctgctgttgcagtgaaatttaatacatttttatgtaggtagaaagaaaagctcctgtacagtggtggctacagaaacagacaactggacacagatctcaaattccagcttaatccaaaaccaaacaggtataaatgttagcttggaaacaatatataaagctagttaccaagagtctccttataaagaactaccccccaatttttgccaatttatcaatacactctgctaagcttagaacttctgtaaacatgcctaatcgagatccaggaaaattctgaaatatgagctgaagcaacatgcatctgctatcaatagttcagtgtcttcagaaataccatttttggggtattagtgtaggagctatatgggcagctgaaaccttaaatatgtatctattttaaaataagtttaatcccactttcacttttaaataaaggtttcaaattctactagaattcttaaaaatgcaacggacttgtgattaaagaaaggacaagactgagtgagaaacagtagcaaagcaaacatacatggcctggtggagcatgcatcggtcgcttcaggtcattgcgtcctctacaggctctgatcacagttttgtgacgatgcaagtgtatttcagcttccaactggttccaaagcttatcatgagcaggtcccttcatatctcgtccaagtagctgtatttgttggactcttcatttgggaaaagaatttagttagtttttcattatatatatatatgtatatatatacacacatacatacatacacacatatacataaatatatataaagtgttcagaagaattactgaacacaagtagctttcacataaatttaatttagtaatgaaactaataggaatttcctgatgtctctcagatttataaa

SEQ ID NO: 44908 - DNA, 905 bp, Bovine  19866881518332
aatggttgtcagtgcacataagggcatgcctgagggagctggccagagaggaattagacgagacaaggtagtttaagtttttgacgtggagcagcccctaggcatgtttgccactctgaaaggttgatctgaagcagaactaaaaatcactcatgaagtgagtagtcaaggaactgctagtgtttgtgttggacaggcagagctagatgtctcagattgtccaggatgggcccactttacacctgtttccccagtgtgtttattaacagcacttcccatactttcaaatgcattcttttacgtttgaatgatgattaattccagtggcagcagcagcggtggcagcgatgaccgtggcccaggggtgaggaggggatctgcacgggggcaggcctggggcctcagccagaggcacctccctggggaatgtgcacacatatggattctttgacttgaactcgaggacagaagggcttcccagggggctcgggggtaaaaaatccacctgccaatgcaggagacacaagagacgcgggttcgatccctgggtcagaaaaactccctgaagtaggaaatggcatggagaaggaaacggcaacccactcctgcattcttgcctggagaatccgcgtggacagaggagcctggccggctgcagtccatggggtcacaagcagctggacacaactgagggcacgtgcacacgcacagcggcaggctctgctcctcctcaaataactttgttagctgtaaactgtacgtttttagaaaatacagatgcgacacagacattgcagtaaattgtatcagggtattattagagttcttcaaaaagtttagaataccctggttttgaaaactgctgtgacatggcaaagcaaatatctacaagcttagaaattaag

SEQ ID NO: 44909 - DNA, 815 bp, Bovine  19866881670582
tgtgtagcccatggcaccgacatcgccttctgccgaaaacgtccatgcgacctgatttcgatccatatctaacaaagctatcttgttgtcaacgagagttatgaggtatggaaatgggttaatttctaaaaacaaacatgtagataatatgtatgagaaaaagaactttagcaaaaccccttgtatcagaccattttgaaacccatgagtctctgggctcatggattacacctatacctgtttcagtggagactgcccaggcactctaagcctaggtttatataagcaggttaggtgatgataaaagtcgattactttgtttgactttaatttcagctcagagatagtacgtgggtatccctgagaatactaagggtcaaaatgtttttaaatcactagagagagagtgaagtgaaagtcactcagtcgtgcctgactctttgtgaccccatggactgtccatggaattctccatgccagaatactggagtgggtaaccattcccttctccaggtgatcttcccaaccctagggatcaaacccagagctattagggaagttcctgataattaaatcactaattgttattaatatttgataatcaaatcaaatttatattatataaaattaatatactattaatacttttataaaaattaatattgatattttataattaaatcactaattgttattaacatttgtacaggtttcagataataaatacctgatgttttggactttactatgtcagaaaatggtccaggtcctttggatgtgaagactcgaacctaaagaaagaaaagaatataaag

SEQ ID NO: 44910 - DNA, 1479 bp, Bovine  19866881678368
aacgcatgaaagtgaaaagtgaagtgaagtcgctcagtcctgtctgactcttagcgactccatggactgcagccctaccaggctcttccgtccatgggattttccaaaatgctctagttatatgtatttcaaaatagattgctctcaagaaggctgtctaagacaactgtaacggaatcaacatttaaaaagaggaatacttggacccaagagccagtgaaatctgacagccaagaaatgagacaagagaaagacagcaaatactctagagaaaagaacaatacaatctggggtcatttaacacagaacaaaagagtcctatccaatcccaaaggctcttacaggcatcacaggatgtggtgcagaactacgatatgagtcataatgaaaatgataaacaatgattactgaaaaaatactttaaagtaatacttaacagttattaggaagatttccataccaaaaaaaaaagtgtttacacaaaagtgctattacccatggggataaatttagttatttagaaaatatattcggaatactttatctcccaatgatgttcaacaaaggagtgtgattatactagagaagtgtagagaaaaggagactggaagcactacttcttactgtaattgaaatgccaaggccttcatgatcttccttaaggaggagaacttttctaattggaccaacaccttggcttttctttaaagagtcttgatccttgttggagaaaaaaaaaagaagaaaaattagtagtacttaaactatataccatatagagtaacttgcttttagaaatgtttgttttcctgtaatggatacacagtataatgttaagaaagtaatcaacagataacatggaaaaaacaaaaacagataacatgggaaagcaaaaatagtggttctattaatatagtgaatgtacatgattttctcaccctcttgttaatttctttaatatttatacgtgacattacaaaagaaactactgccatgaactgataaataatatctttaagaaataaaaggaggcaactttagcttcactggaaaattgctttaagatctataaccatttcaactgatttacagaactgaaaaaaacaaaatgtcaattggtcattaactctttttcatttctttgaactctggaatctacctcttaactaaaggaccttgctccaccaataattctttctctgggacctttactttttacctctctctacaagctcattccctaaaatgaaaaaatgccaagcctaaccaagctataaaacacaaaccacgtacaaacacaaaacatataaaaacccttaaactatccacaatcgtggctaccttctatccaccctccatctttcctgaacctttacacaagttaatcctcactgtcgttacttccttgcctcccatattcagtaagtactccaacccgtaattagggttctgctccacctgctccaccgaagctgtctt

SEQ ID NO: 44911 - DNA, 1334 bp, Bovine  19866881694202
cagaatatttgtttaattggaacacaccataattcttaacaaataagaatgtgtattatctctcacttttatgtataatttttattagtatatattaacctattataaaaataattgttgaattaaaattttataaaaattaaatagatcttctggaaatcacaaatctctaaaactctccccaaaaggatggaaaataactctaaatatgcacaaccttgtcactagtctgatacataatgaggatgtaaaaatcatcaagccatctaccataaggggaaagctttgtcatattaaattaaaaatgcccaaacaggtggcagtagctttttccttttgactcctactctctttcactttcttctctctcagcagccaggtgaaaaatgtgagatgtcaactacctagaccctcagcttttatttccttcgataactggaagtaagggcatccccacttgctggatgcctcccaggaattgatgtgatgtgatgtgatggagaggattctagaagccagaccaaacagcacactacttcccaaccacacagctctggtacctcaccgatgcacccagggacatggctttttcttcacagacgatgtgaagatcgaatgagataatcaatataaaagcacctaccgtgatacatggcctttagtgatggagccaaaaataatgatttgttctgaatctggaagcaagaaagtgtcaggatgtcctttatcctagctgtaccctctccctgctttatatttgctgcccacttgacctctgtgagtacagcatacatcaggttattaacagagcagacttcttaacctggtcctttaatccactctctgtttacactaagacccccgtatccccattttcactctcgtacctggaaggcaacactgtacccaggactcatgccctcaagttgaaaagacatcactgagggagtgacactgacagcaatccagtcttcaactgttttgtttgtgtcgttttggttggatatttggtagaaaatttcgaatcttgtcaacacaccattttcatactgaggcttattccacctaaattccaccacaactacattcttgttacggtgtttttcacttggtaatataaatattctgggattctctggtgctgatggaactgaaaagcagagatacagggcagaaaagagtataaggtcaacttctatcactcacgatgagggtacggagcaacacagtaataaatatttctcattccagacagttaaggtgcatctatcttgtccttaaagatcttctggagagaatatgccatagatttcttcaggaacctatcctatatt

SEQ ID NO: 44912 - DNA, 682 bp, Bovine  19866881769545
aaatattctaacataatcagaatacatacaggtaaatgttgaataaaaaagtgaggtttgcctcactatgggataaatagtttttttaacttatataccaatagacaatgcctatcctgtaggttactctatttccaaatatttcacagttctttctccctatatgatttttatccatttttatcctaaaagatatatgatgactgcttaagaatcctgggtatgattacctaatttagctaataaaacatttgcataatacaagtagtccttgtgattaacaaaattgggttcattcattagcatcaactgtcctttgccttgtattaggtgacagacatcatttacattttaggaatgatgaaaaattattcattaatttttatgtccacattttaaagtgagtgcgttatattttaataggacaaatgaaattattgctcctgtttttagtactaaaatatttactttgtgtccaatactttccttcatttgatgatcagtttatacctacacctataagtcttcttttccattttgtcattatatagaattcctgaaacatatgttcccactgagctagtagccctgatgttagtttacattagacaaatgataactgataaggaaatgatgggattaagctgttcagggccttgcaataacttactatataagagca

SEQ ID NO: 44913 - DNA, 963 bp, Bovine  19866882175461
tgcatctacctgggacttatacccctggcccaaacctcccaccccctgttcaattacaaatgccatctcaattaaaaattacccaaaatgtcctgcctgactaatgtttcccttatcgcttccacaaaccttcctttaaatatgaaacctccctgatccctctctcgcttaccctgatcattaggccgactgattctccttcttgcctgaataaaggtaacctacctctattgaggtagtctctccttttctgcctgggcccaaactataccttacacttggacttcctttgtggttcagttggtaaagaatatgcctgcaatgcaggagaccttggttcagttcctgggttgggaagatcccctggacaaaggaaagactatccactccagtattctggctggaagaatcccatggacctatagtccaaggggtcacaaagagttggacacaaatgagtgattttcacttttacttcttttaaatacaagaatatatatatacatataaaaacttcttttagactttttgaaaattgcctaagtccaatatgtcaaagcattttagacgtctaattcttatccagaatatgatttaatccaactctgatttatctaactctatgcttctttttaaacattttatatgatatcggtaataatcagaataaacaaggcagggagcggcgaaatctgatagcaagctgtttcacaatgtaccaggatttgttctaatcagatatggtgagagacacagacacggaaatgactgtcatgaggggaagaggttatactcacaggttcctggaaggaggaggcacagcacgcccagcagggccacacagggaagcactcagtataaaagtgagggagagtacactgcctcagtcagaagtgaagagaaatcacgggtgagcctttacgaaggaattgctttgcatgagaaggaatgggctgggcaggg

SEQ ID NO: 44914 - DNA, 1709 bp, Bovine  19866880523960
tgccgaccttatcccggccgctatgttgcagtaactttggctttcctgtttctgagacatttaccacgtggtgacctattaattgtctgccttcttcagcagccacctctgctgatgtcacataaatgccacctgctcctcaacaatgagaaaaacaagtgcctcgtcagctaaggtttatcccaggcttctcggtttcactgagaactctaggaactttccagttattttatctccgagaagttccttgaacctctccactttcctcctcttcaccactacagctatcagttcttccctgaattatttaacaggtttctttccggttttccctcatccattcttatctctccctctaacttatccaggcttcccttgtggctcagatggtacagaatccacctgaaatgtgggagacctgggtttgatccctgggttgggaaaatcctctgaaggagagaacagctacccgctccagtattctggcctggagaattccatggactgtagagtccatggggttgcaaagagtcgaacacgattgaatgactttcacatagccaatttaccctccacagtacagcaagaggaattttctttttttatgttcatacagtcttgttatctctttgcttaaaatactgtaagaacttgctctgacattagtataaagatcaaaagagattttcagccttacaggagccagacccaccaacctcatgggacacttgctttctcaacttctgcctcctggcctttttcggggttctcacacacgctgggctttcttcccatcctaggaccatcacatatgctggccctccttgctcctacctacctgtctcctattcattcttcccatcacagttcaataattacctcctcacaagttttgcccttactacttagccaaatcaggtctctcaaggtgtcctgtgtttttcttttataacacaaatcacaatctatgagtatacgtgtgtgtgcatgtgtgcacgattattgggttaatgtctatgtcttctactactgtatcaccaatactagcacaatgccactttggcacttaacagatatttgttgaatgaggaaatgaatgattttgccattttaaaaaacagaatgtgttctctgggagaagaatttacaccacgcagaacccttggaaaagaactttcagatttgaatcattttgtaatactatctcttgtttggcattcagggagtaattttattttaaataaaaatattctgtggttgataagtcaaaaaattagtatgaatcacagcaggaacaagaaaaattaaacctcgtagtattggttacattctgttctgagtataaaattgtactatttatataatatttattagcaaaaaggtgatcctttaatgtgctcttctgctcatctagatttacattatttaaaagtctttgttcatcaagttttatttttcctttaagaattttcaatccaaaggtttagtaaatgaagtatatatacagttcatgaacatattttaagacttttgggaaatactctaaacaaaagctattttgaggattaggaaatagcttgtctgaatattgccaagtgaatctggaataacgtttctgtgggatgcaatgaaaaaagcaaggcaagaacttcaacattctcagttcaaggttagaagaaaatgtgaacaaaaagtgtttctcatcctgt

SEQ ID NO: 44915 - DNA, 1289 bp, Bovine  19866881235827
attttgagataaactctaccatttaataatgactattcatgatatagctctgagataatatttgtatctttttctggaaagtacgtatgctgttttctagtgattatagacaagtatattttatactatcattgagggatttttctatgatttaacaactttatcagaaaaccatcatagttaatagaaattcatattttaatcttaattaaaatcttaatctttaatcttctttgctttttccttcctaccttattttttggggaggctttcctggtggctcagagggtaaagcgtctgcctgcaatgcgggagacctggattcaatccctgggtcaggaagatcccctggagaaggaaatggcaacccattctgatattcttgcctggaaaattccatggatggaggagcctggtaggctatagtccgtggggtcgcaaagagtcagacacaactgagtgacttcagtgtcatgtcattttcagcagtatctcacttccaggtaacaattctgttttagttaccactgctatataacaaactacctcctacattcagaagcttaaaaaaatattctttttgtcttgctcacagtttttggctcagtaattcagaaagggcctctaagggtcagttcttgcttggggtctctcatgtaggtgttgccagatatcagcgggggatacagttgtctggaagcctagttgggctggaggcccaagatgcattacttgtatggctagcaattgatgtccctcattcacttgtagctcagctggggcttttgacatggcctttccagcatagtagaaattgacaattttcatggttgttggcttcttccagagagtatctcaagaaggctggacagaagctctatgcccttttttgacttagccttgaagttcacatcacttacaccttattctattggctgaagcaatcataagtctttctggtttcaaggggatgagacatagaccccaccttttggtaagagaaatgtgaagtaatttggggatcacatgttacatctaccatattagggtaaacatatcaacaaattaccttgacagtctgtttatttactaatttgacagcagagtaaactgctcatttgaacaatgtcttacatgcaagaatgattaaattatttctgcatctaatccaaatgtggtcagtatagcagtccatcttctcttctaaccacaagactgctgaaaaaagctggctgtaaaatattagactcgacatctggcaaaagaaaacagggctctcagcaaggcat

SEQ ID NO: 44916 - DNA, 1351 bp, Bovine  19866881365475
atggtaacgatgacaattaaaatacaaagagtcatccatataggtcccgagaaaaccatccataaagatgcaatctgattttcagtattctttcttgacagatgaatatttgcatggtcaaagtcgccaaagttttatggtgcattttttgggggtgaaattttaaatagctttcattatggactcacacatgaaggctgatttgaactgtcccagaattcaccttagtatgttatggtttttgtttttagtatttagtgggatccccaagcagcacactttcgcattacaaaacaagccatttaaaccaaattgtgaattttatcacccgttaaccacatgaaaagaccagatgggtacaatttttgatacgacctgaactgattcctttctactatgacacagttatggaatcttgttttttcacaactatacaaacatactccatttttcttctaaatcaaaggttgtgtcacaatacaagaatcaaatttgtctacatggcctgtgaagacctcagataaatatactcttttacccttttgaaattactcaaagtgacagtcatgggacaagagcaaatactgtatcaactcaaagcagtaaaccattatttttattatttgaattggttaaaaaaaaaaagccctaatcatgtttgagaaattttgttgcttagaatatacagccaatataaaagtttaattttaggcatcaggattagattcctaattagattagatgtctaaaagttcccttcatctactagataagtccctgaaaggaaataaataaaatatgtatatcctttaattaatgttaatcttcaaaacacacacacacaaacatacaacaggatggcaatttacagtcctgatccccaagaaacttctaatttaccaggcatgatgaaatccgtacaccagtaagtatagcaccaggaagcatgtaataaaggctttaaaatccagatttgtgtttgtcatgttttggggtctacctatgtcatttccctgctatctacaagtgcacaaaaacgcacctgatgagagacacctttaatacagctttacacaccatggcatcagacatattaaaggtgcaacaaacatgggtgtaaatttcaggaaatctttattaattcaaatgccacaatacagctaaactgccaaagcactacaggttttgagaacactgtggaaacattctactattatcaattctaaaatccatttaacaattattcatcacacgggctatgatgcaacagaaagaaatcaatcactagataattataagcctccttcaccaaaaaacagcactgatacccacttaactaaattatacagta

SEQ ID NO: 44917 - DNA, 1381 bp, Bovine  19866880487802
agactgtggcagggaggaagcaggtgtgccagaccttaggctaagagaacctgggtgatagtcaataaagctccactattttaatccgtgattcttgggaccagcccctgtcattgaaaagtttatcggttttctgtgggcctttgggttttcattaactccttccctgctcccatgtaccaactctgccctcggtcatagagcccagtccttctctgttggtgactaagtatgatcatcctgaagaaggtttaaggctgtttcttttcccattagaagtgcctttcagagctgaacaaagagctgcagttggtgtgttagcaggcagaaagaagtgtggaaaatgtaaattgcaaattgaatttttcttgaagggacagctatcagttcgaatcttcagataatcagttatgatgctgtcaaataaaatcactcacaataggggccatttaactctagcaaatgcagattaccccattcactcttaactcctaaaaactctggctgtggtgtcaggcagatctccagtgagaaaaacttgaaaaaagattcgacctgaaatcaatgatgaaatcttgggcagcattttaagagtaactgtataaaaagaaagcaattattgtcattcatttaatacacctctgaaagttagctgaattcttcatgtggaggtgaaagaatctacttgaaaattctactttgcaatagattgtaccctgaatggccccagtagcactgtctgggtataacaaactacccaacacttgtgaatattttaacttcaaccaggtgacttagtggtaaagaatccccctgccaacgcaggagacacaaaagatacaggtgcgatccccgggtcaggaaggtcccctggagtaggaaatggcaacccactccaatattcttgcctggaaaattccatggacagaggagcctagcaggctacagtccatgggatcacaatgagtggcatgagactgagcgactgagcacacgcacataactttatacggtgaactttctttaggtcaagtggaaggaagcattatgcatattataataataaataagaatgcaaccagtcagtctttggaagattcaaaataatgcagtagaaccttctatacatttatatttgtcaagatatcttctttaagggaggttagatttttttttaatttataaagactaattttgagtgtgcttcaactgtactcaagtatagaaagtcaattttaggcattacaaattattcacattcatatattataatctttataattttagacactgatttatttattctatttgacaacaaaaacaacctaaaataaaataacctggtattactttgatgaaatgtcctattatctttcaactt

SEQ ID NO: 44918 - DNA, 4341 bp, Bovine  19866880547884
attattgttttttatgtgtacgaagagtgtgccctagggatcattaacttactgagctcactgggcaggatgtgagcctcatggcaccattgttttattatttgggggcatgtcttgtgcttctgttgcatggtttattgctaagcaagcctgattggttttctagttaagtaaacctactttcttgaataatcattaacttacaggtatctccttttttttttttaacttataactccctcatgggattaactatttaacctcctattttgtttcctggtggctcagaggttaaagcactgcctgcaatgcgggagactgggttgggaagatcccctggagaaggaaatggcaccccactccagtattcttgcctggaaaatcccatagacagaggagcctggtgggctacaccccatggggtagcagagtcggacacaactgagcgacttcactttgtccctttactctgtctgcatcgttaggagtccactcaaagcaagaaaacccaaccacccctcaccacagtttatttttctcagacaagagcagaggtgggcagttcagggctggtgcaggagctccacaatgccatcagggacccggcatttccatctttctctccaccatccttagcttggaggcatttgccttcatgctcattgccttatgattgcaaaatagctgctacacttaaaatatcacatctgtccatgttcaaggaagaagaactggcaaaaagaagcacactagcccgtttggtctcttttttatcaaggaggtgtggatgaagaatgtcatcagtaaatagagggtactgaaatcatcaagccatcagccactgccactgcccccaagaaaaacaggatattgtttccctacatagttaaggtgctttcagggatgacagcactacaattatcccctaacttactctcaaataggaacatggccttccttaggcattcattgtactttagccactgtgttacactcctttaatcttttaacaatcactttatgagaggtactaaggcacacaaaaattgagttaactgcccaagtcgtcggagaaggcaatggcaccccgctccagtactcttgtctggaaaatcccatggacggaagagcctggtaggctgcagtccatggggtcgctaagggtcggacacgactgagcgacttccctttcacttttcactttcatgcatgggagaaggaaatggcaacccactccagtgttcttgcctggagaagcccagggacggcggagcctggtgggctgccgtctatggggtcacacagagtcggacatgactgaaatgacttagcagcagcagcagcagcccaagtcatgggactcataagtagtagagtgaggattcaattcagacagtctgcctctcactggaagactgagtagtcacttcagtagcccaaaactatagcccaataagagggcatggcacgcccctccccctgccctcccacttataagccttaggacactaagtcacctctcctgatatagagggagattacattctcagcagttcttcaagctacagacgtgagacccctggaaagtgaaagtgttagtcactcagtcatgtctgactcttgtgactccaggcccttgagagtcaactgtgagcaagacagtgtagaccctggcctaagagttcatagcttctcaagaagacaagcaaataaatgacatttaatgagtgatacaataggaaaaatttaaggagccataaaatagtacaggggcatcgtttttattttaagagtggaagtgggaagtgatgcttcaggcctctgaaaggttgaagttggccaaagaagctgctgaaaggaaaaactgttccaggaggagagaaagagagagcatgtgtgttagggaggggaagggctgtacatctactgtcaggaaaacctggtttattggataattggaatgaattacaaaacccctggggcaaaagttcaaggagaaaaatggcagaagagtcatgaagagctctattacctaaagccaatataaggtcaagtgctttgtttatggatttagtttgtcacaattagaactgtaattataattacaaactgtcagcagtaaagaaaccataatatagcttatgtcatttttattccaaacgagcttgttaacttcatggtacattgatcatttttaaatgagttttttttttctccctaacttaaaaatgtttggaaatgaaatgcttagcattctgaaacatttcttatgctttataatggaggaaaatagatgtctgtgtgctatctgacaacacactttggtcttagttctccttgtttcatgcccttgggtaatctgggttggaagccagtgaacaagtgactcattgatctgctaaatcctgggtatagaatgtaaggggtctcaacacataggaaggacagggagataggaaaggaagcagagcggctttgagaagaaaccatgaaagaaggacatacaactctggagttgtgtggatatatgctctctagaaagtggagtaaatgtagtgccgagtcctgcagagaagtgacccttgcaccgccaggagaaatagtgccccccaccccacccagaggctcagggctctcctttcataggcagaatagaaaagacacaattctgagggattctttcattcaccaacaaatattccatagtaacgcagcagtgaataaaacaaacaaaaacctctgccttcttgaaacttatattctagtgcggcagagaaaatccagtaacatgcaaaaagtagtatttcatgactgtactgctgggtgtgctaagttgcttcagttgtgtccaattctttgtgaccctatggactgtagcctgccagcctcctctgtccatgggatttcccaggcaagaatactggagtcagttgccatttccttctccaggggatctttccaacccagggaccaaacctgtgtcttttacatctcctgcactggcaggcaggttctttaccactagcgccaccaaactggatttttttccaaaaatgcaattttgaattttggtcttacattgaaaactaaatcaatatcagtataattcactgcatttgtagagtgaaagaaaaagcacacatcatttcaatagtttcaggaaaagcatttggtaaaaatctaatgtccattcatgattttaaaaagcaaacattccaggggacttccatggtggcccagtgcctaagactcagtactccccaacgcaagggcccgaatttgatgcctggttgggaagttagtcccaaatgcagcaactaagacctgctgctgctaaagtcgcttcagtcgtgtccgactctgtgtgaccccagagacggcagcccaccaggctcccccgtccctgggattctccaggcaagaacactggagtggggtgccatttccttctccaatgcatgaaaggggaaagtgaaagtcatgtcgcttagttgtgtccgactctcagcgactccatggactgcagcctagcaggctcctccgtccatgggattttccaggcaagagtactggagtggggtgccattgccttctctgacttggtgcagcctaattaattaattaattaaaaaaaacaaaacaaacactcctagcaaacttgcactacaaggaaactttcttaatttaataaatttaacaaaagatacttataaagtaaatttaatgaatgtaataatggtaaaatggtgaaagctttcttttgagatctataacaagacaaagattcactttaattcaacatatagcattgaagtcctagccaatgcagtatggaaagaaaaataaataaactgcatcattagtggaaatgaagaaatgaaatatcactattcacagatgatataattatgtgagtgggataactgaaaagaaaccacagccaaattaaaataataaatgtgtttagaaaagtcactagaaacagtatttttaaatctatttaaattctatatattagtaacttaaagatcaaattaaaagataccatttataataacttcaaaaatatcaaatataaggaatacatctaacaaaggacttcaaagcaaaaaataataataactgtaaaacattattaaaacaaataaaattatatctaaataattgatgagaaatatattcatggattataggaatcaaaattgtaaagaataatatcagggacttccctgtcggtccagtgccccaaggccaaaaacccaaaacgtaaaacagaagcaatgttgtaacaaatcaaataaagactgtaaaaaggtccacattaaaaaaaaaaatcttaaa

SEQ ID NO: 44919 - DNA, 1797 bp, Bovine  19866880779002
tttctcgaataaagttgtattccttgcctcaacacctcattcctcagattcattggtctgtaatgtggtgagcagagtgagcttggactcagtaacaaaagtacacagattgctggactccacctgcagaatgtcacggccagtcactctgggtagggcctgagattctgcttttgtaacgagctcccaggtgatgttgataattctggttggggaaccacactttgagaaccactaaattaaagagtcactgtggccttcccccacttaaggtaaaaaccagaatttggctttttcctcagtgattcttttcacaaagacttgaatctctgggctgggcttctgaaaggccaggtctttgaatattgcccaagacatgtgttttatggtggctttggcatatccagtaagaacaagagtgctcaaagtgtatagtagtatcagcattatctagagacttactagaaatgcacatttggaagcttcaccctagatttaatgaacaggaaactccacaacctattggttctgatgcaggccaaagtttggggaccacaggattacagaggttgttgggaagccatttaggatctttttagtaaatattaacaactgtgattgggattcccaggtgccactagtggtaaagaacatgcctgccaatgcaggagacataagagaccagggttcaatccttggattaggaagatcccctggagaagggcttggcaatccactccagtattcttgtctggagaatcccatggacagaggagcctggcaggctacagtccgtagatttgcaaagagtcagacgtgactgaagcaacttagcactcaggcaacaactatgaagggctttcctggtacaactatttcaagacaagatgcggcaaaggaaaaaatcaagctgcagtcttcctagggcagtggtcattgactttcagtcttttatgcgtagatgcaggcagcagcactcttgcctcctccacagctagtgctggtctaattaaccaattaagggatcatagagcacacagaaagactaaaacccgagattaacattaagtggcaattagtggtattaggcagtgcccattatatgctcataaacatattaacatgttgctcttaaacagaaatgaatgcagccagacaccattcaaaagtgccaggcttccaggggctctcatttatcgcaagtcacagaatcaactgacccttgatcaatgacatttcacataggttcattctgccaacccagactttaatctttcagctgcctattgaaggccttgtgctgcagcgaggtttctggaagtagtgagtggtatctggtttctcagtccccttctattcccagctgggattttagacgtggctcactgtcaacattcagaaacacggtaagtcactggggaccacagctcagggtgcatgtgtgagcaaccaggtttaattccaactctgtgtgcttgagtcatcactgctctatttgtggaacagagcaaacactgccagcgatcttcaatgcctgatggctcaatagatatctaagtggaggtgaagttggaataattctacccgtttactgtactgttcgcaaacgaatcagtaaaatgtctacaacttgcaaccttttttttcaacatattgttaggggaggaattgaaagctctcaaaaatactcctttgttgggaactttccccaaggtcttctgaaatgtctcaccaaattctgacttcataaagagatgatatggtatagagaaagaacctgggtatgaaatcagacag

SEQ ID NO: 44920 - DNA, 1639 bp, Bovine  19866880818517
gttggctgggattaactggacacaaaattcaaaatggaactctggtgtacagttcttctggtaccattgaatgtaggctgtggaatcaatgtcagatatttgaagacttggatagtgggaccaaatcagagcattcttgaagtagaccagaatttaaagaggttgtgttattacagcttaatatgttaatatgagaacacttaatgcacagtatcctgtacatttttccatgtaaatctctttaaaatgtttgtcttgctgtacaccattttcttttaagaatacaatgtttattcatttctgcagcaatttctgaggatttatctatcttgtctaccttttcctcttctgattaagataaataatagaagtcagaaaaataattccttcttgaagagttccctaagagaagaaagtataaatctttaaaatatcaaaagcccattcaagagtatcaacctgataactctggatagaaaatgttgtgattttggctcttaagctcagtaaatcagtctgcaactgtaccctgccaaaatatcaagaacaaaataaaaaagatggtcactagatgtttccacagattgggatatttggcatgatgaatttggaatatctgcacaattgattgaattcttcatctggatattttggcatcatggcaccaacagctttggaattctttcttttccactgcaaatttgggcagaaaacacacagacccacatataattcagtgcttgacttttgaaagataagaggtgttgcaatctcatttattttctcactgaaatctttttcagaagttaggcagagcagatgagttaatgcacctccacagttctctaagtgaaaaaatatacaaaccaccacgtttcccccttatccttcctctaccttgtcagtttcatcgttccaaagattctatcatcttggtggtaaggaccttggatactggagggtgagagagttggggaacacacagggccactgaatcatcccaaatatagatgtttgtcaataaaggaaaaaataaacttggcatggcagagagagtttgttagcttaggtggggaacagaacaatcttttctggacaggttctcaggatttctttccattctattgcacaaacatgattctgaatttcaaacctatctcagggtactcagttcaaggatcagtatttagggagcaccagctgcaaactcctcttggagtttgaaatccagcacagagtcaagatttaggacagaaaagagtgaacaatacaaatttgaagttctatgacaggcggtatactctgaatgttccaagtcgatgaataacaatgaaaaccaggatttgggggaaagtacatggagaaaggagtattgagttgaatcttgaaggatggccaagatttgactgtgtataaaagaaatattgtctaatggaatcaacagaagcatagaaataattaatttatgaactggattaaagaagagttctatgtggtcaaattatagaaaggaatagtggaagctcttcaaggccaggttagaatatttacccctatgtcatgagggtcagggaagcatgtgagatggttgagcagaactcagcaactgtcacttctatctctgtgtcttcctaccaca

SEQ ID NO: 44921 - DNA, 651 bp, Bovine  19866880864256
cgacgaacgatctaccaagttctcccttggtttttcataaaagatttcctcatttcattgtccttagagaattattgattctgtggtttctgttttttgaggcagatctttcagttggcggaatacttgcacttgtcttttatgcctaagaaataattgatggaacttgtggaatgtgcatatttcacattgcctggttggattcctgaggatgctcagttttctggtctatgttttcttttgtttttgttctgagtgaaggaggtcagcagggcacagaaagccacttctttgagattactagaaaataaagaatttagaatgaacagctccagagagatttatacaggtcccttaaaaaaaattacactctgaaggtttgcaggaaaaacaggtccaagcagggaaaacaggcagattagtttctcaggaagaatttagatgtgtcttgaatgttatggttttaggataatctggctccaccataaacacaataccaccatatatttttctacatagtaatactctggtggagctcagcaagatttatagatgtttgctgatttctggagagacagagcagctattgagtcactcgcccataaatccttaaccctgtctaggagcaggacagtacggggagacactttt

SEQ ID NO: 44922 - DNA, 1896 bp, Bovine  19866881257398
tcctattttgatacttttatctaagtattaatatttcactatctagagtgaaaaagctcaatctcaataatttttacattcctacaaaacagagaagagatagttgtggccacctgtgcaatttgcaagaaagggatttgtacacagggtggtgccttgcagctcctagttttactctatgatacattgccattgagtgcaacttaagttttctcaagtcccaaactaaagactattaaagaaatcataaagtcacaaccatgccatccactctggtttgcatacaaaaattacttgcacatctaaccaataaatctctggttatggaactataggggttttttatcatctcttccatgaaaaccatgtttggtaaacttcccttcttggtttgttgtggtataaatcaagtttgaaagttaatataaactggaaactagtataaactacaaaggactaatggagaagtgatttttctgggtgacctataagaagtcactcagctcctggcctcagtttccttctttgtaaatgttaaattttatgtctttagttttctcagtcctaagattccatgattttttgagaatctctggtaaatagcaccacaaaacgttaaaagttatttcgtttatttataaggaatcagatccattttatggaaaccctttggtgaaattccattttgagtagttttgaggccatgaccatacagtagatattgtccctgctgttatgaagtgctcaagagaagggagaggcatcattaaataaagactcaggaaatccacaatgacgtttatgaaacaactttttaatttcaattgtatatttacaaaaagacagagaataagcagcgggaaggcaggaatgatgcctggccacctcccacctgagggtgcagaaaggggccatggacaacatgtatgtgtcagactgatcttccctgccattattgataacagcaatggacaaaaggcttcagtgaaggaggtcagtgtatttgggaagaggcagaccatctgttcagtccatgtgcctgagaaggaagaagacccaagtcagtctattgaggccttggctctttataggctgaggcccttctctttggaagttttaggccgccttctccagggcatgtaggggtcagggggatgatacctgggaaaacccctatggacctcagggacccgttgctgataacagggtggagggaagcggggcataggcggctggggaccatactgaaagtcaccttggacggcaaattctgtttggatagatggggggacatctgaatgtaaatagtttaaggagaattgatccgattggaaaggatggtctgaagaaaaacaggtttcctggggacagaatgggaatggaggcatcacctggtgtaaggggatgggatgaacgttgtggggacaagagcggaaacaggggtgggcagggaggcgtggggagcaggggttggcgccctgggagaggcaaaggtctgggcagagggcaagccggctgatctccgcagaccaggggctgcctctcaagcctccggccaggtcttcttctcccagggccatccgggatccacttgtccactgggtcccgccggggcagctctaccccccaagcgtcggccacgtgggccagcaggagctgggagaggtggcggtgtgcgcactggttccagtgcactccgtccgtctgcaggtacttccctgtgtggcggcggaagtggaagtgcaagtccagcacatcgaagccgtgcttttgggcctcggcagagctgtagaaattggcttcgatcacactgattttcacggaggaggaggtaaactggacctcgggcgggacgaagcggcggtattttgtcgcccacgggcaggccgtttccac

SEQ ID NO: 44923 - DNA, 1186 bp, Bovine  19866880469424
cacatggtaactctgttaaggagacataggtagttagaaaatctgtaacattttcattaaatagtgctgtttccagagatgaaaaaggcagtttcgcctctattgtatgcggttttactgtcatcatcagcaatttgaagaccgtagacacagaggtctctatgtagaagatttagtgtctacggaacatctataggagagtaattcatttgtgctagaacattaagtcccaaaatactcctcaactattttaaataaatggaaataatacaatggatatgtatatattattatattttaattacagttccagtgaaaattaaaccagttgcatctctgatgttaggtgtgctgttttctagaaaaaagacctttctttcagttacaatgatgaatgtggaaaatattgaactatcttaataattgggctcagaaaagagctgatgatagattcaaatcctagggtacatattcaaacaaagcatatataaataatgaagtcttacttagctataatctctttgggagcatctttacaaattcagaaatgagaacctggaaaacacaagctgatgcaatattctgaaaaatcctccagggaaaagaacatctacaaaacaagcatagcaaatgaatcgtattcaagaatttaaaccaaaatgttaatgctaaaagagcaatacaggatcatgaaagtaaaattatttcacattatcattttaaaccattctctctgtttggggactgcagtaattactttcaaggatatattcattactgggaaattgaaagctatagttgttttgtcttgttttttttttaaaaaaagtattgcttttataatagcatttgatttaataaaagtgatgaaactaacacctgtcactgcaccccaaagtgtggtattattttaaaagttccctctttggctacattgacctgaaaaataataagccaagtttaatgttcatgataaaccccatgagatttgagaatattttatgaatatgaaagctcctttgagaaacatttgcattttcccactgcataaaaaacaaagcaaattgcaaatgaggtagaaagaacttaattaaaaacattttaccaaattttaattctcaagtacttaccgaaccatcatgataatattctcattgactggttaacatagaaaaagcctcttaat

SEQ ID NO: 44924 - DNA, 2286 bp, Bovine  19866880907361
cttttgttattggagtatgccaagaaaatagtaaaaaaaaaaaaaaaaaaaaaaaaagtatatttcctacattatttttctctaactgtataattgaagtaaaataatggataatcagaaatgtagataataaaagaaaagctgaaacattaaaacattcaacctattgtgcaataaagaaatttacaccataaagtaaaagcaatgtaaaaaataaactctattctctcatcaatcaaaataagagtcattttaaaactgtgaacatgtgaaacgaaaattagttatttagaaactccactggaaacactttatgaaacccattagtccctggggttaccaattcacgcaatgatcatcttaatgacttatttttgtttgtcattaatgtattttctctttacttttataattttgatcaatttgtcttatctttctaagtaattttttgcactttactaatgtatacttgacaaacagtaaacttcacatatttccggtgtacaatttgacaagtttggggatgtcacctgcataaaagtatctcaacaatcatgataatagacattttttttatcctccaaagttctcatgtttctttgtaagccaccccaccttctacccacattcacatgtaaacagtgatctgctctttgtgactttactttaatcttcacttctagaatgttatataaatagaatcaggtattatatagagttttgtttctagctttcttcacataacatgattttaagactcaccatgttcctgtgtatatctgtatttcattcacttaaatttatgagtagtatttcattttatagacatcctagctgacttattattcactagctgatgaacactcaggctgtttccagtttggggtaaataatactagtttaggttaataatactgccataaacattcatatacatgcctcccatttttcctgaatagagacctagaagcagaatgggtacttatattgcaactacactgatcttggtatatttttctctgaaggtcaaaaatctccaaaatactaagaaaaaagattagaacttaatgattaatcaggggagaaaaagggattcatcatgatgttaaattacaagtagactatgcacataagtgggaaaagaattgtcccagatgatataaaaaacacaaactatgttgctcagaatttgttttcaaaggcattaattctacttttggatgaagttcttctggaagaaagatcatagctatcttttatcccaaatactatcacagtgattagaatacatcaaggtaataatagtgtttattagaattagaataatgaacttagatgagctcataaaggagacaaatgaacagaaattataatatgtgtaaaatgttaacaacttacaagataaaatgttttataaccacaattggactctaaacaataatctgttttacttctattttctagcattaagtcttcagaccaacactgttttgtaattttacagtcttgtaaatatacaatagaattttattaaagtatttgagatatggcatattaaaaagagaatgacaactgaaaaaaataaaataaaggacactttgagaaacaactgtatatacaaaataaagaaattacataagaattaaagtaaaaagttaacttcattaaaaatttagctggtacacagttcatctatttcactgtggcaagccatcaaaataattatgattccggaatgcaatctaatctcaagcgaatgctaaaaagtctgtcttccaattagcacattagtgtgacttgcctaattaaatcaacagaataccagtagaagataagcccctaagtgtgcactatgagactcatatgaagaaacagatgtaatcatgtatttacaatgcacattaggaaattgttgaaaagtgtttaatatggtgatttttttccttcatatagagcaaatcaaaggtctaggaaaggtattaaaccctagcgaaatgctcaaatgtgcaaaatcagattttaaaaatctactctgttaatgcttcttttataattaagcaatgatgtcttaaaagcatacttctagaattggatgtgggaccataaaaatgggtaaattaatttttaaatataaacgccatattagaaggtaattagaaagtcctcagagatacttatcattaaattacatgctgcttcctttgttttccactgtgtagggaacagcttttcttttctatgaatctcttttccatactaatcattacatacatttaaaagctaagg

SEQ ID NO: 44925 - DNA, 2706 bp, Bovine  19866880967280
tctgtgaataccctaaaaacacctgagttgtacattttaatggataaattatataagatataatgcacaaaattatatctcagtatgctgggagggattgggggcaggaggagaaggggacgacagaggatgagatggctggatggcatcactgactcgatggacgtgagtctgggtgaactctgggagttggtgatggacagggaggccaggcacgctacgattcatggagtcacaaagagttggacacgactgagcaactgaactgaactgaactgatagctgatatatacatgagaaaagaaaagaaatccaaatattaacttttattcaacctgaatgttttccacaggaatatgtcttgcctttggcaatgaaaattcttgttagtattctctttaatattaacgaagtctttaatatatataaatacttaagttatttctattgagattctttgacttggtaataaaagacttaagaaatttctgtaaatagctcctgatcagttaaaaatctgagtaaaatttcactgaaatgaagtcactcagtcgtgtccgactctttgcaacaccatggactatagcctactaggctcctctgtccatgggattttccaggcaagaatactggaatgggtggccatttcttttttcaaaatttcactaggtggcgccaatagtttgagtctttattgacagaaaaccttgtttatttgttaatttcccatattcattaaaataaatggttaaaaattatgtggtatgaaaatttgccttgtagttaccctgagcaaacctaaattggaagttttatttgtttgaaagttctgtcagatagaaataacttggaaccatatattttaaaatgttatttaaattctagttgcagactgagttatagatttttcatttcatttatctatcaatatataaatttatgaaaactgttagaattttaaagttattttaaagttgtaattaataaacttggttttcctatagattagaatatacctaaaaataatatacttgtctgaagtaaatattaggtagaaacatctaccctaagatattaaatagaaatcttcaagtagaaagttgtagtttgaaataagtaaaaatatgctaaaaagattaataacgacataagcggcagaaataatatgtagccttttgtgactacttttgaagtccatcattacaagtaattctagtgattttcttttagggtgaatggttccagtatttctgaccccaaatttcaccttttcatttttcattgctagcctttaagtatttattaaactacctgattagtggacattataacagatacttggtaatttattgcagctagcagtatgtagtggttatcttgaaagaaatgaactttgaggataaacatttaggaagatttgcagaaaattattttctccccaaacacaaattaattgtttgaattatggttgctgtatctagaaatctgagtgatcacttttcttattttttaagatatcttttctaagttttaagttatggatttcaaagagaaagaaaagatgtcaagaaaggttggaggaaaagagaatcattaaaatatgaactgagaaaattgtgtgagaaaagcagtgaagttgaagttggaaacatttttttttcctattgcttaaacagtgattcagtatcttttaaaagagcatctttcttcaagtgtaattgtataatagtttgtactattattagtgagttttatatatactgaagtcatatttgtggtaaaaatgtaagaactatgtaaaataaataaagcattcttagatttatttgtattttagtggtaaagagttcaggttttagaatcacactgcaatttcttgctccattacaactagttgtgtgagcttgggcaacttactttgccattctaagcctatatacttttccttctaaatctctaatgctattgctaatgctaagtcacttcagtcgtgtccgactctgtgggaccccatagacggcagcccaccaggctccgccgtccctgggattctccaggcaagaatactggagtgggttgccatttccttctccatctaaatctctaaagtatgaataataatatctataaagacgtcattgtgaaaattcagtgaaatgtgatcatacacacacacactgcttaatacagtgtttggcatttaataataccatgctgtggctagaaagatgatgaatagtacaaagttttctgaatcaaaggacttacacattgatggatgatacaaatatataaagaattataaaatgatatccaaataaggtacagtgagacttcagaagagaaagtcgttgattctgcttggggaatgacacaagtcaggaaagaattctaaaatgtgtttgtgttttgagtaaagagtaggtgtttgtcaaatggagtagaacattatatgtaaagaggatgtgcaaagccatgaagtttcaagcaaagcagtttttatctgggtgataatgaactagtatattttaaatggaagattcatgaacagttttgtaatttcaggaaaataggacagtaagctgtgaatcaaatggatggaatgtggggaaagggaggacaggagaagtcatgaggtgatatgtagtgattcacatagtggatggctgtgttgagatagtgaaatgagagggtagtgatatatac

SEQ ID NO: 44926 - DNA, 643 bp, Bovine  19866881005030
ttctattcaaactgatctaggactaactttcacaaaatcattacaatatgactccagttagttaaatttgattattatttcatgtgagacatatttctttctctttgctatcaaagaagtagacttttacttttgatgcttgagcttttcatgaccacctctgacactggttttacagaaaaatatatctatctcagcaggttaaagtaaaacatgtgagcagaaatagcctatataacctttttgttcctataaatgctaacactactcaggcagggaaaaagcatagattattaccagataatcctttatctggtataaatcattcatctggtataaatttatctggtataatccttacattatttctacagagttttatcaattcaataaaaatccaaaagtaatttactttgtaagcagaatgtggaaagaaagaaagttagtgtaaatgattctttaaaaagaacataactgctcccagagccagttgaacagatttggataaggcagtaaaaatcatcttgataaagctagaaaacttagaagaggtaaaatttcaatatgatttgtgaggaaactgtgaatttgaataatagagttgtaaaattgtacattaaccctagagaaacatctataaaaa

SEQ ID NO: 44927 - DNA, 1461 bp, Bovine  19866881045434
tgagaaggataatattatttgcaatttttcccccaagggtagctctatgcagctcaatggtggatagcttaatttataatttaggttatatttgcaattgatctctccatgctggcttctgctaagctggaaattttaaattcacaatcatagatcattataaatggcaccaagtgtttagtggctgccagataaatatagattttcatattaacacaaatggcccagaaattatggagaaatggctcactgaagactactttcaggactcaaatagatgataagttctaacattttatagccaaaagctggaaggctggctgtttcgacttggaagacaacaataaatgtatctctaatccactcttgttttcagttctcaaaattatttcttcatgctctgctgcagtatttggatgtggtttatatattagctaaataatatatcatcagtttctttttccagactaaaaaagacattaagctgggaaaagatccaaatgtcagtctcaagctatttgtatttcagtttgattgcctttaaaaaattctgagaaaataaccttaacactaaaaagaacagtattttggcttggaaatgacaagttcagaccactcaagatactaaaatatgccacctgaaaagaccacatgaaatcataatggtcttactggcagaaaatgtatattttatttcaatagctcatatgatcatctgtcccttgtcaacattcttacttgagtgtgatcagaaagttaaatctaacattacttatttcttcatgatccacacttacagtacacatgtacactgactgaaatttgaatatattcatgcttttcactttctgattcaaatccaatttaaaattagaaagctaactgacgattaccaactctcttctatgaacaaagcacagaagggatcgccactcaggtggaatctctttgacttacacagcactctcccatgttgtgaatacggtttttgctgctataacctaatgcaagtttccaagccaacatgtctcattaaatcaaagaagcaccacttccccctttgctagagttttcaaagataaatagaagtaaatgttggcaaattcttccccacatatgtatgtagcacacataagcaagagttgattcatattctgcaaatcagtagtttaacaaagaataaaccaaaattccatacatctgtacagatattactacatgtttataggtactctcatacacatatgctactaatattatatggcatttgcttatatcatttaatgaaagagattattgtgctttctgtgcttttactgtgctttctctcagcataattattgtctttgacttttcatcttattttataagaatatcaggtaggagtgaatccagtcacaaatagcaacaaacccaacactgtctttaaaaataaagttttatttgtctcataaagtagta

SEQ ID NO: 44928 - DNA, 1044 bp, Bovine  19866881402363
atttggtttcaagccaactttttcactctccctctttgactttcatcaagaggctctttagttcctcttcgctttctgccataagcgtggtgtcacctgcatatccgaagttactgatatttctcctggcaatcttgattccagcttgtgcttcatccaacccagagtttttcatgatgtttcatgactggtttgatcactttccagtcatatactcattagcaaaatatatttaaacccagagtaaaatttcttaaaagataaactgaactttcacatatgcaaatttgcttagtagaaaatgtttaataaaaattacaatttgaatagtaatctccgcaatactcttaatattgtaatcttacgtcatttaagtctacccacatttttggcaatatgatttgcctagactatgtcggttcccaacttgtttatgtaccacttttctttttataatctccctaacgccactgagtttgttgctagtgtcaccttttgcctattatcctctatctgtgaaacaactgaagaacattacctgggattgagaaagaaaagcaggtgatgcatcattcacatttgatgtcacacttttattcttctgaaactgactcttaatgtcatattttcctggccctggtactccctaaattacagaaagaaaaagacatgctctcattaagaaagtatctatagcacctaagggaacagttggttaaatatctgaaccaaagctacagggcttttaagtgatattaccaaagctcttcattaaaaagcaagccagaacaaacctaagagcaacaaacaaagaaaaagagagaaaggcttttccttcctttgcaaagcctcccaggaacctaaaaacacactgcttgaaactttgctgccctctactgatagatctcaggaaaaaaaattatctgagcccttcacgtgattaagcattacagtaaataaatatatttcttccatttaacttatacaaccagctcttctattttaactacaaatgttagaagatataagacattaggcttttaa

SEQ ID NO: 44929 - DNA, 1530 bp, Bovine  19866881713083
gaacatgtacctataatagaataataggcaagttaaaaatttattactgtctgatatttgtaggtaaaagtggtaagaactgagattgataaatgacataatatgagtttggttgacatatgaatagtattcttgggactcacaaacttataggatattcaatcactgaacattctatagctgtgtatttatttcaaattattttagaacttttattaacactatggaagtggattttgttttattcaaatgaagtcttttcttttgaagttattcaagaaggataaaactcattttcattagtctaaattaaaggagaagtagtatagttgcagtcagtatactgtataccattaaatgttgtgtaaccaataaaaacacatttgaatcatttaatgaggaagttattaaatgaggtgtatcacattataaagcaatctactcttacacaccacgttttaattcagggatatgtaaatgactttgtgattaatccagttcaggtaaagtaaaattgttaagtgtaaagagaattaaacattattttttctctcatatttaacctgtttttggacatttggaggaggaaaatactcagcaaatttaaaaagaaaatgaatgaaaacattgagaatgtggaaatttggggactcttgtatcacagtggaagtataagttgatgtcagtgattctaaaggacaagctggcagaatgtttcaaatatacatcccatttaaccttaacattctacttctgtgattcctctgtgaagtaattgataatatgccctgaagttttacacatcaagtatattcatccaagaatactaaaaatgaaaagttttaaatatattaaatgaaagaaaataggtaattctgatgtaaaagctgaatagagtcctatgaaaaattttaaaatggtatatatcatttaaacctgataataggataggattaatttgatcagtcattcaacaaatatgtaccaagagcctcttacatattaagcactgttccagggacttgtgatagagccgtgaacaagatgtaaacattgtttcatggagcaaaactttaggcgtgagacatttaataaataaatgaataaatagatcaataggttgataaatgagggaaggaaaagaaagaatacaagatggttatacatgctatggagaaaaatgagaaaaaaggaagaatgggagttcattgtgggttctgcatcagtttaaaaagtgttatcagtgaagagcttacttggaaaataatatgtgattaaacaaccttaggctcatgaaagattttgttttgcttttcaatttttgctttctctatatgaacatacactgttttatagtaagtaaaaatgatttaaaattgtaataaaacaattgaaatttaaagcataattttaattaaaatcaatgtttaagtgaataatagattaaacaatacatagtataaatataacacttgtaagctgaacataacagatactgagactgtttttatatagaaagcatagatcatt

SEQ ID NO: 44930 - DNA, 711 bp, Bovine  19866881908883
caccgaggtgttgtgctaagaaaggaggcatgttttattctagccacaaaagtacgaggtggcatgtatttatgttgaatttgagacatctcatatgatttttgaacatcataggcacctggtgctggaacaccctgaaacagatttcaatgaaccagcataaacatgtaggaaatttccagaaagatgtagcatagatgttcacactataaaatgacatacgtagaaaaatacaaaacttttacttcattattaaaaatagaaatttaaaagagtatccctaaattatcctctcctaaacgaactataaactgactcacaaaaaattaatatgaacagaatcatgaagtacagattcacattcttaaaaaattagtcttcataatatagttgttattgttgtttagtcgctaaatcgtgtctgactctgcaatcacatggactatagatcaccaagctcctcatccataggatttcccaggcaagaatactggagttgtcatgtgttgtcatggccttctccataggatcttctggacccagggatccaactcacatctcctgcattgcatgtgaattctttaccactgagccactgggaagcccttcataatatacatcaaactctaattttcaaatttcacaataaaaatcaaattttttatagaacaccgattatttatctttttaagtagcaaaactattccgctt

SEQ ID NO: 44931 - DNA, 1946 bp, Bovine  19866880365510
gattgtgttctggaaaggagaagactgccattgctcttctatcttaatgatgtgttccttgagtgtttctcaacaggggcaaatgagactcttcaggaacattcatgtgatagttttgatagcaaagcagtcaagtaatagttggggaaggttagggatccatttcaggtggggatttcttcctctctgtccctctgggagaggaaggacggagctctttgggcttcctaccttacttggaggggacacctgctcttggactttcttctgagatagggcttgagctttgctgcctgtccctagccaatataagagatcatttagggccaggtatgtgaccctaccctcagccaggccctgtatcctgtctctaaggcaccactgggaggcaatatagcacagtttgaactagtttcaaatcctggttcttctgctttattgctctgggactttgagcagttttaacatttctgaaccaccatttccttttttgtaaaaggaaaacatcccacattagaatgttgtcatgaggagacaaatgagaaaaatgtacgtcaaggactgggcagtgcgcttggcacatgtaagtagtgaattcatggcaggtgttatcaccatcatcatcattgctggcgtgtcctgtggttcctacctggcttaggccagtttggttaagctcaatttagtttccaaaaaagatgtgctaattggattattatattttcatgtttttatatttatgtatatatatatatgtgcatggatttggaatctacacatgtatatatttatccattcaagtttctcttttacagatctgtaagaattatatttttgtgtcattgaaccatgagaaaattgtttttcaaaagaagatttcattagggatcattatgtaggccatcaaaatggagaataatgtacaaatgaaagttagaagaaaacataaaagcaagaaagaagcttggtgtattaacagggccactagtaagagtacttactgttataacctggatattttagtatctcgggacttgcctgtcttattttggtgttggatggcacagaccaggctgtttcaggcttgtgataaatatttctttttatttaatgctaccacttgtaggcttgtaatcaggagcggcttatcagcagcttttcacaatctgacattccacatggaatgccccgatggaggaaagttagcactctgaatgcttttacagttgaattccacacacatgaattatgacaagtgaggcgactactctgtggtttgttgtgtctggtctggttcctacttttaaagttgcagttgcgtttggtcatttgaagcttattttcacagtctggccaagccagcagggtcccggggctctgtaggggacataaaccgccagcctttaagtttgagtgctcagtagataagcatttcaagacttcattgcatcatacaaaaggacttatgggcttacttaacatacactatttgacttcatttagatatttaatggaaagaaaagccttttattatcactgaaggaaagaactgccaaacgtagggaggctgagttgaagtattgtaacggatatacagagcacaaatatatttcactgccttccataatggggtatttaataatagttgtttctttaaatttagcacatgtatcttagatatttgcacttggtaaattacaggctgtggttcaagaaactccattttgtttgtgtttaaaaatttgcttgaataagcatggactgattcttaaaaatgaccatcagtggtgatttatgtttatttctcgaactcagattagagcgtccatgcgaggaatgagaactttccctcctgtctttgaacacacgtaaatgtgagcagtaggtgagattgctggcccgcttgaccacagagttgttgagtgttttgtttgatgggcattggt

SEQ ID NO: 44932 - DNA, 676 bp, Bovine  19866880448554
agaaagattatggtgttttcaggacattgagatgccagggaaaaaagcaaaaggactttgtgtgtagctttttaaaaaaattatcacacacctaaaaatgcagatccccaacaatgtaggcactgttgtggtttcttttttgttctctttataaaaacatgtttgtgcttacacctcccggcacttgttcagtgttaaataaaaacaactctggtaaattgctgacaaacaggtaatacaagtagaaagaattccctaactttcaaactctctgctcaagggaaaagcaaaagctgaagtaaaagatgtccccaaagtcatctggtaaacatgctttcccgaagagaacgtgaaacgcatagcaaaacagacactaactaattttaaacacctaattatatactgcctaaacagaattatcaagagacttgattgacttctacagagccgtgattgccatcaagcaaacccagagaaatcataaataatgtttgaccttctaacgtcctcaaaaattattcacaatattcgaagtatgtggaccgctggcattccattccaatattgtcagggaacacagaggtcacagattaattttgaagttagtgactcagactcgtttaccctgatttatggaaagggtacaatttgaagaaacacttaaattggacaaaca

SEQ ID NO: 44933 - DNA, 1352 bp, Bovine  19866880578390
cagtgtttacacccgtgagtacaccttttgctccatctcacccacaactggtggcatttttttttctggaatccatgcatgacaattaaaagcaactgcaccctctctgttgggagggggaccacaaaagacctccgcaatatttctttacaatgtctatatcactgatgagcattagtttgagtgacaaaggtcccaggctaaatcaacattcttaccttaatgttcctagtaaaaggctccaggaaacataactcatgagacatgtatgcaaagatatgtctcaaggaattaatccagagccctcagatgaagtgaggagaaaaaaaaaaaaaaggtgggggggggcagaaaaaagaaaatgcggtggcttgtttccaaacaaatgcagctcagcctgggcagcgaaagcataaaaacaggtttgcatatacagagctcagtggcagaagcgagagttctgtaggatttatttgacacttattttccgggaagccttttgtggagttgtaccgtttgtttcttattgtctgggaggcagtgaggagctttctcccggagggggcctctcaaccccgggcctggccgcctccgacagggaggtgaccatattaggctgtgtatggtaaagtaaacaataacagagttgcaatgaaatggaatttttttccccagctaatggtgttggggtcagtcctgtctttttagtcattctcactaattctgtatcctagtgcaaacaggccctcctcctcctctttttttttaagtgttagatgtttccaaatatctgactgtaaattcgttgagaatgtttgcaatgtaagaaaaagcttttaacatccaaataaagatcctgccagtttaatcattgaaggggatgtgaattttcaagcccttgcagaaatccaagcctcctttcctcactcctcccatgccccccaccctaatctttctcccaaggttaaaattacttggtcattgaaaagtaccttctaaataaatcagatttttaaagaaagagaccgttaccttcataaaaattccacagtcacatactgtgttactgagtgaggagtcttaaccgttcatgcgcctgaaaatttattacctggaatttctaggatggttacttttacatgataaagctctttcccaccttctccaaccctcctccccaaagggaaaaagcaggcaaaaaatactgtggtcaagtcatcctacagaaattagctaatcaaaatgaaaaatatcagatatgagtccccaagatgttacacattttaaaaaagttctgcacacctaaagacaacaataaaaagtatggctgctctctggccattgtcagtcag

SEQ ID NO: 44934 - DNA, 1155 bp, Bovine  19866880672190
cgctgtagggacactttcctcccgatggtctccaccacctttcttcctgttgagtttggggcacggtgagggtgtgacacagcgcccgcccccaccccgggcagggggaacctcagagaaacagagtaagatgctgcatttctcccccagctaataagtacggtcaagttcaaggagctggatgcgtccttagtccagtaacattctcaaattctgaacacttaaatcccttctcatttccatacaacttttgcttccaagttcgtttctaaaaagctccaagaaactgtaaaactctcataatcaaatgcaattgaaccatcataaaataaaaactctgagacttgtgtgtaagctgtcaggacttggctcattattctcatttacttaataaaacacacttttaaaataactctctattcatatatttatagtaaaaatataacttttttgatttaaataattacctcaacaaaaactatttggaaatatacaaatcatacaacctaaaaacaaagaatcattactaacaccctaatgctatttctcttgtagtatttatttagccttgcatgcataatgttgatttgaatattagtgaaaaggccgattcaggtaaccatgacacctccaaaataggcacaagcaataaacatgactgaaatcctgtcagattattcaagtgaaatcagaaaactaatttctaatattgaaaatctgtatccatacataaagtactaactgaaacagatcttcagaatgaaatttccccaaatgattaaagtaaaatgtgaaacctcacagtttatacaagacaagaaacatttggctgcaaatggttttataattttgctaattaaaaattatcccattttcactttggattcctcgtgtaacagaaacaggaataaccttaccatgccagaaacacaagcaaatgattaaagttctgctctcaaaaaaatctttaaaagttggcaaaacatttcattaggctacaaatcaaaatccgtctgtccttgacatctctttaatgccttccagattccacatctactttttttaatcactcactgaattactcagaaattaaaataagttaaaaatacaactcatcttggaccttcagaaaagtctcctgatatggtacaatct

SEQ ID NO: 44935 - DNA, 2022 bp, Bovine  19866880677853
gagtttttgggtttttttttttttttggatacagatagggctaaaaatttgatttttgttttgtttcgctttaactcaacgtgatgttggcaatttaacttccacaaaaatcaagttagttggttctttgcaaaaaaacagacactgctcattggctgtgcaaagtgagaagttactctgtggttgtgggcttgggggcaaaagatttgaaacgttctgttaaccctcagtgttgctgtgtgattcttgaattctcatgtgtcttggattccttcctatggttactacttaacagaataaaaattagtcacatgccatctgcagttttaagtctacgttcagaccttttctggaaggtttctagaatagggtgggggtagaatttaggttgtttggttcccagaactgtttgtttgttggaagctaaacatagaaattacgtttgaaaaatctccattcaaagaatgtttttaatttgaaaaaatgattttcaaaagtgtgtaaatgatgattccagtgttgcttcagaaaagtaatttacataagcatgcccccaaatgttggcagggtatcatgtgtagatgaggctattacagttgactttttcttttctgaattaacttaggcatttttcgtatcttctaagaggagtaatcgtttttaagtgcttttctaaacttgaagtctagctgagtttcagtgttgcgcttgtttcaggtgtgcctggcagtgactcagggctgcacagaacctctctacgcacacatatatatgtatgtgtgcatgctttggacttcccaggtggtgcaaatggtaaagaaccaacctgctaatgcaggaggcataagagatgggagcttgatccctgggtcagaaagattccttggaggagggcacggcaacctactccagtcttcttgcctggagaatcccatggacaaagcagcctggtaggctacagtccatggggtcgcaaagagtcagacatgactgaagccacttagcatgcctgcacatgtgcatcctttttccagttcctttctactataggttatgacaagatacttaatatagttccctgtgctatacggtagatccttgtttgtcttcttatatatataaaactgtgtatatgttaatcccaaactcctaatttatccatccctcccactttgctaatcataagtttgttttctatgtctgtgagtctatttctattttataagtaaattcatgggtgtcactttttaaaattccacatataagtgatgtcatatgatacttatctttctccaacttaaaaacttaagtgcttattcgacatcagatcctaggctatgcacgttgtatatattaattatgatatagggactgttatttcttctcattttaacagccgaagaaactgaggcacagagagattaggtaacttgtctagggtcacacaggttgcaagtggtggagctgggattcaaatcagccagaatgactgatggacacttcacgaccatgtgctgcttctctagaagtacattaatgttttataaagtaaacctgtctttctttggaagtgctatgcctctcccaaggtcagtaattcccccaaattcccagggaatccctatttcctcatgcctggagactcaagttccaccttatgctgcagtgaccagaagttcgaaagatcactgttaccccatgagcacaagtctgtgaatactattgtccatctgatgaacacagttttgtttttaacctcccttttaagaaaatatttcttaatttcttgaccagagttatcagatcttccaaaaggtcactacaaagttcctttgagtgttgcttagattaactcactgtattcttctagatatttctaaatttttctgtaatgatctgtcctgtctagcatgtgaatgcagctcccatgtgaatgcaggaattccaagtccatggatgtgtacattaggggccttttgagttatgtcattctgaagtaaaaaggaaggattctaagctaga

SEQ ID NO: 44936 - DNA, 1690 bp, Bovine  19866880690294
atagacctgttagaaaacgctattggcctacgccgatggtatatgtgagggctctgagtccactccacgtccctggagctccatgtggtgtgatcataagtctaggtccctggaagtaggacaagtggtcccccatcctctcacacttattctttctgcattttccccatgtcttttcccacctttaacatagcttggagtattctttcagcctgttttcctccagtctaattattctttaattttaaataatataataactttgacattttcatttctagttaaaccttgctaatttgcaaaaatgatgggtagacacagcacaaattagcaagcctaaaaaatcagcaaacataaaaaaagccaatgattaaagagaaatcaaataggtgcattatgaaatacacatttatttttaaaagcaaattcctcagacttgtgaggaaatatggagcaatgatacttggctgctttctaatactctctcttttctaagctatagggttacttttttctccccacatggtctccagcagtgatattttctgaacaaaatatcagagcacatggtaagcctaaatgtttctgagcaactactacacaattccaaagacagtccatgggttcagttttgctcctgcaagaatttctgaactctctggttacaggaaagaaaaaacacactatcttagtccactgaggtggctataatagaataacatagacctggtggcttataaacaacagaaatttctgttttggagcctgggaaattctagatcaaggtgtcagcagaactggtgcctggtgaggatgtactttctggttcagaaaggatcttctatgtcctcacatggtaggaaagggtgacagatctgtctgataatctcttttaaagggcactaatctcattcaagagggctccacgcccccatgacacattcacccctcccaaagttcccacctccaaacactatgacatcaggtggaaggactgaatacatgaatttgagtaggacacaaacactcagtctacaacataaatgaaagtggttccaacctgaacaaccaaagatgtttccaacccaaacttgacactgctctagtttatatgcttactgtctccctctgtaaggccataccagcgggaatgcagcctagggcctacagagctctgttctcagggtctcgatttgtgcctggcatacagcaacacacgtcttgtgtgcacatgcccatcaagagtatggaatcttttcctcgtctccttgagcgtggactggcagtgctttgacaaatgcaaaggagtgactagtgctatgccaggtctgggcctagaccctgagaaacctggcagtgtcctatttcatgctaagtctatcatgatggtgcagtcaacctgagagccaagtcatggccagggccaagtgtcaagtgtagacatgaaagccatgctgaatgttccagtcaaagctaagctcccaggtgaatgcactcctgagtcagcaccgcacagagcagagaaaaaccacccctgctaagccccgcagaggagaaggaaatcaatcctgaatattcattggaaggactgatgctgaacttgaagctccaatactttggccacctgatgtgaagagcttactcagtaggaaagaccctgacgctaggaaggattgaaggcaggaggaga

SEQ ID NO: 44937 - DNA, 1109 bp, Bovine  19866880716303
tgtcttactctggctaaaaatattagcctcccctgaaggtgaagtacaaaaaaaaaaaatagacctggctgtgcaaaacacagctgacaatcacaatccatctgaagtccaagtccttatagactcacgggcatcaacaagagggcaataaccaaatgctttcaaatgatggaaatgctgtctagtcatgtgtgacatgagttaaataagtaacaacgcaagaatgcatttgtctaccattgcccaggggtttcctgagtttagcagccaaattggcaactgggatcatattatcaagtagtatctataccactttattaactgtcagggaaatgtctattataataattgtcagcaaaataacgtttattttacaaccgccagagcaacctggccaatccgaatcaagacttttcatccgatcattcccagagaatggccagcattctagaaacattgagctgataatattgcttctctcttaagtttgatgttgctcatatcagagagatgaaatactggcttattagcaggctgcctgctcctactttaagatcgtccacttacttagctaagttatgctgaataagctaactaaccactcttggactcagtttcctcaactgtaaaatgggcagagagttgtagtgagttattgcaaatataaaaaggagctattaagcaaagtgttggaagccaccattaactacagagtgattgtttcatcttctatcacaatcttctggtatataagggacaatattagctctctaacatttttcctagaaatacattaagtgcactggatggtacctcaaattttcaaatccaatcaataactagctatttaagaaatggtacattcaggtattctgtccatgttttaattgggttttttgtttttctgatgttgagttgtatgagctgtttatatattttttatattaacccattatctgtcatatcatttgcaaatattttctcccattcagtgggttatctttttggtttgttgatggtttcttttgttgtgcggaaccttttaagtttaactaggtactatttgtttatttttgctttgctttctttcaagggaggatccaaaacaa

SEQ ID NO: 44938 - DNA, 1357 bp, Bovine  19866880742569
agggagtttgtagggaaatcacgggaggcctagaatgccaggcaaaggagattagtgtctgttgtcaaccaacggggctactgaagattctgaaaaacagttgtgatacaattcaggctgctccaatagaggaagaggtatcaagctgccaaaataataaggacaaaacacactgaaggcctgaatgagagagaaacccaacaaagagaatggacagaacagatgatgcagaaacgacacaagtcacagaccttagtgattaaggcaacacaaggattgaggggcaggagaaccaccctaggtttcaggcaagacaagaagactggggatgaaattagaagacacaggaaaggcaggagggtaaacagaggggaagaaaagacaaattgtatgctcaaatgtctgctcagagatctgagatttgaggtgggctggtggggatggtggtctttgtgaaaataaattccagcaaccagaaaacaagtacctggagtcttaaaaaaaaaaaaaagattagttcaaaatagggatatcctggagccttccacattgaggtgaagagcagatccaagagagagaagggggaggcctggagggttcattaagtttgagaagaagtcccacctctgtgtaccagtatcacagcttttaaccaagctgaatgctatgtgatggaggtatagtttttttcctgcaagaggttgagactgtcccatctacattcaaacttcccagctggtgtagtggtaatagtccggcagccaatgcaggagacacaggttcagtccctgcatcgggaagataccttggagaaggagatggtaacagcccatgggagtcggacatgaatgagcacacatgcatgcatctacattcaaagtcctcatatctcccggaagatgaagacagcagcaaaagatcaagcaatttcacccaacaggtcttcagcaaccagggaaatcttgtgaaacaatttagaaaattgttaggtgtctccagcccacctccaagtgagactcacaactcccttttggttttaaaaaataccctggttccaactgtttccagctctaaccaatcaatggaacagtgcagatacaaatgccagtgcaaaatatggcagcagtaaaagtttacagagctaattttccattgttttggcaaaacagcttggtccaccccttcaggtctggaaagcaatcagcttattagcagagaacgggctactgtatcttaacaagtcttgttcagaagcctgctttatggttttcatctcatgagaagttcctattgaaagcacattgttctgaagaggctcccatatgaactggctttttacacccaaggtctgacacca

SEQ ID NO: 44939 - DNA, 810 bp, Bovine  19866880780663
actctcagaaggcatataggctcctgagtcttaagggttaacttggttgcctttagaaaaaagaaaatgacacatataatttccttttatcataaaacaatgcatttattcttttctgtatgtctgttaaagggcatggctttctgagtggaaaacaaaacagaacttggtcacatgtttatttgcttcagctactcccttccccttctgataaataatcaaacatgccatccagaaaaaacaaaaccagcgagctgggaaatttgatggtcatcaaatagactgcgataccaagaaaagcagcccactgttcccacactgggttttcggcccccacacctacactaacatctgagtaaatatctccagtcactctttccattttccctgcaattactcctactgttatacaaattgtccttaaggcagtctcaacataatttttttttttcctcacaaagtagaacaacttctgaacatgaaaaagtcagcctagcaagagccatacacatatacacacacacgcacttacttattttatatatagaaatgtttcttccttgagaggtggggggacaatggccgagcctacttctttttctgttctaatagatggctgatttagaggttaaaatttaagtatattcagtctggggactaacaaacaaggtttagagtagtaacaattcccttcagatcaaaagagctaattttctacttcctgtctattccctgaccagtacatagaaaaaaaaaaaattagcacctggcttaccaattataccaaagttgggggtcagggttggggga

SEQ ID NO: 44940 - DNA, 1906 bp, Bovine  19866880785316
tctttaaactgtacaagttccatatatgaaagttgccactattcttctccaagtgtgtaaaaaaaaaataaagttgcttttaatacttactcaccaaaagtctgccaactaaatatttgacgtagctataatggttccctttaccccaaactgtgaggtttaccatgtaaagtgcaatgcaaattcctttatatattataaaatgcatctttgctctgcaaagaatgctgtcacccccatggtgatgcaaggaacaggaacacttcatttctcacgaccattaaaagtctttttaaaaaatctgccatgtataaagaccttcattagtataattaaatgactgttggggttttttgatataaacaacttttgatctgtcctttaaaaacctcataacaatatcattaaagagttaccatttttaaaagagaaattgtctgcttagggccatggaagagtagccatgctctgggccgcttcctctctctccctttcagacttctcctggacttgaatgtcaccatagaccttgaatccttgaatgtgaaatggcttcacgctaattgctctaattgcttgaagatgtgcaggcaggtgaaacctgatccccgtggccattgtagagaccaagaacaacactggaatgtttacacagtggtttgattttaatagacagaagggctgagtttaagacagcaaaaacacagctaataggtgaccccttaatgtagtcctcctttgaaaaaaaagaaaagaacacacaacaaaaaacaatttcatgttctaaaaggcagtgtcctaaatgccaaggttatttgcttgactcttgaacacacgttacgttgcacctgacatttacacccgaaactctaccccgaatacattttttttttttttaccttaaaacaaaaaagcactttatatgtcagtcaccttacaaacagattatgactgtatggtatttccaagtaagtgcattcatttaaattttaaattgaatatttttcgctcttgcaaaactcttggtcccttaaaggagaagccttgtatctcctattttatccctttggttcttcggctgtccctctgccccccaccgccatttatggtatccctgacccatgtacattcctggaccgcagttaaagttgactccaaaccccctcctgttggtcctttagacaaacgtgcatcctttcggtaccttttttctttgtaactactatgtggggctgtggtctgcttctcatccggaggggctaaggcagccaggggagtggctgacacagttattcagtgacagtggccattctccctggatattttaatcaactgagatggatacagaggtttgacaatggctccccagagccctctcttaacagagcacaaatgtaaccaatgctggacaggaaatacactgcagcaagaccaagataaaaatacaacagcacctatgaggtgtcattaacaaaaggaaacccacagaagttcggggtaggtttagacaggtgttgagacagacatatatgtacatcaaggatctgaatgtgcaggaatgtttcatatagagccaagcaaactgtgaaacaggaagtaagaattaaacgtgttacagaataacacaaaacagtggtacgattctaaggctaagctgggcaattaaaagccatacatacataatataccttgtaaataagaaccgaggatagggaacaccccacagagctaggagcacattcaaatggctattctctaagttatgctgtgtactaaacttctaataataaatataaaatgtgcaagaaaggggaggggggggagtccttttaaagttatgaaacactttttagttatataagctaagtaataaatataggagcttgtatcacctggactgtttgtc

SEQ ID NO: 44941 - DNA, 1176 bp, Bovine  19866880983000
tttgtgtatttctttaattggaataaattgtatcataatgtgcacaggcacaaacttctgtaaatgtccaatgtccagtgtctttcctagaccctggaagtccatttctaaattcctggtttggaggaaatttgttcgtgaacccaggaagcaggtttgagaagttatgggtagggtgcagccggcacgtggacttaatggataagcaggaagggagggtctcccaaggttgtcaccctgcctggggtgggggtaccgtccccagatggttgagaagctcatttgcagccatcactctttgcagtgtctttcattttgcatttatcgcgtgcttcctctgagctagttattgtttctgatgcatacgtcctgctgcttcacctgaactgtaaacgtcttcaaatcttactcttaagtcttcatctctttgcctctcctcttgctgccttacctaagaaatgcttggtgggttcttgttgtccccccaccttttttttttttttttaagtgctgtgcggtagaaacgtttattatggtgttaagtctttaaataattctcagcaactaaacttgaggcatgtgaagataaacgatgacaatttaagccagccaggaagctgtaacgtgggctcggactgtcgtttggcacaggtctatgtctgctgacggagcttccctcctgccatcagggcatggcagacagtgcaggtgagtgcaggcacacctctgctcgcctgcacatcggagctgtgtgcactcctccagcccgacagtcaaggaagcgaaagctcacataggggcttggcagctgcttcttggagtcaagggaggcagggccaaacaaggatccgggatgcacagccagcaggagagagcttatctcaccagagaggaaactatcgccccgtgaacctgttttattttctgtttgtatagcatgaacattcttaatgtatgttttattttagtttgcaggcctttctccctgcacacgcagagattattccaagtttcctctgcctgccctccctctgatgtgtgatgtcagatacctaatgtgtcggcagtcggaacgttgtcgtcactcatggctgaccccgtaaagtctttcccaggttgactgtgcgtgcctgagagtgacaaacactagacgttgctctgttctgatggacacat

SEQ ID NO: 44942 - DNA, 1242 bp, Bovine  19866881005057
tggcacttatttactaggaatgggaggcagtgatgagaatgaagtcatctggaaccaaaagaatgaaaaatgcatcaaaatcgtccaggtccccagttagggtgaaactgactagcatgctaccaaactacaacccagccccagtccccctgagtctctgtgcccagcgtaggctgtggtccccggcgtgcctaccacaaggtgcctccaagagactgaggcctcaacgacaaccaaacaagagagggaggcagtgtatgtcttctgttcctgttagctcgcagggcgattgattttagcttttgaagaatgataaatagaattgtgtgcagctgggctgtaagtggctggctttatcagttgcctccatgctgacatcttcaacctgtatctttactgtaacccacaggcctggccttcaagtacagcaccacgttatccaaggccaggcgattgtcacatctgttctaaagcaagtgttgacttaacccagcccaggaaactgccaccgagagaaaaaggtctccagagattgtatgggaccttttaagttacttacgccaacagttggcctgcaacttgagtcacagctgaaaccagtgttttacaagttcttatttattcatattctctctctcacacacacacagtagctatgtgtatctttatttggaagcccaaagaatctacttgtatcttgaaacaatatgtcttaaagagacctttcttcagtcacgactgagatgctattataaaaatataaaaaaatccatcctcatttcttagctgtgttgggacacatctctgaggttcaggcagtagaatctgagatgaaagacatgaatctccttttcatgattttggtgcatgaaacaggtaaaattcactatcaagtcagcatgtgtggggaacagattgcatccaggtctccgatgcagttcccaaatgggattcgacctgtcattcccatgtttttctgacagtgactttgacagtaagcatcttagactctgtacacatggtagatactggggatttgtatgataatgatgataatgtcaaatacatagtctcatacacaaaggatttatttttcttctttttgggtgatttaaaatccagattacagtgatttaaatatcatgggaatccgaaaagcaaataccctttaatgattgatttcattgcactttataaattctaataaattaggctttcacattctggctgagacctcagtga

SEQ ID NO: 44943 - DNA, 1229 bp, Bovine  19866881120371
tgactatctcgctttaagaaattgcgagttttggtgtgggtaaacaaaatccaacgccatgcaaatgaaacatttattaaaatgctaaatttagtaaagccctttgagcttcctggatcaaagcagctatgtaaatacaaatagcaattactacttaagtaattgcctgaattaaaattctaaatatcacattatattatgatgcgctagggaaggggaagaaaactcacgtttaatcttttttgtccctgtgccaagcaactggctaaacttgcctttggagtgacgtctcattttagccacgtgaccactgggaagcagcagggtttgttatacccattttccagatgaggaagttgattcattaagattaaataagtgacctagggtcatagaactggttagtctcatagttgagacgcagattcaaggctctcttttagtttgtaaaactggacttaagagattcctttcagcacagaagtgaatacttaattatgataagttaaagtcagtgctcctaaaggaaattttaagttggatttaaattcacttcaacagtgtattggcttaccttctgtgtgcacatcagtatatttaaagggaaatcccagagtttcctgtgtaaggtagacaagtagttcctgggcttctcttaaagggagggcaggtagggaggatttgcaaaatataaatcatttacagtctgaaacagcacataaagagcaaaaatggaccccatgcaggatttgcacacaggcaaatgtaaaacaaggcgcgctcttctttaactgtatcctgactttccttcctgccttataaatcttgggcttcctcattgaacatcatctggtctctattctgcttcagctgtccttctgtagtccgtatcagagatggcccttctctctgatccttcccagctttttgcttttagttcaaccaccattagtagatgttttataactcgaatatgtctcagatgcatagcccttctaaatatttgttccagggtttccttaaacgttcggtgaaacgtttctttaaactcctgagagatcctgggttgggcagcctcttctgtgattgaagctgctgtcacagcctcaggtgacccaggtcaaggaacctctctctttctgaggcctgacctgccttctgtcctcaggagataccttccttttccttctcattcattgacacagccccgtgtatttcagttgctcgca

SEQ ID NO: 44944 - DNA, 1768 bp, Bovine  19866881126302
gtggcattctttggtggatataatttaaaccttacatatcctagaagcattttttagggtaattattaaaaacactttaaaaatcagtgttacgagttttttatgtaggtatatgaaaaagaattctgtcatcaaagtgtataagagttgacaagtgtaaatatgcagttagacagtttcaaaaaacgtgtattatttactgatcaatgtagtgtctcctctggagccattacactcagtcatttcctgtcaatctctccaggctgttataatcagactatggatatgcatattaaaatacaagaaagttattgtgcatgtgtggtggcagctttttaattgttaataatgttgctgctttaaaaagatatcaggatagtattctcttatgatggttaatagtcatcagaattgaaggagggcttaggggagctgaaactcagggtgggcgaacatgaggcccacaggtaccgatcggtatctgtgcttccaggcagtgcctcgtgataaaaaggaagagctttttatctgattttggtgctgagtacatggagattcctttttctcttttttctaatgtgtttttggaaaagttttataattaaaaaaaaaaaatatgcttctatatgtgtgtgctggtaaaagagccatctaacttctctgttgataacagtgatcaacaaactttctgatccagagaggaaatattttgggctttgcaggctacctggtctcttgcaactacttgctgtgttgtatgcaagcagccataggtgactagacagcaaaggtccgtctagtcaaagctatgatttttccagtagtcacgtatggaggtgagagttggaccgtaaagaaagctgagtgccaaagaattgatgcttttgaattgtggtgttggagaagactcttgagagtcccttggactgcaagatcaaaccaagtcaatcctaaaggaaatcaaccctgaatattcagtggaagaactgatgctgaagctgaaactccagtgctttggccacctgatttgaagagctgactcactggaaaagaccctgatgctgggaaagattgagggcaggagaaggggacaaaagaggatgagatggttggatggcatcaccgactccatacacatgagtttgagcaagctcagggagttggtgatggacagggaagcctggcgtgctgcagtccatggggttgcaacgagtcagacatgactgagcagctgaacagactgatacttcagtattgcagtttttgctagaaataatataacattgtaaaatccaaaggcaattctctttctgtggttgatgtttcaatactcccatctctcagtgttcagtgttgagctgcatgtgagttttttctagttggtcgtctcatgatttgaacactgttcttccaagtgatgtgatgttatcctctctttccagctattgtagatgatgaaagactctctgcagaggagatggatgagaggaggcggcagaatatcgcttatgaatatttgtgtcacctggaggaagccaaaaggtaagagtcagacttggtctatttgtgccccttctcttagagatgagctttgggtactatatttttaataactcatttgcagccttgttaggactaaggtaatgggagaagaatcaacctgtgtgttgtcagtggaagaattgagaaaaagttgatcccacagccagcatcaaggcactagggaggcagctgttccttttcttcctcagagcctcccaggaaatct

SEQ ID NO: 44945 - DNA, 741 bp, Bovine  19866881165614
ttggaaacattggaccaaatgtgactttttttgtttccagtgaggataggtttgtatgtctggagaccagtcttagctcttgctgtataaggtcttagaatgctttgtaattaaaaaaaaaaaaaacaaaacgctagaccttagatagcttttaaagaaaaggttctaggttgtcgtcctttgctccacttgcttttggtgtcctgaggttgatgctgtccatttacagcaacatctttatccataggtagcaaagggggccatacagggaaaaacgccagctgatgcacttggagcattgattgtaatctcgtcggctgttgtggcgcctgcacagatgtcctgggacatagaagtttctccctgtttagatgcagtgtgctcagtttcattctaaaaggttatatacgtggggtcaggtagtagattagcaaggaggcaaatagagaagaatagcccttttcatgtcttaaggtgcatttgaaagtaaatggatctcagagacagtctaattccaggagaataagttggttggatttctcgttttatggtccttatgtgtctgcacaaaagttgggcttaatcttcattgtactacctgccagcattagaataaggatcaggaaagaattcagatttcattgagcattaatctggatgtaaaaacaggctgacttctccaactgtacatgcaaaggagaagcaactatgaaattatatgctactacttaatctctggga

SEQ ID NO: 44946 - DNA, 987 bp, Bovine  19866881229950
gagatcagccctgggtgttctttggaaggaacgatgttgaagctgatggccaccccatgcaaagggctgactcattgtaaaagactctgatgctgggagggattgggggcaggaggaaaaggggacgacagaggatgagatggctggatggcatcaccgacgcgatggatgtgagtttgagtgaactccaggagatggtgatggacagggaggcctggcgtgttgcgattcatggggttgcaaagagtcagacacgactgagcgactgaactgaactgatggctagttttgtgctacatcagcagaggcagctagctgcaaaagagactctatgtgagactcttctagctgcaagagactgtacaacatactaatctctatgctgactacagtccatgaggttgactatatttgctatctggccctttagagacaaaatttgccaacccttcattacatcacacttccacagatatgatccaagttacaaatcctacactgcaaagccataacgctatcatggaatgcaataaacctattcctgctggttttggaactcatgattgataatggggcattccattatcttctgagggattactacctgcaatatcatgtcatctgcaagggtggatggcaatttttgatcagtacacaacgcaagtgttgtttgtcacttaccctgaatttttaatgtgtctcacagccataaaaagtctggaggtcactggttgaaggcatgcataatgccacaggactgcaacatacagaggaacactgaaaacaaacaaaaaaaaaaaaaaagaagaagaggttaaggaaaggaagtgacaaactttaatgcttcaaaagtaacacattcatgtaagcccttatgtcttccttattgatgcatgacttttacgttcagtatataattgagtatctgcgtatataagcatctattttgtcctttctgttctagaatcagcactctgttagttccta

SEQ ID NO: 44947 - DNA, 942 bp, Bovine  19866881238660
ttttccaccaatcagactccaacaaatacctattcaacacctcctagatgcctgtgatgagttcagagtattatgtgtgtgtgtgtgtgtgtgtgtgtgtgtgtgtgtgtgtgtgtgcgtgcgtgcatgcgcgtgtgagagtgtgtgtgtgtgtgcacgtgagtgtgggtgcatgcacatgggcacatgcacatgtgggtatgtgtgtagagcaggagagactgaagggtaagaggctgtcttctgactattactgacacatcatagaatcctgaggagaaattaacataaacatcagggtttactgcatctggaaaattattctcgggttgacttgtgtgttcattttccacaaggctcagtgttaatgagctaagaaaggaaagaaagcaggcagaggtagagctggaataagccagcaaggttctgatactccagctgccggtaagtgatgatgaaccattaaacaagagagaggaaggacttcgaaggcccaatcttatttgtcagtgccttcagccatgaaagacggcgagccttaatgtaacccactaattcctctccccaacacagtcaagattcatttccacaagcaagtccagtatcagaggctactgtggtcagaactggaaatataaccatgtatcactacactaaattatgcttaaataaaaatgcaatgcatccatcatatttgtataataaaaggattaaatcagttataattttcaagctttaaaagaaaattccaagcttttaagtctatttctagaaaaagataatgtgatgaaatgtcataataaaaaataactttgttggaggaaataattctttatcctttaaaaattttccttattaaatgcatcattttaacttaatgcatttctatatacttatccttaaatgtaaattttgttttgataaaatgaagagcctttttat

SEQ ID NO: 44948 - DNA, 784 bp, Bovine  19866881289058
tgctcaataaccatacaccttttcttcattactactagaacctggaactgatctaggacatcaaattcctcaagtctaaggatgtaattatcagatgcccttatgttaacggtgactaaaatgatgtaagtagaagccatcgagtaagacttcatggaaagttatctaaagagggcttcctcagctgggaagattactctttttatttcttgtaatgctgcctctttcaggatgtagaagcaatggctggagagccagcagccataatgtgaccttgaaaataaacaacatttgaacaggcaagtagagatcgcacaaagataggaaacacagattgctctccccttgatatcttttatgagagagaaaacactactaatcttttaaaacttacatacttgcatctattaccagaaaatcattcttatctgatacaaagacataaaaacatagctaaagattatcctactttttgtcaggaaaagaaaactagaaaattcatgaattgagattcctgattacccctttattcatcaaactgtttgttttaagtatgactttccctcttaatcagtaccactagtccaggggaagcatattttgcttgaacctatctctatgttttgacatgcaagacttgtgaaattcaaacacacttgtagacatccaaagctattttaaatgaggaagatctgaaaacactctccaaacctgatgattaaagggaatttaatagttcctcattggcatttgatctttagcctgccataacctatccatatag

SEQ ID NO: 44949 - DNA, 1066 bp, Bovine  19866881591574
caaatccatcggtccatcctcaaggcagcaggctgggccggggaaactgggcacttatcccactgacaacaatgaacacatctgcacggtcacccgaaacaaagagatgctcccaagcaccgccacaacgttcctgagtgatcacacctcccatcccactcaccagcccccaacctctcccgattttctgattccttctgatttttgtctgagggctgggaaaatcttaacagaggggagctgctaacttttctccagaaaacaactttccccagctatttgtcaacttctgtcattcagagggctacaacacaaatgtatatctttaatgaaattcacagtcaagaaaagttgtcatcatctagctatatctgttatgacatacatttcattttgttcaatacataacagagaagttatttaatcaaacagaagattcttgctaaaatgacagtccaagcaatgtccaaacaagcatttattatgctatgggaaactgatcagaattggattgttttcagcagaatttttttccttcctcttccacagagaaaatagcttgaggggtgggtgcagaaaaacaaccccagacaatagaggtggagtgatgctgagtcagtggtaagtgtaggttcttaagccccacccttaagtcattggggagaaaactaattaaaaaaaaaaaaaaacctcctaccatgtggacagtcataaaagggtctgcttcgaggagaggctgggtcttccgtttcctcaccatctaacgctacagaggagaggttctggcccaaatataatacacaatgtaaggaacgataacatctgtgtttctcaatgacacttactcgtggatatattttgtctttacaattaaatgaacacttagcttcagtgagaaaacttatgtgactgaagaagaatttagtgggttgtagacctagaaagcccaaggccaaaaatacaaggggaaaataaatgttagggtggtaactgggtatctgggctttgggcaacacacatggtgtgaatgtgagggaaagaaaacaaaagataccagtcacgctcg

SEQ ID NO: 44950 - DNA, 981 bp, Bovine  19866881596325
cacatatacacacatgtattctaaagattagcattccaggccatagacataggtttgtagtcagaaataagtatactaaaccactgcccctcccccagacattcataaggcacacatgtatttcagaagctctgagaaagaagccaagcatggccctaactggtttgtctatagaatttttttatttactcagtaatcatctgatttcataaaatctcatgaaaaatcataaggatcccaatgaagagtgagtatccttaagcaggataataccttttcaatttgttaattgtgagtataattttaagtctttattgataacaaagaatgtttcaagcatccatgaaactttgtaggatgtatacataaaaagttttctgaatctgagtctttgatgtaagagtcagtatttatacatataaaacttagaatgtcagagccagaaggaaacttagttatcatgcaattcaattctctcatttcacacataaggacactgagcgatgttaagtggcttatgcgtgactgtggggccataaatgatcccaaaacaccaagtgaagagctagagagaaagagagagagatggagagggtggggggcaggcattattaggaaaacaatgatccgagaaaaactcaaatattagtttttctttttccccccattatgggcattagtaactaatgctgaggtctttgactataaaataatcatgaccgcaaactagccctaacccaaaacacagaatcacacccccccaacaatacagaacctcagccctgtaacataaagacaactttagaaaactgataacatacaccacttaaagagcaaccacttagtttatagtaaaccatttggtttggttttaaagtaggacttcaaaagggctcaaaataatcaaaactttagattatagcatgtttcaaaatagaaaaaacagaccaactactatagccatttgcccaagtagtattt

SEQ ID NO: 44951 - DNA, 729 bp, Bovine  19866881616959
atacactgctgactgatggcagcgggtgtggcccaccccaggtgcgcacaaacctgcgagcatggcagcccgacggctgtgccggccatcggggcgctgtggtgcgcgcctgcgctgccttcccaccctcgttctcggcacaacaagtggatggtcaaagcccatccactgctgtgtaaattctccctgatgcagttttcttttacttccaaacggctttataaagcagctgaacgctagaagaccactgaaataatctggcttatttttcccctgcatcctcaatggggaaaggtaggtgagggggaaggggatagtgtaaaaagcaaacaaataaataagaacacccacagaaacaatactttatttctaatcccagagacaataggaggaattgggtgggaggggagatgacacaatataaatactgaaaataacatgtcatcctttttttttttctttctttttagtttatactcaatgttaactctaagtaaatgctgccaggtataaatacagagagatcttggacatgagcatattctcataactgctatgggtacaaataatgcaaatgtaaagataaacacatttaaagtattgttgtatttccatttctctggattaataatttagaaactgttgttcatctctggttattcacttcatggatgtcccaaggaactgaagtcctttctagatctaaggctctacctggatgataactga

SEQ ID NO: 44952 - DNA, 1097 bp, Bovine  19866881806941
acctcattatgtgcagggaggattcataatgaggaaagagccaccgccattccatgttctaacataaatccctgtaaaatttgaatatctccccgtctaattaaaggctactaattccaatcacccccttcatggccccaaagtaaaaataaacctctttaaaagcacagactacagttatatttctaaaacagccctcgattctgtttggactcagaaccttccactcagatatgttttacgacaagcataattagcagctttctaagatacaaactttgaggctgttcgagctcattttagttaaatgcactggatttctatttttcaaagagcgtcaccttgacggggctacagtgcatgcacagagatgatccacagccaagaaaccagcaggaatgtgcgagcagtataataatgtaaaataaaattcttagcactcgagttccgtgctgaagcggagatgctcagaaaaagccaagcaatcgtggcatgaacccgagattgcatttggacggggatgtattcagatctgcttgggaacaacgtacttgattctggaacaaactgctcacttttaatgcagtttgaactaatgaacaagtacagcccagcctctcacaagccagagaactatttcctcttctaatcaccgactctgatttttttttaaactgaaaactatagaatgcaaacccaacactgccaaacatatttattatgattaatagcctgtaatatccctcaccaaggcttaatttgctcttgttttccattatgaatctgcacagtctattccagtcccttttcaggtggagatgaatttcctgtggtctgtactctattgtattgccacccagcaaggcacaattagttaaaaacagccaacctccacctctacagcctccacagagcaccagattacgcaaaatgagagaacacaatcattgagaaataagtgaaggtgtccagggaattaaagcaattaaaccaaaaaaaaagagaaaaagtacttatgccagtcacccaaacacacctttacattaaaattcccaagaaaagaaagaaagaaagaaaactctagttcctttctttaa

SEQ ID NO: 44953 - DNA, 828 bp, Bovine  19866881853784
ttccatctcaggttaagccacaggtaaagtttgggctggatgaaaaaaagaaatttgcaaggaagcatagcatcacagagatgttagattccttttgagatctagtgagtctcatcttaagaaaatgcatacagaagcacatacagtccagccagcaggcccattatttattttttagtgttttaaatggcatttcatttctcatgaggaaaagcaatatagaagcaggaagctttcaggtcatatagaactttgttcttttcagacaaataaggtattgtgtgtttgaacaataggaggaatgtctaattgatcttaattaaattcagtgatgtccaatttttgagatgggtcaagacacatctatgtaatgtcacaacccaacaggctagacctctggaatcagggagctcggtggcgcactgttttctgacactctttcttatccattctctatcacattgccctgccaacttgttctgccctccagctttcttctctctgcctcatgctactcctgactgcttcccggtttggcacatattcctttgctctggccagccttctgaaatggcggggccccatcgtatactccctcatcattgtcatgatcacctaccaaacaggaatcctattatatacatataccgctgcatatggaggaggttccctggaatttgcagtgtgaaagatgtgggtttgcatcaaatcttctctactaaccagcaaactaggtaaatcacaaaagtccattttgtgtgtatttcctcatctgtaaagtgggagcaattcctctgtctcacagagcgtgtttcttttagtattttc

SEQ ID NO: 44954 - DNA, 701 bp, Bovine  19866881895778
ttttcttttccagtactttccatggagcaccccaggaacatattcagagatgacagaacttaaagagactgaacccgactgattctgttgctataggagaaaatgaagaaacaccaggaatacaaaattgtatgccctcgctccaggatgggcttcctgacctgcccagggaagagaagtctctccagagaagcccgggtttagtatttctcatgtctccaaagaccgccaactgtcagccaattagagaaactaaattgcaacagccatgcctgattcctgagatttgggcatttgtctccaaggacctgccattccttcttgatttaagtggtgcttttacttaaaaacataaattaatacatcatccatctccagggagcaaaggtggttagctccatattgacattgtttatgtcattgttatgtctatatggacagtgaaagcaattatgttttcttctgacggtgagttctcactcttgcataggagtttaaatttctctccctgacatcctctaaattgccatgagcatctccatttaatgcaacattttactatgcaattgttcctagttaatttcctggatacacaccctgacacgtcaacattcaggtaacttaggaatacgatgagcacgaaaggtatagaaaacatttaccaccctctccaaaaaaaaaaaaaaaaaaaaaatccctca

SEQ ID NO: 44955 - DNA, 752 bp, Bovine  19866882182454
tactgacataacattaacagatttacatatgcaaaactgtgaagcaacaggcattccccctcaattgacccacagcttgtagtgtctgccgagttattccccgcttcggctctgtaaccaagtgggcggcatgcgaataccatctgggtaccacttattgaaaactggcagtcgttctgtaataggcaagctggcaataagagggaagggaataaattgcatcatttagttaacatccacttgctttgcggctgttaaaaacccatgactgaataataatttggttatttcttttgccagaaactgccgtcagccaaatcgtactacgcatgcttgcagaagtcgacttgcaaaatttccacttgaaaagggattgaggaggatcagggcgaaatgggcacctcgctctggttgtgaacagcagtgactccgggtacatggtatctctatgcccttcaagtgtcctcgtcaccctaaacatggtcaacaccaagccctggtcagccaccagccacgctgagccacagaaccaggctgtgatgtgcaacagtgcccctaagaggcacagactcagggcgtgtgtgacaattgacagctacatgccgcagatgcggctgagcaagtcttgtctggacagacatcccctagtctctgcctcagaactaagtgggagagcaggctcacgggaagcctgagtgctacctgcccaggtcccctaactccatgcctgggagcagtcaggcggcatgttt

SEQ ID NO: 44956 - DNA, 1087 bp, Bovine  19866880187990
cagcacaccaggcctccctgtccatcaccaactcctggagttcactcaaactcacgtccatcgaggtggtgatgccatccagccatctcatcctctggcgtccccttctcctcctgcccctaatccctcccagcatcagagtcttttccaatgagtcaactcttcgcatgaggtggccaaagtactggaatttcagctttagcatcactccttccaaagaacacccaggactgatctcctttagaatggactggttggatctccttgcagtccaagggactctcaagagtcttctccaacactacagttcaaaagcatcaattcttcagcgatcagctttcttcacagtccaactctcacatccatacatgaccactggaaaaaccatagccaccagggaagaccccaaaatatttttgagtgttttccaaagggtgacccttcatcccttttagagcagaatctcagttcttttgcttctttaacttgtcaatactttctccctccatcaatttcagcccccttcctcttgttctggctttagcaaaagtaaagcccaaatgctccactccacccacaagagaaacttctgatttcagttttgatcccttcttgttgcttaaagccaccaagaaggaggctccctagcttgcattactgctgtagccttcagagacagagagcctggaaaagacaggttggccccacgtttacgatgtgcccatggagttatttacggtttgtttatccactcaatgtggagcatttgtggcctatgaccttcagctccagggtgcattaatagatctgggggaagaattggtagtgttaaactatacagttgcactgggcttttcagcctccccctgaaaagcaaacccagcattaattcccagacactcaggcataataggatttctagaaagatcccaattaccccactggccaacatggtgggagaaaacttacaacaggtgagaagcagatggaattagaatgaagttctctgctcatcaggctcagagatggaaacaagcatggccagagtaaaggtacagatgtagaatgtaagacatcatcatgattt

SEQ ID NO: 44957 - DNA, 2443 bp, Bovine  19866880345575
taacaatactccaactactgaactaggcattgcattcgactctgtacatatggatctcgatttttctggatacccaatgatagatgataccaagtcgcttcagtcatgtccaactctttgtgaccctatggactgcagcccatcaggctcctctgtccatgagattctccaggtaagaatattggagtgggttgccattttctcctccaggggatcttccagaaccagggatcaaacctggatacccaataggcattattaactctgttggggcgatggggagctgtctgaggagttaaccaacaaagcagggccacacagttagtcagtagagaaactgggatttgaatccaagcttatctcagctttaactactataatagtctactggctgagcccagtgttggcagatgtaccatagaggccagagctggggagggagaaaaggaagggtcctgtgtgaaaactgtgctctggttgggaaggaatctgagttgctctttggtaatttttcccaatagagtgagatattcttccaccaccaccattcttctctccacccttctatcgactctcttcctgacccagactaacttcagcagtcaatgggtgggtcgtgtctggattcctaaagagtttgttctactagaacattcccacccagagacgtctgctcactaatgatgtaacacagcagcaagagggacaggaggtaggcttggaggtcatgggatcatgatatgatgtataatagagcctcatagcaggcacattgcaggtgatcaagtgattaggtgttctcccctgctcttaaaatctcttcttgccagttttccacagtctccctatttccctcctctagtaactcttattttatcctggaattattttctatttctaatcatccataagaaagttgctccacagaagacaccattctttaagcccctactctcatgatcggggcagtatgctcctgatactcacctcccacttcaccttgcacttgtgcctttcatcatcaccatctgattcttcctccttctctgtcaagcacaagattagagtgtgacgctctgatcccccttgtttcattattagtggaagctgatatttggctttttgcttcagaagccacattgtaaatgaagacagcggcaggaattgagttttgagttgctggctggcgccaaagatatggttagatctttgaggccagtttccaagtgactttggattgaagtcaggatacatgtttgggataaatggagaaaacacccatctagcaagcaggaggatctcagagactggtgtcttagagggtggcttactaactaaacaataattccttccacatgttcagtatttcacagctcaccaagtgcttctttgtatattatcttttttgatttttgcattggttctcttgggattaatgggaaaataccattgtcctcatgttatacacatgcagaaaaccttagtaaggagcatggaggttacgtgattcctctaaagtcattcaacacttcgtgtaagaaagttcaaaaccttaaagttcaagttgtctgaattcccaagctcaagttgggaatactgtatgaattaggtggatagataaaacacctcacaaaatgccttgtgaattttctgtgttcaaaaagcattagtctctttcctcatttcctttctgaatcttgcttttctgctctttttccatccaccatgctggaaacatagataaaagggagtgatctggagagcagaaacggaggaaaatcatagcacttgaacatggttctaagacaagcttatgaggatgagactgatgctattatgaagccccagcatctcgcaagaccttggtaggtcccaccatcagggaggatgggaaacagtgcccatctctgtgtcagctccatccctctctccctccccaccctaattttgtggtttgctaattattttgaggccagagaatgtcaaggctctgctttctgattcaattttacctctcccctgcattcagcatttctcagaggccatgtcactcagagaataagaggcagacccggtatcttgtcctttccaggctggcacataagtttctgaactatctcccctaccaatctcccccagactctcacccaccaagccaccctcactcacacaatttactggaaacctctgttcttctgaagcaggctttggctttgttcccagaaccaggcagaaggaaaatgctttctaagaaaaacatgagcaagggaattacattctcatctgatatttcttcaccaagatgattttgtttgttcttcatcaagattgccttatccatgttatttatttatttttttttctgtaaaacctgctcttgatggggcaaaaaatcaactggaatttatttttccctagtagttaaaaaccaaaatccaatcca

SEQ ID NO: 44958 - DNA, 1897 bp, Bovine  19866880369852
tactaacttctcttacttatgtgggagtaagattatacaatgggatccccttatttgttcaagttaagcctccagtgtttacttaccacttcgttctacttgtattgaaaataccttcactatgtttttagctcaagcctttatgtttagtcacaggactgctagcggctctgaggaccctgcacaactgttttacagggcttaaggatggatatgaccaaacctggaacctttttctgggccaaaaccacacaaggaaagaagagaaacaactcaataggcaagggtgctcagttaagccacatagtttggattcttagaatctggtatcatctgcgccacccatgatgagtcacttctgcagtccctgccttcttatgggctggagcttggtcttgacagtgaggaatttctgcaggaatggatgtcaccagctccttatacagtcacaaaatcacctctgttggattcagagccatggagcacccacactgccttccttcttgcctgtgaagctcccatggcctccccaacatccaaagtaagagagggggtggagaggggaggtcagagaaggcaaagggagaagagaaaaggagagaaggaaaggaaatcctttcattaagtccccaaatataccgtcaacctctggactgctctttctaacttccttccaatatgtatttcatattttgtactgtaaagctcccatctaaactcagaattctgctgcttaagatgctccatgacttctgattgcctcaagtttaagtctaaactccgaagcatgggggacaaagttcttgataatccggtccctgcttggtccttctattttgcctctcaactcttttcgtattcctatattctctttctccttgcttcatctccttctcctcctctttcctccttccttctctcctcctgtctctgtttgtctttctaccccagcctacctcccctctgcccctcttccccttaccctccatccatgttagactattattctctaaaacaactaccatcccttttgttccctgatcctccctgtgtctgaaattccttctcctattcctttaatctgttgactaactcctccttgatccctaggaccccaacaagctttcctccaggaagcctattccctgaccccgcccccgttctgcctcatgtttagtcctgcatattgcaccacatggtattttattttccagtcaatgttcttccctccctcttttcaaaggaagggatggcatccttgtcctgctatctctacaaaacacagtgtctggtacatggaaaacacaagcaaatattagttgaataaatgacatcaacagtccatagctgcttaagctggtgcccatcccaggcaagggtctcagtctactttcctcatggattagaagtcaaactcaaaagaagttcaagtcatttgaacagagcatgaagctattcatattacagctaggatgagaacccagactcttgggctatgagattcttgatgatgacgaagaagaacacgtcttactcatcttgtgactccagcgcagagcatcaggtctggaaagtagcagctgcctaatgaatgaatgaatgagtacaacggcaccaagttctttccactgcctagggcaacatggaacagcaactcagcgatattacatttggtttaatcatacttgacaacgaacctgaacaattagagccctaggattcagactggcatgcaagttacctgctggcaagatttaccagtcatgctgacaactgccaaattgcttttactttgtccgatactgacataaaatgcctttgcttcctgcattgatgcattgcaatggttcatttggcatcatattcagaggggcccagatatactgttaccaccatt

SEQ ID NO: 44959 - DNA, 1742 bp, Bovine  19866880373662
atgtgctgtacagtaggtccttgttgttcatctcttttataaaaagtagtttgtatatgttaattcctcatatcacacacacacacacacacacacatcccattactatcccctctgataaacataagtttgttttctatgtttgtgagtctatttctgttttggaaataagttcatttgtaatatttttttcaatttcacatgtaagtgataccatatgatgtttgtcttcagcatacttcacttaatagataatctctaggtccatccatggtgctgtaaaaggcattatttcatttgtttttatggctgagtaatattccattgtatatatacatatatatacaccaaatactttttatccattcttctgccagtggacatttaggttgcttccatgtcttggcaattgcaaatggtgctgcagtgaacatcggggtgcatatatccagatgaattgtggttttctccagatatatgtccaggaaaggaattgctgggtcatatggtaactctatttttactttttcaaggcacctccatatcactctccagactaattttgttctctacccagtcttcttcatgcagtaacaacccagtgctatatgggaatctaaattgttggagcttggtaggagataccccacccaaaggagattgtgcatgtgtgcgtacgtgtgtgtgtgtgtgtcattgtgaagagagagaggggaatttttgccatcctagattttctggaaatgccatgatctgtttcgtcctcatcttaaataaactgaattacaagctggaaatatgtcagttccttgagaaaggagatgtacaaggtacattccattcccagatcaaattaaacaatttgctgcaaagagatccactttcacacaaaccaaagctcatctgagcttccctgcaataagcaaggactgtaggcaggaaaagctacattttccaaatgcccagtccctcctctgaatcatgttcattttccctaaatattttgcccattcttacagttgaaggattattaaactgatgttttctcctgtttcctttttctccctcactctacttttctaaatcacaaaggagaaatatattctcacaggtcagagaaattaggcaacctgaagaaaattcttttgactttggaagctatgccatgggcagaagaattctaaagaattttcaccagagttggattcacatgtggctagagttgagtgctccagctggcttcacttgccttcactctgggtttctcacatttgagtggccactggaatgtaggagacttctccctacatgtttgaaaaccaggtcttctgagagccgggtgacttacaggactgctttacacagctgcactgggacatgcaaaactccttagccatgtgtgattggctccatcattttagtacttttgatggtttttaaatctatgttcaaatatctttccaacctaccagtttctaaaattgaaaatttcagcattagagactcaattatactcaacaaatcatgtacatacattttacatcctcaacacctgaaatcttccctgctggactatgaccaatctgaagaacgagagcatggttttcacctctgtatcaccagagcttagcccagctactggtacatggctgctgtttagttgctcaatcgtgtccaactctttttgcgaccccatggactgtagcccaccaggttcctccatctatggaattttccaggca

SEQ ID NO: 44960 - DNA, 1564 bp, Bovine  19866880566421
aactcatttaatcctcacaacaaaccctgtaattatctctgtgttagagataagaaaggctgaggaaagttgagcagctggcttttctgagtggtgggcctgtctttgaacccagacagcctggattctaaacccatgcttttaatcactgagctgtacaagaaaaatacattcattcgcatttataccctatctcttgatctgtttgaaaatagatatgaaaaaaatttgtttttattccattgccaagtggggagattttcctatattttacatcctaagctataatgttaggccaagcacaggactgatgttggcagtcagcttggtatatagagttgttggatgcacactgcagagaacatccttgggaagggatctactgattaaagatgaaatgaggctaatgtactgctcttgggaaaagattagatgtgctcacaatgaaagagcagacatgaccataattaatgaagtaataatcactttggggcttaagcaagacctgattctttgattacaagtgtttccatttgaagtgagctggaagaaccctctggtctgccgtaaatatcagtaaaactgtttcatcttagggttgcagttatgcttaatcaatttatctgtcatttccaaagagcttctgaggttttttttctttccgtctttgtgctttcaattggttttcatcagaggcaagatgctgattcagcttctagtctgaatttattcagctggtgcaaagattcagtgacagggttacatttacatttttatcactgtctcttaaacctgaataatttatcatgttctttccagcccctcacccccatcgttttacagaaccagagtgaaattcttgcttttgtaatcaagcttagtttggatatgccggccatttctcatagacttctgacactcttttctgtgaactttgggggggaaattttttcctactgactgattcattttagatttgtcagagagttctttgtatgcgttgcctttcaaagtatgtggattctgcaataaattaactggctactaaattaaagacttctggctaagaatctgatatgttctttataaatgcattttttaatgaaaagatcaaaaggtgacagtgaactccagggtgataatcttacagacttctttcattcaggcttttttcttggacagtttcactgttcaaaagtagaatgatagtcctgatgtaatcaacaaattctgatcatggacattatgtgcatgtaaatacacatacatgctatatactggtgtcttagatctgaatgaaataactttatctttttgtcagttaagaaataagaatgaataaacacaagttcatgcatacacacaactcaagtcaagactttttagtatttgacttagaaacacacgactgtttcctcaaactaaagtatcactatataatttgtcattttatgaaaaaattcacataaggttcattaaaaagcaagctcttttgtatatttacaatgattattttttaactataaatttatttattttaatggaggttaattactttacagta

SEQ ID NO: 44961 - DNA, 1026 bp, Bovine  19866880603513
attttattcttgtttgaaatgttaaacaagtcccgaaaggaatagctgcggaggcaactcgtggcgtctccagagagcagttgcaccgccagcattttctgcaggggctctagtgggggctgcctctcccctgtatgtttgcccccatctctggagaagcccccaggcacccctgctgggaatccagggctccctcatctgacccatatccatgaggctcatcctcctccccctcaacagagaccttctcatctatagggtctctctgcaggctgatagaatgattaacattctaacgacagcatcagcaacacccggaatgatgggtaatatccactgctgtgctgtgctcagtcctgtccaactctttgtgaccccgtggactatatagcctgctaggctccactctccgtgggattagcccagcaagaatactggagcaggttgccatttccttctccaggggatcttctccacccagggatcaaacccacatctctttgaatcacctgcatggcaggcgaattctttatcactagcaccatacctggtgtatgagtacttactcatttcaaggagctgctgaagataaagaggaagaacatgttttgacatatttcaccctcagcacaggtctgtctggtaggtgacattattattcccattttccagaagaggagcctgaggcacagagaattaagagacctgattataagaaagcaagccagtcaggcacctcaagcacaaaatttaagggattcacaaacaaattcagtaatcaagatgcacagtattgtaatgaaatactttaaaatctgtactaatgagaaaaatccacggtgaacaaaatatcaaactttaaaataaagacaggaccagttgattccagtccagtccagtgagtgtggctgcagctctccaccctgtactgttcagccgtcatttagggctcaggatgtgccaagccagggtgtttgttttttgccgaagttatctctgattcattctcatagcctggtgtggtgg

SEQ ID NO: 44962 - DNA, 1112 bp, Bovine  19866880658785
tattgtgtagactatttgcacaacaccagtccttactaaaattaaaagaacaatgaataattgctttgcctacttttaaccctgaagataattctggctaagtagcctcaaaattagcccaggtatttatttggttgtcctcctcatcggctatttttttgtcttgatttatttctggtttccacttggttttgtttggcttagtttgatgctggtgttcaagtttgcaaagcccacttccctgcatcctctctgtttccatgtgaaatctgtcttgttgaagcccatctgagcggccagtgcagccctgagtcctgtcttctagagctcacagtatctttcttctcttaggaaagttaagtgttaacattgccctgaccgcatttgcctttcaggaagattaatgaagttcagcctgcagaagataagcttgtctgggaagagtaggcaagagctaagctgtgtcaacacggcctaagggcaggagagaaccagattgattacttaggttatcttcactctcctcctccctcccccatccatttataattctaatacaatttgatgtctgtataaatgtgaagaaagataaagaagcaagcttatggaacagctgcttacagtcctagtctttaccaggtgctaaacgcactagaaatacagcaaaatggataaaattgagttctcggggatagcactccttaaatttgtggaggattgggggagaggatgtaggggcaaacagacaatatgagacccccctcaaggggtctgcttgagtgctaatgattattaaaaaattacttccaaggaggataaatctgttcatgtggttaatttttctaaaacaaaataaagcaaattgttttgcaaggggagaggcagagggaattcgctgaggattatcctcctccaacctttctccaggtagcaatgactttcacctttaaaggagagggctgcagtacttggctgtctgggatatttgcatagaattgtattccagcgtctttcctgtatgggagccttttttggctttaaagtagatgggggaagctttaagaccttctatatagtaaggcctctgcaaagctagaaaccaagcagaatcc

SEQ ID NO: 44963 - DNA, 973 bp, Bovine  19866880767649
tgcatagtaagagagtgtttgcaaacgtaggtggagctgagactctcttagaagcccgacaaaattactttttggcttgagtgagcttgcaaacctcttcttgaggctaagcagtgctatttcatgcttctaccgcaagcattttctccctgaaaaatcaatgatgcaagaaagcaattgctgatgggaggggtgggggggggtctctgagctaatccttgaggttgagacagaaacgcggctgctgctgcggattcagcctggggagatcaaggggaagcgtgactgctctgtttggagaggcctctcttcagttggcaccatcctgagcactcaagttttctgtcaataagcactctacgggggagataaatgcatttggaactggagatgggagcagggtgtctgggaaagaataaacacattatctgagcccctccaccaagttccttcactgaaatgctcaaggactcagaccacgtgtttggcagaggctggcgggaaggagagagattctctctactcttgtgggtgaagtaagccgcaaagatctgacctaataatactagacaaaatttgaagaccagacctctgtagcttgcttcatctacaggggtgccaggtactatgctgtgggattattaaatgactacttcactgccatgttggcagcaagactagaaacaactggcttgttacaaagacaggacatgagtattggttctactggggtaggtgacaatattctgcaaacgtggaaggtgaactcaaatccctggacagttttgccatgtattctatgatggcatcccttcctgacacagttttaaatccaaaaagagtccttcctaaggaattatttggggcaatggtaaatctaggcataaacagctctcaagataataagtcgttcgctaaggcctttgttttgttaaacatggactcctcacagagtacaggtcaaggaaacagg

SEQ ID NO: 44964 - DNA, 1297 bp, Bovine  19866880776847
aatgatatgtattggagagaagaaaggaaacagcatgtacaattttttttttttttttaaatcacacgtgcagagagtggaaaataaaagaaaccaaccaacccaactcgaagtcagttctaaaggagggtgatgtgaacttgagctctggaactggagccaggacaggaagtgggcttggcctacatgaggggcatatgccacatggaaaaccaccctgggcccaggcttcccatcttcctaattcccttcagcctccagcccctcctgaccctgggaacaatgcagctctgtgctgaaggctttccagccccagcagccgagactgtgccttttgtgatggcctgggagaggaagaatggagaagctggtttggacgtctgcgcgtgtgaatcactcacgtcacatggccgggccggctgtagcaactccctggggccaccccagggcacacggggagcatggcctgagcccacgcctggaggctgccgagccagctgcagggtgccctgctctgaaccgaataaccagggagaggatggagaatgggctgggggtgggggcaggtctggctaagcaaggccactgatgacatcggtgccactgtgtgggctctgggcccccggatctctccctccaattcccaggtcactttcaggtctatgtctgatgattttgagtcactgaaggtctggttcatccctgcagcctgcagggctggttccttgattcaggcaggtcaggactccctccacagggggactttctccatggactggagtaggtccggagtatggagaaaccaccgcactctgcagcagagaggacaccgtgagtcaggggctgctctgtttcccagaactgtctggattctggcttcaaaatgagaaacgcccaggcctcctgcctgctggctcctcagagtgctgatgggagaatgctgagcatcaggatgggtggaaaactcaggccagctgaacagattgctgagggttaggtagggtaggtctctgtccctgcttcaacttggagggggcttgcttgcgctgcatggaggcaggggaatggattccatgaccctgcacggtatcaattgatttcgcctgccccagcccagcctgggtacctctccctggtgccctgcagagggcagtgtggtaccgcaggcaggactctgctgcctcatcaacttttctttccactccactgccctcctaatcttttcaaatcaaagctgcttagacacacacaacctgagccctgcttgcatgacatatttagcctggtgtattgggct

SEQ ID NO: 44965 - DNA, 719 bp, Bovine  19866880861089
tgaggctgagaactgtgtggggagggactggaggtggaagtgttagcagggacccccaccagcatttccatgtcctctgctactcaagcagagagagggctagctgctgggcaggagacctgtggaagccccaccatctctctccttcttctcagctcccctggtgggctcagccacccagtcggagaggcacagctggatatgaggaaaagtaggtgaagctttgtagacaaagcattttgcagtgaccccagtgtgtcccctaatctctcagtaagacttagggagcaagaaaatgccatctagtactcaagggaactcccaggtcatgactataggatctaatgacacgtggtcagtgacgatgtgcaaactgaggccgagggaatggaactggcttacctaaggtcactctggcctctcgccttccagcccagggcttctcttcctacaatgtgaggctgtgtgcttgtggaatgtcctctctggagattggaggtggagtcatgttggctcctggtctcagttttgacctagagactttcacgccactttgaaatacagtttatttggctttctgtaaggtaaattacagccagatccttttctcgctctcttccagtgctccagccatctgctcatccaccctgaaactcagaaaagaaaaaaataaatgctgtggatccaggaaaatttcatgaagacaaaaccagccccaa

SEQ ID NO: 44966 - DNA, 857 bp, Bovine  19866880920847
ccatctctggaatattattcttcccctctttctgccaagccacactctccacagggcatgaacatttaactctacttttggcttttccagaaatcttcccaaatcttctgttttcctcatccttcctcatctcttccacaccacccacggccccccgtcaacatctggcttttactcaccatgtgtctaattatgcgagtaaatttgtttccttttgcattttcccaacctgcctgtattttcctaccctgtctccctctaccatgggatggaatactactccccctggatagagtcatggttttcccttcttaagtaaatcccaagtgcctaagctgagctcagcccacagtaaattctccagtaacacagtttaatggactccctggttgaagggggggaaaaaaaacccaccaaagtgcctttctgcatctcttcaaatgcaaatgcttgatttgcattaagtttctgggcacaggaacttctgcaaaatttgcagcatttactgtccggtccccactcctctaacgcttgtgctttatcgcagaaccaaattaggagtggcttaaaggtagtggtcagaacacaatgtttcctactgctcactgaaacatgcacagtatgggcacctcgtaattgctgaagaagtccttgctgcacgaagtggaattttcctaaaatgaatactttgtgccttaggactgcactttcatgataaaacaatcaggagatttggctgaattttccactatttaactcgctatgttgaggtcatgtagaaacaacctttaagaacacaatgacctttaaaaaaatccatctctgaagtcaggctttgtcactagtctaggacagat

SEQ ID NO: 44967 - DNA, 1324 bp, Bovine  19866880962082
ttctgggagatgttctccaaatggacacggtctccaattttctttccctaataacagtgcgggaaataggggtgagggagacagagagagggagaaaccccaaacctcagaaaaggatgaaaacatttctaaactctatttcaacaatgacaaaatcaaattcgccaagtcacagtacatggccctctgctcttccaatctggtcccctcctctgggcaggctatggataaagagacactttgggaaagtcataggtgtccgctctgttttcatggcatcaaggatatttggaaatttgcttcccagagagtctaaaattcatcaacatggcttcagtggcaacacggccaagtggctggtggtgggctcctggaatgctgtccaccaaaaattatttttcggctcctaaaggacacgggccatggctcaaaacagaacaaagaaaagaatttcttttcccaattcttttctctcctccacctgacaaatgcatcagccccagtccccaagtccattctttttcatggccatgaaagaagtgtagagattgagtgtgcctattttaaaggtcttcagagctgccttgctttaggatttgggatgaaaagatgaggatatgtccatgtgtacctgaggatatgagcctaagcgtgtccatacttttacacgtgtgcataggagcatacattcgtgtctacaagagtgcctgtcatgtgtgagtgtggatttgggtcaataaatgtatccagaatatgcgaacttggtacaaatgcccatgtgagcccataagtgggcatttgctggtggcatgtgagtgaagcaattgtgcatgtgtgtgcatgtgagtacacgcaagtatgtacacaccccatagatatttcccctgacatgcctgtaggtctgtgttccgggtgggagtgcctgtgggtatgtgctagtgcacgccagcctgtgaaaaagtgtgcctgtgtgtgtgcacgtgtccttcacacaagcagggcccctcatccccctcatctcctctccccttcccgcaaacccacagcagactttgcctgccttcttggggatctgccagctgatggcaagggtccctctcctgggaaacagcactcctcgcccgttcatttgtgtcccataagggctccgggctccaggctcccgcccttaaatggcagcccaggctcacaacggacgactttcttaattgcccatgatgcttgcgggtgcagcacaaacacaacagtagctattaggctgggcgcactggagcagggctgcattttgcgcctgtgtgaatttagtgttcctgggagttgagag

SEQ ID NO: 44968 - DNA, 1238 bp, Bovine  19866880983850
tcagtatcaaaataggcctcatgttaggtaagaatcgttctctcaaagtatggagataaatataattttaaacaataagatattactactttctacttttaaaaaatcaaaagtattaattttgcttgaatataaaataagaaaaaggctattatgaaacttaagaaattgctgaatagcagaacaatgtttcttttccacatgagactttaattcataaaagaaccccttttgtttagggaggtgggaaaaaaggagttgctaaatgttatgatatgagaatcactatctgttaaaactcttatttattttagactctgtcttttcaggctagagcttgtattttacatgtgttttaagctatgttctttaaaagtaaaatcaggactcaccaagtgtttgaactattattcacatttctgctttgaaacttttgcattgtgcttgctgtctaagtagcactaaaactcccctggcacagctacacagtaagagaaaagggtaagaaagagactaaaaggatcagatctctggagaaaacccagtggaaggaaggtagtctggctttctgcctaattccctgtttcttttagcaataataacttgctttagccaggcttctagaaaattagtctcctcaccaaaatctgtccagtaccttgtgacttttaaaatattaacccttattttattggcatttatttatgtgtgtactaagtctcttcagtggtgtccgactctgtggaccccatagacggcagcccaccaggcttccctgtccctgggattccccaggcaagaacactggagtgcgttgccatttccttctccaatgcatgaaagtgaaaagtgaaagtgaagttgctcagtcgtgtccaactcttagcgaccccatggactgcagcctaccaggctcctccgtccatgggattttccaggcaaaagtactggagtggggtgccatgtttgaataaaattacctaaaaccagaaggaggtaggtgtcagggtgagtaactgtaatgattaaaaagcattcagggaaatggaggtgggggatagttagggagtttgagactgacatgtacatgctatatttagaatggataaccagctgggacctgctgtgtagtttcctacagggaactctgctcaatgttatgtggcagcctggatgggagagggttttgggggaggtgaatacatgcatgtgtacagctgagtgctctgctgtccacc

SEQ ID NO: 44969 - DNA, 1548 bp, Bovine  19866880989729
aattgattttattttgcatctttatctaagttgttagatttaacttcaaacttgctttcatatatcaagtacagtaggagaaacaaatatggatacaggtctcttcattctatttgaaggagttgttacagtgaccccgaaaccaggagatggaatatttccacagtgaagtattttccattacgtattttatctagatgggaatttatgtggtgtggattcaggggatattattaagacaactgatgatggatggaaggaaggaactgacgagctgtgtgtaaagattcctgtgcttccgaatgctctgccctagggaggataatggttatctattctccttgtccactgggaatgagcaagggaatactggttaataacatggctgaggagatctaggatacacaatgaatttcataactgacaagttccttggacactggaaccactgaccaagtgctctgtgagtggggtgaaatgcccttctccaggggccatcaaatgcatctgtccagcagaatataagtgcagtgctacccagagagagatgaatggacagttgatggctggattcttgctttccagtctggcaatatttattttaaatcccattccagtcctgagaagtaaatgtagatattccaccataattttgaagatgtcctcttttcatttctttcttttaaaaaaagagagaagagtgaagggaacttttatggaagaaagctgtgatttctttacagaaaagggcatgtggctcatacttcagttatttacatgaacaccatgtatttaaagacacaaaaattcaccttggaaatgaacaacgatcacagttttttcccttcacataatgtgtgtgatgtgggtagttttgaattttatctgaatgaattttaataataactaaagaaaacagactttaatcagaattatagactggactggcttgaaaacaccttgaaaattatctggtggataaggaagctgagtcacagagggtggaataaactgaggtcacaagaatgattcaaagttggtgggaaggcattaaaaaaatcttgactttttacccagagtgaggaagagtagcaagaaatctagtctcataggaggagaattaaactgttgccttaaagaaccaaacgggagaaatggtccagtggatagcagtgatttccagtggatagcaatgatttgcagaaactgtgacatagcttcccagagattcaagatagagaaaaagtaataaaagcaattgaatcatgtgtcatttacaattggaggtgtcctttaaaaattatttttggcttagcatggcaagagtttatttttttaattggggtaaagttgctttacaatgttgtgttagtttctgctgtgcaacgaagtgaatcaactctttgtatgcatatataccctttcttatatatatctacccttccgttccaccttcccctcacctctcagcccctaggtatcacagagcactgagctgagctccctgtgctatacagcaggttcccactagctatttattttacacat

SEQ ID NO: 44970 - DNA, 1015 bp, Bovine  19866881025382
atctacatggacttcaattttactttcctcgtagtgaagagagccaaccatgtttaggatctactgaagacttggtgccattcttcaaggaaattttcccccaaactgaaataacccacaggacaatggtgctgctatgtttgatcctacgcgtgattccactgccttcaggatgtgcattctgggctgctcttctgttcaagggtttggaactgagctgattcatccacaccttattctcccctccccacagagaccataacagcatgccatgtgcgttacaagatgtctggccagaatttagagcatggactgcagccacagaacagagcaaaactgaatgaccacacacagggtctgagtctctgaccacggcccctttgctctgcctaaaaaccaacccagctaaatgaaagcttcctttctgccttgtgcacgtcaaacgtgttccaaaggaaggttctcaccactcactcccaagctgctgccgcggaaagaattcttcacttcttgcacaaccccttgcttaaagagcgcagccaaattaaccacagcctgatggactgctaatggtaactttgtgcttcagagctaaagacaaagctccggtggcgacaggggctccatcaagcaccagggtcaagcaaaaaccaattcactcagaagagaaaacggttgtaaatgctgagctaagccgcttgccggttggcattctctgctacctcgcaatcggtgtcctgcctctccttggcttttcctttaaaactcatgaacaatgttttccagtattggttgcccctggttcttcaccatgtccctggctggctgccttctgtccaggtgtgagaggactttgcattttgggagtctccgcactgtggtagagaagataggctgagaacaactacatatgcatattcagcctctcccagttgctgggcaaccctaagcagttcattcaatccctgttagcctcaacttcctcccctgtaggagtacttgcctcataaattta

SEQ ID NO: 44971 - DNA, 980 bp, Bovine  19866881077881
ttagtcattccggtcactctggagtctgaaaatccctcacatgagccccgtcctggtccctcctttgccacatcatcagaattcaataagtccatactcagttcaaattcaaaaatctttttttttcctttttttcaatatcctgaattattttctagatcaggggtccccaacctccaagatctcatgcctgatgatgctaaggtggaactgatataaaaataataggaataaagagcacaatgaatgtaaagtgcttgaatcatccagaaaccattcctcctgacatcagttcatgggaaaactgttttccatgaaattggcacctggtgccaaaggttggggaccgctgttctagaccacagggggcagtcattacccaggtcttccaaggatgatctgaaaatatcgggacagggacttaaactaaacacgagaaagaacttgctgatgcatttggcacagctcagacagctctgatcaatctctgagctggcattcagcagattgttaccatagctgtgctaggacagagaggctattgaaattctgaaggtatatctggtcctctctgggactcaactgaatcttaaagaatgacctcactatcctgtggactccccacatgggtgtaaaggcattaaaacatgtacggggagaatcagtgtattcctccaacagagcaggacttctcagggatggccactgtaatcgctaccgccaccaatgcctcgtgaggaactttcgggaaacggcatagtgctcctcctgtaaatgagaattcttggctccctgggattcacagtcaaaaacacacacagtggaaaactctaattcaaaaggatacatgcaccccagtgttcatagtggcactgtttacaatagccaagacatcggagcaacctaaatgtccactgacggacaaatggataaataaaaggtaatgtgtgccttgtacatatatatttatatatatatga

SEQ ID NO: 44972 - DNA, 2041 bp, Bovine  19866881082330
agctgtttatgtttctgtgggcaattggaactcagacctgttgaagatcctctgaacagctatgtctcataattgtctgaaactgcaaaagagaagtatttatcccccagctctggtcccctgctgctcatgtttgccccatagtattcaccccccagcacttcagatttcctgccgacactgcagcaggaagcctagggcagaaggcaggagagaagtgatgtagctggggtgaagcatggccaggccatacccacacacactgtgctaaagcaatggccagaggagaaatacagattgagaggatgtgagctggagataaaagatggacaacacgaatggttagatgaatatgcatgtttatttctagctacgtcttatttccccttcacagtcccactttccctcacttttcccaaagtcaaaaatgccttgggtgagggggataaacttagaattgggggttaacagatatacattactctgttattattgttcagtcactaagttgtgtctgactctttgcgacctcatggactgcaggcacgcccagctttcctgtccttcgctatctcccagagcttgttcaaactcatgtccattgagtcggtgatgccatccaaccatctcatcctctttcatcctgttatcctcctgccttcaatctttcccagcattaaggtcttttccaatgagtcagctcttagcatcaggtggccaaagtattggagcttcagcttcagcatcagtccttccagtgaatattcaaggttgatttcctttagtattgactggtttgatctccttgctgtccaagggactctcgagagtcttctccagcactacaatttgaaagtaccagttctttggtgttcagccttctttaaggttcaactttcacatttggacatgaatactggaaacaccatagctttgactatacatacaatagataaacaacaaggacctactatatatcacagaaaactatattcaatatcttgtaatagcctatagtagaaaataatgtgaaaaaggaatatgtatatatggtcaatcaactatacttcaataaaaaaattaaaaatgaaattaaatgaacatgtctttcctattctaccctgtgccagttaagctctgtccttacatgaccaccgatgtctgatgctgttggcatcgggggctatatttcaggtggcaggagtcacatctgtctttgtcctctggtgtggcagccaccatgactctgatggatgatatttttcaacaaaagctttgttctggggatatggaggaggtgactgtgaccccgactgggcgtactcatctgcaggcaatcctttttgacactgcttcttccattctgatgtgtatatataaacaagcttctctctgcagcatcattttctaccagtcatccctgaaaaagtgcttggagggaggacactcaccaccgtttgttgatctcaattttccagactctccctgtccctgggaccacaaatagtagacttgtctgtacgaagtgccttataggaatcaaagctcttacacaatgcagaggttctcagggaagtgttgatgggaatagtagtagccttcttttctccacttgtagtcatatgtacacagaaggtgccaaataaatatttgattagaaactgaaaaaatgaaatcatccatctccactctcacaggaaaaatgttgatcagattataaacattttaaaggcaaggatgactaatgggatttttaggggtggagaatttgagagtttctgaccaagttctcaaagggtagtgcttggaccagcagcatcagcatcagtagaaaggtttagaaatgcaaaatcttaggttccatccagatttactacctcagtgactctgtggggaggactcggtaatctgagctttaacaaaccctctcagtggtcctgatatatgttaatgtttgagaaccacaggtctaaaagtattctggacccctttagttttttgttttttgttttttttgtagatgaggaaattgaaggcaaaa

SEQ ID NO: 44973 - DNA, 749 bp, Bovine  19866881143346
cttccctctccttggcccccccaccccacccccgttgcccttctttttttcccttgaatttcagcttccaatgaggtcagatcccaaagcccaaataagtgaagtcgggttcacgtcttctcagatgaataattccagctcacccaagcacacagtgttcacacataatgattgcacattaggtttgctgcctgctgggctgacttctctctccctctccctctcttttcaaatcaagggctggagatagaagagaaagtttgaaccatattcaaaacacagagtgaaaaagactgatttcaaaagaaagaggagaaaataggagaccgagccatcttttcttttccttttttttctccctaggcttctttattattaaacggcctttacttcaacctctggtattttgcttcatcaaactctgttgggagaaaaaataaaataaaagcatagaccttttcacaactgtgtaaccttatagtgatgagttcatatttatcattcatgtcttctgtggataaggggaaacaaaaattgacacaaagaaagtgctcacctagcttcattcctaaatttagacctcactgtatccatcagtgttcaaccaaaagtaatgaaagtcatacctgagtatctaaaacagggattttgggaccaggaattagttagccaggacatggaagaagagctaacagtcagacaagggataatgaggcagatcagaaggtaataacagcaagatgcagctg

SEQ ID NO: 44974 - DNA, 940 bp, Bovine  19866881205750
ttgaaaggcatgtctgtttttaaaacttaaatcaaattaaaaactcagtcctcagttttgttcaccacatttcaagtgctgaatagtcacatggctcatgctaacatactgggcagccttaggtagagtcctaggattatctctgagttgtttgaccacctacccacttcctttggagaatatttagttctttagtccaaagcatcaaagtattctagcatagagacactagcacttggagaaaggtcataaaagaaagaaagaaggatcagtttcattgtggtgggggtaaggatgggagctactgaaaaagaaagagtgagggtggcatggcctgtggattatcagggagaagtgaaagatcaccatctctttacctccaaaaaagttattgtcccatcatcagaataattttaaaaagatataaaatatttgacaaatataaaattcccaaagccccaggttcctgtgattaacttatatatcctttacctgtaggcaatatacatcaacatgatatgtttctactttcaagaaattacatctaaaaacacctatcttcaaaaagaaaaacaatctttaaaactctaaagggaccttacaatgtgatcaactacatggtttccttaaatatccaacctccctctcatatttagactgtgattatattaatgggggaaaaaatggtggcgcccaacttttgaagaacatacccacaacagagagcagagaacacctgttgttgatcttgtcttttgaatcttaatttcaaaagttgttttcttagctaaatctttgcttacagaatggtcccacccaatgttcttgggtttaagactttggacatgtggatgattacttaaaagcatcctgccttgggcctaagtgtctgaacaattaccctaactctgccctctaggcccatttcaacattattaag

SEQ ID NO: 44975 - DNA, 883 bp, Bovine  19866881291930
tgttcttggcaaccaaagctataaatgtacaaaactttatctctggcaagaatgttttaagaaaaagaaagacaggaaatgtctatagcagaaccccagccactggttaacttgactgatctctctggagccacatcaaaggcccagttctgtctgctccctgtggcctccatgagtcctgccctaggagttcagcagtttcttggagccaaggagggaagaaagcatatccactgtaagtgctccccttgtcaagacaggggtgacctggggctgcagggaaactggtctccctctccctagtctcctttccaggacacttcttcaccatccagataagatacaagtgcatccatgtggctgaagcctgatggatttcataataggagcattgaactggaggtcaggaagctaaacctatagtctgcaacaaataaagagttgctgagcacggagaaggttgattccttccctaagttcgtttccttataaaatgagcaggtcgaagatgaattgatagcactctttgtgattccctccggtgactacagaaaagcaggatcagcttttaaatttcaggaaaaaaaagaaatctctttttcaagggaatttcattcagaatgagaggcaaatcccaccccttccataagttacttctaactgaccacactgatgaatgagaccagctgggatcaaaaggaaacagaaactagattccctagggctgattgaggaggtttgtctcacccttaatgccatcttcctagagtctataaaaagaatcaatctgtctttaatttcctagaggtttcatcccagacattttgttcttcctttctctctcatccttgggaacagttcattgtaaataaagtacctaaag

SEQ ID NO: 44976 - DNA, 973 bp, Bovine  19866881341069
aaaataatgagaccaaggttcaaagaagtaatttaaaccaaatacggcagtggaaggctgagccagcaaggggcaggctctctctgcagggagcagggagcagcaggtttggagctgagcagagttcagtttaggacattccttgggtcagaaatgagaaaggagctcatctgatggcctggagctcccactgcccaggtcagtgaaaggggtgggactagatggtgttctagagcctacccggtagcaaggagactgggtcgtggtctctgcacccaccattggcaagactgcttgagtttgcaaggcttgtcctatctgggtgggctgcccttgcaagagagagcccctgagaccaggcaaatgaaggagaccttgcctgtttggagccaaactttttttaggcactattttacacttcatttcatcaaagaattacagggacactagtatggcagtccactccagtactcttgcctgggaaatcccatggatggaggatcctggtgggctgcagtccatggggttgctaagagttggacactactgagtgacttcactttcactttcatgcattggagaaggaaatggcaacccactccagtgttcttgcctggagaatcccggggacgggggagcctggtgggctgccgtctatggggtcacacagagtcaaacacaaccgaagtgacttatcagcagggatggtggatactaagctcattaactgcctgattaattttggatttggactcttgctgatcctacattctaggtaattgagtgagtgaaagagtgaaagtcgctcagttgtgtctgactctttgcgactccatggactatacagtccaaggaattctccaggccagaatactggagtgggtagccttttccttctctaagggatctttccaacccagggatcaaagccaggtctccttcactgcaggcagattatttatcagctagccac

SEQ ID NO: 44977 - DNA, 1059 bp, Bovine  19866882017059
aatccccttgaaacaagaactctggcttctgttcccaatctattttaaaggcacagcaactggcacagtcaccaccacaggcaatggcaccatcattgaacagattgcttcactggcttctggaattggcaatgggaagacactcattgccactaagactgagcactttgtgtgcactgtggcaaaagtggccacttcaccagcatccttttctttcttttttcttttgaatttaattggaggctaattactttacaatattgtaagtggttttgccatacattgacatgaattaaccatgggtgtacatgtgttccacatttctgaacccccctcccacctccctccccatcccacccctctgggtcatcccagtgcaccagccctgagcaccctgtctcatgcatcaaacctggactggcgatgtgtttcacatatgataatatacatgtttcaatgctattctcccagattatcccaccctcgctgtctcccacaaaatacaaaagactgttctatacatctgtgtctcttttgctgtcttgcatacagggttatcattaccatctttctaaattccatatatatacattagtatactgtattggtgtttttctttctggcttacttaactctatataataggctccaatttcatccacctcattagaactgattcaaatgtattctttttaatggcagagtaatagtccattgtgtatatgtaccacagcttttttatccatttgtctgtggatggacatctaggttgcttccatgtcctggctattataaacagtgctgtgatggatattggggtacacatgtctcttcgtgtcaattctggtttcctccgtgtgtatgcccagcagtgggattgctgggtcatatggcagttctacttcttaattgtgtttagacctggcgactgtctggccacggcctccggggcggcctctaggcgtgggctgagcgggggcagcagggggcccgggattgcaccggccaccaccgcccacctggccatggccgtccccaggggagttcggggagcatggg

SEQ ID NO: 44978 - DNA, 998 bp, Bovine  19866882105379
acttcagtagtgttcaactctctgcaccttcatggactgtagcccaccaggcttctctgtccatgggattctccaggcaagaagactggaatgggttgccataccctcctccagggatctctttcccaacccagggatcgaactcacatatcttgcatctcctgcatgggcaggatggctctttaccactagcgccacctggatctgacaagccatggcaaaaccagaccaaagtgttttctgcagccattttagaaaagagagtgaaagcagagagcagagggagctcagaaacaccccttttgcagggtgttttgttttgttcccgataatcttacttatctgcggcacaaaatcttggattagtgtttcacttaggctgagattggtgtttcactgtcctgggctggcggacatgtacgactttgcatggctatccaagttttccccatccaactttgtcaggggctcactttctgtctagtggaagctattctcagcccacagaagcttgagatttttcagaggcgcctgtagatggacttgcctcttttctgctatactcattcgaagccacggcaaccttctctgggccaaaaccacttactaattaatacatttcacagagtgaatggagcgctggcaccactgccaggcctggggcagctcccaaagccacgggccttgcccagtgcccagaaagagccctggctggaggcagtcagtgccagttttcctctaagccagcatctcagccttctcacttgaactcagaatgcatcgctgccagcgtcccccagggcccccagctgtgtcatcctctccttcacctgcttccatgtccaaggaagcaaggtcacggtactatggcacctgatctatttttcatcctccccttctctgggcagaatgatagattgactctggaaaacccattagggaagggctgggctgtcctgcatttccgtcaggcctgtccagggactttagtcaagcca

SEQ ID NO: 44979 - DNA, 4719 bp, Bovine  19866880485429
ctgcttctttttaagagaggacaataatacgtatctggtgacacactgaagagacacgatatttgaaagttgctgattgagtgctactttgcacttctttccctgtcctagacccaatttgcaaccacagggcatacacaccactcactgctaccacagccccacgccacagccggggccccagcctggcagaatatcagcagttgccatgcttaagtcagagaagttaggggactgtgatctcttgtgcctgaagggtgagggctctggagcgctaggtacccagcctctgactgtcattccaaagccctttgattcttggacagattatgtagcttatgtctgagaccttcctggggactagcagtgacacacaagtctccagttgattctgatgagaaaaccagagtggtccaaccaggatgccgtagcctctactcttcggggcaagcgtctccatcttcccccacctaattatccgtggagctggaatagacagtcctcacagtaaggagtctttacttggggatcacactaaaacaaaaataaaaagaacaagggattcatgtctgtttcatgtgaaatgaatcactgctcagtgataaccagtcactttgaggtggatgcagctatgattacatttgggcaaacgtgatttagaacttccctgatggggacttccctggtggtccagtggttaagaatctgccttccagggcaggggacttgggttctgtccctgctcagggaactaagatcccacaagtcacgtggcaactaagcccaagagcctcaactagagagaagcccgatggccacaatgaggagcccatgcactgtaacaaagacccgacatagccaaaaataataaatgtaaaagaacttctgtgaaacagacctgtgccttcaatcagaggtggcccaaacgacaacactgcaaactctttccatctacagtggctcaggacatgacgtgtgtgatgttaagttgctgcagtcatgtctgactctttgtgaccccatggactgtagcccaccaggttcctctgtccatgggattctccaggcaataatactgaagtgggttgccatgccctccttcaggggatcttcccaacccagggattgaatccgtatctcctgtgtcttctgtgttggcaggcaggatctttatgactagtgccacctgggccatagcaaacaaccttgaattctgttaagcttctgtttatctaccatgcctacactttgaggccaaaatctaaatccaaaccgtttcaggtgattggcattgctgtgtcgtacttttccaaaggaggatgattaatttctcaaaatccatcagtgctgattcctttgttagcaacagcagtctgggtcaatacttaaaactggcatgggaaagatgctttcaaatccagctctgtgctttgtggtggttctataccagctcccgtgtgaagaatcattacaaatgtatgcatttctctcatgctgaggcagcattttatactccaggggactattctggaggaaggtggttggttaaagacagacaaagtagaaaggagagacattttaacaacatttttatattgttttggtctcaacatgtagccttagtatttttttttgtccacagagcattttagcaatgagtatcttttggtgtgctaaaaagtggtatgctaattaaattatgcatacattataaatcacactaatataacaacatgattttggagtttagtgagatctcaaaagatcctccatcaccaggcagattattttctcacagataaggaaatagagctgtgaagtcaatcaaggcccctccatatcctcttcttctaggtagcccccaatctttagtctggttgtagaaaatgaaaagacttcttttctcaggagtcaacttctttggactatactgactctccgaagagaattccagaagcagctcctagattcaactttttctgtgtattgccatcatcacatccacttgccacatgacaagagtaacgagcggtaggcagaaaaccaggacgtggacagcaacagcctttccataccttcctcccctcgcacactgtgttagcctggggggtggtgtgtggccacacagaacaatcctcctgtggccaaggtggctggcattactgatcccgctccatctgcagcccaggccttttccctttcccagcatccatgagaatgcaactgtagatgagaacttcctctatgaacagaaacacagtccattcccaaaaggtcctggatccggtgtcaatcctgccataggcaagactagaatccacttagagatgatcaggggcatggatgatcagagacaatcagatgatcagccgtgactacttagtgaagagggacagaagtctcagagcaacatggggatgggaactggactagttaacaccagtcactttctccctgccacattcccttcttcaagaaccttaccttgcctgctgtcgctgagggacaaccacatgacagatgcccctgccatcagtaactgaactaggagcagacatcgggcccacttggaaccaatcagactgtcttctatagtttttggagttgggacactgagagtctggggttgctagttttctgtgggtgctggatccatacaatcctgtcgcaggatcctgtgaagcatgtagctctcttaggtcatgtgcaaataaggaagctggattagagggaggagatggagacgatgctcagagacaaagaaaactgagagaaagggaggaggaacagtagctgcctgggactcttcagtgctccaagagtaattctcaaaactgggtttcataatagtgccttatacatgtacaagaaatccccatttccttaagttagtctgagtgggtttctgattctaagcaactgaatgctccctcacccaaagatgagatggctgtagtgtaagtgggaggcgggggatgaagtgaaagaaggatcgaggaggaaaggtaaatctggcatttttctggagagaataaatctcagagtccaagtgcatgcacaatatccatatattccaagttttataagacagccctatttccagcgtgtcagcttccccaaatttctgttgagagaaatatgatgtatctgtttaaatatataatcttagcattaggcaggtctttctacataagacacaaacctgaaaaccattaaagaaaagattgacagatgagactacccattcttcaaattctaaatggactttgacaagagacgtcggtgacaaaattcaaagtgaagggtctacatgagatctgaggaccccattgtcattccagactccctcccactgaagaccagatgctccctcaaggctgctagacagggcccaaccctggcttcctggcagccatgactatggagggtgttgcaaccattggcagcaagactgtgacctctcactgttccaaaatgaggaaatgaaagggaaaaaagaggaaatgggatggaatgaaaaatggatgaccacaacagagagggagcaagaaacagtaagaaggataaaagaaataagctgtttatcttgactctgtttctaggccttctccttgttgatatcccagtgatacatcagcttgaactgttgttactcagtcacggattcctgcagaaagggaggtgtgggacccaaacttgaccgtgtggccacagtcatggtttaggaattcaacccactccatctaaccaccaacctgtggtcagacaaattaagtccatggattagccaaaaggcttctgaataaaagttttaggttgaccattttctcctcgttcttatcatttcctcttctcctaaattccctttattcttaccacccaccagaatggagaattgaaattaggttcttttacttaatagcttgccaaaatataaacaactctctcaaactaagccacatctcgtctagggagagggcaataaaaataatgatctatgtggtcaagagcccagtgagacatttttatagcatcacagatggttttccaaattgtggagtggctttgtttctgtgtatctcagtttctcagtccataatttgaagataatactagctgtccaccgctgactttttgggtgagttggttggatcatgagagtctctgtgtaaaagcactttgaatcttagaaggtggaaagaccatatgggaacagcacataatgagaaggttaggcatattgcagtgtttggagggggggaaatgatttgggccaagaacacttgaccccacgcaatattaagctgtttaagaggactcaaatctaaacagagcaccattattccagatatgtctctggtagttctagagctatggaagctactgaaagtgcctaagaggtggcatggtaagagaaacaaggtttgcattgacaccttactcctcttatcaattttaaagtcaaaattacccaactttggcttttgtcatggtctctattcagctttggcctcaaccctgactctgaacaaagactctgtttcaacttcagtcattgttgttcagttgctaaatcatgtccgactctttgcaaccccatggactgcggcacacccagcttccctgtccttcatcatctcccagagtttgttcaaactcatgtccactgagccagtgatgccatccaaccatctcatcctctgttgtcctctttccctc

SEQ ID NO: 44980 - DNA, 1569 bp, Bovine  19866880523409
agagctgcttaaccttcccctgacatattcttatctatgagttcagctcctgaatttttctgaaatttgtagcttatacatcccttaacctttcaaactcttaaatataaaatgtataaaggagaaggatgctgactgaaatcttggtggtttaaagtttcaaatagcactttacactcactcataagaagacaaaagtatcccacaatacactagcctgggcaaaaagccacaggagtgtccattgatctaataagaccatcccagctggaagatcttttggaaaataactgaattgcattttaactccaatgcttctccatttgaaaaatgggaactctgaggcccagagggattcaggaccagccccaggtcactaaatcagcaaaaggcacagtagtcagaagaccgaggatccagtgccctattttctccactacagagttgtttgttggaaaaagtatatttctgttttggcattcttgagtctacagattcctagcataagttttggcataatgaagtatggtgttgtaatcttcttcctaactgtaacccttcttcagtcctaaaaaccatataaggaatttgatctctatcatagtttccaattagctttgacaaacttgatgtcttgccaaccagtacactacatcacacctactgagtccaacagaaaaatgattctattaaatacctagacttaatatctcagctaaaaatcaccatctgttcacacttaattacaatcttccgaaaacatatttatttaacaatcttaaagaaaaattccacttgcagagaggaattaggatttgaatttttagtctttgtgccgaagagctgtcaattaaacttaatattattctcaatcctggctcaagtcctactggaaacagaagcacacattttttttttttcagatggtttccaaaaacacactcttgcatttatttctgaaggaaaattttaagatggtgaaaaataaataaataaaacaggatgcatttcttgctctttctttcttttcagctttatttcttaagtatacctttcttgaaaacaggaatggaatggaaaaaactcagcttccaggtgtactttatcactaattggcttaacatgccagacaagaagccagccagttattttcacctcctgtcattgtacttatatgcctctcagaaggactcttctgggttcaatcaatataaagaactgtatgtaagcggtcctttattctgcgacactcctgtagagatctgatttgatgtcattcagagtctcttttgaatggtttcaatagccagaatctcaggcacaaggtgcttttacgaagttaaacagacactaagcttgaagaaatttacagaagaaaaaggaatgccctgcccattcagaataaacttataaaaactgatagtcacaacattcataaccaagacttttatggttgaactgtcagtcacctcacaagacaaaatatccctcgccaaaaaagtattctatttcgggagttattttctgaaatggagaagaatgaattgaactgcctctggccatctgtgt

SEQ ID NO: 44981 - DNA, 1360 bp, Bovine  19866880614842
agtgcccaaatgtcatctatggacttgggtggcaatgatgtatcaatgtggattcataagtcataacaaatgtgcaactctgatgggggatgctgataatgggagaggctatgcttatgaggaggcaagacatatgtgggaaatctctgtatgttcacttcaattttgctttgagccaaaaactgctccaaagaaaaataatgtctttttttgaaaatggtttttatattcacagttaccaacagaagaaagcgtgccataccatgagggctaaacacagaagcacaggcttggtcaggaagcaaaaagagaggatgtaactggacaagagactttattgtgttttccacatggaataatgagcagggcagactaagcaggtttaggattggctagtttgaataatttcagctggttctggaacacaagggctctccccagttgtatagaaaccgaatttggcttagttagggcagatggatagtggcccagagtttgagagcacagtaaacggggttgttgggtgtatgggtccagtagtggttggtttgcatttgaagctacactcataaatgaaggaattcatcacaactaagcctgcttcataagaaatgctaaaaagcgttcttcaagctgatgttcagttcaattcaatcgctaagtcgtgtccaactctttgcgaccccatgaaccgcagctgatgaaatggaactaattaataacatgaaaatgtttgaaaatacacaagttaaatgtaagtatatagtcaaactcggaatactactatgatataatatggtggtatccaagccactaaactctaatatgaaggttaaaagacaaaattattaaaataactatagctacaatattgtgttactggattattgttgttagtctgtaagtagtgtctgactctttacaacccaatggactgcaacatgccaggcttccccctccttcattatctccctgagtttgttcaaattcatgtccattgagtcaatcatgctaataaccatctcatcctctgtcactcctttctcctgttgtctacaatctttcccagcatcagggtcttttccattgagtcagctcttcgcatcaggtggccaaagtattggagttttggcttcaacatcagtccttccaatgaacactctggattgatatcctttaggatggactggttgggtctccttgcagtccaagggactctcaagaaccttttccaataccacagttcaacagctttctttaaaaccaactctcacatccatacataactactggaaaaaccatacccttgactagatggaccattgtggcaaagtaacacctctacttttaaatatgctgt

SEQ ID NO: 44982 - DNA, 1846 bp, Bovine  19866880725399
tgagctggtttcatgattgtgagcacctgtttcacaaatgtacacgcacacacataccccagtatgaatgaatttgtgtgtgtttcaaagctctaggctcctccttctatttcaaccaggattccttttgtcactggtgagttctcaaacccagtgtaacttcagtccacatttctggggagacagtctccctaatactgctacccaaagtagctagtaccttccaccaaggtttctgaaaagcggcccctcccagttcctctccctcaaataagaccaccagggacccttcccttgctctccaccatcactctcggaatgcggagaaaggagtgaagggaaggagcaggatggtttgctgacctacagctcttctcaaatgccctttggcagaaggctcacaggtggtgtgacattctgtagcagttagagagaacacctccagtgagcttgacccaacccctgatgagctccagggataggagcgaggagaggcctgccagccaagttccctctggctgttagctgagggtagaaacagggaccaactgcctgattctgcagacttaggtttcatccttactttcagagatctggatttcttctgacattaactgcttcctttcctcgaaggttcctgccagcccttttgtctcaacatcttaaaaggcttaaatggaactaggccagggcttgtatgtttacattctcctgtgcctgttccctctgtgtcctggtggcactgctcccattctattgttattctctttgttacagcccataaattctgtgctgccagggcgttgtctttgggggtttaactctaagcttcaccacatacctgtaaatgattagtaagcagtgtttggttaataaataacattcaggtctgatattaataacagacttcttcaagcacgacacagctggtgacgatttagtgacacagggtcaccttagttttttggagcgttagcttggaggagagactgaatgctgccagatgtcaccaagctgaaaaaaaaataaacatatctgggtcctgagagagaaccctggaggatatgtgcacgtgtgcacaccccgcccccccgctccacacacacacggaaggagattcctgctcttttcaacgtcatatctattgttgcctcccaagatcctgtgggtccatctcatgcattatgattcttcccatccctagagtgagcacattttctgagctaaaaatcagtgtttattggttggccatgagtcagaaattcagaatggtctggaaaagttggggaaaataggtttctcaatagtgaggcatccagcagccttccttatggccatagttgttcagtgctattgaaaaacttactcactctctaagtgcttccagagcctggagttacagagaagaaagctgtcctcctgaaactttgctcctttatgaagacactatggatgggcgctctattctggcttattcaagttccaagcaaatgtttgaccttgcttggctattgtcacagctgatgcccacccctcctccattcaatccctccccaacacagacatcacttcttatttcttcctttttaatgttttttttaaaatatttatttatttttggctgtgctgggtctccgttgctgtgagcagactttctctagttgcagcgagtgccgtctactctctagctgaggtgcatgggttttcattgtggtggcttcttttgtggcagagcacagactctagatcgcaggcttcagcagtcgtggcgcacaggtttagtagcctcgaggcatgtggaagtttcccagaccagggatcaaacccatgtcctctacattggcag

SEQ ID NO: 44983 - DNA, 932 bp, Bovine  19866880745408
cttgggcttcccttgtggctcagctggtaaagaatttgcctgcaaaggagacctaggttcaatccctgggttgggaagataccctggagaagggaaaggctacccactctagtatcctggcctggagaattcccatggactgtatgtatagtctctggggtcatatgaagtccaaagaggcaactgtgttgaaaattagcaattttaatcaatggtgaaagcacctcttttttttgttgttttaacaaagagggttactgcagaatgaatcttcacaaacagtgctttatttggtcacaggatccatgatccactatgaggatgggagaactttattggatgctaatctaacatctaaaattatatttgtctgctcttctttcttgccatttatggtgaaaaatctgaagccagagcaccgtaaatgttttgcttctcatttctagtcccatcccaatttcattttcttgcaatgagaggaagggttggaagataattagcaatgtccttctcccacatttaacatctctacttactgtgctctatgttaccgcttactctgaaaaattcagtatgtagcttgaatgttgttttaggcttttctaagttttgtgtgtttctggggcattactaatggtttaccttaaaatgcagaaaaactattatgaaggagactttaggataaaagcataatcccctctaggaaacaaaccacttcactaaaatgccgttgttaagggatggggtggaagaagcagaaggaaggttagacagtgacttagaaataaatatcaacatttgatgtcaaggcattaatccctttatacctggtgatctgtagggtgaatggaaccatgttaatcactgggagctttatattaatgttctcttggtactatctaatttgcatcagttcagtgcgtacgtgcgtg

SEQ ID NO: 44984 - DNA, 1669 bp, Bovine  19866880783526
aattactttctactttctgtcaccctggatttttatattctgtgtatttaatataagtggagctgtataatatatgatcttctggcttctttcaactgaaaaataatggcaccaaagttcacattttagcatgctacacactttcattccattttatttttgaataatattttgtgatgtgcatataccatattttcttcctttatttatcattcagtgggaatttgtttggtcatggctgttaggactaacactaatgtgaacaattgttttcaccttgtgtgtctgctgcggtccgtggggtcgcaaacagtgagacacgaccgagcgactgtcgtgaactgaactgaacagtctgttatctactcattgagtcgtctggtggtgaaaagtggccgtgaaagtagttcagtcgtgtccaactctttatgacctcatggactacggtccatggaactctccgggccagcatactggagtgcgcagccttttccttctccagggaatcttcccaacccatggattgaatcggagtctcctggattgcaggcagattctttaccagctgagctgagggaagagctatgagggaagcccgagtcatctggtaactgcacgttttatgggcaaatcacatcttgctcaacttcatgctatgagtgttaagtagacatattttcatttttatattataaatactcaggaatataattgcgggaacatatagcacatattcagctcaataagaaattgctaagaatatataattggacttagaaaacccaggaattagttcttcagccttaaggaaatgttgcaaagcttcctgtgtagctgaggacggtatttttccaaacagagtagcggccatgcttttgctcaacccagttcagttttgagagtgtaacagtatctccccttgttttatctagatgtttctttaagtgttgttggtatttgattttgttttgtaagccctcacattcagatacacagccacacaaaaccacatgccatagacgacaatgtccatctttgagtgttctcttaatagctttttcaccacgtctttacaatatttgcataacgcttcttttcttgtgtgtttgtagatagctcatacatatctccagaagcaggagcaaattcccaaataaacgccattgcatctctaaacttttcttctgggtcacaaaagtagttcaaactctcaaacttgctgaactcattcacatgtaaattatcagccatctgaagaagggcatctaaatttaattcctctgcatgggtgttggatgtcttagggactggaaaagaacttgctcttcaacaaatcagatgtggtctaccgcaaatttaaactaatcaaagtttccttttttttcaattatcttttttttttttttctttttttatgtgagggtaatgtgctcagatttgaaggtaaaatcatgtttctgcaggatgtattccactagtagaatgacaaaactaatcatgttattggagaaatctatttcccatatgtcactacaaaaagatctttaaatatgtatgtttatattcttcccattaataatgtaatcttcagatatttctttaaataaaatatttagatcaattcaatgaaagaactactagtgagtgcaaaaaaaaagaaaaatcgcca

SEQ ID NO: 44985 - DNA, 2532 bp, Bovine  19866880851972
tttatttctatacatcttaggtccccgtctaaattaagttccttgaagataaggatggttttttatttaccttctggccagtgagcacataatttatgctcagtaaattcggatatgtgaaaaaatcctctcacaaaacagagagcagtgcatcaatctagggtacacgggtgtaggtggctgatcaccatctgagaaagcacatataaagggaagcactgtgactacttctagggaaaagggaaaggcagtaaagaaaaaggacatatacattgataagatcaaacagcgtatgtggcccttcctactggctcagcagtttagaatcgccagcaatgcaggtgattcaggagatgtgggttcaattcctgagtcaggaagatctcctggaggagggcatggcaacccactccagtattcttgccttgagaatcccatggacaaaggagcctgatgggctacagggcatggtgtcgcaaagagtcagacacaactaaagcaaccgagcatactgtatgtaatgcaacatatatttatataacatgttaaatttataaactcataaaatatgtactgatttcacaattttctccatagcaggcactacataaaacaagagtaagccactgaaaatctatcatataatcatagtatattcaaataagatttacagatagaagcattcaacttacagcgtaacagtatcttcctttgaggtaatacaaaaagggttcttcaggtaaaaattcgattgctttatctagatgttcctgaaagaaaatttaaaaaaaaaatttcatctcccaagtttcaggcagtgctgaatggaactctgcctaacaatttcaaagggactttatgatgttgcttcttcctttatcattaatagaactaagcttatcaataatccaatcatcaaaatgctcacaactagaagtgtgattatgatttaataaggctacagaggatgtcactttaaaaagagaaaacatccaagtcgcatttttgtctgcccatgacttgcctacctaatacttactgattgtcaaatgatgtgggtataatggagaaaaagaagagcagaactaggtgatagaggaatctacccacttaacattgtcaaatggttatagggagctggaaaacaaagaactctttgcccatccttacaattattgaccctgaggggttatttactgagtgactataactatttactgttgctgttcagttgctaagtcatatctatgctttgtgacccatggactatagcgtgccaggctcctctgtcctacaccgtctcctggagtttgctcaaattcatgtccattgagttagtgatgctatctaaccatcttatcctgggctgccctcttctccttttcccttcaatcttgccaggcatcagaggcttttccagtggagtcagttcttcgcatcgggtagccaaagtactggagcttcagctccagcatcagcccttccagtgaatagtcaggtttgatctcatttaggattggccggctggatctccttgcagttcaagagactctcaagagtcttttctaacaccgcaattcaaaagtatcagttcttcagcactcagccttctttatggtccaattctcacaaccacacatgactactggaaaaaccatagctttgcctatacagacctttgctggcagtgtggtgtctgctttttaatacgctgtctgggtttgtcttagcttttcttccaagaagcaagcatcttttcatttcatggctgcagtcaccatctgcagtgagcccatttagagccaatctagagcccatctgcatttagagcccaagaaaataaaatctgtcactgtttccattttttccccatctatttgccatgaagtaatgagatcggatgccatgatcttagttttttgaatggtgagtttcaagccagctttttcactctcctctttcacccttatcaagaggctctttagattctcttcactttcattagagcagtatcatcatatctgagcttgtagatatttctcccagaaatcttgattccagcttgtgattcatccagtccagtattacacatgatgactttacaaagaagttaaataagcagggtgacaatatacagtcttgatgtactcctttcccaattttgaaccagtcagttgttccatgtccagttctaactgttgcttcttgacccacaaacaggtttctcaggagacaggtaaggtggtctggcactcccatctctttgaaaactttccagttgctgaaccacacagtcaaaggttttagcacagtcaatgaagcagaagtagatatttttctggatctcccttgctttctccaaaacgtaacaaatgttggcaattcggtctctggttcctctgcctctttgaaacccagcttgtacatctgggagttctcggttcacgtactgctgaagcctaaattcaaggagtctaaacataactttgctagcatgtgaaatgagtgcaattgtatggtagcttgaacatt

SEQ ID NO: 44986 - DNA, 1578 bp, Bovine  19866880869476
tgcagtcttgattgtgggagcatccctccagaggggtatgaaggggagtagggggcaacttgcttctcatttgcttctgcaggtgccccataggcctcactagctatagatttggggcttctggcccctgaaggttgtctgtatttgaaccactaattttccaggagtgcaggtcaggggtctccatttccctgaacacttccactcactcagagcctagactgaattggatgatctccttgggccgctgggcagaatgttttctagtccaaactttcactggaatccattaaaagtccggacttcatacagacatctcaactccttatatgagaatctttgtcccttcatggttattaaaatccaacctatggcagtgcctgaccaattaccatgccctcctcatcgtggctgtggcacatatacacaagcctgccctcctgggttttcattttctctttatttttttggcatccaggtatctctgtattgaaaattaaagcagacataagaaagaacactcataaacttccactccacatctacatatctattagcaactaccctctactttttctccagttaccatggaagaaccatttgtgccaaaaggccagtccctccacttgggctccagctcccatgcctctcacttatgcaagaacatcatttcaggaattctcctctctctcccctgccctcactttctctttttcctggactattcgtatcaacatacatatggtgttatttcttctatcttaaaaaaaccagcaaaaacctcagtcctcttcctgtccaactgctgccccactgctctgccctctttagagaaaacttctgacagtttcttcctccaatttctcttctccatatcattccaaccaaggctttgtcctcaatatttcaccaaaaccactgtcttcaaggtcaccaatgacatccacattgctcattcaatactcggtcagcatcttacttgacctagtagcagaatttgatgtggtaaatcattcccttcccctggaaatcttttatctcttagtgttccggactcctcattttatttgtttttcttttttctcatcagcatttctcagcctcctttgctgattcttcattttccttccaaagagtaactttggaataccccagagttcagtatttgaacgtctcttttctagccacattcagtctatggatgacctcattccaatctcaagactttaatgccatttgtatgctggcaactgtgactatgcacctctagcttatctttctcctaaattctaaattcttatgtcaaactcaccagtcaacatctccaaaagtgtgtccaggggacatatctatcatatctactccaaaactgacctcttgatctttcctatcagtcctgctctatcctccacaaaggctaggactagagagaatacaggaaaatgaggccaaaaatataatacccagatcaggctactaaatgtggagtcaagctaatgcaagcaacttgcatgcatgctaagtcacttcagtcatgtccaactctttggactatagcctgccaggctcctctgtcca

SEQ ID NO: 44987 - DNA, 821 bp, Bovine  19866880953736
ctgaaaggccaaacaatggataaaatacagtgatttgaatttcacttcctctaccttattcagccaaactctgggaatcaggaatacgcagtaggaggtagtaagaagcgaaacacaatctgaaccaccacaaaaacaaatggctttggggtgaattctaaagtagaccacaggaaacggaaatcattaaagtatttgtgtttagctgtgtgtaagtgtgtgtgtgtgtgcgtgtgtgtgtgtgtgaacctctatctgaatcccactttttcaaataccatccagtctctttctgcaggtgctgccctgctcataattcctccacgtcttgaatgggccccatgttcttctctgaacattatttttgtttgaaattcaattctttttcttcaacttagttaaatagcaaacacttttgaatttctttcccttctctactccagtttcaaattttttttttttgccagcttttgagaagtcagtcataataaaaattctgaactccattttccttacccctccaatttctctttctcaaagttcaaattttggtctactgctctaactcattctgtgtatacagaggctttttttttttttccccttcttttttcgtcatgcatcatgtggaatcttagttccctgaccagggatcaaacccacaccccctgcattggaagctcagaatcttaaccactgggatgccagggaatctgaggcttttttgtttgtttttgctgtgatggatcttcattgctttgcatctcgggtttttgttggtgttttgttgtggtgagcgggagctactcttcattgcagtg

SEQ ID NO: 44988 - DNA, 2233 bp, Bovine  19866880984581
aacagtcagaaaatgaagatcatggcatctggtcccatcacttcatgggaaatagatggggaaacagtggaaacagtggcagacttttttgggggggctccaaaatcactgcacatggtgattgcagccatgaaattaagacgcttactccttggagggaaagttatgatcaacctagacagcatagtaaaaagcagagacattactttgccaacaaagatctgtctagtcaaggctatggtttttcctgtggtcatgtatggatgtgagagttggactataaagaaagctgagcgctgaagaatcaatgcttttgaactgtggtgctggagaagactcttgagagtcctttggactgcaaggagatccacccagtccatcctaaaggagatcagtcctgggtgttcattggaaggactgatgttgaagctgaaactccaataccttggtcacctgatatgaagagctgattcatttgaaaagactctgatgctgggaaagattgaaggcaggagaaggggaagacagaggatgagatggttggatggcatcaccaactccaaggacatgaggtcaggtaaactccaggagttggtgatggacagggaggcctggtgtgctgcagtccatggggttgcaaagagtaagacacgactgagcaactgaactgaactgattgtgtgaacaggttcaggcaaggtgatgagggtctccccatgccatgtaaaaactttgggcaatgggatgccatcaatgtgtttgcaatagggcaataaagcattgttaaattgtttccaaaagataaaaatacagcagagaaaccaattaagagggcatgaaaatagtctgggtaaggaatattaaagacctgaactagggtaggagtgatagaacagcaaagatagagttgagagagaattcagaaataaaagagaaaagatacatgtagagtgatggtcggccaaggttaccagattctttgttgaaagtcatggatcctgtgcattccatctgatgtaatgagaaaattattttattaaataatgtaagaacgcctatatagtcttaggggagagccagagaatcagatttgcaggtgttgaagctcagagaagaccttgagttgtgtcaaactattctagtgagcccctgccactgccatgactgggcttaagaacttccatgcgccactccgttatgcacgcttagttgctcggttgtttctgactcttaggaccttttgaactgtggccctccagactcctctgtccatgggatttttcaggtaagaatactggactgggtcacaatggcctcctccaggggctcttcccgacccaggggtcaaacccatgttgtctggatctcctgcactgcaggcagattctttacctgctgagccatcggggaagcccaggaacttaggtaccttgtactcatttcctcttgccgctataataattaccacgcatttatagtctaagacaacacacatttattctcttatagttctgaaagtcagaagtccaaaatggatctgacggggctgaactcaaggtgtcagcagggctgcattccattctgcaggttctagggagagttgttctgcctttttcagtttctagggaccacctcactccttgacccacgccttcttccaacatctcaaagtcagtggggtgacatcgtcaaaactctctgcctttcctttttttttggccgtgccctgtagcatgtgggatcttatttcccagaccagggatcgaacctgcatcccctgcgttggaagcatggagtcttaaccactggaccaccagggcagtcccaaatctctttgcttttcttgtcacatcttctctccttcagcttctgtcatcccatcactttctctgacactgatcctcctgcctccctcttacaggggcactatggatatgtaggtccacccccacagtccaggagaatctcccatctcaggcttctgagtgcaatcacatctgccctgtgaaatcacatactcatattcaggttctgaagatttgaacgtggccatcttcagaaggccgttattctgccttccacagaattttccctcaaattctggagtcaggcctctattcgaaggacctcagcacccctgtctgtaaaatgctggatggatgtcaccacacccgcccttatcagaatggcctcagcacaggccttctttctgcccagagctttcaaatcatag

SEQ ID NO: 44989 - DNA, 1414 bp, Bovine  19866881051007
tctgccttctaacctggtgtttgcctgtcttatgtttgagcattgcttcattcccttggttgctatgccctacttgtttgtttgaatttctgtcgtcaccctagcccctacttgtcccagcagttccacccctgctcacaactagtcccgatgccatgccttactgaagagccatgacatttgatagggtaaatagtattgttacttctgttgctttactcttaaggaaactaggctcagaaggattaagtgacttggccaattaggtatctaatacacagtagagtcaggccttgatctaggttccttgtctccaaattgttggctctttgctcatatctgtgcttttggctctaaaaatcttaaggatggttttaaaaattagatgtgattaaaaggtaaaaatatacagaaataaatgttttactgttattgtcatcaacaaatgggcttcctccagtgtgcagcaatgcatttttttctgagtccttgaaacagaaaagctgcggcttcttgcattagacgaagcttgcacgtggatggcaaactacagcaatgtctaccgatgccgggtgtggaacattcgtgcttcaaaagttcatttgtggttgtttagaatggaggcttcattttcacaaacgagtaatgttataaatggtggctagattcttgagttatctcacaaggctgtttaattaacaatgtcttagagtacatttctagtttatcaggtggctgaagtaatgcatatattatgccagccactgcaacataatcatcaagttcttgatcaattaaggagtgtttactttgagccctgagaactgtctcctgacagcagtactgaatctgtcactataggttctagagtatgtaggagttgttggaaaatttcccatattttaatagctgagaaagctggtttgtcagatgagaagtgagagggtattctcgtgagaggtcaggtggcttgaaaaaatgtgcagatgtggagtccaaaaagggcgggaaaagagaaatcccaggaacaaaaaatgatgtgagtagagggggtggaagaaatcagttatctgaggatgagaagtaaaatctgacaaggaaatgggaactaatacagggatttagagaatgtggatttagaaggttagggatttataatgtgagaaacagaagatgacttgggcagaagatttcgaatggcttttgatggaaccacttcgattttagagaaatgtaatagagaaaagctatgggcttccctggtggctcagatggtaaagaatccacctgcaatgcaggaggccagggttcaatctctgggtggggaagatcccctgactgagtgactaacacacactaaagaaaaagtcgtactgatgaaagcttgtggaaagtgaaagtcactttgtgaccc

SEQ ID NO: 44990 - DNA, 540 bp, Bovine  19866881185648
ttaaagggtgaactttatttcttttgaggtaaagcgatgaacccaggcaaagcactcactctatcagatatgatttgaaacagctgaaaaataaacctctgacaataagattttaggacagaaacgctgccagagctctaagtgccttcaagaataataaaaagaaagtaaacaatgccagaggccagacgaacaaaaggaaaattcttacttcgtttgttctcatcaaataccggagaaaaataatctgtgcttaggcagttctcctggagtccaaattcctgccctgtgatcatcattctgtttaagctctgtgctttcaggctgtcataaaatgccttacgctgctggaaggggccaagatggttttcgatctaaagccactgagagcctcaaggcagattctaaaggccttcaccacctgagccgggccatctgggctcttccttccacccgctgtgacattgtcttggcgtctgacccctgagggagagccgagtccattagtggaatcctcttgccttcagcagcttcaattag

SEQ ID NO: 44991 - DNA, 1299 bp, Bovine  19866881418927
tccattcacgtcgttgtgcaaccaatctccagaaatctttgcatcttgcaaaactgaaactatacatgacatcccccatgacttattattttacagctggaaatttgtaccttttgacccccttcgttcatatgacttggactgttgactcatgcagacagcttcacaggcaaatgctcttgttcactgcaagtcaaaaccccacctgcagagcccaccaggagctcttcttctaagcctcttctagacatgccgactcacaagactgccatgtcacatggggtaccatctgactcagaaggtagcatgggccaggatgcacagtgagctagctggacacgtctggcattcctctcctgcaggacctagcagctgaccacaaaaccatccgtctatttccgccagttattctcctgggccccaggtgagactcagatgtaaagcagtgagactcacatcaggaggatatggaagccaccctgaattggaagacttgtgctccatagcactcaatatcttttggaagagccccatgggcatagcttctatggtccccagagtgtcatgccagtgataaaagtcactgcccttaggggaaaccagaaaaagagcttccaacctggtacttacattgtcccagtccagatacagtttaccaatcagggccatttttttactttcttttatcaggtctccagggaaacagtgctaggaagtttaccaaaaattgaatgttcaggctaaaggggaaacaattttaacatgcttttagtcatagtccttcaaatggttaaatgataatttctggcaaaacatctggttaaattgaaaggagtcagaatgacacactgatatgaagaactaaattacacaatgaaatctgccatctcttatcggctacagttctgttccccaactcacaggttggtaatgaaagagctataattagaagctcagatgcctgacaacacgcccatcaaacctcacagtctttcctaagagaaggaagaggtagcacgtgggaagggaagaaaagggatgttgatctaggaaggaggtaacagagaaaggggaaggcaccaggcatgttttcctggcagtggctgctccccagcagcaaagagtagctctttgagatgctggatgagattccacaggggtaggaaggggaattaggacagtaatttgtgaattctctgctcttgctaaagaagagtctcttgtcttcaaaagaggaaagtaattaaccggactgtcattctgcaggggctttgaattgcaaatagacaaactgtggac

SEQ ID NO: 44992 - DNA, 1058 bp, Bovine  19866881595339
aagaaaagaaagtgcagttgctagtctggctgagtctttgtaaccccatggattgtagcccaccaggctcctctttccatgagattctccaggcaagaataatacagtgggtagccatgccctcatccaagggatattcccatccctgggatagaacccgcatcttctgtgtctcctgcattgcaggcagattcttcactgctgagccacctcgaaagcccccatcaagttagtatcagacagcaaatctcagacccaggaagcttagagaacaccaagcattataaacactgggaaaaactacatatggaacctcaccatcaaactacaggaaatcaaaaatgaagaaaagaccctgaaggagccagaggggagaacacctcacccatggaggattaaagataagaattacatccgacttctccacagaaacaattcaatcaaggaaagagtggaatgaaatatttaaagtgtagggagaaaaaatccccaccagactaaaattcaacctgtgaaattattcttcaaaagtgaaggagaaagaatgattttctcagtcaaacaaaaattgagggcatttgggctggtagacctgccttgtaagaaatattaaagccattcttcagagataaggaaaataatataggtcagaaactcaaatctacatgaagaaagaagaatgttgaaaagaggataagtgaaggtaaaagaaaacttatttttccaattcttctttgatctaagagataacagttgcccaaaataataatggcaaaatgtatttgatttatgtttgcttacatatatatatttgtaactgctaagtcacttcagttgtgtctgactctctgcaacactatggatcgtaacccaccagtcttctctgttcatgggctttttcaggcaagaatcctggagtggggtgccatttcctcctccaggggatcttgctgactcagggactgaactcacatcttttttctctcctgcattggcaggcagggttctttaccactagcaccacctgggaaagcctatatatgtatgtttatgcttat

SEQ ID NO: 44993 - DNA, 1059 bp, Bovine  19866881763273
tactttggtctttaaaggagggaaatttcaaatgaacttgggaactattattttcaactctgacacactagtgaaatattcagttctactagaaagcatacttgaacttcaagtcctgccctcaaatgcaacttgctcaggggtggatataattatattttccatcctctttggaagatagacaacaaatactgagtaaaaataaatatatttatttatattttgtacatatgtgtatatatacatatatgtatacatatacatgtatatattaaatatgtatatttaatatatgtgtgtatgtacacaccccacactcttcattgggaccacctagggtaccttttcttacccatgatctccagctcagccttggtagcagagccttctagtaatgttgacaaagctaggcatccagacacaaccagcttatccacaagacctgccgtgtagagttaatttcaacctgccatctggtcgccagctgaccactgctacacgcatttccagcatctcaacttgctattgtcagtgccccaaattaaagcagtcaatacagctgcgccgtggctgctcttagtagagggtgttttctgactcactctgtgaaatcactgatgaggagggaatccccaccgtcatttcagctgccaagacatttcacaccaacaagctgtgaaaggaaggctgctaatgacacgaaagccctttttatggccagggctgggccaaggccaccagaaaggccatgctttccccatactgctggaccgctcagaggagttcttaacaaccaagactgatccgtctgttcatggaaggtaggagaaggacaggccaatccccaagccatgcccaaggaccctgagaaaactggcaggattccttatccatatccaatccttccttcacacctcaacgttttagaagggaacttaggtttagaggtaaaataaaagaggtaatacttttggcagatcacctaggaaaactaaaagtattcccacggtacctgtttgagttgcggaaagtctcataaatatgctaccccatcaatgt

SEQ ID NO: 44994 - DNA, 1001 bp, Bovine  19866882019676
tgcttgggcttcctgttgaagtgtgctggcttctcttgttgcggcacgcaggctcctcgagctcacggcctcagtagttgtggcaggtgggcttaactgctcccgtgagatgtgggatcttagtcccccaaccagggattgaacccgtgtcccctgcatggggagaacaaagtcttaacccactggaacaccccaaagtcctgtgttctctatcttgacagatgagaaaactgaaggcgctttgcaagtctcatagttaactcagtgagagggcaggaactagggttgagtcgtctggcttcagccccagtgccttgcacagctgaagagatgctgttcctgctgtgcccttgcacagctaggcagccgttaaggacagcccagggcccctgtttcctctgtcttcaaattgcccctagatcccagaataggaggcagaactcagtaaagcctgctcatatctgtctttggggaattcaggccctaggcttaaggaagggaagaacctccagaaacgctgctgctgaaatctggttgttccctgcctccactgctcatttgctttttattacttacaaaagattgattgctggtaagaataaataagaatccaggttattcggaatatttcttaaggagatggtggtggtttagctgctaagttgtgtccgactctttgtgaccccatggactgtagccttccaggcttctctgttcatgggatttcctgggtaagaatactggagtgggttgccatttcctgctccgtcttaaggatatagcaccttttaatttttttatagcacctttttaatcccaaagaagttaatatattgtccagctgtgccagaggcacatggttgcaggaggtggaagccaactggcatctgatgtggaacaaatggaaaattttggccgcggaaaccagagggaattcttcaccttaattaagaaagaactctgcaatattaaagtctaggtagaggaggcccagacccggt

SEQ ID NO: 44995 - DNA, 1615 bp, Bovine  19866880394998
acagcttctggtggctcgtaggcagtttgtcccagtttggcatacccacagctctggaaaaaataataaggaagccaggtaatgtgggaagttgaaagaaaggaagccaggccagtaaaagaaaaaaaaacctggcagaaggtaagagtaaactcacctctgttaggtcaacgtgtcagtagaaagaagagaggtggcaggggtgggaattggagcctcctgtccctttaaaaatggcggcctggcacggaccaacaataccattggttgcgcgagcagaggggcgggctcgggggcggggcgagcggagctgcggagtcccacctcctacggcaagtcagaggtggcaagatggccgcggctgagggggacggtggtgtccgggccgaagctgaccgggaattggaagagcttctggaaagtaagagcccgtcatgggaaagccccaaagagggcggatgtaagggtccattcaggggggtaggtaaacctgcgatgtttggggcggagcaagtaaggctcgccaaaggctggccgggggcggagagtctgactgcgaccctcgagaaaatctctgggtcaccctctccttcctctacagcggtagttgaggagttctctctgggtccctgaacggcccacactgttgatcactctgccggaggggaaactaacccagaggacgtttcacgctccctctccaaactccccttactttagtaagttctgaagtcctgactctccccaccagcagcagcatttggtcctcggggggcagcgaaccgaacaaccacggattgcttccattaactattagcaaacctgtagtgcgttcttctgtgcacgctcctgccctccttaatagaaaagacactcctttctttctcccagtcctttcatccaccaggcccctttccagttctttcatcatgtcagagctcaaacccttcccattattttgaaaaacagggtgagacagcctcagggtaagacagttctcttttgaaaggaggtggctgtacttttccttctcagccctgccatccactcctctctggtttggtttcttgtccagagtggggctggtgtcttactcctaggcctggcaaatatagtggtggtgagaacagaggtttttcagggtagaggtgaatactttttgtctcttgctcagtcacagagtgggcaggtggaaagataaacagaaatggtgagaagtgctaagtgactgtgtgagtctgcagagatgaggccacagggagctctagcaactctggggagggagagctaaattgaaagagaaaagagagttcagggccctccggtggagtataatatggagtccctcagtttgtaccaggacccatgggaagctgggtgaaatatcttaaggcttctgctctcttgccaaagattattccttgtagggctccagagtgagttctagggaggttaaggacatctgtgttctctgttccccttgaatatctgtatgggatttctaggaaccattaaagtatggcaaagaggcatcatgtagatgaactgtcgtcttacagctttgagagatgttttttccaccttaagagatttcttcctctatgattacaataca

SEQ ID NO: 44996 - DNA, 1404 bp, Bovine  19866880412463
acatcttgttggagaaatgaatgaaattggaaatgcaagaaggagttgatcagacaacaacagagtcttagactagtttatagaaaactattaatagagctgaaggatttccctgtctaccttaaatatcctcagtaaagtagctttactctcttggagacacaactcctccctaactctccccctccaaataaataaacaaaggagaaaaaaagatgaacttgtacacttgagttactgtctttacagtctctaaatagacaaagtagcccataggagttgatacaatgaggaataaggaggaaaagcataaacagaagttcacaaaccttttctgtgatttccttcagtgacgggtacagcacatccctggacagtaggttctgcatgatactctgcatgatggggaggatggtcccttccccatccccttcgtccatgcccagcccttccatggccttggtcagttcctcttctgacatgccagagttctggaaaggacagaagagaaatgagcaagtataccaccttcttgggacacttaccaacttttcaggtgggaaagaactatttaaacatgcctgtagcaaaatagtgaggcaagaacagacttgagatgatagccaagagagtctgtcttttgagactctgccggtgaagtctctgtgagtgggacccttgtggttccctatctcttccccctcacctgaaggtcagtggcattcttggctagtccacttaacgtctcctttaggcaagaggtgaattcttgttgggaagtcgcatcactgcctaggagagatgaaaagagcctaagtcatttaggattttaactgtttgcttgcttagactgacctggttaccagcttggacatggagcatttattagtgaattactacactccaaatctttgaatactctacgtttatcttcatagttatttccacaaatctacgtggactgtgtctcagtttgttctctacaatgacacccacattaacactgatctttaaaattatcccttttcaataatcttttctgttactttccaacctatctcacccctttcattaaacagggtctcctttttccttccatctcctcccctataccatggcagtggtatcataattcctgtcaacttttacaaaaaattttggtgttgtcaagggacaataacccaagaggtttgttcagatatttcccactgtttcccctccttacctactctcccagcagcctctgaaagcttttggaactgctctaccaggtggggctcttcctcagccaactctttcattgctttctcaaactctgcagtggcttgggaagccagctcgctgtcaaacagttcctggaaaaacttctcctgggaggcaaagagggcatcctgcaggcgacaa

SEQ ID NO: 44997 - DNA, 1232 bp, Bovine  19866880625780
cagagagaagggagagtccaagggcacactgttaagatgaaactgcagaaagattagagagatgggagatctggaatccaactgttttagcacgcagtgaagggtggttggaaggggcagctcttgggaatcagagctttctgagtttaccacatcaccccttctcttccataggctgagtcaatgcttttctcccttcatccaagattattatagacgttgccaccattttcatggagacagtgcatttgcgtggtccctcttcatcccctccccccatcagaaccttgaaagggcagagagaaagggattatgggaaaaaccctcccgtgggtgtcaggcagctgggagctggatttgaggtggtggggagaagggaagggggttggctatggaatgcaggagagaagtgagaactgaaatggtggcctggagaaggaggctggagaagcatgggcttgagagggcttaattagcacttcaggtccctgaaaaggtgtagtattcaaggagtggatgtggccaatggcagaagacctagggaaagggttggggctgcagcttgaaggacttaggctagatttcaggaagcatgtccatagaaggaaagagatctggagtttggaaaagagagggagaccaccctgtggactctagcaaaaacaaaaaagctcccaaacaacaaacaaaagcccatcattaaggcttgtgaggggagttgtgaaactcagagaaatgcagggattactgtatcaggccaagaggcctcttctggaaggaaggtgcgacccacagcatgtcccagggtgcatttctgttgcctgaaaggcagaggcatagcagttaggagcacagccttggagtcagacttcctgggtttacaatctgtcttctgccgctttgtagctgcacattccctcatccttacaatggggctaaaagttatagttgtggattaacagagtcagtatttgtaaagggcttggaatggtgctcaacaatcggaaactaaaacagtgcagttgttggctatcgtggtgtccccacgtctgtgactctttctactccatcatcttgcctggctcctgggcctgccgccacagccctggggctttttctgaggtctgtcctaggtctctatctctccacccttctagactttggaagggtgggagaattatcaagttgttgaagatgagcttcctgtcttcattccaacagtctggccacag

SEQ ID NO: 44998 - DNA, 998 bp, Bovine  19866880629141
ctctgtttgtgcccttgctggtgggcacgggggttgctctagtcatcggagccaccatcctcggctccatcacctgctgtttcatgaagaggctgcggaaacggtgattcctcgcatcccaggtgaggggtgagaacccccagccctgccttccccagtcctccctggccctacccagccgctctcagctctgcaggaccctggcaagggccaggagggagtcacgctctccctagccccctcgccgcgtgctctcctgttcttgcaggtgtgactgtcttccagcccagccgcaagcctgcctctggtgtctgaataccctctccctctgcctgcccttcctttaatttatttgaccgacccacccagagctggggacgtggccccccaccccccacgccttccttcccaagctcgtccctctggccttctcttcatgatctcatacccaacccaaagggaggcagttccctgtcctagaattagtttttctaaaatgtgaataaacttgttttataaaatccgggctggctgtgtcttccctgccgtgggggctggggcgggtggcagggagactgctggggcctgacagcctcttctggacaacccaggctgctcttccccctacaaacaccatctggcctccgtgggccatgccacccaccccaggaggggacacctgggtcccatctgctgtccgagctgtcagtgcagagccgattcctgttgggattcttgcttggggtggggagggaggaaggtgggtgagttccagctgagcacaaccttgcctcagacttctcccaggttgccgggtaggggcttccagggcccagtgcccccctttctgagttcccgagctactctacaatctcagtctcttgatcaggctaatcttggacctgactcctcccctccaggccctggggcctcagcctttccctcctgatcttcattgtttggtctgacagcagaatggaagccccagaacacagccg

SEQ ID NO: 44999 - DNA, 1593 bp, Bovine  19866880818694
tgagtggtagtggacataagaggtgaccccagggccccctgtacccgccttccactgggaaggctgctggatctcctaggcttggacccaagggattggggtggagaggtggagggatgcagcccgttgaactcgagtactgaagaggcagcagcctgggtcaaaacggactaaccaaacggtgaagggagtgggtgagagaggtctgcgtcagccccttgctgtggcctgtgtcctgtgcagctgtacgagtacacctgggttcagggcccattgaacgccaatgagacggaccggctcccccggtgtgtgcgttccacggcacgcctggccagggccttgtcccctgcctttgaactgaagcagtggggctctaccgaatactcgacgtggaccgagagccgctggaaagacatccgcgcccggatatttctgatagccagcaaagagctggaggtgagatggggagggtgggtggcagaggtctctttgacctctctctattgcctcttgtctcttacccctgctagctcccatttgcccccaaaacctgctgcacgtctgtccctggtcagccagcatgcaccgttaggaagcttgtccccacggacagtttgcgtatgtgttcgtcctggccgtgtgcacccatggagacccaaggggacagtatgagcccttccccagctccactgctgcccggcatacccacctaccggagctagaacgttgctctaatgcctactgagcaccggtcacaatcacgttattggccaccagagaatcaaggtcatggccctgccttcaggatgcttaaaatctaagtaaaaaatgaaaagcaaggacagaggtattttactcctctttccaaatggggaggctgagtccccagactggggagatgttgcctgtcatggttcagtacttggtgattagagccagctccaggattctagtgccctgcctccccgccccgagcagttaccacagctgcctggagttctgagaacacctttctcctcccctgcccacgccctcctgcagtttatcaccctgatagtgggcttcggcatccttgtcttctctctcatcgtcacctactgcatcaatgccaaagccgatgtccttttcatcactccccgggaaccaggatctgtgtcttactgaagaggaccccagcttttccctccagctctgcagttcgcttcctagatcatctgtcccactgggacataaaccactagtttgtcatggaacctctctgggcctggctcagacttgacgttgacataaagcggaactgcccaaaagagaccgtgagagataatcgagtcacccaccgcccgcatctcccttttcctgtctgctcttccctgttccttcttccttgcccctgcctgatcctgggatgatgaatagaagcctcctgctcctgtctgactcctgccccatggtggttcagagctgcctgccctaacttccccttcttcagcgtctgttttctctctccttcctgcttgtacctccccatgctccctgctcccccctctcccttcctgaccaggaaggacatgaagggttgaatgccaggaacaa

SEQ ID NO: 45000 - DNA, 1304 bp, Bovine  19866880827062
gtaccttggggagtctttttcccgggaaaaggagacgggaaggggctatcatagtcagctgggactcagaatgggaccatggtttaacctggcttgccaggggcctctgtccctgccgcctctggtgtgagagactgagggggttcatctgtgatcctgccctggctctcgccccagccccaccccttccccagctctccatttcttgcttatgaaatatgcatggagaacagatgtcccttgctcccccactccccgcccccctcagggccagcccccgcccccagctcccaagggggttcccagatctctctgccaatggctgcctggcctgactgtttaatattgatgagaaaggggggctgggccagccaatggagagctgggggtgtgtgtgtgtatctccatatatatacatagggctgggccagctcaggtgtgtgtctgtgagtgtgtgtgtgcatgtgagtgtgggtggccccagtacctggctaagcttaccacctgggccctctatccccaacatgtgtacccctctcatctgccccggagcctgtacagccatgccacgctgccctggagaggtctagaaagctggtcagtaactttgcagacggatgagctctgagcagccagaggagactggggctgtcagcgctggccccctgtcctgccagtttggatcccctcacagggtcctcctaggtaaagggggaaccatgggctgggaaggctgggcgtgtccctcccactctctggctcaagtcccctcccagagcctccctctagttctgtctcgtgctgtgtctctctgcatccctggacctccctcttacccacttctccccttggactctttgtgcctatcattctcagtggggctggggatggcagaagcggggcaggaagtccttccccggatgcttggaattgcagatcttcggagcctggaactttgagagcagaagtggattttggggcgaggactgacttgatgggtaaatagacgctgctgtgcagattggagttggggaggacagtggggcaggtggaaatgggactggggtcagattggaagcagatggagtgggctgggggaaggaagggtaaagtgatcagggatgaaggaatgtgggggccagggagagggggaaccgggctgtgactggtgtggagaacccggcactgaactcctggagcatggagtggggagttgcagcattaacacatactgggaggtgctgacttcagggcctcctacgctgtcgcctaaatttcagcactcaccttcttctgttttgtgt

SEQ ID NO: 45001 - DNA, 718 bp, Bovine  19866880937293
tggccaattaaaaaggaatctgaaaaaattaccaggaaaacacgttcaagagtaaaatgcaaagaagaggacactaacatacaacttatttaaagctgtatcaatgatgtgtaaagaaaaattttttagtgtctatcttgtgctaggcataatgtaagacctttatatgactttcctcacacaatactgacaaggactctaggacataagctgtattattccacttatagagaggcgaaaattaagaaaggactcagaaaagtttaagtgacttgcccaaggtcacatggctaataaatcttagtacagtatttaaacccagacctatcaagttctaaagactgtatttttcttttattttattgatacacacacatactgccaatgaccttatttcagctcctaataagcaatttctacacagaacaccatgtggaataaaactcaccagtgtcacactcaacctcttcctactacaaatcataaacatattaagaatcagccagggtctaccttccagagccactcaactcttccatcacattccatgaaactcaaccatagtactattctctgctaccaggaatccaaaatctttacaaaaattacatttaccactagtatgtcctaactccctctgtggcactggcccatgctgctgaatgcataggatgattcctctgctaaataagaattcttcagaccagatataaaagag

SEQ ID NO: 45002 - DNA, 906 bp, Bovine  19866880969467
cagctttctcccctctctccccagtgggtttaaaaggtaacatgattctcgctcaggtagcacttaaaccttcaattgcctactggctcacctaccattctattttcagtgcctcaaatggcacctggcactcaataagccctgcataagctttggtgaaggaatgaacgcatgaacagaacactgtcactgcttccctggagaagagcccacatccagccactggctagagagataagtacctctagtacatgcttcaccactgcatccgtagttccaaacagatcaacccccgtaattcctctcacatccgactccactgcaccaggggacaggttttttttccttagacctttgaaggggtgaggagtgggatgaaagatgtaaacataatgttaccaaaaagagcacagtaattgaagcacccaaaggtacagtgatacaccaaaattaaggaaaaagaagggaaaaagaaatttaaggagactgaagaaagacgcaagagctcttatgtatctcaaatataaaacagtttatttggtggatgatattgtaaaactataaactgcaaaaagtgtactcttatttccttcttgactcttgggcagtggacaaaatgattaaaactctcattattcctttaaacacttgctcaagagactggttatagatctgaatatatgtattttgtcattaaaattttcagaggctacagggagaaaccagcctgtaatttgaaaacaacagaaaaaagacaccaggataaggtcagtcttatgtgtataggaccaacacctatggctcaacaacaatctgtctttaaaatctgaattatctgtgctatagtcagaacccaaattacgataacacgaactaccttacaggtgaaaagcatcttgcagtttt

SEQ ID NO: 45003 - DNA, 1351 bp, Bovine  19866880984626
ctcagtttccatggggagaattccatctaggagcctagatccccaatttcatagcttgaagtcccaagaggtttgctgttctgagtgctggttttctccatctgtacaaaagggagaagagggaaatgctgacgtaaaggcactgctcaggaattccagtcccacaggaagcctttagagagacaccttagatttccctggttctggggtattctggggtagcaggatcttgccctttgctgagtccctcacctctgttccagtcactccatttggaagccctcttaactcagaaaaaatagcaagtgggaatgtaggtatccgcattgattttgattataggcttgaagcggcattcaggctcatgtgacctgccttccttgttcctagttaagccttcatttctcctttaccccagtaacttcaccttggcttatatgtagtggtgtcactttcactggtgtcatatgctatagttacttagaatactgcagacaactcttccactggctcatggagtcctaggttttaaattacatactaaccaaactagtaataaccaatcaacttgtctagagagtttactatgagatgtctcaatccaggagtccctgattaatccttcaaatctactacttcccagtgtattttcttctgtttcctcccattctccttctaatcctggtgcagacatgctggctccctgcttctcacttgcttctccatccccttttcccctcctcctctttcctcactcattttcttccttttcttctctctccttccatctttggtccttgaggaagtcaaagtccttctgtcttattctccagggcacttggtttatcttgacattcaaactgaaactgacctgtgcattgagttcccttatgaccttcctacttgtccagcttacagatgactcatagaatcagcttttaattcttattcatgaatgcatttgcattccattttgacatcccaatatttcctcccactcgtcacttgttatcattatcatccctttctccccagacatctgggttcaaatttatctttcctggttagcttcctgcctattaactcagctattagacagaaacacttccaaaaaatttgattcacccagagaccccaaagctgtcctgattgtggtggaaacaaggactttcagatagtaacaacactgaaccaggttccccaaactgaaagtcctgtcaaaggtcaggacctaccttccctctttgcatatttgagagaagcatgctggggcacagggaacatgagtatcactagagcactacaaatgcttgtacaggtggcacactgtgaaggtctgctgagggaacca

SEQ ID NO: 45004 - DNA, 1229 bp, Bovine  19866881060901
tccattttctgaattctgtataatgtggttttaccaattaaaaggatagtaagaataatccagaggaaaaattttaaatgacagaagcaaggaaacggaagaggtttctaagctgctttctgaatggtttcaaaagacaagaaagagcacagaggcacagatgtaaacacagagaaagagagagaaaaaaaatccaacacagtccttgtggtccagtgggggaactgaggcagcagcaggacctggacaggctctttgcagctctcagcccaacctgcccaccacaagatcactacaacctgtgaggagagagggctggagaggaggagggagaagaggcacctttctgggacagcccaggcttgccctgctccagttcatcctgtcacccaagacagcctcccagagccaggagagctttttcactcactcccccaagaaggccccagaagcctggcagtggtgacaagaccctgaagagcaatgggagggaaggggagcagcggggaggggagggaatgacggaagggagaggagagactgcctggagcgggctgacagagggagaggaggaagagcaagcaggactggggagccagggagggactggggcagagaagtggggtgaggggtgggcacagggccaggggcggcagtgacagcggctcccagcgcttcctgcctcccactcgccctccctcgcgctctttcatgatcttgaaacaaccttcaagtctgggctggaggccccaggaggccagtcacttaggaaacaaaactgtttcttggagaccttgaaagcccatctgcagttgagccggtgtccccaccccctccccgtgcacacacacattctcccatggactctcacgtacacccacccgactccacacgtgctccgccccagccacacacgcacagcaggaacaccggggacggggtgttgccacgctgacgacaccttctcctcaggagttcactcggctccttcccacaggctcttccccacacacagcagccctccgtcacggactagcacacgtctgcacccacgcaagaatataccctcctctgcctgtctcctgtctcgctctcacgcacacacctccacccagaccctcccatactaacagaacacttgattcaggaccacacagcctctccttcgtgggtctgctttctgatttaagactttcagatccagcccccagcccatttcccctggactt

SEQ ID NO: 45005 - DNA, 1145 bp, Bovine  19866881078736
ccatctcccgctccaggaaatgggaccagtcctatgcaaatacgttcttgcccaggagtttcgtttcttctccctgggctcctggcacagtggcaccaacgtgagtggctgtttggcaggacagagaagggcgggctagcagtcctgaggctcaggtgacagggctaggcccaggagacagggatgctgacggggctctagctaccctcctgatgccaatctcaggctgaaaactcgatatttccacttagaacaagaaacacaggggagaaggctagaagaggagggcagtgtaccaggagtgccccctgcaggtctcactaggtggcactagatcaggcgaaggtggcgctgggtgggcggggatttcaggagccgcctgggtggaggataatgagaaggaagaccatagctagcatcttccaggtggcgccagtggtaaagaacccgcctgccaatgcaggagactaaagaacgcaggtttttccctgggtcaggaagatcccctggaggagggcatggcaaccaactccagtattcttgcctggagaatccccatgaaccaagaagcctggtgggctacagtccatggggtcgaaaagagtcggacatgactgagcgactaagcacagcacaggggactacgatcccacaagctgagttggtggccaaaaaaaaagagaatactttcacgttctggtttttatgtaacagtgtgcctacatgcatgtttacatgtatgaacatagtaactgcttatattgctttgccatagatgttgcattaccaagggagtgacaagatgtgtgagtgtgaccacttctctgccaatatccaactctgtgacattcaggaaaccatttaacctttctcacttttagttttctcatccataaatagagaaaatagtacttatctcatagggtatcacccagggtttttaaatgaggtgtgtctagctcagagctgatactcaaagaatccttaatagtagtgtcagtattcagagaaggcaatggcaccccactccagtactcttgcctggaaaatcccatggacagaggagcctggtgggctgcagtaccatggggtcgctaagagtcggacacgactgagcgacttcactttcacttttcactttcatg

SEQ ID NO: 45006 - DNA, 876 bp, Bovine  19866881081469
cttcaattacttctctcactctcctctctacacacccgaggcttgaacttggatctgttttctccttgttgtttcctcccactacctgatctccccaggtccaaagtcaaggtcggtggaggggccggtgcagagaagggagttgcccccttccactcacccttcctgctgtaacccaggaagagaaggagggcagatgctgggcatgacctaccggatccctgtaatggaaaatcccaaccgctggcccggagggggtcagttatttggggaattcaaacatgaaccctgtgctctgagagtggacttgctggaggagaggtcgataatccctctgtggggcgttccctctggggccagcaaggaccagtcccgccagcagacacctcaggcatcgggctggagggccccactcccgcccttctctcctaacttcctttgacgcttattcgccagggctcagacctgaccccagcgcactggcttccctccaccaggagaaccctgtcctctggcagcctccacgtgaaggcaggactttttttctttctgtgccccttccagtttccctttcctcctttggcccccagttctttggctcttttgacagatgagcagcgacaccacggcgtcctgtcttggtcacctcccctacccctgtttctggctggtgtcagcaaccagagccctcccccctccccaggcactgcctcagtttctcccaggcttccctgcagagaggtccctgtgtgctacctgccatcctgcctgctgcagactctccttcctttcccctccacccgccccccaataaggaagcagctgccctcctttctagttcacaagtctggtacttgttagcatgcgacctccaca

SEQ ID NO: 45007 - DNA, 894 bp, Bovine  19866881126311
ttaataaaactggagacagttcaatctcccaggtatcttggctttctccccagcacccactttcctagaaaggctagtctcagtgcttacaatagtatttccagacccagtttgtattgtgaaataactggatttttttcactttcagtgaaaaaggaaacaaacaaactaactaactaataaaaagcccatacttgattaagaactgtaagatgtaataggtttgctgtgaggagtctctttcagataagctcctgatctctttgagaacaaggaccaaacctcattcatagccacatgaatgtcacataaaagtcactaagttagtactagtttccttcccttctaactttccttctctttctctattccacatgcacatgtgtgtgctaactcacttcagtcgtgtccgagtctgtgcaaccctatggaccatagcccgccgggcacctctgtccacaggattctccaggcaagaatactgaaatgggttgccatgccctgctccaggggatcttcccaatccagggattggcccacgtctctttgtctcctgcattggccagagggttctctaccactaacaccacctgagaagcccctctgttcctcacctatccccaagctttactagtccctatgcgtccaatctttatcaagtgtgagcttcctcagatcccatcctattatcaccaattttaaaagttgcctataattaaaccagtggttctcaaccgtgactgcagattttaatcaccagggaagctctgaaaacataccaatacccaggacccatgccagactaattaaaccagaaacttccaggttgtagcccagctatcagcacttttgtgtgtgtgtaacactggatatttgttgctgcacaagggcttt

SEQ ID NO: 45008 - DNA, 1505 bp, Bovine  19866881132435
ctctctatttctgttgtttatttccctctcgcctctccttttttcttcccaccgcaccccgcccatttcagccctttccttttcacttcccctccccacttcagtcctgttgccaaccctgttgcaatacctgtgatgagacattgggatcccttctcatttgaaacagctgtttcccagagttgaagcctctgtccttctcttctgggcctggatgagctccctttgcccctctgtggtgtctgtcagtctgtcttctctttcttctgccttccccacggggcagcatctgctgatggagttggtcctggtgtgtgattgttgtgatttgttcttttgtgtgtgcaaggaagggggctttttgagttccttccaagtgagattgtaaatgtagaattttccactgttggatctagatttttttcccccctttttttgggttacagagctgagaccttgtgcatgcatgtagaaagttgtaaaatgtaaattcttttttttttaatatataaaaagcttgtttttacagtttgcagtggatctaaacattatggcaattttaggttttttttttttttcttaaacataggaattaaaactgtacaaatttttttttatatataaaataaaggcatttgacttttgtgggggcattctgttgtttttttttcctcttctttttttttttttaacaggagtgaaaggggcctgagaaggtcagggagtgaatgtatgttccttgttagggagtgcgtgggccaggagggggcagtgtgagctcgtcactgctccacccttctcagggtgaatgaaaaaggaagctgcttattctgaactctgatactgagaagagaaacacttgggaacgtgaagacttagctgttctctggggtggttgtcaagataaggaggagggaaagattcctttctgggtagattcatgggaatttcagagaacagttgatgatttcattcgatagtgacagcctctcacatgttactaagacacattcctgaagtgtatctcgtatttctaaggattgctttatttctaccagtatctctctaatctttcagatactgtacaaaagaatattccagcaggagtcatttatttaaaatgggaattttcagttgacactgtgcttgtaatcaagccctggaattattgttgagagatgaggggctttctctcagctctacccagacccaagcttctctgtgactttggccaaaatgcttagcacagaaaattctttgtaaggttaaaaataaacaaaccaacaaatgtaaacatccctgtgtgaagttaacccatttactactagattttgtcctcttctcccctgccccctccttttccatgctctgaggatgcaaagaccagagtcttgtccttgtcctggaggaagatctgagttacagggaggtgacaagccagataacctaacacaagactgtgtggtctgttctcaagcagagcacaggttagccctagcaggttt

SEQ ID NO: 45009 - DNA, 1064 bp, Bovine  19866881204705
tcatccaaataatcttggtatgttttgcagaggtaatgaaagtgccaagttggctgactttaaaataaggagattactctccagctggtggcagaagtcagagacctggtcttgctggcctcaaggaaaactgcctatgggtccaggtgaccaggaattgattctgcctagcaaccagtgagcttggaaggggactcgggctaaaactagatttgctctcgatttcagcccgtgaaccctgagtggaggagggttcagctcacctgcgcctgactctcaggactgcaagacaataagtgtgagttgcttcacagcgcccagttcatggtgacttgttaaggcagcaacagaaaacgaacgcacacatcacatccacatcatcatcggttacagaagctaggtggtcctcctctccccagcctccccagcagccccccagccccactcctccccaagacccacctggccctccgcttgcgcaccctccgctcatgctcggcctcctcgtagtagtactcattgtggctgttgtcccgcctgcgggccgccgctgcgatcacagctcgggactgacccgtggagttgttggtactgttttctgcgcagaagcaggagagagagaggctggtcccttcagagcgccgccttgattcccactccaggaaggctggggccagccccccgacatgtccagaggaagccgtgtccacccccagaaacacccccctttcccatccctcctggccacaacgtctgggcgaggcccacaggaaggccgccaggagggcaccagagagcaggagtcccgcacgggcttctccccagggcgggaggttcgggcctccgagagtgagggctgaggagcagacacagcggaaccagagcaagggacacaccgtagcataaagggaaagacagcagactcagcagctaaaaccagccacctggtgtggagggagaggacagaacaggaggggctgggacacagtccgaggaaggagaaagcacgggaagatgggagaaagaggaacgggaggcaggaacttgggagtcctgcttgggag

SEQ ID NO: 45010 - DNA, 1307 bp, Bovine  19866881374432
cacacacacagcagatcagaaccaccacttcaaacacagccaggagggaagctgatgccattgtgcttcccctacagataaatttcaaaccagacagggtgccaatcccctcccaaccctttgttctaaactgttccagcctagagctccctaccttcctcccagctgctgattaaaggcccaacataaacctggctcccctggcctgcttctcccacccctaccaacccagctcaaggtactcggaaagcacccaaacatgccgctccctcccctaccaaacagagaggccaaaaatgaacccagtttctgagacctttgcctgctgtctcatggagcaccccaggaatctaacccaagcactggagaggcgatggggagggaccttaaggtgagaaacgagaagggcagaagttccccttgtttaatcggacccaggaatcaggggtttggagggtctcccgggtgggcagcattcccagggaagagggtgggggagaggatcactggatgggatcaacaagtggaaatatgggaggcatgacggaccgggagggaagtccggacttcgtccagggcagggagggccctggtttaaagggtgggaggctgtaaaagggaatgtgttccgttgcttttcaccatgcccccaaccccacctcaggcacaagaacacagagactcggtcccctgctcaagccaaccgtggattatctggggttaaaaacaggccagagaggagtgagcaaaggaagagaaagtctgtcacaaaaagcagatccttctcccctccaaaggcctttcagaaataaaattaatggaatgtgtctcagtaccatcccatgaggattggggtgaggaccaggggggagaaatgtgggggcttttgtccccgctgcccagcttctcccacattgatcaccatggcaaccaaagccccctgttgcctaggtgatggcagccaggtcctggaacccatacccagcatccaaagcgagagaggttatggaggtgggggggtagggacagagcgggagagaatggggtttctcctctggcggccccagcttttgtataagctctgggatcaggtttcttcaggaaacaatcagaggcctttggaaaaaatacactcagaacctggcaacaggcagagggagtaaggccctgggtagactgggaggcatgggagggcttggtgttggccaaaaggcagaccaagactagacccttccccactgccccacctggaggagcagcctaggggatgagacctggacacagacccggcagctcggccaggcgcg

SEQ ID NO: 45011 - DNA, 802 bp, Bovine  19866881445936
tagaattcaaggacagtatattgtacagaaactaaccactaacattcactagaaaaatgattaaataattatttcaaaagatgttagaaggttatcagtgaaatttaatgtttattcctgattaagatgtttgaggaaaaagcattaaggaaaatataattatgttcagagaagcagggaaggatgtatgaatctagaaaactataataataacaattataacaaaagcaatagcagcaacatttgaaatcttggataagaagtttgtatttatatggtctaagtaaagggacaagctggaagaaataaaaacatagttttttgataatgaatatggttaaatacctaaaagtatccaaggaagtcaaccaaaagaaagctatagcaacaacaaaaaagtcctataagcaatgacttcaaaattataggtacaagacattggttttttaaaaataaaatttatctctgtgtattagaaaatacagtaaaagagctctctatttacaacagaaccaaaacaaattacattcaagacttagcgtttgtgacataaggtacttattaaagaaaatctaaaaacacaatgagaataattttaaaaaaaccataaatgcatggaaggctaaacttgactgttgtttgggaagacggaatatagtaaaggtaaaaataagttgctataaagagccaatatcataccaattaaaagcctcactgtctttttataaaacatgacatgtgggttgtgacattcagctgcaagagtcatcaggtaagaatatcagagggtttttttaataag

SEQ ID NO: 45012 - DNA, 1010 bp, Bovine  19866881663685
ttcctacatagagaaaactgtcactggtcaaaaacaagggtctctgagtggttattacattctgctctctttacgtttcgtttgtacaagtgaggggctcctactctgaaaaatctccagattccacagttctccagagatagccaattttattgcctaatcgccttcaccgtcaaggtcttcgtctttgttggcactttaatctaaatatctcctgttgcctgcatgtttctcattttgtcctcggcagctgaagagtttcctgagccccaggaatagtggttacccttctgctggaatccagcgttcccaaacccccccatcctctaacccagggcttctcaatttgcacccccaggactcatctggcagcatctgagttgagaccgagatgggaggggttgctactggcacctaatagccagagagcagggtgctgccagacatcctggcactcagaggacagccctccttcccctaccagcaagaacgctgcccaggtgtcagtggcgctctgcctggagccccctccctgctttgctggctggagccagtctgacccctgctggctggcacaggccataacagtggggcttctgggccctaagtcaggaggcaaacttcacacacaggatgtagaacactcaggcatgcggcttgaaatgaaggaccccacaaagttctttgcttacaataattcttcttaccttaccacaatgactgaaattcctaccattaaagttacagtcagaatcacccagaaaagcaacatattatagagatagctcttattttttaatcagaaagactcgtgcctgaaagttcaacttttcaacgtactagctgtttgctctggggcaagttcagatttctaaagtcagcaccctctcttgggatgctgagggagaagttagggcttacttcaggagaagaatgaattagcaaggctgaataattttcttctcttctatgctattttcagctcatagagcacagtccattcactacat

SEQ ID NO: 45013 - DNA, 821 bp, Bovine  19866881741820
actgttagaagcctcgttatataggaagggtgtttggaaatcatcaggaaggcactaatgccgtgctcggaggcatataatataagaacagaaagaggctcttgaaccagactactgagtttaaatcttggcccaaacccttaactagctgtgtgattatgggcaagtttatttaacttctgtctttcagtttatttgcctttaatttaggactgataacgtacagggttatgaagattaaataacaatagaagctaagcagttagaaccgtgcctggtacttaataaatcattgatagataaagttagcatttttattctctggaagttttacttagcagcacatccatcatatagtactagacctttatccctaagcatgttctctttcctttcccagtatcccctctggtttcctttatctttgtagcaaatttttgttgacttcttgaatcaaggaagattcttctctgtttttcccttacctttctttcttactgggttagtcctagttcacctgagtacttaacctaaaccagttcaaccttccagaatcaacagaaatgctctcatattagaaattctttctcttctcctttaaccctcggaagaaattgaacttgagccagctgtatgagagcaggaggtctaagtttccagctgttgtatagcaaaaggggatgatttgggattgtcatcatgtttttacctctcggattcactccttcaatttctcttggcctggtttttttaattaacatccaggccaagttccttcctaacagtggtgattccaccctggccatgtgtgcccgtgatgg

SEQ ID NO: 45014 - DNA, 733 bp, Bovine  19866882078847
gacaaggtggggctgggcactgtgggagcaggtgttgacacctggacccgagtctcccaaactttaagcctctagctgacccctcgcagccttagacagcttgctttttagactctgccagtagctctgacacggcgccctcaccttgcagccgtgagaagagatgatccggaggtcagcgggcacgcggtccccacccttcacctccaccaggtcgcccaccaccacctcctccgcgttgatctgcatcttctctccttctcgcaccacaagggcttgctgcagggaagttgtgctcatctctaccccgaccttcctcttgcacccgtctcccccctcacctccaatcccatcaaggagaaggacaaacccggcacccttagaaacaagataggtcccagtgtggagaactggagggtcttttctgcccaagcctccttctctgagcacaaggagttgagaagagctaagccagactctcccagaaacctaacgccccagcccccagcccagcccccagccatctacctgaggcaccatgttcttgaaggaatccatgatcttggagctcttggcctcctggtagtaggagaagcagccagtgacgatgaccacagctgccagcaccacgcccagataaagctggtaaggacaaaggctttgagggacctgacttttcccagccctagagggacagctgccactcagggtgagagtttagtgcccctttgtt

SEQ ID NO: 45015 - DNA, 1416 bp, Bovine  19866880124944
cgtgtccgactctgtgtgaccccatagacagcagcccaccaggctcccctgtccctgggattctccaggcaagaatactggagtgggttgccatttccttctccaatgcatgaaggtgaaaagtgaaagtgaagtcgctcagtagtgtccaactctgagcgaccccatggactgcagcctaccgggctcctccatccatgggattttccaggcaagagtactagagtggggtgccatcgccttctccatatgtttccctaaaaactgaattctagacttttcacacatgtcctgggttggaaaggtattttacggagtctcttttttatgataggaaggcaagtgtaatactcactttctgaattacccctttacagtcatgagacaaggccaggtttgaaagaatcatgaacactgcctgctgaacagccgtgttctctggaggcacctgggaagccatcttcaggatacacagcatcagggagctgccgggggcccctcggtgtgcggcttgaacaggatgctgtccataacttgaccaacagagggaactgcaaccttcaaaaacagcagccgttacaaggtggctcagcttcacactttggttcaaccacctgagtggtgagctcatccgtctgtggaaggactcggtcattaacctgtcaactgcaattgccctaaaggctggtgctggtgacctaatggactgagggcctggcgatctcaatacagcactgaaagcactgtggctcctgcctccattttacagaaggaaaaaatcaaggaataccataatctggggcgggggcagggggaggacaaacgccaccaggacgggaggctccagagcggagggcgaggtcagactctgaggagtaagccaccctcagcacagcagtgatgagatgggctgtgtactgtccccagttctggtcccttctgtcttttgatatttggaaaagccaactgctgagctgctgaatgttgctagacttgctggttaaacctcaactctgtgcccctaagtttacatgggaaaggcatactgcccacaggcccccactttcctttcttttgctcagagagtgtttttcacagcttctcctcccttcccaagtcgtcgcctgcctgcctttctcactctcagctgtcggccactaacaacagggcccatgggaggcgctcaataaaacgcctgtcagaggcattagaaaaagaggcaccccagtgacatcaactgtcaccaagccacccgacgccaggaccacctgtcatcacaccagtctcctgctctagaatctgtaacagcttaacctatacctggtttttaaggtcttccatcacacttttccctctcccaattctattaaatccagtgttctcctgcggtatcatcaggacagtttctccctctgt

SEQ ID NO: 45016 - DNA, 2610 bp, Bovine  19866880245003
tactcaaactcatatccattgagtcagtgatgccatccaacatctcatcctctgtcatcccccttctcctcccaccttcaatctttcccagcatcaagggtcttttcaaatgagtcagctctttgcatcaggtggccaaagtattggagtttcagcttcagcctcagtccttccaatgaatattcaggactgatttcctttaggatggactggttggatctccttgcagtccaagggactctcacgagtgttctttaataccacagttcaaaagcatcaattcttcagcactcagctttcttcagagtcagacacgactgaagtgacttagcagcagcagcagctttctttatagtacaactctcacatccatacatgactactggaaaaaccatagccttaactagacagacctttgttggcaaagtaatgtctcttgacttaggcaatggtttcttagatatgaaaccacaagtgcaagcaaccaaggaaaaaataaactagacttcaccacttcctttttataaaatatcataagcttaggcatttgaccttccaagtaaataaatgtggacctctgtaaagtcccagctgttatagttgatggtttttgtatagttgaatgattttcatccctttcttctaagtatacttctgtcaatcaagagacagaaaggacatgatttttaacgtagtttaacggaaagaatcataaactatggggacttccctggtggtccagtggttaagaccctgtgcttccactgcagggggcgcaggttcgatccctggtcagggaactatgatcctttgagcttcacagtgaggctgaaagaaaggaaggggaagaaaggaaggaagagactattattcactgtgtctgaagtgctgaaaaggtaaaaaggagaacactaacccaccaccacagtaacaactgcagggtgttccctcctctttgaggaactaaaaagaaacttggaaggagggggtcccttagagctgacgccctgaagagggtttgttcctcagcactgggattgagacttctgcaagctggctgatgctggtgcgtcttgaggacgtactttgaggctagcccttcacgggttagaaaaactgcagactggttcaccttctgctgttgttgctgcagtggcaacagagtaagaggagcagactggaccctcaggaaggggggtcctcgtcccagcctgccagcctctctccagcgccccccgccccgccacaggcaggatccccagggaaccaatagatggagctgacacatgggttgcagagaccccaaccccatgtcaggaagccttgtagagagggtgctttggcactgagagccaatgactctgtaactagtaccactgttacagagtcattgtaatctgttacaatctgtccgctgtggttagataatttgttatatgttattaattttattccttggagaaggtaataggaacccactccagtgtttttgcctagaaaatcccatggacagaggagcctggcaaggtatacagttcatgagggtcgcgaacagtcagacacgactgacggactgagcacaatattattatttaaaaacacatggcaattcctccctgacatcagagctgcatgtgtactgaagtgatgagggccaatctttatttctatgtgtgataaactggtattctagtgtaggtgaagcctaagaataggtccccaaaggagtaatatattttttctctcttgaatagggaaactatcatgaattgtcagttaatggtgaattctttatcctcctgaatatttaatttataacccatttttacttccaggctttcagaaaggtttattattggtggctcttgtagaatataatggtaaaatacttctaagcattaaaccactagtaactgctccattttctgcaaatctataaagggtagctctccattgctgtgtgaatgtttctctatcccatgggctattacctctggctgtcaattctttccttgatgccatccttcgactgaaatgcttagactgtgtttcaaaaggaattccattcaaggtatattattacactggttatgtttagttacttctgtagcataaagctcagtttaatgatcgaggaaactatatcagtatcattaatcacagatttgcagcttgagggacttcccaggtggtgctagtgctgaaaaacctgcctgcctacgcaggagatgcaagagatgtgggtttgaaccctggatccgagagattcccctggaggagggcgtggcaccccaccccagtattcttgcctggagaatccctggacccaggaggagcctggctggctacagtccgtagggtcacacagagtcggacacgactgaagtgacttagtacacacgcacccatgtagcttgaattgtttttaactagcagtagaaattcaagactatattgaaattttaataattaatcagaaatatgcaatgttaatgaagccccatatactctgtatgagttctttaacacagaagaatatgcatcatattgtttaaatgagaccacagagttggtggaaaaaccccacaatccatcgaggtaacaccttcc

SEQ ID NO: 45017 - DNA, 986 bp, Bovine  19866880346479
tctgtgctaccccatagacggcagcccaccaggctcccccgtccctgggattctccaggcaagaacactggagtgggttgccatttcctcctccaatgcatgaaagtgaaaagtgaaagtgaagtcgctcagtcgtgtccgactcttagcgaccccatggactgcagcctaccaggcccctccgtccatgggattttccaggcaagagtactggagtggggtgccattgccttctccaaatgaaagccttaatgagtcttaaaatagacattgcttcaatagttgtttactgtctgaaatatcaaaatgggtcctgaagattttgaaaaattaggagcaaaattgttactccttttggcccctacagtggactttttgggaacctcatactttaaattttccttatttaccaattattgtttatttttattttcttttcccttcatctttatgccactgtatcttgtttcctccatgacagaattttgaattgctgtttagttgaattattcctgtggcattttgcatggctagttaatcacacatgtattgattgtaccctgttttcctagaacctgtcaggatgttagaagcgggaggtagatcttaaaatacacgggtcctgccttgagctgcagttaatagggagacaagggcacaatcgagccgtcaaggaacatgccactcagaggtaaatagaataaagtctcaggtggtgttgagttgggcattctctccacatttttcctctgaggctgaccttttcggtctgcttgtggagatggttgacttaagcagatgtgaacaggctcagggcctctggatgatccagtttcttgaagctgctttgttagctgttgagaatcttactgtgtatgaccttgacatttactgttgcattctgcgtcttttttagggagaaaagaatctctcagagttagtggagctggcagatcaagccttacgagcttttcctaccatcagca

SEQ ID NO: 45018 - DNA, 949 bp, Bovine  19866880369500
caagaatactggagtgggttgccatttccttctccaggggatcttcccaacccagggattgaacctaggcctcccgcatttctggcagaccctttaacctctgagccaccggggaagcccaggaaaccttaattcctctggaatgggtggctgtgtgtatgtgtgtgtgtgagttgctcagtcatgtccaactttttgggacccctgtagccctccaggcttctctgtccatggaatttccaggaagaatactggagtgggttgccatgccattccccagggggacgggtggctacttaggtctaaaaggacctgagaaatcaggccgatggagagtcacgtggacagtgagaagaatggtaggaatgagcaaagggtttacaagcagagccagggtcttcccagtagaggcaataactgaagtcagagtgggtggtgacatgacatcttggggaaagtacagaggagagagagctgaagaatgtttaaagtaaaactaaaccaaaaacaacaccagacaaaccataaaccatatgtttctaaagggtccttaaaagatcagaagacagatcttagggtgggttcaagttctcagaaatgagaaccagctcatagctgagcagaaataaaagtgaaacataagctctttccacagtgttttcaatttagtgatcatcctatcagttcagttcagttcagtcgctcagtcgtgtccgactctttgcgaccccatgaatcgcagcacgccaggcctccctgtccatcaccaactctcagagttcacccagactcatgtccatcgagtcagtgatgccatccagccatctcatcctctgtcatccccttctcctcctgcccccaatccctcccagcatcagagtcttttccaatgagtcaactcttcgcatgaggtggccaaagtcctggagtttcagctttagcatcattc

SEQ ID NO: 45019 - DNA, 1267 bp, Bovine  19866880456665
tttttaaaatatttttctttgattttgggctgtgtcaggtctcatctgtggctcataggaactttttgtgggaggtgagatcttttctgctggggttcactggcgctcgggtttctcttttgttctgtagcgtgggctctagagttcaggctcagtcgttggcaagtgcacgaagctcagttgccccagtatgtggaatcttcgttccccaaccagggatcgaacccacgtcttctccattgcaaggcagatttttaaatcctggactgccaggggagccctatatccagttaccatctgattctcttttcacattaagatggcttaattggctcatctatgttgaatatcaacaacatgtgtgcaatatttttttttcctgtttgtaaatgagttcttggcaaacacttttatgtttattgatatgctatcagaccctggcaatttgaaactggattagaatacggcgttttgctaaaaagtattttgtattattggcctacgagaaagcacactacagattggctttctgaattagaacaatatcaagaatcgccctccattaaaaacatgacgcccaatttttaagacatttatgtagaattcagaatgtgtttaacttgaaaccaaatggctagatcttaaacaaatggtatcatgaggcaggtgtggggaacaggctatgcccacataagacggagttcagggcagtccaaagatctctgtgtaccttgaattcacaagcagtacatgtcaatgcttccagaaacacagagaagccatctcaacagttactgttaatacacagagactgtgacaatgggcttccccggtgtctcagtggtaaagaatccacctgcaatgcaggagacctgggttccatccctgggttgggaagatcccctggagaagggaacggctacctactccagtattctggcctggagaatcccatggactgtatagttcatgaagtctcatctaatatagatgcacagggacttttatctcaccctagatatattttaaattgtttaaaaataaagtattttgcaaaaaaaatagtttaaatgttattaatttaataacaactttacaactctgcaatagttcttaatccaaatagcttataatgatcacttatattattagagtatactccacattccatcttattaggtgaaaacatatcagaaaatgaaagagaagtgtttgctgcaaggtacaatcaaacattccaccaaaattaaataccttttcctcttga

SEQ ID NO: 45020 - DNA, 1380 bp, Bovine  19866880457039
acagtgcttctagttatattgttattctcttcctggctgtctttcctacttatgagcacatttgattttttggtggctgaatagtgttatgattgaaacagaagcctaatagtgactgtatactgtggcttccctagtcatctctcttttaacagttctaaagacatcaaaaaataagaagagaaataggaatttggggggcattagttaaccagaggattgagcagtatgctattcacctttacccggaagttaacttttttcccttctctctcctgtttgtattcccaggtagtagacagatgataataagagttctggagttgctcgcagaagttgtggtgcttattggtgaagcgatttcagcacatctgtgggatgacagcagtctttttgcaatagatatggtgagactcaaggttttccttgcagcgtgggtaataacatcagtcttttgttttatcttggtcctttcaagctggcttcattgtctcattagcctttgaaatctttctttgttttagatgcaatagatcccaggcttattttgcactgtgtctggaatcggctatttcttcagagattctagttacttttaatgcgtgcgtccatgtaatggaaaccatatcatattttacacttcccatatatcataaatcatttgcttttttatatcttttattttcaaattatcatctgatgagcttgcttttctgggcagaactggtgttctgtttttctattaatgtaaatttgtaacttatgcctcacttttcctttttttttttccttcgtcagagaattggaagtaaaatttattagtcataaaaatatatattgcttcctagagttaccattttttcctctttatgttattttgacctacctagatctgtctacattttattaaactttgctgtaggctgcttgaaatccttgtgcatagatgttaaaacaggaaaacaaaatcctgatgtttactttataccagtatctatgtgtgaagaattcccccaatttttttatatacacaaatctcttgagaagaagaaggatttaaatcttttacaataggtttaataaattgtttcatgtccttcaatttccttgtttataaaatagggattatagttcttaatcttagttttctgatagttcttaaggttatcccactattttgtagtacttttagaagattttcacatattgaagattttcaacaagtgagtttttcctgagaagtgtgaagaatgttttatcagttgcttcttaaaatagcttgaatttcttggccagaacatttatctgtaaaagttagtcattcacttttaacttttggctgctgatcttttatgattcaatgaattatttttactttaa

SEQ ID NO: 45021 - DNA, 2458 bp, Bovine  19866880560761
aagaagagaaagagaatttttcagaatttggagctaggaaaatacttacactacttgcatccacctttgttgtgggtttttaaccagacagcactgttgcaaataaatcttctgaaaagagagcagctccagaaagactgcagctggatggacaccagatgtttttctaacaggcagtttaactggattacataaatcaaatataatgatggtttttaaatctctattttctccaggtctattttactttatgattctatcatctgatttctttggtgacacccaggcttcttgtcttgtttcctgtcttctttttattttataccagctttattctttaatttgaacttgaatcacaatcttctttgtcatctgttctttcctttttctccttttagttctgtctcttctatagtctttctaaaatattttatacacaaatagcttttattagaagtaggactttttattggaacctctaacctaaaagttttctttactttagaatatgatccaaaaggcatctagttgaatggaagcagggatgaaaaaggctgtgattaactaggttaacttaaatgctgatatttgaaaatcagaggtgatgagaagtacaataaatttatttggtgaataatttggcctcttctgccggaattagaataaaatttgagttggctaattaacagttttttgaagtgtattttgcatgaatgtggcatttaggaatgtcagagacataaatattgttatgctagaaagagatgctgtgggtctgtttggttgctgtatacaaacttatttagaattttaattcaacttctgatatgcttgttatagctgttatcattgttgttttgatgctaagtcatgtccaactctcttgcaaccccatggattgttgccccaccaggctcctctgtccatgggatttcccagacgagaatactggagtgggttgcccattttcttctccaggggatcttcctgacccagggaccgaacccatgtcccctgcattggcaggcagagtctttaccactgagccacaggggaagcctagatgacacaatttttagcgtgcatgtagatctgagtttttccggcaacacctcagtggagatttaaggctaggtttgagttgtaaagaagagatggacactttctgcttgaaaatgtcatctgacacaagctgttgtgtcattcgtagaaatacggtccatttctcgggaagccctttttctgcttggatggcatgtttcccttttttctgtcctctttttctgtttagtcaactcctccacattgagactcagcctcagtgacgctgtcctccaggaagtattatgtgactgtttcacccgcccttccccactccagcctcctcctctctgggtctggattagatgcttctctgctcgaaacaccatgagctgctgttgcaagttcatctgtcttggccatgacacagtcagcttcctgaaggctctggaagcctgaagccttctggaagctgatgatgtctcaccagctctggttctcagcataatgtctgagaagtactggcgtttgactagttctcttactcatattcgctgctaaactgggcaattaattgtatcttggttgttgttcaatcgctcagtcgtgtctgactctttgtgaccccatggactgcagcacgccaggcttccctgtcctccactatctcctggagcttactcaaactcatgtccatcgcgtcggtgatgccatccaaccatctcatcctctgtcatccccttctcctcctgccttcaatctttcccagcatcagggtctttttcaatgagtcagttcttcccatcaggtggccaaagtattggagtttcagcttcagcatcagtccttccaataagcattcagagctgactctacaaaaacagagatgtactgtaatatccccgcttgcttggaattgttctggctcataaagaaatgctgtatgttgtgttcttctagtctgcaattttttgatatatacaatatgcgcctgcaatccacctcatgggagagtgaaagagtagtttgatcacagatattatagctactaggatagctcttagaaaataaataattaaaagcaaaatgtggctgtttgaaaacaagaagaaatattgcagttattggatacagtaatttgaaaataaagcactaaattataattgctagtgggagaaagaaatcagattttccctggatatgcagaaaacatccactgtggagtttgtcatgtaagtgttttcagctaaactctcataaaataaagttgattcaatactcataagtcaaaatattttgtaattttaaaaggtggcaatttcttgttgtataaggaataagtccatgcttattgaagcaatgatcagacttgcttcaagtagaataaagttacaagaaggcattaaaaagtatataa

SEQ ID NO: 45022 - DNA, 1140 bp, Bovine  19866880647580
aaaagcatatgttaacatccctttgagttctttagatcagctaaaagatgaatttgccattttaagaagataatattgcaaagatctgtcttcaaagtgaacccatgctggaatacatttttatcttaggaaatttatatattttttaaaggaaatagcaaccaaatttggaaaccaggtgtgtgtacccaatggatcaggtttttcaaagaaccgtgtgctcaaaaaatagagcttttgatttcttaaaatgatctctgaagtcccatcctaaaatacataaatcaacaaattgaattttaatggaaaatcaagggtgtttttcaaaagacagttgaatgcagctttgaaaaatgcgaagacagagaattatcagcttgttataacggcattgacttgacactagagtttttatgtttaagtaagaaaggatatgacatcaaggacaaatgaggaaaacagcttgtttaaaaacataagtggcacagcctaccttccccccacccccacctgtggactttctcatcagctcgttgaaccacctgctggagcaccagctaccagaatcataatcacacattctgcatccagctcatttcagcgtagctgtgcattcgtgctcagtcgcttcagtcatgtccgactctgtgtgaccctgtggactatagtcctccaggcttctctgtccatgggattctccgggcaagaacgctgcagcggattgccatgccctcctctgggggatcttctcaacccagggatcaaacccatgtctcctgtgtctcctacattgcaggtggattctttaccgctgagccaccggggaagctagttgcctctaataaaatagaagatgaggtcagcatgttgtagagcgcattcagtaaaatgttctagaattcctcccatcactttgtaatgtagtgttcaaaatataaacacacatggacatcatgtacatcagatctctgcagagtaatgctgtgagactgttattttattgttcccatgtccacggggaggacctgagatggtggggctggacgggaggctcggttgcagttgatggcaggatattcctcaggtttggatattagctacgagtcacatgtgtgttccacctcactgggctgcaaattt

SEQ ID NO: 45023 - DNA, 1784 bp, Bovine  19866880663595
tgtctctacatatttgggatgcggtgttctcagtgcagtttatggagacagagaacaaacatgatcaaggctaccgctaaagtcagcggtcacactcccagagctccacgcctggagggaaagagcaccttggtacagcatcctgtctcctagcaccagggagagccttccctgggtgaatgttctggaagcacagatatgaagcacagatttttctacagatgctttcatcacagtccccaggtgaacaatgtcctagcctgttaccattcacctgaaccagggagaggggtgtttagaaccagtcttggaacccagccttagtcaggtgccaaaggctacatccatgcctgtgagtcttcctggtggcattctaaactaccaggctcagctctgttcatgtaaaagtgaacagtgtgggtcacgtggctaaaggactgccctgtgttagattcaggtcctggctgagtctagtgagtcaactgatcctaccctggctgctcactcaggtttttcattcagatcctgtccaagctcctggcagttcctagagcattcataacattttcatcccagaaatcttttcccagtaggacatgtttccaccgttgattgcttagttccaaacttagatgtaaattgctcattctcattgcttctgttgtatctgactctttgtgaccccatggactgtaacccactggagtgggttgccatgctcacctctgggggatcttccagacccagggatcaaaccctcgactccttcattgcaggaagattctttactgctaagctactggggaagttctgtatgtaaatttcaaaaatctttaatctcagacagtggtctggaggacccgaggcttctaaaatttgcccatgaatcctgctctttatagttcctcctggcaggtaaaataaagtgtaaaaatgtaaatttcacattgtgagattgcccactgtgttgtttctctaatttaaagtggcttaatgtatgagatgaaggagatgtaacacttcacttaacgctttttcagagtagttgcagaacgaacatcatcgtaagactatccatgagaaagaagctgacctattttttgaaatcttgcagaaatcttgaatgttccaggcaaacagggagtcagaaacagtgaggcttaaaaaaatatcattggctgaaaaaagatatttgttgttgttcagttgccaagtcatgtctgactctttgtgactctatggactgcagcacatcaggctttcctgtccctcaccatggcctggagtttgctgaagttcatgtcccttgaatcagtgatgtcattcaaccatctcatcctctgttgccctcttttccttctgccttctgtctttcccagcatcaggatcttttccaatgagtcggcttttcgcatcaggtggccaaaatattggagtttcagcttcagcatcaggccttccaatgaatattcaggactgatttccttttggattaactggtttgatctccttgttgtcctagggactctcaagggtcttctctagcaccacagtttgaaagcattaattcttcagtgcttaaccttctttatggtccagctctcaacatctgtacataattactggaaagaccatcagatcagatcagatcagatcagtcgctcagtggtgtccgactctttgcgaccccatgaattgcagcacgccaggcctgcctgtccatcaccaactcctggagttcactgagacttatgtccatcgagtcaatgatgccatccagccat

SEQ ID NO: 45024 - DNA, 1903 bp, Bovine  19866880687326
tgcagatgaatgttcataacacccccaattcaccacagtgaaaggaggactcagtgtctaccagcaggtgaacagataagcagaacatggcatatccgtccatggactatcatttagtcgctgtcatctgctacaacgtgcacagaccttggaaacatgatgctaaatgaaaaggtcacgtattgtctgactccagttatatgaaatgtccagaatacacaaattcatagagaaagaagattaattaatggctaccaggggtctgggtaagggtgaatggggacagactgctctgggggtaatgaaaatgttctggaattaaccagtgatagttgcacactggatatatatcaaaacccactcaattgtatactttaaaattaaaattatgaatttaaaattatggttaaaattatgaatgtaaaatttttaagtcagagctatagacatacatttgaaaatcatcagtgcaaaaagttgtaaagtcatagaaatgggtatgactgttcagtcagatgtgtagaaaagtaagagagaactaagacctaagtaaaagtcaaagtgttaatcccttaattgtgtccaactcttttgtgtgtgtgtgtgtccaactctttgcaaccccgtggactatagcccgccaggctcctctgtccatggaattctccagacaagaagactagagtgggttgccattctcttctccagatcttcctggatctccaagaatcaaacccgggtctcctgcattgcagacggcttctttaccatctcagccaccaggaaagccccaagaactaagccaagagacaacaaaatagtgcgcgcgcgtgtgtgtgaaattacaatcaggactgatataaaaacagaccacaacaactgatttttactgaaatctttcctcctcttaatttgaaacaagtgaaaagactctttggaaatcaaaagaaaactaggttctacataaatgtccccaaacctccaacgatcccaatggtacctgtcagtaacagcctcaaaactgagcagcaaggtactaaagagagcaatcagctctttctggagctgctgcctgaccgcagtgcggacatcatctgtttcctctcgtgtctgggactccgtcagaaccagcaggtccaacagtggatttggactctaaaaaatgaagtttgtaaaacatgtatttactctctaaagctatatgttgttcccctaaaatgttggggtttttttgttgttaatcatgttctggagaaactaagacttaataatttaacataacacttaataatttaactcttgcagcatgatattagagagtaaattctccttgagttactttgctcatgtttaaaagtattattatttataacactagggatgataatatataagacaagataaaaagctttctaaagcagctttaataccatacaaagtcaaacaaataccaaaaatccttttctaaaactgcattaacattacagtaccatcatttacaactctgaagaaatttcattttaaaaactatgaataaattatggaatatatatcagtactaatgacatactataaaattcataattattgaaatataaagttttaattgactatacttgcacaatttaggtaaatatattttaatttttctactgttatatactatttacagccttatttacaaacattcaactattgtacagcttttcaagaaaagattctaaaactaaagcccggtatatatctgctattttcacaaaccaaagccaccacaactcccagtgtacaagaaactctaacaaaagaaggagattgttttaaagggtattcttttcttaaaatgagcaaaaatattatgaagttataaaaaagtttatagatcaaaaatcaagttatgaaaaaa

SEQ ID NO: 45025 - DNA, 1158 bp, Bovine  19866880812756
tcatactttatgcatacctttcagtttaaaagatacaactactattggagtcgtaagctatctagaaatttatgatggtggaacatttgctctgaattggccttgttacctgaagagagattatataatttaatatttcatttttttaaaattatttgtctctgcctgtttcatgtcttaagtaaatttgggatccctttgagggcagagatcatatctctaaaactagtgccttttcccccacaatcttaccactgtgttcaggagacaataagtccagtaagttactggatgagaggtttatatgtaatgttcaaagttggaacaatcaagcacgagaaactaggaggaatttatggtcccttaaggttttatattttgtttatttattattagagtttatcatgttaatttcttaaaacttgtagcttttaaacaatttaggtgtgctgcttattctcgcctaccattaaaagaatcttgtttattcttaccgggaggaatacatttgagttatttaatgataacattttatgtcattctccatgacgtttgcatactggcccctgcagttgactgtggtcccctgattggtgtttaaatgtttgcagaaagagaagctgctcgtggtgttggcgtcccttggagacaccgtgtgctaccataaaagctgtgtcagtctggagcagccggaggcgctggtcgtgcaccacaggatggcctttgtcagcatctcgctgtttgctgtccggctcctgcagacgctgctccctgtggaaaaggtaaggcgggtagtgtggcttatttgtagtttaccgggtgttacggtccctgttgtaattccttctggtcatttcacagtgtacagagattttattggaaatgcagaagttgagaaatggctaattttaacatatttgactagttttgaccagttgacagaaaaaagcactcattttgtaaagttctttttttttttttttttaaggtgatttttaaaaattcttgtgaagcatgtttagaaaagtccattcttactaagtgactagttgttgttgttcagtcactaagtcgtgtctgactgcagccgcgtggactgtagcatgccaggcttccctgtccttcaccgtctcccagagttgctcagattcatgtcca

SEQ ID NO: 45026 - DNA, 4459 bp, Bovine  19866880897029
tggtgtacgtgtggaaggacagagagaagtgaaggagtgtagtagcatttgtttcctgaaggggactgtggggagacagtgggtctttttgaagaaataatgtcgtaaattcctgtctctctctctccctcttttcctacagggcccctgtgtccatgatgaggactctgggctgtctctcataggaaaacctgccctccaggctcttttataccactgccatttttatgaacatttgaatcagatggtaaaacattgttacctgggacggtatgcatttgatttcagtttttcagctcttaatggagctcctgaaggcaatgatttaaatggtaagtgtattatgtttatatttttaataaaatatatttcttaaattgtttaaaacctttgtgttggttacaaaatatttgaaaacaatgaaaaataccaggaaaacattcatatctagtcctactacccagagcttgtagtgttgcatttagggtgtgtgtttccttccagtcttctttctctgtatagcttttgtttgctttatataattgtgttcatatcttatgtacatttttgtatttccttctttcactgaacattgcctaagcatttttctatgttataaattcttcatgataaccatttttgacatcttattaatgtttcataagttatttcatgcccttcagtaaaattttatagtttttccctctatttatgtcttaaatttttttttggaaggctcttctcaagcaatcaagaatgagacttttcctactaaattttctaacttgttttgctaatatagtgaaaacctgttttggcatattactcatttatcaaaatatttgctgaaatcttttaatttctacttgtttgtagattctcttggatttcctaagtataagatcttagtgcctataaataataattgtgtctcataaaaagaaatagcaatttaatagtaataatttaataatgaaaaatagttttaaaatataaataatacaaattttaaaaatttaaattttaaaataatgttaaaaaaccttgacataatttcccacagaagaggtttaagagtagaacaaagaattcccaaatattaacattttactgtatttaccgtcccatgtgaatgtatgtacatataagaaaaatttatttatttatatgcatatattttttttctgagccatttaagagtaaattgtaaacatgaaatttctttaccctgacatacttaagtgtaagtttctaactcacttttctgctcacttcctgaaggaattaagaggagaaagacatttgatgacgtttcttgaacattctaaacaaatgtccctgtagaaagctacccctttgattgtttgggttttctgtgctgatgtcactggatgcgtggccccggagccagcagcactgacatctgctcccatcttgttagaaatgaaaatgtatgccgcccccctcaccccccacccccggccccaccttgatttggggaatggaatctctggtgctctccataaattatgttagattaaactattatgcatattgaaacatgctgtatatattaattaattatggatgataaaaattaggcatacttttttctttagttctggactggtttcatgtaaagactactcctgctgttaattgttaagatgcccagaagaccgttgatgttgacagttttcctgttgtcacaggtttagatgactcgttcaagttctggagggctccatctcgaatgtccagtcaagatcgagatccaagttctctctctacctcggaaacaatggtacttccaaagaacgcataagtgctgcattttgaatttctgcaaaaatttgcatttacatagtggagggataagaatggatgtgaagaatcaggttacgaccaccatggcaactgggatttagttgaagtgctgtctgcctagaactaggttctacctggctcaaataagtgtactaaatataattttatagatgaattttcaaccctgttttctacctttttttttgttacagaagttcaaaagttttgaaatatttatcagtagtagcagaagaaagggcttcccgggtagcgcagtggtaaagaacccgcctgccagtattataggagatgtaagagatgtgggtttgatcctggtttggaaagatcccctggagaaggacatggcaacccactccagtattcttgcctggagaatcccacagacagaggagcctggtgggctgtagtccatggggttgcacagagtcagacatgactgagcacacagtagctgaagaagagaacagaccccatgtgattagcagtgcttgattaccctgaaattttgcttaaggaccagacagtttgaagaatgttgacccattcaggtgattccagtgtggtactgatgactttaaacacatttctaaatacttgtatcagataggagcttgtcttaattatctgaaatgcttgaaatttatgtacatctgcctgcctttctttctttttatttataagtttctttgttctaaaaagtttgagacactatttttgaataatgacatgctaggtttcatttgttttggaagcatacaaagttattctcaactggaaaacattgcagtgtttttttggaataatcgctgtgtcgtagaaccaattaggaaggcaaaggtttgactccgctgcttccaggagcaaaaataatatgagaattaaataattatacaggaattaacgagattcacctcctgcagtttctcaggagaggggtactttttgctaagttttaagtctcccttccctcccctgcctccagactcagaagagtttatgtttagtgctaaattgaacctttatttagaaaaatggaataattaccccaattctagtaggagtgatgctctcttttgcacgctagaaatagtatgtatctttgtttcagtaagagaaataatgatatgactcagtgctaaagggaaccatagtaattggctatttaaatagttcatagaaggacagtgttaattatgtgcttaaaaatagtaattcttaggtttaccctttttgtttaaagggctataggctaactttgaaatctgtacatacttcagttctttgtttatagaaggtatgtagtaaatagtaattgctctaagtaactttgagttatcttagctgcttggtagataaccaagttgtattttttctatataaggagacttaaaaaaaacccaaagtaaatcaagcatttatatttctctattttataataatatataaaccttacagattaagatactagttcttctgagaaacactttgtaaatatgtcacttattataataattaaaatagaagcacctctattaatccaggacagggaagcctagcatgctgcagtccatgaggtcacaaagaatcggacatgactgagcaattgaactgaactgttaatgcaagtctttaacttgtttatgtgaggatatcacatagactttgagaagtatataccaatgttgttaagaattcttctgtatagtcctatgtaaaacttacttctcaaaagactaatagtacctgttagaatttttacagtcagctctttatttcttttttggtttccaaacagaagagttttgtttttggtaacttattcaccaaattgctaacttttattcacaaaaattagtctaattactccagttctacgaattgtcttgttttccttatcatatcagaggtactatatctttttttttttttccagcaggagacaaatgtggagagtttttattcattatgtcagtgttactttaaacctaagcagtccgtacccagaccaactaacacttcctcagatataagaaaatgttgaggtatcagttaaatggctgtaaatcttgctaataagcttctctggttatttaaatcatagttttgtctgtcttccagaattgagaaaagaaacagcttgttgatgggtttgtctttccaaggagagcgctgtcttttgctgtgggccacgccacgcagtgcagtgtggccggaccgttgtctggtgctggtgccgcactaggtgcctgagtgctgttatctgatgaacactggtgtaggtgactgcagctcgtatgctttgtgaattacaggtagagtaaggagtgtcgtcgttaccttgggggatattgccctataaataaagcctttttagagatggcttcctcaactcactgtccccttccccagggcaggggtggcagtggggggtcaggcatcagttgttttccctcttggaatcacatttctacttctcagagatattcgaactagatgggtgtttatgccttagacataccagtgtgtatcaacagctttaacacttaagtttggtcttttctggatcttgagcagaattatgtctgtttatcagttttcaaagtaaaggaca

SEQ ID NO: 45027 - DNA, 1356 bp, Bovine  19866880984810
gaaagcaggtgctttgtatacaactggtattaagagcacgcctcaataggtctggctgaacaccttccaatcccaaagaacataagagttatttcaaataatgacggtgccatattggttcagtgaatgaaggcaccctgcccggaaactgtacgcttttccatgaagtctcaaaatgttgggccaagtgatacaatgctcaaaagaagttaaactagtaaattagaatgatcagctaattaaattatggggcaaagtctttcatttccatcatgaagttagatgcagaaccctattccaattagggagtcatgacatttacaggatgaagagctcagatacgctccaacctctgcacagcatcagctcagaggattcagctagtgagagatgagttttaaggatgggggagattcaagcaataaatcattttcctgtgaaaaaagtgctagtcgcttagttgtgtccgaccctttggactgttagcccgccaggctcctctgtccatgggactatccaggcaagagtactagagtgggttgctgagccctcctccaggggatcttcctgatctagggagggaaactacttctctcgtgtcccctgcatggcaggtgattctttccccaagggccatcagggaagccctatgcataactataaatctgcttcaggcgatgtggacagcaaatataagagacattggtttgcttttcctcatatgcatgaaatgactagtcaggagttttgaggaatcagaccgtcctgataatgacctgaactctgcagccagaatttgaagtatttaccccaagagaaataaaaatgatttccttccatgccaaatgcataatttgctgctcataaacttttttaaacaacatacactaactattgagtaacccaagtattctccatagtcatgtatagcataagtaagctttaatgaggaataaaaatgaaactgaaacctatgtggccaaaaaagaaaaacaaaccaagtaagtagaatagaaatgatttgaatctaaacagtatataaatgaatgtgcctgagctactaagcattagaaatcgcaaaaaaaaaaaaaattatacaattaactgatgtcaatttgacattaaatgcagcagctttattttcagcattgtagaaacaaacatgcagtaagctcttgaaaagaatgaattgtcctttttatagttcagtctgggtattttaagttcccaaatagttctagatcattggacttttaaaattatatacttggagctttcactttatagcagaatgattattgtcatgaaagacatgtttgaaattgcaaaaaggtagaaaaagttaaaattatattt

SEQ ID NO: 45028 - DNA, 1023 bp, Bovine  19866881081619
tgccccccgggggcccacttgtgacaggcacgatcagagctgccccgggtacacacagcgaaagagacagaaaccgcctgactcgtgagaccttctgctctagtgcgggcacaggaggaatgcacggatgtacactgaacacacagcatatcagctggtggtgactctccagaggaaaataaaacagggaaaggaggcagagagaaagagggtgggggaggcaggagacgggcatggggagcaccaaccacgcggacaggccatctggaaaggctccaagggcggggctgtgcctgcctaaaggcacaagagtcagaggatcgggaggctggacaggggggaaggaggggcccaaactctcccaggagctgcctcctgcgcccagtgtggccctcgtgcggtgacccgtgaacgccgggcgagagtcatgcccgatccgttcccacagcctccgcctccagcagagccttgaacatggctggtgctaaatgaccaccaggcggactgtttataaaactactctgttttaacctgaacggaacactgtgtggataagcacgtgtatcagtggattcgtgcggtgcacgaggagaagactcaccgttagccaggatcttgggcttgttggcaggactgaagcagatgttatggaaaataagaagggggatggagaggctgctcttgtgcttgaacctgctcatctctgtgagcaggtctagacagccgtccagccgcaggatcacctgctgcccatcttcttcgaaggacatgttcagtagcagcttcagccagagcacgctcaggttactcagatgtttgtttccccctttcggcaacgtcagagacagaaagttctgcaggaagttactctgtggataaatgcagagaacgttactttactttctccgagtctttcagaattactttctgagtcccacagagatcaattagccagcattctgctcctgttttcctttaaattaaagaaacttaatttctccttcctcccaagaccttcccaat

SEQ ID NO: 45029 - DNA, 712 bp, Bovine  19866881174509
catcgggcacagtacctttcgttggacgagagaacgtgtctgtcagctgcggtcagggggagccaggggaaagtagaaaacttcaaacactttgcggtcggatttgctgctgatggaagagcaaaacataaggcagggaaggaggcaacgtggacagatttgcaatgtcccgaggaacgctttgccttcaaaacaagtccccaaataaagttacagctcacggttccctgaagcatgtcaaaaagatcagctgcaaatttgtcttctcaaagaataaataacagatctcttttcacaatttaaacagaatgcgtattatttttagaaaccaataatgaatgacatttatagcatcaattatttattctaccacgtggctacccagaacagagaccttaaacaaaaaagaaactggtatttggagatctctaactatagtaattaaaaatgatataaatgtaatcatacactgtatttagtaagtcaagttcaaatatcataaatagggttcgacattttaacggttacactttgaggatgacttgaagaccataaggttaaagatcaaatatcagtgctcaaacaagattaaaagaaatccgagaaacccgaatgcaattttatactaccctccttcaaattacttctaaacagatcttctagtgtacaacttaaggtggcaacacataagcccttccaaatggcaaatagt

SEQ ID NO: 45030 - DNA, 1031 bp, Bovine  19866881201616
acacacacacacacacatacacacacatatatatatacatacacacacacacacatgtaatttatttaaaagacctcttagaaaacagaagaattggagaatgattatcaaattcctttcttccattatttaaatggtcgtaataagcattgttttttaattcgaatgactgaataaaattcttacaagaccaagactgaaagtaaattatttaaaaactaaaccaaatttaaaaaaatcaagaaacattaacctgaagaatgacttcagtaagtcgttctagtgagttctgactttcctgggttttgtcaagaagtgaagccactgttggactgtggcataagcttgttttctcctcatcctggagacgcctttttgcttcttcggtcaagagaacagaaaggaactgcagggctggcggtgtacagagcagggcttgtggtagacaaacgcgcacacctgcagaatgtatctgaaagatagtttcatgtgtaaacaactggaaacatctttcaaaattaaagaagtcagtcaaatttatttgagtaacaaagtttataggttttttaatcctaatgaactttattagcacaacaataactgcagtgtttaaaggtaaattaaatagtaccaagacaacctattgatcaagaaattgatttcattttcattttgttcttttcacataggttcctgtttataagaatgtgagtgtgtgtaaataagggattatcttaattttataagcaaaaacaccctgagcccagcaagaccatctccttaccgatcaccgctgcccaagaccgggccagacccagggtaacatatgggaaagaggcagggccagctcgcctcagcagtgcggccagaaggttgaacagatgagtccatgtctgataaaaagctgaccttaactctacatctgtaaaaaacatcaatcaaaatgtttcgacttattaacacaaagaagaaaaagaaccttttaaaaataaacctcaccaagacactttactacacaacgtaaaaatcac

SEQ ID NO: 45031 - DNA, 1104 bp, Bovine  19866881320859
tcccctagcactgggtgacgcaatgctgatgagactctgcagactgcctttgctgggcattgtaaaccactttcacctaccagacccaaaacctgcaaagcgataaatgcaaaggactaaacaagaatgagctaatgggcaaagagaattaccaaacgaatgattacttcattataaactctttcagacaactatcatattttaattttgataaagaagttacgttgctttagttttccccactactaagctctatattcagcatttcattagagcatattttttaagaattgcagacctttggagatttctgatattatattctggacttgcttatacttgttatttagccatagcttataagaataattaacacctaacactcactgtactttgtaacattacataaagaactttaccctcatttaaaatgacagcacaggggaacggcccttcactatactgcgtacttgcctcaaacggtctcctggagccacttaaaatatccaacctgtaagacactttatgaaaagtcttccaaaaacactagcaaagaacaacccaaaatgtgaccttgatctgaatacttggtgcaaagttaagactttttcctcagtattatttactgtccttctaaaccaaaaaaaaaaaaaaaattaaaaataaagctcactatggagggaggtgggaggggggggttccggatagggaacacatatacacccatggttgattcatgtcaatgtatggcaaaaaccactacaatattataaagtaattagcctccaattaaaataattaatttaaaaataaataaataaagctcacctaatatatctttggtgcatagggtgagaactcggatgatgtttgggataagaggtttcagaagctcatcctgaatcacaaggtcgggatccaccaataaacatgactgcaggagccgggataaggaggacaagtattccaggagaaaggacacctgcccgaaagaggagatcagtaaaaacagagcacatcatacgaaaagcccatctcagtgatgaagtatcacttctttataatacaagttaataaaaagtcataaaatattcatcataattt

SEQ ID NO: 45032 - DNA, 1384 bp, Bovine  19866881357588
ataaagcgtaagtattcagtagcacaggatcagtgatgctctcaacaaaatagggcttaactatgaagcatgacaagtcactgtaattaaacattcaactttcaatgcatactgcgtaagaacacagaaccctgaactgaagtgtaggtgtggcaaggccagcccagtactcctggtggccattaggtggtgctctttccctgagaagtctggcactgctaccacattaacagaaaacaccgcctacatcacaagttgcattaaaatagtttctgtaatacagacaggtatttttcaaaccgaacaatttcttaacacaatgtataacttgctaaaatgcccaaagccccacgtgatcagctggacttacaatcccagtcctcagttgtcgccactgcatgcatgggagaaaaacaccgtgcagccgtctcatatcaaaaaagaggacgcggggacttccctggcggcccaagaatcacctggcaatgcagggacgcgggttccctccctggtcgggcaattaagatcccacatgccagggcgaaactaagccagtgtgctgcaagaactgagcccgcaagccacaacgagagcgtccacgcactgcgacaaaagatcccaaggtcccacgtgatgaggaaaaccccgcgtgctaaactacgaccagacacagccaaaaaaacaaacagaaatacagctacgaccagacacagccaaacaaacaaattaaaaaaaaaaaaaaagttaatgagttctttctgtttaaagaaaaaaaagaggatgggctcatgagtgctttcctcattaacacgctgttttcaaagattatgatttgataaacactcaggatgggggcgtttccgctttgtacacacacagtaagcctgacagtaagtacgacggggagctcttggaagaatctacaaataccgccagtgcacaaggaataaacaaacagaaataccttgtttattagagaagaaacttggatctctgtggaaattgagtctgtttcttaaacacgtgcacagctgctgcaggcaggacactgactgtaatgccagacgatgcttcccgtctcctccaaaggccagtttcaacagagataaaaggctctgaaatgaagagtgaggaaaatgaccatgggaacaaagtgctcgactgcaaagacggacgtggagcttacgcaaggttaaatggacaatcaaaggaatcacaataggtgccaaatatttataggcgagaagcagcagaaacgggtaaaaacgacttagcatactgctggaagatgggtcgaagatcaaatttaaagggaacagtcagcgtttctcatatctaaactgttagttgagtatctatcccgaagaacacaggaaacagtccc

SEQ ID NO: 45033 - DNA, 1252 bp, Bovine  19866881411573
tttgctgagtctacagctgtcacatatgaaatttgcattcagaaaacttaatttccaaataatgcacacagaatttaagtggagtatgagcttataaggtgttgcacaagatacacgttttagtagttaataaaaagtcagagttcatataaagatgaaaggaacactataccttgaaatagtaacacaattgaaaatactttagtcttgagaaaagtgtatttttagaattaaattattcaaatgtctaaaaacacatcgggtgcaaggatttggcacagactgttgctactgatttagtggccactgttaataaaatgtcttcgaaccccacaggaacctgaagtctggtcattccaagccacagacttcagccctaaataatgaataccagttcccctgcctttcacaggcaaaataacagagacagcaagagacggcaagagtaattaaattgacaacttgaaaaacaaaataaaatattgtttagaaatgaaatttagcctctccttgtctttgcaatttttcaatttagaatgatgacatgcacagaaaggccacaagggggtgctgctggtaaaccgacaagagccctttcttgaccactccagcatcgaggaaataatcgctcaatgtccaccctcctgagacatcaagatgaactcggacggttcacaacgacgggagagatcttcaaagaggagaacggtcaagaacatttttccagaaacagagcaccaggccgtaaagacaggcatcgaaaggcaaacagaggtgatgtcaggtctacttcccttattttctcatcacagattagtcatttgaagaaaaaagcaatctctgcttctcttcaacggagcattaagcttgagatatatttattcttcattctctttggggaaccatccactttaaaaacagctccaaagttcagtgtcctgggggagccttccacgggacccccccacccccgcccagccagcctccagttaccctgcacatcatttgggttcaaagagctgtcctccgtcacattctcaagggctaagtaaaaaaaaaataaaataaaataaagcaaacaaacagaaactgaaggttttaaatgcaaatcgaatcctgaacatctgagtctggctttgttgtgctcagaattaattccactatttctaacttgccctgaagtgaagttgccaaagaatttgctgaaacgaggactcgaagctataaacctcatgatgatttagcttaaaag

SEQ ID NO: 45034 - DNA, 1415 bp, Bovine  19866880151855
caaaggttcgtctagtcaaggctatggtatttcctgtggtcatgtatggatgtgagagttggactgtgaagaaggctgagccccgaagaattgatgcttttgaactgtggtgttggagaagactcttgagggtcccttggactgcaaggagatccaaccagtccactctgaaggagatcagccctgggatttctttggagggaatgatgctaaagctgaaactccagtactttggccacctcatgcgaaaagttgactcattggaaaagactctgatgctgggagggattgggggcaggaggagaaggggacgacagaggatgagatggctagatggcatcactgacttgatggacgtgagtctgagtgacctccgggagttggtgatggacagggaggcctggcgtgctgcgattcatggggtcgcaaagagttggacacgactgagcgactgatctgatctgatctgatttaattagtcacaaatacagaattttactgaaggagtagtgtctgcagttggcagaagcagatgtagtatatctcagaagagctctcctcgggcctctgtgtccctaaacaaaggcaggtgttaatgacactatctgtgcaaggtaagaacttgagatctggaaaagctcaattcttttacctcacggtctcctcataatgatgctgtgctgcttatcgcttggcactattcatattttacttaactacttatcacacttttggtaaataaccaatatacaatggagctcagtgtacctgactgaaatttaaagtgaatgaatagtcattaaatttttctcagttaagagatctaaatgcagctgaaaccataaggacgcctaaagtttcttttcagtttcaagaatattattaacaacaaatgtcaattaaattcacagacctggacaaaaatattttatgtgtattaagactgattcaacaaaacacttgcatattcagccttctctagcaaatccttaagacagtacataatgctttttggtcaaagcgttctatcagtttaaaatgttaaaccatcttgaattccaggcttagaaataacaaaaggtacactagagtctcactgttgaagtttctcaaacagaagtacatgaaggcagtgcttatctgtagaatggaggagaaaaatttcaagtgtttaaaatgaaaccaagtattgtaatttagtctgaacttaaaaaagaaattcagaaccactgagtatgatattatagcagtagtattaaaaactatttattctagaaaaccctacagtttagctcattttaaaaagttatcttttataatataattacaacagttattcaatatcagtatttggaatagtttacttttgcaaatcatatgttggaaatttatttcatttcataatagcaatcgat

SEQ ID NO: 45035 - DNA, 1757 bp, Bovine  19866880523426
aacagttagttgctcagtcgttacagctctttgcgagccatggactgtagcccatcagtctactctgccatgggattctccaggcaagaatactgtagagtgttgcattcccttctccaggggaccttcctgacccagggatcaaacccagggtcttctgcgttgcaggcagattctttactgtatgagccacctgtctccatgctgaacactgcccagcaccaagaaagtgtttcatatgtatcatcttatttttcctttcttgaaagcaaccccttgaagaaggtaatatttaaaaagttattttatagataagacactaaagcttagaaagattaagtaacatcaaatgtaggtctttatgacttcaaagcttacactttagaatttgcatttctgttttttttttttgtgatgctaaaactactggtcctgggacagtttgagaaattctgctgtaatatctcctcaaaccatagttgagttgctctaaaacccacaaaaagtgcatatgcacacctctaaaatgtaaacataacactttgaaaggaaattgcaaataactcttcaccaggaaaacactgatgaccccagtcttcagttacatacaggtgttactgagttcggcctgcttgatgcatcgcaggcccataattgggagatgagatgttgaggcaagaaacagcgactttattcagaaagctgggcatctgggaagatggcagactagagtcctagagtgccatcttctcagggtctggatgctggtttgtttaatagaacagagagggggagaaagtgaggaagtaaaaaggtcctaagtcttgcagaatatctcctggtttggccagcctcggggagtggatttgttcatttcttctttcctgcagccattcataggtggagagggacagggtgtttccctgcgagctgagcaaaggtgctttagtttaacattcaggcagatggtcagggttccctgaggccggccattttgtaggtttatatctatatatagcgtctctttagtgattatagtaactgaagcaatggaaaacaaaggttaaagtaaaagaacagatccaacatggagtcagagtttgttcttccctgttacacaggtaaaaccactcctgtgttagatgagttcgccagtggctgaaggtattttgtggtgaactttgtatttctcgttgttcccatggcacataactttggtcctacattgtctaactctgatttattgttgtcatttcaaataaaatatttctatgcatagtaaaacaaagcaggaaatgaaggcttgaaaacggccgtggtttatcaatggtaatgccattggtctaacatttgtttgtttctgaggttttagaaaattgctttagaaagccttggggcagaaagcttcacttaattaaaatattttaaatcaaaccacaggaacttcagttcataaagcctcaggatacagccggcaattgtaggaaactcaaatggaatagggtagatgaatataataatatagggtataatgttttattatttctatttgctatgttgaaataattaggcagcagaaaatcttggttaactattggtattctgaggatattcattaattgccacataactggtttagtgttttctaaagagtatccatggagcactgggatatgttcccaggttgctttttgaagaaaggacttcctcttaaaagtaactttagaaagtattgcaccactcgcttaaagtagaca

SEQ ID NO: 45036 - DNA, 1768 bp, Bovine  19866880587528
agagatgcagcctaattagctcttctgatggcctcttgaacaaatgtcagttcagaaacccgaagtgcttgctaatgacaagggcaaaactgtcccacaaaactcaaaaagtggtgtttgttatctatttcaagaactagagatgaaagtcttaatgatacaggaaatgctcttcaaaggccaagaagtcttagtgcaaggtaagaggatcaatcagtcttaaattcgagtttactaagagtaagagacggatgctgccagcatggatatgcgtttcaaaaggcatgaataaaacccagaaatagtgttaattttactttgaagtatataatgaaacccctcaagtactcagacttcaacacccctttcccaaaatgaccgaaatttccatttttgagcgtttatcattccgcctttttccgttctccgcgtcttaacagaattttaaaagagcagctaataaatgaagtatacttcagtttcatgtaatgggttggatcagaagggaactgataagatgatattggaaaagcaggtgggggggtcgaaaagcctcacaagtgctgagctctgcgggttcaattgattcctggtgtgcaggctgcagtccctgggttattccagaaaatggaaggagaaccgtccctgctttattacaactgagactcttctccagggactggttaccagcagggccagaggtgatgaaggggagatgaggccaattaagaattcagactggggaagctggaaacagaaaccatggggagaattccaaaagggaaggcgggaaatgagactttgggtcactgtaggaattcaaggtagaatacaaatatgagctttaaacccgctcgagagaaactcattttagtggaaggaaggatcaaaggaggctgaagctttgcagtgtggtttctaaaggcaaggcacaggggcagaatacctgagtagaaacctatcagtaaaacctagctggtgtttatcatcctttctgtgttcttggcatactttgggatattagaaatgttggtggtatgcatgaaggaattgaaaagctcaaaacaaaacagagaagcaattcagcaataatttcaacacaatcactgctacagtttaatgataatggcacagtgtctataatagctccccagggacagaaagctgaggctggggagtggtaatgaggtgatgagccagagggaggtctggattcatggctccatgatcttgggcccattccttaaggactgcatctataaaatggggaagaagagtaggacctttctcatgggatgttgctgctgctgttgctaagttgcttcagttgtgtccgactctgtgtgaccccatagacagcagcccaccaggctcccccatccctgggattctccaggcaagaatactggagtgggttgccatttccttctccaatgcacgaaagtgaaaagtgaaagtgaagtcacttcagttgtgtccgactctcagcgaccccatggactgcagcctaccaggctcctctgtccatgggattttccaggcaagagtactggagtggggtgccattgccttctccacatggggtgttagaaagattaaataaaacagcagtggagaagtcacagcccctggctcttatgaatgctcactactatcctgtccccttgctcctcaggccctggcacagtccccgtgtcctgacagcactctcttctgctccagaggccaacttctcatctgcttcagtcaacatgaactctttttgggg

SEQ ID NO: 45037 - DNA, 1193 bp, Bovine  19866880633717
cttctaacatgggtttaataatccatgcaaaaatttctgtacttcaggtagagattccagtacggaatagttgtcaaaaaccacttcttgaatatcttctaatacttctaatatttcttcaaatatccgagcactaaatactgatttcccaagcctatcaaatgtgatataacaagtaaatattgaagatcaaactatttgatttaatacaatcacatttagggggcgattttctgtctacactatttcccttaactttctggatgcctctgggcatagctgaaataccctgttacttttcctgtaccatgtgttaaagtttaagtgtgttacgtaactgattaacaatttttagaagattaattagcatcccaacagaaatttaacagagcttttcattaataccttaatcttgatagtaccaatttccccctcaaaacactctgaattcccagagatggcttccaaatacagagcctctatttacttaatggagctttgagcccctgagaagagctctgcagggtgctggggaactcagaggaaaatgttaaaggggcagcttacaaataagaatgcaaagtagaccctctcagcttagcaggtttcaagtattatctatcctttaccctgattgcaacttcagcagagaagagtggtttgtttgctgaaataatgaatagtagatggcatccattttagtggaaagttttaatttgtgattccctgaggctgtgtgaaatgaaacacccttattcattcccgtaaatgaagccaaattgtttctggaatttcttctgaaaaaggccatctaggaacactgacctgacatattggtctgtgaaagaaaacatttaatgaatgcccttttgtagtgaaaagcactatttctatgaagaccaattttatttctgaagtatgttgttatctgattaaatttctgcttttaaaaactgatgctgaggtacaacagaatgtttaagcttgcctcagacattcagagaataaaaatgtctatcctgtctgattttgcatctgttttagttaaaatacaagttacgtctgaaagcaatcatcagtgccacaataacaccttattactaaacttcaataaacaaataattcaaagggattaaatagtagtgagtattggggaagaagaagaactaaagttaccctgcaaaacacacaag

SEQ ID NO: 45038 - DNA, 711 bp, Bovine  19866880695183
gctggtgattctctctgcatggtgggaggcaccctgggcagtcagtactctccgtggttttggggacattcagaatatgcaagtgtgagagcaggatgggtctttgtgggatcctttccctgcaaatgagcctaggaagcatggtgaagtggaattgttttgtaagaaaccagaaatacaaacatttatggaattactaggcacaaattacttggcactgcaaattggaacaattagctcacctttgtgaggaaggaatgttgaacgtgaaacaacttgagaatggaataaaaatggacctattattctttgactcaattaagggcacgtaatatattcaatatgcatttgccaaaccatatacttatctgtgctgtttgaggctgaaggtggggctacttctaagcgagactcattcacatcagccctgccactcacccaccttggaatggcaggaaataatggctcctgttaaacggatgagaactagcccagttacacaatatattgaacaaaaatgatgccaataacactgttacttttcataatgggcacagatttttataggaattagtgctagagaaacggaccatctgaaataatgccatttagtaatgtgactcttttcccttccagataagtccacattatggacatacccttccctgtattcgcccagatggcaaattaaatgtgttggttggaagtgag

SEQ ID NO: 45039 - DNA, 1147 bp, Bovine  19866880705054
ttctgacaagcacttgggtgggaactcttcttgcatgtagctctcatcagacttatcctctggcactgagggctaactgccctctgattcctcatttgttaaatgtctttgtcgggcagtgtattgctcccagtgggtaatgcaattttgtagttccgtttattaatatacttgttcttacaaactgaatgttgattgcattctcagtatttcagggaaaagagcagatctctctctttggggattggtttatgaaattgtactgcccagagacagaatattaattagaccatttatgaggaaatatataaaaagtaaaactctggcttctgtgtttaactgaactgttcaaataaatcaaacaatgaccctctgagaaatgtataatattttgcttatcattttagacttgatttcatacaaccttgtctttgagttggagcaagaggtaaaattctaccagtatttggaaaatcagttggggatgctgcagatagcagtactgatatgtgtgcttgaagaaaatataattttttgagcctaatgtaattttcatgaacttattttgaaagtgatttataagactggattatatggttaaagctgagatctctttaccctaaagaatgggcaagaaccatatcagtccatcgattaatcagtcaattgatctatttagttttcacctccttccactgaaaattttcagtagccctcagacctttaaaaattctttctaggggtttttctgaattcaagatgttttagcaaacccagtctagggagaaacacagtaatttctgccgtgagagaatgaggggattctgagagattgtgttaggctaggctggtaacagtgggtcagctaagcctttcttcctggaaatttgaggactctagagtacttacaggagaaggcaatggcacctcactccagtactcttgcctggagaatcccagggacgggggagcctggtgggatgccgtctatggggttgcacagagtcggacacgactgaagcgctttagcagtagcagcagcagcagagtacttacaactcaggaattgaatattaatggttctggaattagctacatattctcaaggtattagcccagcagctggaaaggatgtttatcagaaaat

SEQ ID NO: 45040 - DNA, 1956 bp, Bovine  19866880772730
ctcagaaacaaggcaatggcaaggatttcaggatgcttccatctgcatcgtagtttccaagtttcactttctctcctctgaaaatcactgggccatttcagagtttcagcattccctgaaagcaagtctgaggaaccagcccatgcaccgccaccatacctgaacacaggtaaacagcttccattcatgtgagtgttgatgtgtgtaatctacatgaccctcaggaaatacattaagatatatacacatatacatacatttggatgatctaggttacagaaaaatgcagttacctgattaagaaatagtgttcatagccagagacaaatgagattttaagattagtttgtgcttggtgtttattctccttttcctgtgaaaacattctttaaagttatgatcagacaccaatccaatccggaagacaatttgttactttttttcttctagcccagcttgtcttaagtgccaattatgtcaggcgccttgctgcttttttacattcctttcctcactgacagctacagttgacttttcttagttagtacgtaaaatgatatattctcctgtgtgttcaaaaacttggctctgtaactgccagctaacttttgaaataatattgtcatgctgcccttctttggggaggaaccccgagctgaggaatgggttggttctgctccctggctatcaggatgggggtaaatattatccaaccagatcctgtgccatggaggaataaaaggagagcaaaccatgctcaggggctgaaagtttgccacggaccagagatattaatttcgcaaaacaaagggtaaatggaactcatccaaataggtcttttgagaagatagggttgaaacagccatcagagtgaagagtctggatagacacaacttgggctgtttgcttatacttcaactggtaaagggctgggatcaaatacaaacagctttacaatgaatgttagcatttattgagaacttgctgggtctgtgcagtgaccagagctgggtacttggcatggatcagttcctctgtgtttcaaccatcatcttactggcaagttcctaattgtgttcttgttttaccgataaggatgagccttagacatattaagaaacttgcctaaggtcaaacgttcaaataagtgtccttactcaccatgatacagctctgggaaaagggatttgtataacacgtgcctaatgctttatggtttattaaacttctttcactggtaccactggattttactctcatcttatcctatggggattggtggcattgtccttattttgcagatgagaaaatagaagtttaaagaagttttgtggctcactttgccatccttaggtggaaaggagtctgatcctatgttaactagagaattctctggggcaaatagctatgcttcctgtctagggtgagttgtcttagaggatgctgaatgaagagcactaagctgacagtcctagctccaacaccttccatagaacttggatggggagggaagtgcgaggggggttcaggatgggggacacatgtacacccatggctgattcatgtgaatgtgtggcaaaaaccactacaatattgtaaagtaattggcaaccaattaaaataaataaattacttaaaaagaaaaaaaagaggttacaccagacaatacagaaatacaaaggactataatagactattatcaacaaaaacatggctacagaatggataacctggaagaaataagacagattgttagaaaagttcaatcatccaagactgaaccaggaagaaatacaaattatgaacaacccaaatacaagcactgaaattgaggctgtgataaaaaaaaaaaatctcccagaaaacaaaaccccaggaccagatggcttcacagaagaattccagcaaatatttagagaagagctaatgcttatccttctaaaactcttccaaaaa

SEQ ID NO: 45041 - DNA, 2300 bp, Bovine  19866880790037
ctgaatatctgaggttatttatatttctcccggcaatcttgattccagcttgtgcttcttccagtccagcgtttctcatgatgtaccctgcatgtaagttaaataagcagggtgacaatatacaaccttgacgtattccttttcctattcggaaccagtctgttgttccatgtccagttctaactgttgcttcctgacctgcatacagatttctcaagaggcaggtcaggtggtctggtattcccatctctttcagaattttccacagtttattgtgatccacatagtcaaaggctttggcatagtcaaagcagaaattgatgtttttctggaactctcttgctttttccatgatccagtggatgttggcaatttgatctctggttcctctgccttttctaaaaccagcttgaacatctggaagttcacggttcacatattgctgaagcctggcttggagaattttgagcattactttgagatgagtacaattgtgcggtagtttgagcattctttggcattgcctttctttgggattggaatgaaaactgaccttttccagtcctgtggccactgctgagttttccaaatttgctggcatattgagtgcagcactttcatggcatcatctttcaggatttgaaatagctcaactggaattccatcagctccactagctttgaatgtgaagtcaagtgggccttaggaaaagaaaaaactgctcacttatccaggcccagcctctctcacctgggacacaggtagagaagaaaaggctcacttccaagaaatgctttgctctcactttgccttgaattcatgaggccagttgcattagaagaagacctgtcgagtctgatgatgctcttttatctacagcaggttgagtaaaaatgatgttcagtttgagagtgtcttaaattctgtaattataataccagtttacttgaattctgaaaatatccttcttctaaacccacgctgcactgaaaatgacgtgcctttctcatccctcctcccgaccccagcagaccagatgagcagaagtgcacttccacagtgttcctctgcggtggtaatgtggacaaacatatgcagcaaggttcttttcaagaagattaagtgaagggggaagtttaacacagaagctcagcagttctgccaggatctcacttgcaaacagtcattaaaaaaaaaaaaaaaaaaaactatgtaggagggaacgggttgatgcttgctgtttgctacagggcatctcagaaatagcaaaggaaaccacagaccaggccaaggattgctgtgtcttaactagcttccctggggaaagcagcccccgatattatctgggaactggatggaaaatggcaagcacatgacactcctttctaggtatagagtgtttttcatattcaaagctctttaatgcttccctcaggagccttgtgagataagaggggaagtgattatatcctcagtttgtgaaagggagaatcaaagctgaagggtcaagcaatttgcacagaaaataattggagtcagtgtccaaccaacatcaggcctcaggggctcctggtgttgaagccagagctcagaaaaatgaggcccagagcctgagtttgaaaagaatatatcaaaggaaacaagtacccaagtacagcctcataattaaaagtgattggacaaaattcagtcacggtgcacaagaatgcaggcagatttagagctgaaatgacaaataagtggcacttcactgaaaattaatttccctgagcttatttctgtaggcatattggcatttgatggacttcagtacgcattgataagaaagcagagatgaaaatcaagaaacctctggatgcctgaatttgtctctaaagagtcagttgcaacatttcaaaaggagctcgagttaacttgaattaataaaagcttaactcaaaatctcctttcctccatatctagccttttcattgctttctttcctttaactcttttttcctgcagtgctgttggcaaaaagaaggagatttggggggaaaaacaagttacatcatctttactcaaagaatataagaaattttacagaatatataccaagcactcctatttcttttctgatagaagctcacacatgaatcagaatgtcttctccattcatgcttcctttgatatttggtttttaagaacacgctcaggtgagtcctccaaaatcaaacctgtgagaatatatatacacacgcacctggcaaccaataggggtgtgaagaagagaggtcagaggtcagactgcatgtgtttaa

SEQ ID NO: 45042 - DNA, 947 bp, Bovine  19866880803467
acatgccctacaataattgaacataaggaactgctcaggactgacagcccagtctacagctcaacccagacctctctccagactcccagtatcattatatatccaacccctcatctgacaccagcacctacaatttagattgacctaaactgaaaccattatcttaactctcaagtttggttaatactgctatccatactgttcattcattagacaaatacttattatccttgaagtcagaaacctgggacacatcttcatctcctcctttaatctcactgactgcagccaattagtgaccaaatcttgtttgatttctcttcctatttctctatccttattactgccattgtggcttagacccttgtcatctcatgcctgatttataactagtctcctaaatagttccactttctctaccctggattccattttagcctttctccacataattattatgtgcttagtcactcaatcgtattcgactctttgaggccaaatggactgcaggccaggctcctctgtccatgaagattctccaggcaagaatactgggagtgggctgccatgccctcctccaggggatcttcccaacccagggatcgaatccaggtcttccacattgcaggcagattctttaccatctgagccaccagggaagcccatatacttattataatgattttctaaaatgcaaatcagatcatcatgtattctttagttactattttcatggtctatctagaatttaaggtcctcaaaatcttatcctttttgccttaagagttccaaacaatgaaaatatatagcattgtctgaatagtctattgggtttgcatctcagtatctttgatagggtaactcactgcttggaatgcccttctctccatatctcccctactcatactttccacctcttccatctactgaactcttatttcaaaatt

SEQ ID NO: 45043 - DNA, 4939 bp, Bovine  19866880829587
tgagctacatacatctctgaaatagaagggttttgtaaaatatgaccaaacttcattagcctttgatgtgctcagatgaactaaattactgcaaaggcacttggcccctggaggtgttctcaaatgactaccaaaacttcatctgaaaatgtgtgtggaaattacacatacccattataacataaacttatgagtgggaagagatagttaagtaccatgaaagaatcaatatacacaaaattctagcattcccaaaccccaggccagtgcagctacataatatgccaggcaggtactaaatgaacatgtaggttcccttcctcaagttgcaggaaaaaaatttccttttttttttctcttgacctatcatcaggcttcccttatgactcagacagtaaagaatcgcctgcaatgagggagacccaggttccatccctgggtcagaaagatcccctggagactggctctaaagttgtattaccttggcttggagatactgttgtggagagtgcagtccctcagaaatgttccaggttcacatccagcaacttggtgctcatggcacaagtacagaccctcccaggtccaagcaccacctggagaggagggcggcagcaggagctggcaggatgaggacgcagcagggccgtaacttgttctggggaggcagaaagtcaaggcaggcacacagactgtgagccactgacgctccaggtgcatgctgcattttcttatcaggtttcgcttattaaaacacagcgtcagagataaatgattaggaatttcaaggtagccaccattgagcattaaaccctatgcccactgagcaactgcaagagttgcttgcccatgaagccagcactgtattataagtaatcaagccagaaaacaaaaggaaaaagataatattcacaacaaaaatacaactttgagttacctgcaagtaactctctaaccaaagatgtacagagaacattgtgaaatgctatgttgttcttgctgttttcattttgctgctaagttgtgtccaactcttgtgaccccatggactataccccaccaggctcctttgtcctaggaatttcccaggcacgaatgcttctctagggaaacatcctgacctagagatcaaacctgggtctcctgcactggcaagcagattctttaccactgagccactaggtcatgctatagagagacataagaatacacagagagatgtattatattaatgagtgaagatgaagatgaagatgatcattaacacatgcagtcttctcccaaaccagtctacaaattcaaggcactgccaataggatttttaggtataattaggcaaatcaatttttaaaatttatatagaagagaaaagcctgatagtatcaaagttaattcaggtaaagaacaaaaggagagatttccagatcggattttaagacaaggttttattcactcagagaaatagtgatagatcaatgaaaccaaagatatacagaaaattgtcatataacaaaatggcactacaattcagtgggaattaggcaacaaatagtaatgagatgattgaatttttgtctagctaagtgtcaatttagatccttacctcataccattcactagagtaaattgcagctattcaacagcctatgtctcttaaaactgagttcaggtgacgttggctgtaccattgtctcaatactcagttttgatgaacatatgggataagggaatagaagcagcaagggagtactgaaccaagagccagtcatcagaacaagaaaaatacaatttcccaatggcggcaaaaaattacaggagagtaaagttataaatcagtgtattaaatgatttttaaataaacacacaaaatactaattcatcagggaaaaattaacattggaaagttcaatatttgagatcagagaattaagactcagactggggtagatatttgcaatgtttctaattaataaaggatcagaattcagaatacataaagaactcctatgcatagattcaaatatgaaaaacaaccaacagaaaaatgggtcaaatgatagaaaaaggcaatacacggaagaggaagcccatattgatgataattattgaatatatatatacacatatatatgtatatatacatgaactcacttctagtcaaggggtgcaaattaaaacagtaatgagacacatcatttcacaccaaaaagaaacagaaaaaaaaagttggtaagaacatgggtagacaggaattctatacctatggggtaagattgtaaattggcataagtactttgggcaacaatggaaacagtgacagactttattttcttgggctccaaaatcactgcagacagtgactgcagccatgaaatcaaaagacacttgctccttggaagaaaagttatgaccaacctagacagcatattaaaaagcagagacattactttgccaacaaaggtctgtctagtcaaagctatggtttttccagtagtcatgtatggatgtgagagttggactctaaaaaaagctgagcactaaagaattgatgcttttgaactgtggtgttggagaagactcttgagagtcccttggactgcaagaagatccaaccagtccatcctaaaggaaatcagtcctgactattcactggaaggactgatattgaagctgaaactccaatactttggccacctgatgtgaagaactgactcactggaaaagaccctgatgatgagaaagattgaaggtgggagtagaaggggacgacagaggatgagatggttggatggcatcaccaatgtgatggacatgaggtttgagtaggatccgggagttggtgatggacaggggggcctgccgtgctgcagtccatggggtcgtgaagagctggacacgactgagcgactgaattgactgaataaagacaaaaattcatatgtcctataacttatcaattctaaatatattttggttacaatcattgcatatgtgatctaggactcatgtgcaggatatgtattgcagctctaattctaatggcagaatgtggaacctactcatatagctccttctacccattggatgaagttttctttatttcattttgtctcaacctcaaaagttacactttctgcttctactgctttagtagctggtctcaaatttttttgcaaatatattctatttttatttttttattgaagtatagttgagttacaatgctgtgccaatctctgctgttagagcaaagtggctcagttatacacacacatacattattttttatattattttccattatggtttatcccaggatattaaatatagttccctgtgctatacattaagactttgctgtttatccattccaaatgtaatagacatagagaacagacttgtgcttgccaagggggatggtgggaaacgagagggatagactaggtttagggttggtagatgcaaattattacatatggaatggattcaaatttctaatgtgctttttaatgtgcttactcaaattaaaagaatccttttctttttccatgttgcttttattatgttttccaatttctttgttcatctttgcttactgaaatatcacttatcccttccttgtctctaattttttgacacttatggttgcttatcagaattccactaccagtctaacagtcatcctcctattaaaagaaaaaaagtctttggtctcattttcttttcattctgttttttgctttaacggtctactgcttatctgtgacatggctaaaagaatatttgttttttatgtatcttcctcaggacttgatatgctccattagctttagtgagaactcatgtcttcattcaagctgagaaaatcctcagctattatgtcatcaaccccttcttgtccctcgttttctctagttcttctttttggaagcagtacagagtctccaacccatgagaaaggatgccacaaccaggtggaatcgttgccatccataaacaaccagcacatccaaactgatgtgaggaatagaatgtcactgctgtgtggaagcagggctcagagtcccagctgccagagccctagctccggtctttgcagatcccatatggtgtaaactgtttgagcttcagctgctgcccactgttctcactttatgtttctctctctgtgtctatcatctgtgaatattccactgtatgttccaaaattaattatgaaataaaaattattttagtatactttaaaagcacatgtatatgttggatgagcagaagaatttgtccttctactcactcactctatcagaaagacttatacccatggttctgaaatgcacagatattaaaaaccagatgcaaaagctagttagaattgtgtgctctaaggtacgaatgaatatattttgtagctgagaggtcttaaccatctgaatgatccctgaggaattttttctgctgtgttcaatgccatgttaatcggagaatgagccaagaatcctcatatcacccttgggatggtgacttacaggtgaagcatggaaagtattttctccaactctgcgtaaacaacttatggcccttggtaatttccaagatctggcctcccactcctgcagctcatcagcctgtcaggcatgccccgggtctggcctgaaggaggtggagttattagatttgcactcctttgaaaggccaggtggtcctcggccaggagcaggcttcacagtggacactacgcagtgtgggtaggagtacaagcagggggccacagggggcatcgaggtgtccgtgtgggtaggggttacaggggatagaggagtatcaagtcggttgctattaaatttgataaattaacctgaatattcatatctattttattaaggtagctcttcctatttgaactagacacttactatctcaactcaaaaactggaaagat

SEQ ID NO: 45044 - DNA, 1233 bp, Bovine  19866880912961
taaacttgaatatcttaaattgctgtgctttcccaattcttcacttagtatcaaagacaataattaaaagggaagaaccagcgccatgtgttgagtcctccccagagactagctagcactgcatggtattccttaaatacattatctcatctgctctgaattagcttagtttttggagttatttgaaaacacattctcagtggctttaaaaaaacaaataacaaaactggaatatcagtcagcagtaacttaggttattgaaccatctaactgtcttagttttttattgtatttgaggaagtgcctggctgtcttcctgaccttgccttcatctacaccactctttcctggagtctctaacagaaaaagggtgaatagctcacatgcttaactcatttattctctgttaatactggggaagcagctacttctgaaataggaaagtctctattacctcccagttatccttcctgctcctagaaacatatatacatgttcatattgggaagagagcgacccatgcttctctagcgagttgttgtggcagttttacctctttttgaaatacaaacaaaacttgtgtgttcagatattttgataaattggctggttggttgttcgagttaacccatttaattgttttgacattaagtcacacttttcttgctgtccatgtgtgtaatacactcctatcagtaacacctctcgttctctgcagtgattctcattgggaggagtgggatgggcggctagaatctttgctaattgaggctgacctactggaaaagaatgtacctcttgctttccccctttccctgtgaaggaacactgataattgctgagttggcacagccttatagtaaacttaatgtgatcgaggagagaaggaatgtgaggcttgattaggtagaagtccataagactgaatttaaaatataaaggtcccatatgactgtttttgattttaattaaacaagggcttacatgctttaatatatggtgttcagttcatagccagcttaaatttaggcatgagagtatggttgtactccaattatctgtaattggatgtcctctgtttacctttagaaataaaaaattaccagtagcaataacttttttctctaggaaaaacaatcatctgctttcttgctttgtttttaattatttatgacagcaaataaataaaacacatgctgtaattccagataccaatggatcagataattccat

SEQ ID NO: 45045 - DNA, 1232 bp, Bovine  19866880916330
tctctcttactagctgctcttgggtatgtctgtctttttttatccccaatatatcacaagtagaaacccatattgtaagagcactatgcattacaattattattttgttctttttctctgaaaaacacaaaaaactgctgcccttttaaattaaaaaacccaatgaattaggttgttttaacatatgcacttctacatttttttcttggtcagtgggccttgaaagaaaaaggttttacctgtctcttccctacaatttattctgttagcttcagtatcaatatttttcttagaaacagtgcaaagctgaactttattatttacaaacttaaaccagattctcaatacctaaaattatattcaaaattatttaaaaacaataaccacacatttatagtatatttcacagcagagatgaaatttagttgatactgaaacctggacttatgtatgatgcctagctattggtgttttgtggtattttaggttccagaaaaggaacaaagagagatggaagttggaagaagaagaacacataaaatggaatcacagcagttaaatgagagggatgtaggagaactctgattttgccctcatgaattcgctatctgccccactttgactgggatgtctaggttagtccaggatgaaatgagaagacccagcaaatgctgtaatgccagggcaagtataccctcattgaaggatgtgtgaatcaaagagagctaaaactacctgaatgtcaacagtcaaatctgtcaagatcatttccctgtccctttctgaggagaagcctgtcatgataaacatgtgctgagtagtgggcaatgttctggaaaattggaggctgggctgtgatgggggtgaaatttaggagtttctgccaccactaaatttaaactttctaaaactagggagtacatccaaggctaaatatagttctatcttacatgacacagagaaaagccacccagttaattttttttaattgcattatgaacttgacgataccatgtcaaatatctataaatacttataagcagaatttcagtttgtaaagacagaaagctgactttttaatttcaatttaattgccattattaataccattgttgatctgatataaaatcccaaatggtttagtttttagaggtctaagagatcatcttccctctctgacacaataacatataaataattttcatagaagaatattctgcatatttatcaag

SEQ ID NO: 45046 - DNA, 1931 bp, Bovine  19866880964368
ctaggatgggcttgcaaggaaaatcatcttccatatttataaataggatacttgatgaattgagatttattcctttaacttcctcactaacttgtcctgatttgtcaggttttttactcatttgctatcgtaaaagtagtttaggcctaagccttttagctggagcaattatttccattttccatgatttatcttcagttttccaaatatacagtaaaacaatacaataatcactgcaggaaggaatgatcagttacattggatcatgttcatttaccttttaatttcatttaagggatattaatattagtcataaaagctttacagtttcagcacacatacatgcaatcacagaattaaaaatctttataccttttaagaaaagggttccactttgttcaatgtatcaaagtcaaatttaagtctaaagaaatacacttctattaaatacagcggccatcacttaccttaaagtttatggataaagttcagtactgatccaaggatgctggcatcaaagccctccctctcaactatccctagtttctgcatttctataatgtaccaccaattattctagatttataataccctgtctttaacttggtatataccaccttttggataaaaagattattggttgtttgagatgagatacaagaacaaaatcattcttgaggttccacctcgaaaaaaagacgatgtttgctcatagcagctagtttgacacccctgttttccttaggctagccttcacacaacgagcatgcatatacagccatggttcactgcatctgttctgaagttgagaactgctgcttattcaagtacagatgcccccatgtgatgtaaggagacagttgaattgcatgtccaccatgagaaaaggaaaataaacgatgaaacaaatgcagcaaatataggcagctggcattcagaacacgccaaaaagctaacactcatgaattgtcattataagggtctttctttcctttaaaaaaaaaaaaaaaaagtctttctttgcatattttgaaatttaagggtcccagagaatcatgaagtgccttgtcgtttttgctgctgactcctgatgacctctagctgttttttgcattgctgatagtaagttgaaaggcttttgttttcatctaaaagctttttatgttcctgcaccagacgagatgtattttgctggtccttttcatcctggtccagttctgcaactagttcctgcctaaaaacaaataccatacattacataggatggaaatattcctaccttaacagctggtgataaaagctctaaataattagaactttgattctgggtctatcattatacatcttaggtacactgctgctgctgctactaacggagaaggcaatggcaccgcactccagtactcttgcctggaaaaccccatgaatggaggctaggtacactagtcggacacaattatgggctggaatggaaactatcatctactcttctagcatacccatacaaatatcatactccttttaataagtgtaactgtacttagataagtagtgaaaacagataaaatggtataataaagttccagaaaatttcatttgttaccccttgtatgtaggaaggaagaaaaaaggctgggaagagcttactctggctccacttaaaagtaacccgtgaagttttaatcattcacatttgactttcacattcccgttttcatatgcaaagttgaagtcacaattgtattcaactacaatgcagtggtagctaataaaacattgccaagataattaaaataggtgctatccaacttaaatcctacttaaatccaacttcatttcctactttgaaaataatgaatgaaaaaatgaatacaaagtaccacccttgcaattatttttgagaaaaaccagagtcttttacagcctgataa

SEQ ID NO: 45047 - DNA, 1479 bp, Bovine  19866880982754
tctgcaaccccatggactgtagccccccaggctcctctgtccatggaattctccaggcaagaatactggagtgggttgccatgccctcctccaggggatcttcccaacccagggattgaacctgagtctcctgtgtcttctgcattgcaggcagattctttaccactgagccatcagggaagtcccatttaaaataattaatcctcatatatgaaaaacatattcaaactttttagaactctgaacttttcttctgaacttaataaagacaatgacattgacaactgtggaattttatatgaacctactggccatgcatgtgtgctaagtcacttgagtcatgtccaactctgtgtcaccctatggactgtagcccaccaggcttctctgtccatgggattctccaggcaagaatactggaatgggatgctaagccctcctccaggagatcttcccgatccagggatggaaccgggcctcctgcattgcaggcagattctttactgttgaggctccagtgaagcccccatgaacctactacttttggaataaattatccctggctgatagataagcaaccgttatgggttgaattttgtactcctcccccaaatacacatgctgaagttccaagctccagcccctgggaatgtgatcttatttggagatagggtcactgcagatgtaattagttgagatgaggtcatagtggagcccggtgggccccaatccaatatgactgatgtccttatcgaaggggaaacttggagacagacacatacagggagaacacgatgtgaaaatgaaggcagagatcctggtgttgcttcttcaagtcagggaacagcaccgtttgccagcaaaacaccagaagctagaagagaagcataagccagattttccctcacagctctcggaaggaaccaaccctgctgacacctcgatcttggacttctagcctcaaggactgtgagacaataaagtgtctgctgtttaagcctccgtgtacagcactttattatgtcagccacaggaaactgaaacaataaccaaatttggggattttctcctctaggcttatttctaaattatcaagtccaaatgactcaaacaatttgtataaggctgctttgttcattctactaactgcacacacacagccacgtccatacacggagaggaggggctggacctggccctgtcgagagccgttgctgggaatgccccacagaccatgccgtagctgtagacgtcaacaggggtggtgttttcttactctcagtcttgaatcagtaaaagaagaagaagaagaaaaaaaaaaaaaaaaaagcacacttgcgtattcactggtttgggcccagtcatgattcctttaaagacgctgccaatagattttagtcattctctggcaaaggtttctcttcaaccgcaaacactgcatagttgcggaatgactcaccactttgagtaatctaattc

SEQ ID NO: 45048 - DNA, 938 bp, Bovine  19866880985368
ctgtgtctcctgtatctcctgcattgcaggcagattctttaccactgaaccatctgggaaaccccaaataataaagcctaattttgaattttaaaaaactatgtgaaactaagatgtgggcaataacagcatgcaagctattccagaggtggtgagcgctgctgagttcaagggttttttatgtctttggggaggagggcaggactttgactaatatttggtattattgagtcagaagcatgtgttaaaaataagagccactattaaggaaataaaaagacaatataagggttccaactaggaaggggctataaacaaaaccccatcatcctatagaaactaaagaaggaaataaaagaaggataaaggaaaccatcaacagaacccaagcagacctaaaccaaacctgaatcttttggaagagctacctcccaaagcagattgcttctttcaaaatgcaaatagttctctgttcgcacacagcacaccctgttgttgtcattatgatcacaaccactttttatttcagagactgccagatttaagctgccagggtctaattaggaagccccctccatccacaactgcagttatgaggctcacccaccacaggtccttattatcccagttggtgctcagtttaagaaagcatcggtttggaagagcataacaaaaaccatccccccaaaagagctcacattcgtaaatacacatggatacactccaaaaccctagagctcatcacggtcttttttgtcttgatcctgagtatgtactgtacagacccctgaagtcagatcttcccactataatttagctaaggaatctgttacatatgtctgcaaaaggaatttaatttttcagaacagaaagtcatagagttcaccagaaactgaaattgcaagggttggaacctccctgcctcttagcatcagtag

SEQ ID NO: 45049 - DNA, 877 bp, Bovine  19866880995257
ttcaggcattttagacatattatatttgtcagagagcaagcaaacaaaccagccaataaaccaaagcagcaagtcacactatcaattattaataacttgtaaaatgccattccctgtgccaaataaggattttatataccttaacccatttaatccttacagaatcctattctcagaatgatttctatataacatattaaaaaaaaaaaaaaaaaaaacttccaagaaggcaaatgactgaaacaagttcacagttgttgtttagtagccaagtcatgtccaactcttttgtgaccctacagactgtagcctgccaggctcctgtgtccatggaattctccaggcaagaatactggagtgagttgccatttcatagagctagaaagaaaagtttagactgaagttgtattaaaccagtacaactatttactatttatctatgagaggatttaggtgatttttttttaaaagtcaaagatgctttttgtgagcagttttctatttgtattattgaaaactaaatgtgtatgcgaaataccagcattttaataatttaaaaaatcattaaggaagtgaaaggtaagagaagttagtgcaccaccaaaaattccacttttagctctttcttcagttgcacaaacttctttcccaccttccttgacacacatgggctgtctcctgtgtaacaaagaatgataaaagaaaggatgctatcccaagacgaggtacagcctctctcaacacctttcaggttattctctcttctggaatgacaattccttatgcatctttccaatcatctgtctttttctataaagattctgagaatgcctcctctttcagacccatcagcttggtaactcccatcagtaaatga

SEQ ID NO: 45050 - DNA, 1452 bp, Bovine  19866881030841
ctctgtccttactatctcctggaggttgctcaattctgttcattgagtcgcaatgctaactatcttatcctctgctgcccccttctctttttgccttcagtctttccagcttcagcatcagtcattccaatgaatattcagggttgatttcctttagaattggctggcttgatctccttgcagtccaagggcctctcaaaactcttctccagctatatgcatatatatatatatatatatatatacatatatatatatatatgtgtatatatatatatatatctccccttcttattgggacctcccaccctaccccacccatctaggtcaccacagagcaccgagctgagctccctatataaatatcattgccctgtgcacttttaaagttttcagatactcaactgacgaactatgttagtaggttacctagtttatatgatttacatagcatttacagtctgcaaaacattttctaccatcttatctcatttgggcattataaccactgtattcaatagaaggtaagttaaaatatattctcatttgaacaaactgaggctcgcgggcttcatttccagcaaggaacgaagccagaacataaatccagagttcccattttaaatccagagtcttttctcaccaaaaatgaaaggccatcaggtgggaagctatgtaattatctgtcaaatgaagaaacaatcaccattagggctgtctgaaggggcactctgaggtatagtggttagaaaagctttatttaaaaaccaaaccaaaaaaaaacgaaagaaaaaactggtgtttgagctgatttttgagggaatttgtgcagaattgttgaaggtcacagtttgagttagtgcaatggtagaagagagagaccgaggaagagaatttaatagcctgtagtttatcagagaagaccattatagacaaagcttcagtggaatcacagatggtggcaaacacagggttaaccagcagtgaggatcatcagaccagagcagacagattgcacctctgacctctactgtgggaaggcctacgtatgtgtgccatggcgcatggtgtcatgcagagagccccagtcttcaaactggaagtccaaagctggtccaaatatcgtctctgccactgacatattcttttgggggaagcaagctttttatcctctgagagcttcattttctatgcccacacggctgccttgcctggttcacaggaaactggatgagtaaataagaaaacactctatggaaggcctctcgtcagccataaatacatgaagcagcacctaggaagaatggagcagaatgctggctcatgaaggggctctgcgtgatgatctactttaggtacttactacagagcaagtgaaacaaaactcctgttccatttgtagtcctgatgaaatccctttcccttttcaattatgaagtcaataagcattca

SEQ ID NO: 45051 - DNA, 764 bp, Bovine  19866881053817
tatctaagttcttgatttatgggatcctggagaataatgcatcttattttcaaacagtcttggggtagggcagctctggtccctctcaatatgattctttccaatatcttaacttccgtcatcacgaaatatttaccatctaatctaaatcctgactgctgtcatgtaggcatatgtccttttggtcagtagatgctagtgtacaatttttatttatacctttggaagcgaacaggaaatacatctgaatgatttctgactgctgacaagccctaataactgatagttccagacattgaactgaatgtcctttgacagggatggctattttgaggggaaaagacagaaactagcaaaaacttttttttcaagcaggtgtgattttatgatggcattttatgacagaaactaaccaagtgtcctgtatatggtttatgatgttataagctcctggcctgagatttctttctcattattcatgtttatttgacttaaagcaaattaaaaatcagacaagaatattgtgatataattttgattttgcagatgtaataagacacctgagcaacttcagagaagttggcttcttttatttgtgctctttagttctgttctgaaaaatgcatttgcattttcagaggcgatattgtgcttcgcagtttggcttgtgcaattttgagcacttgatccgcacttgatattaatggcaaacaagaaacctctgtaggttataattatttttctagctgcaaagattttaaaaa

SEQ ID NO: 45052 - DNA, 1478 bp, Bovine  19866881053895
aaatattaaataattagggttatggctatggaagcccagccaaagctaagtggcattttcaggttgtaaaacatgttagcaaggaaatctgggattgaaattaagagttcttaacctcttcctggggcttggatcagtatgtccctctgtttccttaatcacatataaccattggattccttggcaactcctaatccagtgctcagttaggcaaaatttggaagcctccaggcaatgacctgtttttcaatgggagaacatatttacttccagctggaacacatcaagacaagccatttctcttatagccccgttcttgccaaaagactggaaaataacttattagtgagtctaacatctcaagagccacaacaacagctgcactgaatatagaacacacagaatgactgaacgctgtgaaactgggatgactgagaccaatgcaatgataattccaggcctcactttgatcttttcaaccagagggcgagtcggaaggaaactttaacacctacatgatcagattgatttagctcgtctgttcatttgtacactatttttgtagcctttgcatctgtgctccttcagataatatctaaattaataatagagacttatgactgaattttatttttagaacctctctatagttcacattttaagcttcttaattaggccaaacatcatactgggaatataaactcagtttaaaaatatatgttattagtcatgaaattcaaatgctcaataagttcaaaggaaaccaggttcaaacaatatattattttgtaatatgcactcccatcacattactgaatatttagagatctactgaattgagtgaattgattagaaattatatcatttacgaaatatatgaatttaattgcaatggtatttgcttttcagccagttggcagcagcatttttggaaaaatctcctatatcctggacaagtgtaaaaaagaaagagagaacatttcaatcctttagtgtttcatttctttaaaaatctcattcttgtagtttaatacaaagatttaaaagttgaaagtaaatgcttatcacccattcacttaagtgctgctaagatactagacagttcaatctttgatcatttagaagaggaaaataggttatcttttatttgaaatttgaatttgtttccaattttgtccaattatggcaactggtgggcatcctctcagcagtgtttcagtggcatatacacagtccgaatgttgagcagacatttaaaaatatttattgaaatacaatgatatatattgtatggcatatgagtactagttacagagatgctgtaaaactaagctgctgctgctggctaagtcgcttcagtcgtgtccgactctgtgcaaccccacaggcggcagcccaccaggctcccccatccctgggattctccaggcaagaacactggagtgggttgccatttccttctccagtgcatgaaagtg

SEQ ID NO: 45053 - DNA, 1490 bp, Bovine  19866881080196
acatttttgcacattgtactcaaagcaatgagtgcaaaagtgatcattttcttattgtttgtgtttctcattggaagaagtaattatcagtgaacaggagaatggataaatatatgatagcatatgtaggcaatggtatatgatacagcaattaaaatgagcaatgatatggcatctccaataacctatgaaaatatatcaactccaaaagtatgctaacaataataagagcaaatacagtgtttacaatgtgtctggtgttggtccaagtgccttacatacattatttaattttcttcatatttatatttaatacctaccacaagcagaatagattgacactattacaaccccatttaatagattaggaaactgaggcatagaaggagggaagtgactcactttaggtcatacagcttgttagtgtcaaaagagttttagaccagtctagatcttaatttcttaatttcattactataaactccttctgaacttttttcaaaattgcatagtataataccacttctatttatttagaaatggtaaaaccatatcatgtaatgtccaaaaatattcagatatattatagaattatagaaaacataaatcataaatatttgcaatttaccataatactttataaaaattgagtatatttattttatatttatttaaaattgagtatatataatctgcttagtatatatacacaaatcctatattctaagtgttttactctatcctttacccctgattcaaatccctcccaggtaaagaaacatgaggtcatcggctgtgactgaagacctcacaatgcacttcccgcttcagttcactcccctccggcagtgaacagctgtggtcggtacagcagtcactttcagcctcagtgtcaccacagccatagtagagcgggctttgatatgtctgcgactatagcaggagtgtttgaagagactgagagtggagagaggtggggggtcaagaaagggaagccaataccaccccttctcatatcccgcttcaatccaccccccacctccaccccgatcccagctttaaatgggcttgtgcagtcgaaaccaccagtttgggcttcaccacaggttcagcctacaatgtggacacttcaaagacttcaaaggtaggggacacagtaccgtgtctggagtgaaaccaaaaatgtgggatttagcaaagcttccagagggtggttcaagggcttgaagtgatttccacttaaatacagtgtaagtgagtgaacaaaaagagaatcaaaaaataataggcccgaggaagaaaaaaaaattttcatttttctcttttgttaatgctatagaaatatcaatccagagggcttggtgagattttataaagcctgatccatgaatctgagcctgactttcagcagcaaaattcaggaagctctacttttatgcttttctactcggttccatttttaaataatgataggtaaaaaaagaaaagaa

SEQ ID NO: 45054 - DNA, 830 bp, Bovine  19866881099621
atgaaattgtgctgtacttaagttggtttcctcaaacattaagagttaatgtccatcctgtggagatggaaagtgtgaggaggaagggggcaaggcaatgaatgtttagttgaaataagaaatagataaaactctgaataagttggtgctttttttccccatagaactcatttgggttcatcttatatttaatgcttttagtgttgcgttatagataaacagccatttgaaaacatttatcagatcggattttcactcaagatggcagaatgaaacaattggaacacgtgtttttactgctctgtattaacataacacatttgaaatgttccaccaactcttttgaaaggagactagaaaaagggaaaaagacaaaagcagtgctctgagagacaaaattaaaacagagaactcccttcacctggttgattatttcagggcaagagataaggctcctcattaagtacacacatcaaagaaagtactgtgtgaggaaactacacagaaagaaggaagggaaagcaggaagcaagggctgtggaaatgtttctccgtttttctaattattcgcttcacttcctagaaaagaatggctgcccacaggtgggttggtctagtttaacatttacctcaaagtacaatgcttattgctggtggtggtttagttgccaagtggtgtccaactcttgtgatcccatggactgtagccctccaggctcttctgtccatgggatttcccaggcaagaacactggagtgggttgccatttccttctctagcacaatactatcgcctaagctttattaacaaagtcaaaattatcgaggaaa

SEQ ID NO: 45055 - DNA, 736 bp, Bovine  19866881102691
gcagtgtttttcatcttagcctgcctggcctcataaataaacaaggatattgtgtgcatgggttggttgtggctcttaggacttgagaggtaaaggaagcacaatttctatatgtgaagggactgtgagggaaatgcaataaactttcaaacttcagcagtggaggaactgggtttacttttaatatttatgtgtaatcttccaggattctgtgaattagtcttttctttctattctgacctttgctttaaagggaatgccagtttgtgtctgaaacaaaagttgctgtcactatctgtttttctttctctgtcagataaagttaagagaaccagcttttaaagtgagtttatacaatcacaatttccacacattcattcaacagccccatgcaataaaacagtgataattcaaattaaatatgtcaaggcaatttaggtcagaaaattttgattttcttctgtgaatgagtaaggaaggaaatcctagatatggcatataaaatcttcaattctctttatgaactgtgctattcaagacatcttcctgacaagtaagaaaaatctaaatttgaccattttcattgatctcatagatttgtatctgcttggctggtatgatcttaaataagtagaagcagcaagtaagtgggtggaaagtttagaatacctattctctctctacatattaatgctggtgttgaatgcaccagtgttgtgctcagttttcttgaaat

SEQ ID NO: 45056 - DNA, 4079 bp, Bovine  19866881106088
gctatgacattgggtaaaaatgtctttccctacctgtttaccattccatgttaagagatctcatttcttcttattatttaaaagacatgttactatacaaagtagtgccatttggcccttataggacagggtcatacaaaattacctatataaacatttctagctgtagaaatcatagctcttattcaataattgtcagagaataatttatagaatggtgttttgggagatcattagtcatttgacttctggaaaatgggttcatttggaggtatacccttcccttctccactttgtccttcatttgaatctttatgttgcatctgtttatttgatcactgctttctagtaaaaacgtgttaacatggaatgtgttttttatgtgaggcactaggaacaaaaagaaaaggagactaagaaaactaagatgaagccagaaatgagggaggtatacaaaataaatgccaggggactttgctgtttgctagaatcttgactttgaacatcataataactaagaaaaagagagaatgtcttcctagctattctttgactatgtaagatttgggagtccttttctagtcttcctctaagaagcaggtgactcaaagtagccaacttgaacttcctgggctactttcttctcagcaggtccattggacaacaggacaaatgacaagccctagcatgttgggctttctgtgattactccctagtctgtcttttgggctttgctcccacatttctttcagattccagttgagtgggatagttcacttctccttgagtacattctctgactcttccttttgatacactgtctctcctaccaagcctgctctctatttccatcctccaaggctgagcccaaatgccacttcctccatgaagtcttccagaatgcccacaaccagaactgacttttcccaacttctcattcttgcttattttccccctagtacatttagcttgctatactttctatataagcagcttagtacatttagcttattatactttctacaccttcttattatactttctctctctatatatatagctagtagagagtataataagctaaatgtactaaaagaaaaaaaatatgtatcttattgcctctgattataaaatactggatgggaagtatgattcaatactaatacactcaatattaagacatctaattcaatactttacatataattggtgcttaattcatgattcttggaatgagtgatgaatgaatgaatgaattttagctggtaagatttgagattcttcataaactgaagtggtttggctttttccccaacttggagtgagctattttttagagttgtatttgattttaaaaacagaattaggggactataaaaatagcctgcaatgagttatttgagcagtctcactgttttttaagagtggtaatgttccttttatgatgcttttcatttatagcatggccttatagctggctcttttttgaaacacaatcccattattatggctgccttttgcctcaaacaacttcccataacattagaggtataatattgcaagaatatttttctgacagagagatttctggtttgcagtcaggggggatacgggatgtcaaattgctcatcatttctggatctgaggggaagtagtttgaagattttattttacctatgtgtttctagccaaccatatcatgaaaaacatatttccctatataggacaaggaaatggctcaaataattctcacactttgctgaaatccaaacatgaaataggattgattttgttttctttcatttctttggatgatccaaacagaaaagagtgcatgtaagaagaaaccaaaaagctcagattcattttgagagtttgttgttgaacttttttcaaagagtggtgggtacgagcctcgaagatttctatgtctggatattcaaggatggctttggaggtgttggaggagctggagagaacagtgggtggaagtaacaagtacagaagactggagggtgaagcctgaaaaaaggcaaagtctgcatttaggatcctccttgcctcattggaaaagactgatgcttggagggattgggggcaagaggagaaggggatgacagaggatgagatggctggatggcatcactgactcgatggacgtgagtctgagtgaactctgggagttggtgatggacagggaggcctggcgtgctgcaattcatggggtcgcaaagagttggacacaactgagcgactgaactgaaccgaactgcctccaagtgctcggcacctcttaccctgtaagctcccttggcaccatcccctctgtttaaactgacttattctccatctagccccccaggaatcagattctttttgtcctccaggacaggactatttcttacctgataaaccaaactaggataattggatattgtgaaaaagttgaaacccaagtactcttctttgctttctgggcaaatcagaaagtgtgtgtatgtctgtgtgtgtgtgtgtgtgtgtgtgtgtaacaacgctgttaaggcagtaacaagattggatggaaagaccagaggctttggacttattcatccattagtttatgctcatattctgctatgtggcttaggtacagtgctggacatattcattctcttctcagaacacctgttgccccttgccctatctggaagactgagaaatggattaaatgagctggtaggaaagggctgagtatagatgagtacgtatcggccctaaaaagtagagcccgtggaacactacttttgatggttaattctatgtgtcaacttgacctgggctaagggatgcccagatagctggtaaagcattatttcctgatgagtctgtgagggcatctctggaggagattagcatttgaatcagcagactgagtagaaaagatttatcctccccaatgccagtgggtatctttcattccactgagggcttgaaagaacaagaagacagaggaaggataaattcactctttttgcttgagctgggacactcatcttctgcccttggagtcaggactcttggttctggaaccttcagacaggggcttacatcatcagccacctaattcatggacctttgcactgggactgaattacactattggctctcctggttctccagctcactcacagcagatggtggagcttttggcctctataatcacaaggactcattcctgtattaaatttcctcttatgtctgtatctacgggctttccagatggctcagtggtaaagaaccctcctgccgatgcaggagatgcaggagacataggtttggtccctgagtcaggaagatcccctgggaaggaaatagcaacccactccagtattcttgcctggaaaattccatttttccaggcaacagagggacctggcgggctacagttcatggagttgccaagagtcagacatgactgaggaactaagcacaagcacgctatatctatatcctatttgttctgtttcagtggagaatgctaatacgctgcttctctccactttcctctgcctttcttaatagagacctggtgtatcttgcttacctgttttttttggtgtgtggtcccacataggaaacaacacctccttgcttagccagaagtggggtattttgtttcttagctcacactgtacaaagagccagctattctgcactcaaatgtggctcttttaacatgtgatttctgcagtttgaggttaaaaaaaaagcaaaacactagatagctaggattgttattggaaaataaactttatgataacgaactgtatatttttatatctattttgtgtatgcaagagataagcttaaaaatacaattattaataattatatttcaactttattataataatattgcatacatccaggaagaaagcagagaggtatgaaaaatgaatgaataaatggatgggtgaggcttatccctcatttgtaaaagaagatacagcaattcagcaatggaggttactgcagcagtattgagctcctggggtatagtgtttactcagagataagtcagggagttttatctacta

SEQ ID NO: 45057 - DNA, 1227 bp, Bovine  19866881107589
aaaaaaaaatcagatgttcaaggtaggttatatagcagccaagaatagtagttcatatcagcctcaagaaaggccgagcaccttagagcaagagccctttaatcaaaaggcaatcttcagggatgagttagtagtactttgcctctggcactaacccagatcccctagtttcattgtatatttccacaggagtctaacgacgaaacacattagatcttctcacaggtgcagtagaaaaagcattgctttccaagggtcacatgactcttctaaaaacaagggggtgaaggtcaacagcaataagagcatccaaaccaacaatgaattctgcagctaaagtctcaatgaagaaggggagagattccccttttcataggaacgttcatgggaaactcacaatgtgcaattgtgaagaagagcaacaggaaacagtttggttttttcatgggaggggttggggtgcagatctttgtttaaaaattaaaaacttacccttttagtcaggaggatatccctgatctttaaccagaaaagctttaaaactgtaaggaaaaaaataaaattcatttgagggcaaaatattctggtactgtaaagatttacattgatccagtgggttttatctgtaggtctagatctataaaggcacaagcctcacttcataggaatgtggttcttcatcatttgcacaaagaaaggatggattgcatctaattgagttattttatttatttgtattttatttattttcacataggcagaaaaagaatgcacacacatatgcagaaacaaatagcataaattttcacttttcatatatatatccgtgtgtaaacacagaagcaccctcacatacatccagttttgtagcacacgtggaagacacagtaactctcctccccacattacggtctcatgaccactcccccaacatgggaggcgtccccgaaacaggacaggaggtaatatcttagatatactgtgcctttgaaacagctgcctcttccttgggttctgcaaggagcctctagtcaaacaggtaaaaacatatcagggtgaatcaggatgaaaggcctataaatatgccatatttgtgtttttatgttgggtttgtgttttgttttgttttgaaccttcactgatttgggggaagtaattaagtgctttggcataaaagatctcatgctgggtgataggctacatgggaaagagaaattagacaaaagg

SEQ ID NO: 45058 - DNA, 948 bp, Bovine  19866881149998
taaggcaaacctggaataagtttcacacagactcccctttcccaactcatttggcaaaattagaatagtttctcaggaggagggattggaagccaaaggcattaggatgcttttataagtcaccttggtagaagtgagttttttaccatgaataaaacacctgagaaagtgctatccctaagcctttaaataagaaagcttccaaacatttggagaaatcatccgaagacagaccatttcaataaaagttccctgattcagttagtttcatctttgtctaccaaagtttttttaagctttttaaattctcttgtgacaacaaataattatatcatctcttccctgactcctcccaaattataaatccagttgaatagatgataaatacccaagcctgtacccacatgctgctaagtcacttcagtcgtgtccaactctgtgtgaccccatagacggcagcccaccaggctcccccgtccctgggattctccaggcaagaacactggagtgggttgctatttccttctccaatgcatgaaagtgaaaagtgaaagggaagtcgctcagtcgtgtccgactctgtgcgaccccatggactgcggcccaccagggtctccgtccatgggattttccaggcaagagtactggagtggggtgccattgccttctccgtgtacccacatattcccattctaatatcctctcctgggacttttctcttgcctttccttctgattacttgatcacttgaccaaccgatttcagcaaacttccccatttacaaaaaaaatatgacactggtcagatcagtgatttcagttgggggttatggtaatttctctaaaataagagttaccttaaagtttgatttccaagtatataatttagaagcagctaaaacaaaaggaactctgccagggtaaaaaagaaatcaacttaacagcatag

SEQ ID NO: 45059 - DNA, 1052 bp, Bovine  19866881240829
cacagatcagataattcaggcacaaatcatatgaattaaaactatctaagcagacaccatgttggtatgtgggaaaaaaattatattttgcacctgatggtctgcaaactagcagtttgccttccagaaggggagggaatttcagtgacaagggtcttctgaaaccgtctgtgtctgcttccctgagattcaaaaatggccttgtacattctctccgagcctcaaggcttgaaagtcatccaaaagctggggaccaatctaaagtaaattggcttatacccaaatttaatgaaacttccttagaggaaactgatttccctcattatcctttatgtagataatatgtggaattaattctccttcactaagttatcattacatggagcagacaaacacagatataatattattaaaagtaatggaacgagttcatccagtgttaactttaatggtttgaatcttctcaagtgtcccagagaaatgcctctgtctcatcgctttagcagattaaaggtcagggctaaggttaccacatttcatgctcactaaagaaggatctgcactctctcaggccttactcccttggagctttgaatgaagctggcctaagagcaaacataactcgtctaaagacttctttccaaccatagtggtgaagatgcagaattgtatttctctatatatattttgcaaagtaattccaaaatattttatttttataatgaaattataaacagacatatatgagatatctaacctttgttatagattcttcctttctgcatcttggaagtagtatttcttagttaatattcaacaaacatacttatatgcttattaatattcagagtgagtaaaggctgggaaggtaacacctttacattttaagcatcaatcttgttgttcattttgctgaagtgaaacctaatcaaccctttctttgctgcaaaaaagcttttactaagcatctctcagctgtataaaaaaagagaattccagaactgtaagtgcaatggaaagaatatacacttacacacacatattcatacata

SEQ ID NO: 45060 - DNA, 1048 bp, Bovine  19866881295614
gtttggtcgatggagatagcactgagtggagactttatctagcacagctgtgcaaatatcctgggtaaaccaggtcacataagactcatattcctctggcagtactcatggttgcagaaaataggtctaagagccatctcgttctggcccttttccaacccagtgatgaatccgtttatcaaaatcactgtcacgtaaatgttgaaatgttctaagaccttgaccagggtattccttaaactttaagagatggaacactttgtaatgtattttcaaattgaaagtcacttatcctcttagcaccccaaggaggtttacgaaccaaattcatgctaagaaatattttgaaaagaaccagttaggcttagatggaaagcatcaacacagtggattgcagtgtatttccaattctatctaaaataggttttcataatttaaagtttagggttttatttactcaggggaaaaaaaaaaaagtaaatctgaagtactggaaacgggatgcaataaaactctaggatttcatccaactattgcttggaaatgaaaattccccaatgggaataggtctttgaaatgggacatctgggttttactaagtgggtaattaaaagtttgaagtcttgcctggaaaatgggacaaaagctcaaattaccaagataggtgagacattccccactgcctttatcataggaatggcaggggtccaggctctaacaaagcaaggcagagaatgtgtggagcgttaagccacccaaggataaagagaactttgaaatctgatttctaggggatatttttcagaaagcatgctatatttcccgcagctaatgacacatcctctgttccaagtccagcacgtggtgactaatgcacagccaggtaaactgtcatcttgaaacaccctctgctctttagcgactcactaccaagacctgggctttccagggcaatggccaggcaccagctcagaatgaaagtcaccagctagccgttcacctggatagcctcctaaggcatatagacgcacgccaaattcaagtagaa

SEQ ID NO: 45061 - DNA, 798 bp, Bovine  19866881341634
tggtgatctgggttttatcatagttcatctcctcaccagatgagtttatgttttctgtgtattatctctgggtccttctctccactgggggtagtgatgcctgcgttgctgtgatgccaggatatttgagaggatcccagaaggcagcacatgagaaagcagctcatggaccataagcacaagccaccagttaggtatcatcatccagttggtgagacggtagcaactggtcttgttgagtgagaaggcacctgaaagccacaaccagccagtgttatttttaaatcctcaaattttcttcatatacatagatttttagaactttgcatatccagccatagcaaaaacacacagctgatactttagatgaaaggtaatggggacagtctgctttatggctacatagggggaaaggtgggggtgtgtggacccacagcaatcccaggagggaggaagaagatccttcccgggccaaacatcatacccctgcccctgtgcttcccagcttttttgtgttcttgcccatctttggggggtggggggagacatcctagctagtataatttgctgtggatttgggattacaaaaataagatcattcttggcaaaaggttccagatgctaggaaaactactacagaataagccggctctgcagagtgatttgattcaaaatgtgtccaatttctacccaggagaaggctcctgaaatgtctgtagcatctgcgggctctgagttactcccgtccagggccccagatgctggcaggcatttccctctattaaatcagtcttaaag

SEQ ID NO: 45062 - DNA, 926 bp, Bovine  19866881343913
aaaagtagagaaaacagcttggtctccataatcaataccttaaaactttggattactataaattattcagattttgattgtgcctatctgtgctttgtctaatttgagaagaaaacatttctcttttttctccctaaattctaatttttatccagcagatatatccagtattttacctctggttcatagagtgacagtcataatctatccttgatatttaaaatgtctaacaaattattccatggcataccatctctgttgtcagactaggtcatttcaacactttaggagatttgcatcactgctatgagaacatgagtaatgtctcatgtaattatgaggaatgatactactgtatttcatatgttcctctagaggaatattggctgttttcttcaagattatctaggctctgtgaaggtagatacatggcattgataacagttgaaattcagaagagttagcacatctttgtatctacaaatttccatatatgccttagtgaaaataaagcagcatttttgctgcattcagatctcagcaaggaagtaattcaaacatactctttaattttcacatgatttgatttgtattaaagaaattttaaattgttatttacttttttatatatagtactttccaggagcagatgagccgttacaatatccttgtcagtattcagatgaaggacagagcaactctgctaccagtacaggtaaatggatagattggaacgtaataagctaaatgtttgtgtctctgttcctgtgaagtgataatcaagaagcaatgactgatgtccctttttgcattttaatttattcctttaatatgattgcaatttgaatttttcaggtgcatcattcttcatgcaggtacccagggttagttaattgaaaacccacttccaagttttgaaattctta

SEQ ID NO: 45063 - DNA, 757 bp, Bovine  19866881371470
gttgtatctatacaataaaactcaaaaagacgtggtttgagtagtggtgaggatttctattcatttgtgccaagttccacattatatttatctccttgctatcactcaaacacaggcttgattcattaaaaaaagtggtctttgtgttaccctgagtccattcttccggctatataaaattaactcgagttctccttgcctttgtctcaaagtttttttgtttctttgtattctctagctgtatttcttctattgctcaatgaatgaggggaaaaagcacgtaagaattcaatgtgtaaattctgagtctcaggtcctcagagagcctgtctctgcctcaggttccttagaccaagcaataaaaatgctgcatgaggtggatgtttctagactgtgtgaaaatgcctcttttctcttagtcttaaattacaggattatgagtcaagttaattttcattcagccttatctatttggaatggaacatttcaaatttaaaactatttttcttttcataagcctcaaatgaattatatttccatgtgttcaagtaagtggaaaaaagtaaagtgacaattgattgtgtcaccttagccaagaaacagcagaggttgatgggctctggtggagatccatgattgggtcctgtaataggatgacccaacctgtcatgagaaccacaaaaactgccagtttggcaaatcaggatgatcatgggaactaagtcagatggaaggacagatataatgccatttatag

SEQ ID NO: 45064 - DNA, 1262 bp, Bovine  19866881375974
gtataaacccacaacaatcaaaataaaaacaagttttcacaagcccattgcgaagctaaatatagattttttttttttcagatggaccccactcaccttcaaattcatgacttttgagaactatttcaaacattattttcaaaaagaatgtcagtcaaaagaaaaatagttttgcgggggagggagggtgaggctgggcttgtacgtgtgatgggggagcatttctctgacttagctccccctgcaaaaaccatcaagctgtttttaaataccatttgtggtcacctgccctggtaatattttctaattgtggtcaaaagaagctgactaaatgtttgtgtgttcgctccagggggaaactgtcagaagccaggcccttagtggatggccttccgcggtgttatttctcacctggttcttgggtgcatctgtgtgagccccctctgcgttctgccactgtaaagagcgtaattcaaactggaaaccaaagcactctggctgcagcaggggccatgcacacggctttttccttttcctgttcctctggcctcacctctgtgcccaggaggaggcagatggcaggggctgggatcacctggggcctgagggttgccccagaaagatggccccttgggtcctcaacgtgcggtgagggctttgagccaggacgtttgaactgctgagcaatttcttattaagacgtgagcacccaagtgtcagctggagccctaggcttttatttgtggtgggctgttttcctgtcacggttgttgtggttcaccgtctacctgagtgttcaaaactgctttgcagaatccagtggctgagctccagatgggtactgctccttccccacccaccggtggccccccgggacaacaaaccccacgtgcatctcctcctaggccccactgcattcccatccggagaaaaatcgtgagaaaacaggcatgagaaaacacattgtcagatcttcagtgtgtatttccaggaatggtactttggggaaaactgagacaggtctccagattgctgtgccaaagaattcagactgtgatttcccgaaacagacgatggaaatcaattgtaaccccatgaagtccaagaatggaactgggacttcaaaagccttagaatttggggaaccatgcctcatttatgctaaggaaataatcatgaatgtgtaaaacattttcaaaactaaagatacagggatatttattaggagttcacctagataacaaaaaaggaaaaaaatctaa

SEQ ID NO: 45065 - DNA, 1156 bp, Bovine  19866881457003
ttcaataaccaagttggggaccaatgaacagacatgaaggattaggaactcacagactggcctgagcaaaaactccccaactgattccaatctcaatagcaagtgtttactcaaaaacactaattagcaggcaaaatgtgggttcatgaaacagtactctccagaaagtgaggaaggatggagaatgtggagtgggggcagtggggggaagtaagaccatttcccttgtgcgaatgatgagagaattgcttgctcaagggcaaattttatggaaaatcatgatccagtgctaacagaggagaaacctttccaaagagttaatggagcagttagagaaattcaggttcagtaaatcatgaggactgggagtattgatctgaacatcctggtggatgaaaatatggagctgagctgctgaccaaactatataatagaacagctcttccacagaggatggggatttttagttgctgagctgatgctgcagtcttgcccacccggctctccctctcaagctggttctctttaaaaaaatgctttccactctgttctggaagttggtcgactaacctcccactcacataactgcccttctcatctctgatgagttccaaatccacaacctccaggccaagctctcatctgacctccagggggacagttctgggtatctcagggaatcgggtaactcactgtcacaactaaataaatgctcatcctgcccagagccctcaccaccatcatcaatgaaaaaacaaagcaatcaaataaaccataaatcatttcaatcgtgtttcctatctgccaactttgaaaatatgggtttacctgtaatccctccctttttcagctcctttacccaaactgtcaataatatcagcatttcaccagttattccagtgatttctctaattctgttgtgccatctagagaatgagagtaagagactgacatgaagactgaccaaaaaccatgtgtgtggaacattcagaatgataccaggcatttcgttattacacacaagccatcattttgaccagcactggcactgcaggaaactatttgtccaattctttcctctagacactccaccagcatcacatcaacaccttcattgcctcagccattggagtttgggatggttaagtttccaagc

SEQ ID NO: 45066 - DNA, 1334 bp, Bovine  19866881563981
tggagggaggtcctgccctaggcagcgtgtatgaaatgtgatggttaaacatctgttgtggctgcactgcagatatcttagggaaggattctgagagctccagcaatggctgtcaagcttagcagatggcaggatggctgtgggaacagactggtgattctagacttggttcgtataaaacagtctgaggagggaaaaaaaaaaaaaatgtagccaccttacagcattcagaaggttctctgcagactaagttttgaaaagctcctccaagcataatgccatccacatttctctgccttctgaagggacagaggcctgagtggcttccttgctggggggcggggagccagaactggcagctttgcaactgactgaaaatgtgaatggaaggaagagaaaactataactgatatttgttaatagttaggtcagatcctctacatttttatggatttttttttttttggtgtagctattctactattggctgtgggtgtgggtgttaaaaatctccagctatgattgtagaattttctatttctccctttaattgcctattttatttcatgtattttaagctctcgactgaactgaactgattttaagctctgttattgggtacataggtatttataattattatatctttctgttgaattatgagttcttcttttcctatggccaattatttgtaatgaagtctactttatctgatatcattatagctgctctagtcttcttttgcttactgttggcatactttttccatccaattcctttcaactgatctgaatcctttatgattaaggtatatcttgtgtaggcaatacctagttgggttttactttttctgtgtttttgaccacctgttttctaaataaagtccacttaaaattgaatgtaattattgatatgattggatctaggtctatcattttcctattcattttctttagaaattacaaaatgtaatgcattttatttatttttaattggaatataattcttcaacgttgtgttagttttttgcttacaatgaagtgaagcagctgtatgtatacatagattcccactctcttggacctccccaccccacccatctaggtcatcacggagcaccaagctgagctccctccaccgtctagtgtgtatatgtcagtacattctagcagtttgtcctaccctttcctcctgccccctaccctcgtgcccacatgtccattctctacatctgcatctctattcctgccctggaaataggtccatctgtacccactattcagtttctatttgtcccaactaacacttactatcgagaaggcaatggcacccca

SEQ ID NO: 45067 - DNA, 942 bp, Bovine  19866881625925
attatcctcatattctaagagattgtactgtgaatgcttaggtatgtgtctagagatccccaagaaagtaggaatcaacatcatatatgttaaaagaaattagtcaaaggaaaaatcttacctttgtttgtgcatgaaagatggaactaaattgaaaagaaggagataaattttctatttctgtggtggaacgagtcaaaggtaaaccatggtgattctgtttagggatccatatatatgcatatcatgtagtaagacacaattgcttccatagcaataagctacttttatttgttcttgtttgttatgaagtaagctttgttgttctccggggccccaagagattttagaagacgataatatgaagatggataaagcatagtctgtatcacatctgtaccgagggaagtcaatatatttttagtgtaagaaaattggttgtaacttgttgataaagacgaaccagtttgcaaagaaagactgtttgaaatctcagagaatgagtcttgaaccttggagagctgatataggatgggtaagacccgggacaacagttagttgatagcatttctggagcacacatcaagtgcagaatactgtaaaggatgtaatgttcgttccaatattgtaccgtgtgacatgtatagtttgacaaatttataaattgatagagaaatatcattagggccgctggtttgactgcagagaagtagcataaatgatcctctgtccaagtggaaatgttttctgctgctttttctttcattcctacttagaaaaatcacatgaaaactatagaactggggagtaccttggatatccagtttctgctttttagaaattaagaaatggggaggctcagagagggtgtctgagttgtgctaggtaacccagctagagagtggtctattcaggatgggaaaccagatctgtggtccaatt

SEQ ID NO: 45068 - DNA, 758 bp, Bovine  19866881725660
acggcctccctgtgcagtgtctagcatcaccttgtatgcttggacagcataggccagaaaattcatttaaagttctctgatgtactaagatgctgactctacaataccctctcctgtcatttccaagcccagtggatttgcagtgatagatctatgtcatttgggtttcgtcatcatgagtgtggcctccacaaagaccacttcttcgatctttcctgggatttaatcattcagttctccagtcccatgtgtaacccatacccagggagagcctgtacctctatcttaatctaggcaaaaaataactatagtaatatatactagacacttattgcatgattattatgtgccagtcacagcaccatgaaatttatgtatactagttcatttaatccataaaatcatgctgcaaagtcacacttttatctctgttttatggataggaaccaaggctcaaagagtttaaatgacttatccaaggccacttgaagtagctgcatcatatttctagttcatttctgatgctggagctagcataactatagggcattgtttagtgatgaaaaccaaatctcccttgttctttctcttgcagaagagtgcttgccaattttctgtctatcagagagcaccataagacacttaagtgagaatgttgtttctgctccatatactctgaaaactatggaaagcccttcaaaatcataaaatcttaaactgaaagagacctgaagcattaactagccccaaacccattg

SEQ ID NO: 45069 - DNA, 1274 bp, Bovine  19866880420889
acaattagagttacaacaatcattagtagaccagattaataactcttatcattagtcatctcctgaaatgtgagattccgtcatgactgaattgaagccttttattcattatacctttgtattttaggtctcactgacttaagatcactttatagtgtctcaaaatgcctttagcacttactctttgtcctaaatcattaaaattgtaattttatacttcagcttctaactaggtattacagttattcatgaaattcacgaagcactttttaaaaggactgcttaggaggttaggttgtaaattgtttagtaatttacatcttaatgttacagggatcaattgtctttccttctttggtcaaaatttggaagtttcctggccgttggaactgttaaaggaaatttgctaatttataatcatcagacatctcgaaagattcctgtcattggtaggttacagctggaaacactgcttaatatttgggatgctttaacataaatgtaaattttatcacctcaggtttccctgatactgcaggggaaaatttgtagtttaaaattgacttcccttgtcaagccatacctctgtctaactagaagatccatcttcactacctactaagaacttcccaggttacatagaacaagttgccctcaggtgagtgagcctgtgcctctggacaccagtacattaatagcatgatttccatctgtccctttctcacccagattatgcctctgctatggagtagctcatgtgcctatcaacacattagtagatgggctaaaacatttggcgacttcttagacagagtatatccatattcctaattctgacccctcactgtctccagtcactaatctaggagtgaactaggagttatttttacctcagggtatatgactggaaggtatgcgtatttattccttctttgaccttcttgattcagcctctttgattcccccagcctctggcacttagcatctgactacctgaaggaaatagtattgatttttttcaattgttgtaacatcaggctggtgaggggtgaaatgggtaggcttaattataatttactgctaatggaagaattaaatgctggagataatagtgcccacagaatacttgagaaagggcttttcagttaaagacatttattcatttcaagttattttcacatatatgtatatctttcatatgtgtatttttagcactcggctatacagttacaccattgatccatttaaaagtgaactaaaaaatcagctttcac

SEQ ID NO: 45070 - DNA, 1283 bp, Bovine  19866880427468
gccccagccttggatctgtactcatttctttctaggcctatcacaaagcagtcatccttgaacaatccagagttctgaatctgatgacctacactttcttggtttactcttttattttgctggagtgcatcccccagtagcatctggagcaacggtaaaaagaagataaacattttgatactatgcatgcctaaatatatctaagttaaaaatttgttttctaattctgaattttgacaacaattatccattgtcttctagcatccattgttgctgagaaatttaatactgtttaatttccaattttttgtatgtgatcttcctttgaaagctcctagaatcatatctcattgcattctgaaatttcaagttcatatgtacttgagttgctattttaaaaatttattataatgggcactcaatgtggtcttttttttttcttaaaaaatgagatataattgacaaataacattatattagttatattaagtatacaacataaggattccatatctgtatattcaatatactcttaaactggagacttgggctttatttctggtaaatgttcttgtgctgttttcttgataattttgttccatttaactcttggttaaatgttgaacttcctggcttaaccttttaattttcttatattttttacttcaccctcatttttaatttgcaaaagctccttttgttttctaatgtttcttccttctccctgtcatttcctttgctctctccctttccttccttccttcctgagagaatttcagtcttatttcaggaatacaaaatcttagcgtcttgagaatgttaatttacttttttgaaatgtttggctacctctgcattatctgttcctctgggtttttctttacccgttctgggtttatttgttttggtctctgtctgtactgttggaaactttcctcaaagatctggtgatccttggatgtttgttcagattttcaaatgaatggctgcaaagctgactggaagctctgtgtgagtgggtaggttttgtcatcttgtgggcttatttttagattaaagaggtagccagcaagcttgtgggtgagggtgtggtcccccaaatgtcagtgtgtaggtactttctctgtagcaagttagtttatcaagaaaaagtgcctttaatccgcagggaaggataaggctggctgttggcagctgtagcacagagtgaggtaagaggactggggaatctcagttcagaatgcagactttcattttcattaaatcctcacctctgccctctt

SEQ ID NO: 45071 - DNA, 1439 bp, Bovine  19866880460133
tataatgactcaggaaacataagcttatagtttcactcattgtttcaaatattgattttactgattttttgatgtttttattctaggactgattctgctaaatagccttgatttgtgtaagtctctcactttaaactttttttctgtgtttaaatacaggaaaacattacaaatatttaatcagtttattttaaaggggatatttcaaaatataaaatatatcaaaaagctgaatatttacaattatgtcataggttactattaatagtacagagcactgaatgtgtaagactcagaagaggaaatatacaaagtataaaaaatagcatgttatatatcactgtccctctacagaagttgaaagtggtgacctggagatgtgaccttattttttctgtatccaggagggaaccatccttaatctgctaggggcagaaacacagcctcttgtggaaaaatgctatcttctcaggatcattatacctaaaaaggccaaaaaataaataaataaataaaccccatatgcttttataaaggtttcaaataataaactggcatttagtaataaaagctaagcatgatattttgcgcatttctagaatgtgaagcaggatcactacatgtaggtgagaaattttcagtctgtaattagtactgagtttcagtcttggcctttcagttgataaaattgtatgggcaggttgttgaacctctgttataaagtgaggatcatgttgacaacagccaccttactgagaagaataaggaaatgcaaagttagtgctcagcagctcaacccaaagagacccatgccaagacacattacaattaaactgccagaagttaaagacaaggaaagaatcttaaaagcagcaaaagatagcttgttatgtacaagggaacctcctccccataagaacgtcagcagatttttcaggagaagctttgacaacatcaggcccttctcttctagcctgtaaagtgctgaaagaataaaactgcccgtcaagaatagtttatctggcaaagccatccttcagaactagaggagagagaaagaattttccagacaaggaaaagctaaagaggttcatcaccactagactggccttatagaaatgttaaagggacttctttaagctgaaatgtaagggcactacttaataatagggagatatatgaaattgtaaatctcaatggtaaaagtaaatgcagactaatgaaagatacttacaactagtgtgaaagttaaacgagtaaaaataataatgttttattatatccattaagtgaataaactatgtatataaactattctatggatacccttctcataatgcaaaggttttataactacagtaatttgttaatgatacataaggttcagttcaattgcttgggttgtgtccgactctgtgaccccatgaaccacagcacgc

SEQ ID NO: 45072 - DNA, 1937 bp, Bovine  19866880501902
ttgcgacttaagtgagatttccctggcgcctctgaaagccgaacatccccccaggaagtggtcctttgcttagggaccccattttggcctctgaatcaaagtcttttgtgtttagaattgctcacatggagtgctgctgcttttctcccttcactgaccgctgttcttaagaaactgacaagaaaacaaaccagagagccttttcgaaggcgaagtcctaaaattctctgtcgtgacatctatatagctgtcctgaaatgcattgttggctgccacaccatataatggctttatttcatgttaagaaaggcctttcttgagtgtttcaggagatcgtgtttgtgtgagaccttgaaaaattataccttcttgtatataggaaaataattgagtaaggtcaagaattctggtgtatagaaaagaaggattcactgatagggaacttttcagggatatacagaggaggaactgttcattcactgccctcaaagacacagcgagtctgtgagtttattcaaatcccctaagaaatggacaactgtagtctggtctgtttcttggtgggtaggagggtggttctggaaatgaaagaggttactgtgtgctctgagatgtgcttggtagtgcccagcatctagtttaaggtaagggatagacaaccctgatttaaagagtctcatttcttctcctgttgctgtactcctttaataggaaatctgcacccaatactcatactccatctactctcttgttgtttccacagctttacatgaaacccattagatataaagttaacagtcttattcattgactaaatatttcccccaggtcaggcatttgttagtatttaatttctgaaatgtctaaaatgatgtgtgaagttgatgtgacatccattgccttagctttgttgttgtttagtcactaaactgcatctgacttttttgcaaccccatggactgtagcctgacaggcttctctgtccatggcatttcccaggcaagaatactggtgtgggttatgatttccttctccaggggatcttcctgacccagggattgaacctgcatctcttgcactggcaggtggattctttaccacttagccaccagggaagcccattatactgggtagttatagagtatactgaagaggggtggagatggagggattatattcaccttagattgtaataggaggtttgctctttgttagccagagcttgtaggttgaaatattgatctgaatttgtaaaatttttaaagaaaaatagtttggaacagcttggattgctgtgactttcccaaaacacggggtcaaaagtcatttcaaactgactcgttcttaagcaaatattaccatttcccggacagcacagtagaggatcagaaggtatataaaagtagaaatttaaagtggtaccagaagatatctgtgtcaggtaaagtacatcactaacactgtatcaagcttcatattaaagcttattgacgattttgttgaaacttccaagtggtaatttattggacttgcaaagatggtacatcgggcttcttcagtaatttctccattgtcatctgcgagccatatgaaatagcaacacaggggtaccccaaaacacatgtagttctataatacaggcccacctgccatcagcagtttaccctagctgtttatatgaaaggcaagctgaatatggcctggcaaccaaggtggataagaagtaactctgggggcttccctggtggctcagtggtaaagagtcacctgccaaggcagggagcacaggttcaattcctggttcaggaaggtcccacatgctgcggagcaactaagctggtgagccacaacccctgagccagcgctctagagcccaggagctgcagctactgagcctgtgcgtcacaagtaataagctcgtgcgcctagagcttgtg

SEQ ID NO: 45073 - DNA, 1448 bp, Bovine  19866880514530
caattatattaggcacatactgactggcacattactggctctcaatatatgtttaatgagacatatataactgctgacgtattccattataaattttgttgtgaaaaaaaaattttttttgttgtgtcaccagttcttccttatcttgatccagggttgacatcttgtctggccatggaggtagttaagaccaaatgaaaatttcctgtggattatttgttgtaaagaatatgatttgttttacacagaactagtaataatttccccttaattatatgccatgaagaaaagcaagcattcttaatcccatgacattgggtagaactggaggaaaacaatagttgtggaaaattttgccagagtatttcttccttcgccccccatttattataatttaagaatacactattatcagtagtttgaaggatgttgtgattagaggatggggaaattgaactgcagctcacaaaaacttgctgacgactgaggtggagtcctctagggttgccttagattacaccatcaatgatacagatttttttggccatgtcgagaggcatgagggatcttagtttcttgagtagggatggaaactgtgtgccctgcagttgaagctcagagtcctaaccactggactgtcagggaattcccaatggttcatattttgaacctcaacttttctagttcaacaacacagtcaagtcagttaaatgaatgagttaaatccatgaattctcatgccaacaaatttcttgtgaaaataatatgtaaaccaggatgctttaatttacaatgataactgtaaccagagagcaggttgtatgccttatcagctgcttgatacactctttcttggtaggaaaataggggaggccatatagctataattggtcttcccaggtggcgcctgtcataaagaacccttctgccaatgcaggagatgcaggttcaatccttgcgtcggcaagatcccctggaggagggaatggcaatccactgaagaattcttccctggagaatctcatggaaagaggagcctggtgggctgcagtccagtgggtcgcaaagtgtcgggcatgactgaagcaacttagcatgcatgcacccatagttataatcagaaagtttcctggtgaaatgaaatctggagcaagaagaattagatgggtaaacttctagtttttatttttaaaaatgtaattttttttggctgcagtgggtcttcattgctgtgctcgggctttctctagttttggtggtggtggaggctactcttcattgcagtgtgaaggcttctcactgcagtggcttctcgtgtggtggagcacagggtctaggtgggagggctcagtacttgtggaccactagctgcctggacgcatgtagaatcttcctagaccagggatccaacccggcaggtaactctaaccacggaccactaggaaagt

SEQ ID NO: 45074 - DNA, 1402 bp, Bovine  19866880573864
aacagtgttgcataggtcagttattttatataatgttctctcagttcgggttcattcagtgtttcctcattactgggttgagattatgcgtttgcagcagaaagtccacagagtaacataccctattagaagacatcagccatcattttaaggatttgcaagtagttcataacgttcactgtagatagtaaattccaggccagaggtcttgatctctgtttatatttggcaaagagtactcagaaataaactaattttgagcacctgaaattacagagtgggtttgtaagagaagaaaatctgctatcacggagagaaaagaatccagagtaaagaaactcaatttaaatttggcatgttttgaatccacatcatttccaagaaattcatttttgaagtcatctgcactatttcatgcatacctccttagcctggcctttcacgatctgatccttttctataatactttccagcttccttatgctcccctactcacgttctgtcctccaagcctataaatttttttcacatccctgtgtgtgccgtgtactttaatgacatttttctctctgtttgtagcagaactttctggctacctctgcttagaatgtctgaattccttcagtttacttggcaagatcctattcatccttgaaaacttctcaaatattttctctcataagaagccttatgtttactattgtaaacccaactgtcttaatcctaataagtaaattttctgaagctttaaattttaggtagatgtagaagaatggcgtatctacaccatgcagtgagaaaactagtaaagttgaataattaccagtattgttatattatgtatatttttcatatttataactatttacagagctctcaatgaaatgtggaagtgtcagaacatgcttagaagtcatgtacgagaactgttggatttgcacaagcagcctacagtaggttcatgatttgtttaaattcacagttttagtcattgttaatttttctgtataatgaagcaagcaaaaggtatcttagctgttttatattctaaatgtcagttagtttctgtggttatccaagataaatttacatttcacatgaatattaaaaaaatatttttcaccatgagcacagaaatggtgttttctagtatatcaagtattttgacactaagaatttatagtttatcagttttcaaataattagaattaaatctcagtataaaattgtattagaagtcaaatttttttcctctttgacttttggtctgtcattgtagtatcagtatcaaatcaggtatcaatcctttgaagattccaaagtcaaattaacaaagaaatgctgcccagcattttctgaaggttaaaaaagaaacataaataatataaagcttctaaacata

SEQ ID NO: 45075 - DNA, 1290 bp, Bovine  19866880581573
ttggcaatgcatgcttcaatagtctggactgtccttttcaataggacttttgcgaggtcaaacgactgtttacttaagttctgaaacacaaaaaatatgcaaagttacaaacaaattaatgaatttacaagataataccactagatcatcaaagtcttcaaagttcagaaaatatgaagcaaaaaatataactgaactgcattcaaggttttacccaatatccactagtcaagacgtcataaacgcagaagttgcaaatagcacaaccatgaaacaaaaactaaaatacaaaaaaaaaaaagtaggtaattagccaaaagttcaaccctatattaagtttagttttactaaatctaagaccttttaggttttgttaaccgggagctggtgatggacagggaggccaggcgtgctgcagtccatggggtcgtaaagagttaagacacaactgagcgactgaactaaaccaatctgaattgataatcacacccattaatcccttaacacccacacattatcctcagtatttcactgtctaatcaatgtctgttctgacgaagaggagacatgggaagtgcttcaagcaaaattctcaatcagttgtatttctgaaatgctaactactgccttcattcctcaagattcccaatgcgtggtaataaattaaagggtctgaggaagtctgcaaaaagatatatttaattttttaaagttattgaaaatggaatccttgtgctgaaaaatacctattaacatctctacactttgcagttttagaccaaacagattcattcaccatcatcttgcacttatctccaaaaaaaggcaaggatatcctataccttaggttgctgctactgctgctgctgctaagtcgcttcagtcgtgtccgactctgtgcgaccccatagagtgcagcccaccaggctcccccgtccctgggttctccaggcaagaacactggagtgggttgccatttccttctctaatgcaagaaagtgaaaagtgaaagtgaagtcgctcagttgtgtccgactcttagcgaccccatggactgcagcctaccaggctcctccatccataagattttccaggcaagagtactggagtggggtgccattgccttctccaataccttaggttagtagtcagcaaaatttttatgcaaagaggcagatggtagatatagattttaggctttatttattggccagccatatcgtcactgctgcaactacacacctctgggttggtgcagcaggaaaccaaccatagacacaatgaaaacaa

SEQ ID NO: 45076 - DNA, 1342 bp, Bovine  19866880627307
ctcattttcctccttttcccttggagtaaaccaagaattcattaaatattttttaaagtcagaaagataacaagactctaaaatttttcttccaaaaaaaaaaagagagtaagtaaatagcattcaaatgtcagtaatcaaacaggcccccaagacagctttaagatagtttcatttaacagggaagtttacaacacaaaagcagcttcctgagaggcacccactttaaaaataagttatagcttaaattattactgtatagattatacctggcaaaggtagaaagaattaaattttttcctcctttcatgaactgtgtaataaggctagtgtgcagaggcttacaaatttcatataatggactgtaaatcatccaccatatttaaatcatgtttatttaaagttttcttaatattagacattttatgggaataaaaacttagtaaagagttatttcatttcttttctcttcttcttagccacataaatcatctgtagtggataatacagatttcagctgtaatttgtaaaatattccaaaagttgtcacagtcctaagaactagagaaaactgccatccacaaataaaccaccaaggtaaatataaatacagtgtggttctaatcttctttcatacaatctcaggtaaccccaaatatctttataaataccttattaaaaaaacaatttttaaacccattgaaactacttaaaatatttaaatgtagagatctcaaatttccttctatcaggccggaaattaccacaaaaattatgatcacagttataaacagaacgaatggaatgtttaagttcaggataaccaaagaagccccatgtaactttttaatgtaatcacttactcaaatataggaaaggtgatgacacaggaagcaaaaataagctcgcaagtgaaatttctagaagctcatgaaaacaataccatcccatactgcagatgcaaaagaaaaaacagttctaatggggttaagactactctggtcatcttcgttcatttggtcgtgcaaggtgttaaactattttcacttcccatatccacaaagttagtccacaggaggggctggtggatcttgtccattttaggtccacaacctaatttaaaacctaaaggaatcagacccagaacaagcaaaatccgatgtcagcagaaggaagaaaatcgtaaagatcagagaggaaataaaatagaaaccaaataaacaatagaaaagatcaatgaaacaaagactttttcggtaagataaacaaaattgataaacccccacccaggctcacaaagaaagatagtgaagtcattcagtcatgtcgactctctgcgacg

SEQ ID NO: 45077 - DNA, 949 bp, Bovine  19866880661024
ggaacagctataaaaatgcttcagtaataggtaaaatatttttaaaagcaaagttttgtactaaattgcttatgatgtagtttaataaattaaccccaaaacactaacttgtaataatcatgtttaacagaactaatacataaagacaatgtcagggaaattgaggttctgagcaagaagaacaaggaacagaaggtgtgatgacaacatggcagagaaaaaagcagaattgatcagctcctactttgcttccattttctatcactgagaattatcatcaaattagaaaggctaggacctacatgggaaagagggttttttggggtttttttttgactgagacacatggctcacaggatcttagttccccaaccagggattgaacctgggccttcagcaatgacagctcagagtccttaccactatattgtagataattcccttcattttctataatgagggggaaaaaatactataagcccgtgagcacagatttccttgggaaactataagcccaagagcacttttttcctcgggaaaattatggaataagtaattaaacaaatgatatgtgaatatttagaaaagtgatgaacatgaggccaagactgacttcactaagaaataagtgggtcttcctgataggtttcctattctccctggtctgatcccaggcccacaagggaagaaagtgggccttgaactggaatgaggctgaatttcaatcctacttccaccacttaccaaaattctctgagcctgtcacattacccaaatgtaatggagctctttggggctagctctattctcacccagggccttcctggagaatagtctctacacatggccttatcacaatgcaacaataataatccaaactttgaaggcatgataaaaaatgggaattatatagacaaaacaaaaactccacaaaaatccccttacttaa

SEQ ID NO: 45078 - DNA, 1590 bp, Bovine  19866880674674
tactttatctcattaggtgcggattttatctgtcatgttttaaaaataaattcattttccagtcttaagcattctgaaacttttttttatctgaacatacttttagaaattttgacaagtaggtgaaaatatgaagaaagagaaagccatatcccataatcccattaacaggagacaataatggtgaatattttctccttgcttatacctaagaaaattcttcatgccccaccatctccccaatttcattctgtcttttgtccagacttcttctttccaaattagtaagttaagatagcacaaaagcatgcaaatataataataacataataacacagggaaacttcaaattgcctgttgacgttggggactgtatcttatccacctctgcatcctcaacatttactattagaacctgcacacagtaagtgctaagtggatcaaggtagcaaaacccaatttgacagaggttcctaactggcctctcctgttgtattcaaagcaaagtcaaataaaaacctcaatacatatacagagatgaaactaactttcatggaaaattctagtctcagtacaccatgtgccgggtactgtgccaagcagttcaggtactttatctgattaggtgtggattttatcgcatacacatttggttcaatcagtctctgattctacacccacattttgcaaatttaagtgtttttcagattatcaacactgaagcactagggggttatgttcaaacaccaaatattttcctttatgttcactatcctattcttcctaaagaatgaaaataaacctgttgtattctagtaatatagtcaactgagtgaaaaggagttttctgattaagtttcaatttgtcaaaaaattcaattaacaagaaacttcctatctcctgaaaatcataataaacctgtattattagaaggtgaaacagctcttattaaattttctacagatccactatttaattttctttaatctctggacaagtctatgcataattgaactctgaagagtttttccaaaacagtatttatctaggtagtccacattccaaaaactattcagtttctggaactacttggaaaaattcagaaggcaaaagttacgcaaattcttgacacattccttggacaagtaaaatggtgctggtaccagttctgatgtggttacagttccagttaaactagaaatttgatgttctgttacttagtcttataatctgccaattagagtaatgacatttgatggttctaagtcagaaaatactgcattgatgaaaattcttagttaataaagtggacataatgaaaagaaccaattgattattaaacaaccagacattaactttagtccattcacttttgtacaacctcatttagtacattatatattctcatccctgtactccttttaaaatttccattttgtacttttctgtgttagccaatgaatactttgagccaaagcttggtggagctgtctgccaagcaaaagttccatttctgcagtttctacatcttagttgtataattacttaaatattttcttgcatattattatttcctaagaatgtagaaa

SEQ ID NO: 45079 - DNA, 1390 bp, Bovine  19866880684810
ggaaatagatggggaaacagtagaaacagtgtcagactttatttttttgggctccaaaatcactgcagatggtaactgcagccatgaaattaaaagatgcttactccttggaaggaaagttatgtccaacctagatagcatattcaaaagcagagacattactttaccaacaaaggtccgtctagtcaaggctatggtttttcctgtggtcatgtatggatgtgagagttggactatgaagaaggctgagcgccgaagaactgatgcttttgaactgtggtgttggagaagactcttgcgagtcctttggactgcaaggagatccaaccagtccattctgaaggagatcagccctgggatttctttggaataaatgatgctaatgctgaaactgcagtactttggccacctcatgcgaagagttgactcattggaaaagagagcaatatgcttagcaatatgcatactctgatgctgggagggattaggggcaggaggagaaggggacgacagaggatgagatggctggatggcatcactgactcaatggacgtgagtctcagtgaactccaggagttggtgatggatagggaggcctggcgtgctgcaattcatagggtcgcaaacagtcggacacaactgagcgactgaactgaagtgaactctactgaatatttagaaagtcaagcagcacaataaaacctttactctctaacacagtagcataacttttattgccaagggaaaatcataggtgaacacacccgtgcaattcttgcttaactaaatgttggtgtacaaaggtcagctttatgacagatttagactaaaatgacagatattaagattagttctaagcccagaattgacctgagattatattccctgcacagtttggcttcagcaattctttcctaggtactggacaaagatcttaaactctatttcaattttaatcagaaactatgaaatagttaaagggaagtaatttctgtagttgggctttcgtagctcagttggtaaagaatcagcctgcaattcaggagacctgggttcgatccctggattgggaagatctcctggagaaggaaatggcaatccactccagtattcttgctgggagaatcccatagacagaggaacctggcgggccagtcaatggggtcacaagaattggacacgacttagctacttagactaatttctgtagttagcaaagctatgtcacagattttgatgacttttcaagtgattaggtgaactgattcacactaatcaaaatgacaagggactgagttatataaaagaatgtcagtttattcagtaataagaacaaaaataatcaaactgatcaaattcttagaaattttgtccttgccaaggactaaat

SEQ ID NO: 45080 - DNA, 3734 bp, Bovine  19866880689685
ctagtaaaattccattaaaattctggactaaacagaaggcatgccctcccatttaacttaccctgctttgtatgaagaacgcacccagggggccacttgcagtataatgaaatccaagttcatttcctactttttcccagtatttgaacttttcaggagtaatgtattcttcaacctagatttaaagaattaattctagattctagaattttccgaaatcattttagttctatatgaaaatctacttgttggctacttggtcagaacatgatggtagtgaattacagcgaagggaaaacatcaattttgtattacactagctattccaaaagtgaaaggatcagtcacgcctataagattcctaaggataagattgtgttacttatcttgtatctgctgctcagcactgtgtctggcacacggttactactcaagaaaagttttctgaatgaatgaataaatgtctgatatagaaatagggagactggcttttctttctttcttcacctctggctctcatataattctaaaacaaatcacaagattggtaggagtgatacgaatgtacttcccaacttaaaagtttttttcctataggtcattttagtaagacaatattgagggcagcaaataagtgccagcatagccgctttatgcagataataaaatggaactggaactcagaaatatacatggaacattacactaaaaagccagcagcttctgaattctacctatagaaaataaagatgtaatgcaaaccaccaagaaacatttggcgacttatggtagttgtaccttaaggtggcgctttgttggctgcatatattgtcctaaagtcaaacagtccacatctgcctcacgaagtgctacaggaaaagaagcacacattatatgagcagattttttaaagtgctatctgtatgcattgctgtaaaaagtagcttttaattatcatttgaatttattactctttgaaccgataactgcaagttggccaaggaccttcaggtaaaagaaaagcttttatattttaaaatttaagaagctcaagaattgcaaagtaaacagatttaatagactaaaagtcaaaagcacaccacgttatgtaacaatgctataagtaagcactttctcaaaggcctggattcatcttagtcatctttgagtcgtcagtggttgacagagctcctggtacctggctggcactcaaaaattgtcttgactggacaagaaaagcagacaaaaaccatgtttttagttgatgaaagggtaaggaataaaatgggatgcaaattccatattctaagcatcctgtacatcattccataaagttttaagaacacattcttcctttcctttctatgctgctgtttataaccatatcctgaatttttgttctcactagcactttcactgagactatggagaaagcataccaggttttccaaagtgggactcctgctatcactcaagttaaatggaaaagagttttcatttttaaatttctttacctttcatcgtggcatatacttgctcatcattctcacctaaacccaacataatagatgttttagaaataacatcaggtcgaacctccttggcatgttttagtacacgtagagactggtcaaaattggcccggggatcacgaactttccttgaaaacagcagagctgttgtcagcaagaataaccacaagctcaactaagtacataattatacaagcaacctgaaagaccaggaaggtacattctggacatcacgctgcatcatatgggttcaatggtagcatttgtgcacaaacgtctaactgttactttgagaaagaaaataagccttcactaggcccccagttctgttgacttttcaggcctttcaagcctggggcacagaaaatgagaacagaagtaatgaatgaagtaattcagtttatgaattactcattgagaaactaggattctgaagccggagaatgagtgattataagggtaattgagagaagggggaaaacatggaagaaaatttcgatactgaacaaagaaaaaactgtttaacctgaaccatttaagaggattgaaacttttatgttcatttcttttctaaagactaagctgccctctgctggtaaggatacagcattgacatttcttaggttaaaaaaaaaatgcatgattctggaattttcactggaaaggataatgttttttaaatgaaaacagagaaactggcacccactggtggtgggatcataagatatgacaaggctggaacagactgtgtgcttgacttcaacagggaacaaaccaccaagttttaaatggataaaggcccaaaggacacagttgctgacgttaaattgcattcatttgaactctaacgtacctttcttctgtgtaactgatctgttgttatggttgctatttttaatcagagaccagttcacacaggaggagagggaacaaatttatgaatttaaaagtaaccacaatactgataataaggaaaatactttttgaaagtatttctccactgaatttaaattatgctccctaataagttatgatttagcagaaattctggctattgtttatcatacttctttctgtgatacagaataacgtgtagaacctaataaaatcactaacaaatgctttactaaactaatgaaaatgaatgtataatcttgcctgaaattttttatttttctgaaatatgaatagttattgatacagaataacaatgtgtaattattcctaactactaaaattacaaggaagagtaagaaagcacagtacctactttttttaaaagagatttaaaatacatccggaatgataccatttttttcttcagcatcatttactgcatatattattgtcaaatgcattgttatatgtccttttttagaactacaatcaattgctcttttgtaatatttttctttttgaaaattgttctttggggaaaaaatcccagctcatcagcacttgcaatactttaccaaaaaaaggaaagcaaaaaagatgctagttatgtttgtatgcgtataccaaaacatatacacacatgtataaatatgtaagtatacagacactgagatgtaagtaattgatattaccaggtggaaatacggatgatgtttatactctttttgttgtctatattttctaatttttctatactagacatatatattttttttaaaaatgcatttttgttttaaaaagagagttcactttatagaattacaacattctcccctgaaaaaaagtatagcagatttgaccctccaaacttcccaacattactcaacacgcgaaatcacctctgtaattctggaactgtttctacattatgtgcatatacatctaatcctgacagggcaactttttctattgctttaagatctcctcggaaatcaggggtgagacattccacaagaatttttggattcctatagtgaaaaagagataggtatcaatcacagtgaggaaaagaattgacaaaacttgctcaaaacagaaatcatcagtatgcattcagtatcagtttcaacacagtaagcttcagaatcttgccaagaacagcacgagcagacaagtgcttatatatgaactgctaaatgaaaacggtgacaacctagaacatcagataacatgtacactgtggttaaaacacatctgcttgcaaacaatgatgagaatacattttgggattacaaaaactttcaa

SEQ ID NO: 45081 - DNA, 961 bp, Bovine  19866880877671
aaaaaaagaatatattgatgttggagaaaaatgctatcctcaaaactttcaaaatgcttttctgttgggtttcaaaaggataatatcatgaactctttttactatgaaaacttaaaaaatgaaaccttacttaataaaatagagacacattttcctaactatgagttctctaaattaaagaaatactgaaattccaatttaaacaaatatgtgatactgaacactgaacatgaaagacaccatttattcattcaaggtttatctgatataaatacaataatccaaaaatataataggcttacatgaatcaatattagaaacaaccagttttttaatttctattttcacagaatgccactttttaattgcactattataatatggttgccatactaacagacaaaattagaaaatagagaagaaaattactcgtcatctcactccactaatacaacaattattaatattcagtaaacttttttctacacatttttcctaggcatatctgacataattataatgttcataatatgtatttagacttttccattttattcctatcagttacagtcatagagttttacatcaaattaaattagcaaaaaaaataagaaagcaaagagcataagaacaatgcattgtttaatatggtttacctcataaataggaagtgtaggagagttccatgcattgattcttgattcattgatatcaacaaccgtcaccctgatttcggggcacatgtgagcaatgacactacacgtgggtccaccaacatagcctgcaccgatgcagcagatcttcttaatttcaaacatgactgtgctagaagagaaacagtaagactgactactgagagcagaaaatttaaagaaaccacactgcacattcatcacactttataaaaactgtcaaggtgacaggtatagggaaagatttcctacattcagacccattaaga

SEQ ID NO: 45082 - DNA, 1903 bp, Bovine  19866880891826
agttgagctgggcaggacagttgagcgatgcacatcttcactctttctttttgtggccattcttgttaatatttattaacacatgccaggctctgtgctcagcttgtccatcctcacagcttcccctccaggcacatcgctgttgtttccctcatttacaaaggaggaaacagacagggttaagtcacctgcagttctcccaaaacccaggtagtctgctcaatgacctatgtttttgtaggaaagaaggctcataaaattattgtttcgaagtttttttatttgagtgaagatgaggtagggagtagaatttcactaactgctccggaaactattgcttaaactttgcaaaaaaaaaaaaaaaaatttgcagattttcagtgaaattggaggactgctcttgatgctaacttaatgcacagttattcctgtcattcctgcatttctgttaggtcgtagaggttaacattctggaatttctttttccctagcggcaaaatttggtaaatttgctggcaaagatgatggctccagttttaaagcggcattgctctcaggtcctcctggtgttggcaaaacaaccacagcttctctggtttgtcaggtgggtattctgtcattacttttctaaaatctaacctctgcagtttgctttggttctgggcctatttgtcattttcacccttttaaaaatattggtaattataataataggtgatatttacttgtgtgccaggccgtgtgcaaataagcccttgggtgcataatcttacagataatatgtcttacagactgttacagatatcttatatgcccctgtaggaaaaattctgtgtaccgaatatatgtactcctgccgtcgtcatgtgacaaatgaaacagatttgtagaggagggtggtggcacagtgtgaccccaggcagtctgactctaaccactgtagggtcctgcctttcctcttgttgtctctacggttgccacatctctggacagtgagagcatgaggcactggagcaaaccaggactcgtatcagaatgcgtgctaagccacttcagtcatgtccgactccttgtgaccccacagactgtagcccgccaggctcttctgtccatgggattctccaggcaagaataccagagtgggttgccatttccttctccaggagatcttcctgacccagggattgaacccaagtctcctatggctcctgcgttgcaggcagattctttaccgctgagtcaccaggggagtccagatgtatcagaatggtgtgaaacaatacatgaagtagtatcagaaaaattaaatgagagattttaaactcactttaaatttattactggatttcccaaccctttgtcccataggttgatgtttttgtttagtattttttattatagaccagaccataaatttttagctcttataataactatgtattttctactctattatttaacatttaaaaacaaaaacaaaaaatgttttccctagtttttacaattgtgaaaatgatgccttttttcccctttattattatcattacttttttgtggaattaatggttttgcataatgccttaacataatgatcccttttgggaaataagcccaagttagttgatttttcagtttgagagggagattatatattgggataatttgacacagaacaatttatagtttatcttgaagagtcaatgattactttttgttatcttaatgtactttttgatatcttaattctacatctggtattgaaattttggggtagttatatttaattcttttggggactttaagaagtgaactttaagaagcgaactagtaaaattgcttgtcagatatgctcttccagatatatgtagcagttgaggttttaagaccacatttgtgtgtgtat

SEQ ID NO: 45083 - DNA, 1970 bp, Bovine  19866880893524
tataccagtataccaatggattgttggtactttaaatagacaaagattttctggaacttaatataagaaactcaaatccactgggaggaaatgggctaagacaaggagtgccagaggaggaaatacagttatgaaattatattttatacagatacgaaaaagttccatctcactaatagtaattaaattaaagcaacagcatatcattttaactcatattgggaaaagatgtattttaaactaataaccatattgtcagaaagcacttgttatgcatgactaataggactgtaaatttctaaagtctttagaaggttatttagcaatatgtattaagagatttttaaaggttacttccttctacttttagaaaagtaaccttaagaaagagatacacactaaatgtcttgttaaaatggaaagagctagagagctcatggagactgaacaaaagtcttgagctccatctagaggtcaatacacaatgattttatagattactgttaaattgtatctgtaattgtgaaaaattgctgattttctgtttgctaaaataagcctgtattactgttataatctttcctctttaacaaaacagtaaaatataaaaaattgtatatatatgattcagatgagaaaacacagttcattattggtattttactgttagtttatcaaacctgtaaaaacagcatattttaatgaaatggttcatggtattctttctgataaaaaaacaaagaagagcaagaaaagtgagcaatcaccatcaattaaaaaaacaaacagtatcccaagcattaattgacatttttctcccaaatgtgacaaggttgagaaagtttgtttgagttaagtatctcttatagatacaaagaagctgttgtggcttatgagaatgcaaaacagtggaacagtgtgatccgcatctacctggaccacctcaacaatccagaaaaggctgtcagcatcgtcagagagacccagtccctggaaggagccaagttggtagccaggtaatgtaatgcgttatttttggacttccaaaaactagcctttaaagaaagcccccacttccccttgtcaaaaaaatcatttcaaatggaatatttattctttcttttcaaaattatatcttctaagtgtttaaattaaaaggctgtttgttatggtcaacatacgcgagtatgtttaccaaatgtaaacatatggtgtagaactacagtttacccagtatgtttttactttggaatggtttctcgggcttgaaaaagattttattttgtgaatgacagacttcttttaaatgagtcaagctaattaaagtactctttgctttagattttttctacagctcggtgactacgggtctgccatccagtttcttgttatatccaagtgcaataatgaagctttcacactggctcagcaacacaacaaaatggaaatctatgcagacattattggtaaatatcattgttttccccaatttctcttaaagattttatctggtctaataatcagactggctacatccgcacgcacgtgcacacacaccattccatttgtacacagacacatacaactatatgttacttgtcaggtttcaagatccctactgtcaccttcaaggtgagatggaatcgtaagaccactttgaaaaattaaggtgtttcaggtgacttccatggaaggccagatttcccaaattctcctaccgatccaccagtggtaaaggaaggttccaaaacgaaagtaataggaaatgcagagtgacttttcaaaaagtaattgtgttcatcaaacttaaaaattgagttgtaaattaagaatataggatgtggtttttaaagattttgaaagtccgaaagaaaattttatattctgagaataccagcttacaggttatcttcccctggttgtaattattcttagaacttactgaaataactttcagatttttcacttca

SEQ ID NO: 45084 - DNA, 1653 bp, Bovine  19866880986221
gctgctcgggaagccgctgccgccgccgctcctggccgccgggctgcctcccctcctctgttttgattcgactgaccacgtcctcttaagccacgagacccggatctgccggctcccgcgggcggaggcgcaacagattgcagcggctcaacacccaaggcagccggcctgccgagcatgcgcgcgccccgcgcctgcccaagtgggtccggaggggcggggcggccgcgaagcgtcacgcggttcgagggggcgcggagcaccggagttgcagttccggttgggaggggtggggcgcagcgttgtgtgatggagagggcgaggccccgcgtttgttgaagtggtctgcgtaggttctgtttcgtgtgtcgtggacgtcctctgcagtgtgtctccctttgccgaagctgatggctttcctcagctggagtcttgagaatagcgggggtagtggtgcccaagctgatggctttcctcagctggagtctttagaatagcgggggtagtggtaagtgggggcgcaaggtggtgtctgatgagacttgtagagattgttttggatcacttaggctcaggtgaaaactggagatcgaggtttggtcttatatatacaaaagtatgacagacgtggcagttattgatcccctgtcccggaggcaaactgcactcggaaagctggctaaattcagttcaagaggagtgttaaagggaatgtgggactgatagagcgataatggggaactgggagaggaaagctgttgttaggcagtcagctcaaacctttgttgctttgaccttcgggattgaaatacttatggtgtgagaacctcatttcttctaaaccaaggtgatgcttcctactctctcattctggccttcttagtctccccactgaacaacgggcccgagaggtttcccactttgggaaaacttcgggctactctgttttcttaggtccataaatggaccgactttaaagcgagactagtgtttaaatgaaagtgtgagttccaaagatttcacagaggtgcttatttgcctatcgtgcaggagaggtgaaagttagctgtaagaaacggccttccttattctgagttgaccttttcgcctaacctggacttctacctcagtgtctggtttatcacctcaactagctgagtcactttcagcgaaattagtataatctgcgagagctgctttttttttttttttccccaatagtacttccctggtggctcagacggtaaagcgtctgcctacaatgcgggatacccgggttcaatccctgggtcgggaagatctcctggagaaggaaatggcaacccactccagtattcttgcctggaaaatcccatggacaaagaagcctggtagtctacagtccatggggtcacaaagagtcggacacgactgagcaacttcacttatttaacctaatttatccaaaatatggggcttcccaggtggctcagtgataagaacccacctgccaatgtaggaaacttaagagaggcgggttggatccctgagtccaggaggtcccctggaggaggccatggcaacccattccaatattcttggctggagaatcccacggagaggagcctggcgggctacagccaatagggtcccaaagagtccaacacaactgaa

SEQ ID NO: 45085 - DNA, 1077 bp, Bovine  19866881016915
cttccacagtgttaactcaggctattctgtgcctgttttgccaagagttaaacaagcaaagtcttagtttgtcacacagtgcatactgatttcataaatcttataatatcatcatgagagatttgagaggaaatcttttaaaactatgattttaatcattatggtttggcaaacatacagcgaatactctataaaagttaaggtccaagagtatctattaaaattgtaatgtgttactcaaaaatgaagtgaaaaaaatatgaaaaagtaggttacagaagaacatgaggtatgataccatttttgtataaaatatctaaatgcaaaaaagtctggaaggatataaaccactgctgacattctggtggtctctggatggcaagaatactgatgacttatttcttctttttttcacttatctgctttaatcaacattttctccaattatcacaaattatttcatataaacaaaattatttaggtatagattagcttaaaaaataaaaaaaagagaaagaacttcaagaaaacataatttcatttgtttcgatcagcggcattccaactgtggtattaagaaaaaaagatctcgattgcacacgctgaaggaagaaatttgctaggaagaggtccattttataccacacaaggacataatatacccttcaagggagtagttcaaattcctaagatctcttcctggatttgatatatgacaatcaatttaatacatagctctttttctttcttgccgtttgctaaagaaacacctcaattaatgaattctctggaggaaaaaaaaaaaaaaaaactttaaaaaaactaaggacaaaacagaggtttggtcttctggtctcattcatgcggtggaaaggcgcggagggtggcagggctcgaagcaggctaccccagaggaatctgcgtggcgggtcatctaaagtggaagggaacacaaaccctctgcaggctccacagactcggcagtgagaacacctcctaagggtctcaggacttcccctggaagggctgacgccgtccaagttattctacgctgccaacggtttccgacaaaacaca

SEQ ID NO: 45086 - DNA, 1224 bp, Bovine  19866881045786
acagttttagtggtagtagcttttagagtatctggaaaaaactgcttcacattatataaacctgaaagttctgtttgactattagcaagtacttcattactattatttagctctacagtaggaagtatacttgttactaatccatgtttttcagtagttatagctcttatttctgcctgctctaagttttcctttttggaattacaggtagattgtacattagtgttattgatatcaattccatggctaaattctggcacagaaaaattagaatcctctaagcttcctctttggctaataatttccttcaaattcagtcccagagaaaatggcccaatttgtgcttcatcgtatgatttttttatattctcaaattcagtatcctcacataatttggtttcagaatccaataaaaggcttgtggcccaaataatatctttgttacacctctcatataagtcttttagggcttctaatgaaaaagatccaaatagtttacaaagaatgttaagattttcagattcatcagcattggtgagctcactttcttccacatatgtgcttttgtcatacattaccctatatggaattgcttcttgaacatccaattttgtgttaatattgaaagttttgggtttaaatccatctaatcttcctgttaatactctcagagaatcagaaacactaatcttatttttttctactttccataagagagcaaaatcctgtggttcagtctgggtacacatgcctactcctatttcagggacttctttagtcttttcttctgaaaattcagctaaagtttgtggtcctattttttcagggacagttggcacactattgatataaggaagagacaatgtgtgttccctatgaatctttttacttggacaagtcttactctcataggtcatttcattgggcaacatttcagaacttcctcgagtacaaccacccaatgtttttagctcttcagggcttgtgccccaacaggcctcatgtgaagagtataaggatatttcattcatactgctgttggttccaaattctaggctgggttcatttaagccagcctttggtattcttgatctgtgctctctctgagctaacaaatcgagggaaggccagtcacccacaatgttgaatgaatctctttccgggtttttgtaagtatcatattcacagctactgaaaggttccgaggcatcactacactgtgac

SEQ ID NO: 45087 - DNA, 1819 bp, Bovine  19866881068400
ctgctgggaagctaaaaatatatataaagaataggaccaacagcaacttccagggtggttaaagtagaataatatcatttgaaaggagtttttgttggttttttattttgttttgttttttggtaaggcaaatttctcacttttataagtaagtgaattataaacttttaaatttctttaaaattaccagtaaaagaacaaagccttagattcagatggatttggatattatcagatgataatatggttaggttcttatcagatttagataaagcatgggacagcagggattattctgtccattacttggctaggttatgagccttgggattcttggtgattatgtacacatcacagtcgttgcattctactcagaagatcccctggagaaggaaatggcagcccactccagtgttcttgcctaggaaatcccatggacagaggagtctgctgggctacagtccatggggtcacaaaagaatcagacacaactaagtgactaaacaataacattaagatgacagagaagttcatcagactcctcatgttgggcctggagtactgagctctggcgttaagcactgagctgtggtgtaacagccagagactaagtggaaccttaagacctgaaaagtgaaagtgccctcctctaactagctaatttagtgcacaggcacatcttagagtgtggagagaatgcaagcccattataagtgaagagctcttgctgccctagaggggaataagttaaagagattccatcaaatgaatttgctcaactgcagcaaggtctccattttataaatatcaaatctaggctaataatgtagctgaattgctctctgaaataaccgtgccaaccaacagcaatactttatcagtgatgaggaatagctactgcacataaagtagaataaatgcacataaagtagaataagtgcaccttagatacgatagggtcaccctttataatatgttgagttactcaaaataaaaatggtagaaattgtagtgatagaaaaagtcttttaaggataatgatcgtcatggttgaggaaagagccaaagatgtgtgggatctgtggggttagaaacttgacattgagaattgagaaggaaacaccaataaatacagaagtcttctttaaagggaaacacagaagtataattattctgaaatctatacctaaaattgatactaatatatttttttatttttcctaaataggtgaatttttcctgaaaaatctagtggctaaaagaaaaacaaaagccctgtaacatttaacgagacattcaagatcatgataattttggaagtttcactccagttgttaacagaagtgatggtataatgcctagaattcagtgcatatatcctaatttttttgttttaagaaaaatgtcaataagatatgcatatttaactataataatgcattcgtcttttagcatatcttgtttgtcccagtaaacaattgcttgttatgttataatcataaaatgtctttgtaagagtttatcattaatttaaataatacattaaaaacttagaaaatctttgagcctctatacatcattgtcacctttcatttctggaaaatgacactgtgatgaaacagtatagacttgagattatgtccgtttagcaaaaacattactggaataatttagaaaggcttaagaatttcagtgtagacccttcatatagataacaactgttttagacctacaacataattctacattgattacttgtttaggacttctatgaaaccaagaccatgatgttgtccaagatggggaaataaacctaaga

SEQ ID NO: 45088 - DNA, 949 bp, Bovine  19866881231375
aggcaacgtgaagaaacctggagtgggggactgatcaccacccatcatgccccagacctaatggaacgtctgtccattactttcttgcccagaggcgtatggttattgtcctgttgcaccaaacgactaccttctgacaaagcttctactttgagccaggcaccgtactagcttctatttctctaagttgttgcatttacagaatttgatgggatgcccagttcacacagtattaacagtaattaataatgtagtaacgagcctctttataatgataccttactgtgttttgctttagcttcatatacataataaagcagcactcagcttcagagatatgaagtacaagcaactagcctactaattagtgcaatttggcaatatgtcaaaagccttaaaatgtacataaggatgtttatttaaatattatttattatagcaaaaatatattagtaatctaagatcccaacagaagggaattatttgaacactggtacatcctcataatgaattattatttagtaaatatttttaaggtaaatacatgttgatatagtcacaacataatagtgaaaaccaacatatacaaagtgatcccatttttgtaagtatatatgaatggaattgtgccaggcttcaccatcctgtgaatgtcatacttccattcctatggtcaaattattatggtacaggactggtttggctatgatttcccctcaaagtatccctcaggttatttctgccctgaaaaaagatgcctcatattagggccaccaaagtccgccagctacattcaccatgcaggatccaccttcctacactgattctcactttatcatcaccactgcctcaaaagtcacggagaaacctccccactgtccataccctcttgagactacgaatgtcagagccaagggaagattccaacggctcccaaagcttccaaacc

SEQ ID NO: 45089 - DNA, 2231 bp, Bovine  19866881347042
tgggacaagggtcacattgctttttccgtgtaatttcttaatagtcactggcctaatatatatcttacttcatttgtcttggattcatctggagactgggcatcttttgttagcttgatattctctgccatctttttcataaaggcatggctattattttcattttttgtcattaaaacttcaagcatgaaccagaggcacctaaatgaaacatattcacttaataaagagactaattgcaggttcttttgctgagtggataaaatagtttactgggaagttctgttgttcgagtatacaaagaataaaactctaatgattaatagaaatatcttgttaataacattcaattaaaataggatataacatcacaaataacaaacatgaacatatagcttaatatgagaaagcctgacagtttcatgaggcatacatatgaagagtcattctataggtatttaataaacatttagataatataatgtgtattaatatccagcaatgacgagcaaaccagcatacagcatagtcttgccattttgaccatttgtaagctatttatcctatgacctagggctcatatgtaattctactgtgacataactctgaatttcatgtgttatgagactggtgtgcatataacgagtaattcagcgaaacagtcacatttcaaatcatttttctgttttccgcttgttatttattttatagtcatttaatacataaagtgtctggtgacacctgaatttctaagtaaattgggatgaagattagaatcatctgaggaacttacattgccaaatctagaatcaaaatctattattaagttcccatgatgattttttaggcaaccccccatggacttactgctttactctatcaagaggagaaaaaaatcacttgaagataatctgtgtgtacttctttgcctatagtatatatatatgttttaaaagactactgtaaaggaaaatttagcattaggttaatggagtttgcttttagtagacctgtcttgcaaaaataccaaactcagtccttcaggtaggaatgaaagaacactaaacagtatcttgaaaccgtaagaaataaaaaaaaaaaactggtaaaggtaacaaagctaaaatataaggccagcattactgagcttctgatttgtaactcctttttaaatatatgatttaaaaagcaaatgcagggaattccctggtggctcaatggtaaagaatctgcctgccaatgaaggagacaagggtttgattcctgatccaagaagatcctatatgttgcagagcaactaagtccttgtaccccaattgttaagcctgtgtgccagagcccaggaaccacaactattgagcccatgtgccgcgactactgaagcccacgtgcctcagagcctgtgctctgcaagagaagccaccaccataagaaacctgagcaccgcaactggagagcagactccgctctctacaactagagaagagcctgccagcaacaaagacccagcacagctgaaaacaagtaaataaaccaaaagcataaaaataatcacatctatgtgaaaagaaatgatatataaagatataatttgtatcaattacaatataaagggaatgaaacagagatgtataagagcagagaaggaagtggcaacccactccagtactcttgcctgggaaattccatggatggaggaggctggtatgctacagtctatgcagttgcaaagagttggacacaaaggagcaatttcatatttcacaagagcagagtatctctacactagtgaaactaagttgctattattcaaaataggtcgttacaactttaagatgttaagagtaattatgtataatcggttcctctgtatatgaagtttgtctgtatctgtgggtctacccgctgtggatcttaaagcactatagtatttattattgaaaaaaatctgcatgtaagtggacctgcacagttcaaacctattcatgctgtaaagttcaactgtaaatacaaaaatgagaggcagtaatggagcaattaaataacaaaaaatatataagacacagagaaaactaatagttatatggcagaattacgtatcagtaattactttaaatgaaaatagattaaatctcccaattaaaaagcagacaagcagagtagattaagggagaaaaaagatccatatatatatcttgtctataaaagactcatttcagatacaaaaacac

SEQ ID NO: 45090 - DNA, 1261 bp, Bovine  19866881377254
gagaaggcaatggctacccattccagtattttcacgtagaaaattccatggacagaggagcctggcaggctatagtccatggggcttcaaagagttagacacaactgagagactaacactttcactttctcatccaggcaaagttcaaatttatttacagggtatatatgacatatgacatcacaatttggacttcacattccacttacacattgcactagaacattggtcatctttatttttacacacatcatgtttttacatggtatatctgctatctggaatgttgtttgcatcttgacttcttgctgcatacctattcattctttcatatctgtgactgtaacattcatagtattctgtgacacttttctgaacctcacaatgagagtgtcttcctttgcactatttcactcctttgcatatgtttcccttgtttcacacatcacacatggttgtattatgttggccaagaagttcgttcgggtttttctgtaaggtgtcatggctaatgccaaactaactttttggccaaccagtatttttattccttttttttttttaattgatatggctatcttcccaactaggctgtgagtgtcttaaagggagagactgactcatagttgtaatccaatgcaaataacaggtactaaatgtggcagctgttttagaacacttcattgaagtgaactgaaaatcctgccacattaaaagaatttagggaaggcagagaagacatgaaatgctgaacataaacccttgcataaattttacagtggctaaatcctaagatgccgacccaaagagtcatctctgagtcacctcttttgaatttcaaagtcacataaatgaagcaactgaacatagcatctaaccacttactttgaagaggatttcttgctagctatttggggaagtacaaaattatgcaaatgtctttttttaacggaaaatctatggaaattcaaatcaagtataaaaacgcaaggccagcttacctctccagagagaatgagtaacttggaaggggggaaaatagtctaaacaaaatttgtgttattaatatagcattttttattttttcctgcattatcattttgtactttctgggagatggaactcaacttctattcctaccatttaaacaggcttccactttaatttgaaaaagctgaacgcagagaaacagagaatagaatggtggttaccaggggctgggggaatgtgggaaatggggagatattggtcaaagggtaca

SEQ ID NO: 45091 - DNA, 2291 bp, Bovine  19866881521194
tttgctactattatcttatgatacaggttcgattttctcagaaaataatatcaattcctatagtaaagtatttctcaactttttctttattatctcccctctaagaagaaatactagttttaatttagttgattgaattaatttaaattcaatttaattttttcctattgagacaaattaaatactaaagagaataagattttgtttaggattgagttttggagggccaggaaccattgtaatagccacgggccctggagtgcacaggctcagtagtggtggctcaccacttaggatctttccagaccaaacccatgtcccctgccttggcagtggtccactgagccaccagggaatgtaatcacttttattaaaaccagcactatatggtaactgtgcagaataatttgctatttgaaattaatatctttctctttctaatagatgagaagggatctgcagcactgggacagcgctctacaattggcaaaacgtttagccccagaccaaataccgtttatatcaaaagaatatgctattcagcttgaattcacgtaagtcctcatctttatatgtttcagtcagtaactaattattgaatatcttcagttctaaactcctattcattataaggccattgatttaataattaaatacatggatttaatagtagcttcttaggtggaaaaaaaaccatattaattatacatccaaaaatgttttattctaactaatgatgtcttatccatgtatctatccactccctttcagcatcaaaatctcagtttgggtctaagccttttccatatttagaattgttttgaattgagaaatattgttttgaaacacatttggccaacaacagttacacatagtgtcaaggtgactctgcttttcttaatctacgatcatgaccttgaccacgttgaacactttgaggatttgcagtgtgaattcaaggcatggtgaaagataccaggctttgttccacaactctgtttgcttcaacttgtacttctgctttttaaaattgaattgcacgtggataaaaattcatcagttcatgttgcaaatcaagccagaagcttttcaaggtgaaggtgcagtgcttgagtaataagccctgctgatgcatgatgaatatgcttcacagatcttgcctacctttgaaaatgccataatctcttctgagagatttagaaatttctagtgttcttaattgctgctgctgctgctaagtcgcttcagtcgtgtccaactctgtgtgaccccatagagggcagccccccaggctcccccatccctaggattctccaggcaagaacactggagtgggttgcccatttccttctccaatgcatgaaagtgaaaagtgaaagtgaagttgctcagtcatgtccgactcttagcgaccccatggactgaagcccacaagggattttccaggcaagagtactggagtggggtgccattgccttctctggttcttaattactagacagtcttgactgtcaatagtcttaattgatagactatacatttttacttcagtcctgcctaaaagtgtaattttagagggatttcaggatccaatttgaaactcccattcagctgtggttaatgtcactaatgcagatacctgcagagacaagcaatgaatcatttattgacaaatgtaagtttgcaagtatatgtagttgcaatgacaactacatcataactgggtgatttattataggatatattccattttcaaaaattataaaatgggaaaaacactgcttcttgaacaaagaaaatatggttctaacattaaaaatcatttttatgtagttccattttattttcatatagactttatagtcattgagaatattgacagataataattgtagaaattactccatcaaaaagtactctttcatttctaaccaggataccttatttaaaagttcccattttgcaaataaaagctttttggagactttatttcttcttagtcaatcttaatctaaatttatcacatttctgccccttacaaagttatgttgaaaagaacaaatgggaaccttagtgcataacacaagagaggaggcctcagtgccctggccctgcatctgtgtcctgagagtgactggggctgagagtaaagagaagagggtcactgcactgggagatgacccaccctccccggtctaagcacaggcacttgaggaagctctggaactatccagaaaactttcactgttcctcctttcaggagaatcagtcttgtagcaaaccctcaaaag

SEQ ID NO: 45092 - DNA, 801 bp, Bovine  19866881665380
catgaccgagcatgcctgccagcatgggaaatgaagtggggagaaaatgctggagcacactgacccccagattcgtgccacaccagcctgcgtgccagtttggggaggcactggatctcgccccacgcatgagtgctctatagctgtgtggtctactgtggtagccactggcacatacggctatttacattgaaaagtggataaaatttaaaagtttctcactacccacattccaagcgctcagagctctgtgtggctcctagctaccatattggtgagcacgcaattagaacactgccgccagcatgaaaagttgtgttgcgcagccctggacagcctttaccacttcagtacacaaagcgaagtggcgggctcactgctccagtgatctgggagacgggatacagccagacccagccatgctttccgcacatactgtgctgtggcctctacccacccccccagcagaggtggcccatgtaatgctatggtctgagccatgctcattcctcttgctcctcgctgggctggagcatgggcccacagtctctagcttgtatctctatatatagtctcaggaccatcatgaagaaacaggtgcatttcatgtgattcttcctcacaggagacctgatacatcagagacagaagaggccacaacccccgtgtcccttctgcgaatttcttctcccagagtgtgaactcctctgtcctgggtgtaaaaataacatcccatattgcattgcaacagtaagtttctttatcatttcccttctttgcatatatataatctatagcccg

SEQ ID NO: 45093 - DNA, 684 bp, Bovine  19866880163912
attagttctagtaattttctggtggagtctttagggttttctatgtagaggatcatgtcatctgcaaatagtgagagttttacttcttttccaatttggattccttttatttctttttctgctctgattgctgtggccaaaacttccaaaactatgttgaatagtaatggtgaaagtgggcacccttgtcttgttcctgactttagaggaaatgctttcaattttttggttcaattctgacatctgtacccaattgatttcataaagcttttaggatcttcaactaagcataaataattccctcaacctctgactttgtaactcttggccttaaagttactcagcaagaatgcagcatgattttcctgtcaccactgtcaatccactgacaaacatagcccatgaatactttttggcacttagggacttaagagtgttaatacagaactaccaagattttatttttagctgaatttttctgtcctcactctttgtgcacaagagttaagatttgggggagagttcccaccatttcttaagttataggagtaggccactgggcttactttagcactttttatttgtaggtgcttggtatttttgaatattattctggagatttctttttatactgtcagatattaaactgctagaacgcaacagaagcgcattcaaattcaacaa

SEQ ID NO: 45094 - DNA, 2183 bp, Bovine  19866880454691
agctggggtggggtttgaataattaatataaatagagagggggtcttggacagagtggtccacataggaccctgtcatttattagagagtggacatttcgagctctcgctgaggtggaggacccctagaacataaaagaacccaggaacataaaagtgtatggttgaaataactgacaagttctcaggtgtaaaggtaaagagtttgagtgtagaggctgtgtgtacttatccactatttcgtattatttttattttcttaaggttttttataactccttccattgtttttataaagggggagctggtgtgagctgaggatatttaaggactggcttgtttgaggtttgtggcataggatgtgatgatgacaataggttacacagtgggagttgatgaatatttgctagggatgatgtgcagtgggaatgcagttatcttaggataaattatggaattggacttactgtaaaagatgattgtgacagacttcttttgagctgggcttttttgtttcttcaaacgaaaaatattggcttcaggaattactgtttattttacttgacattcgttttaagtagtttttatgtacagtcagatgcattttactcagcctagttagttttagaatttttgagagattgttttctagaagctcagtgaatcatataaaatacccctgatgtcagcttaccaataaatcaggccatattttttcttcactgttagtattttctagggatctgttagggaagagtaaatggaagtaatggtttctgtaagcaatagaactttgctttttaaaacaattgatttttgggaaaaagaagttgctttaggagaagtgccaaatttttatggtgtgaagctccagaggacagaatgtaccaccataacccagggtttattttgtactctagggtgttcagggtgcccatgctagtcttttcatgttaacgtatttggtagtttgtaggttgcaggaggcctggtaacagctttttgaataaagaaaggaagttatgcactggagtttaagccttcagtttgaattcttgatcttacagaatgtatgaaaaaaaaaattgaagtttcaaactgctactcttccatagaacaggtatcatttgtgaatgagcatggtccctggtatttagtagatgcttaaatataaactgttaaccagcatgtgccagctactgttggacatagctccttgggatctttcagatgtttgatatgaactatagtactcaaggcattagcattgtttctattgatcagttggttatgaaagtaaaggtgtgtttttatcttctatgattattttggtttacattcataatcagagatcccctcaggatattaggctgttgtaatacatgactttataaacagtgcatttaattaaaaccaaaattaaacatatgatcacttaggaaatttcaaaagcagtaggtaaaaatcaaagtactacaatatttgattttactttttaatcaatttcattgttttaagtaattttttttttaatattcttgagcaagttaaatgaacagattcaagcaggttgcagagagagatgcatttgcttgagtcatgacataacacatgctgccaagtcgcttcagtcgtgtccgactctgtgcgaccccatggactgcagcctaccaggctcctccatccatgggattttccaggcaagagtactggagtgggttgccattgccttctcccgacataacacatatatgaaattaaaattatcttctttgctatttctataaacaaaatgcacttatcacagtatacaaataattttgctgttgaatacctcctttgatatacatgcaagtcatttttacttcctctgtgtaaaactatcaaatttggtctaagttgcaatcattgttattaacaaaatgaatgttaccaattaaagttactatagaaattcaggaggaatgcagtattgtacctgttttgttactttttgtttaaatttcttttagatgtgttattgagaagctcttgatatactgtctaatcataatattctgtaaaaaaacaaaattatgttatacagggcttcctaaccagagtgtagtgcataggaaggcttgcagtgtgctgtttgcaaatgttttatggttttgaatttttaaatcatttttatgattttaa

SEQ ID NO: 45095 - DNA, 1640 bp, Bovine  19866880489889
atttcagtagaaaacatcaattttagctatgtatctttttcttgggcacacaagttttatgaccgaagcagttggaaatggggtgctgtaagttttgcaaggacttagtaaaagtcttttccagaaattggcgaaagagaagttaatgttgtgctactgagaatttccaggtagcgcaaagcaattctgtttccttcattttcacttttttagattccctgttttgtcagctgacagaatccatattttctggatcaagcattctgtttccatttatttttataaatactcaactaaaatgattggttttattttttattctagttcaatttaaatgttagccaattcattaatgactagcctaagtacacatatttatcttatccctttactatgagttaaaaggggaaatttgttagctacaaatattactaaaacattattgaatgctaacgatagttcaggtactattttaaactttacatgcattacctgtttaatcctaataaccttacgagagtagatactattattcatatattgcagataaggaaatcaagacacagaggtggcaagtgacttgcccaaggtcataatggtcataccctgcaaaaacttgaacctggaaaatctagctctagaatcagttctttcaaccactgcacagtcctgtctacatcagattttttttgcttcctaaaatgactgtttccactacgatccagtaaggttcagtatctagcaaatacatagctactgatagaaaataagacttggtttggggtccactgtcttgtagggagagcctgtgtgcaagatgcagtgacagatctgtgaaagggaaggcttgctgctcccatcagcttcaaaaaacttgcttttctggccctcccaaaactcctttttaaaaatattatttttcttcaactttttaataaaatgtaaccaatttttgtagaatatatttttccttttgagggtgaggtagaagtaggctttcttaccagctacagaaacaaggtaggaggcatccatgatgtttatccccaatgttttggctctggctaccaggtgaaaggtagggatgaaatatgccagctgactgagaacaaaagaccacgtaaatatgtagaaaaaaggattcttaaagagagaaaagtcaaagagtttttgtttacagctccgtgaagtagtttttttccaataagtttcttcattagtttttcggaaaagtccatttctgttatattcattgttgaactctttgctttgattttgtgagacagttaaacttatacctggtcgtcgttccttctgcataatactgtcctcaatggccgactcttgtatctcattgcagcatgatgtttctgttccacatgctgcctctggaccagttggagacaaactactttcatctttaatatcagaatcgctcgtgcttttgatatgaatgggtcgcaagagcatactagaaggaaccagatgcaatatgatagctccaagtaatataagagcacctaaacaggagagaaaaattgagaagttaaactaaaattacctctttgatttcacaatactctgtatccttagactcagaagaggccccaccacgaaatattcagtcatagtacaataat

SEQ ID NO: 45096 - DNA, 1468 bp, Bovine  19866880560508
tctcccctcgctggaactctggggccacagctctgagggagcctgggtgccccaggtagtgggggctgaggccagagcccccaatgtcatgctccacattgcctgcaggaagattctcgggatcacccccctaccctttgccagcttctgggatggcattcccccaggctgaggagaggagagggttcctggtgcccacgtggagtgacccagcagtgctgaggtcatatatgggagggcctgggaaactgtggggcgcctgccgctgtgcaggggacaatggttcctgggttttccctgcaggaagcaggtgacaataaccagttttgctggagaaacctcttttcttgtattaatctgcttcggatcttgaacaagctgacaaaatggaagcattcaaggacgatggtgagtcagcacagccagcaggcatgagtcccagagcttaaaccagagtgccacacaccatcctgtccccttcacatgggggcagagagtccccagggttgctggagcagccacatcttcctcacctaactctcctgtagccacatccttacatgttgagggcggatccctggttccttgatgagttgaactggaagcggcacagtcatgcactgagacaaattcacgtgtaatatggaaggaattttgtatagcctcctaatctccaccggtaacataaccagggttctgagaattgtcttaactctgtggatgcctcgggtggggaggcccactaaccccctgaaatcgtatgtacctgcacataaggatacttcgggtggtggaatccgtagctttcttcaaattccagaatgacccatacttgggcgaccaaccgtccaggtttgcctgggacttgcctagttttagccaggagactttagtctaagtcatatgtcccaagaaactcttcagtctgaggaagactgcgacagttggtcaccctacccagatgatagagcagggttcatttctgccctcaacacagcctcccttgtgcccatttccagatgctggtggtgttcaagtcagcccccatcctgaagcgggccctgaaagtgaaacaggccatgatgcagctgtatgtgctgaagctgctcaaggtgcagaccaagtatctgggacggcagtggcgaaagagcaacatgaagaccatgtctgccatctaccagaaggtgcggcatcggctgaatgacgactgggcctacggcaacggtgaggctccgtgtgaggcgagggaggggggggtggggggcaggcgacagctctccctttgctcttaagtttccctccgagcaaccaaccttggcagtgcccagctcctgcttctgtagcatcagagagggaagcccaggaaggacttggagaaactgccaggcttctgtctgtggtcatccctgctcctctttgtgcctcctctttcctttaccagaaattgtcacaagactttctccgacct

SEQ ID NO: 45097 - DNA, 1035 bp, Bovine  19866880685171
acacacacacacacacacacacacacagacacacacacacacacacacacacacacacacacacacagagcctccaggcctcctaccagtccctgccccacgctggccccggagtacacacaggccgaggcctcaggcctcgagccctatttccagctcctcttccttccttgtcattcatttccctgccagttcttttcatgctaacgagaggaagctctggccagggagtagcttggaaaggaagtctttgaaatggaaatgttatgacaaaatgatggattgttttctgagctgtgcagtttgtttctcccttgcagccgcagaaggcgagaatatctcttcaccgggagtgctggaggttgcccacatcaggaagccctagatagcaggaactgcaagtgaaatacacaccaagagcaggtagcggcagggggagacctcgggcaggcagaagaacacagccgggatactgcccagagccctagttggagcaggggccctgaacgaccagagaaggcagtggctccctgctgaggccagaagaaacagtggcaggtcctctgcgcctttgctcctgccattcgctctgcgccttgtccccttcttctttctctgacccgtgagctgttcttcatccctcaaggtcaacttaaatgtcccctatctgagaagcccccttaatgcacacaatgtccaccttacccttcgaacagtaggagtaccctggccactcctttatttgaggctaattagaattgtcatcagtcttgtttattaaaaaaatatatattttgagtaccaactgggtgtgaagctctgtctatgcaccatgtccttttgtgaacacagcacacagagcctccacccccaaggatccctgtagggaatatggactgtggagacaagaagtgtgtaaactgggcagcatgttggatgatttaagctccactggagaaaatggagtggggtgagatgactgagcgctgtagaaacgaacagtttatgttataaagcaaagtggaagggtaggct

SEQ ID NO: 45098 - DNA, 807 bp, Bovine  19866880702256
cccatatctattactgtgtccataggaatactcggtaagggctccgtctctgtcaagccatgtaacaaaggacactgtgggaaaatgtctggcatcagagggagcatgtggagaggaacttaggaggaacaagtttattttgtattgaatgatttttaatgaatgcaatattaatccttgcagatgagcaataatcattaaagtcaattaaaatgataagaccttattggaatcctgtgtcattcttggttgaacaacaccttcatttagaatctgttttccaagatgagagaagtcatgggtcagttaacaatatctaagagattttttaggacctagtatgtagaggaagaggctagatgcagagttcctcagtaatatcttaaattttgtgtctgctctgtgcccagcattgggcctgcacactttcactttaacttcgttcctgcaccttgctgcctaaaattcaggcctcctcaggtacacagtccccttcataagaccctgtacctaattcttaaaaaatgcctccaaagttacataagctttagcccatccccaccccacaccatacctgtatccatctctgaagtagtctccatattttctgatttaacagtgtatctgttaatattgttcaaaagtaataccctttctattttattaaactgatcccagtgttgattttgcagtgcagattggtaaaatgagtgtttttagttctgcaaggttttatccatgcaaataaatccaaatataagataaacttcatgttgcctagagttaaactttaaaaaaaaactgttt

SEQ ID NO: 45099 - DNA, 1236 bp, Bovine  19866880771668
cactgtcgcctgctaagggagctcagtgcaaatgacactcattcctggtctgcttggcccctcaccccacttctttcccgtaatcgctgcacatgtcactcagttaatttcctgcatttcccaaagcaggaagctgtatagtgtttagagcaagcagttcatgccagggctgctcttaaaaagcaggtgtcacacactcagctcacggtcccagctccaacaccgggcccctccacaaggcagataagcctcagagggagggagaaatggaaagtgaccacactctttgggggctgttcttggatatacagtaggtgctaagcagggacatgaagagcccacaagagatgcaccaggtcatgtgaggatgccgccataaccctgaccgccctcctgagcctcagggggtcagatctggcagctgattggttggcttggagcagagagaaggggcggggctcctgggtgccctccccacctcctaccttcggccacatccttcgggctgtctggctgaaaaagtaaccgtgtaacttaattctctttttctggcagagccgctctggatatgcccagtggaagcacccactgcctgaggcagctgtgctcctggttccctgctgcaattccaggggcaaagctgccaaggcatctccttctgccttggtatttggcgagagcaggtctcagatggttttcctttcccctcttgctgaaggaaggatcctgtggctccctggggactggtctagaactgatcacttgcctcttctggtacctccctgcagggaggtggcacagggttctgcagagcaagacctggcatgaacgcttgagggctgtagggagtgtcccatcttagaccaggacctcagcctgccttttgttggattcactgggggcttcacttgagctgcttcttaccaagatgccctcagagccagtctgatgacaccctcagcaagacattagcaggacccttctcatggctggggctcttgggatgcagaaagaaacagtagagaaacctcagctgacccaggataccactccaggaaacagatgatcctgtgtctgtggcctgacagaggaaagagccttccacatgggaagagaaaatccaggtcccaatccagctcttcaactagccagctagttcccacttttgactcaagctgccctcagagccagtctaatgacaccctcagcaagacattagcaggattcttctcatgg

SEQ ID NO: 45100 - DNA, 1741 bp, Bovine  19866880886911
taggtgccaggtctaaaaagtaacttacttaagtttacaatactctttctgtatataaaggcaacacaagcccctctgcttgaaactaagtcaggtcacagatatgccactatggcagggatgatggatttattattattatgtaaaacattaatcggacatacagtgcagtcgtttgggccttgaaggtttcttgaaggaatacatttagttttagatttctgcacttgaatttcagcctttccatttatgaacgtgggaagcacctcaaaaaaatctgccctttttcctccaaccaaccagtctgtgtgcaaaatctaactgggtgacacagactactactttcaattactctgccagcaacaattctgagctttaaaaagccccatagtacagaggagtaaagaacaagatgtcctgggtttacttgttctgacatgacttagctgaagccttccattgtttacttttctggatttattttctcatgtgtaattgttaccatttactgagcattatgtctgaactctgtgttgagtgtattatatatataatcttatagtactgtgattaaaagactttggagccagattcaaatcctagctgaaccatttactaactgtgtgaccttaggcaaatttactcaacctctgtgcctcagtttctttacctcatagggttgtcatgaggattaaatgacttagtgtatgtaaagcacttagaatagtacctggtacacagtaagagctcatggatgcaattccgtaatatttattattaaaaaacaactcagtaaagaaactgagcctctgagatgttctttttggtcccagttcacactactagtaaatagaagagcaaggggttgaacctacgtgtgtccaaccctgcatcccacatttttattgcctactcacttaccgttaagtgaagttgaactgaaaaataacaccatcacacatttagcagggttactgtgaaaattagagataatgtatacagagcttagcagccccaacatctattcaataaatagtaactactgtcattatcttaagtcctttctagacccaatttaaaatgattcaaatactacttcagtagcagcaactgtgcagtgccagaactgcaaggaacatttctacttttacaaatgtcaattgagaagtttcagttttctaatcttgttatttggagatgatatctactctcataaaagtccccagaaagggtccggataacaagaaataaaaactagagaacaatagcacactaggctctcagtccggagaacgcaatgcaccctactccagtactcttgcctggaaaatcccatggacagaggagcctggtagactgcagtccatggggtcgctaagagacggacacgactgagtgacttccctttcacttttcactttcacacattggagaaggaaatggaaacccactccagtgttcttgcctggagaatcccagggacgggggagcatggtgggcttccgtctatggggtcgcacagagtcggacacgactgtagtgacttagcagcaggctctcagtcaacatcaagtgctatgcagtccaccaaaagggatgatgtgagatacttacaacctagattgagtccttgcgaatctgtgcacaggactccaacaatggatggattcttcattctaattccaggaacacaggaaaaaggaagaaaatgatgtgggaaaatgacattaattataacaca

SEQ ID NO: 45101 - DNA, 599 bp, Bovine  19866880938159
ctatctattgttagtaataataactattaactggaataaaaagaggaacttggggcattgttacaaagatagaaatacacatgatattcatttactcgacagcaaagaaattaaagccagatgtgcacagaacttttctaacttgtttgaagatcttttaaatgagaaattgccataggttttgacttcatgctattaaaattattgcctgtgtgcatgttcagtcactcagtcatgtttgattcttttgcaatttcacggactatagcccaccaggctcctctttccatgggatttcccaggcaagaatactggagtgggttgccatttccttcttcaggggatcttcccgacccagggatctaacccgcatcccctgcattggcaggctgattctttaccactgagccgtgtgggaaggacaattaaaattattaaagtgtaataattatgtaatatataacaaataatttagataatgtttctgtttgcttaaaagaacagactgtgagtgttagagcaattatgtgatgctttttgaatactgccttatactgatgattgtcttatcccacgggaagtgttctttgtcttctgac

SEQ ID NO: 45102 - DNA, 858 bp, Bovine  19866880986721
aaggtggtgctgctcatcagtggtggctgggactgcttctccctactgcccaggctcttcccttcctgatggacatgggctcaggacacctggacctcagaagccaggccctcagggaagagaaggaagacactggggtcctcaggggcggggggtggtggagccttgtcactgactaggcagatccatccatccgatggatctgcgccctcctcgggaagaagcacagtgctggccactggagtctttgtgtgcttgggtttctctgcgcctggaggaggcccaggatgggggtagctgggctgctagctgaggccaagctgctctgagcaatgtggttgtgtttactgggagggtgggagggccgggcctgcttttttcctgccttccaggaagataaggcagaaagcggggatgaaggatagaatgggtaatactctgaaaccacaagaaagggtcctggctttcgtctctgccctacagctcagacatgctcctggggcatctgggagcagggaatggccccacccccactactctggggtccctgctcagggaagctcagaaccctcagtgggctccccagacttccatctcccctccagtgtcagttcacccacaagctgtttcagctctctcactccccttcggagccctagttttcccttccaggtgagcccagcaaccctagagccaggcttttccccttgctttcctgtaccagctaaagccacagggaccctgggcaggtgacatgacatgcatgggccttgagggctggctgcaggttcatcttcccctaccctctaggatccctgcctggaccccaggcacagatcagccctagagcaaccaagg

SEQ ID NO: 45103 - DNA, 1117 bp, Bovine  19866881064690
catccagccccagggcctgatttctgttgggaagagtttgttgttgtgggcaggggcttcccgccaggctctcccagccacggtctgggaattggcaacactgaggtcactggctcaggctggctttaagcaccaatgatcctgagacccctggcagggaccctccccattctgggcagctaccctgggagcggccctgagacgtgtttagcatttcacatctaaaatgctgtcacacctgtgatcctccaagatactcctcatgtggtagtactatcattctcctttcctaaattgggaaaccaagactgtgacatgccccaagtcacctggtcagctagtaagtggcaaagttaggacacccacacaggtcttctgactccaggaggctatcaccctcatcccatacaggagcctcaacttggactgcaagcctgtggctgcagctgagctgggcgtggaggggagcccgggagggctgacagggcaagggaagggcaacgctgtggtgccagcatccacctctcctggcccccatatggcctggctcacggtctgggtggtcaaggcagccagggagccctgtggccaaggtgccctcacctgtactcgggcctcggtcaggtccgtgcgcacagccagctgttcccgggcatatacatcagggtagtgggttttctggaagactttctccagttcctccagctggaacgtgctgaaggttgtgcggttccggcgcttcttgctcttattcttggccagctccatggagtcagggagtcccggggacagagggacacgcaggctggccaggcaggggcctggggagcctggcaaattagaggtcccgtctcgggggccccctcggcagtccaggggtagctgggggaagctggcagctttggaggccttctcctcagctgcaatggaaaacacaaaaaggaggatggaaaccgaaccagggggttttgtgggtggaatggagggagggggaagaacgttgacgcttcagtccccgcctcccccttcctttttcctccgtcctcccagcagccacccttcaagggagcctggcattcggaggcctgcctgctgagcctacagctggggagggggc

SEQ ID NO: 45104 - DNA, 1221 bp, Bovine  19866881066424
aaagcattatgccagcccccccatgagaaataacaaaaagatctgccatcccaagattacccaaaagacccaccagcagagcttcttgggcagtaaaggcactgtgcatccaccaatgcctgaaaccaaaaggtggacttcacctgggctactacatgccagacgttgttttatgtgtattaatttagctgaatctcacagcagggttgtgacagatgaactatttatggatgaagaaatggaggttcagagaggttaggtagtttgcccaaggtcacacaacttgcagctgagcctggatttggacccaggcagtgggctccagagcctgtgtgctgagtcactgtgctgtggtccctcagaaagattaagggataggctcaaaatgacaagctggtaaatgtaaactggacaccaagccttctaacaccagtgcaggcctgttccacctttctgtctcttcttcgtgctgttatgcaaatagatcacctatttaggtgatgagggcaaatagctgggacagttccctctctctgcattggccccttgggggtgagaccttctctttcctccaggccagggccctcctaggtgcctgcacttctggttggagttggagaaaggagccttcccttgttagtcaggtcagggttctgttcctcaagcccagtggtactgagacaagcccccagctgtgcccttaccctagcctttctcacaggtggccaggtgtggggaggcccagatggagtccagggccgtgtcgaagaatctcaacgccaaggatcagtcactgagcaaaaccatcctgactcgatcacccatttatgggcaaaatatcctacaagctgggaataatatggggagacacaaactcaccgccacccccctctgtgcctacatgttatcatttgctcttaggacactgggtcgaactaatccagcctctggggtcagcatctgatccgcgcactgtcaggtgagggccattatttcaccaggtttgcccctggtgccctgcactttgcaccctgcccactaaccctcctggatcctctctcaagcttcctccagaggcacagacagccagggcgatcctatttcataggatagcatttctgaatcccaggcatcagctgggcaggctcctcctgccagtctgcccgtctgcccggagaccagcaaatcccctcggccaggagagcgacttagcggagcatc

SEQ ID NO: 45105 - DNA, 1893 bp, Bovine  19866881114367
agaaagaagtgattcacccacagtcacatggagccctaaggctgctcctgctctccctggggccacagcttacactctggctggctttcccacagaactgccaaggccctgagtctgggtggggaggggtctcacctggggatggctgtcggttcggggcagcatggagatgtcataggcagatgtgaaggggttccgcccctcctggatcttcccataacgctcacgcttccgccacttggctctgcggttctgaaaccagacctggggacaggttgggagaaggttgacgaggtgacaaagcagccacgaggcatggagcccactgggtagagagttgatggctgtatcctcctgtgggtggtggggagctggctccaggctggtgactctgaattgcaggaacttataaattcacgtcattctcagggcctgggatggggcctaaaagaagcccaagcccagagagggtttactggccctgtgggccctcccctaccccgcaggctgagtcatactggttctccagtctggctgtgtctggtaagggtagtgttggggtctgtggcctcagagccccggggcgagtatgcgtgttgggcttctagtcttatctcttccccaatgtccgcacctgagaaatgcagtaaggtaacctgaaggccacagcctaaagcccagctccttaacacggtcccttggcactgacccctgcccctccctacagcctcatctcctgtcgggcaacaacactcagttcttcctagcagcctctcaccccagctgccgtctcaaacactgctgtctcgctcctcctgcctttgcctaggtttttccagcttgcgctacccgtccccccacacatacatgtgagctgggcaccctctactggacttcctgaaaaacccagcagagctctcacgatactcatcgcatcctactgccaccatcggtcttggaaactcttccccactcattactgagctgggaggtgaggggggcacatctgtgtgctgcccacgtagctgggctggatttgtcacctggttatgtcctgtgtgtgccggtgcacgtgtcaagctctaggctagatatcggcactatcaaaaccaaaccaaacacattctcctgctttccagggattcggctgggagccacaacaaaaggagctgcatgtgtgtataagcaaccctatctgagtccctcactgcccaccccctctcacacagaagggaaggcccgatagttaagaagttgggcgtactcctggcccttaacccagggttgcagatcccagagcaggcctgggtcaaggctagggagggcccactaccggttcctccttgatccttaatttgctctccctcccctgcagtccatggggttgcaaagagttggacacgactgagcaactgagcaacaacgacctctgcagacagatggaggagcctggatttgctgatcacttttcttgtaattcttccgtcaccacccgctctcccctgagctctgaacctgccccctgcactgtcccatgggtggtcgccttactcctcccaccgaggtggggtctatgggtggtgtcaatgctcctgtcaagcatccctggtcttgggcctcaggcatcatggaagcttctggactaggtctgggccatccctccacccctttagggttgaaaaggcctagaagggcagtgaggaaagtgtgtactgcctccccaaagcagttccatgggggtagctattcagagcatcccccgccacaatccccactgaggcttgctgggctgtctggaaatgtgacatttggacttccacagcttatgtgatctggaattatctcgaaagctgggcctcttaccctgatggtcccatgccctgaggagccctg

SEQ ID NO: 45106 - DNA, 953 bp, Bovine  19866881127653
actctgggatcaaaccactactctcttttctttttatttgccatacctttattcctactgaggaaagcgcactgtggctgacacctaagcatgaactggctcccagatggatgtcatttccagccagccagaagaaacttgggcgtccagggaaggaaagtggagaaaaagtgataatgaagggaaagaagtttgtggaattcagaatttccaactgtgactgctttgtggtcttgcttaaaactgtcagttatcaaggtcttagaacaacggaaaagggagagagcaagctgagtcccagatgggagagataatctgaggtcctggaattgagggaccctttttctcccaggaccacagccaagtgaggtctggagcatggtatcctagcaccaccagggggcagcacctacccatctacagtaggctgtcacatggttggctgagcagggggctctctccttcctgggttctgagctctgaggaaataggaggtcctcatacacacagaatagagggagacaagccctgtgaggccaactgccacatgctcaattctccggaaaatttcagagaggctcaggtaacagattagcccagagctctaggataaaaccttcagcaagtggtgaggtcttctctggaggcctctggcctgaggcagagtcccctactccagaagctgggcagtgtgctgagtcggaggccctcctacccagttccctttctccccactgcctctcccaggctaggccctctgttttcggttactccttctgggttcccctatctccatcccagttttctgatctccaggcctcctttttccctggtagccttctccctccacccatctccccacaggcttctcaccatctacacaccctgcagtgtggaaacaccaagagagcagagatttaccagggcgaggctggagacatgttttgttcatt

SEQ ID NO: 45107 - DNA, 1039 bp, Bovine  19866881173151
cagactgcacggcccgcgtcccccgggccgtctctccctagcagcccgtctctatagcagggacgcaagccacccgcccaccagccgagttcaggctagggcactggggaggccactggcggcccggggctctacccagtttcggctcgcatccgccgcgcctccatttcgtttggtctgtcctctgctcaacccgcatggttagtttccttctcctacttgtgcccattttgctattttctgcacttttaggatgcctctttttcttcatattgtctgctgcttctcttttcgtccgttcccctcttctccatttaccctcttccttcgatcctcctccgctttttattcgttcgttcttcatttatttctttccgttttgcccagttcgctgatcgccttttacctttctttctttcctctctccactattgttttgtcgaatttcctcttccctctttttggttgtttacacttttgtttttttttttttccccacgcatttcgttgttgacaccgtcgcggtcgctagagtcctcctcgccgctctttctgctccagcgctctcagcagttagctcggcgccagggtcggtcgcaatcccggctgtccgtccgtgatccatcgtgcccagcagggaagctgagccgcagggtgcgtcatccgaacgcggcgcgtcgagccaggccaggtacctgtgtcccgggcggtgctcacggcgctgcgcggccgccgccgtctggctgggatcagaggagccaggccaactgcttctcattaagtcccaactgtggtttttatcaggagagcctctttcaaagggcacagacacgaagctccgcggactcgctcatttcctccactgacccccacacacctccctgccctcccttacacgttctcacagccccgactgggcgaaggctggagccgcctggccactccgcagaggcccgcgaggcgccagcggggcggaggagagttgggaggcgatctctaaggattcagctccgggcctaagcttcgggatgtggcagca

SEQ ID NO: 45108 - DNA, 1081 bp, Bovine  19866881200627
aatttggagggagcacaattcaactcctaacacatgtgaccctccatggcagtgggcagcccaggagaatgcacagtggggtcaggtgcaggggatggggtgaggcgggtgaggttctaactcttttaggtaggttcagtgctcagctgaattgagatttccaccatctcttttatgaaaaacttaaacatttattaaaatatattctggatacagaggatataaaaatggatatagaaatgaatagataaaaatgagtgaatgtagtccttgactacaagggaaaagagaaacagacatgtaaacaaatcattgaaaggcaatataattcatgcagtaagaattctatatgacaagaaaaagggggtctgggacaggattgtcctggaagtttcctgggaggcggtagcattagcatggaatctttgaagatggctagtgttccaggcagacaggaggcaggggcatatcagtcagaggacaagcaccacagcatacaagtgtgtgcccagcttgatccggctagatgtgtaagctagggagacagaggtcaaaggtaagttgggtcacattattaagggggttatccacaacctaagaaattgcactttttatcctatagctaagccatgggaagctctttctctactattaacctctgaccagacaatgatttcactggtgtagaaaatgaggccagaggggtggcaggagctagtataatggctggcagatatcaggcgcttgataaatacgtgaatgaatgaatggcttttaagaagcagagtggaatgagaggagagacaagagtaggatgaatgagaaagcagaaaaacacagtcgggataatttaccatagaccaggtatagagttgtgaaagtctgaatgaacctcaaagaagaggaggaatatctagggccttaaatgggttgaaggaaggtgggaaaggtgaaagatggccctaaggcttggaagtcaaagggagttcctgcccactgagctccactgtctctctgcagtctggctcctgagggaaaggagagaccaggctgtggaagcaagcagtgaggtgtgggagga

SEQ ID NO: 45109 - DNA, 812 bp, Bovine  19866881203452
atttgggtttggtgtatggtgtaccccttccatcaggcttgcctttctgatgatgctcagctgagaaggctcatggggaaactgagggtgcagaccttgaggccctcagtggccctcactggggaagaaggcaagcttgaagttcaaggccactgaccagcttctgagtgtgcgagagggagttgattgggtcgtgtccactcggactccccacctctctggtgtggtcagcaaatcctctcctgctcttctggtttcagaggtccctggatgagaaggagctgacggcagccaagtcccaccttctccacgtgctgggaagcagggctgcgccacccagggggcccaatgccgaagaacagcaaggtgacccagcgtgagcatagcaatgagcacgtcacggagtcggtggccgacctgctggccctggaggagcccgtggactacaagcagagtgttttgaatgtggccggagaggcaggcggcaagcagaaggcagcggaagaggagctggacgcggaggatcggccggcctggaacagcaagctgcagtacatcctggcccagattggcttctctgtgggcctcggcaacatctggaggttcccttacctgtgccagaaaaacggaggaggtaaggggcagccctgcttgtcccagagtgccctgcatgtgggctgggctgaggggagaaaagaaacacccctttatgaggcagagccaaggcccttgtagcctggaactcaggactccagagtgagactgagactcttccccaggaatggctaacagctcttaagaggctgcaggag

SEQ ID NO: 45110 - DNA, 1957 bp, Bovine  19866881207438
ttaaaagttttcaaaaattttcaacagagcctccattctgtgaagctaatttttgtttcctaaagctggccaatgatgcaatacttcaaatctcagcaccaaggacagagctcactatattagggaataatgcactgtttttcaactctgcagatgggaaatttctgtgagttcaagatgaaaccacagagtattgtgttaaaagcaattaagtagctcaacattttttcactctacagatgaagaatcaaatgacctgcttaacatcctagagccatggcactagaactcaggttttctaattcccagctctgtgctctcactgcatgattctgagacctggaatcacaaacggattattaccatgctcctctccagaaagcttccatgacctttcagtgttcagttaacattagtgccaagagagaatatttggggtgacagggaaatataggaaaaaaaacaaaggaaagagaaagctccatgactcctcaatagggaaagcttttcttattaccttctgggagtgtgaccagttggaaagagagtacaggtaatgaagcacacgtaagtgaattgctgctgccaaggtcacagcttagaagagtggatggcagacgggaagccccagccagccaaacccaggactggggaacaaggtttagagactattcccccaaccccaaatgtcagccagtcagcagcacaggttgagaccccaatagacatacacaacaccaggttcttggagtcaaacacaagcatggttcctgacctcagaggtgcactcaggccagcatgccatatctctgtggaaccagctataccagtgagaacaaattcatgacccccaaatgtgaatccacccatggggaggggctgtgtgaatctggacaacttatccaaactctctgagcctgagcattcatttctatagagtgaaagtttcgattaaatgatctggaagtacacttcctgaatcactatcccatgattgtctttctaagcaagctatatgggactaggaggatactgttaggcagtgagtccctgcatctgtaggctaagctcggcgcctctctcccccagcttcccctaccagtcaggagcagtcactcccctgaccttgccctagacttataaatgccaggataacaacatcggccatagaattggaaaggaaggtggatattaatgcagaggttacatgaggccggctggctgaacatcaaaggcagctttttattttgatgagctctctgctgacaagattccagccctcatccttacagattgataaactcaaactctatcaagattccaaacaaaatttgatcagatttggggatactgatatacactaacaaatcttacatgaagaagaccaatgaataagaccagaatgccaattaaatcacaatgagaaatataactgtcaagtgaattggaaacttactcaagctgaccagtctctccatgggagtcaaattatagaaacattgaggaactggccaagacaagttaactaagtcatttctttgtttaatggcatcaggctctctgatcctgccatactcgtctcaataattgggcttcacctgacgacaggaaagttcctcccaataactacagggtgttagatgaactctgttgcttttacctggctaattccctttccttctgcttcagtttctaatttcccttctgactggtacttcctgtatgtgtgtgtgtgtgtgtgtgtgtgtgtgtgtaaattcatttaccatcaagtctttctggtctcattggcattttctttctggaagtttatctttgtagctctactctgacccattgtatgttggtgtttactactcatttgccaagtttagggattagaggagggacactatatcagttagatttgtaagatcacagacaactctcaaactcagggttaaaaccacaatcattt

SEQ ID NO: 45111 - DNA, 1126 bp, Bovine  19866881279846
ctgcaaagcaaggcacctgtctcccagggctctctttcagcaaaggagaaactgaatgtttctactggccccagtgctgagactccttccccactggctctgagcgtctcccctctggccaggtccttggacctaccccagcatcttagggcagtttctctcttcagaaaagaaagcacatttttgtttggtttttggaccacccttcccaacggtagctgcctgcttgatgaggcgtgagatagaaggtgtttatcccaaaggaaggaagggctaggatgaggctgtctgacctcacacagggatcctctgaacagaccctgccccttaactttgccaaaactctgggcagatctgatctcctggactaagggcttcaggacctcagaaggtcaattcagaggtacttcagtccctagattctcagtactggtgggtgataaccagagccatctctgagctttggccctgtgatttgggatgggtgtggtcagagtcaggcctctgggatgtggccaaacacctcccctgcttagcaagtggtgggctctccccaaagctggatgtccccgcttctacgcttcctcctaaactgccactaaccatttcatcggtctggagcagtctgctgacactgcatctgtggagagctgctgtggagagctgctgtgaagatctgggggatttgcacaaactgtgggccctggtggaggccagagatggagcctgggaggggggcggggcaggcacacagacagcctctgttggcctgggaggcggagaacagtggccagcgcagacactgttgtttgcaaacaaacgacctcaggctggggggaacagcttgtctttgttctggttggtgctgatgtgggtcctgcagccctcacccctcggttctcctctccttgccgactgcagccttggagccccggcctgaggcacctggtccccagaagaggatgtggttcctaagtgtgacccctcttacctagtggtcacgggaagtcatgtttagggtcacaggccccacttccatccctactggcctctgcctccacctctgcaagctctccaggcccttctctttgtctagcacctgggctgcagctctgtgccacatact

SEQ ID NO: 45112 - DNA, 1764 bp, Bovine  19866881320703
tgagtcactgggcacggccctgtcctggcactactgcatggctgactgagggacctcaagggccacaagtgcagacgaggggcttagagagggagctggagccagtcctggtgctgaggaccacctggctctaggcagtgcttcagctttagggggacctgagccctgtagccagctggagccccactcgctggcagagaactactgagtcacagatcactgggactactgcccaggctgatggagggggacccatcagatttatggggaactgaatctctaccatagtacagcatggggcaggcgccacaagaataagcatcaacaggccctttccttcctccccaccagaggcagccccagagctgaggatgctgagactggggtgggagtgggtgggggaggggcaagggagggacggagtttctgtccgtctctccatctgtttctcactctactgtttcctccatagccccacagttcccctatgtctctaacccactcctagcttcactcacttgctgccccattgccacagggtccctgtcctgcatcctgccctgccctgccctaccctacactggccctgccttctcatgcctcgttgtcccagccctcatgacccaaagaccagaagtagacctagaaagtcctccagttctagattcagacttctggttcctttgcccccaagctcttcacagcaggcccctgagactctgggcaggcagcagctgatcccaaacaaactgaccccatggaaagtatggtaaaagtaaaaaacatcatcctctacctgaacactagccagcctgggtgagagcagccatctatgaccactccccaggaaatggcaccccaaaaggtcaatgcagaaatgggctcctgctgaggtgctaccccaagaaggcctcaagtttgcagagctattgacagcttgcaaagcacaatcacagctgatttttatagaaaccccagagtcacagtgatcccattgtacagatgaggaaactgaggctcaggcatattaagtgcccagcccaaacttggcagctaagcaataaaacttggactggaactcaggcctgtcatattctggtcctcacactctacattaaaccaagattcttgctcactcttcatctgacatcaagtccagatgacaggttgtgataggtggtgattccctcctcacctaaagcaatcactcctgcttattcacatcctggcattcatcaccctgcaaacattccctccttgtgcctcctttagttaccctcacctaagtgggcccctgccctttgcccagaaggttctttcccatttgctccttgaaaccagtcaccaccctttttttaggaaatgtcacctcctctgtgaagccctcccatcatgactgagcagagccaccccttctctgcaggcccccacatctctctgtccctggacttctgcaggctctgatgttaacccaccatgagagaatcacccatctgtgatgtgcgccctccactccccccaccagcacagaagccctgctctttgttctcagtggctgctggtggaaggaagaaagtagggagagaaggagggaaggaaggaaggttggctgtccagggagtctgatcatgtgtctgtaagaggggcttgcatcaggagggcacccagtcatcttgagagaatggagaagccgaggccaggagaaaaagtgacttcactggcccttgagccacccaagggtcacatgtcctcctcatttctggc

SEQ ID NO: 45113 - DNA, 1077 bp, Bovine  19866881411033
tcctttcctcttcagtgtcaccgcctgtaggccaatgacaggaaatcacccttggtcttatccattcccaagtgagctgccctcacaacaccagccctaccccaactcacacatattgtgcttgcgggcgatgtagcgcaagatggcattgctctgggtcagcctgttcttaccgtccatgagatagggcagctggaaagaaaaggacaggccaaatgaacaacctctctcttgcctccctgcctctctctcctgggaaagaagacttgcagggaagagaacagtagagaaaaaatgctgtgttagaagaaagaagaaagaaagtaaaaggtagcaactgagtctacacttaattctagacagggtgctttactgagtgtgtgtttgtgtacgggtatgtgcacgctatgcactttctctccgaataaggcttttaaatgcacaaagcaaattacacatattacataatttatataacattaaaagaacaaaattttaagagtaatatgtgcctatgaatgcattaaataacaagaagatgtaacgactatcatactttcaaagtatgataagtgtaaataatatttatttatatttgcaacacatgtaatgcaaaaatacccagtcacaggcttggctaataatcaaggttacattgcctacattcacaacagaaagaactgttaacttttagctagtggttagtagaaatgcaaatgtaattttttcttcatccaagcctaaggacaccctgcattctatctattctatcgagatgaagagcccttattctacaaaccgctagaggagagaggaaaggagcaaggatacagttgaaggccttcccttctgccccctcctctaaaaccacctacgttagggaagtccaggtctagtttgaatttcacatccagccactggctcttatcatagtcaggagctgtaagagaaagaatgaagtgggatccaaccagcttaatatcccacctgaggagcgtggaaagatttagagacacaccctaattccaattcctcacaagcgtgctaagtcgcctcagtgtggccgactctttacga

SEQ ID NO: 45114 - DNA, 837 bp, Bovine  19866881630722
tactgtgctgagcattgtgaaatcttggtgagaatggacactaaacagatgcacaggtgcacgtataattactagttatggtaagtgacatgaaggagtagtgcaaggtactctgagaaggcttggtagggagagccaaactaacccagaagacaaaaacgttgagataaaacatcagaaaagtgaaggcagtgatgtcctataacacagtggtgtctctggaagcatgtgtgtttgttcctttggaaaacactcatggtgatcttttatataaccctttttttctcaacagggctattctgagtctcctgacctggagtttgagtatgctgacacagacaagtgggctgcagaactctcaggtaaggcagaggccttctactacttggtctttaataaaattgagagtgagtgtcattttggagttcattttatctcctagttagtactagtaatgatatgtatatatgaaacttattattagattcaagcccttcatatctcataactttgacttgtcctttacttttatgaaacatctccgcatggtcagctcaattggctgtggcccagtcccactgtggacattgatgttctttggccatacacaatccccctgacagtggtctctcctcaaacaaggagtcctgaggaatgccagtgagtgggtctatctctgtgtccatctgttgttgccactgctgctcatgtatagtatgcaatcagcctgagctgcttctcaagcctccatagtacaggccctgttctcatgccacttgagagagacatgttcatggtggcagttagcctttggcatagcatggtgggatcaatgcg

SEQ ID NO: 45115 - DNA, 868 bp, Bovine  19866881859190
ttcagcatcctccctgcacgtgttaagccattccccaggctcacagcgggagggagaaggtgcctgagtgtgcaagtggatacagttataaagatggcaaggaaacaagagacaaacagtgagtagtacgactgatgagaatgagtgaaccactcattcagcaatacctgatgggggcattccacgagttaggcctctcaagatatcaaagagaggagtgtctgcccctagagagcccacagtccttgagggaaacagagaagaaaataaaaatgccaagtggaccctaggtaaagggctaggcccagcaggcgccacaggagggcgccaaacccttgtcatgaatcctaaagaggtctggaccgaggggagatctggaggacaattaaaagttggagaaaggaatagagtgtggagaacattccaagcagagatttctctgcagcagggagaaactccaggagcagactgtgaggttgccatctcccatgagcccaagaggggtgctgcccgctcaggacaagggtcaccacccaggccaggtgggcagaggttgcaatgggggccatttggcccaagcttcccatttgtgaaagtcatcatatttaggactttctacattacctccagttgaggtctggatatttaaaatacaatttgttaagtgcaatccattgaaatatatctcaatttttatgagcctgttcagtttttttttttttttttttaatctaaaagaagcctaacaatactgaaaatggcccagttctgtctcgttcttggcaaacaggcagcactaattatagataagagaagtgaggacttagactagccacctaatgcgtgctagaacttactcagcatcgca

SEQ ID NO: 45116 - DNA, 415 bp, Bovine  19866881910081
aaataaaataccctctaacccaggagaaaggatgggcctgcctcacagagtgctgatgggctggtaagcagagcgggtatctgggatggtccacgtgtccccagaggactctggctgagatgttccagacctttcctccttcataacaatcccaaatattacatcattcaggcagtggtgccaacttccagtttaggaagtatgtggtcctgagacaccagttggatgcagtactcaggatgagggtctccctccctgcccttcacccctcccaggactctgggctgtaagccctgtgcccgagagcagccccgctgcctcccagcctgtgcccgccaccggcccccaacttactatacagctggagaagccgatgccacccaggcgggggcacacatagtgccacacgccgatg

SEQ ID NO: 45117 - DNA, 1335 bp, Bovine  19866882013499
aggatccttgtttaatgttggcagttatcagtcaaactgaacaagtcagccagttcttcatcttccctgggtattcatccgtctttttctgctactttgtattgcaatggtaatatttgtccttggacctttggaaattgagattatgtcaaattggattgttggtttttttaatttccccccatagtgtaaacccaagtttgttgaggaagcctcctgagatggacacgtttctttggaaggcctgtcagaacacctgtacttttgaacatatagagtgactctgtagagtgaaacattaggcatttgactaggatctatacagtcaaaccttaccaccaacatagtaggaagaagagaaaaagaacacgacagaactacttttgcttgtaggatattctttgtaggatgtatttgaataaagcatatgtggaactaattcatcagaagggtcagctgagacttaggaagcataccagatagagacccagtaagtaatgcttagacatttaagtgaaatacaggatttttttttttttttagtcagggttttgttgtggctaattcttggtgcagttttataaaattcacaccagtacttcttggattccctgagaagtgatttgatagattggcatttcctatcctctccacatcattagtatctgttacttctctttagaatgaccactgttgtagtgcagtctttgaacaggagtcagaggtgtaagaagatcctatctcttttagatttctctacagatactgattagctctctttttcttattggattctgtttagtttgtcaggcacagttttcatattactttgttgtaagttcctttagatttttagcttgtaacagaaatctgttcattgtctacattccttgctgtcagtgttataaatctgtaccttttgtttcttgaggagggtgtcctcgggctccagtgtgttacccagtgtattattcttgtaaaattgtttgtaaaagatattttgatacatagaatcatatcgatctttagttgcctgtgactcctaaaagtttattctgccacctcaagtagttataatctgtaaataaaccctttaatgctctcttgaagctgttacttaaaggaactagccactaaaggagaatcatgtatacctgactgtttctcaagtttggaaatttgaatattaaaattttataaagaaaggccacccttgtactggatataataattcagaatacatcacattgaggtgggtcggaagcacacccctcttgtatgaagaacaatccattcacatagaatataatttttttcctgaaatccaagaatcca

SEQ ID NO: 45118 - DNA, 1627 bp, Bovine  19866880360932
cgaattgttacctaccagtgaaatagaatttcggtgatctatttaggtgggacatgacttccatttgaagagaatatagaaatagaagagcagttctttttttttttcccttcatgtcaagaaaatagtttaactattatgtctattttaaataacagcaaaaatgcaaattacaagtgcatatattttcttgtgtccaaagttctatttcagaatagaattgcaaaaataatgctatcccactgtgtaaaggaaatgagaaatgcagagaccattaaggaggattgtgaatgcatacagtgcattagcaccaaaggaaacagcatggatattttgtaaaaattcagtgtttagtggcacttggatttgtactactaactgtcagatgtcaaatccatgatgaggtcagtatgtaccttatcttgcaaagagatttgaggtgacttttttttccttatcagtttctcactttgtttatgagttttatttatttaacaatgaagaaatagtttacgttatggcaacacactccagtattcttgcttggagaatcccatggacagagaaacctggcaggctacagtcaatgggcctgcaagaattggacatgacttagctactaaaccaccaccaccaaactctgtgaacgcaggaaacacaataagttctcataagcacataagttctcatctgactaaatcatatcaaattcagataaaaattatgtgtactgtttgagggtgttagttccatattttttttgtccaggacctattatgactgacaattaaatgaacacactaggattctgtctcctcattttttcactattcactttcatattgtttagccactgcacagtaattatatatatatatatatatatatatatatactcaaatgtgacttttaggtcttttcaggctttattataaaaacaacatttgtgtttgtgtgtttgatgtttttagtacccagttgttgggatttcaaaaattaatgaaaatggtttttaaaagtctttgtaaatgaatgatatcaaatttatgatgaacaggtccaatttcagataaagaatactgtgagattctattcataaatttgtttatttttctaaacatgatggtgaaatttaatcttctcctgtatgtgaggctcttggtacttaggatctttcctttttaaatgatacatgttggtatttatattgtagaggagcaaaatttgccacaccaaaaatgtgtttctttgttttcagtgtttaatttatttattggctgcactgggtcttagttgcaacatgcagaatctttagttgtggcatgagaactcttagttgtggcatgttggatctagttccctgaccagggatagaacataggccccctgcattggggagtgcagtgttttagcactagaccacagggaagttccaaaaaaatatctgtctttgacatgaatgttaatttaactgattatttttaagaacagaagactaaggaagtttgttttttgtgtgtgtgttacctctctcttaactgcctaaaagattttagagagagggacaagtagagaagaagttctacttgttcccaagtagagctatcaccagaggtatctgcaaaga

SEQ ID NO: 45119 - DNA, 2810 bp, Bovine  19866880597940
ctctggtgctgggagggattgtgggcaggaggagaaggggacgacagaggatgagatggctggatggcatcactgatttgatggatgtgagtctgagtgaactccgggagttggtgatggacagggaggcctggcatgctgcgattcatggggtctcaaagagtcggacacaactgagtgactgaactgaactgaactgatagctgattcatttgctgtatagtagaaactaacacaacattgtaaagcaactatactccaataaaaattaattaaaaataaaatatacatactgtaaaattttaaataaaacttttataagtaactaaaaaacagtttagctttagttctatgggatgagaaggcaaatccatatctggaaaaggcatctatctctctgaagacaaaccaatggcccttctcaaacagaaggggcataataaccaataggtaattagtctatccttaagaaatgatgctgtgttaggggatcaccatgtgtctctgtaccttgcaggtttaatgttcccagacattagccatatccatctgagaaaatgagaatggattctattgaccccactcatatactctatatctgccaccatggccactttgtatgcaattatacccgatctgagacagccaatgaagataagctgatgttaattcttcttgaatgttgactgtctattatctgatgggtgcatttttggagacatttacatgtaaatacagtatctccatacttcatgtccacatgtctgctcacatgcctacatcctaattcccttatctctaagcctccagccatttttcttttcagcctcctgcctttaaccactttccaggcatctgtacatagtattatcttagcccatttctctttgaacacaaaatggattaccagatatattgcttacagctctgtccactaggaaacttctcccatcttggcttttagggcctctctgaatgtgacagtaatgcaactgtcatctgtttttaacttgctctgcctgattgctcaaatggtgaatattgctttgcagtggcattattttggagctgtttgtcctccacctcccagcactgacacactgcaagccaagcacgtgttgggatgtagcttgggaagaattcatgggttaatgcacacagaacataccatcttctgcaatcattgaaagactcctggtagttaccagagtataatcatataagtttcatatagatcagaagagtagacacaaaatggggtagggatggtttttagttgaggaattaaataagagcttgtcttatttcaaataataattctacatttcttttatggtacatttattatccaccaattgaaattgtttctttgagcaaagacaatgtacctctgggaacctcctattaaaataccctaaaaaaagaactatgccattagcaacttcaaggagatcaaaccagtctggaaggactgatgctgaagctccaatactcaggccacccgatgccaagagctgactcactggaaaagacattgatgttgggaaagattgaaggcaaaaggagaaagggggagcagaaaatgagatgaatagtattaccaactcaatggacattaatttgagcaaactgtaagcagatagtgaagaatagaggagcatggtgtgcttcagtccagtgggttgcaaagagtcgaacatgatttagtaactgaacaacaaataatgtaatagtttaataagttatttcccaaaaggatgtgcctgagtattaatatgggtagccatgcattttgggataagaatgggaaagagaaatttatatattcaacctttcttaaaaatattacaatgtgatttaccatcatctgcaacaaaataaaatagatgctcttggcatggactctaaaatctttcctaatttaggttttgcttactctgatatccttttttatcactgttttctatttacacataattattcagcaatatcagattattttgttaccattgcctcaatgaatcccctatcaattaattgaactctattcattctttaagatataactgaggattatttccataaaggctttcatgcccaccttccctcagatattccctcaatcttgattcatattttcctataggttttcataacatgctgtgcaaatttttttctaaacacttactgtgttaccgtacaatgagactcaagtacagagctagcacataacaggtactcaataaatgaccacagatccggggacctcctacaatgaccagaccttgaacagctccacagtgaatgctccctgcactgcaaaagagacataaaaatactgcctgctgagaatcaccctggtgcatatatacaaatgtatatatacacatccatatgtgtgtgtgtgtgtataggcataggcatataccctgtacctcatgggaaattaagttatcttcagagatttcttggaaattacttgtataaatcactagaggaaagatttagaaatgataactaagtgtttggggaatttgcaataggcagtaatacaaaaatagagtaaactaagtggtgcacatcattaaaaaataaaattctttcttcttcaagttttaaatcctttaactgcatttaaatatttaaagcttagactctttggaggaaatgaaggcaccactgatgtctccagaggaatgcttctatccagtgctcctgaactaatgtcaatatttaaatgttttaaaagtcatctttgaacagcagagatttttcatcttgaaatagtttgcctttgttgcagcctaaga

SEQ ID NO: 45120 - DNA, 1663 bp, Bovine  19866880620334
catagggatagtagaagtcatactattagacatagaatggacacgggctaagggtgggcatatacctagttggccttgttaccataccctagttcacaaaattgcagtgaactaagtagcaaagtagttgctactgaaccctggagagttgggcatgtgagagcacaaaatttagacacatgatacattctcctagggttggtgatgaaataaacacagagtgtgcaccgagtggcctgataaccctagtgatgaggggtggatgtggtgcttaggtcagtgataagtggaagctgaatccaacatgtgcattccacctgtatccatccccaagggtgccaagaaaaggcctgctatggggaggctgtctcagctttagggagcacagctggatgtgttgatggtgtcagaagtgcagtcagtcttcacacggaagccgcctcaaaccgagaaagtagagaggctgggagagttgctaattcatgactttttgctgaatgaatattatatttcattcaaagtctttcagaaatattttcaggagaagtgcatgaaaaactttcaagaactttctttcctccttcacaagacgagtttcttaatgattaaaatttgggcacattagagggttttctatggaaaccagaagacgggcaaatcttactttaggcgttagatgtgactagggaaacctgtttagaaacatattttagcatagagagtactatataagaactacttatttacaagagaccctaagaaacccttcattaatacttttcctaaaacaaactatcccttaattgatttgcttttcttgcagctacaaagactgtagacatggaaaaatacactgtgtcttaaaatcttgtgagagatagattgatgatttcatctctcccgttttctggggtctgcctttctccctgtacctctgaaattttgtcttaactcagaatcaggtcttttcttttacgttctctacctgattgcattcagtcaagtcacatactacatgaacctttgaagagaagaaagttccattttctgattgtctggggtcacttagaatttaatcttaaaagtgctgattaccagttccttgatttctccctggggctctaaaaagacctaaatatagagaggttttttttgttttttgttttttttttttttgcgtttgaaagggtcctcgaatgtgaaagcaatgattagcaactttaaaactatttttctcctaagtcttaaattcctatttacaaagcccaggttagttttgttcccaaagaattgtgattgggggaattcttttctcattctctcatatactaaagctattttaaaagaaggagcctaaattgtttcgttttccttttttttaattttgaattcatgctgactggtcacatcttcttcctctcctttttttctcccttttatggcttctggctccccccagatcatatctggaacaagattattatcttgagtgatcttcttttatgaggttttcttgtcagcagcttcagtggaagtcaggcatgcagagctgtgatttatcgccaccgagccccacgtgatttaatgcattcacacatctagaagaacaaggctagtagatgaatggacagctacttgggaatgagactagctggttcactca

SEQ ID NO: 45121 - DNA, 961 bp, Bovine  19866880776553
aacaggatttattaattttggaataataaagtgtagcaaagacagaatttgtaaaagatgggctataagaaattatgatgttacaatagtcctattatcctccctcaacttttattttgtttaattgagtttaacaaacagggtgaaagggtaactgcattcccttcaccaacacccttgtagttgcagtccccagagcatggcactaaatttaagaactacactaattgtattagtaatgaaagtgtatttcccagacagaccattatcatctttcttccacactgaacattagctaaaatgtttaggcaccaatcctttaactctttctgactctgtgtgttagtacaattattatttgcctgtataccctcaatgaactaaatatgatcttcttctttacattttatcttaaaatgtgtatttcaagtggtttttaagacgtatattattacaagataaaatggaagtgagaatttgaagaaaagcaagatataagatgaaactaacaggcttcctaggtgactcagtggtaaagaatctgcctgccaatgttggagatgcaggttcaatctctgggtcaggaagttctgagaaggacatagcagcccactccaatattcttgcctggaaaatcgcatggacagagaaggctggcatgctacagtccacagtgttacagagttggacatgagagccactgagcacacatgcgagatgaagctaaggttaggaatttgtcaccgaaaattcatgccatgtattttttaagtcaaataaaagaagaaaacaggataattttatctctttttataaaaaaaaattctccactgaagagtgtttacatagattcagtgatgctatgaggcaggagcaagaaaaaattatctcaagtctcatgtttatcttaaacagtcctagaaatttgttttctccttcatatacatacagattaacattt

SEQ ID NO: 45122 - DNA, 1417 bp, Bovine  19866880837545
tcattacagagcactgtgctgggctccctggttacatagcaactttccactagctattttacacatggtggtgtatatatttatcagtgctactttcaggttcatccccaccctctcctccccctgctgtgtgcacagggccatcctctacatctgcatctctattcgtgccctgtaaataagttcatcagtacatactagattccatatgtacgcattaatatgatatttgtttttctctttttggcttatttcactctgtataacaggctctaggttcatctgcctcacttgaacagactcaaatttgttcctttttatggccgagtaatatggctgggtggcatcactgactcgatggacatgagtgtggataaactccgggagttggtgatagacagggaggcttggcgcgctgcaattcttggggttgcaaagagtcggacatgactgagcaaatgaactgaactgaactgaactgaatattccattatatatgtcctccttcattcttacccacacgatgttgttactgtctgttgaattttgttttataagaatatctttgatttctctggtttctcctatcggcaaccagtaagtcctattgatttgacttgcataatgtcatttatatttgtcactcagagtcccatatgcttaggctctcgttatctctcatttagactgatacttttatacaagtgttatgtaattgatattcttccctttattgtttacaatttttaatccatcctaacttgtaaatcaaacataatctttctaaaatataattttacaatgttatttccactgctcaaaaaagaaaaaaggaatattaacaatccctccttatcactgaagaaaatataaactcttcatcctggtgtataaaacttcaagcaaatgctccttccttatttaccctcatcccattgtacatgcccttcgcatctaattgtaatactctcaggcctgtggtggagaaggcaatggcaccccactccagtactcttgcttggaaaatcccatggatggaggagcctggtagctgccgtctatggggtcacacagagtcggacacgactgaagcgacttagcagcaggcctgtggacacactctgcctcacatgccacactcatcaatatcagactctaaagtccatcttaagaagtgtcagtaaatccattttattacagaaatacaaaacctaccttggaaaaattaaaaaacttccacctttactatttcaggccctttctttgtagcggtacttgtagtgtaatactgtattgagtattgttgtgtaattatctaccttcctaaatcaactgaagttttgaaggccaacatcaatatttactcatctttgcatttcagttattatccagctcaattactgccacaaaaagcatt

SEQ ID NO: 45123 - DNA, 1943 bp, Bovine  19866880962205
tggatactgctgctgctggtctaggtaccaaactttgaagagcaagagtctggttatgtaaggagtagctcttgaattaaatagcctgagtttgtagctggcttgcaacttaactatgttgtgatcttaggtgcattatttaaccctctccctgttcaaaattgtctgtaaggcagggctaatcagaatgttgtttcataagacagtgtatgtgaaacatttatcatagtgtttggtaaataagagataattagaagaaggagcaggaggaggaatgagtgaagaatcaatgtattttcttttaatgtggctgtttaacaggtgcaaagggacaagttttcagccttatggaaataatggaattgtgtgtgtgttcactgtttcacaactatctcattatatatgcatatatattcactgtttcacaattacataattatatatgtatatatatatatatgtgtgtgtgtgtgtgtatatatatatatatatatatatatatgtaggaaatggcaacccactccaatagtcctgcctggaaaattccatggacaggggagcttggtgggctatagtccatggggccacaaagagttgcacacaactgagcacatgcacacacacacacagttttagtgttgattcacatatttacttaggctttctccaaaatgaatgagaatacatgataaaatgatgagcatgcctcaggatctaaagagcagatataaattggtcactgagtgtgagcttcttgaccaagctcacaaccataagttcgaagttgaagttgagtcactcagttgtgtcccactctttgcaaccccatggactgcagtacaccaggcttccctgtccatcaccagctcccgaaacttactcaaactcatgttcatcgagtcagtgatgccgtccaaccatctcatccgtcagccccttctcccaccttcaatctttcccaacatcagggtcttttctagtgagttagttctttgcatcaggtggccaaagtattggagtttcagcttcagcatcaccctaaaactggctcaaaatccaggagattcagggaagccctgagctcatgaaacagctaacacaggactaatttgactactgaaaagctactgagaaattttgatggccacttggaactaattttccagccggaggaacttctggtcagctagtgacgataaaaggtttttccaggggagtaaaagttagcttgactagtaggaagagaaaaccgcatgttcaaaggtcggacatggtggagcatggtgggaaagaattgttgaaagaagataaacattctgggagagcaaatggcaagaggctacatggcaagaaatgagggtagatactggggcaatgccagatcatggctgacctggagtccatagaaagagatttatcttgctcttaagagcaagcattgacatgatcagatttcaaaatatcacactatctttagtatgatataaggtctggaatgaggccagagctgatactgatcagttggaagactattaacaatcattgaaaacaatgatagtagaatgagagagggggaggtgattcactgaggtgaatcaagaaggtaaggttgtcattttagaaatatatatgataaattaaccattcagcagcttaatgtatgtcttccttcaatcctgccaccctcttgctaataaaatttcagagttgtcatagttctgagaataacactgtaagtcaaataatatcatccaagtataatttcccaaatattttcgtaagagggaattgtgttctgaccaagaggttgatatgcagtgatttaaaagccagaccgcacatgtcacatttaatcaactgtaacttggtgtgtgagtacgctgtatgaatgaaaaccattttgtcaagaggcaatgtctgagtctgcaaaccggattgaacct

SEQ ID NO: 45124 - DNA, 1916 bp, Bovine  19866880986783
tattgatttagtaattacagctatgttacagtagatggaactgaagatctccacactaatgctgtttgatgaagaacagtggaaaagtagacacaaacattgttaaataggagtatatctttcagtccatcatgtataggatattccattaaaatttcagtgagctatgcacataattagacattcctgctgtcacaaagaatttcctttatgaacactctgatgcaccttgacatggaaagctcaagctggctggcttgcctctaaataaggatctgctgactaattcacattaacctctcttgcatttctaataggttcagtgagactcctttttaacaagcagcttctgaaaataagagatgctcctgtttcagatactgtttctcaatggaaggattttggaaatgtcaggaggaatttcttttttccacaatggttatcatttcattccatgtggtggggcacagagatggagtgggtaggagtgctaaacatccttgaccatataggatattccttctcagtaaataattggcctgctaacagtgtagataatgtcctgtggtaaccagcctccaagatggccacagagagccccacctctcagtatttacaaatgtgttcccacctcacattatacctggattgatctgagtgatcagtatggcagaaaattggtatgtcacttccaaggttaggtcataatatacaccaccttctgtcttggatgtacattctctctctcttatacctcactctgaagaaagccagctgtcctttcacaggatattcaggctgcctaaggtgaggtccacaaggcaaggacctaatgtctgtagccagtaggtaatcaggcagtaaagtctgccaacagcaatatgagtgagctgggaaagctgccttttggtcccagtggagcattcatatgactgccatcccatccagcagctgtatggcaagttcatacaagaacctgaactagaatcagttgagctaagcctctcccagattcctgactctgagaaactttctgagataagtgattctttatttaatctgataaattttgagaagattttttatgcaacattagataactaatacaatgtccctgatgacaggtctggcggcaaatattttattgatttatctgaaaaatctcatgtatatgggtaattagtctaattgtattttgtactgaacccaaagagaaggaaatggcaacccactccagtactattgcctggaaaatcccatggacagaggagcctggtaggctacagtctctgaggtcacaaagagtcggacacaactgagcgacttcactgtcactgaatgcaaaatacttcctcctgaccagtaaaattttgattcttttaatgtgatcttacaagttccatacagtcaaacatatggtttttccagtagtcatgtactgatgtgagagttggaccataaagaagactgagtgccaaagaatggatgcttttgaactggggtgttggtgaagactcttgagagtcccttggactgcaaggagatcaaaccagacaatgctaaaggaaatcaacccaaaatactcattgaaaggactgatgctgaagctccaatactatggctgcttgatgtgaaaagccaactcattggaaaagaccctgatgctgggaaagatcgaggacagggagagaagggggcaacagaggatgagatggttgcatggcatcactgactagatggacatgagttggagccagctaagggagatagtgaaggacagggaagcctggcgtgtgcagtccatggggtcacaaagagttgggcatgatttagtgactgaacaacagcaacagtgcctacctgacacattgtatatgttcaataaatatttattgagtgaatgaaaggaagtatat

SEQ ID NO: 45125 - DNA, 849 bp, Bovine  19866881019054
ctgaatgaacttattgagaacattattttttaaaacatgttaatgtcaactagattatagggatgaatctgatctgggttctaccttcagaatgtctacattcttataaagaatgttcataatttgtagtcattacaggggaattcatgatttatttttattaaaatattcactcaggtagaatttaaataacaatttaaattctggcctacagaatactacagtattctggatactacagcaccctaaaagtccaaacagacatacaactggacatttccttggagttttaaatattttagcatgttaaatgaagaaattagcaatttgctaatattggatgaacaaggcctctgagaccaaattagatattgtattgctttcagcagatgttctctatggcatcaagttggtttaaaattatgctatttaaaaacagatgtttgcatgagacggcagttcagtggcatgctaggaccagtagatagtaggtcataagagctaggtgctaaacttttaagaaatctgtaagttggttaaccatgcactcatagcctgaaatcaacagttgtgggagtatttatatcatggaaattgatgaatggtacaaatcaggaatcttcaaaatacttcacgaagagatggtcattaaacagaccccaaaacatctctgcagcaatgtttctagtcttgagtgtgtgatcaaataagacagaaccactctagtaccacactcaatatcaggttactttcttgagttgcatggccaagtcataatcctggccagccaaaaggataatggttttcagtccaggagaacaaagcattccaacaccatccagattatat

SEQ ID NO: 45126 - DNA, 780 bp, Bovine  19866881050486
tgttgacaaagtaatgtatctgcttttcaatatgctatctaggttggtcataacttcccttccaaggagtaagtgtcttttaattccatggctgcaatcaccatcttaattgattttggagcccagaaaaataaagtcagccactgtttccactgtttccccatctatttgccatgaagtgatgggactggatgccatgatcttagtttctgaatgttgagcttaaatacatgattaacaaaaactaagttttagaaagcactttattccagagtttgttatatgaaagtgatcatacttcatcactttttattgggaaaatatccaaaactatatattatatacagaataatacatttagaaaacaagctgaaggggattaaatggaaatataatctcaacaacaaaaaattcaaaataagaatggcacaaaatatcatagagcaattggggatttccttctctttccctaaaaaagaacatcacatacattatttcccttgttttgttttctaatgataatcacactctatttacgtgttagatactgactcagtatacattcattgccataactttcacaaaccaagactgtataatagtcactgatatcatccatggtctcagcatggttcatgtgattatttcctgggccaggtatctgaaacatggacctcagggagttggatcttttgatgtgacagttgtgcaattttgaggtaatcccctcagagaacacttatgggaaaattttctctgtggataaaatgagttgatggg

SEQ ID NO: 45127 - DNA, 1159 bp, Bovine  19866881060359
ttcaagtgtggcaagttagcagtctcataacatgacatgggaccagaagtgcaatgatttcctccgttccctaaaaaagaagcctaatgacagaaaaaacagctatgggttgtcatgctaagcaggttttctagaagaaggtcagacttcaaaaaggattgttctggggtttactggccattaatagatatataaatttttaactggaaggagcaagaagagggaaagccaaagtcatctcgttctaaccttcatctttttttagtaaaattaagatagtaaaactgaagttatttttaaaaaatataatatatatatatatatagttgtttcagtaactatttgaaaggtctcttttcatccaaaaagagaaatattttcacaaagtaaaacaaactggtatactataaccagaaaaaaatcagattgattattttagtagccagtagagtctgatgtagatgaaatatttacatgttttcccaccacacagttatacacatgaatcaaatcaaaatctcacacacgtgaacacctgaatactgaaggatcatacatatgcatacttcaatttttcatttaaaattttaagtctatagcttatttcccattgaacagaaaagctttctgccattattacattattactagctatacagacacaaatattctgtttattattcaaggacattgtattagaaccctgtgcatttagagcagaggaattaagaacatgctagaaaatcactgataatgcaatattcaaggaacgtggtgcattgaataggataaaaacttttagaagcaaggtaataaatgtcaaaacttgctgttaaacaaaggctgccctttatgggtctcataagattaacaaaaatagttactggtgtgtctgctagcatctctagaacaattactgcaatgtaactttctatctacagacttcattatattttgttggatatattttgttggatatatttttattcctataatagatgttaaggtaaatgatacacaataaaagataaaggaaaaaataatccctagcgatctggaaaactcatacccatcaaatatctctttctctttccctagtctaacttcagaaaattctgttgtagcatctaatatttagaatggacatgcaagctacaca

SEQ ID NO: 45128 - DNA, 915 bp, Bovine  19866881089965
ataaaagccctttcattttatctgcagtataaggtgatcatgtagtctcaagcaacccttgagaaatgttcttcttgaacaattgttcgttaagtctggctgtgagcagctgagcagagtgttttgaataataatgatcctgatgataagaaaaataactaccatttatcacacagtttctgtacatggctgacctcccatggagagttttacaatgaaggtttctggcattgcactatgtgctttgcacagattacaacatttaatccttataaagctcctaatgaggccatttaacaggcaaagaaactggagtgctaaaaggttaagtaacttagaaaagatcacaagtaagtgattgaatcaggtttaactgactccaaaccttcagctcctaaatggtacacgagaaaaccaaaatactggacttctatggacatgatgatttattgggagggtagagaaaacttctttgaatttatctccactggaaattctgagtacttgctaacatcagaatagcaaacattatttgaatatgtgactgaatatttaaattagtcaggaaataattatggatttcaagggggaagtatagtagaatgacactaaactaatggtttaattggtcatctttttttaagaatgaggctgcctttgtactgacatagatatatacagctgagaaaatacatacatctaacaaatgtgtgttcctgtcaggaatgtagtcatgtgtactgtttctttgacataatgggcattatttctaccacttaattgattactcagttgtactttgcaaatacttgagtgaaaataactgataccagatatagtaattcagaagtaagtgtaagaatatcttatatctaatatgtgggtagttactaaagtaactgctgccaacagtta

SEQ ID NO: 45129 - DNA, 1154 bp, Bovine  19866881127956
tatgttccctcacacatggaaacatactttacttaccccatgtaaagaaagtagaaaaatgtgttgacttaaaatttaagatatcatctatcactatgagtatattgttgttagcagtaaaaaattacatgccattagtttaataataaaattagttggcccttgaatttaaggattctctaacctaagacaaacacaaaattttcaaaaattactgtcaaaatggtcacaccctttccaggcataaaatgtttacttatttataaatgatctttaccataagctatgatggtacaaatggttttttccctacaaatcctaaaatctagacttgcaaaaatctgggaataaaaatcaatgggacgaggaagggcaatacagtaagaaaagtagaacaccaggttacagtgtatcaatcattcttagcaaaaccattacctttaatttctactttaccagacaaattaaaggaataaaagggatgggttgtcacatatgaggttgtatagaagatggagagtatctcccgtgttgtgagtagagttaactatgtggttcattatggttctcaggtagcttaccagaaaagttgccctagctgaatccacctactgagaaaagaagaaaataatacaaaaacaaaaccctctctgttgcctctttcatctcccagaagggaacagccatgtctgttcataaacgaatgccttccctgggcataaaccatagactagatcacgttataagttacactgatttgaatcccacaatttaatactttctgagagagaaggacctaacagaagtctgaggcaaggacatatctggagtctcagacagtggttaagaaaaaaacaaactttactgtttctgttttccttctctgagaagggaaaagcccccgaggagtacaatgggagtaattctgtctgtgatagtttacaatcatccagaagcctaaggttttacaataaaagatgactcccttgccttcactgatgaatggctataattttccactggacatcctgaatcagctaccctgccagaacaggggaaaaagcactctaactctgaactgaaggtataattctaaaacgtgagcctttactgtgcaacaataacacacatcttctaggaatctttatatgcaa

SEQ ID NO: 45130 - DNA, 1199 bp, Bovine  19866881561045
acaatttaaatatcattgtaataaaatcaaaagaccctcatttttgtgttttcgttctttagcacagaggaaagatgttttgctggtaaatcaaaacaagtaggaatgatcaaggctttcggtcatgcagaataaagataactaaaaatttaacccccagtttttgtctctttcttattccttaaaatgagaaagaagaagaagattaataaataattaataattgtcactggggataaagcttatttaaatcccacttcttcgaggatgggagaaattggacataacctaatgctcaggatctgggtaaagcctccattgctagaagagttaatctagagaaattaataattaattaagaagattaataataaacaagaagaagattaataacatcacagagtggtacttgtaacattttagggatgactgagaggatttttttttataaaccttttatccttatatttggaaaactacttcttatgagatattataaaaatgtttttctatatttaaaaaattacctgtcccctatttctgaatttttcttgttttgtctattccaaagtattttctagcttttatgaagattttactccgagactcttgcaatggtaatgaaagagagaaatgcccttgataatggttagatttatttttccaccatttctttcttgcattgtgaataccaaaagagtaaagcccagtgaatgtgtcaacatatttcctggaacacttgaaactgctattattatctatcgctgaattaaatattttctgtttgcaatataaaacattttaattacaatacaaattacatggtaccaccatgtagcagtaaacaaagaactaatttgtgttctttctgtacttatcatttgttgactaattagtttctctatgagacaccaagtgactcttataaatgcaaacctcctgaggatataaaggttaattttgaagtgattacaaatattccagtaacattgtaattaatagttacatctgtgatgcataagtcttctaaagcagcagtgagtaaccctctgtaaattagtacacatagttggcatcatttaggatacattattccttttgcattatctctttcattcagtcaagtttcagggagcagcagggtcgcatattaaaaccatcatcattctaaaactatgacccccgtgtgcttgcatctg

SEQ ID NO: 45131 - DNA, 867 bp, Bovine  19866881743346
taagatgttaaactcggagttttttttaataatagtttttgcataagtatgtgctgctggtaatggtagcatgtgattttgatatttctataggaaaaagaaacaagatatgaaaggagtaatatgaaaatataaattacttacaagaaaagatgtttattaagcagtcatgctgaggatctaaaacaaggatatttgatgaattgtcaccatctctttttatatctttaatcaatactctattaactagtgttaccttttatatattaaatttaagtcaatcaactttattttgcatttcattttcaccttcactagccagaaaataacactatttgctttttgtagatgaagttttttatgcatagtctacactaaaatcctcattaatcacactactgtgtttcactgttataaaaactcatcaaaataataaatggaataattggagccttttcaattttccctttcaattcagcagaatgggccaaagagcccagagcactgtgttctgcatttttcatttgcatcaagtaatagcctctacagaagaacttcacagtctgtctttctattaacattccctacaatttcaattctttatcaggcagtatgtgaatgaataggcagagagtgacacatgttctcatcactcagctaggtaaccagggcacgtttctgtctcacagcttgtatatgttttaagaaaagaaaataatggggaatcagtgatttaaatttctgatatttttgaatattgctgcctatctacgacaatttaaattcacttttccacatgatgtcacaatcttattctctattcctctccaaatcaaagcccactatatagtcagaggtgtggagtat

SEQ ID NO: 45132 - DNA, 1045 bp, Bovine  19866880155756
ccactccagtactcttgcctggaaaatccccatggacggaggagcctggtgggctgcagtccatagggtcgctaagagtcggacacgactgagcgacttcactttcacttttcactttcatgcattggagaagggaaatggcaacccactccagtgttcttgcctggagaatcccagggacggtggagcctggtgggctgccatctatggggtcgcacagagtcagacacgactgaagtgacttagcagtagcagcagcagcagcagagcagtatttgggcttccctggtggctcagggaaggaaatggcaacccactccagtattcttgcctgggaaatcccatggacagaggagcctggcaggctctagtcaatggggttgcaaagagttggatgtgactgagccaataacactggtggctcaggtggtaaagaatcctcctgtaatgcgagatacctgggttcgatccctgggttaggaagatcccatggaggaggtcatggcaacccactccagtattcctgcctggagaatcccatggacagaggaacctggtcggctatagttccatggggttgcaaaaagtatggcaagactgagcgactaagcacagcacagagcagtatttaccacccatcatgtatttactgaatgaaaggattcacaaatggcccagcaatccaagatgtgaggtaatgtaaaccataggtcctccttcccttgagtcctttagagtctataaatataatgtattgaaaaacagttaatgaaagacaacagggttattaaagcatgattaccatcatttaagatatagtacctattctatttttttccccatggtagacagcttggtaaaaagcctaatcacctaagattaatggaaattattttcatagctcatgtcataatagagatcattagcctggtgcagtctccttttgtacagctccaagtaggaaaagattaataaaataatttgaaatgtagagctatttgatgtgcctatagggctataatttagttagggaagtaacagcaga

SEQ ID NO: 45133 - DNA, 1895 bp, Bovine  19866880459018
actggctgtcccaagcacaagcactgttgtctgcatggctcagaaaggatctcttgtacaggaattctaaccgagttattccatgttgcctcacagaagcataaatccattcttttaaccttctaaagttcaaaattgcatggaaaacacaactgggaagttctaacaattcagtgggggcttccctggtggctcagtcaataaggaatctgcctgcaatgcaggagacctgggtttgatccctgggtagagaaaatcccctggagaaggaaatggcaacccactccagtattcttgcctggagaatcccctgtacagaggagcctggtgggctacagttcatagggtcatgagaattggacacaacttagtgactaaaccactaccagccaacaattcattgagtctaaactgcttcccttcagagtcatgggaagagccaagaagaaagaggtaggaactgatgtaaccaaattgggagtttctgatgatacccatacaggcattaagtccaggaaagcagacagaacagagtgataccaaagtaaagtggtgtgttctcctgacacaggggaagagacagcaagccaaaggggtcagacaaatacaaagggattcaagttaatttcttaaaagaactgactctatttgagacttgcttgcatgtgccaaattttcaacagccacaggctgagtggataatgatgctgactgccttgctgtgctttccagagatgggcagcattctctggccagctccatggcagatcggaaatgaggaaccccgggatgttagctgtgaatgatcccagtgctgaccggcagatcacagatttatttaagatcagcaggaaatgaagtgggtatcatggccccctaaggctttctgatcagcttagaaggcaggacgacaatgcgatacagtagacagcccttcgaaatcagtgaagtgctatttgcatctctttggggaataagagctggtgccgatggggaaggacaggaggttctgtctttcattgtcaagctgggaagcgcctaggagcttaatcccagcctcccttgctccaatgctactattggaatgagatcttctgcaaaaggctgctttggcaaaagatgctactaatgtttctcgttgagtttaaagaaagagagtcaaaaaattgctttatctcctatagcctcttcgtcagtgaataggattcatgaccctggagtgagtgagatttgagtttcttcaggtcaaatactatccatgagagcaggcacctgggttgccccaagctatcgagaaattcttatggacagaagcgatgaactgcagttcccagctgcatactgaatgtttcctattaactcactatcctttgcagtaaatcaacttactctccattacaatagatggcaatagtgtattacttgtcagcaacaagctgccataataaggctctttcagacagcctctcagatacagattgtgatgtctggagaaatagaattgcttttttaaaaaaagtatgagccatgactgtgtaatgaggtcagatccagtatttcaacaggagggtccctgaattttcttacatcacaacaagaaattgactgcaaagagcatgatgaacattcattattttaattgaaaactatttatgaaattgaggtcctatgaattcagcaacagaaatatcttgtccaaaatgttcaaagcctacagaaactacaaattatccagtggattctggaaacagccagaaggcttggatccattgattgcctctgcagcttaccagctgtgtgaccacaggtagggtgaaaggggaaagtcgctcagtcgtgtccaactctttgcgaccccatggactatacagtgcttgggaattctccaggccaga

SEQ ID NO: 45134 - DNA, 1866 bp, Bovine  19866880589916
aaaaactttaaaaataataacaagaaacccaattctttggcagtaaaattaatgtgttagctctttaagaaaataataaactgggtgaagaaagacaagatgtgttaattcataaaagatgtggcctctgatgacagtgtcacatgcaacccctgagtcacctgaccttggcacagagcatcagaaatgtgccagtttctcagcccagcaccttgtggtagctcggggagagcctggtatctttccatgttgggaggaaaggctatgattcttaactgtcaagtggaagattccaccaaacctttgtggagtctgtgtttgtgacaggtttttactgcccaggttgtatctgtgtgttccttccacaagctgccatggaggaccattcattcattcattcactccttcttcttgatctatgctggtaggtatatgcctgctggtgaatagagaaaataggggaagagacttccagagataaagtaaatgtatatttcaggtcacatgactgccatgtcaccttcactacaccacacacctgtctcctgccaactgaaaaaaaaaaagcagaatctagaagtcgagaatgatgttttattcagtggacttgctgaggacttaagcccaggcagcagcctgtcaagtagctcggagggactgctctgaagaggtgagtgaggagccagtatatatgggaatttttgtaacaaaaaccaggtagctggaacgttgaaagattactgttaattaaagaaaaaactcagatgtctcaagtcaatgaacttagcgcttttctatatatggggagatgcagagtctgggctcattgaaatcaatcctttgatgttagtgttaactatttcgggccagtgtccttctcttttgcatcctgaatcccctcagggtgcactgtcagtgactgatgtcatgacggctggcgatgtcctttgtttactgagctggtagatggcattctttcttcacaccccaaatagaagacagctgaacccatgaagagatgactgccctgcaggttctggtcaagaacagaatcaagagtccaaaaatatgacaagcagagcaaactcatattctaacctctccattccctcattaatattacaagattcagagctgctttattttcctggaacccaaagtcaattgttggggaaatataaggttagatgcacagtttccgggatccagtgatgaacagagccagtggctttctttctacactaaagttgcctgttttcctgcagaacaagggctaaggaatagatggctgcaatctgtcagagttggagactagaaatgtcaatagtgcctgtttgtggtaccaggaccaagagaagaaaaaggagtctagcctctgggacaaattatgatgaacagaatggtagtgtatgcatttgggggtggattatgctatcaaagaagtttctcaaagagcctttgatcttaagaagccacttgtaccaatgccagtcactaagaaaaatatggcttctctgagaagtaaaataaaagaaataagcaaaataaggtttcttttcattttttaaaattttcctctctcactttcttttttccttcagttcccttgacctcccttctggaataaaacatcataaatgactacctgtcactaatagagggatgacaacttctttggacccttcaaagcactatttaagtaactgttgcatgattccaatcaatggtgtacaaagagaaaatgctagcttaacacacaggatcatttccaattttcaaatacagctttgacttttctgacccaaatcctactatatacctgcttccttttatccatctttagggaaaaaaactagaatttataat

SEQ ID NO: 45135 - DNA, 1369 bp, Bovine  19866880641281
cttctaaaaacaaatagaaaattatgaacttttacagttcccaaaaagtgctggtatgttgttgttgttcattcactaagtcatgtctgactctttgcaaccccatgaatcacagcacctgaggcttccctgtccttaaccatctcccagagcttgctcacactcatgtccgttgagtcagtgatgccatccaagcatctcatcctctgccaccctcttctcttgtcctcaatctttcccagcatctgtattattaataggtaaagagttgtctttcatggaatgacatctcatttgcctaggattcactgcattgatacacattttgtcttggtgattcccagagcccctggtatcacctagggagatagaattggtgggataatctcaggatgatttattaccaggaagttgttgtagtgtctgcaggaatgaaaagccattgactggggcaacagggttggaaatcatgagtgggttacccacaagctgtgagtgtgaggtctgagtaagtcattcaggggtcctgtcctctaaataactctcccttccctactcctgcctcttaagtttcccttctgtctgttatcagaccacactatcgagttaatttactttcctctgccagacacctctgtgatgattaattctaatctccggtgaggacgaaactggagagcttgggtgtattcttagtttctgtacttaagactgaacttgccatacttctgagggatacgtggagtggttattatccaggggaaactaaagagtattcattaggcatagtgcactttcaaagaaggatttttttttttttttatcaaaatacattttaatcttgttgctaggataaagtggcaaaagacatttagccctaattaagcatctgccagtaaaatgaaatatggatctacctctcaattagctccatttaatttgctactttcagtatagcatgttggcctgaagacgtgtaagctcccttaagaaatggaagcacagttccatctaaaggcttctttgcatctcaaagttttaaaacttcaaatacggatcagattcatgtgtctttactagagccttgccctagaccccgagctaaatactgggccttcaggttgtaggtagaatggcgcccaccctagaagcttttggtggtgctatagagaggttaaaagcttatcttgtgtgatctttggccacctgtgcttctcctgttgtagaatttgtcacactccaacatttgggcaggttgaagtgtctcctgctctatccacagctccttgagaacgagaatcttcatcatttgctttgtcacagtatcttcagcgcctggcaaagtagcaagcatatctgaggcctcagt

SEQ ID NO: 45136 - DNA, 1371 bp, Bovine  19866880649592
ttaactgaagaaaaataaaggaagaagacttccccatatttccaaatgaaatgaggcagaacaaatgaaaggggattgcttggcttgtgtagagaactacaagtgtacattactaagaggtatagccatgtctgtgcaaacacagtaactcatgtcaaataaattgtgccttttgcaggaaagaactcttgctctgggttttccaagctaaattgcatgaaaacacacaatcctttttcttcttatttgaactgttagatgacggggccaaattaccagaaaagaccaaaggcagtttgcagcctttaacaactgaaaggacttattgcttccaatttggaaatacaaaagattctatgtggactcccagcactcccaggtcctatgcatttcccattagttcagtgaagaaagaaaacctgtaagtaaaaaggatatcaaagttctctgggattaaaaaatggagaccatgttggccaaagatattgaagcagatacttttcaacttcttaacagcatggataattctctgctgctgctgctgctgcgtcgcgtcagtctacccctggtcaaatgtggtcccactgttcttggtctcctggtgtcattcactccccctggactggcaggaactatttttcagaccccatcaaaagccattaaggctgtaaggtagccaactcctgttctccagctccacagtgaagaaacccaagggaggggtaatgcatctatttttcaatacctgaggccattttgtttccaaacttaattgcacttatgcattagtttggggtctaatatctccactcatcttgctccagtgtccacttttccactgaatacagagctttggaaacataattgcagtgttcggtagacagcgattttcattaagcacacagaagaaaaaaacagttttagggagagacatttcttttctattgattcaatcaaaataacttggaagaaaaggttgtgcttattaaattcttttcaaaaggtagttgttaaaatttaagttctttctcaaacacttgttttttaaaatcagtgtataatctcttcagattttgtcatttatgattttttttgttcttccaagttcctttgaaatttgtgacttttattggtcttttttaattttatttgttttttaaaggaagcaaaggcagagcccttttacatggaggcagagaatgtaatcaacgccgctgtcttcaagacatgggagttgcctagcaatgagaaaggaattaaaagcaggaagcaatgacaaaactgaatgttgtgaaattacaagagggtagagtggtaaatgggcctgcaatatttatcaagaggtttttaaatgagaatggatataggatt

SEQ ID NO: 45137 - DNA, 1467 bp, Bovine  19866880672886
tgctgtatgtcattcaggagtggtggtgactggcagagtagtcagctgggcaggatttgtctcttgcagccttgggtttccagaggattattctcctaattgtatatttttttccataagctctttaatcagcccttaatcctccttccttccattgccagagctaattaaatcctttatggaagtgggcagtctccatgatgtcggcaggatgggatcctggggaagcaggcctgggctcttgtggtggggatgcccagagaacccagtgcaagactggtgaagactggttcattgatcctggggaggttgccaagctacaataatcttttgaagaaggtgggatttctccatcaggaaagagggctttttctggaagagtattcaatactgggaattacataggaagctgggaagggcttcctatgagaccaatgctaaatgcgatttcacccctcctaccatcttgttgggacttctccgttgcccttggacggggtatcttttggtggtgggatccaacattctcctgtctgtggttgttcagtggttagttgcagtttttcacaggagaaggtgagcacattccttctactccaccatcagaacaattcaaactaccacacaattgcactcatctcacacactagcagagtaatgctcaaaaccctccaagctaggcttcaacagtacatgaaccaaaaacttcaagatgttcaagctagatttagaaaaggcagaggaatcagaggtcaaattgccaacatcagttgggtcatagaaaaaataagagaattccagaaaaacacctacttctgcttcactaactacactaaagcctttggctctgtggatcacaacaaactgtgggaaattcttcaagaaatgggaatactagaccacctgacctgcctcctgagaaatctgtgttcaggtcaagaagcaacagatagacatggaacaactgactggttccaaattgggaaaggagtacctcagggctgtatatcatcaccttgcttacttaaattataggcagagtacatcatatgaaatgctggactggatgaagcacaagctagatcaagattgccaggagaaatattgataacctcagatacgcaaatggcagcacccttatggcagaaagtgaagaggaactaaagagcctcttgatgaaagtgaaagaggagagtgaaaaagccggcttaaaaaaatcaacattcagaaaactatgatcatggcatctggtctcatcacttcatggcaaatagatggggaaacaatggaaacagtgacagactttatttttgtgggctccaaaatcactacagatggtgactgcagccttgaaattcaaagacgcttgctccttgaaagaaaagctatgaccaacctagacagcatattaaaaaaaaaagagacattacttactgacaaatgtccatctagtcaaagctatgtttt

SEQ ID NO: 45138 - DNA, 935 bp, Bovine  19866880702664
ttgatgcattggagaaggaaatggcaacccactccagtgttcttgcctggagaatcccagggacgaggcagcctgctgggctgccatctatggggtcacacagagtcggacacgactgaagtgatttagcttagcttagcttaaaacaatgaaaatgtaaaatgaaaatttgcatttagtaaaaaattaaaatgtaagacaagtttgttctattttcatgttcttacatataaaaaattaaaatgtaaaacaagctttttctattttcatgtgtttttgctgagtataatatcatagtataatgcaccaattgttaagcatatagttcaatgaaattttctaaaccaaacacacccacagatcaagcaataaaatattcccagtacttcacaacttcagttcttgtgtccctttatactatcctgacttgaagctccaaaacgcgtttttaatccactggtatacacacacacaaaactctaaatgcatatgattttttatttgttccctttgtcaacattatgttagtgatgttatagctattcctatatttgtgtgcagccatttgtgttcttttccactgctatgtagtactcctttccatcattataccatatgatatatttatctattctacttttggaaaatatttgggctgtttctaaatggtactcatatgtacattcttgtacatatctttcggtgagtacacacacacacaacgtctgtcccagtatatacctgggaaaggaactgctcagtcaaaagatccaaaattatacaaatttaaaaataacagacatgaaagcatatttaggaatgaagaagaattactaggcatttataagattcaaaatggtctccccagagaacagattttctcaagtgtgtagctcaaaccagttggcaaatatctacagcagcttatttgagca

SEQ ID NO: 45139 - DNA, 653 bp, Bovine  19866880714228
cccaacaggattagacctgctaagagtaactagtgtttcctatctgataaatacggggattatagcaataactgctgtcagcatttttctcatttaaacaaataacggtgacacatgatgaagctctgtgcggctctgttgtgtttagtacacgccgagcaattactcatccgctgccagcattcgtctctctacaactaaaccatccacagcgtagaaagcttattagcatttcagttccatagtcatatttttatcttctgtaagactctcctccataacaaaggctgatggttataatttgcacaataatttaaagggttggacttttccgtgcctattagagttgcacaagttatcaggtaccaggctcgtcttatttatgacatgccagcttccatttgcctgggatttttgttcccctgtagcacttcctctgaacaagttagctgtcatctcttgagatggagaagtagatgatgatctctacaacagtattcatttgaggggggctgggggggtgggtaaaaggtgtccggaaatagagctgctttcaacgaatgtttctcagatgtgatttctcatgtatatatgtaaatgcacacatttatacatttatgtgtatacgtttattaatgcatgtacacactgtg

SEQ ID NO: 45140 - DNA, 1303 bp, Bovine  19866880715333
accaaaaaccaaaccttgaatcctacatactctctccagcaacagctggataacctccaattctaccaaaagctgctttgtcaacgcaaaaggaataaatcaaggaagatgcatccacttttagtggagccaggtgattgccagaatccacttgcccatcatcttccatcattgagaaatttagtgaataggagtcaataaatgggcttaaataaaaccttggcttttacttgctgtgcttttaattttgtaaataaatgccttccactggcgcgcaccctagagaccaggcaatgatgtggactgagcagtctgttagcaccacgcagctgaatgcatctcagaggtctagctcacgccaatggtcctggaccattcagctgaaatctccctgctgcttaattccaaacactagaaatgggtatgtgggggcaacaaaactctgaagttaaaaatacaactttttaatagttttaaggctgctcactatacaaataagagaaagatgtcttcaacttaagaacataagcatatggatgattatagaagaccatcatagggtagtttacttattatatcaacctgaaaacaagtctcctagtgtaatattagaaaggaatattgagcaaaagaaaggtcacactgtcctacttggtttcatagatcatgtaagacatggaaaatataggatatcatctacattgtgaattctacgatcactcacagggagaaaaggaaaccttcacataggttttcatttgctcctttattttctatacttcatccatcttttataaatctgtgttggtcagattatagttaaagtatcacactaaacgtacagtccttgaaacccattcagaggagaataaagaaatttagaacgttttctgacgaacacttggaagaactctgaattagcccaaaaaggcaggtggactatttgatggacggtgaaagagccgtagccagtcctgttcagatgacctacacagcttcaaagggtggaagttacagaaataaacatttcatttaaattaaaggggaaaatgagctgtttagacatgaaatggactgccttaggagacggtgaaatgcccattcttggggtagctaagaaataaacgaaaggattaagcgccaggagaaacaaaaagatgtgcaaagatcatattagaggttcaccaaatggttctgaggtttcttccaaccctgagagggttagaaaacaggtcacagaagtgggccagaaagcaaaccttcacagactcacagcctggcgaacctctcacaagggcaagcg

SEQ ID NO: 45141 - DNA, 1145 bp, Bovine  19866880716582
aaaaaacataccaaaataaaataaatgaaataaaaatcaccctgtccttgctatcaacagagtcttactttagtgtcagctgtaggctcttctttcaataaaaggctcaaaaactgccccccttcaggttggcaaaggagaaatcctagttctgaacaaagatctgagacgaggaaactagtcctttcatagtggtacccttttccagtggtagttttgttacagggacatttttttcgatatttccattttagaaatgtgccttagaggttcttgcagtttgtttccaaaattgattcttggtctaaacacaacataaagttctttggcctcggggaataaatatttaatttttctatgaaatttgaacatgcctgtttgacctttgttgtcatttattgttgtttttatgagaaactttaaaatttaagacatgcttatgaaacagttacaaagagacctctacaggatctcaagttcagaggccaagagggagattatcaggaaagagaaattggtgtcagcaacaaaaacagattattcagaaacgttaaaggtcatcacttagatttaccttgtgatatcccttctggtttcaattcttttttttttttttagtaacaaaacttttattttcatataaatacagcctattgaaggcttgaactttattttaattggagtgtaggtgctgtacaatgttagtttctgctgtccaaggaagtgagtcagctgtatgtgtacgtatgtcccctccctcttggaccgcccccctcaacccatccacctgtgtacatcaccacagagctctgagctgagctcccggcactgcaggttcccactagctgtctgtttcacacatgacagtgtccgtacgtccaccccaggctcccagatcatccccctcccaccttgttcacatggcccttctctacctctgtctgcatctctaccccagccctgcaaaaaaaataataataataaaggttcttctgtaccattttccctaggttccacattcacgtgttaacatgcagcattttttttcctctttctgacctatttcactctgtatgacagactctaggtccatccacgtctctacaaatgacccagtatcattcctttttaggcttcagttctcg

SEQ ID NO: 45142 - DNA, 1617 bp, Bovine  19866880759201
ttcaaaagggcaggttctgcatctttacgttttctagatcctacgtttccaatcacagattctttttctaaggggtcacggaagagtcggacatgactcagcaactaaacaagaagtgaagccgctcagtcgtgtgtgactcttcgcgagcccacggactgtcgcctgccagtctcctccatccatgggatttttccaggcactaatactggagtgggtaaccatttcctcctccaggggatcttcccaatccagggatcgaacccgggtctcccacattgcaggcaaactccttgatgtctgagccaccagggaagtaaacaacaagaagggtacctggtaaatacggccacctgctccctacacatgggcctcctatccgtcctatctcaccaggaggagggcatcctacatgtgtgaaaaaagattcttaccacgtcctattcatggaggaagatttagagaattggaaatttagaatacaacatcattattgggtctgcattggagggctgtttccttgaaattaagtttttaatgaaccaaaggatatagggaaaccaatcatcaacttggaacaaacgcaggcacaagtcactaatctacctagaaggtcaggcagtagaacagtagcgtctgactagtccaactacagaattcactgtacaagataaaatgcttgatatttgaggtgggtttgttctaccctacagagaaatctgctaaggccctgctggtcccagctcaatgctatccagatctttaacaacaatggcagatctggcattttccctctcttctcagccaacagcgatgatttagagcactccctaaatctcgttgctcagatagtggggcgggggggtgggtggtgttggggattgttctcttcctccatcccacatcttagatggcagctctgaagactaatgcataggtagagtcaaagttatctgggctgtacacgtcaaaacaacatgaaaatcttccaaccaaaaggaagaaaacactcttaggcagtcttgaactacatagccaaggatccgagcttgaattcagaacagcaaccccaaaaggaaccctcatcactgctcatcataaagcaacatgatagcaggggtgatggacgctgattattcatcaggtcagttactgaggaagttcgggtgtcatttcactcatctatcaacttgtctgtaaaccacgcttcactataaacacagtatttggcagtcatatcaaagaatgttttcagtgcttcctgaccgtgttctaggaaatataattcaaggggcttaaactctagggaccacccaaaacttccgagccagcatggctgtcagccctaacagggcatctgatggagtgtatggtccatgctgagatgcagacggcaaagtgtaatgtcagcgctgcttctggcttgccgtgtaaatcaagccaacttccggagctatggtggtgttcactctgacaccggaagagtcaagatcttaaaaatggaccttacgggacatcatcatgtaaatataatacattcaaacaaacgctagaagatacacaaacgcacacttaccacccacctgtatttggcattactaagcgtcctcccaaatg

SEQ ID NO: 45143 - DNA, 1441 bp, Bovine  19866880852957
actatacctagccatggccacactgaacaatgcaactgaaaacagctttcatctttatctaagtcaaagaggaagacacgaaagcttgcaaaaagctatccttagagttgtaactcattttaagcatattcaggcaaaaggaaatcccatggcgggagaaacctgtctatctatctcaaagcctagagaagcacctagaaaattagaggcacccaatacatgtatttaaatgagagaatctgaaacccagctctcgcactctctttaggatcagtggctctcctatacgtacaattcagaattcatgaatctcttaaaataccagcggtgtctctactatatataaaatagttaatcagtaagaagctactgtagagcacagggaactctgctcagtactctgtaataaccaatatgggaaaagaatctgaaaaagaatatgtatgtgtataaatgaatcactttgctgtatacctgaaactaacaccacactgtaaatcgactatactacaatataaaatttaaacgagatcactggtatttattacgacatttgtgtattttacaaacaaagctcacccaaacagatgtgtactactgatgagaaatggcaggaggccatcctcagtgacacagtagtatctccataatgcacctcaggggcacatttcgatgttaaaagttaaagaaagaaatagtgattttttttttattgcagtcacaagtacagtaccataagttggcaactgcaagaaatgactgcctataaatttactgtatgttatgagccactgttttaaatggccatgaagcaggtgtctgctggagactggtacaaagctaagaggttcataaaaatataaatgaacagtgcagctctgtcttagatcttgtaatttaagatctgacaggacacaaggttttacttttaatttgaagaatatactaaatcacaccaaccactcccctaaggacaattattacacagtctatcaatggatcataataactaattaagtacaacaatctattatattattgttgttgttgctattaaggttgttcataagaaaaaggcaaaaaggaactcaatatagccagaaccaaaatcagcaaattcataaagttttgtgtgcgtcctcaatcccttcagtcatgtccgactttgcgacctcattgactgtagccctccaggctcctctgtccatgggattctccaggcaagaatactggagtgggttgctgtgccctcccctccaagggatcttccagacctaagaatcaaacccaagtctcaggctggttctttaccactagcaccacctgggaaaccagttttatattaatacatggcccctaatacctcgacacttcccatttagacgtgggtctatgctcctgttttttaatttaggtgggcttctgatggcttccatccaca

SEQ ID NO: 45144 - DNA, 1539 bp, Bovine  19866880860421
ttggtcccccttgaagacctttcctggacttggactggctcattgctttggagtaatcaggcatgaacattttattttctcccagctaaccagaatatcaactcctgctaagaaatcaagaaagaaaaaactggctccatattgggctgacctttgtcaaattctcaagaggttggaaacctacctctttctgctactaacctgcttccttctatgaagaaatagtgcagccttaaacctatgaggacattgaaagtagttttttatttcttacaaaccactgatccagagagactgtctacccttagtcactaagaagctgacttattcaaggcttatgtgatgtatgatgtgtgtgtgtgctcagtagctcagtcatgtgcgactctgcaactctatggacaatagccctccaggctcctctgtccatgggattctccaggcaagaatcctgcagtgggttcccatttcctcctccagaggatcttcctgacccagggattgaacccaggtctcctgcattggcaggtggattctttgaaccactgaaccacttgggaagccagacttgtgtgacagaaggggctttttatacccagagagcagggagggaccagttatggttctcttagtcagaaattcctcccaaagtttgcagaggccttttgataggagggggtgcatccattgtccagacaagagataaaagaaggatgccactgagtcaggattctactaagatattataaagaagattgtggctggaaaagtagaactaagcaaaagcaaaatgacttcaagtggagctatcagctctttctctgtatcagcagcacacacagagagctggggcatgcttgtcaccatcagtggatgctctccatgttcatcgctcaggtaaggaaatctcccattagctacaaagtgtgtttcctcccattttctgcagcacagagtaatatcagattttgtgtcagtagtgctaatggtgacagatgtccataactgggtcctgtttgtgggtgaagaagggttattactgtcattattccttcctcgtcaagtgcttgctacaaactaggggccatatgggatggcgagctcctccccatcctgccagggcccagcaagattgtgcgaggacgatgctgaatggagatgctccctggggtggctcaagccagcgaactgctttgatgcactttgggctgacaacgtgatttgcagccattctctgtgatgcctccgagccacttcaaatctttgtcagatgccaacccagtggggacaagctgactttggtctctttatttgttcctttgggaagctcaacgttcaacccccatggaatatttcctgagagttcaaatctgcgctggcatgaggggaagggcaagagataaggagcaggcatgctctggttccttgaattaaatggagcttctgactgtacagacttagaaacactgggcataagacaacactaactgacgttgatctgatacctgtgttacagggatttgtgggggcacattaagg

SEQ ID NO: 45145 - DNA, 1541 bp, Bovine  19866880968161
attagtttgtgatgaatagtgtgaagaaaactagccagagagatgcaaagcctgtaaagactgctgggaggacctattttgaataggatggtcaagactgcctctctgaatagatgatctttcaactgagatctgaaagagaaggagactgttgtacccagtggagggaagaaaatttgaagcagaggaaatggcactggtcctaagactggatagagagagaggtaaagcgttttcaaagcaacaaaaaactagaatgctacatacagaagaagagtgactcaagaagaggccgtattagtaccttaaagtcccttggactgcaccatccaaccagtccatcctaaaggaaatcagtcctgaatattcattggaaggactgatgaagctgaagctccaatactttggccacctgatgtgaagagctgactcattggaaaagaccctgatgctgagaaagactgagggcaggagaaggggatgacagaggatgagatgattggatggcatcactgcttcaacggacatgagtttgagcaaactcttggagatgctgaaggacatggaagcctggcatgctgcagtctgtggggtcacaaagactcagatacaacttagcaactgaaaaacaacaaggagctaaatcatgcaggcagttgagaggcagggtattcctttcactgtaaagtcaagagaagtcatcacagaagaatgacccaaccccactggtcttttaagcagaccacttttctattgggtgacgaatgaccatcagtggtgtgcaggtgagaagagcaaaccaagaagctgcttcaatgacgggaaggaatagatggcgcccagcctaggaaatcagtgacaaggatgaaaaaggcaacagaaacatattttagtgcataactgataaagcttactgatagactggggtagagtgaagaaaagagaaaatgtgggtaactggagactctggctttaagagctggtcaggctgccccagtggaagcccaggcagtgagttgtagcagcatcaagttttagctcaatgggaaggtttgacaagagctgagcagttccatggggttgcagggtttttcctttatttttttccccttcctttcctcttaacaggcttttgacaaggagcttgacactgatgtcttggtgattgaatataaatatgcttaattcattacaggcagagataaaggaacccagcttccccttaagggtcattatctagataagattatattgtaaattgaagccaggtctctggaggcagcgatcgattggctggttcacaagcccctccccgcctcccagcattaggatgcagcacaagttccctgcctagaatccaactccagctgccctgtgttaaccagactctgagcctctggtgtcagaaaaccagagtaagtgactgcctaaagacaaaattaattataatgtttttatctgttcctgagactcatcctaggctaatgtattgatttaaccaccgctcctctgaatggtgcttatgaatcaatatctcctag

SEQ ID NO: 45146 - DNA, 590 bp, Bovine  19866880987030
atggtgttgtctgctgcaggatatgataggggagggctgtctttcccattgctctccagattgatgcgcatttcaagctgtctgctaaacttgcgataatagccaatgggtttcagttttcatttttgtatttgggatgggtgggtggcgttttatttttatgtactctttgctccaaggtgaaaaaaaaaatgacaaatatttttaaaaccattcttcctttaaagcaaaccccccaaacacttacatcccacccacacacctaacactgacaaaacctgtgaacctcctgattgcctttttttgtttttgaagggagataacttgggaagtttcctgatgcaagcttctggcaatcactgaggctgcaggtctgtaggctgagggagatacaagggttgactattcggatgaaggacagttacaattttcccagctcctttcaaaaggcttacaacatacatatttctccagcaacaatttcattttgtggtctgtatttttttcctatttctttttcaaaaatagaggagataattcttaaagacacattgatgaaaattattattgcaagtccaaatacacgggtt

SEQ ID NO: 45147 - DNA, 1420 bp, Bovine  19866880987313
cttcccactttaaggattttttttttttaaagctaggtatcaagaccattaataattgataaagcatttgtaaaccctttgcaaatgaacagtcaagggacacattaataaaacatctttaaaaatctccatcgctgtgctgattctcatcacacttccccaaagcagagtaaatgggcagctcatcctccagctcaaagcaaaggccagcgcctctgacaaggtgacacaggagggtggagggcactgccttttaggaaaccatggccatcttttacttttatccacacccctccagctaactctgagcttatgaaccattcccccaataaattaattcttgggccaaatttttctgctgggtcacttctagtgatataaattcataaataaaccttttgacatttctatttgcaaagaaaacatttaagatgctggaggaatggagggttaggcatttaggaagggtcaatgaaaatcttcaccttgaggtcactgcacatttagctcaggctaagagagcggtcagggttgccgaatgccacagcttcaaggcagttaagtggcttggctcatcttattctcgctggataatgcaaaaggaataaaaacgtattttattgacatggcatctttcttcttaggattgaatagtgaaggcacaagaaagaactattagcttttagcatatcagcctgtcactgcccttggacagagaagagattgtcaaaaatgctatgtaaataagaccagtggaccagggtcaagatttccaagcaggaggtcatgggtaataatcctttagagagaactatccacctgcgtgtgatttgagatgacctagtaagacttccttcatcaggtaaaggcccttccctcatgtcaaagtacagaggtcattttagaggtggtgattttctcattagaagcaccctaaaacatttattgaacactgctgtatgcatgacttcacaggtgttgagagtacaatgttaagactccaactatgcttttccaaatatttcatttgaatttttggaggcaaaattcatagataaacagagaagtgatttctcaaggggacaaaaaagcccaaggaaaccaggtaaatagaatcctactggagtactgaggtgggtatttcaaggatctgcaactgatgtaatcaggggcattataggataatgaaacataggttctcttgattcctgtaatttctggactaattaatttagtactgcatctgcctagattctcagtagttgattcagctctgttcagacaaaaagagagaggagagccccttacttggggaatattaattaagacatagagtctgttttttctgctccaataaatttcagagtcttcggtccatctttaaaattgcactttttttcccccaaaacctgtatcaaaa

SEQ ID NO: 45148 - DNA, 1648 bp, Bovine  19866881009345
tgacatgctctgttgttctctgtgtatcatgtacactggtaattatcattaccaagtttgattttttttccagatgaattcatacccaggtggtggtgtatccctctggtagaaggtgcagagtttcctgttttcccgctcattatgatagtattagcaaccaaaaatcactaattgcattaattcattagaggttagagataggtaatctatcattctttctttgatcattagtgtgaatacttctttaaagagagatttgtcttcatcaactgtttggttgccctaaggtatagctcttaaaggttaaatgcttgactttttttttttcatctctgagctttcaaaataatgagttggtcttaatatttttcaaaactgatggctgacttttttgtatcattctgaactcatggatttaaatagtttaatatttttcaagccactgcaattattttcttgatcaatgctcaaactggctcatctgtgaacaggcagtactacctaagttggctcccaagttctttcgacccaatgtgatcctctctgatggcttccttgttcactggtgtggaaatgctcatcttgtttcctttatatttccatccacttttcaaggcaccctgtctttgattatttggaaaagtatctaagacattttccttccgttaatagctatttctttgaggagtcctgttttgtttttgtttttttccacttggttttagcatgtaaaagccacaattaggcactagggattttagccactatttagtcattcattgtttttaggcagaactagaaaacacacattaaaaaaatataagacaggggacctccctgacggctcaggacaactcccggcgtcccctgcagggggcgcaggttccattccttggttggggaactaagatgaagcatgctatgtggcatggccaaaaataactaattaattaaaaaaaataaaataaataagatgaatttttaatttatacttattttccaattaaaaatcaagactatagagattttacttaataccactgatcttacatcaatatttcatttgtcccatgcctcagaatcttagttctctataatgccaatgtaattactcattgctcatctcacattatacacacaaagttctcctaagaataatatcacattaccaccaatgatatggttagcgaaaacagccacattttttattttgcacttcgtttcctttgggatctattccactgtggatgtacggccaaattatcatgttttaaagtcccttgaaatatttcctctctgactggctatgccaaaaattgaatcacagttattttttatttcattttagtttttatttctaagttctttcaaaaatttttgttttagaattacataatacatgtccatgatttcaaagtctaatttctaaagcaaagtatagtcaaaaaagtttagcttgaatttctgttccctttatcgtattcccacctacctaccatgggtacccttaacaatatcagcaaatacttttatatttatatgtatatacctgtatacccagatgtatacacatatatactacacacatatatttatattcccttcttccttaaaacatgataaactatacatactttttctgtat

SEQ ID NO: 45149 - DNA, 1173 bp, Bovine  19866881021600
attctccaggcaagaatactgaagtggttcgccttgcccttctccaggggatattcccaacccagggatcaaacttggatctcctgcattggcaggcagattctttaccattgagccatcagggactctcctgttctcattagttatttgttttatacttgtgtgttagttgcttagtcatgtccaactctttgcgaccccatggactgtagcccgccaggctcctccgtccatgggattctccaggcaagaatacttgagtgggttgccatgcccttctctgaggctttatacatagtgatatatatatatatcagtcccaatctccccactcatcccacccctccacatgatttttgtttttagttaactttggcgactgaaaaagtacacaagtgcctgtgtggtttttcacatactactagtcagatagaacctgcccgtttctccttcatggggtacttacaggcccacagaataagcacctgcccccaggtactatggagatacgcccagctgatcttacagcagtttcacttcagatccacaatctgcgtccgctgcaagaatcctcgatggcctctttcatcgccctgtgtagctctcacgcttctccactctgctaaacgttaaggagccctgatcttcccacagagccgtcttaggatcagcacagtcagtacactgagtgcgagagcgacttcatgaaactccctgagcctcggctggtgcaagtcatggtggcttccgcaccacagatgacaggcccgccgccccagcttagcacagctcacatctgcacgtaactccgattcacttggccttgtcagttaagcctccaagaaaaaaaacatccagcattcagagctgagcagctcatcatcccctgcccgcggtgaattttgatttaaatgtaaccgagtctctcttggctctggcttaactgaattggaactgttcttttaattgttgattcagtcttgccttacagatctggctgtcagtcctcccatcagagtctctttcttgatgtgcttattcatcatgcacgaggatgctcatcctccgtggacaccagcaccagcctttgctagtcagacgagatggtttaaatgttgacttctgtgtgcagggaagtgtcacatggggtgattcaagagccagctccatagt

SEQ ID NO: 45150 - DNA, 1691 bp, Bovine  19866881028269
tttaaaaacaggtgctaatgagccagtttgttgtgatactcttggctgtattttgggaaccatgcagagctgtgaattcttctactaacaagtgattcttgaagacttctggcagcttctgccactgcacccaaacagcgggttcacattttcaaagtcccaatgcccagcagaagtcagtgaccatccaccatcccgtgggctttcaggctatgtccacatgaaaccaaatatgaaaatattaacacctgtacaccttcatccttccaaacaccttctcaactcaaccatgaaaattctagcaatgtgtattcaacagttttggacataatgtttaagacattgtagagacagagggaagacgaatattccagagtcggctggtgagaagactatttaatatgttagatttggtttgcttttatttttattaaagtatagttgatttacaatgttgttagtttcaggtacacagaaaagtgatttagtcatatgtatacatatatccactcttttttagactattttcccatataggtaattagagagtattgagtccagttccctatgccatccagaaggttcttattagttctctatttcatatatccatgctaagtcgcttcaaggtgtccaaatctttgtgaccccatgaactctagcccaccaggttcctctgtccatggaatttcccaggcaagaatactagagtgggttgccatttctttctccaggggatcttcccaatacaggaatcgaacccacagctcctccattggcaggtcagttctttaccaccaccaccacctgggaagctcattttatatgtagtcatgtgtatatgtcaatcctagtctccccaatttctcccaccgcctgccttacccactggcaaccataagtttctcctctacatataccatggtagtcttatatagaaactgatactattgatgagatatgacatagcaatgggagacggcttttgttcctatgaattcccaccttttattgattttctgttttggtttgtttatttgttggcgtcacaatcaggaatcctgcccagactatgaatggcattctatcatatactgtgaagacaggagataaaaagcttttagcatttattcaattcagcagaggtacttctgtgctcaaccagcctgtaatggaggtctatagcatgtggaaaagctggtctgcaataaaggatttaaaatcatcattaatgtctattgaaatgaacaatatgccccaaatgccactacatgtcaagtatgaagccagcttctggcacctgcagatgggacaaaaatgaaatgaaattctggcagcaactctccagccctggaagggaacaggttgaatctccgataacaactgctccccagaggctgtgaggtagctgttggaaaactaaggggggcagggctaactacaataaaccactgagattagttctgaacaccgctgatgtgagccctgggcagtgagaagcaaaaagagcaggaccgactggcttttaattaaatagaaataatatacaacaccaaatagctttaaagcagtttgaaccccaactctgttttcaaaactcgacactctcagcagcaggcgtagggcttggaaagaggagagctccgggctttccagaagaaatgaacgcactcacctgattaaaactacct

SEQ ID NO: 45151 - DNA, 1189 bp, Bovine  19866881041548
cctatttgcacttctgctgtcaagtctaattacttcttttgaaataaaaactttggccttcactcgggtctgtggtgcctgtcagtgaatgatcatctgtttgcatcttctcagctatgttcacatttcacaggtctgccatctggtcataggaaccgaagctccatcagtatttatacgtacaaaatggcaattcctgagaaaggatggtttcaacttaagtgaatgcatggtttaacgttgatactagaattacacgtggacaccatgcttcgccggtcaacagcgattattccacgccatggatgttttcgtctttcataggaaagagccattgtgctgtaaaacttacaggacctgaaatctgtgcttttagtgcttgaagaggggagatgaggagggagagagctgggttggatagatgacagcccccggccacagaggggtagtaatggcacgacagccttgtctgtacatcacttgtttcatgcttgatgtttccggaacaactgctcagctgcagggacgtgggctgagagctgatccctgctcagctgggctcttcttcctcaacatgaaacgattctgagcactttgaatgtttgggaagttcccccataacaattattgccctcgcaagccataatgtttgccagtgaactgagctctgtttcaacctatggatttagacacccaggcatgatgaccttgctacccaggatcatatagttttagggtagaaggaattgcagttaaaagtcttaaacactcatgttgcagacaagacgctgagtgcagaggagttaagctgatggttagatgccctggtcaccgcttcctttgctcagggacaaaatcctgaatcactcggttgcatgttgtgttttttgcccatagatcattcaagttcttagcctttgtgggtctttgattatattaatgggagatgtgcatctggaaaaataactttttaaaaaacattttattttgtattggggtatagctgattatcaatgatgtgatagtttcaggtaaacagcagagggactcagccatatgtatacaagtatccattctcccccaaactcccctcccatcccggctgccacataacattgagcagagttccctgtgctatacagtaggtccttgttatccatttaaaatatagcagtgtgtccatgttgat

SEQ ID NO: 45152 - DNA, 1251 bp, Bovine  19866881057783
cagggcttttattgttctagcttcattcaggcatctagcacaagtctgctgttatcttaaactatattgtgcccctaccttctcacttaacaatgacacaaagatccaatttataaccagcagagaggagggggtgtttatctcgtgtgaggctacacacaagtgcaggaggcacaaatgggttggcggcacttgtcacagtccactggaagctgaagatgaatcaacaacaaagaggacattttaaattatcattttgatttcaatttgctgctacacccacaagtaaaaaagcaaataaataatcattctataacaggaaaaaccatccatcctttacaccaaccaaaagggctgtaatcattacaggagacttaagtgggatgatattgtgaattaaaagccagaaaaagcaacattaatactttgaatacaaacctgagctcagaagatattttattttactttattttgagtttactctgctactgaaccatgaaccaaacaaaagttttgggggtttgcttctttgttcttaatgtcttagagaaacaagataaacaaaatatacatatgcatatatacacacacaatatagtttctatatacaacatatagtcacatattcttgtttagttgctaagtcatgttagactcttcatgacccatggactgtagcccgccaggctcctctgtccatgggatttcccaggcaagaatactggagtgggttgccatttccttctccaggggatcttcccaatccagggatcgaaccctcctctcctgcactgcaggcagattcttaactgcggagccacaagggaaaccatatatatatagtttctaaaatgattcacttagaactaaacaagaatataaaaacagtctctaaactagaagaacattttctttcagtacttccaattatatattatataatcagagacacaaccctaatcatatgcagaatgttgggtgtgtgtcagtgtgtatacatactacatgagtatcagctatttgaagattaacttggggggagtataaactggtatccatatttttctgtcttacaacataaaaacaaacagcatgacatggaaatgttttttcttttaaattaatgtatttttttaaattgaaggataattgctttacagaaccttgctgttttctgtcaaagctcaacatgagtcagccataggtatacatatatcctctcccttttgaacctccctaccatcttcctcc

SEQ ID NO: 45153 - DNA, 1179 bp, Bovine  19866881101126
aaaattatatatagaaggctgggttccatggaggtggtgacaagtgtcattaagagaaataaagcagaagaggctcaggtagggatggagggagtgttgcttttttgtgtaagctgttcagagaaggtctctgcagtaaaatcacctttaagaagacacctgaagaaaagcaagggaacagacattctggatatctgggaggagaatatccagggcaagggaagagtgggatgccaaggctgtgtgatgggaggctgctgtggtatccaaggaacaattaggctaggtatctgagcagagtggcaaaggaaagaggcataatagctcaggtcacagaagtggggcatggggggaaagtaccaagtgtattataggccatggtaacgactttgacctttactgtgagtgagatggaaagctattgaaggtgtttattcatagtaacatgacctaatattttcaaagataaactctacccactgcgtggaatgtaaacatacagggaaccagagcagaaacaaggagatctgttacaatgatctgttataacaagagtctattccgataatctaggctattacaatataacttatataataacctagattcaagatcagtgtggcttgggccagatagagaacattggaaattgtagaaaaggtccataatctggatatctttgggaggcagagtcaaaaggagttgccgatgcattagagtatgagagaaagaaaagcattaggaatgattccaaaatttgagctatgcaacctgagggatgggctggccattactgatctggggagaacttggtttagcatatctggagggagactcaagagttcagtgttataagtgctacatttaagatacttcttaaacagtcagttgaatatatgagtctggaggtcagaggagaatcctggcagtgacataaatctggggcttgtcagtgtccagaggatatttaaaaccaataggttgaatgagatcactggataatgagtgtgaacagagaacatatctgaggcctcggccctgaaagatatccacactgagatatagggcaggtcagaagttactgcacaggagacagaaaagtaatagccagcgaatgagagaaaagccaagtaaaaggaaaatggtgtccagacaaaactgaatattcgggacagcttt

SEQ ID NO: 45154 - DNA, 1616 bp, Bovine  19866881117934
atttcatgccagagagctgacatcactaatgaagatgggtaaaaggctttattaaatcaatggataatttcattttaagaaggccctggatgcaaatctcataattcatgcacttaccaatgttcttccttgccatggccgttagataatgacatatcttagggcaatagtcagaatctcaagtttggatttttggccttattttatttttttattttttgccttattttataataatcaacacggatgggttcaccacttcaaaagtttttgaatttttattgagctgtttttcacagtgtgacagaaacaaagtgggctgccatgaggaagccaacacaggggccttagtttaaatgttgatatacagacttggtttagttgtcaacctagaacaatctgtaaacagattaacagtccatacgttagaggcacacacaggaaagccccctttccttcaacagcttctacagaaagtgacttgttggcataaaattgttgcaaccttgtacttcaatattctgatacaaataggaaagcacacttcgccttcaacatctgttctcactagattcttatttcaaaggcctgtatttcttaaccctcactacttgctgctgttatttgtccataaaggaaccacatttcaagcaggcacccgtgctcgacttacaggcatgtgtctgtgaaaggagaagccaacattgagttctcatatttggttagggttttattttcaatgtttttgctgaagctgatgatacgtgatgtgataacgttaaacattctatgcattttgatcaagtgtgaatgatgtatccaaggaagcaaaaagtcaagtacaacagttttgtaacctgcttttaatgagatcattagggagttaaggctctgttggttgagttgcactgcagttgtccatcttagctactgagtttatttaaattacatttcaaactagtcattgtagaagagtgttttggaaaatgagtgaaataaagggcaggtctttcaagagtatgatatctgattagattgggaggtttagagaaatggtgtttgtctctggacctcagaaagaggaatgttgttgatagaaatatcttcagtactggactgctgcattttccttcaaatccagactttgctcttagaggctttgaaaagctttgtaccttctgattttgaggatacaaacacacaaaccaggtaagcctgctttgctcaaaacagggcagaaagtcacctggcatttctaataaatgatttgttagtctttgagaggctttggtttttgatgagggtattctcttttgttagagaaggaacacaaaggcgttgaaatcagctgatggctggagccaaagtgtcagtgttatgactgtgcagctttccattacccgtgtgtgcgttaactttgtagggaatccatccctctttcctctgggagacactagctgttgactcgcctgttctatgctgttttctaagagtgatccctgaccaacctgttactgtcttccgtgctgctcactgactcagctgagcctgagtcttttgcagccccacagactgtagcccaccaggcttcttgtccagggatttcccaggcaaga

SEQ ID NO: 45155 - DNA, 1461 bp, Bovine  19866881134198
ctccttgtggactccgatcactggggaagtcccgcgtgcctcataccacacccacgctcgtcaccagccctgccattgttacctaatgggtgttggcagcactaattttctggatcattcctgtgaccctcccaggtagatacttcctttgcatttaagatatctcccttgggtgtactttccttaatttatttccatctgtattatacctataaagtccttgaagtttctggtgtgaaaaccatcagcagattattctttatttaaaaaaaaatccaactaatggtcatttcagtgcatgtctaaactagggaatggagtttcatgggttcgaggaaatgtctgcccactccagtgttctagcctggagaatcccttggacagaggagcctgatgggctacagttcatggggttgtcaaagagttggacatgactgagcaactgagcatgcatgcattctttatttttaaaaaacccagttgatggtcatttcaatgtgtgtctgaattagaaaatggagtttcatggaatttctttatattacctggagaagggtcttttcaaaacaatcccctaaatattaaaaatttttttgctgtttttattgctattactttttatagtttttattttattggggtatgattgattcacaataatgtattagtttcaggtatatagcatcactcaattatacatagacatatgttctttttcagattctttactcatataggttattacagaatatattacaaatgaacttgtttataaaacagaaacagatctgcagattttgaaaacaaacttacggttccccaaaaggaagtggggggctataaattaggagtttgagattaacatgcatacagtattatatatcaaacagataaccaacaaggaccttactgtatagcacaggggactttcctactcaataaatgttaagttttgtacactgtgatagggtctagttattagtaccagtagtgagtgattatctgccctaagaaagatacaggatttacagccttggagaaatccaatttctgctttatgccgggctccctgctatgagcccaggagactgcagagcctgccagaatctcctgtaccctgctgagatgctctgaggaggacgggggcatctcctgcattctaatgatgccctcctttcaacgcctgtgtgctcagtcattttgtaaatagtgactcctgcttacagacgtacagcattctttctgcaagagcaaggtaaataaactcaaaaggaatagttgggacttcactcagttgtccgcccactggcaacttggggtgtccgtatttacctcggagagaggtggtgctgggaaatgagggccagctgttttgtgagatttaacgatgaacttgtaaactattcagagaatgtaaacacagtataaattttatgtgggggcaaattgctcccaagccga

SEQ ID NO: 45156 - DNA, 939 bp, Bovine  19866881155925
tcatggaagattataatggctggagtcttgcctacaagaaatgggggacagaaaggcctcctagccctggagccccacagggacttggtttcaagcctgccaagccccacttggtttcaagactgccatcaccaataaagaaaaggtatgatgttcaaaaatatatatgtatgtcaatgaccagcacataacagttgccacttaataaatacatgtgtactaagttgcttcagttgtgtctgactcttttgtgacacaatggactgtagcctggaaggctcctctgtccttgggattctccaggcaaggatactggagtgcattcccataccctcccttcagggtgtcgccccaatccagggatcaaacccaccttctcttatgtttcctgcattggtaggcaagttctgaaatacagtggcattcaaacaaataaatgatcatgaaaggcaaatacaccctcagaggtagacttgcctgcaactcaaggcaactcatttgcttaccaacctcaaggccaaaactgattcattttcttctttactaactttttctctaaaccaagtaaaatctgattatcaactgttatatatccaagacatgcctccacaggaaagataagtttacccttctgtgtctacatttttctgaagtttgagaatttcccactaacattttgcaagaaacagaggggatataggtggctgcttgatggtactaagacacatccgaatatggagactcatggggaccatcttgcaacctgcatcacgtgacaatcaaaacacatggaaataacatggcatgggctgttccttcatgttcactgagaacagagaccaactcaatgtgagagcaacttggcttaccctaataggagttacagagtaattaaattcttccacatcacatgtaagtataatgtgttaataaaaaagt

SEQ ID NO: 45157 - DNA, 1420 bp, Bovine  19866881202115
cagtggtgctgagttctgttggctgcgtccatccatagatggatcctggaaaactcttcctttctcttctggtttgattttgttgtttgcaaacagctcccgctggaaacaggcatgatggttgctgtgggatggtatgtatatatagacaattccaatttcccctctatttttgtcttctttatttgcctcagaataagctataatgagcagacctatgtctctggcgcttttgtttagtaaggatttcattaggactttcttggcatgctttcactgtatgttgaggatttatcatcagtggcataaggatacatttttccgggtggcagttttgtatcgttttgctttacatttggaacgtctcttcttccttctttttgtttctgactcttaaagagtattccaggtatgtttccctttcttcatttttcttaaagcttgagaccaatttatgttttaaaactttattttttattttgtattggggtatagggggttaccaatgatatgagagtttcatgtgaacagtgatggggactcagcaatacatacacatgtatccattcttccccagttgagaccagtttagagagaaacttttaatccagagtttctaagaggctaacgtgccttgtgaggaagaaaccttttcctagttaaactgtatctgtggtcttcctaaaatgacctggtgaaatgtaactctcacgtaatctgtagtgtagtagtataaatactctgtatcaactatgactattcatttccagaagggttttcaaattgaaaattaaaaaaacaaaaaagcttgggtttctgtcatgacatatggcagaatgctaaaataaataaaaaatatagtttgtagtaacagatggatttgaaccgcacttggatctgttgaatacttttttaaatatttaatttacaatgaatctttaatataacatttaactaagtgttctgtcatattctttttaaatgtatgcagtcttttcaatgtaattgtgtctagaaaatttcaaaagaatattgagtgttgaaaattaaaactgtctctgaaggaaaaaaaaaaaacagtaattttcctgagatttttatggttcccttttatttgcactgctcagaatgttgtatattttttttaaacagtctgtcagcctcttctttattttcagtttgctgaaaaaaaatggaaccaaacaatgaaagtaacttttagtcaagaaaatcaaacatacatgctgaggccattgaatccattctgtttgttgggatggagccaaatactacagtagttttctagtagaattacggttgtgatataaccatggttactatccttcatggagataatctgaataaatgaaatcactaagaaagtataaagcaactaatcaatcacatctaaagagagcca

SEQ ID NO: 45158 - DNA, 888 bp, Bovine  19866881207064
taactttgcctctgtcatgctccctttttcaaggccctcaagatacaatcccgtttgctttacaaatcttaaatctccattttgatggataggatgcaacagaatggatgccactggtaatgattcaaaaagaactctgaaattctgggatgataattcacggctctcggtaccagcaaatgctactggagtcaggaacagaaattcaaatagaaagaaatacaactttcatcctcatgacatccacttcaggtcagtaattaaacagatttcctcactttccaatgaagacatccagattcacaaaaggggctggtgggtattctgattttgtgtaagagccagaagcccgcaggacaaatgcattatttaattctctactatcacacactcaacagctttttttggactctagacatcaatttgttccaatattaaaggccccagtggtaaaaagatatgaaaatattcaaagtaaactaatgcctctgaaactcttggatcagaatactaatgcctccatctgaaggggcctaagtctgttatctttccattagaaacctttcacacaagtccatttggacaataaatacctgcagctcatggacagtaatatccatttatttttctatgtaatgcccttctttgtcggcatatcttaagcagaatcatcagtgacacttttttttttttagccttaaattctaaagaagtcaaagaaagctactactatgtctctttttatctaactttggttggtaattaggataacatcatgtggattaggtgcttgaaaatgtggttaataaaggaaattagaaatctcttctacacacaaacacacgaaacggaagcaactaaattaaatacttatggggcattgaactc

SEQ ID NO: 45159 - DNA, 1890 bp, Bovine  19866881256764
ttaattgaagtatagttgatttacaatgtttgttagtttcaggtatacagtaaattgattgaatctatctatttatctatacatatatatacatattcttcttcagattctttcccttagaggtaattacaaaatatgactgtatttctctgtgctatatagtaggtcatgttatttatctattttatatacagtagtgtgtatatgttaatctcaaactcctaatttatccctcttccactttccccatcggtaatcataagttctttttctacgcctgaggccaggttgttttttcttttaaatagtttactaaatacatatcaatcattggccaacggatgaagatcaatccttatttggaaggtggattatgctcaaaaagacaatcagatgtctttatcttcttgttaacaagtcataaacggagaaaatccacagggggtggataacaaagcagagacattttacagtgatttgttgtatatggttcattcttttgccttttttatgctcaggtccacttaggatgtggtacttgagttcaggtcctcttatcataaggcacaaatagaacagttttagccttgtagaatcttttaaaaatgccttcactaagacacgtgagtattaagctatctctattttcttttttaattaagcacatgggaaacttcagttatgagccacttcagtctttctcattaaagactgttattctctggtcttcttactgggtctcatcgtgggagagtttttactggggcattgggggaaggctgtggctaagctgctaatgataccatatgtgtccaaatctacattcttattactcctgtgggtgtgcaatattatatctgcatcttctatgcagaatacataaagacaactctgaattaatcaattgtttgttatgcacagaggcagttattgggtatttctaggagaaatctttatgtaaaaagggatacctactatatactataaatggagtgggaatgggcttttaatattaaaactccttgggagaattagcaagcagtaggaaacttcatgacgacttaatgcactgtgctagtatgttatcttgctgatgccagttttatttttttgtgatactacaattttgtgatactacaattttatgatactacaatcaggcagctgtgtagtgcagtgggccctgaaacatgaacttatccaacaaaaagttgaagaatgagtcctgtgagtcctgactctttgcccaaaggatgtgtggattttgttttaataaagggacgtccatctgttataatcccatatacaaagcagacattcggtaaaccaccagcaaaaactaagagttgtttcagatgcactcagccaactctggaatgaacattttcttattcagtgccctagaaaatacagggaaggaacccaggtaattactgtaatggataacaatgaggtttagaatgatccaagggaaaaatgcttaccaaagcaacctttcctttgatgtgattacaggttcaccttttcggtcatgtaagtagatagctcaacagacaatgtggatagattggagatgcagcttggggatgtttatttgaacctgctattgtatgggatgtctttatccttgatgaggtttccaaaccgtcaactccaacttttcttatcagcgtacccatcagaaatgaaaacaaagcaccgtgtaactgctctttctgtttctgaactgtcaatgttgaagtgacctatctcacatcctgacaagaaggacggattagccaccaggtagctcagccacgaagcttctctttcaggcccctgtggcatttctctgggttcatcatcactgcccatctgggcactaatcctgtctgaagcgaattcacttaa

SEQ ID NO: 45160 - DNA, 883 bp, Bovine  19866881356913
cgaccctatggactgtagcccaccaggctcctctgtccatggaattctccaggcaagaatactggagtgggttgccatgcccttctccaggggatcttcaccaccctggaattgaacctcggtctgccgcattgcaggcagattcttaccgtctgagccatcagggaagcccactggagttgagtcccccaggagacctagtcacactattggggttgactgatgtgccacgctggctttctaaagggcctgtatctctgggagatcctgagatggtgtttcctactgatctcaaagatttggtcagagctatgtagtgatgcacgcatcagactcgagtaagacaagagaaatcataaacctcaaaccgtgatttttatccatggcgatgttagcactgttgatcagtgtgaggatttcagggaaaagagaaaaagaataataacagttaaaactctgtatcatctcaggtagaaaagtgtaggaggctggagccagctaagtatagctttcatctatcagctttttatgtctgttccattaaaatatgatttaattatggatcgacccagggtctggcatagtaaaactatcattaccttcctacctgcattcctgagtgatgctcgggtaaaggtgatcaaaaacctacattcatctgtaatgtagaccataaggaggaaaggagagagtgatgattaccaagcacagcatggcagatgacaataacagtcaaaaccatgtctttaaaaatggagctgagtgttttgtttgaaaagagtgacacgctgcaagcctagaatcaggtcaagagatgttgaaagcaaaagccaaatgtgcccggatgcagctccagacctgccatgggcatgccgccttgcaa

SEQ ID NO: 45161 - DNA, 1101 bp, Bovine  19866881395304
ctcggtacccaaacaccagagctctctcccctacacttactgtgttttgagagaataaaacattgatgcacactcagattaatgtcataacctttcctgaaaacaaatcttactggaggagaaaggggatggtggataaagtagccctttgtggcagatagtccttagacggggttggcggggaggagaaggggactctgtatgccttcacaatgtagcccagatccagccttgcagagaaagacagcagagaccaggctctaacttcagtcagtcttgggtaattccaaaacaaaggagtcacacatcgtttctgagctgtatcccacttgacttgtcagacattttatagaatgctgatttttatagctctcctgggcctaccctttctatactaaggcacgagagaaatacacactcccttccaacgtactgaaatagcagcctctccagggaaaaattctccatattaatggatctgtttaataggacatcactttgacttttccactcacttatatcctgaactgtaggctagtacgggaggaagtggaaaacaggaagcaccttctgcttcctaagggggaactggtatcttcacaaatacacgtgctcatctgttcttgagttgtaacttctcagactccaggctaattgtattcaaatggatggagctaacaggcatttcatcctgggttccgtgttcacatctaactttgagatatccatgacgcaacaggcacagcatcacacaggcaactacctttaacaacagccagaagggcatcagtacaggggaaagaaacagtaagagaggatgctgtgtcagtagattctaatgagaagtttcctaggaggtcagatcttgttcttcaatctccaatcaagaggatgtgtgtgagttatttaccaggtttgtgaaagctattaaattaaatacgtatatataaaacctgcacagcttccacaaggttctttaatttcaaattttttccttataaaacaacaaaaaaagggagggaaaacgaaaaacacagttactgaaatgatccttcattacctggccacagagatgcaagagattcctccccgcaggaagtc

SEQ ID NO: 45162 - DNA, 1403 bp, Bovine  19866881566259
caagttgcctttcataattcatgaaaaaagtctgtttcctcactctttgttttacttgatggtataaaaaaactatggttttaaaccagcctttaaaaaagtggttataatatttctgtaaattcttagctcatttctgagccagtgcttaagcaaaatatgatgatagttttttttttccaaattgtttaccatgatttgagtcatcatattttgcttaaccactgggctcaatgcactttaaaggctgtcatttctctaccttgatttgacaccttcaatttaatttcttaagtgttagagaacaaagcataatttaaaaaggggtagaaagggttcctctagaagactgtttcttgcatacagatgagtaattagagtgacctcaatatggtggcttcccttcgttgctgagaggcaaatagttttgtgtggcatataaacaagcttccctctacaaacccttaatgtgaactaaccccctggatgtgagtgagacttcggtgtctttgccgatagatgaaaggcagcagaacctgcagtgaaacaagagtagggaagtttaaagtttgactttgttgttatctggccgtgcaaagttaactcattagaagtttgcccctgccagaaatccagtcaagattccaccatatttcctttaaacatacacagagggggagagagagagaaaaaccgaaataattctttgaaagttcaggagaaaacaaggtatggtttgtttgggtttagaatgtgtcaacttaaaaacaaacttttctaatggtgagagttatgagcaattagaatttggttttctgtaatgtgagcagtggatttttgtttgctttgtctcttgtttgtttgtttgttgccttttataagggtagactgtatataacacagaaccgaagatgtgattattaaaataatgtgattatttcagaaatagtggcaacctactaaaaaataaatagattggaagttatagatatatctaaggaagaatattaatcttcattctgtgtctttaaacagatgtagaacagtcttcagtctggaattgagcatggcaggaccccataggcagcagtagagccttctaatgacttagcaactgggagtggtatagggtggggtgttggaattaagcagttgagtctcaaatcttggctctaccacttaattacatagtgactttaaatgggacagctgaccttgggctctcaggtctttcttgaataataaaatttataaaagccctactctaattattctgagatttatgcatctgtatctagccagagtgtagttcaggtttaatactcaaaagctcttatttttcctcttctgggatcactcccttttatctctaatcccaggccaggaacacagcccaactaaag

SEQ ID NO: 45163 - DNA, 2703 bp, Bovine  19866881621469
agcctgttgggcctagtccctggggtcacaaaagagtcagacacgacttagcggctgagcacgcacgcagtagtaggtattagatgttcaatccatacttattattatggtcttacatcttcccactaactcctcactgaggcttttattgttaaggtgaaaataaagactttgcttttatgtatttattttaactcattcgtgtagtagatatttattgcacaattattctgtataaatagtcttggccccgtgaagcgtgaaggaaacaataagaaatgtttctttcctacaacctcagtacaaagtacaagatgacaagtgatttgagaagaggggaagtgaggaggcagtatttaataatcatctatttggtgcccagtgctaggtgacagtccaaatgggaagtttcccagaacatttctatcaaagaatgaccccaatgtgtccttgtgtgttggtcgctcagtcatgtctgactctttgcgactccatggattgtagcccaccaggctcctctgtccatggaattctccaggcaggaatcctgaagtgggttgccatttccttctccagtgtgtccttacagactagaaattaggtatttctcatcgccttactgacagtccactctacatcttttcccctaagtacactgctttcatctatggtggaataatgtggattctgggaatacacattcttgggttagagaactcctcaaaagatgcagagtccatactggcaggttggacattctttttcatgctgtatagacttgaatggtaccttgaacacatagaactatctgcaaccttgaaccatgcaggcatgctcgctcagccacgcactcatgtctaactcttcatcaccctatagactatagcctgccaggctcctctgtccatgggattttccaggcaagaatactggagcaggttgccattttctcctccagggaatcttcctgacccaggatcaaacccacatctcctgtggctcctgcactggcaggcagattctttaccactgagccacctgggaagcccacattgaaccatcagttcagttcagttcagtctctcagtcctgttcgactctttgcgactcgatgaatcgcagcacgccaggcctccctgtccatcaccaactcctggagtttactcaaactcatgtccatcatgtcactgatgccattcagccatctcatcctctgttgtccccttctcctcctgcccccaatccctcccagcatcagggtcttttccaatgattcaaatctttacatgatgtggccaaagtattggagtttcagcttcaacatcagtccttccgatgaacacccaggactgatctcctttagaatggactggtcggatatccttgcagtccaagggactgtcaagagtcttctccagtaccacagttcaaaagcatcaattcttcgatgctcagctttctttacagtccaactctcacatcaatacatgaccactgtaaaaaccatagccttgactaggcggacctttgttggcaaagtaatgtctctgcttttgaatatgctatctaggttggtcataactttccttccaaggagtgtcttttaatttcatggctacaatcaccatctgcagtgattttggagccccaaaaaatagtcagccactgtttccccatctatttcccatgaagtgatgggaccagatgccatgatcttagttttctgaatgctgagctttaatatctttaaattctcagcagacttctaggtctttaaactaacattagggtgattggcatcaatgctaatcttctagccatgctttacaggataatttttttttctattttacctatcatttttcatctcctgctgattattttccatcacataaatatagcattttccccaaattgcatgacttgtttgtcctttagaatcattcctactgtgaatcaattcaacttgagcatatgtgcaacatttgtaatcttcttactgcttgcaatctttttattatctaatttttatcccatcataagtgtatgccttttcttatgaccatttttaagaatatcgttgaccttattggacatgatgaagttttcttcactaaataccctggaactaagcacagccacagtgaataagtgatagaatataatgttcttcagcatcagaataactcagggtacttgctaaaaatgtgaattcacaggtcccatctccccacgtattactatattcaaagttagaacttatatcctgaattcccagagtagaaaatgaaagtgaagtcatcttctcaagggctggatttcaaatcctgctttttgagtctctttctcattttaccttggtcttcctgatggggaaaaggacagttcttttgcaatccaaaggcagaattaccggataaaatagagaacccttggttacatttgaatttcccatcagcagtgaatacatttttgacataagtatgtcgcaaatatggcatgagaaatacttctactcaagttatacattcttgatcagaaattcaaatttaattcaaattcaaatttaatcgtatttgtagttgcttaatctggcaactttactgaaaagaataaaacatgtctgaatgtgcattctcaagaaacattttattaaatagattatctgtactgtcaatctcgggagaatgggtagaattaaaa

SEQ ID NO: 45164 - DNA, 1576 bp, Bovine  19866881663321
ttagcactaatggtggttactctcttgatggtggaattaggcagggttttcttgcacttatctattttttttgatataataactgcagtaactataaataaaaaagttttgaagaaagcataacaatttaaaatgctattaagaaacacttttttgcatctttagcttttacatctttagcaaaatcattagaagactgagttataattccttattatcaatttccatttacccagtagatattcttggtgtatatgttagaccctgtgaaaactggtaggatttccccaaaccacagatcagctgccactggctcagaattacatttctctgcctctaagatccttctggacccatctgtacactccagctgccccagagcctcttaaagaggcagagaggaaccagagtagagtacacagagccttggattttattaggaagtgggggtgccctcagtaatcacaaatacacaaatcccagttaattagaagttcttggaggatggcccaggcatgggtattaaaaaacaaaaacaaaaacctcccagataattgtaatgtgcagcccatgtgaagaaccacggctttcatagattaatttactaaaggggtcatttgaaccatggccttggagagaggtgaaattaaaacacgatttggttgaccaaggccagtagctgcgtggccctgagccttgtgagaaaatgattatgcaaagagaatgaaaggacatgacccgtgaggtgagctgttcttgcataacaccatgaggtctgggagcggatagtgaggagccctctctggagttcacggtagaacaatctctaatcagacatttcaagctaggaaaacggtctctgagagcagcttgctgatgagatactggcatttcacaaagtacagcagaacccagtgttgatgctgatgccaggggactaaagccctcatgggcaccagtgacttccaacctttcccatgagaagatgcaggcgaacacatgtgccagatcttagcattgtcaccaatgatagagaagcagccatttgaacacttaactctgtttctgaaattcattttatgtggatttgtatggaatgtctttggtagttattctaaagatttataggggtggaagctagggcacatggaggtcttcttgtccctgtcctttttatatatcagagtaaagttgcaacttgcccttggtgccagcaagcagaggccaggagtcagcacacattccttttgtgtttgggggttttgggttttttggctgcgccgggtcttagttttggcatgtaggtcttcgttgcagcatgtggaatgtttaactggggcatgttggatctgagttccctgactggggactgaagctgggatccctgcattgagagcgcagagtcttaaccataggaccaccagggaagtcgttgggcacatgtttctttatgtgttcaactacccctgaaattcactagagtttctgacttggagctgtgcctggttcccatgcagcagcacgtgggtcacttgtgtcctctgaacaagtatgatgatcatatttataaagttaa

SEQ ID NO: 45165 - DNA, 742 bp, Bovine  19866881818458
atgccatttactttatatgtttaaatgagggttcggatggggaacaaatgtatacctgtggcagattcatttcgatatttggcaaaactaatacaatattgtaaagtttaaaaataaaataaaattttaaaaacccagaaaactaaaaaaaataaataaaataaaatgaataaatacaaatgtactgaaaattacaaaaggtctttaagcttgaaagtataaattaagaattatctgaaaataggagaatcatgcccaatttttggttcaatgttcaaaaattaatattcaagaatttgaatattaaaagtcttaaagaagaatctatattaacatgtatataacatattataacttaaaataatgaaataatgtgttaacagaccaatttaagacagtaaatgactcagaaataggcaagaacacattggatttattgaatgataaaactgacatcacaaataaagatgtttagaaaatcttacttgactgaatctaggcaaaatagtccattgtttggaagaaaaatgaactccataactcacataaaaatgagcatttaagaagtcagttgtaaaaagtaaactgtagaaaatagaagctatcccaaaagaattacttttttttttaatttggtattttaatataggaaagggacgttttcagtgacctgataggattgacattttaaaaaggttactgaggctattgtgtgaagagtgattggggaatgtaagatgga

SEQ ID NO: 45166 - DNA, 1181 bp, Bovine  19866880247263
gagggcatggcaacccactgcagtattcttatctggagaatcccatggacagaggagcctggggcgggcaacagtccatggggtcacaaagagtctaacatgactgagcgactgagcacagcacatcccccacacacctgtacttcccatgcgtcttatcccaagtcaagcatcagtaacacatgattttattgaaaaccccatttatttaaggaaatcagaagtattttttatatcttattaaatccctaagtgtcattatgtggtgactgtaagtaaccattgatttaattttgccaccaaatagaatttagtgccctcaagttcacagcgttggatgaagtattatacagaaagtaattcacatagcatctcgatcttaaattacatcaatgacatgtattattagccatttccaaaaaaaaaaaaaaacgtgcaccatgcaagcagacagtcaagcccaccctgtaagaaaagattcatagtaatactagtaaaaacaataagagcaatactcacacggtgagcttcccaggtacaggacctattgtaaatcactttacccataatgagcccgtttaaatctctcaacagctcttagacatactctcaggacagctcattttatgggcaggaaagatttctgttgtttttctcagttgtgaaaaaataactgagtaaaagtaaacccgggctaactaccaacaccgacttaaatctaggtcaacaggtttcccaatctctaatccccagtccaaataactgttctctcaagtccaaaacacagaagtgaatctcattctcaacctaaaatgtgcagttctgggtttgtaacatcacataatgccattttcattagccatctggaaagcggggaggaaaactctttcttaaactgataaaactatactccttcggggacttgccttgtagtccagtagttaccactctgtgcgtcccctgcagggagcgcagtgcaatacctggttggggaactaagatctcacacgctgtaccgtgcagccaaaaaaataaaaattgtacggcttcaaagcatcaacttcgaagcgaggtgacccaactgctagagaggcctcccagtctcttccttgcacaatcctttcccctctcgtgactcgccactccgcgtattctcccataaagaaaaaaacaaaaccaaa

SEQ ID NO: 45167 - DNA, 1125 bp, Bovine  19866880265711
ctgtgaacttgagggcactaaattctatttggtggcaaaattaaatcaatggttacttacagtcaccacataatgacacttagggatttaataagatataaaaaatacttctgatttccttaaataaatggggttttcaataaaatcatgtgttactgatgcttgacttgggataagacgcatgggaagtacaggtgtgtggggatgtgctgtgctcagtcgctcagtcatgttagactctttgtgaccccatggactgttgcccgccccaggctcctctgtccatgggattctccagataagaatactgcagtgggttgccatgccctcctctgtgggggtacctagcactttttgtcaagggtgtctttttctaataattaaaaaaagaattttctgatgagtagtgtgacagaggagctctccttgtcagacccctttgagctccgttcctgattaggaagtcttaaataaagtctttcttgccatttgaaaaaaaagaatcttttacaatatcactcactgaggacgagttaaggggttttgctcttgggtttggtgttctgtttcatccagctttgatgtcctgtcacctatgtgacctctatagctctgaaagcagagtcttagaaggccattactaactctttgtacctccttcaccctccctcgagttctggatgagctattttgacccacccactgggagagcactcctggcactggaaggtcaggagccctgaaaagaaggcaggagatgagaaggtctcattcctcctgcattagctgtgagtcagcaaaagaaaccccctgcagggcttccagattttaaaagcaccctggtgcttaatgacaattgtgtgagtgcagagcaaatgcggaaggactctgcccctctccagccttattcctcattccatttctgtgaaaatagcaactagtcaaatgtgctgaccagtggtagcctgaatttttactcctagggctcaactgcctgccttacttttggcaatgttgagtaagttccagcttgtgtttggcatctctcctaaagggctctgtccgggcacagatttgtaaccctttcttggcatctctcctaaagggctctgtccgggcacagat

SEQ ID NO: 45168 - DNA, 1813 bp, Bovine  19866880382733
cctagaaagttccctcatgccccttttagtaattacatccctctgccctagagacgaccgtggttgatttccatcccccttgtagcctgggtttggatttagtgggcttgcaatctgtaactgtggtcttaggtcatctggacaaatcagcaagaaaatctcatcagcagctcagatgtctccactttcttagtgctgcaaaaggtcctgcccctgagctgccagtgcttggctcctctgtccccagtgtgccatctgaccccccagggctaccctctgagccacagcccttctcccaaagaggttagcacctgtctcccaggtaagtgagtggtgaagctcttggtaatggtgacgatgcatgctttgttgattaatacagggacgtgcaatgcacagagccacggcatgtcaagcagcatgttgatttttactgaagcaccatacaaaagggagctcttccttttgtgcatttccttttagaaacaaaggattccatgaccaccttcttccaggcttctagccatcaagatggctgcagagctgaaatgattagtaagcgaggaggctgggaattgaatgtgtgtgggtgtttgtgatcccaagtcctgagcccgtggtccatgaaattgaaggatcccaaaattctattggattaaacttagcctaatgtctcgaaggtgaaaagcgctttgtctgaatgcaaagctttggtgtctctgaaatgtaccttctgcagctcagttcttaatcaccgtatattttttcacttggacaaaggctgccggctaatagcattttcaaccatcttcagctgcttcactcaactacgccaaggcctcaggctgagctggtagcagtttcctggcaccgtgatccattcccaactgaccagcattgaggaacagcacacattcacaccctgaaaaaaacgccttccccctgtaactatgcaaaatgccaggcagaggcagaatgactgctcccctccctcagtgtctcctgcaaacccatccaaactggaggatgggggtgaataggagggaggaaagagccctagatggtgcagggcgggaactcttctctctctctgggcagtgaaggtagctgggagctcccagcaagcccatagcagcacagaccttgaagcagctcatctctgaacacctctgctgtcagatttcactttgatccctgaaaattataagaacctcagctcttcagaagagaggcagctgctgagccagggtgattgcaggatttctttcccccaagccggaaggcaggcatgtagccttgcctgcgtcctgcatgagtaaccaccttccagcctcacccgcgaggtcactgcctagtgaacagattgcagttgggctgggctgcccctggaccgccctgaatgctcacgacctcctttagcagcagaactggcatttggtaaatgcacaggtgcaagagcaggcaagggaggcaaaaaatgccaaggagcaccacctggatggctagaggttgggaacattctccacgctggtcatctgcaccccacccctcacccgtgaagccccgagccctggaagcagctgggggagaggaggggaaggagggatgggctggccacaggtctttggagtcagagctgtgaggctgagctccaggacttaggcaggaagagattaattagcgcctcccagcccagccagctctacagaacagggaggtgtggagggtagggatcctcagggctaaattcacctccaacagacagacacacagtcatccagaaacagaatctctaactctctcagccacagcc

SEQ ID NO: 45169 - DNA, 2136 bp, Bovine  19866880417984
atagaggtagtttattttgaaggtagttattttccactcctacccaggccccccgtactcattcaaactgcccacccaatgcccactccctcctgctgaaaggcctgggctccagggagctttattgataggcttgtgttaccccagtcctccctgtcctagggagtgagagggtggtgagcagtggccatgtggctggagagtctgggtcacatccaagcctggtgactgtgggcaggatctcttacccctctgtgcctcaaagtcctcatctgtcaagtgggagagatggtgcctgcctttggagggttgttggaagaatcaaacaagtttatatacattcagggttagaagagttgggcatcttaccctcttaatattaatagatgttggcagtgactctgcttttctatctgcaaaatgcagacacactagctgatattttcccacactggcatcttaaggaaaatgagatagtaagtaggagaagctcgattttcttagcagaaagaagttctagaattcaatggtgttactgtcagtaactcttggaaccaatgtgccaggagagactttgagagggatttatctctgggatgctttgtccaggagctcaggttattgcatgctgctggacaggtgctgatcttgggtctttctgagaaggaacagaattgcacagatgcagaaatgctgaggtgagctgtgctgtgaccgaactctgggctcctgcttctagtcactgctgcctcctccaagggggaggcaagtgcttcctgcctgaatgggctctgccctggaaaagggcttgaacagccttcagaccaaagcgggtgagggtgggagcgggtctgtgtgcttcttgcccgtgtggcctgccgcccctttgtcagacaccttgctcatcccggccctcctgtccgcggtgggtgtgtgtatacatgttcccagcacacgctttttgtaggcagcgatctctgcttgacaagctggcattccaaactccagatcttccaaacaccagacccctatgttatttttaactgtccaaagttttttccacgaggtgtaattgatgagactcaatagcctggtcagagactctaaacttgagtttgttttgtctcccttgaacgggcctgtgtccgatgaccaggcaaaaaaacactgtttcgaaactgactggtctaaatcttcccacccgtcccatcccccacttctctttagggaacagaagtgaacaccaagataacctgggctcgcctgtttctgtggctccagataggagagaggcagatcccttccgtctgtgaccttctcctccctgctctctctctcggagtcccgatagtgagggacaaagctacgttttcagagagataacaggaagggcattgaggagttgggcatgcaatctcttctggccttctttttcagcccccacattccccgaggggtaagtcacattctcctcgtcctctggggacagtcctggacagatgctgttatttcagcgtgcccgacatcttgtgacatcgagtgaccaccatccttataacactggagaagagtctcagctctgcacacccaggacaaagtggcgccgtctcacactggcctgccatttgcatcgtgaatttcttcagcctttctgtttttcgtccacacatctctccaggctgtggtatacttggcactcaagttaatcaagtgtgcacaaggtaccagttattgtggcactgggtatacagtgataagcaaaaccgatagaaaccccatctttgtggagcttgtggtccagttggggagatagatgttgatcacaaaaatatgtaaataaaagttgaatctgtgttatgttggaaggtccaggaggatagaagagagtgtgatcgagggaactgttctggtctggtatgttgagggaaagtttctttgaagaggcagtgcttcattgcacgcagagggggacaagcatgtacaagggtcccgtggcatgttgggacaaccagggaaggccgctgtggctggagcgcaagagagaaagggaaactgcggcttaatgatagggtaagagaggtcaggagggaccagaacatgcagggccttgatggatattttaagagtgtgtacttt

SEQ ID NO: 45170 - DNA, 1094 bp, Bovine  19866880420781
caatagccatcctcagataaatctttgcatgggagtttgtttagacagttcattcgtggctccccttcagaacccccaagctagactctgaaattagatgaactttcataatttgctttgattatatgcatttttttaaatttcaagttcaaagtcaagctgtcactgagaatttcaggactacaagcaactacaagatttcaaatgaccatatagattggttggatacatttttattagtgtagaagcttccattttaccagtgggagcaagttgtaagtctatgaatccaatgcccaagtcaaagtaacagaacagatgaagtaaaggggtaaagaatgacagcaagagcaggttgcaagcccctcagcagaaatcaacggtaaccagctacattggctttttcccatgtgagcatgcaggaatattacaacgttggaggtttatgccatattttctaagaacagggccacatacagatcaggcagaccatctcccaagtgggtgaggtagttaccctcattctctcacaactgagcacaaacgcccaggaaagcacttacatatttaaagcaggagaaaagtggaagccctttctgtctcaggctaccagaaagggaagcataaagagtccatttgtgggtttctttgcttggtccttgcttctgttgggttggtatattagtttaatgagaggtctaattcatgaggctctgcaaaggctggattgtcaaagcagatcctcccagacacttacagcctattgcctgggtggcctcttaggtctcccaacccaagccaaggggcagtgcctacgtctctgcacctacactttcatgaaggccggagaccctgaccacgcttaggggggaattcagaatcttcacatcaactgggttaaatgttgtacctaatcagagatcttcttttaattggcacctagagcaaagaattccaccctagacatgcagtcccctcactcctaccccaggacaacagccaactccaacctcagttccctgggttctgcttccaggtgtagccaaaggaggcagttagctaagcactcccccagccatttctctgcagttaaa

SEQ ID NO: 45171 - DNA, 725 bp, Bovine  19866880435657
ccgggcaaggattttgcttctagctgaaatgaagtctgccaggttattttggtctttggaatggagtagtcggcacaaaggaataagcaataaaaccaagaactatcacatttcaccccaagaagcagttcctgagggcagagatgggtctccccatggtgtccagctcactctgactggtgagaggaggagaggggagggttcaactgtaaagcggccaagccagcagggaacaaagttcaaaatctaatgagctaaaaaaaaaaaaaaacccaaaaaaccaaatgagctgctcagcctcttccaggttttacctccccttcccatcccccatcgcttctggtacccaaggcatcactggtcaggggtacaggactggatttgatgcacttccaaagccaggactctatccatccaccaatgcttttaaagggagattgagaagggcctcatttccacctgccgccaagccctccctacacccctgttcctgaatctttcctctgcatcccatcccatcccactgtccccttctcagatctgcttctgtgctgtcccttcccaggctcccctcctcactctcccctgtgctcatctcttcactgttccatctcctccagccccttcactccagcaacagaaccagctggcctctctccagagcccccagagagcgcttgccaagttgggcatccatcagactttcaccctctgccaggagtctt

SEQ ID NO: 45172 - DNA, 1356 bp, Bovine  19866880468088
tcttgggatgatcccacttaaataaagaccaaatctgggttagactttccagagtttctaatttggccaatattaaatactgtgagggacctccctggtggtacagtggataagaatccacctgccaatacaggggacacaggtttgatccctggtctgggaagatcccacataccttgggcaccaaagcccacgcaccacaaccactgagcccacgtgctgtagagcccgtgctccgcaacaagagaagcctctgcagtgggaggcccgcacactacaactagagagtcgcccccactcgcctcagctggagaaagcccatatgctgcaacaaagaccaacgcaggcaaaaataaattaaaaaaataaccccgtccaaggcagtgctgccaaagcagctccagttatactgcttaaggaccactgagaccaggggcgggtgacaacttcctgctacaagttgcctccagttccacaggccgcccagttggtgacccaagagaccaaaggaggtaccttttaacacagcagacaccccttatctgacacagagcagagctgtggctgtttgtttcactggaaaagttggttaggagagaatcatgaaaaagtgatacatgcataccttaaccacttcaaatgaatggagaatataccaaggaatattcattcaagagccttttgaggtaggaccaaagattctctttgattttcggtccccataatttgagtttctttcttaaataaaccacacttgaaataaaccacccagttttgacctccttaaagtacatcaagaatttaaaaaatacttttaaagcaactgtatgttgacctctttcatatttttattctttttttcatggttttttttttcaattatcttacccataccaaagttatcagcaattgtcttagctgactctcctttatcaagttgttccaaaccattcagctaggtcttcgtagaaacaactgtactctctcttttcacattaatttcatcagtgtgtgtaacatttagtgaatgtacgttattagaataacaggtatgcctgacataagcagattcgagaacaaacacaactgaccctcactcgcaaactcgaatgatgtgagaaatgtgggcatacagaggagatttctgccagaaggctccagcatattgtagtctgcatcaggaaaattttcagaccacgtgagcaggttggttaacccagcaaggagttgactagagttcctgatataattaggttgtcaaacagcagatcagtcctggtcctctctgaccttctctcctagtcatcctattactcattcataccatttgtctattgtctcccctgggtcattcta

SEQ ID NO: 45173 - DNA, 1247 bp, Bovine  19866880499446
caaggttttggtaatgaaagagtggtcaggagcttttcatattatccaacctcaagtcaatatttctggggatacctacaatagaggcaggaaaagtatttcactcatctaaaagaagtgcacctttataaaaagattgtgattaaatatgaggctaaaactcccaagagaaatttcattcttgaaacttaaatactgactcattctgatcctagaaatttctcctcaaaatcatgattaaggctgttccttttgaaaacaactacctataggatcaaagcacttaacagactctgtcgctttatttcccagactgaaattctctgttccttgagttattagattcagatcgaaagcactaagcaaacagtccttgaagggacaaccgtccctgcactccacaattgggagaggcgaagaaagatgcctgtaaaaagctacagaagcaataataataaactctagctccatcaaagtcctgggcaggtccaaagacccttgtaactgggctgtttcaactctagacagatgcctattaaggactctcaacctggaaagagtcaccattctacggtgcttaaaaacaactattgtacttcctttcatccttttctcaaattgcaaaaaaggagcgacaggagacagaattccttcactatggcccactgcaaagccaggcatgcagtgagttaaataatttttctctttgtcactcaaaacccaactttaaaataacttaaaaaaaaaaaagaaagaaaaataagtggagcaagaaaggggcttttgccccttctacaatcatatttctaactccccttcgcctggatacccattctaatgctccaacgaaatgtaaagccctagcttttaggtattcaactcctcccatacagaaatcaatctatccttctaatttttagataaacagggaaggcgaaaggaatgactaggagaccttatttacaccctaatcacagacgtgcccaagcagctcccgcaacgttaacaaaaatcaaaattgtcacaattgattaaaaatgtaaaaccaaccttcaaaaggctacctctccgcccaccaagacccaagcaaacagtctgcccactcggcctcccacctcggcgcctctccccagccggggatttctcacccttccttcctcccaggcaacaccacctcaacccgaggggctggagcaggatctaagacaaaagagggtccccccaaatcttccccacgccggcagagg

SEQ ID NO: 45174 - DNA, 1370 bp, Bovine  19866880512348
ctcatacttacatcctattccttgttactttcccaagctgagagtttcatcttgcattagtcaccatatgatctctatcataatggtgggggtcaatgaatagattagctttatgggaatttacagttcttccatgcatctaaaatttggtaagtctggtaaccactgacctactttttaaaatctccccctctcaacttaaatctacacaaatataatcttaaattttaatctcagctctaaagaaaaggttttcctaagattaagttaaataactgcccccagaaatacactacagtgtatgttattctgctgcccccttgaattgtttaaatctgaccttgatgtttatgttgaaatctaaaaataaaactagcttttattcatattaaagtgagatgactgcagagtagtcagtaactgagaaatctacatacaatatgccaagaactactctaatatggcactggtcttctgtttctttgtttctatctaagtataaattaaacctagacaaaaaagcatttaaaatcatattctactgtaaggttgattttttttgtctgtttgctttggattctgtaaaaagtctagattggtatcaagtgaaaaaacaagaatactaccttgtgtgtgtctctgaatttgctgatctctcgcgatatcaggtctctcttgtcttcttccatttctatagcatttatatcctcctaaaaaacaggggggacaggtaggaatacataaagatcaatctatattgatagaaattaaaggctagatattctatacaggctttacaaaacataggagtaaagactttatatagtaacgaatctaagttaaatagtaaagaacacaagaatcacacatctggcaagtagcagtaaacatttttttaaatttattcattttagttggaggctaattactttacagatgtaaacgaaccttagtgatgagtggataagggatcagtggggccacgggaaatcggcggaagatctgcggaaaaatccacaaagattaaaacaaacagttcatatgactctgaataacagttttctgtatgtttacactataagcaatgtcagatttctgtaacactttcttgattttaaattacttgataacaaaagagatttcactcaatctatcacctaccacttctactccttccaagacccccaaccaggggaataaagaggatctcacactagcagtgtgagacctttttcatcctttccaagagagagggaacaatcaaaacaacaaagtttacctaataattcttgccacagagcagaatttttgactctctcacctcaaaccatttcaaatggaaggtgtctaggtactttctcctttgccat

SEQ ID NO: 45175 - DNA, 3138 bp, Bovine  19866880554433
cagcttttcaggccatgagccaccccatctgcaataaccctttctgtgctgctgctgcaaaggtaaacaattacaggtaaaattctaatgaagtttatctgcactgtgcctgtgatattacatatactaaagtaaaaccatatttttattattcagcccacgctgctacattcactcattttcttttttttaaatttcttcattcatttttgactgctggggctccgttgctgtgtgagctttctctagctggggtgagcaggggctgctctctagctggggtgcacgagcttctcattgcggtggttttccttgttgcagagcgtgggctcaagagcacaggttcagtagttgcagcacacgggcttagttgccctgcgacatgtgggttcttcctggatcagggattgaacctgtgtctcctgcattggcaggtggattctcctccactgagccaccagggaagctctactcattttcaaaaccagtaaaatggagttggatcttaaaaagagggcattagattgtagaaaaggcatctgatcaaattcactcctaaagccttttggggaaaactaagctgttgtttttcaatttatccaacgtagcttgcttgctttctttcagtgtcagaataattctttttttattcgataaagtgtttttctgcatttctatcttgcttttacctcagaatactagcatcacaatcttattttggtgagggtgcttatgagagctgtgaagaaactgtgagaatggtttgagcaccttcccttttgtgatctggttaaatttgatctttaaattggaatttgtaaatcagaaaatatagcacatagagtcatgtgcttcttaaaacaaaactcaataagaaagttaagtagataaggttttctcaataatcaataattttagaagaacatagaatattcagctaacattgtaagaagtctaaatacctttgtagaagtgtgagcctttcagtctttattgttcactgtttactcaggttctctctccattgatttggttagaatcaatcttaatttttcccctattgatctgggatttatcagtgtttgtcattttttttttcttttccttctcaacccagggatcgaacccacattacatgttggattctttaccagctgagccaccagggaagcccaagatgtcgtttttaaattcactaattttcatcacaaaatatttgtgactttcttgcattcagcctttaatctgactagaaggagaaaagtttagttacttggcaaaagttaaaacaatttatttagatgtcttagcatttatcgctctctcgcatgggtgcacacacacacagcacatatgcacagcctctgccgttgtcttacctcctgatttctttatctcctatcaaaagagagaaattttttttcaacataaggcagctgtgaagggcatttttcccaccagaaaggagtttaaccaactgttttactaaattaatctttagatttcctcctttccagtagttgccactatttcataaaattttcctacagtatgaaattgtgtctattttgttactctcaggataccattcttataaatctatacatataaatatagcatgtcatttttaaaagatgttattgttatataagcagaagtaagtttatttcatcactcatatatataaaaggcaaaatacaagtaaataatctgttttggtatttagctccagacttcttaaagttcaaacaattgtatgtgaaaatgaaagtcgctcagttgtgtccgactggtttgcgacccccatggactgtacagtccatggaattctccaggccagaatactggagtgggtagcctttcccttctccaggggatctttcccaacttaaggatcaaaccccagatctcccacatttcaggcggattctttaccagctgagccacaggggaagcctgagaatactggagggggtagcctttcccttctctagcagatcttcctgacccaggaatcgaactggggtctcctgcggtggtaatcacagtagctgtgtaataggaatcttttagcccttgccagttataactagcattccccacattgctgtgtggcctgcatgatggccacgtgctgtgtcaccatgaggctcatctgagcagtcctctgggtggacgttaggactctcccacacccagttgagtgaagtcagacttgctggccgtgcccctcactgccgtttttgcctctgagttgtgagactagatatctgttagttttgcccggtgatggctacaccacataggggcaagtcaggtcactccacattccctcatggacaggggccctcacctggtgggaatgcacagagaacgtggggactgggcagttggtcttaggcagcccacctggctcagcctgggcagtcacccacagtccacctcccctctccaggcggataccaacagtgaccggctcttcactgtgaacgatgtcaaagtcgggggctcaaagtacggcatcatcagcctgcacggcctgaagacccccacattcagggtgcacatgcacgaaaacctctatttcaccaaccggaaggtatgctgccctgcgctatagccttggcagccgctttgcctttggatccagggcactgtggtagttggtcacactcagaggagaggagagcttggtgaaggaggcagggctccattacctcattttcacaagggaaaacgttgtgttttagctcctgggaggtgcgccacggtgggcagagggtcctcccactgcatcatcctgtgttccatctcccagccagtctagccagcactgaaatttacataaatgtaaagagccttgcttgctgactagcgggcagcctttacattgatttggggtgatggcatctgtaagaagctgtgatttcctcttcggttgagacctgggccacaagacagacacagcttgaaaatggtttctgggttaagtgagatccgttgcagagaatccatcccctccctggacgggataccagatgcctcattatgaggcccccatgctgatgatgaaggaccccagcccaggagttgcttcctacccttgccctcaaggttctacgcaggggcagggagctt

SEQ ID NO: 45176 - DNA, 1152 bp, Bovine  19866880607853
tgattcatgtaagtcctcctgatgcttgtcaaggtctgattcattactgactgccgggctcttcggtgaggttgtgagagaaatacgatgcttgtgttaccagcatttgagaggatgggtggccagcatctgaagaggtgaggctggttggtcttggagttctctttctgatgtcataagaagttactgttgccttggcaaacgtaagccaacagttgtctagggccggtgacaatggaggttctatggggatttgtctcatggtgatcaggctgcagattgtttcatgctaagccttgagatatttagaaatgtcctcatttttctgaagatcttccagagaagtgaatcaggccacttgagtttggaacagaaaaaaccttatgctgtcactattattgggctgcaattttacatttactggggagtgccatgccttctgagttcaacccagctgttggattcatgctaaatttgatatttttcctaagaaaaagtattacttaggttatcctttcagttacctatttaaaagagaaaccgagggctaaaaatgctcttctttgggtttcattatacatctttagtagcttctgcgttccttttttagctctcttttttttctttcttattttaacactgcatttggtacttaagcatctttttgcagctaaatattcacccacaaatgcaaccagccatgaagaccagggagctgtcatggaaaggagagaagctcttatatcccttctgttagctggatcagttggtgagggtatctgaaggataaaattaaagaattctcagcataaaaaataaaaatattaatcgtggcagctcacggtttctgagctctcaatctttgccaagtgctctatggagtaacttcatttgatctcacagtgtaatccatggagacccctgctccaatagccacccccattttacagataaggaaattgaggcacttgaagagctaccaactacaggctgaaataattttttgtggggggtcctcacatttatgcaaattttccatttggtttcatgctatacccaagtttattttttaagtaaaaataacttcctgggacttccctggtggtccagtggttaagattctgtgctttcactgcaaggggcagggttcaa

SEQ ID NO: 45177 - DNA, 960 bp, Bovine  19866880623299
cccgcccccccgcctcccccaccgccccggctcacaccgcctttcccgcttgcttcccatgcattatgaaaaataatagggggcaggagaccgggcgaggttattaccaactcataaatcaactgggaagctctgagggttgtggtgaggtgtctgagctgggctccccccggtttgttatctcacccggggcccccaccattgattcataacctcataaccctccgcgtccgaatcccaagtcttctatctaattgtcacccgccgagtacatgatttgcaagaggatgcgggcggtggcagaagtgggggtggaggagagattagttttgtcaatcaaaagcgtccagggcagggaggtgcacacccgggatttagctcaacgatcagcttattaaaggggaggctggctgtgctacacatattatacatttcgcacagggagacggaggatctcggcctctgtgggggggcgggtagcccctgctctctgagggtggctgccgcccaggcccgccttccgccccatccgaaggcagaaatgaaaaacagacaagcatatttgcagctttgagggagaagtgagctcatgccaggtgtccactagccacattggagagagcgtgacaaacgttctgaggactgtggctcctttccaggagggctggaggggtcccaaggctggacggtgtcagggcaggtgctgtctactggtcacctcatctgtgcgcctttgaacctgaaatgtggtctgaggatattgaaattaatctaagaggctcaggctttctggaagggagtaggagaagcagtctttgtgacgcccaggtgtgcaggctgcaatcactttacctggaatctgatccatctgactgcactgtttggggataatgctgacacgcttccacggcactgatctaagacttacgtctgcaaagtgctgctgacacctgccatcac

SEQ ID NO: 45178 - DNA, 1204 bp, Bovine  19866880689756
cggacgcgactgaacaacaacagaataatttataaattcttcaatattctcaaacactaaatagtttttttctctaggttttgaaaaacacaaacagcatcaaatatttccacaaaatgttttcaatttaagctagaaatataataaggaaagtgggtagttacatagtaagactaagcttatttctgctgccaagtttggtgactctagctttgttagacttttaggtaaccaccagcttttaaaaggtacaggcgatgttaaaagattcaccattctttaaggacaggaaggtaccagaagaagattcattaatatttaatttagctcccagaaaagctcctgttaaacatggagtttgccttctttttataaaagacctcagatgttaatgaaaaaagatgacgtgcaaaatgcatcaagacagttattagattagagaataaaactaatttaaaaaacaattatgattcttttacctgctaaaacaagaacatatattaaaacaaatatatcaaatagtgaataaaaaaccaacatattagaaactggtagtataatgaaactagtctaaaaccaagacagagtgcgaaagacatttacagagacaatgggaagaaaagacattttaaaaggtcctcttgcaccagtatcaagcaagataaccaaaggcccaaaacgctttttataaaattggtactcctcactctgcaactatgtcatcaaggcactgaaaatgggcaacagtcctttctttcatttatcttatacaatctacacccctaagtggctaagtaaattatgccacaaagtaaatgaattgaaaacactgtacctaactttatgaatataatgtaaaaaaaaattaaacatatctagtctctgagaagtatttgtttaattatatcttttcctttgagaatataaagtatgttgataacttctaattgaagttaaagtaatcataaattttaacaaatcacttggaaggaaaataaaaaaactgtacttgcaaattatcctgctacttcaatcccccacaaatttaaaaaacactagaacattacatttttagttcaacaatgatttgagtgataggtttaagatgtttgttttcctatttaactggtacatttgagctacataattctttatattttaaaactttttggcattcaaacttgttccagatatgctatttctt

SEQ ID NO: 45179 - DNA, 1166 bp, Bovine  19866880733604
gtgtttggggacttccctggtggtccagtggttaaggctctgagcttccacttgcagtgggtatgggttccatccgggtgtgggaactaagttcccgcatggtgtttgatgtggctaaaaaaaaaaagctaaaattgatgttttaccctagtgttatattaagtgtgaccgcaaatttaattgcaagttcaaatgttattgtctttcttcactttaggtcttagtacccacagtgtccatggttggaaagcatttgggagcaagaaaggatcatccaggcttgaaggctaaagagaatgatgaaaactgtggccccaccactacagtttttgttggcaacatttctgagaaagcctcagacatgcttataagacagctccttgctgtaagttaaactgtttatttttcattaaaaaacttttttgttgttaatttcaggcttaagaaaaatcagagaagactgaattattgtctcgcttatattttgaaaagtttcaatcctgcaaaaaagttgaatagtgaacacctttgcaacacattttgccacatttgttttctttctctctctccacacacacgcctctcagtttttttctgaatagtttgggaataagttgtggctttacatttcacctctgaatacttcttatatctcctatgaccaagatacttgcctgcatttttcacacttaggaaatttaaggctgattcagtattgttaattaaaatacatacagctcatatttttaccaacagtttctataataggtgttttttgtttttggtctataatccaatcagggatgtatatacattgcattaattgtcatggttctttagatagcttctttattataagttccctgcctctttttgtttaacttgtttttgtttttcgtgatattgatgttttgaagtgtctgggtcttttgcagaatgtctcacccgatttgaatgcattttttagaatggccatgtgtgatgactattctcaggtgcagcataggaagaaacaccatgtctcttggttccatttttgatggtattaagttatttgttaaggtgatctgatctctccattttaggatatcttttctccctttgtcattaatgagtaacctctgggttaatattttgagactgtgtgagttcttttctttagaagc

SEQ ID NO: 45180 - DNA, 1241 bp, Bovine  19866880762568
ggcctcaaggatgtcctggaagttagcaaactttctggctggaagatctcagagaaaatcctaacccagactcacggaggacttgatgacctcgccttgcgcacggccatttcctgacatctcagtagcatccctcccgacaccccactggccccgggagctggtctggactgtgtccccagttgaggcccccagttgttccctgcacgggggcttggctctttgaaagcaatgatcaggcatcgcccaactgttcccaagggcctggctcccagctcggtggctcccactccagcccagaagcaagatgaatgactcttctagaagcaaacacccctctccccttgctgctctgaggaggcagccccatctctcttgggcttctgtttcttgtctctcccactgactccctgcatacagctctggctgcttctctcttcctgtttttttttttttttcctccgccctgttttgcttttgttttggttcattagctgcggctgctgctgtttagaatccatgtgttatctgaagaattttttttttttctgtatttttctccctatcttttttttccctaaagccagaaagtgagcaaggtcgtagaacttccttagaaaagttcactcgcagtgtggtaagttcagctggttttctttggttttttggctttctttccgtttttctcggtggtggttgtcgtttccttcgggaggagagggagcccagtgctcttccctcagcacacccacccatggtcttctgtgagtgtcggtggcttctgtcctagggaccagtttgcaaaagacaaaaggcccagcagctccccctgcagacgggtgcacggccctcccccgcctcacccagcccctggcccaacatttgctctcctgtgcaagggggcttcgagaaggaaggaccacccctgccccacccttggggctgctcggtggatgcaccttctgcagcagcccagggagaaggccatctagctggaccatgaaataaattggctcagaactgtagctcataaaaaaaaaaaatccaaatttccctctgggactctggcagccacgcgggtgcgggaggctagctgctgctgctgtgccggtggcttttgtgtgtgcaggaggcggccgtgctgcatgggttctggcggtgaggtccagctggcgtgtgtgcgtgtgcgtgtatgtgtgtgttggtggcctctgcatgagttcccatgtccctgacagccc

SEQ ID NO: 45181 - DNA, 1244 bp, Bovine  19866880777112
tcaacggggcatgaccggggaccagcgctgggtccagctccgagtgctgggtgaggcgcagcctgagtgggcgggtgcgtgtggccagtggcctctggggtcaggaggggcaccgcggggcatgccgtggctgacagtgccccctccttgggcccaggggagctgactatcacagggctgccctccacaatggaggtgccggaaggggacacggccaggctgctgtgtgtggtggcaggagaaagcgtgaacatccgatggtccaggtgaggctctgtccctggccctcaggccctcaccctgagctccacagcccaaaccagggccggggggcccacctttgtgcagaacgttgctgccacctgcacccctccccctcacgtctgctcccggctcctggcctggtgccaggggaaggggctacagcgcccgcctcccttaatggggaagccccaccaggaccactctcttctctgctggtcgggctacacaccagagcttctcaggctcggcactgtcgacgttttgggctgatggttttagttgtcggggtgcattgggggatgtttagccgtgtccagcctcggggtgcctgtagtactccctcccacgtcatggccacagaaagtctccaggtgttgccagatgtcccctgggtggcggatgctctgctaggctgagaaacactgggctccactcagctctgggggctttgggtggtcttttaccccaagtctgctgggcttttattcattcagcaaacagtttgatgcccccttcctccttgcagtatgtcaggacgacgctaggcactggggatcctggtgtaatctgagcccccccaacactccaggtgggaaatagcccagtatcccccaggctcggaggaggtttgccctgagtgtgtctgggtcagtgggtggctctggagggagccttagacggcctcctccccggccctgggagaaccagctcagcacccgccagggccttggaggttctcccagcatcctttcccctccaggaacgggctgccgggtgcgggccgacggccaccgtgtgcaccagtccccggacggcacgctgctgatccacaacctgcgggccagggacgagggctcctacacgtgcagcgcctaccgtggaagccaggccgtcagccgcagcactgaggtgaaggtggtcccaccgggtaaggaagggccaccccaggcagctgcttgtcttcgggagctggccgtgtg

SEQ ID NO: 45182 - DNA, 1388 bp, Bovine  19866880832540
tgtgcaagataccaccgcaagtaggggactaaaacatcatggaggtgggagcagaatacggcagggcagcctggcctgatgggaggctggagggatgcctagggacattggtcttgagagcagtgggaaaacacactggaggttttaaataggcatgacgtgatcagatacgaattttgagaaggtcactcagggctcaatcagagaaacagaagctctagaacataggactctgtgtttgaatatcactgaagtataaatatgaatatatgtgggttttttttttcttggccgcaccacatggcttgtgggatgttagttccctgaccagggattgaatctgtgccctcagcagtgaaagctcagagtcctacccgttggaccacgagggagttccctgaacatatgtatttgctacaggggtttgatgtgacccaattgtggttgctagttgagcagtctctgtaaggctattgccttcccatctagtcacctgatgttggatctcggagtctgcaggatgggcattcaggagggaagatggatgtaagatggagagagaggaatcactggggtcccccacacactggaacccataagactggaaacatgttagttctcgtcacctcccttaatgacacagtagtcctgctggccgatgctcccatcatcagagagatgatcacttggaccaggagtcagaggagctaaaggaaaatctaggggaatgtgggagttgcaagcctggctgctgtcccccctcctcaatgatgtgcacccccagataagggccaacgtgtatgtcctgccgctgcccttccactctcagcacagggagtccccaccctagctggaaaaactggaggaaagtagcctggaaggtggttcagcctcactaagatgacagagctgcccaggcagcctggctgcagtgtagagactgtgtgcaaaccttctgccttcccctctggcagctcccaccctgcctcctgggtcaagtgtgcactttgaggggacataccttctccatctgcatgccagttggttggggggaaattcagaattcccaggtgagctgccaacaggcagagattggaaagaagcagctaataacattacaagtccatttggcagcaatgcacactccctccatcacaacgagagcaagtggaggggaagagactctcctaatggcccaatcaaataaggagtggcagcttctcagaaacagagacacagactagagaaaaaaatgtatggacaccaaaggggaaaggggtgggggggtggacatgaactgggagtcatgctatgtatatatactatgtatgggtatatattgacatacatactatatataagatagataactaatgggaactactgta

SEQ ID NO: 45183 - DNA, 753 bp, Bovine  19866880839518
gcacctggccaggagcctgccctgggtagggagatgggagccggaggagggggcgaagccctctctgaatgcttcagctgtcttggggctcagtctgattctgcacgacagataattccagagtgagattgctgacgtgataaaaggatagcagatggttctaatactttattttcagaatgtatgtttcccaacattctattttcttgcaactccttcaccccagacttcagaggagaaactgctagttcctctcacccacccccaacctcgccttgagggtttattccctttgtggatccgcagtgtggacgatggctgatagcggctgaggcttactgcgagccctgcactgctttccatgtattctctcacatagcctcccagctgtgtggtaggtgggctgccgtgatcgtcctgttttcccgagaggatgctaaggcacagagagattcagccactcgcccaagatcacacagtcaatcagcagcagagcttggatttgaacccaggcagttcagatcagcttacccatattccaagacagatcctgtctctctgaaggaagggttgccctagaagcagggccagagctgtcgctggcactaaaatgcccactgttgaatgactaaccactctggccaggtttcctattaatagttacctcagaggggaactttactcctgactagagctggctgggtcctgcattcactgtggcagctcttacatgaccagggtggctgtttggaa

SEQ ID NO: 45184 - DNA, 2417 bp, Bovine  19866880852955
cagactaattgtttagagatttaagttctagactcaacccttcaaatacctgcaagactttgctaattttcttaatcaccatttctacctctgtaaagtgatattaaaaagaaaacgacctttccctgtcattccctcactgggttgttgtagcaaacaagatagagtgtcaagtctcctgagtgctttccgctatcgataattctacttcttaacagagttttacttattgacagtttcaagtgcttttataaatatatccttctatgaggtctatttaccctttatctatctgccttctcacattccgctgtctggtcaccatattttcaacaacaacaaaaacaaggtcggaaacagttaaagttatccttgatggcgaggagaaaactgttgctcaatccaagaggtggtatttctggcactgaggattccatgtgactaaggtcggacccaacatcagcctgacttactctctgggaccaaagtcccaacggagaactctgggtcctctctaggctgcaccaggggctgccagctgctaaggatacagcctggtcctgctcctcttccagcagcttctgcccaggatggaaccaaaatctccatattcctaagaatgactcttccaacagcctcagttcctgccttgggccacgtcatgggatcagcctagccaagttctgagcccaaatcaagcactgctgaaaccagtctcagcaactcctcctacaacagcaggaccaggttggaagattacagagtgctctgagcactttgggaccctcttggattactgccctcttccaaactccaaaacctttggaagtcataattctgaggtgagtaccaggtttccttgggcttcccaggtggcgcagtggtaaagaatctgcctgccaatgcaggatatgtgggttggatccctggtctgggaagatcccctggagaaggaaatggcaacccactccagtattctttggaaaatccaatggacagaggagcctggcgggctacagtccatggggtctcaaaaagtcagacacaaatgagcacacatgcacacacacacacacacacacacacacacacagacatatcaggtttccttagagccaagagtctcagagcagaggggaggcagagcaggagagccgctgcccacgaagcccagggctaccctcatcctgtgcctgatgagggcaggacagaggggaggggtggctgctactgaaaccagggggctagagctgaaggggctagcagctctggtcctgctcagtgtcctgagtcttgcttacagtaagggcccagtctgtgcatcagcccatcctccctgtctatggtggccatgggttatctgttgaactgccatgccacctccttccagtaacaacacctcaattttcctccagtgaaccagctctccccaccatcaattgagtaaaatcaactcatttccatccctcagctttagggagagggttgtgacccagccctggccaatgagaaaaccacctccccaagccttagtggttgcatcaaaggtaaatgaacatgtggtgcgaggcaggcaaattcgaatcggtcttggaatttctgagggaatgaggcactttctcttggtatgaaaaaaaagctaataaaaatgtgtatctgatgctgctgggagactccacgaagcaggcctctctgcaaaggaagtcagtgtagaagaaagcagaattaagagagaaaggagaggtggagggaatccagatgaccttgttgagcccctagattcagtcccaagtgaagcagatatactcctgaactttaggtacacgagcccatacattcctctttatgcttaagcagtttgagttgagtttcttgccgtttgtagcatttaaaagccctgactagtgcacagtccagggtttggttttaccgaaagaccctgcacaaggctgaggaagaagcctggggccccatccaaacagatctaggcgggcaacctaagtgcttgtgagatgaggatggttcactggagccatcagtgttgccatacatcaaacctgagaggaggtcagagtcagggaatgctgtatacggcagctcagtaaactgcactctccagcttaccacagtccccaccactgccttctgtatctaacaagcccattttcctctttgtactttacctttctggtcccataagtttaccatccatcactggatgggtgggcagatggatgcatggacagatgaatggatggatcagttaatcaatcaatggatcaattaatggatggatgagtggatggggccgacaggcaagtggctgcatgtgtaagtcacttcagtcatgtccacctctgtgcaagcctatgcaccgtagcccaccatgcttctctgtccacgggattctccaggca

SEQ ID NO: 45185 - DNA, 1061 bp, Bovine  19866880871551
tgtctggcctacactgaagcagctggtcattaaaacttacatctttggatggacaacgtgaaatgctctttattaatgagcacacatcttttgccttagaagaaacactgttcttactggacaatgaatcactgaaatttactgagcaaaatcttttgagaaagtgtttatagcatacagatcaacactggcaaccatcaaatacatacagctttcagtctttttacagcatcttcacagatgtgcattcctcttgattcatcaacttctacatgcccaaggtactgtagaaagaagataagagttagggatattgctgtgtttactaagtagctactatatggtaggtattatgtggtagaaaattgaatactaaaattccactcaagaaactcatagcattacacaacagttaagataatgtgactttacttattctcgtgtcctcatatgaatgagatttagaataaaggtctcaaagagttgttaaaggggagtaggtgaaaaagaacatgataaggaaaggtaaatgtcaggtaaacattcaggtaaatgttacctgaatctagtgaatctgaggcataaaagcttgtgctagacactgtttatctctagacataaaaaataatcctaaaacaaagcatgtgtgtgtgtatatactgaaaaggtacaaaggaaaacaacagctattcaaggcctgaagagatcacatactctttttatgggaagcacataataagagggctgaaaactaaaagtttaagacagtacatttgagctttaaaatatgtatagaacttgaagaagccatatgggaaaggctggaaaactattttaggcagggagaattaaacaaaagctataggtgtggaatagaataataattacatcagcaagtattcctcatctggcaagaatatgaggtatatgcagctatgaaacttgaatactgaaatgagtctgtactgaaccccagagacaatggagagctaaaaagcgcctttttttgcaaggcagtattattattcaaattatatcttagtatgggaatagtcttgggt

SEQ ID NO: 45186 - DNA, 1498 bp, Bovine  19866880872573
catctgcttgattttatgaagaaaagtattccacattcagatttgatttgagttttagagcagaataacattatactaatgctgcagatttttatcatttctattgctcccctgtgatgtgttatggttggatggcatcaccaacgcaatggacatgagtttgagcaaactctaggagacagtgaaggacagggaagcctggcgtgctgtagtccatggggttgcaaagagtcggacatgactgagcgactgaacaactcatgcgttatgagccatatggtaacccggcaaattcacttgagttgctgaaactgcttcttttcaggaaggttcttgaaaggcttagaactgctacctgaaatggaagttttagggattcccctccccaaagcatctccttttttcaggaacagaaaatcctaattaccacatcccctgcaaaaggagtacatccatccccaccaccttacactttttattgaatgcaatttagagcttagggagcttttgagtgaaaatcagacatcagtgagatttccgattttccacaatctgctcactggacgattcctcttataactccagttacagctgctcctcttcagaatgtgacaaagcctggcgggtggagactcaaaagtccttccagctagtcctgactttgggttgtaaacaatcgcagtgcaaggtgcttccggaaggcagagagacagaggccttcccatccagtcccagcaactttctaaagaaggacctccaagtcttagagggagttgaattgaaacagttttggctcgccctcccttccttgactgccagaacaacaagctagaagcaacatcctatagaataacagcaaaaatagcacttcacacatggctccctcacaaaagcactcccgaattctgcaccaccaggcagttattattttactttacagatgggaaaattaagacctagagagttgacacagtagagttggaggtcagacccaagcctgcagtttgcacttctaagagcagaggggtcctattctgaggggacttttaaggatgatgtgacactattggagctcatgaccatgtcttttgatggatgactttcacatcctgggcttgggcaatttgtctggttagaaaatcatcttcggtgaggacatgtgtacaaggagtttattgctattttgtatgtaatggccaagaattaaaactcagtgaatacctgtcagtaggggaaatggtctgatagcaatggtaccttcatcctgtgggtcattacagaaccattaaaaggatttgagcaacatatgacagaataaacaagagggagaagagcatatatctctcccaaaacccctatttatgtatgtctgtgtgtgtaaaattacttacatggtatgaggaaaaacatggaaggacacagactaaaatattaacatgggccgcatggggaaagcagggtcagagttggggtgctgatgtggaagacagaatacagg

SEQ ID NO: 45187 - DNA, 2319 bp, Bovine  19866880890338
acaaccattttgacataaaaccttccagcagtttttgggtagaaagtggaaacattcatagaacttatatgaaagagctgggtaaggaaacttcatatatacattgtatagctgcttgcatttatctaaatttaaattttcttcatattagagaaaaaaatgataatagcatttagtccaatttgactcgagttcagtattttctcaatttgtccaccatatctactattcattcctgattagtacctgaaactgcactctccacaaaataatcatcagcctctactatcacagatcaggaagtgctctgataagattcaaaaatgagtaacaacataatcttctctaagatgttctaaggctggctgggaataaagtctcgaatattggagctattcttgggcatccttttggaagattacttttatgttcttaatataaatgatacctatcatttatcatttgcctcaaaaagtgttttttaagatatacttaaaaagaaaataaaaaaagaaaaaaaaattaagctgcatttatgcagtctgttaggacaaaataccagtactgacactgaactgccaatcaagtagtccttatatcacttagcactggcaccatgtgggagctggtcagaaaggcaaagtctcagggccaccctagcccctgctaagtctgcattttaacaagatccccctggtgattcaggcgcatgttaaagtttgggaaaaccactttcttctttcttcctgttgacagatggacacatttaaaattattttatttacagggtcaaatgcagaaaaagcatatttgtttcctagctgccacatcagaatggctgtcaagactttcatgtaattttataacaacttgaaggggcaatatatagattaactaagggttccaatttgaaattaatctatggacaaatggtaaagacaacccagaaagttcaagcgatttagtaaacattttgttaagagtaatattactgacactagaatgtgccagcttattctcatgcttatacatggtcggttctttacatacaaacctgaaaaattctgaagatcctgaagtttaagctttgtggcaaaatctgacttgaactgacattaaacaattaatgtagcagtctttaactcaatgatcagtcagatcagatcatttgctgcagaaatgttaatatataaatctgggatcctgacacccatctcactggaggtattatgcagtatatggtatgtgccctcaagagcttcacatgagggcccttttaaggtaaatatgattgaaagagcagaagagaccaaagcggggaaaattaaatctacctgaataaacttccatgctaatgctggctaaataaaaccaacctaatatgatgtctcagaagcaataatatgtaagagaagatagagaggcataataaactgctcgaacaaggagttacactgggggattaatctgagaaaagactggcaaattaatttgtaaatggcaaggaacatgtttctacaactttcccttcagaaactacaacttaaaatataacactgaaaggggctatatctccatagatgtctagattaatccaaaataagggaaatggcctcttctcatcttcaggtactaatacttaaaaatccagtccatcaaaaattcagcccatattttcaagttaagtttctactatgcaccgcataattacaacatgatgccatttatttaacaagactctgaaagaatgagtccccaagatcaaatatatacatttttaatatttgatatatttacataatggaaccatgcacatcatggttcaatgttaagaacagtgttttcaaatgtcctcttaagatgtaaaaaaaaaatcttgtaattcaagttcaattatgctttttatgttttgttttttaacacaccccctcagtctttttaaaaaataaatactcagacatgggaatagctgcacctaatttctgttaagaactgtttaaaacttggtacatttttgggtaattttgctccctggtgaagtcctgatctataataaagaaagcctcatgtatatctctaaggacacgatcagtacagttttgaacgttgatgagcagagaagtaaacaaggtgtgtgcctgcatatacacacacaagatataaacccctgacagacacacatgagtggtaactgctttaaacgacttactttatcctcagaaatcagatgtaaactttgtaaattgccatgctaaattgctacagtattttgtcaaatgttttctagcctgtgaaaattgcctaattttatcttttgat

SEQ ID NO: 45188 - DNA, 1063 bp, Bovine  19866880893911
tttccattttcatgcgttgaagaaggaaatggcaacccactccagtgttcttgcctggagaatcccagggacgggagagcctggtgggctgccatctatggggtcccacagagtcggacacgactgaagtgactcagcagcagcagcagtaggtctactgacccccacaccgttcttctgttctgatttaaatcctctgaaatatttaatactcatttcttgatttccaacccccatattcactgagtcaccaaggggctttgtagtctaccacagcatcctgtgagtctgtccgctccctccctcctcactgccagggccctaccctggtttgaggcatcacgacatctttctttggtgtctagctctgacctttctttttccttcacaccggctctagtcctccatactctgcacgcccaagtcatgggggtccactcgctgctccctgaacaggtcagccaccctcttcttcatctcttctcagacagaatcagttgcttcttgcaatgtgtgtgctttttgtacttgtgcgcttggctttgtgtgccacttggttagttccatgtctgtacctcccaccagaaggtgtggtcttcgaggacagaaccacttctcctcaactctgtaaggctggcagccagccccacacctgccacacggccaatcacaataaatatttatagacgcaaatttcccaggacgtgccttccatcagaactggctccctgggtcgtttatcaggtcagccaccaaatcctgcctcattcccacctacattctttgggggcagatgcatgcctgccttctgccagttactccttcctctgtggggacaactggctggccattcctcttctgccaagcctgaggctgggctgtggagggggcgggagggggcaggagggaccggggattgcacagaacgctgtgtgagtgaactggcagaagttctgtgggctcaccagctggtaccgtgtgggagagagccaaaaggaaagttcatttttttcctgcccaaagctcggagtcctgagtgcagtcacgagtctcagtgctcaag

SEQ ID NO: 45189 - DNA, 2838 bp, Bovine  19866880933064
aaaaagttgtatgagttgtaagtaatcttgccaaaggtaaaagggttagctgtaagaaaatgtacataagattgatttatcattgatgcctattgaagtaaaagagaggaagggcctggaagttgcaggtgggatccctagctcacttggtatcatttactgtaagtagcacactgcaacaacaatcacgcttatgaccagtaccgtcagctaggtagtagttttaaataaagagcaagcagtattgtcctggttttacacctgtaatgaaaaattctaatgtcattattttaatgggttcaatctaaatagagaatgtcttttcttttctatactgctgcagtttccttatgttaatcctttaacactaaggtgacaatgatgtaatcatatccatgagacgggaacgcaggttaccgtgttggtttgtcatgtaggtcttggtgggttttgttttgtccttttaagttttgttccgagttttgtggggatggagggcccagtcttgttaggactgcgtgtgtgtgttatgtgtgcgtgcgtgcgtgcgtgcatccctccctcttgtggtgagccgaacatcctgttttcagttgtagccacttgacctctggtaaccacgtaagatcccatctcatttttactttcgaatgttggccttacaatcagatgtaagttatatatatatttgtactgatgagaatttacaatctgctttaacaaaaataaatgttcgtggtagaagcttttgccatgaagagctgttctttgcgcttttctctattagcgaatgagttttagttccttgtcttgtcctctctgcattctactactgccgcagatctctagtttgatggctagaaaaatctttcactggggctagtattctcttaaagttcctatctgtattcatactcgagcctccggtcattcctaagcacatctctgatgtcagattcttgctgctccaagtgcagacttgaatttggcagttgtgtagagacacagaacttctgccctagcccagacctagttgtcagaatttgcattttaacaagactcacattctgagaatttgggctgcagcagtgactctgaactgtggatatatatgagagtcatctgggagcttttaaaaatcctcatatccagcccatactccagaccaattaaaatctccgggcagtagacccccatcttcatttcttgaaaaagctcccagtgtgagaaccactggtctagactgagttttactctcaccataccccaccactctgtgactggttccaagagctagctaaggtctggagtatgccaccaatttaacaaatagtgatttaactagagaacagtggagtccaagaaagtagtccttaccttccaatttctatagccaaaccagccatggtacacgggaaggggatgcacctcaatggtttttaaaactggaaagaaaaaaagacctctgtcctggcccatgtttctgttgctgaatgagaggtagaccaagaagtatcactcaaccatgaagcaattgtttcttttccagctagagtgttggtaatagaaatcacctgtcccggtaatgctggtttttcctgtgccccagaaagacctctgttactaggcccagcccgtcctctggggaattgggagaaggttaaagtggaaagggacgtggaagctcattgaaaccaggcctcttgtcttagcatcaaggccttaagaggctgagaggaagaatgacctaactctgaaaccacttccctcttctctttcttaacgtcgccctcccttccactggtccccctatcctgttggtactgtgttttacaatagcctggtttttagttttcattatctcccactttgctgagggctttcaccaactttgtgctagtatagcaaccagctaaagctggtcgccatattccctaggaagggctagagagactgaagcgatgaaccatatctggaccccagatgagacctagttctagcaaagaatgtttccctaacatacacaccaggagttagttaccttccccaatcagataggacacacctccccacccagctttcagcaaagtgagaaccctggtagctggctttaagaacacagtgagctgatcctgtataacaaattatagagagaaactgtcaagtgaaagatgtccttattgcaaacaagtggccgcttcttgacatcccagcaggcaccggtgaagccagagaagcggacaccgctgggaccgctgctgctggcactccacggcagggggcggctctgaccaggccagtgtctgcggaggagaactccctcctcagccagagaggggagaccgagagccttctcctcccagtgctatgagctgtgtccctgctgccagacgggctgcgcgggcggctggacacgggagcagctggcacagcaaaagctggagtagtactcgttgccgcagagccgggcctgcaggatcaggtcacagttggccagctccggctggtcgacacagtccctgctggggtcccggggctgggtggccagcactgtgagacaccggggggggagagggtggtgagaaagttccgtgtggctggaaactcacctgccctgtcatttccctaaaggagagcagcgctgtaaccgccaggttcccagagatgccggtcactgtatcccggtaacacctgtgtgtccagctgagggcacacggtctgcactgccctgggccccgcttcggcatgcagtgggcctcctgttatccttttatagctctccccaacccccaccgctcgccccagtgcacagcccatcgcagacccccagatatgact

SEQ ID NO: 45190 - DNA, 4395 bp, Bovine  19866880993653
tcttaggaagcaggcactgttaactcttatacaggtaagaaaactctgaagagtttaagcaacttgcccaagacctgaggcatggacctgggtctgtccgtccaaatgaacctgggttcaaaaaggaagtgtgaaaagcagccaggctgagtagttgggagggagagggctgggcaggtaacaaaagacctattctagacccctgtgtgaagagtgtggtgcggatcctgtaggtgttggggcattatttagggtatggcaggatggacatttgagggtggttaatttgcaggatggtgtgagtggggaagctgcggcaggaagtgactgtggtctacgagggggtggcggtgggaatgcgcctggtcagactgagtaatgaaaatcctcacagcccatcaaacttaattaaaatcaaataaacactccggcaaacccatctcataccaagtagggagtcaggtgagctgcagggacatagcgcttcgtccttatgtaatacctgtgaagtatgcctgtgctttgcgtcgacaggcccccttacacagtcacagagtcagcttggtccttggtgccccttctcttttctcttttctcacccctttccgtttcttcctgacagcagttgtttcagtattttgccatttaacccgaaatccctctccatcctctccctctcagcagatcatttcccccagacttgttcaagaaaatcgaagccaaaaggcaaggaacttccttgtcatccttgccctcagcctcatcatgatgaaagccacctcttctgaggaccccccgccgctagcccacccctcttcctctcccattaccctggtatatttttttcacagtgcatacaaccctcagaaattatctttatgcatttgtttacctgtcttatgtttgcctttcctcttggaatttatgtgccacgagagcacagaccgtacctgtcttgggcactgcagcatccatggtctcagcacatagtaaatgcctggagcaatggaaggtgctcagacgtggaaacaaataagtggattcgcatgacttccgctggcacgcatgagttgatcttcttctctcctcctgactgtcctactgcctatttgactccatcaggttgtccctcctcaaatttatgttctaaataaaattttcttcttccccttatgctgcttgttcctcttggggttcactatcgtttaaacaaaaacctcagggtcatctttggctcttctctctcctcactcctatatacacttagtccccaagtcctgttgacttaaccttggcaatacctctggactccatcccctcatccattcgcctctcattcaggcaacagaagcactcacagggatgctggcaggagcttcctaattgacttcccaacctgtaatctctccccatgtcaagttgtccctacccacagggagagctctgcactgtttggtttctctttacttgcaccagcacctactgattgtagatccatccatctgcccatctgcccaaccgtctatccatccatgcctgcatctgcccatctatccatccatccatccattccatccatccattcattcatccatctatccatataactactcatccatccatccacctatcctttccatccacccatctattgcctatttactgagtgccaattgtgtgcactgtgagaggtgctgggtagagaactgagagcacagtctttcctttcatatcaattttcaaccttgtaggtggagacaggtatacacaaccttgaccttcacgtgttacaggtgctttttattcattcatcaactatttattgagtttccaccatgtgccacacactgcaggtgctggggatacagccagtccataaggcaaggtcccagccttcgtagaagccacatgccagcagtggacagaaatgcaggtataaatgctgtggggaaataaagtgagggtgaggggtgcatgtgtgtgtgttgccccctggagagggtattcaaagatggcttcatagagagggtgatgtttgagcagagacctgcaggatgagaaggagtggcatgtgcatacagctgggggaaaagtattccgagcagagggaactgctgatgccctttgctgaggccctgctgggctgggagtgtgctttggggagtgtgtacagggcatgatgagatacaaaggaggggaggaattgctctgctggacgggccatggggcactcctcagaggaggtactccctagcatgacgactcagcctcacattgcaccacctgtccatgaactctgagcttgaatcatgctagaccatggactttccatctccgggcctttgcttctctgaccgtctctacctcctctgtctcctacgcctcttcctggtgaacatctggttcccactcacccttcaagaactcagccacctccaaccagaatcagttgcccctctgtgggtcccagtggagcacttagcagagtgacatctggtgagctgagtctgggctggtcacttccacctgttaaagctcctcgcatgaaggaaccgtatcttggaccttcctgggtccccagcaccttgcgctgtatgggcacacagtaggtggtttgatgcgtgttgttttggaaagcatcctgttttgtcaccagacctctctctattgacatatgggcggacatacatgccccctttctacacatcagttacttaaagttccgcagttcctaatgaaagcaagaaggtcatgaaattaatctgtcaccctgatgccagcttcactcagctgactcatggcttgggaaggggtttttaaacatgcgtttctaatctctgtgctaatttctcttccctttctcagtcatctccccctcagacttggaggcgggagctgcctttggatctggtggtacctgcacctccttttgaatactttgcacagatgttttccagctttgggcctgagaagaggggaggtggtctctgatttaggaagggtaagagggaggaaaaatgaaatgaggtttcctcccctctcgaaattcattagagcttatttatttgcttgagaaaggcctgaaatacctatgttttgctatgaactggatcatatgtctgtaaggggattccaagatttttccccttgtcatgtggagttaagaatatttccaggtgtcctgggattaatttattaagtcagcaaatagttactgggttgttgtttagttgctaagtcgtgtccgactcttctgcgaccccatggactgtagcccgccaggctcctctgtccatgggatttcctaggcaagaatactggaatgggttgccatttccttctccaggggatcttcctgtcccagggatcggacctgtggctcctgcattgctggctcctccctgagccagcaggaagtcccatttactaagtacttagcactattctgagtaccggacatcagcaatgaaaaacaagagcaaaatcctggccttcttctagcttccattctagtggaggcagataatggtgatctaagtaagtaaatgactgggatggtgattaaatctatgagggggatggaatagggggtttggggaggacatttaaggtggccaggggagatttcactgaaaaagtgacatttgagggtcatctgggggaagaagattcagggcagagagcagtgagtgcagaggtcctgaggtggtccttacttaatttgcctgatgttttgcagaatagcaagaatgccagtgtggctggagtagaattagagagggggagagtagtgggaaaacttaggcttatttttggagttgggaacctgctggagggtttttacagcatcaacctagctgcccagctgagggtaaacagatgaatcaggggctgagcagggaaatgggtaaggaggcagcggctgggaccagggtggtaattgtaaaggttgtaaaaagtggctggatttggaatacatattatagataggaaggcagtttttgcagaaaaattggaagtggagtatgacaacaagagaggcattatggatgacttcgaggttttagacctgagcatgtaaaagaatggaattgctgagatggtgaggatcgaggggcagtgggcatgtgtgggcccagctttgcccttgttaggctggagatgctcagtcaacatccaggtgaagaagtccaataggcaagggtgtggatgcacctgttttttttttttttttctggctgcactgtgcagcatgtggaatttccctgaccaagggtgggacccaagtcccctgcagaggaagcgcagaccactggaccaccagggaagtcccagcacctgcccttgctgacctccacctggggaagagagtaggatgggtccagggagtcttat

SEQ ID NO: 45191 - DNA, 4214 bp, Bovine  19866880996765
agtaaagcagtcaggtggacaagggctcttggagccagattttgtctggcatgcatcattcctgggagctctcctgtccatgcaaagactgcttagctgaatgtctcagaagaggcttctgtgagaagagatgaaagaggccacagagaaactggcgctttctttggaaaggagtggttttacaaaatctagatgtgcaaactccacccgggtcattaatccactgtgctatccatttcagctggacccaggtttgcttcagaaacatttgggggctttgttttttgtttctcttctctttaaaaaatgtttggaatgaagggaaaagacatcattattttatatggaaatcaaatcgatgtttacagatagagaatgtaaagaaaagctgatcaatggtgacaaattagaagccagagatggaaagagattctctataaagtccctaataccacaggcaaatggggtttccattcagttcaataacgatatttatagtaacagctaacacggatgcagcgtttacacatgctaggcatggctctgaatgctcacatgcattaacttattcaatctccatctataaggtaaagattgtacaactcctactttgcagactgacatcgaggcccagagagattaagaaacttgctcaaactcacacagccagtaagtgacagactaggctgtctggctagaatctgccttcttaaccattataccatggagctttctaacaagcattttgttgttgttgtttagtcactaagtcatgtccgactcatgcgaccccatggactatagcccaccaggctcctctgtgcatgggatttcccaggcaagaatactggagtggattgccatttctttctccaggtgatcttcccaaccccaggaatcgaacccgtgtttccgtttgccaagcccttattatgtgctgggcactatactgggcaagaggtactaacatatacaaaacaccaactcataggttacaggattagtctgtgcagtgataaagctcacataggcatccagaggtctaactcaagaatggaaagttagaaaacactctccaaatggtggatgtaagttttcaatgactaaaaagcaccatctgttttctcagtacattctaagaataaaattccttgatcttatcttctcagtaaattataaggatcaacattccttgatgccccaccctctcttgggtcatgaaactcaataaaactctcttcattttgattggagggggaaaaaaaaaaaagaacccgtaaatatgcttgtttacttttcctgaattgccctcttgtgtaaaatggattgctcaccactaatctagcaggctccaatacagggcctctcagacggtgcccaggttattaaaaaatcaaagaaatgcaaagcaggattgctacacatacagcacatttttaatgtttacacaacaaattcacactcttcacatatatacacacacaaacttaaatacaatgtaaaataattatgatctcaagagaattacaagacctgtttcttttaaaatattattaattcagagagtgccccatggatgctgtggtcaagccacagactgtacagtggatgtcttatgatgaacaccttgggacctacacataaaacctcatgcagagataaccccaaagtttcatttgaggcctccaggaatgggagaccaagtttaatcaggtcccactactgctctatccacttgataagcctttcttaagggaagaagaataaaagattgatcccaatggtaaggatcgatgaaagcctagctaggaaccagtaatagggaagaaaggaggttcacagagctgaagactatgtgggtgaaaactccaggttgtggccaataaagtcacaggccagccaggtgtaggatcttcataatacccagaggtcaaatccagaagttcaacaaaggttatgagcaacaggcaggaacacaacctcctgcctacctgcccttgaactagctctgacccaggcctccagatgctacactcatgcccctggcccatctttgctggcctctctacaaggacaggggttcctaaaaacatgtgaaacttccaggatgtgctcccttctcccatgtccatcccatttcctgggagtcaaatgtttttagagaatcaaaaatggtgcccattgtgacatggcatcctatgctcctttccagaagagtgtgaggtccaattctaaatagatcctgtcttagaaaaagacctgaaaaaggtatgagagctcctcagacccaaagatgagacagtacagaaagctggttgaaaaccattttccaatgtctatttatttttaagctaaaatctattcactgtgtgagttgccaaggaaagttaaggctcttgttctgaagcaagagaggttctctttccacatgacacctgtagaagatggaaaatgtgataccctctgcgtatcacagaacaccagttcccggtaagaagataccccaatttctgccagggcagtacccagtgggggcagcttttccacttttctcctcttgctgaaagggccctagaaacgccaccagggccttccccaagggcaaagtcctccctggcccccagtgaggactcactatcccttttatttagctaagcagcagagtttaaaaataatttctagagctctttgatcttccctggtggctcagacggtaaagcgtctgcctacaatgcctaccatgtgggagacccgggttcaatccctgggtcgggaagatctcctggagaaggaaatggcaacccactccagtactcttgcctggaaaatcccatggatggtggaacctggtaggctacagtccatgggatcgcagagagtcggacacgacttcactttcactttcactttcattttcaagacggacaaaagctaaggttcattatctccagcagaacacatactgtaaggaatctgaaaagaaatgtttcaagcaaaattaatgatgtcaaatggaatcacaaatttccgaaaagagttttaaaaaaaggggtaactatttaggtaaaacatatatgttatatatacatgtattatatgtgtgtatttatgtaaaagcacaaaatcatccaaaaaacaccccaaatttctgaattagttaacataaaaacaataagactacatgctttttgttttgttttcttgtttttttttctttttatatattttttaattagaatatgattgctttacaattttgtgttagtttctgctgtaacaacatggatcagctataagtatacatatcccatccctcttgagcctccaactcaccctctccacatcccacccctccaggtcatcacagagcctgaggtgagctccccgtgcaataaagcagtttcccaccagctatctattttatgcatcatagtgtatatatggcccaccctctcctttccctaaagtgttcacaaggccattctctatgtctgtgggactagctatatgtcgtttacaaggaaaaagatttaggtatgaagaactagatagttttaaagtaaagtatttgaaaaagaaattcacactgaaaatctaaacagagtttcattttagtcaaaaagagtagacaaaaagcattaccaaaaattgagaaaaacattttctaatattttaatttagttattcataaaaaagacagaaaattgtttgtggacctctatatttatggaccaaaaagaggatgtttccaaatatattaataattaacatgactaaagggagacgtagataaatccaccaatatttggagagtctaagaaatgttactgtcaaattatgaagaacaaatataaagaaaatcgatcaagttatagaagatctgaaaactaccaaccaacttgacataattaacatttatatacagttcagttcagttcagttgctcagtcatgtccaactctgtgaccccatgaatcgcagcacaccaggcctccctgtccatcaccaactcccagagttcactcagactcatgtccatcgagtcagtgaagccatccagccatctcatcctctgtcctccccttctcctcctgccctaaatccctctcagcatcaagagtcttttccagtgagtcaactctttgcatgaggtggccaaagtattggagtttcagctttagcatcagtccttccaatgaatactcacgactgat

SEQ ID NO: 45192 - DNA, 906 bp, Bovine  19866880998147
catctagggattttaggccattggaacatcaccacagaagcaccaaagagcctcagtatttaaaaaaaaacattttgtgtgatgtttacattatgtatatactgtgccattcagtggtattcaaaattaaataagttaataaacacataaaattgttctggaaattatgttattgagtgtaatttatatggggattggattattgtttgacatatactgtaaaattgaacatggaatttaccattgtaaaactagaatcagcaagcatgtgtattatagaacatgaagatgaggtgagggaaagaaacatctgtggagagtgcctctggggatctcttctaggtcagatccttagtattccaacttctggctcagataagcttttccgcagccctgatgcattagatgtagggattctgtgttgtgaaatgaacatcccgtgtttcttctgagaaacttgattgacctctcaagtccactgttcctttgtgtttccctttttctaggacctcatagttgaccagacaatagaaaaagtttctttctgtgccccagataggaactttgatagggccttctcttatatatgtcgtgatggcacaactcggcgctggatctgtcactgcttcatggccgtcaaggacacggtgagtccagtagcctgaattgcatcatgactagccacagtcatcaagcttcttcccggttggctcagccagtttccactgcatttttaacaagtatatgctgttacagaacttgtaagcgcctaaacgagcccgctttcaccccttttattcaagcagttcacactcttgatgtaaccccaccactcacagaacaagatagttggctgagatccaagattattaaaggaaagtaaaagtgctctggggatggtggctg

SEQ ID NO: 45193 - DNA, 1780 bp, Bovine  19866880998431
aacgaaaatcaggggggggaaaccactaatgattcacactcccttaaggagaggctgacacagccagctatcaacagaaaaaacccatttcattcaatagactgttacttgccacaagagaataccatgctctgggagagtaataacctaattatcccagacatctggattggcacaataccaggtttcctttacaattctattcttgaattaggaaatgtttaagggaaatttccaaagcaaactaggaaaaaataagacttttatacatacactcacacaaacacatccatacagagatacagtaggaatggattgtctgctaatttccacactctaaatctcatgccatcatgagggcctgccatttttgatcaaggaggtaagggtaataggtatgactggttattttttaaatttaaaatcattcatgttggtgcctgtacagttcaatattaagtgcaattctgcataagaattggggagtcattttaatatttacaagaaacaaatcagcagaacaagattatatcagatagggtgtgtacagtagctgcggcttataaaacataccagtaatttgtacctggtgagtataaagagaaccatggtaggattcagatgtctttacaaccaagggagtacacacagcatcaacaaattagaggacaaaaaaattcacattttctacattaaaaaaaaaattacagatctcacaaatgtctttgaagacgaaaaaaaaaaatgaagtcctttgaaggatgggaaagaagaaatctgaaatggaactcttaatgtaaaagagttttacttcacaagaccaattttcttggcttctgtttcatatatcaataatctccacatcttgactataaaaacttctgcttcttcatcaagtacctagaaaaggaaaaacaaaaaagccagttacacgtgtaagaaaagcaatcaccagcatctcccaacaaggcaaatggaataaaaaaggcttttctctacgaacaagcatttactttatttatacatgtcttgaataactatttcctaaggaaaccatatgtttgttataaagaatatagtcattcagacaaattagttatataatcacctaatacttagtacagagtatctcacttaccctctccccaagaacctcataatcttaacatttactgagcccttattacatgtaacactgaaatattaaatgagaatacatctgggatacagtaaacaaaataaacactgtcattcccaagggacacaagactactgaataaataaaaggtcctttccccttggcaaatcaaatgatcgtttttttacatctgtgtctcctttgctgccctgcagagggctagggtggggaaggagatgcggcaggggggttcaggatggcagggacacatgcgtacctggggtcagtgttaatgtatggcaaaaatcatcacaatattgtaaagtagttaacctccaattaaaataaataaattaaaaattacttgggattcaaatcccacttctccctcctaccagttacatactcttggttgggatacttaattacagtgagtctccgttctcttatctgaaaacggaggatacagtagctatgtcatactggttctactatgggaattaaaagagacagtatgtaccaagtgctttgaagagtgcttagtaagtacctagcacaagccagaaatttgatttttctgaaaaatttcccagcatttctcagtgagacaaaaaaagaacttcaatcagacataccacgagc

SEQ ID NO: 45194 - DNA, 1573 bp, Bovine  19866881003818
tttatcttgaaatatgaaaactgtggagagggtctaggaatgcagtgaacatgcacaaaggtttggaaaaagacttttcatggaaggaccagatcgaggcaaggtgaagttcatacagactagcaattagaagaatgggttccgaggcagactggggataaggcgggattttgcccctgaccagctttctgatactgggcaagttctaagtctccctaagctgcagcatccttatcttgaaatgggatgataactgtactcacctctagggcggtggtggggattaagtgatacacggcagtaacagctgacacagtttgagtgtttactacctaccaggcattctgccacatgtagattgtgtttttatcttcccttgtagttcagtcggtaaagagtctgcctgcaatgcaggagccccggattcaatccctgggtcaggaagatcccctggagaaggaaatggcaacccactctagtattcttgcctggaatcccacagacagaggagcctggcaggctgcagtccatggggtcgcaagagtcagacacgacttagcgactaaaccacgaccaccaggcattctgtgtgtgcacaaacacatcagtgctcgttggggctgagcctgcagactactgctaattcaatgagtggggctctcgtcaccatctttactgtgtctaggaaacatcatttggctgcgttcttgtcctgctgagtggctcctggtgaagttacttaacttttctgagcctcgggtgactcgtttataaaatgagataattaaagcagatgatctgtaaggccttctcaactgtaaaatactgtgcagttctggaaatagaatttatttagtgttgagaaggctgagggggatactaaaatatgaacttcatatatatataaatatatatatatatgattcttataagtttgaaggatggtgaacagctgttctcttttggctgaggacagggcatgaggcaacacattttaattgtttgagattagacatttggaagacttgggagaaagactaatgtgtcactggagcaggctctagagctgcacactttgaactcatcaaggcagacggttggctatttttctgacactgagacgtaacttcatcacacagtccttccctgaagccttgatcttaaatagataccccaccccccacagcccccagcaccatattcttccttcacatttcaccctgttgttttcctccatagcactcaggacactttgcacatttattttgtactttcctggtagctcagacggtaacacgtctgcctacaatgcaggagacccgggttcgatccctgggttgggaagaatccctggagaaggaaatggcaacccactccagtactcttgcctggaaaatcccatagaccgaggagcctggtaggctacagtccatggggccgcaaagagtcggacacaactaagctacttcacttcacttcatttagcacttaatgtctgtccttttagattgtaaaccatgtaaaagttggattggtcattatttggctcatcgcctgtgtacctgttctagca

SEQ ID NO: 45195 - DNA, 2966 bp, Bovine  19866881013684
aagaagctcgttagttgattttgtttgttctaggttagtcttttactctttcccctccaatatttgttatatactttaaaatgttagagactttgtaaattgaattttttgttgggacaagtcattgataatttagttttaattacaagattcatagccacttaagtgtacccctctatacaattcgagaccccacaccaagtactttcatttcagagggtcaaaggagacacagttgctggctactaccaattttgctctctccttaccccaagaatgccttgtcaccaacttcttgtcttaatggttaggatgttgctgaagtatagttgaggtttagtggagacagccagtcacttatgtcagttttttgttagtcatccattctttgggaagaagcaaaacggtgtccttcatagcataacagtggtgttaactgactgattactgtgtgcatggcttctttcctggcaagtcctgtgttaagcattttccaaaactttatcttctttaaacctcccaagaaccttaggaagtgtaagtttctaacagtgtccccattcagtacatgaagaaattgagacttggggacagattgtgtcttgaccgtggttacataataagcagtagagccaagcctgtaaaagtcatgctcttgaccaccaggagatacctcatcctttcattgtcctctgaaggcccagtcttacctttaataagatagttacaggagaagcactgtatttctacaaaggaagagctaattgcattttaaggaaatgctatttttctctcattattgctcctttaacatcaggaatagcaaattatcttttccacttgtgattattgtagcataaacatttgtaagtctgggtttgaattagaagacagatatgtagtgattaagatcttacgttttagtgtcaaactttcattgaaaagagagagattctggaaatttagaaatttatataaaaattcttcagtcaaaagaaattttcatactagtttgaggatatattaaaaaatcttttatcatattgttaatgttttattttcaaattgacattaatttttttttctattaggttatggctcatagttcacctcagagcattttagatgatgttgccatggtaagagaaaatttactgttatttatattttaatttaagatcagtataatcaaatttgctcctctgaatttgattgactttctagaacctgtattggttctagactctttataggactaaattaaaatttgaatatgcattgagaggttaaaggtattcacagtaagatatcattagacatcagtagagttaaagttttctttatcagtctcttcctttcacctgtctttagtgtttgtgtgtgtaaatataaattctgaatctatttcatacatttagagaacatttattaagtgttaactaggtagagcagtgtgcttaaaagcacaaaaagatggaataactacccttaaagaactagcagggacacaggtgtaccaatattgatatgacaacatatttaatataatgggtgtatgtaaaaaaataatggaggcagaggaggtagagcagttaggtgttgagggtagttagagaaatcatcacagaaattaccatctaaactgaggcttaaagattgtgtaactcttttgttacttggacaggtgtctgttgggttggtagtagttcaaagaatacaagtggtgaattggtccagataatggcaagatgcagagtatggccatggaagtttctggggcagaacagatgtcattgtttagagtgtcaacaaactttaagctgggttataacacatagaaattgaaattgctgcatgttgggactgggattggagagaaatacaagaaccagctgccatagcgctcatttaatgtagatgaaagactaggtatttcctagacagctgctgttggagtgaaggggtggtgttgtgaggtgttatgaacgtcattggagatgctgtttacgaggagagaaccagtgaagatccagcaactttccctctgttgtggagacttaaagctttgaaagtgaggaacttcctcagaaggccacaagactgtcagggtcttcaggggtcacatcaggttttcagttgaggatggttagcataaagtgaaatagagtctaaagggctgagtgggaacgtagcaatgggaagaagagccagggaggaagaaatgtcaagcatggtacgagatgataggtgatcagggaaacttttattttgagctacaattaaagttgtaagggagtggcatagggggttgcctaaccaaaaggagctctaaagtcaagatattacatgtttaagcacttcatgatgtttaaagccagataacattaattttctgcagcctagctagcctaatgtatctatttaaaattcctggggggaaaattgtgaaaagcttttggttttgtaatgctgagcctcagatgaaaggagaaatgtgaatagatccttaagggtagaatgtccttggccttccagcctttctttatagttatctttcgggtaaagagagggctttgtagttactcctgagttaaggaattaaaaaaaaaaaaaaacagggaattccctggcagtctagtagttaggactccacagtttcactctcaagagccccaggttcagcctctggttggggaactgagatgccacaagatgtgcagccaaaaagaaaaaaactcagtgttctggtttgccttggcaaggatatagttactgttggtgaagatggcatatgtcactattttgatcagttgaaatagtttgatttttggagtataattaaactaccatttaaacacgttgtttttgattattttctatttcagtgttgatcatagtgggaggaaaccaattgggctagtgttgtcagctcgttatggtgatagctcatggaccctctaaatatt

SEQ ID NO: 45196 - DNA, 1314 bp, Bovine  19866881044590
aaatgcaaggcttccctgggttgttggagccctgagctcattaacaggatgcaggcaagacaaacccgaaagtgcaacatgggagtacagtgagtaattaaatcccaggtcatttaaaaatgctaacgctcagatgtcatggactcatggagcctccgactcctcgtgcattttttttttggctcaggatggaggactgggaacctccaagtcatatatggattataataaaatatgccatataaaaaaacagattaagacagttcttctttggggaaatatacaaagaggggagctgtctgttagctgtcgagtttgcaagagataccatctttggggaggctgtgctctgccgacagacaggctgccccaagggaaatcgtggtgaaacaccccgacaagccacatccatccgtccatccatcacgggctctctctgactcaggagcctggagatagagccatggtgcaaaggagggagaaatcccacagacaatggcagacagtcctcctgctgcatcatgagcgctcagattttttttcccccacctgactcgtttttttaaaaaatacaaacgtgcagtcttctattctggttgcttattattttgaggagttaaggtcatcacatttccttggatttatacaaggagcaaaatgcttaagagtcattatttcatttatgcccaccagactctcaggctcacagggaaggaggaggaggggattgctatcactcaccccatgggggaggagactggaggggactgaagccctgatttcctgagatggtggcgggcccccggaatccatctgctcattccttaggggtgccattttcttggctgcatttgactccctgctttgtgattcataaagctcaaaatagatgaggttcacaatgaggacccatcacccaggctgcaccctgcaggtccttgttaccacttgttttagaagcccaggatatccacaccacaggaggactgatcatgccccccagaaggcctgtggtgcccaccctctgctctgccaaccccctcaccccttgccaacacgcaaggatgggcccctggaagcagcacccagaggttggcaccacagataagcaatctcccacctatgagacacaggaaaacacccacgctgttgaaggaagctcaccactctgctggttagtggacgaaccaagttgatagaacttagcgggaaggtgcggagaaggcaatggcaccccactccagtactcttgcctggacaatcccaggacagaggagcctggtgggctaagtccacggggtcactagtcgggca

SEQ ID NO: 45197 - DNA, 1777 bp, Bovine  19866881051697
ctgaaaaatggcagagaactgtgctaatggaggctgtatatccagaagcacgtcaagggcatgatgtgctgacttcccaagctttccccatcaaatacttcttgacttagtaacaatataaatgtcaagaaatatttgataggcatattgactaaatttcaatagtcagttgactaaactgtggtgcttccacacttgaaatgtgtgtgttaagtcacgtgcgactctctgagaccctatggtctgtagcccatggggctcctctgtccgtggggattctccaggcagaatactggagtgggttgccatgccctcttccaagggatcttctcagcccagggatcgaacctacatctcttctgtcccctgcattggcaggcaggttctttaccacgagtgccaccaaccaggcaatgactgagtactactgatatgattatactgctgctgctcgttggcattgtgagtttgaggctgctctgtggtgatgtaggataaagcaaatgacatgaagaactaacgctgtcatcgatagtgcctttgagaatcaggtttctagaaaaaggggacacagacctaagaaagaagaggttaaataaaatcccctgtagttttgaatttgaatgcagagtatcagtatgattcatgatgtattttcatcagaaacaaccaccacctatttcctagttttggccactggaaaagtctaaaactgataaccaacccaggaacaatgagtgcccccaaatgcccagattatcgtctctaaaaatatttcccactaacaaaaacaagggattcttagattcttgaagaactagctgattccatatctggggaagggctggatcatcttagctttcctgatatttggatcacatgaaagactaccagggtcatgtcagaaggagccaactggccagagatggcacaatgcaagcagcaataacaataataaacaaaatgggttaaaacatagcaaatatgcttaaacccatgggtttataaggatactaacaaacacacaaaaacaccctaattggtcatcattggaagatgacagtaaactattcattatttttaaaattggcaaatagaggaaatgattcaaacatatattccatccatcttatgtgaattgcattactaaataatcaaacagtagatatatttgactatttgtatttcacttaataaatgaagaaagaataacagggttagaacatcattttgtaacccctaattaactgacggatctaaactatgagcatcagtggctgtgaaaaccgcaaagggagatggctagacgtcatacgccttctgacaagagagcacagcacagtctaggaagtagttttgcccacaaaaatcaagctaaaatctgattaaatatccaagtcaaactagcaatttataggaaatgcagatggtaggacacattaaatagcaacacaaggttgcaaacagaaaaatccggactgcgggatctctccagcacaaaagacccaacttcttcccttcaataaacttcaagggtgaggagaacataaaaggagcctgtagattacaatgtacttaaaagacaaggcaagctacatgtgtgggccttatttggattctgattttgaataagaatttaaaaatggcatttaggaaatactatgaacttgaacagttgcacgacatttgatgatattaagagataattgctaatttcttaaggtattgcaggaatgttaagaccaaagggtcagtttctgttagagatatataccta

SEQ ID NO: 45198 - DNA, 1142 bp, Bovine  19866881058502
actgcaggcccaccaggctcctccatcccatgggattttccaggcaagagtactggagtgggttgccattgccttctccatctctccctctagccagctctaaactctggaaggttaccacctgggaccagagctcttctggcggtttcctctccgagtgttctgtgaggaagaccatggatacagtctctatccagctgcagctgggttctgaatctggggtccagttgtctgacaggcccccgacctccctgatctcttccctccctcctggcatccccagcttacccgtcctctggtccgattcttccgcttgggaatatcctcttctaaatcctcttcttcattcccttcttctacattttcatcattttctaaaaccctctgaaataagaagaaaatagaagcattgagaaatgaagcacaaaggagaagatcctcagagggtaacgaggagggggttgtgttttgttatttttagcacagtgaagatgctgccgtggctgggcctccaaaacactggccaggagttggagctcctgtgtaccgactctctctcccagacccttccagccaagtcttcccagaataccgaccttttcaacactttttgcccacaaagtgttttctaaaaagagaatactctagtaagggtactcttctatgtaggcccaagatgtctggtcaaaacttcagttcagttcagtcactcagtcgtgtccaactctttgcgaccccatggactgtagcactccaggcttccctgtctgtcaccaactcctggagcttactcaaactcatgtccattgagttggtcatgccatccaaccatctcatcctctgtcctccccttctcctcctgccttcaatctttcccagcatcagggtcttttcctaaagcttactttaatgtaattttccttttgtccctcaagggccacctcaaagatatgaaaatacgtctctcctttccctggcattctggaatgctgcctagtttgatgaaaacaagtaacttcctatccatctgaccagaatttgacatgcatgtgttattcctcatctcccattgttatttcttttaagagaattggattgtcattacagcactgaatagagcttcaattaattctctctctcca

SEQ ID NO: 45199 - DNA, 1722 bp, Bovine  19866881073681
tgtcagtgcaggaaatttaggcagtagggtaacatggtcatatttatgaaaggtcgcactgatggaggatgtttggcatgaagcagagtgaggaggatgaagggaggttgtcaggatcggatgggggggtcctcatcctatcctgacctatagaaatattcctagaggtcagatggcatgcatccacagaaaaacatattcttcaccacacagtgctgggcatatagtgagggctggctggctggatgagtggatgaacaaatgagtgggtggattatgattccaccatactgctagtcttacatgtgctgtaatttctcttccttcagccatctacctctgtaagaggacaatgcagaataaagcaaggctggaactggcagattatgaagcagtaagtatgattattttccaggtacggtgtaggaggagagtataaactaccttcagctctgactcagcttgcatttttccctttttcttcccccaactccttcagacagtggaaaggaagtctcttctatttccctttttttgttctcagctcttcttaccatcacaatataatcatatctttatataaaggactctcaaatctcagcaataaaaaaacaactcagcctaaaaattggcaaaggactagaacaaacatttcaccaaagagggcttaagtatgacaaagaagcatatggaaagatgttcaacagccattagagaagtacgtactaaatccatgatgagatgccactacacatcagaatggctaaaattaaaagtactgatagttcaggtgctggtaaggatgtggtgggcaactggaattctcctatattgctggtgggaatgcaaaagggtgtggccactctgaaaaatggtttggcagtttctcatcaagttcaacgcacacgtaccatatacaaccaagtaatcccactttaacataactacatacatacccccagagaaatcagaacttacagccacacaaaaacctgtacactaatgtccatggtagctttatgtgtgatacctcaaagatgaaaacaatccaaatgcacttttacagatgaatggttaaatgaactactctacagccttggaacagaatactattctaccctgaaaaggaatgaattattaatccaaccacttggatgagtatcaaagacattatgttgagtgaaagaagtcagtctcaaaagattgcaaactgtgatgttccagttatgtgaaaaagctgtcatgagggaaaacagatcagtggctgccaggatacatgcagatataaagagatggcatgaaggaatttgtggggtggggggcaatgatggaaccattctgtatcctgattgtggtggtggttaaccatgcatatacatgtgttaaaatttatattactatataccaaaagaagaaaaacaaatttactatatgatctttttttttagcttaatatatgataatttttaaaaattgcatcttcagacccaattcaccaggacttggcagtagatgcaaaatcttaggaccaaatccaatccagaagacaagacggatgtcagatggagatatatactcccaactttcctcctccttctttcacaaggcatgattgcttgcagaaactggagaccccaccgcgctcatatccacccccatttaatagagccaaagcatagcgaacttggaagagtcacagataatgttttaagtatttaaaat

SEQ ID NO: 45200 - DNA, 1453 bp, Bovine  19866881126466
atgtgtaaatttttaatcaagtttgagaaaaaccctatattaagtttctttcatatttgtatagaaagattttagggcatttcaatagttccctgtgctgtgacatcaccctgaaatacttttcaaagtgagaattggaagtaatcttgcaagggaggggccctgaagcataaagaatcatgggaaattagcctccaccccgttccttatgtaatgtttatctgatgaccttttgtgtttaatattcgtgtagaatttcattggcttctcttttcgtctctgaagtgcacagtgacttgtggccgagggttacgttatcgagttgtgctgtgtatcaaccaccgtgggcagcatgttggcggctgtaacccacaactgaagttacacatcaaagaagaatgtatcattcccatcccctgttataaaccaaaaggtaaatttgtggtgcattttaaagtgaaatcaggtggtgctttccaggtctcttactaatactgcagcatttgcatttaaacatactaactttcttgcaaaaactgttcactgacagattgacatgtccacctagataaagaagttaaacctatgtcattaattgatcttgaagagaaacttagatcttgttgattcagtgcagtaagtcccctacatacgaacgagttccattctgagagctggttcataaatccaattgttcgtaagtccaacaaagttagcctaggtacccaactaacacaatcggctctaagatgctgtactgtaataggtttatatactcctcacacaaatagtacgcgaaaacaaacacgaaaatagggaaaacatttttaatcttacattgcagtaccttgaaaaggacagtggcacagtacaacagcttgcatacaggggctgacattgagtgaacagagaagaagagttaccgaccagaggagggagaggaggtgagagatggtagcgttgaaggatcagtggcaataggagaggaagggcaagttgccatttccctcacgcctgactctgacggaacatgtcttctcatctttgaaaattcgcaacttgaaggttcatatgtaggagatttactgtggaacaaagattcaaagcggggtcgtccggcccccaagtgcagccctcctcttcctcatcctcttccttttcctccatactacctctccaacaggaggtccgctgtgattcaaacacacctggaaaaagtaaatgcatttccccttagctatcgactgtgaaggaaacaaaaagcctaggtccaactgtgcccttgggcaaactcctgacagttcttcagttagctgattgctttccccagccttctagaaagatcttaacaagttctatttatagctgacccagagagcacggattctctccttctttgggctcccgaggcccctatcattaagctatcgcagttctgatagtctgagtgtgg

SEQ ID NO: 45201 - DNA, 1717 bp, Bovine  19866881206092
ttcctcctacccggtgtctcatatccgtctcatttcctggggccaagactacatgttctcttttaggagccccagttacacgtggccccatgagggcgtatgcccagtaagtgctcagtaaacactcacgtttagcttatgtggaaggattcgtgcaccatgtctaagagttagcaaaggttgtgccaggactgagtcaggctctgacagtttcgcctgaggccagtgagacccccataggcagtcagcttctcagcatcacatagccacagacaggccgtgactcagatcatccatctgtggtctgcacatgctctgctggcccaaagggcatggaggcgggatgtaggcactctcgtcaagagggccaggtgccagacacccgaatcgcctagagactcataacaaccccacaggggcagcaagatggttctctctgtttcatggatgaggcaacaaaggagcagagaagtgtaacctgacccacatccacacacagaagatggcaaggtggccaggtcatgattcgcacacgggccaggccaactccagtgccattttctcagccacagggtccagagtgtggatgatccaccggtttggagagctgactccaagtatatcttcaaggtcagagcaacccctcagattcttctttgctttggaatctataaactgttcagtaaaataataattcacctaaggaacacccgtgtcccaaatttgctctttagggagtgggcagctcactttttcagacacagccctggatcaaagcctgaacttcctgtgtcaaggttgggtaagtggtggggtgggttgtgtgggttataaagcttctcaggcacctttcagagtgatccaaaattcttaagctcatgcaaaacataactttcactctctctcttgaagctgtatctgctgcccctgggccatatgctagaggacagagatgtcagaagactaacatctgttccatcttccccatcagtgtggcaatgacatcatatgcttcttttagataatttgcacattatcagactaattttcagattatctaatcagccgacattacccttaatcaactcagctctcctctttcagttctgcagagtacagcgtgccctccacaggcacactggggtggggacttttcttctcttgacagatattgagagcctagctatatgccaggccaccgctattaaacagaagactgagccctcttgggactgagggcaacccgacttccatgccaggaacctgagacataggcttggaataaattttatagatccatatattaaaacacatttccttcatagaagctccaagtatgttgtagagagcattctacaatcatttatgctattaaataagaaagagatgccataccaccattaataatgtgtgtgtgtgtgtgtgcacgtgcgtgcatactgttgagtccaactctttgcaaccccatggactgtagcctgccaggctcctctgtccatgaaattttctaggcaagactgctggagtgggttgcccatttccttctccaggagatctttccaacccagggattgaacccccatctcttgtgtctccaacattggcaggcaggttctttaccagctgagccaccacagaagcccaacagttaataatacgccacatatatttctctataaatcatttattcttacttctagtgatgactctccttttc

SEQ ID NO: 45202 - DNA, 1271 bp, Bovine  19866881209324
cagtcaaatgctatggctcaaattcaaattccaattaatgtggccaaggttggagaacaaactttatgttcaagctttattatcactggatgagcacccaccaacaccacagtgtttggttctttaaatccagatgacatgtgttcaagctattggaaacatgtcttcaataataagtcaatggtcgaatggatttaatgacaccatccttacactaaaaccataaaaccatggagctccatggcagaaagggagctcagagacctttccctttaaaactttccaatctctggggtcctgaatacttgacaggctaacgagaaaaaagaggggtcagtgggttcacttcagaatttcaagaagtcacagttaatactgttcaagaactggagatgtaactctaaaagctaatcaaaatatacttttctttttggggggaattctagcaactccatgtagtggttgctttggtcacttgatgccagtgaaaacattgattgttctattggtctgtgagtaatcaagatggggaaaatgtactaatgtgttgatagttactgtctagtagaaaaaaaaaaaacttttaaaacatgggattcattgtaagagaaaagaaagggagcttgtaaaaaggggtagggatggtggtcatgcaaaactgagtaacccgggatttattcaggctttcattgtattagatgtagaaacagagacatacagaaaatgtggcttatctaagaccctgactcatcttggccaagtgttgtcttctcagtgggtaagatggaaatctcagtgttttctgggcaccaggatctcttttacatacaaggttaattcccgtcttccaatggcatttttccaaagagtgactttattaattttttttttactttaaaaagaccatatgctgtgaacaaaagactgtgtgctatagtgttaatgcgcaaaatccatgttatatattcggagttggagaccatatcagttctgtacatcaatcaaatgatatttatcacacacctatgctgtctccagcccccaagaatctgctgagggggtgtaagaaagacaagatgcatgatctttgcctgcagcaaccttgtcggtccttgaagaaaacacacaagaaatccttaaatcattaaatgaataaaaatgagtgtaaactctgagaaccattttggtaatgttttcaaaacatcctaccagactaggcacatcataagctgggctttgaagagtgtacaagatactgatgtagacaagaa

SEQ ID NO: 45203 - DNA, 942 bp, Bovine  19866881226165
cctgaaatagcaccaaaaacaagtctccataagcattcattagaaaatactttggctcaaatttctagcagttctctatattcatacacacatacaagttctaatatttacatattgcaaaaatacataagaagcttcagctatagagaattcatgcacagtgcaatcaaatctgaatcatccacgctaaagagtaatttgaggagaaaaaatactactaccccacctggggaaaccctctcactccaatcagacccattcatttccccttattctctctctctccttccctgtctctctgtctctatctctcccattctctctttctctccttctctttcaatccccctccactttgagacccagtttgtcaaaaggagggaatgtggctctgagtctttatacttagtctgtaaagggggatggagaccaattctgagcagtcaagaattcaaactttgtgcacctgtattgtgacaagcttttactcaggcactgcttccccatctagattacttctccagcccttctttgcaaaccttctgcaatggtctcaggctcacctctcatctgccccagatattacttctaacactaggacatctacaaatctatggccacaatggcattccagagacatctgcctggctccctttttctcatcattttgatgtccttcaacaaggatgaagaggagaaagaaagtagaaaggataagaccaaagtaacaaaaacacactcaaaataaatgatggtgaatgccatggctacctcttgctgggctaaaacactaccatcagcaagttcaacccatcttagaggtcttcttatcctctctcaaagctgtcaaactcaaggcacacaggtgccacacaggaggcaagccacaggggattgtaacttcaatcattgtcatcaataatcatagaaaacacattcatg

SEQ ID NO: 45204 - DNA, 1736 bp, Bovine  19866881244108
aaaatattacagtaaatatctcagtggtgaaatatgggtgattttttttgtcttatctttccttttttccccacccaatatggtttcttcataataagcatattaaaccaggtttgactggagaactaaatttgatctctccattggcttcagaccagaataactatgtaatacctctggggtggcgctgacactttgaaagccctcacacttgtggcattaatggaactaaatgcaaatggggttctctggtgactgcttcaattgagcctattggcttcggtcacccactcagcattcatccagtgcctactgtgtcctttgacttgcaggaggggctgcgtggttgttgcaaacgggaggtgctggcagactctggtcttatgtagcagcggatcttcccgacccaggaatcaaagcagggtctcctgcattgcaggtggattctttaccaactgagctatgaaagaagcaagtgagtgaagtctctcagtcttgtccgacgctttgcgaccccatggactgtagcctaccaggctcctccatccacaggattttaaccaggcaagaatactggagtgggatgccatttccttctccaggggatcttcctgacctaggaattgaacccaggtctcccgcattgcaggcagacgcttcactgtctgagccaccagggaagttcccctatgaaagaagcaaagtaaatataaaaagatgttaagttgaaagttttgccagaagcaccatgatacaatagacatgacatcccaatttggtgccaaaagaagcagcacatttttaagggaagatctaaaaatttgttatggaactcaaacttctcacctacacccacattgagggcataaaatactctggcttttagaaattgaaggagagaatttgtagagaagattaatttaggaaaaaaaaaaaaagcattgacgtactgtgaacttcattcctaccaggagggacagtgagaagttcccatgtctcttctcaaatacagtgaagggaacttcaggggaaaagcttggtaagcatcctttgtgattcaggggacagagtgaacccgcgttggattcctgcctggaaagctaaaaggcagggagacatgggctggctggctgctcccaccatggctggaaggagatatttctgcagctttgggactcacccacaaactcccagagtgggtctgggcagggacacctgggtgtctcccttggaccagatgtgagccactggtgcaagagagagttggtgtggtcaccttggaccaatccgagagaagccttcccaagaggtgaacagtcctcagcagggagaagctgaaatgatcaccaggtcctgtgagctatgggaagatttctgtgatgagctagaggagactgactgccctggacaagagagctgcagcagacagtcctggtgatggagagcctcctaaggaccaatcatgaaagaacatcagtcttccttacggccagtcaagcaagagcctccctgcccctctcctctcttctcccctgcctgctccatttcaggaccttaattctacctgggggactagaggaggaggaaccaagaaaggaagaagaaactctccgttcccacacttttatcacccacaggcttcccacctgtagtagccctggctattgagctgtggggtttggggtaattgcatgggtctcaacattctaatttctgggttgagacactatccaata

SEQ ID NO: 45205 - DNA, 1785 bp, Bovine  19866881334929
ttgagacttttcctatagcagcaataataatctacagtctcatttttaatggctgtctagtattccatggtatgactgtatcatgatttaggtaactgcttcccagttgactgacattcaggctttaccagctttgcttcttgtgaacagtgaaaaaaacaaaagtggaaaaaaaagtgaaagttgctcagtcacatccaactctttatgaccccatggctatacagtcagtccatggaattctccaggccacagaactggagtgggtagcctatcccttctccaggggatcttcccaacccagggatcgaacccaggtcttgaacccaggtctcctgcattgcaggcagattctttaccacctgagccacaagggaagcctaagaatactggagtgggtagcctatcccttctccaggggatcttcctaacccagggaatgaaccagggtctcctgcattgcaggcagattttttaccaactgagctatcagggagaatcaaatggttggttttttgaaatgtttacacagcaagccttggtaataactgagtttacatgcattggtcttcaaccaaagctccttttatattaataatccactaatgagggtaatcaattagttttggcatgagctctatgaaaacacacagcataatgtgggctcttgccttgcattccatcagaattaggcgagtcattaagggacctgtcagacaccccgcctcactgtcctgttgtgccactaggttgagcaacagactttgccaaaaggcttcttccctctccctctaaaggtgacccagaatgccttttctttcctatggtttttgcgttttcctttcatgaacatcacaaacctgggcactcccttctttcccagttttgaatctggactttcaaagtgattaatgcaaggccctctgggttctccttttctgccaccttctagcccctgattgctagaagacaaatcttgagaattccattcttggtcttgcagtcagttgcaaagacccctctcgttccttccctaaacccagcgtgtttgaacaatcacatccagtctcccctgtcttcagtggcctttataaatgctgtgtgagtcatgttcctgtaaaacacataagaaaagaagaatcggggaaccacacagacttcagccttaatggacgtgtaaatgaatattaatagttatctgtacaacagggtctggtgcaatgtcaaactgggttcatgtccggtggatttaaagtagggccctgctgttttgttgcaagtaaccaaaatagatggctgccttgtaataagtatcgatgtgcaaactcacgatgattaatgccttcttgttgattttcatttctctttaggaaaacttagcaagactccagagggcctttgcaaggaagtgggaattcatctttatgcaagcagaagcacaagtcaagtaggtgaacttcacaggaccccttgcaaagagaaaaagactctctggaatttagaggtggtatgagagtggggtttccttccatccagccgtggttggtcactgtctctctcatgacaacaactgggcagaaatcaaggtcaggatggataagttgcatttctatcacccacgataccctgaaataatctccaaagtgtgtgttccagcaggtaatggggtccctcccaaatgtgtaactctggttctaagaagctgtacctaattcccaaggagatttccaaatcttctgtgcttggaagctgaaaaacactagacccactttatttgttggtctg

SEQ ID NO: 45206 - DNA, 1214 bp, Bovine  19866881372362
tccccgcattgaataaggttctggaggccttggagaggaaggtggggaggtggggaaccagccctcctggagcattcctggctccgttctcaatctcagtcctcccaccaaccttccagccacagctttaaaataaaaaaagaaaaattggctataccatgcagcatgcctgatcttattaatatttccctgaccagggatcaaacccatgtcccctgcactgagagcaaggagtcccaaccactggcccgccaggaaagtccccagtcgcagcttctctatctccacttttgcagattaaaaaatgagtctcataaagattcagtgccttggccagggtcagtggctagtgagtagtggagctgagattgccgtcgggcccccagctccccttggcctctccggcactctccccctcggctcggagacgacttcatttctgaggaaggcaggcacacagacaggaaaggaatgggtgccagggggaggtcaggatgagatatttgtgagtggggtttgttctgatttagcaaaaacactctgctctgtgggccgggctgcggctgctggctgtgtggtcagggtttgcaaagcttccaaagatccttttgctagaagggctttaaaagctgcaagctctcagcagtttctatcagttgggattttcttccctgcagactgaatcctgtcagggttttactggcttctgtgttcccagactgacctgtggtctctgtcatctgagctgcacggctctgtcctctcaccagttcctgtccccggtatctcctcgggaaagggttcttcaccagctccatctcctggtccccaacatccgcctcgtcactctgtcagaaccctctggtttctccaagaagttgagcacatcagggacaaaggaacgccaggacctacttttgatccagatttgggggtttgcttcttttcctggtatcatattttttaaaaataattttgcaagttttttaatctatttaaattaatttttttttttttttttggccataccctgaggtatatgagatcataattccccaaccagggatcgaaaccatacccccggcattggaaggcagagtcttaaccactgggccatgggagaagtccccaggctcatattttaaaagagctctcaaacaccagggcgccgtgagaaattactgcttgaggggctggggtgagatccgaggtca

SEQ ID NO: 45207 - DNA, 1392 bp, Bovine  19866881385670
tatgtacctctttgtctggctgttcatctgtatcctttaataaactggtaagtgaaagtgtttcccagagttctgtgagacactgaacaaattaaccaaacccaaggaaggggtcgtgggaacttctgtttatagccaagtcagacaaaagttgtggggaacctacggactcgttatgactggcatctgaagcggggtgagtgaaagttgctcagttgtgtccgactcttcgtgaccccttggactctacagtccatggaattctccaggccagaatactggagtgggtaccctttcccttctccaggggatcttcccgaccaagggaatgaactcaggtctcctgcactgcgggcggactctttaacgtctgagccaccagggaagcccatggtggcgtgagagtaaagggaaaacacagggaaaggaagactgtattttttccctacacagcatcccaagaatgaagtatatacatagtacatagtatatgtacatatacatatacatataagaggtacatagtatatgaaggggaagaaggagagatgctgtcaggctccaaggaaaatgggcagtgagggctggcttgcagctgtgggaagtgattactcaaggggagcaagggcatggaatacaaagcattctgggagagtgaccatcattctgactttagaaatacaacgcaaatgtgctgctgcattccctaggagatcagggcctcttgcgggaaggaaagccggagacagaatgtgagaagggtgaacaggagagtgagtttgcatcccctttggtacgtgtactttcaaaatgatgatgcacaaggggggaccgggcaggaagaggatctgaatgggaagggaatgaaaagcagagcagcacagcagacacagaagaaaaaaggttgcttcttattaattcattcatctctctttcttcacgtgggagaaaaaggggaggaaagacaatataaagaaagaattccttaattatgggccatccagagaaaagatatgcaacagagaaactcaggttgagggaagggccatggaggtgaatgtggccccttagacagaagagcatacgccaggccagctatcacggcctttctaggtcttggtctggatacaggcaccctgtctacagtgttacctctggtgttttctttcctatcacctaacatgagctgggaacgagaagcaaggactctgaggcatctggaatcacataaaagcactgttgtaatgacctccttcggtccccattttttcctccctgaaactgtcattagacagtaagttcacagacttctatcacctcagcaggtttttaatagacccttaggatcctgcagtcccttgctcattatctcatttcatgaattacacttca

SEQ ID NO: 45208 - DNA, 1276 bp, Bovine  19866881415794
cccaaggaaggttagagcgtgcggacgccgggatcctcacccactgctggaaggaagccgggtcgggggtgaaatgcagcggccattctgactctgcgccagcagcactaggcaattgtgtttttaggaagggaagtgaagaacaacttatccagctgaaaccgtgaagaccagtggctttaggggagcccctgcccagacgcgcacccagcagcagcaggggcagcagcagcagcagcagcagcagcagcgggcaggcggtccccccgcggaggcacaggcaggtgtgccgcgtgtgtgctgcacacaccatacactggacacggaagcgtgcagcggccaggcagcacatgcactggtgtacgcagccgtgcacacgcccatgtgcgtgtttacaccacaggcacttacaagagcgtctcgtgcaaggttcataagcaaccacgtgtttggctgtagagctttacctcagactcctaagatgcccatctaaagcatttaccttaagagacatctataaacccgattttcctcaggacaaagccatttgtgtcagaggaaatggcttctgtgcttctgtttctgtccatactacaagtaggggggagtgtgctccccggggggctggtttacgagggatttcaaggcatccctggatttcaaagccacttggtcctaactcctccgacaacccctctttgtagtacagcacttaaaaaagagaagcctctgtttatctggcagaggaaacaaccacgcacgggaggctgcgtggctcagggcggctccagccgggcagcgagcggcgaggtgagggtttctgggaatgaggctctgccatgtagggcgcctcctctggagaactggagttcacgctctgctaggggagaactagctttggtctgggtctggaagcaggaggcttcttagggtcctgcacctcaggggacgggagcaaatgccagatcctggcaacataggcagtgcttccctggtggccctccccatgtcctggcaccatgctgctgcaagccccggagtcctacagcttcttgggaagagcaaaggggccctgggaaatagaccacagggcagaagccggtctgcttggtaccacagtccctccgttctgaggcaaagcagagaaaccagctctctgagttgactttaaaaataagacagtaataatagctaccatttattgagtagggtcacgagctggttgctctaataaatggatgtgctttgcacatatctgtgtccccatcctcaactg

SEQ ID NO: 45209 - DNA, 1381 bp, Bovine  19866881473657
gaggggatgggaggaaatagcttgataaaatagaagcagcaagaagcccattcaccacaactagagaaagcccgtgcacagcagcaaagacccagtgcagccaaaaatgaatacatacacattaaaaagcaacaaaacagttgtatatacatgtatatatatccacgactcacacacacatacatgcgtacagctaacatttcctgagtgtttactgtgtgctcagcactgtgcagaaggcgttccatgtattatttcatttactccttgcaacaataattctgtgaggtatgtgggttgaagagtgttcccccaaaattcatgttcacttggaacctcagaatgtgaccttacttggggctttcctggtggtccagtggttaagactgtgcttccactgcagtgggcacaggtttgatccctgggggaggaataagatcccacatgccacgtggtgcagccgaaagattaaaaaaaaaaaaaaaaaaaaaaggtgaccttatttgaaaataagggctttgcagacgcaaagaaaggtagcatactggatctgaatgggccctaactcccgggagagtgacttaataagagacagaaaaggacatagagacacagggaaggcgtatctggaagaaggatagaggcagagttgtggggccgcaagatagtagctgctgctgctgctgctaagtcgcttcagtcgtgtccaactctgtgcgaccccatagatggcagcccaccaagctcccccgtccctgggattctccaggcaagaacactggagtgggttgccatttccttctccaatgcgtgaaagtgaaaagtgaaagtgaagtcactcagtcatgtccaactcttagtgaacccatggactgcagcccaccaggctcctccgtccatgggatttcccaggcaagagtactggagtggggtgccattgccttctccgttcacccatctactgttatgcaaatatgtttggtggaaactcttgataactgttggaccattaaaacatacataacatgaaggctaagaaagtatcaaaatttatgaggagttgcactagataaaaactccctaacatactgttctatgagattcttcatttttagctttcatcaaaacacaaatgactgagcaaactcaacaaaccaaatccctttcaccagacgacttgcagattagtgttgaaagtgagttaaatgatggcaacttgaaaagtataaaaggctccaaattcaagaaaaattttcatttacacataaatttctggaaagattatgggtgatgctttcccccaccttggcttccaaactctctgaatgagttaactgtaactaaaaaaaaaattgtgtgtaagactgaactgcctgggaaa

SEQ ID NO: 45210 - DNA, 1383 bp, Bovine  19866881474705
gcaggagcgaggctcttccaaatcgtcctcgtcaaagccgtggaaagttgaggtgtcactttctgacgtggaaccgaataagtcctccgtggtgcgtgccgcggccgctgcctccttctccttcctgcctttctcctcccaaatgaagctgacatgtatgatgaatatatcagcacatgggttaagcaacagacagcattattaatattcttattacattattacagtgttattcttaatagcaagaccatacatcattccacaccaaaggcattaactgggagcgtcacctggtgacaggtgtttggggtaagaggacaaagccaacatctccaaggaaaagggttttcccctccccagaaaggcattgtctctactacaatatatttgtccgcagctctgacagcgccagattcaaccacgatctttttctttcttctcttcggaaggcacacattcacatgcacgctcgctccacccgccccagacaatgagttttcttggtggtttttaagcctggttggtatttctttggtgttttcagctggcggttctttgcacaatgtttgtccttcattttgacagtcagctttacaaaggtattactgtcagataacccggtcaaggtggttaagcctccatccgttttatttttatttttacccgtttctaatcccattcttcccaagccctttcaattctgcccttacaacatgtagttcatttgcactgaaagcaaaaagaagttggaaagtctgataagtggtaggtattcaaagagcctcttgctttgtttacccctggaggacatgtctgtgtgctgcacccacacacatgcacactcacaatcacgcatgtgtgcacacaggcatgcaggcacgtgaacgcacgctccaggtcttaaacacgcccaggtctaagttactccacaaagtctggggttgttcagtctaactcagagcactcagaaagtgggaactaggggtggcaaagctgaataaaagacagtatcctgaaatctataaaacttgggtacaaactctttcacgttctaaatcggccccaggactgccccctattgaggtcacaaggttccacttacagtgtcagtttcaggaatctcattttttctcccaggagaagtaggtagtggagtagatgggaaggaaaagacggctttcccaagctccacactcttccttggaaggactccagggaggccctagagaagtattcacccacctgccttcacaaagcatatcccatgggctaatgccacctgtttattccccaggtgtcaactatttcaggaacatcagagtcagacctagactaaattatccaccaaaactaattcttggcaaatgcaacgagaacacctag

SEQ ID NO: 45211 - DNA, 944 bp, Bovine  19866881890435
ctgtttttgatgtggaccatgttaaaactctttactgaacttgttacaatattgtttctgttttatgtctttgttcttttggttgttgtttagttttggtcatggggcatgtgggatccgagctcctggactggagattgaaccggtatcctctgcattggaaggcaaattctaaccactggaccactggggaagtctcctggctgtatttaaatgtagagaattaggtttcttctttaggaggttttgttcaaattatctgggacttaatcacagtagaccactctttcaaactttcaatgaatttgctcagaaaattttcatagcgatatgaatttcatatgcatatgaatatagaattctgggcaagagaaattgctcttgagtcaggggtagtttagggttctgttgttagtgtcaataatgtctctgcctgttacagccccgtgttgggaagttcagtacagatatgcaggaaggtgaccttaatagacaaaaggcgggcagcctcaggacgctgggggcccaccagcagcctcactcttaagatcatgcctgtggctccagaagcgaggtggtctttaaaccaagttcagcgctgtcgcaaagcccatgtgtttattttacccgaaggacataaggcatgtcagagccttaggctctcaaaccagggccctggtttagaattcagtggaaattactatcatgaatgatacttgcttgatttcagatctcctctgaaaatctctcattctctccaaggcagagtggacagcaggttgagggggcactgagggccaagaacagggccgttgagaagccccgattgatagtgagaaagaggggaggtaggttccccctctcccagcctgcttgcatggttgagaccataccacggtctaaggacagccctgtagcacccacctatgtgttccagatactca

SEQ ID NO: 45212 - DNA, 765 bp, Bovine  19866882050605
ctgagagacttgcctacccccagggcctaagttccatctctgacctggaaccgaggttccagccttgattccacctcaggcatcagaggccaagtcccatccctctctgttccacgggatggaccatcctcatcaaaacggccaagagctgggatgcttctgtcagccttgtactgatcctgatcactttctggagaggacagagatgatgagtgaggcagggaggcacgagaggcagaagaggcatgagtgagagtatctgctgtgcctggttgttcctgcaattttatttggagtgatggagaacgagtgagttttgacgcctcctccttgacagagagcaccccaggtaggggcactgctcccgatccctctgctgtctcagcagcagcctttagctcaccaggaggaaatgaggtctgtgcaacagtacgaagcatcattttgcccttcgactcagagtgcttcataagtgaaaaagggcttttgagggaggcttggaaaaaaaagttttcagcgatgaggtttgctcactgtggttaacgataattattaaataggtagggtgagctagtgcttgttttccttattattaactgtatttatgggtttttattaagttgtgcccagctgagataattgtaaaactatctgcttaagactcttagggttcccattctattttctttcatttcaaagatggagtcttttcgttactcaaggctcatgctataaaccaggagtcagcacacttcttctgtaaag

SEQ ID NO: 45213 - DNA, 1735 bp, Bovine  19866880294021
atagcaccacccttatggcagaaagtgaagaggaactaaagagcctcttgatgaaagtaaaagaggttcattccccggcaccttcaccaaaagaaaaaagaaaaaaaaaaaaaaaaagaaagaaagtaaaagaggagagcgaaaaagttggcttaaagttcaacattcagaaaacaaagatcatggcatctggtcccatcacttcatggcaaatagatggggtaacagtggaaacagtgagagactttattgtggggggctccaaaatcacggcagatggtgattgcagccatgaaataaaaagacacttactgcttggaagaaaagttatgaccaacctacacagcattttaaaaagcagagacattactttgccaacaaaggtccatctagtcaaggctatggtttttccagtggtcatgtatggatgtgagagttggactacaaagaaagctgagtgccgaagaattgatgcttttgaactgtggtactggagaagactcttgagagtcccttggactgcaaggagatccaaccagtccatcctaaaggaaatcagtcctgaatattcattggaaggactgatgctgaagctgaaactccaatactttagccacctgatgggaagagctgattcatttgaaaagaccctgatgctgggaaagattgaaagcaagaggagaaggggacgacagaggatgagacggttggatggcatcaccgactcaatggacatgaatctgagtaaactctgggagatgctgaaggactggggaaatggcatcctgcagtccatggggtcacaaagattcggataggatgtagcgactgaacatcaacaacagcaaattccatttctaaattcatctcatcagtaaacttcccaggtggtgctggtggcaaagaacccacctgccagtgctaggagatgttaaagacacggattcaatccttggtttgcgaggatcccctggagcaaggcatggcaatccacaccagtattctttcctggaggatatccatggacaagggagcctagaaggctacagtgcatagagtcatgaagagttggacatgaccgaagtgacttagcggaagaccataataggggtttggttttggttaaatttgggaggaggaggacaagtggcatgctgataaagtcatttctccataaaatagaaataattttattgttggaaaaggaaataaagtgaatattcaaaaggcacataatggtcacaaaaaccaaggtctcataattcctatacgcaagaccaggagaaaggatgaggaaataagttgagcaagttttgaagagtataatttagaggcctgatgatataaaatagctacaatcattttcaaaacatgcatagacaaacactgcagccagggattgtagtcggcattgcatttttccagagaccacagggaagtaatatgagagtgataattaattcttgtattaaaaaaaaatgtattccctgctgtttctctataggaagagagcaagagaagcaaaggatggttttaaaagaaaaaaaaaagaagtagcaacatattttcaattcagtacagcacttttttttcccttttggtattggaaattatttttcagtgtgctcactaaatttgacttgttgaagcactactttttcttccctaaagagtgaacagacatttctaacataggagaagaaaagaagcattaagaaaataagtttttcaagag

SEQ ID NO: 45214 - DNA, 811 bp, Bovine  19866880367522
aaacatttatttttaccagttatttataacttgcaatagcatctccttcaagaatatggagccccttgtttttcctaaaattgagcgctttctctggacggcaggttttggccgggtatgtgctgcctgaaacaaagtttttcctgaggtttttgtgcattcaatatatttgtggtttaatctgaagaaatacggcttactgaatcttctgtctccctcagcactaccttcttgccaactcttattttggactggaatgtacttcaaaaggaaaacgtgtttgccacagttgaaaaatgattgctgttaatgccagggtcttggtatcagctcttcaaaccactatcattaatcttaattagaaaactaaagcaaaggtttttaccatttgcaattaatatgggacctaatttggattcagattccaagctgaactcacttgtctgcctgtgttggacagcgtgttttatacctgccagtaccaatattgttctagtgaccgaggagagagcagtgccttgactgacatcagaataatctgtgtcgaccgtaagcattaatcttatttagaaagtgaagctgaactttgtcaaagaagaaagatctagggggaaaaagaaagaggagagaaattgacttcaaggctccacatagtatcaaagcaccaaggtttcatctttgacttttttccgtgggagaggtggtagatttggccatttgtaatgaaggtcttgtcctgcactctttcgtgtgttattcctcattcttcagaggagacatgtgacacttgagctcttcatgggaaaactgt

SEQ ID NO: 45215 - DNA, 2097 bp, Bovine  19866880423727
cagctttagcatcattccttccaaagaaatcccagggctgatctccttcagaatggcttggttggatctcccttgcagtctaaaactcaatgatagatgttagctgaacctgttgagaaaatcacttcacaatgtatatacatcaagccatcatggtcaaaccttaaatctatatggtgatacatgtcaattatttctcagtaaaactggaaaaaatagtatgaagacagtaaagaaaaaaatttcctcagaataagtctttatatagcaaaactgttgcctgtctttctgattgaaagtaccataaaagaagtaattttttcttctttttattccccacgaactctgtgcctttcattgcagacagcaccaggtgactctaaattaagctggaatgaaaataccgagtggacatagggtatcacacagtgtttaagggagggctggggacatcggctcacaatagggaaaggaagctttcaagtctcaagggcattaattgctggaaaatttctgcactggtaggaagcaggaacaaattccagtcatttgtctcaccttgtcactcccctcatgattcaaaatgtgagagagaggattgattgacgaagcttagtttaattacctacccacatttactgtatctcagaaatgaaaagagtgatctgtgtgtgatggaaggatcctctgggattttttcatagcactgtattttactgtttccccagatcattcagaatgggagagaaatatgtctccttcccaagacaaagagtaccattaggaacactggtagtggttgcctggtaaccaaaaaccaaaccaagggaaaaatgcacataaccagttttcttatattgcatgaaggtgaagtgtttgaggaacactctggacctctttttgttattacactgtgcaatgaaaaccaaacagagtagcagctaagagtttcagggctctatagggccatgtctttggcaaaattgccttctcttctcccagatttagtcattctccagataactggtagactgatgtgattttctcagtgcaaatgaactaatttatttgagcctttttctgagactgacagttaattcttggtggaggccagaccccacagttggtggtgtgatggtagtggagggagtgaattatgactgtgctgatttcttggagttttctgcaacatgtggaaggattacatgatgccttgtcgttgcaaataagctagtacagaaccaagatgtagtattcattagaaccataatgcaagtattatagctaatttgaggaaagttccagaaaaagaaaggaaactgttctctgctggcatgagcgacggcaggagtaagctattctgacaggcattgtgtttgtgtttcctgtgctttttctatttatgtgcataaaaaattaaacctttgactggatagcagttggcaatggttcatttttattcaccactgtccaccgactggattgaataattacaatttgtcctaccatctgagactttccctgacatttggctgcctctgccctgctgctcatttatgttgaagtttgtacctgctcattaaccgatttgtcctaaaaataactttgaaagtctcagatcctgagctgttagcagttagcccacatagttcagactgtaaaatctagcgtctggctagagctcaaaaagctggctctgttctcatttttaagactaaggtgaagacatttattttgaaactgcttctgattacctctgaaaactataaaatactgaaaactatcatgagagatgtgcctcactgtgctgcagtgttcattacatcatcccaggcatcagaattcaattatgatatctatcttggacatgtggtgaaagataccatcgcttgtattttccacaaaaccttaagcccaagcacttagcaatagcactgtgtttctctattttttggttaaatatttccatgcaaacgttttgcacttttttagaaataaagtgctaaaattattgacatttttagagtgccagaacttatttggtaacatttgcatttgatctttgagttgaatatttttcaagtttggctaacccaa

SEQ ID NO: 45216 - DNA, 744 bp, Bovine  19866880461487
aaaagaccctgatgctgggaaccattgaaggcaggaggagaaagggacgacagaggacgaggtggttggatggcatcaccgactccaatggacatgagtttgagcaagctctgggagctggtgatggtcagggaggcctggcgtgctgcagcccatggggtcgcagagagtcagacatgactgagcaactgaactgaacctgaacctgtgccatttgccgttgattttagctatgaatataagaaatagagaccttgaaacaatagttcttattttatgttcgtgataaaagttttttgaggagaaaggtgttttaaggtttgatatataaatgacttacttattttatatgattatatcatgagacagcatttatattttccttcttaaaggtgtgtttatgaacgtgtgtcctcgtgattgtgattacatttttttcttacttttttgctctctcttactgtatcaccattgttatactttaaataatagtagttcaaattatcaaatatcccaagggcattgatattctttcagtgacttcaagatatattcccaacttacaacacacttgtaatgaattccacatctgtgtagctgaaaggcattttatgtatcagggtctccagggcttttcaggtctggagattataatgcagcaattaaagcgagggttgtagtagcattctcatttttgaacagagctccatcttcgatacgacagaaaatgtttaattcggacat

SEQ ID NO: 45217 - DNA, 830 bp, Bovine  19866880545464
ggaagcataaaaatgtggaaaccaattaaatctacttcgaaaaaatgttgaaatccaagtaatttggatcccaaaaataatcagtggttcatatcctgttccaaatgagaagtcatcttctcagccaattgctgctgtaacattcagtgagctcagtgtcagaccagctctgtgtatttttgccacaacttaaataggtttagctttcaagtatggatcgagagaaaaattatatggggggaaaaaaaaaacttatgaacaactttgaagcattacagctcttgttttatagcataatgataaaaggtgcctgaggtgagatcctgcactgctacttactggctcagggaccttgtgaaaattacttatatcctctgtggctcaggcttttcatatgtaaaatggtgataacaataatcattcagggttgttaagataattaaatgtcataatacacaggaagtgtttagaagagtggtggcagagagtgagggctgtaatagcattacatgcagtcattatccttggatggtttccctttatgttccacctataatctatcaccgtgttccaatcacatccaagaaaacagcagaataaatacatacacacacctgaagcttatattgttaatgacaacagtacagttgatgtcaagtaggagacaaaaccgttgtgaaaaactcaagaaatgccttagcatggaggaggaatttaccattttttattcagaatctcgattttacttctatttaccccattcaatcttttcaccaagaactgtccagataattgctcatgggctgctttcagaaatatatatgccaggg

SEQ ID NO: 45218 - DNA, 1126 bp, Bovine  19866880590364
agtcagtgatgctaattgtcttaatgtactaataatctgatgaattaataaatcaatgtttaattctatatttggaacatacatatataggcttagaattattacagtgagagcagattggtattgctcggagatacagagcaggtgcataagtagaaaactgtagacagagaccagtcgggaggctactaaaatactcctggcaaaaggtcatgaacaaatacatgaaaaagtatgactcttatctcattgtattttactattcagctgcttaaagagaaatatccttattataaattgcctcataaatttaaagaactgaaatcattaagcgtggaaagttgactctagtaaattacacaggtcctggctgtcattctaagatgggaagttctgaggaaatgccatattttctgaagttatatatcttagtaactaaatgaggactgcagtgggaaatcatcactctgtctcaaactctgtaactctgtatagcctggctcatctttttttttttttttttttgcatttcacagtaagtaaaaaaactgaaagactgggttgatgactgttatatcacaaccattaagaggaaataaggcaaactgtccatcaaaggagtgacaacaacaaaaaagaaattatcgagtttcaaaacgtccaaaactgatagccttagtagcacagtcattttccagtggtctccccttcaaatttcatgttctaataagtaaaaaggccaagcagatggccactggtctggaaaaaaaaatcaccctggaagtttcataagtgtgatgtttctgagttgtatatattatctacccacatttttcatacagatagtgtaagatcaagccactcaagatggctgttctcttgctctctatacactccagtgcctcatctatatcctactcacctaactaatcttttacatacttgctccagaccccaactaatgaccggtctaacttcagccactgtgatagaattgtgtccccctttctggtttcccaagaaaatgatgagctaaccctgacattgattcacatataattggttaccttccctgctccctgcccctgagcgaaggctgcccccatgccctgcccaccttctgcag

SEQ ID NO: 45219 - DNA, 773 bp, Bovine  19866880738144
tgacttgttttaggtggccttcttgttttagctttaagtaattatgattcaacatcctgtaagtatgaatagaacaacagtggattttagaatagatgatagaataaagtcaaacattctgttcagctctcatattttacaatattgctacacagaaggttagtaggtcaccagaacacagaaatcaacatgagacaagatttgtgtcagttctcatgtacaaagatccttttttacattacctgttcatctgacaagaagatgtgtttgcagttatttgtatacttttaattgtgatacaaaataattgagtgtctactgtgaaagttctgtggcgatctaggcatgaaatgtctgagtctcaggaacctatagatggagccttcagaatctctgagaagcatacatgccatgggaattggaatttgaaaactaaatatttaatagaaagtatgccaataacagatcaaataaacataaatgttctattccagttcacaattttagtgctccatgaaacaattttctaaacttatgtttaagttagtaggccaacactgcagctgttgcttttagacatgagtggattgacttctggcttattcagtgattggtaattatataacatggttttatttattttatttttttaacatggttttaaaaacgaccttaatttctcttttctatcctgaactatgggaacattatttaacaagattttacatttgaattcttagagagaatactaccctaacataataatacttatt

SEQ ID NO: 45220 - DNA, 687 bp, Bovine  19866880753810
tcaaaattacacttaatatggcaccagcatgtgtgatccaataagattactgacatatattaattactgtaaaatgaaacaaaacactgacttagactgaataaaacagtagttttaaaaaaaacctagttccagttctattcaacatgtcttgcttttcattatacagtgtaaactgataaatagacattagtccatattatcaaaaatgtattctatgagtggaaattgcatctttagaaaaacacaaatatatagttaattgccataagtatataaaataattggagtgataaaaaattttaattaaaaattatgctttcaaaaactgaaagtaatattgggacacactcagaataatggaggaatttccacaaaagacaaagacttttggggaaaagagaatattttaaggaatatgaaaatagatataataaaataactatcagagataggttaggagttcatattgcctgaaacaaatggtacttaaagagaatgtagctcattaaaatgcaaaggacatgaagacagcaacaaggtaagctccttgacatctctcctggcaagatattttttagatctgactcctgaagtcaatctaaccaatgcaaaaataagcaaatgagactatatcaaactaaaatatttctgcatagtaaaggaaattatgaaaaaaattaaaag

SEQ ID NO: 45221 - DNA, 1343 bp, Bovine  19866880809412
tgagtagaaacaaagatattgttatatgttagaaatgtatataggtgttacatcactggggtggaaactaagtcattaacttgcgaatggaaagaaaagggaaaatatcaagaaatattcataatggtgagttgaattgtagcatttggaaagtagggaatggctgtttctagttttctaatatgatcattacattcccttgtattgcaattaaagaggacaaaagtgtcttgcacgtaggagctaggtgggagtttggagaatatgcattatttacaggagagaacaaagtttactagtgaccaattagacttaaaagtttttatgccttctgatttaatgttattttgttagaagtattcatggcatattttttactttttaagtgtgatgatcaaaggaatgactttgataagttaaattcacaaaacagcattaagcaatttaatatatttaatcaaatctaagtgaccttgtccaaggtgtcttttctttcattgatctatttaattcttagttatttgccttgaagtcatgttttggatgtgcacacaggtactttgctttttcctctgtggcaatggtaacattaggacatgaaagaagacattaaacttgaaagaacacaggtagtagtttaaaggcaattttatttttcaagtccccatttggtagtcattctccctgactcttcctgaaccacaggaaaatgcccaggtgtaggagatagcatctgtgaaaaatcaagggagagtgagtgaggacgtgctaggtagcttacggaatgcatccatcctcagatctacagtcagggtcatattagcagaatacaacctagggcttgtcagaagcacacgaacttttcattttgtatttgcaggacaaataattctattttttgttgttatttagtcgctaagtcatgtctgactctttgtgaccccatggactatatagcctgccaggctcctctgtccgtgggatttcccaggcaacaatacttgagtgtgtttccatttccttctccaggggatcttcctaacctgagttaggcagacaagcttcggcaggcagatccagggaagcaccaattctatttttgtatcatttatttatttaggttctctttcatgacattcatgagagattataaattcaatagcgagtctggaaaaatagcttttggaccaagaaacattgaagtacaacctctctatgcttattattccattgactactggatgaatgtttctatttcaacatcaaataacttgaaagtaagtctgaggagcacctgattagttggctagttaggtgattgttgcaaagtaagtttccattca

SEQ ID NO: 45222 - DNA, 1799 bp, Bovine  19866880938368
tttgcctatattagcaacccagttatcataaatccattttaatttgaaactttcaatcaccacagcactacttaaaactgtatgtctctttttaaactttattgtattatggttgttatacagtaagaaacatttaatcacagtctatgctcactgaatctcctatcagtgatgggactgactctctgctggactatgtcacttgagtcagggtgctaatatgatctccttcagttttcagagcaatgcctgatggaaaacctgtcaccgctcaggaggctgaacaagccactcgattcctatggattcgagtctatggaagaggttcaaaatctttttatttatttatttttttaaatataacttttagacagaagtcaacttgcccatatgatattgtttgtatagaaatcaaatagtatgtaagatatacatttggtttataaaaagacttaagatgttctgactgagtaaagaagtagggacatacagacagcatctgtgtgatttctgcctaatccattatgtaggacatattgagtaagaagatgtattgtgtctgtttttcctatcaatattctgcaactgagacacagaaaagccaatagacttttttcaaagaagccatttaatgccttccaagtagatacaggacataccaaagggaacacactaagatattctttcttttgctgagtgtagaggtctctcttggtggatgcattattttttttcatgattgtgacgggaatttccacttggatgtattatttagaagaaaacaaaataattttctataaagaatgactttaattttaaactgcttgtatagaaacacaaagcaaagggcagaacacctagaataaagtcttgcaattgtgaatatcataaaataactctttgaaatagtgtagtgtgaagctaaatgagtgtgataaccagttttgtgcgttttaaatgatggtgtgtgtttttggcacttgctacttataaatcatactcagtgtaatgtgttttatttttgtgcccttgaatatcaacacaaacgtaagtatgaaggaaatcttgatgataccttttctactcttgtttcagtggtgatactttgttctcaaacttcttctctgcaggagataaggaggtcaatcctaggactgagttggatatcacatcagcacactgaccggtgtcttctctctgaactggtgaagcactgcttgattggcagcatagggctgtctcccatgctcattcttgctgttcgttttgtttttccgttttatgtgattaagcttcattatgaggattttcaggtcacccacagttaaatgttattctagctgatgggcactttgatcagcttgtctcacaacttttctttgaaaatcgcatgttccctttcagaagatttctcggcaaaaatggttttaaattaagtcatcaaagaaaaaataatgcacagaggccaattaatatgctcactgaaatggactgtgctccttcttctttctttaatcctgacccacgcagttaatttagaggacacgtatttgacatgtgactaacggaaaaaaagagaaagaaaaaaaaaaatcttctaattcagagtgcctatgcattggccttagaaattattttctgagtagttcagtgggatgagaaaaccataccacttgctgtactattgttactgttgaaatgtgtgaactttctcctataatctattgattgttgcgagttgtgcacttgccaatgaataaatcagtcctgaatattcattggaaggactgatgctgaag

SEQ ID NO: 45223 - DNA, 857 bp, Bovine  19866880967447
actaaaggtggaaatgttacttaacactttgactactgttttgttttaaagaatgaagattttcatcattgtgtgcagagggagaaaagaacatagagaacaaattctttattcaggatctagaaatacattctgaaggggaaagaaagaggcgtgttttgaagcaaagagatgtacaagaaattttgacaaaaagaattctcattcatatgcctaaagggtaaagtgtaaagtccctttgccactttgttcattaaaaatgattctgaaggtctactcagtctccagccacttcagattagctctttttcatgtcaaggactcacctgctgaaatgactttttgtttactcatttatttttttctcttttcagtgtctctcctatccagagtacttttagctcttagaaaagaaagcttcatacactattactacagtattcatgctctccccagtttaacaattttaagactcacaagatcaaaccttcttcctcaggtttagatattgccttttttttttttcctgtcaagaatgctacttattccagatatactaccgttagaataacttcctccctagacaatgataatctacaaggcatagagatcaatatcaattatctcaattcagatgtgaataataaatcagtaagccttaaaacaaacaaaatctgtctaagcttttaaaggtaacaaaaagaagaaactgaatgcaaactgtaagggaattacctcttgcttactcagaataccctttttctcttgattctttgtgtatctgtgtgttcggatgtgcagataatcagaaatgtctcaaaaggcaagacagctacaatcacagaaatactagatta

SEQ ID NO: 45224 - DNA, 1050 bp, Bovine  19866880968364
ctaaattgaaattaaactagattttgatcattccttgtttacggttagatcaaatcatgacaattctgtttttttattccacctattcagggcaaatatatttatatatttatgtgtgtgtgtgtgtgtgtgtgtgtacacacatatatatatatacactatatatatatagtgagtctacttgaatcattgaaaatatttagatatcattgtttcctttcttcctctgttatcccagctagagaagattacccacttaagaattacaaggcattcatgtgtataattatatacgtgatctcgtcccttagactgtatgccacagtgacagaacttccctttatccttttcttttgtaaatgtgttcagaaactgggaaagtagaataatgataaatgcataaattactcaaatggctacatttgatgggtgacttttgagagaattagcaatactttagagttcctttttttcttaaaaggacagggtctatgtttcactcatcctgtcttccgtagagcctcacacagtgctattgaaagttggtgtcaagaaataatttcagagcacaaggacagtgaagaaattagattgtccttcagactcaaaatgaggtaaaagtgtgctcattagtagccatcccctatgtgtttccaacttgtatatgagcaaacgttataaaaattagaagaaacattcaagaaacaagttcacacctctgtcaaaaagggacttaattattgaattatcttcatgtttctttccaacttcaaaacttttaattcttaatttcagtgattattcatactatatgtattccagtcacctaattaaaaacactctatcacttaacaaaataggaaaaggttgaagaaaagaaacgtagtctactcttttaccctggagaaacaaaccaaaacaatgataaaaatgttttaagaggggggaaagggtattgcattgaaatagctatcaaatttaggacttagagatacaagtgccacatgaagtggaaatttgtaaattgtggaaagagctgcttgtatcttg

SEQ ID NO: 45225 - DNA, 1151 bp, Bovine  19866880993776
aaatgttttattcaacttgcacatctcttctccacaatcgttgatttagaattcagctctctgataatgagtggaaattggggtctgaaagagaaaaacaccattttcttaaatgatgaatgctgcaggcacacattgtcttcaccttaaaaaaaaaataatgaaaccctgaaacactttcctaactgctaaaatgcttgacctttgaaaacaaagaaaaaaagagcaaattacaactacatatttaaaatatccaagatcgcatccctgacattacagcataatgacaagaataacatcaaaacctggtctgaaaggatttcagtggtattctctaggcaaatgtgtgacctgatgaggcaggcattgtgggagtaagtaaaaaacagacaatactttgtctttctgtggtggtggttgctgttattgttgttgccgttgataataaaaaggcctgatctcttcaggaaggctgtgctcaatcctttccctgggctgtacttcgctctcctattcaacctaaggacactgggcagcctcttcagctctgtaatgaaatctgagcaaaaaagcttttaaaataaatcagtcctgtttaaaccgcagctcagagagttgggacaactcattgtgagacttctctgtttttagctgtggagcaagctgttttgttttgactctctcataaacccaggtctaacacacatttacttggccattcttggaaaaagaaatcaaaagagccagtcctggagcgtctgagtactggtaagttcagagagctttcagcgtccaggggaggcaacagagaactcccatctgaatgactgcttcttaatggagggatgaaaggatatgatggacgcaaaggccatgttggacaagcgtctcggtggggaaatctgccaaccggacaacgcctcgcccagggaataaggatgcagttagaaccaccttattttcaaatggccaccatgacaagagctgttaagtattaaacagatgtctgctatccgtgattgcatttggatctcacaacttagcggtgtcagtagaactaatgactgagacagataaagtggcttacttcctgcatggattaagaattcggtataaaagccaaaataaagtgctgcacacctgccacattt

SEQ ID NO: 45226 - DNA, 1117 bp, Bovine  19866881027111
ttaaaaatacaataatgtaaactcataaattttgaaagaggatagattataatgtgatgtttgctattggctttatttctaataaaacagacaggaataaacctgaatacaatttatcctttaaactagttttttttctggagtgtgtgttacttttgaatgagaaatatttgttttatttaaaagaaatcaaccacattttagtcaataaataagcattgagcaaagcattatactcaacactgagttgctataatccatacttgaatttatcagaagcatgaagcagttttgaagagaggcaatctataaacactcataagagatactgaaatttttccaaactctgcaatatattattatgctggttaaaaaccagaaaccactttagtctcatccttgcctttaagattttaacccattgatttaatgtgagtattcaatgacccatcaatattcctttttaaatatttttctgattcacgtgtataggttcaatgttaatcaatttaataaatacttattagaaatctataaccatatgttgaggactgttttataaatgcttgctttattttttattgcaagatttaagcataaagactattgcaactcaagtctgcaaaaaaaaatctcctgtcatttctgttgttatctacctaattctatcacaaataaatcatgattcatatttttactgaagcagaaatatctttaaaatgatttctttataattccatactgaaaacaaatacagcagcttacaagaaaagtgtgtatgtctatgtatgtgtctgtctgtgtatccatcttgaagagttagtatactgagcagggctggaaaaaagtcgtgtggaagtcctcagagtggaacatgtcatcatgaaggaagaccctgccactcatcagagggagtggaggtgaaaggtgttaggagaccagagcaagcctgattcgtactggtgacaggggctgatggtggaagtaaacccaacttgtattacatttgtcctaagtcttctgacttttcagttcagtccctgtggtgaaaccactctctccttactgctgccgttgccgctctgttatcatgtgcagaagattaaaaacgctgtca

SEQ ID NO: 45227 - DNA, 1415 bp, Bovine  19866881079366
ttccctcaccctcctttccttatattttatcatatgcataaaggaatacaaagctgcctccatggtctttttgttgttgttgttcaagtttccttctgtccacaatcatgatcatgagtatggcggctaatatttattgaatgctaactctcccagatggctctatggtaaagaaccttcttgagaatgctggagccacaggagacactggttcgatccctgcattggaatgatcccccagggtaggcaatggggacccactccagtattcttgcctggaatattccatggacagaggagcctggtgggctaaagtccatggggtctcgaagagtcagacaggactgagcaactaacactttcactttcatacatactcagattccagagcctgcaacccagaaaagagaaccgtgacatgatttttcaggtagcattttctaataccagttttgaatgggattgagtggaattcatatcctcccagagaaaaataatatggtattggtaaactaatgactatatcacatcacagcccttaatgaaggaaaaaaaatgtgagacattggcacttaaaacaactatatatacatactgacatacaaatctaatagcctttacaaaaaaaaaaaaaaaaacaaggaaaacagtctgatcaatggggctgccaatctgatcaagatggcttgggctacttaggaaattgatagttgatgaagcaaaaagctctgaaacctctgccaaatctggcacagaattctactctgacaaccacagaacagaggatttgcaagttttctcttgctgtaacattttgccaatgtcaaaacagttcattctgcaagcctgccagtctcccacaaagctcttcattcagtttttaagggaagaacatagatggtaatcaaatgtctttgattcaaatggcattacagctgacacatgaaaagatttaaaagaaaggaaaaaataaactgacttcacaactcccatagtcttaaacaagaaaggctcatcactcaatagaatgagcacttcctatggtcttgacagccagaatttttgtacagcttattgcaatacaaattctcttgcatgcaattaaaaatgtgaatctaacttcagttttctagtattaattaataaagtggaaaataaaccatcataaaagttctcagcattcatgagaagtcatccagacagggtgtctatggtggtcaatgatatagattctggagtcagaagtcctggatttaaatcccagtaggttaggtcttaatctcctggcactgttaggaattatatatatatatatatatagctaatgacactagattcttgccttgcagtctaactgaaagggctccattctatgaccaaattgtcccccttttttcccctctgaacctctcaaa

SEQ ID NO: 45228 - DNA, 797 bp, Bovine  19866881147127
ttagaggtagcagaaaaattatcctaaaactaacaactgctctgacaatttctgatcagctcaacataaaattaatcaatgaaaatatctcacagcatagtcaggtattcaagttgtagcattctgtgaaacaaggaaatttttcaggttccattattagaacctatgagtgagttaagttcacttcttaagcatttttgaaaatggaatcaaaacattgcacttgggtggtttccaagactattttaagagataatggtggaggagtcagatttttcaaagtagtctgtgtgtaaaaagttggaaacctatatgtgtttgctttaggagggagttgaagcaagaaggagaagggagaagcagaggggagttgaggacaacaacaaaaaaagaagcaatccactattcctcaaagcatgggcctgtgtttatgaataatgtaaggagtatgtttaacattcattcacaagtgaaattctccacaaactctagactcaatcactactttcttcttgagtagcactcagtctttggaagtacaaatagaaatcacctaaaatcttgttaaaagtgtgaactcccagactgcactcctagagaacttacattttagaaagtatctcaggaaacttttctttagaaggcgtaggacccacaacttgcaaaatactgctttagattcttttatggagaaaaaaaaaaaaacccaagaatctaagatagtttaacctaacaatggtggtaatttctctttttgttgctatcaacaaaaatcaagctagcaatttttttgaaat

SEQ ID NO: 45229 - DNA, 1061 bp, Bovine  19866881148717
agcctcctaggtttctttccttctttactttttaaaagccgctctggctctttttaatgctacagaacagaggttaggtcaggggtgcttttttctagctgatgttgccctcacagggtgattcagggaagccagctggccaggtgcaggcctctttgcactccttcacctctagtaacagaaagctgcagaattctcagctgagcacatagagtgaactcgctcaaaaggtgtcactggtcacgtgcacacactttgtggcaagcttcccattcttcagctagagatgatggatagtcttcctaaatggcttcgtatagatggcggcagcctggcaggaagacctggggaagagtacataagagtattagaacttcttgagtttcagttttaaggtttgtaaaatgtactaactgaccctaaactaatagggtttatataggatttctgctttatagaaacatgggggctgggggaatgtctttcaaatattgctgcaggtccattaaactggcttagctgcacattacccatttctgtatatttgaaagagtagaggaccatttatttgaacatgagttgtttcattatgttattgctgtgacataattttttttgtaggtgtctgatatcttttaaacccatactgagaatggatgcttaaagtttgaagaaatatcactttattttccattaagttaaagaaataggaataataagaatgaagaattcttactgaggaaaacaaattaatagataaatgggtcaattttaaaatgtactttgcagtcaccattaacagaataaatcgtttcttagatgtttttattcagcaatatataaacattgcctctcaccttatactgtacataactggtggtaaatggataataatagagtgttacttcacttgttaataatccaacaaagagaatgtgacttagtgatcaatggcaattacattagaattgcaacatatggtaaattgaatctttttgtacagtggcatttagttgtttgggaccacgtaccaaattaatgggaacatcaggtaaatttaa

SEQ ID NO: 45230 - DNA, 828 bp, Bovine  19866881169468
gtcagtaattctacaatgtgagtctatctgctactccaacgtggatagtgattcactttgcagaatgatgtgagagcagggcacaggtgcgtttgcacaactctttcagttccatcaggagcacccttcagcaggcaaaacatgtctgttgtcaccggggttgggggagggagtaagtatatttgggaactagcacccttgggtagtataaaggagcatggttcacattgtctgaaattgctcatgccctggttcatccagctggtaatgaagcagtcaacatcccatctctggagtggaataggcaattattccagcttgaaactctgcccttgcaaattgagtgtggcaacaattcacattggctgtcattacaaagtctctcaaaacagggtagctatccgtatcagatcacaaggaaaaaccagagatgcctaaaaagtttaccttaattccaaatagattatcgtgtgggctgatgatatggatatttaagctgctttcgaggagacctttttgttcagttttattcttcgatcttactccaaattgctccaaataaatctaaaatcctagtcacgtagaatatttctgtagagtctcattaaccaaaacctcctgtcttgcaatacagttagagaataaaaacatctctcatttccgtctagttacattttaaggctgttacaagaaatcaagaaaagaacaaactcctctgggaatttgaaccttaaatgtgcaagtaaaacgtttgtacttagacctctcaaagccagctcatgtatgtatcttctggggagctctcaaaatagtatctgcgcctgggcc

SEQ ID NO: 45231 - DNA, 1746 bp, Bovine  19866881254055
aatgtgggttgaaaatgttttccttcttatatattgttttatataatgagcaattcactatcttaaagaaaaaacttagagaaagaagttggcaaacacaaatatacaaaatgattattagatattaagaatgtgtcatctttctaccacagaaaaaatctaagtagagttttaagtcatctgcaaaagagcaaacaaaaaatctagacttccttcctgaagtcagcatagaggccgtctaggtatctaggggtaaaaggtagaagaacagaaatctctctcttccacttccctatgaaaatcgttcccgtctctgaggggagccggtgcagaagccttccgccgctattgtgagttcgtccattgtgcttctcttttccatttttttcctccaacccaacagaattgaagtttacttacaaactgagcccccgcccccgcccatatatctgagctttgactgacagcaagtttattccgtaactgaacttgaatggcactgaacgcttcagatactctttcctcttgccaggtctcttcttgcaagaagacacgaatctctgacttgattctgagggaagtgctttctatccacatgtgacttttcactcactgaaatgcatgacaagagttgaataaataacacctacagatacaatgtgcgcatttgttcaatgtatacaaggctctgaaacttctaatatcattatggttcttgagcatgtttatgtacaaatgaagcacactcagtccatctcagagaactgtttatttaacctcaaaagcttgactgcagccaatacaagcaagataattcacaatacatagcgaatctccattctgacacttctattcattcaatggtattcaactttcctttttcattttactttttgaagtagagttatagaaaggtttgcacatttaaaattccccacagacaatagctctaaaatagtcacaatacaatcaacagccaggaagttgaagcacacttcccctatagtgcaggtaagtcagcaaatagaagattaacatttaatgcgacagatccgtatctgtttactgtgctttagagggatggtactttaagttaggatttattttcttcagtacactttatgcagaaatgtctctgaaattttcgtattttaacaagaagtgaaaacagtaacctgggttaatgtgaaactttctgccaactttgtgcatttcttagagcacacagcgttgcaaatattcacaaagaacattttgtatgcagtattcaccaaactcaagtgcagaagaaatacctttttaaaggagagagaataccttttccatttcagtaacaacttttacctaaaccattctgataaattttgcataattacttcactcagttcttggtaaagatagtgaatgatgtttcattaaactacgttaagttaaacagctctcaccagaggaaacatttctacaaatgcaaagcactgtaactcctcctgtacacttctgtttggagaagggaatggcaacccacttcagtatttttgcctggagaacttcatgggcagagaagcctggtgggctacagtccctggggtcacaaagagtcagacatgactgagtgactaagacagacagacacacacacacacacacacacacacacacacttccgttacatctagtaatggccttggccatggagggtggagaagagactccagttcaatttgaattcttttcagagttagatgt

SEQ ID NO: 45232 - DNA, 1041 bp, Bovine  19866881417227
cttattctctaattgtccctaatgtaaattttggcacaagacaccttactagaaactttaacaatttatatatttatagaagttcattcttctaaagccatttctataaagaaaaactcatttaaagacaaaatagctaatttgattctgacatgattttagatgttgctcacaggaggtgaaagctctggtatggttccaaagtaaatgtattatattgctccctgaaaatgtacatttcctgcttttacacatttcaattcatgtcatttagaattgctctatatatttcattagggatgtgaattgacttcaacatattatttatagaaaacacctttagcctacaaatttctattgtaattacttattaagatgttacttgcattgttaatctgagctgaaacaaattaaatgagatacctaatttacttttccttaaatcttttcttaggtgcacttaattcctaaatgagtatttttattcttccacaacagagattacttcctagaatattatatatacggagtgctctttttctgtttttgtaaatattgggttaataacatttctgtcactactatctaacaattgttcagagtaaaattgattttaccgtccaaactgtgcatttataccaactgacataaatgactcagggtcaaaagaatgatatacgctttcaaaaatcagaaggattcagctttaatcataaagacatttatatgtaagttgtctgattcatgatgactaaagaacttatttagttctcagatttcaggccaataaaaatgtgagaggtgaagaataagatgatattcattaggaggagcaacattgataatcctaagaacccatagacattggaatcaagtttgcatacagctctgctacttaatggttgtgtgactgataaattcattttgtgatctaggcttaatgttttataaaacaggaatagtgccttgcatgtcttaaagggatgtgttgaatgctaagtgaataatatccataaagaacctagcacaatgtctggcata

SEQ ID NO: 45233 - DNA, 1073 bp, Bovine  19866881472589
agaataataacagcattttatacttctgggtgtgccctacatctcagtgtcccttactaacatgaataaattcctgtatcacttctgtgcgatattggataaatattatgacatcaagttttacagatggggaagttagaaaatgaagcacagatgttacatagttttctccaatcccgagtcaatatgtagcacttttccacaggctgcataaataataccaaggatcaaaactgatgtccagggaagtagagatgggtggcgggaagtggggctcatttaagccaattgaatgtggaaaagccacagtgggaatagttaaactaagaaggtgattaaaaaaaaaaaagaggtattaagtcactgtgatttatttatagcttctagcctagtgacttcccaaatgaatttccagttagagaattaggattctcttctcctctaaggtatttctgcaagaaaaagaatgagaacagacactaggaagaaaattgtattagactcctaatgagggattattgttcagttggtctggactgataatgaatttccttagatggactaaggaaataattgatcgaggactcatatttgtgatgtctttagcactagaactctcatctttgctcttttctgtccccttaatctttatccacatctgttcatggttacatacttcctgtctttgcacaaaatatattgtatatgtaatatatttatacatatctacattatttaatatatattgaatacaaactggatgtattcttctatatatagacactgttttttttttgttttgttttgtttttggtcattttttgtttggttttgttttgggtcattgttttttagacaccacttttaccttcttaatagttttgattttctcaggatctcagattaaatcaaagtttcttgtgcatgcagattccacaggattaaaagaatcatttgtatagttatgtctttaatatccatctcccactgtaaactccttaagaatagcaaccatctgtcaggtttccaccctttcttctacctttggcacataccagagggtctacatatag

SEQ ID NO: 45234 - DNA, 1890 bp, Bovine  19866880374222
tggcgctggactgtggcggcgaacaggatgggcactgtgcgtcgctcccgtaggtaccgtcggaccttggccttcaccctcaggagcacggtgccgccactgggggaggggaggaggagcaagggagccgtgactgccggacttaggagtagggggtcccaagaccctggtttgatcgcttgcgacacccctttcccagcacccgtgtgcggggcagcgttacctgaagtggctcactgatgatgcatgataacaccgggcacccaggtgatgatttcctccccacccggtacagaggaagacaccagtgcccagcacctgccctgggcttcaaggtgggacgacgtggcagtgctgacatttgaactttagtcccctctgactccagagttcaacccctattgccctctaagctctgctcggagtctgcggctctgtcatggccttccacgattccagggaccaagccaaagtccaaactcctcgtcttggacctggcacacccccggatcatccctctcccctcaccactctggtaaaaaaggacaagcttgcaatttgtccggtctccctccctgtgggcccagcaagggtggggctctgtcctgcctcaccatcttgctcctgggccccggtcggtgccaggcagggcattgatgttcaacaaatgtttgtgcaacaagcttttggcaacatccccctaccttgccctgccacctcggacccctgaactctcctggctccccagcctctccgcctttgctgctgccatgccctccgactggcatcccctgcttccacctcctggatgtgactctcaagcatacctgcttctcctctcggaggcctcctctgatttcccagggcccaggcctgaagccgtctctctgcttcacgcccccacacccctgggctgctaccatccttcctgcggtggccactcaacacctccttttgcaatcagctcagattgacaaacaccgagctgcctgttctgggtgcgggtcacactgctgggacactaccatgagcaagacaagactgccaggggctctgctcacagggccctgctagcctgcgggttttctgtgttccctgccagtctccctgaccagtctgagcctgtcccaggtccaggactgccctgtccactcaaccccacacccagagtcagcccaaggtctggcgcagagcaggtggcaggcagggtttctggtacagaatatcctccttgtggaccacacctgcccttctttgtggagcaggttctttgtgggcatgattcagggtctgctccagaacccgtgccagctggaggacagggacttccccatagggttcctcttcaccctctcacaagctacaacatcttctcgggaccccttaccaaggtctcctcaacatgcctggtgttcagtgtatggaccaggaccccaagtctgctctaggccaaggggcaccaggttagggatattccctgggaagagactttgaccgtagcaatggagataccacgtactattgcgaggggaaggatgcggagcgaagactgctcctttggggcccaggtgctctgtgctggtaaaggccatgtggtctggtttggggaaattaaacccagaagagtgtaggagacccaggaagggctgttccaagtactcacaagatatcacgcctgacagtcttgataaagattcggatgaagcgccagccgccagaccccaggtagaggaagaacagggagagccccacttgggtccagggcagtttcagcaccagccaggagaacagcagcacccccaacagagacgccccaagcagcatcgtggcctgtgggcacaaggcggtcagtggacccaagtgcctgggtcccctacctcctggcccggg

SEQ ID NO: 45235 - DNA, 1410 bp, Bovine  19866880386503
gtctggggactacacgggcctgcagctgcttctggccctccgccccaagtctagatgacagctctgccaggccccagcgaggtgatgcgggtataccactttaggtctcttgatcccaatttcctcatcagctcacgggtggggtttaaggactcagcagatcacacattctaggtgtttagtgggtccctgacgtctcacagtgcccaatcgaaggcagcttaaaccctaatgataaaatggttatttttgcaattgcatttctagccaggtgacacctccggatggccgagaggattaacagacactctgtgtgcagaaacactcggcgtggcacgcagcacagaacctggtaaccatgaggatcacggttcgtaaggaggcctcagagaggtgaggctggggaaacagtgcaatgaaccacctgttctacctgctcaaattgggtcaggctggagctgtgtacccggctgttgccatggcacccaacacacagggaaacactctaagctagaagtgtggttgctgcaggagtggggcctcaggcctgcttcactcagacacctcccatgctgccactacccctgctttctggaccacatcagggatccctgaggttggggcagtacaccgaccacctaagcaggtctcatacccctgaccccaccccaactccaaaacaatggggctttggccctctgggcagagtggggggcgctgtgaggaggggctcccaggctgcagaccagggtgagtggaaggggagtggatggggtaggaacctaggagccctcatctcctgagaaaacgccaaagcgtctctaagcagcctcaggtcccaacatgtctgttccctccagccacacctgcccagcagcgaacaggtacccagagcccacttcgtgcctagctgtatggggttcagtgccagctcttccctcctcatcccactcagctttcatccagggtgagggttggcaaaggctgtcgagactcagccgggtttagggaatccatggcccgtggccaagagggaagaaggggagagagaggagaaatccagatgctgcaggctgagatctggaatttttcagactttcccacatgagggggcaggtttggggcaatggaaaggctgacaggtagggtggcaggggccccagggcctgggaagcccagctgagactttagcctggggctgaatactgacttctcagtagaatccaagactgtgcccgcaaccctcagctcagatgagagccccccactgctgactccagctggtacccccaagatggaggaggggcctggggtctggacccctctaccatagtaactgcagcggctgcaacgatttgcctggccagacgtggtacatacattatccattccccgtcacaactgtagtag

SEQ ID NO: 45236 - DNA, 4960 bp, Bovine  19866880388815
ctgacgctggagcctcccaggcccctcccgggcaactgtcggcttctctcttccctccaaatacgatctgtgtagctccctgcctctgcctcaggtaagagtaacgacaacgacagtgagggtgacagcggggacatcgactgagcacccaccacgtgcgagtggctgtctgagcccgttccacactgccactgatttaatcttcacagtaagcccgtggaggaggtactgttttcactcccatttcaaagatgaggaaatggacgcacatagatgttaagtaatccagcccgggacacggagctggctccaacagtgctacaagctggagtcttacagtgaagccacttgactccagtctctgctcttaaccacgcacaccctgggtctcctaatgtggtatctctgcacacactcgtgaagccagaccccacggctcagcagggatgcaagctccctgacgccaagacggtggtatccacttctcagcactgcggagagaatgcagtggtatcaagatcaggctctggggtcagacagacccaggttcaaatcccagctctgcctccttagaggccgtgtgaggaaattccctggcagtccaatgggtaggactctgcactttcaccgctggggccaagggttcaatccctggttgaggaactaagatcctgcaagcccagtggtgtggccaaaaaaatttaagaaataaaggctgtgtgaaccagaacaagtgtcatctcctctttggggcctcattctttcatctgtaaaatgggttaacagtagatcccatctcacagggatgctgtaaggcatccatgacggggtccatacacggctaggcacagaacagtcagcatgggacaacgccagctgtcacgatgatgctgttgttacagcttcccctagcacaagacttgccctgccccaaaatgccgtctgatgtccggggtatcccttgtggaatcctctccgcttcagaatcctaccagtgacccccagggaaagggcggagggataagcaggtggtccccagcccccgtaccttggtgaggtgagcgttgtacatgtcagtgaggagcctgcgtccatgtcccacgccgagcactgaaaggtaccccagcctgatcttacactgggctcccccttccggttcccctgggctctccaacccccaccccgtctagcggaacactcccactgctgatgggtgtggcagccagggggcaaggagagcatcttctactggaagcaaggtagcctctggacacgtgtgtgaaaaggcagatttctgggtcccagccacatatactgactgactcaaagtgggagtgggggtggagggctaggatccttagcaagctccctggggatcctgacactcaaaagtaagagaccaccagcccagtcacacagacctatactcccatctggggatggttctcagcatgtcctttaacgtcctggggtctcaggctccgcatcagcaaaatggggataaaattactgtctgatccctgtgggtgttgtgatgaccgaggcaatgagcaggaaggaagcggtgagcacaaaggacaggcccaataagcaggggcattgtggccactccctgtctttcctcgggtctgtttctccctctggctgaaggaaagaatgaccctccattcactcctggagaggctaccccgggaggggtacatgagatcacgtccacccgcctgtgtcccaggaagcaggacaagttgctgtgactattgtgcatggagaacgtggccaccgcctgaccctggggacacagatggctcatgactcagggctttgtgtgcccagcgacatctagagctctgccagcggggccagggtcaggcacttggctaccccacacaagcaagaggctttccctctctggtccagggactcactcgctacatgacccaagacaaatcatctgtgctcctcgaggctaacttttcttcctaaaaccatacggtatctaccaaacaacactgttatggtgattcatgtgtacaaagggtttcaaaccacatgtcacaggcaagggtcacttgataagggtggacgatcaggacatccctcttcccaccagtttcttcctagacatcagacttgggagggatcaggggaggaaggcaggagtgggaagtggcagtcagttgagaagtggactgggctcctcagaactccccaggcctctatcactgcaccccaggctcaccataccacctaccaagcaccccagacgcctgggaatccagccggtgtcccacgccaaccttcaggctggtgaatgcgagtccacgaactggaaagaaacaaatgaggtctttatccaatgaacccagcctccaggatggctttaggcccacatggcaatctcattcctagaatgttgcctcatggagcccaaaccagcatcaagctggactttcaggcttccccaccaaggaacctggggtcccaaaccattcatcagtttccggggcccagagaaaaggcaacccaaaaggcctgttaagtctgcctgtcaccattccctcaatgaagggctttgagtgcactgggcagaacactggaattaagactggggggttccccatccagctcctgtggaaggcgggttctggacagtctcccagtgagaaaatggaggctgcgaattcctgagtgtgtgtgttcacagagcccagaactcactgactgctcaggaaataacccatttcccaaaagaatgaatgactcatcaaactgatataattatgtacaggtttttgtacataaattatacttcaggaaagatgtccaaaaaaaaaaaaaaaatgaagaatgcaggaatgagctagaagcttttacatttctgaagatcaagaggaacctagggtaacagtacggggtagttaagagcctaatgaatccaggctacatgatttaacatgagccaacactgaacttccatcttatcatttgtgaaatgggactaggacccacttcacaggtttcagtgagatggtacttgggaaaagcctaacatagtacttagtacagagtaggccctcaacacatcatacttcctattgctgttgttatactgtggactcattgaatatttctgtccaaggggttttggaaatggtgggaaattcttagagatgagaataccagaccaccttacctacctcctgaggaacctgtacgtaggtcaagaagcaacagttagaacttgacatggaaaaacagactggttccaaattgggaaaggagtacattaaggctgtatattgtaaccctgcttatttaatttatatgcagagtacatcatgtgaaatgccgggctggatgaatcacaagctggaatcaagactgccaagagaaataccaataacctcagatatgcagatgacaccatccccatggcagaaagcagagaagaattaaagagcttcttgatgaaagtgaaagaggtgagtgaaaaagttggcttaaaactcaacattcagaacactaagatcatggcatctagtcccaccatttcatggcaaatagatggggaaacaacggaaatggtgagagactttattttcttgagctccaaaatcactgcagatggtgactgcagccatgaaattaaaagatgcttgctcgttggaagaaaagctatgaccaacctagacagcatattaaaaagcagagacattactttgccaacaaaggtccctttagtcaaagctatggtttttccagtagttatgtatggatgggagagttggactttaaagaaagctgagtgccaaagattgatgcttttgaactatggtgtttgaaaagactcttgaaagtcctttggactgcaaggagatcaaaccaatgagtcctaaaggaaatcagtcctgaatattcattagatggactgatgatgaagctgaaactcccaatactttggctacctgatgcgaaggactgactcactagaaaagaccctgatgctgggtaagattgaaggcaggaggagaaggggatgacagagtatgagatggttgggtggcatcaccgactggatggacctgagtttgaaaaagctctgggagttggtgatggacagggaagcctgacctgctacagtctgtggggtcgcaaagagttgggcacgactgagcaactgaactgaatactgttgactcactgaatatttctgtccaagcagttttagagcttcctggcctctaagctccttagccttcctatagcctcccaaacatatactttaattatatctaataatgggggctcattatcgaaactagtttcaccattggttagcttcattgactataaaatgtcactcttcacagacatagagaacagatttgtggttgtcaaaggggaagggaagtaggggaatgatgaattgcgagtttgggattagcagatgcaaactattttatataaaatgggcttcccaggtggcacagtgggaaagaatccacctgccaatgcaggagacacaagagattcacacttgatcccagcgtccggaagaccccctggagaaggaaatggcagcccagtccagtattcttgcctggaaaattccatggacagagaagcctggctacagtccacggggttgcaaagagtgggacacaactgagcgactgagcacgcatgcacacacacacacacacacacatacacgtagaaaggataaatatactgtgataaaccataatggaaaagaatgtgaaatagaatgtatacatcagatcagatgagatcagtcgctcagtcatgtccaactctttgcaaccccatgaatcgcagcatgccaggcctccctgtccatcaccaactcccggagttcactgagactcacgtccatcgagtcagtgatgccatccagccatctcatcctctgtcatccccttctcctcttgctcccaat

SEQ ID NO: 45237 - DNA, 998 bp, Bovine  19866880430202
acaagggccacgggtgcagtcccttcccagctccccaaagtagttcctgatctcttagcccatcaggaactgaagtcaggacagaactcccaggctcagaggtcaggggtgcccccaggcatccatctccctcacacacacatcgcactggggttccatctcccctgggtgagggcaggtgccacaaagcagtaaaaaggcacacggctcctttttttttgagtattgagaaattagagttcgtcattcagcaaatgttttgcaagtactaactaggcccaagcaaacgcattctattgcttcaccagcaaacgccagctcaacttgaaaagcccagttcaaacatcccacctcaggacatgtcttccgtgatccctttcatctgtacctcagatccttctgccttaactatccattttttcccactagatggagaatcccaagggtagtgcccggcataagtgcagtacagggttaacaccatggggaaggcaatgcatttgttttttaactgctgtaaccttaaaggtcaatacacagcctggtacatagtagctgctcaataaacaaatgaatgaacacatgaattcggctgagccggagaatggtcactgttgatagtccaccagtgacgaggaaggtgtgttcagtcaccttcaacttaaggccacttgtgccccctactcccaggccatacctctgacctactgactggcagacaaagagaagctgagagaagacagggtgaaggcagaaaccagctgccctgtcccccaagaactggaaggaggacaccactgaggctgggcttgtttccttgctgtgcaggttagggccccgctctggcccaggtttgagcagagaaggcccctccatagtgcccaccagggggcaggaccctgggacagggctggaaccagggcctacctcggccagtccagtgcagccctggaccagaggagaccagatggcacccgtgtggcccacgcaagctgcct

SEQ ID NO: 45238 - DNA, 1235 bp, Bovine  19866880449940
gcatcccaagtctcaacgcacaaacctggaggagagaggagagtggggacaggttaggcccaaccccccgaagatcgaagggctctcccacgctgagagaagccagcttcgatcctgaatagccatgacgacacagtctggttcaggagaggccagtcagtaggatctgggcagacgtaaggcagaagcagagagcaggcctaactggtccacgcaacccactaccgagctttaccaaggatgttggtgggactgctgatgtcattctccttaactggggaccactgcaagcaaggccatgggaaatctatcaagtccttcagactggcaggtttgagaagttatccagagactcagacatccagggcctgaaaggtcctgagtacactcaggttcaagagtaggcaggtgatttcaagtactaagaacgtgggcttggggaccagacagagctggctggcttccagtccctgttgagaagcattagttcaggagagtgtgacctgtgacctcaggaaatgacttctccccctctctgcccttggctgctttttgtgaaatggggaaaataagaccctttgcaaagttactgggagaattaaatgagagaatgccggagcacagagcacatgctcaaaaaatggcagctacttccaccgttactgcaaggacgcaggtgtagacaggggaagggtctcgcccaaggtcacagtgcagatgagaagcgtaccgtttcttagaccttgccggcttggttccaggcacccaaaggcagattgcctctgggagaaaagcagtcctctgttgggacagaagctcaggcaaggggtctattcagactagggaaaggcagctaaagcaagagaaagacggagacaaagaaaacctatggcttggtgtccgctggtggcatgaggcttgaggacagcagcagagcgttgaagggcaaggccggcggagacttggagcactcggggagcggcgagagcaggagggcccggcagctcctataactacaatcactttgtgcaaacacaaggcatttggcacaccagacttttatttcacagcactgatgatagctcactcctttcagaaagcggcagccaagaaaaaggaagtggtcctcccttggggggggggcggcgcgcgcgtgcagctcatcttggtaagcgggcccctgctcgggccagttcgtgggaccctttctgccagtcccttacccggctgcgcag

SEQ ID NO: 45239 - DNA, 1071 bp, Bovine  19866880453102
atttgaacccaagtctgtttcttaacttctgctcttctctgcaccgtgggctttcagctgtcttctacaacagagtcgatgagatgttctttatgtgtattcaggtctcaatgctgggaagcctcctgcccctaaacagcgtgttcgcttcctgttgggacccgtggaaggcagcgaagagaaggagctgaccctcacagccacctgtgtgcccacactcatcgaccatccgctgggtagtgcacattcgggaaaggggctgggtgtcgcttccccgggaaatccctgcccaaagtcagtgtgtcccagccagactcctcctgtcccagaccaatgtaggaccacagtggcaatgaagtatttgaccagagattggcagaatttcctggaaagggctagatagtcaatattttaggctttgcaggtttctgtcgttgtagtgcagaagcagctatcgacagtgtgtaatgagcctggctgtgttccagtaacactttacctgtggatttgttgttgtttagtcactaagttgtgttctctaagtttgattcatttgggaccttgtggattgtagcctgccaggctcctctgttcataggatttcccaggcaagaatcctggaatgcgttgccatatccttctcaaggggattgaacccgcatctcctgcattggccggattctttaccactgagccaccagggaaaccaggcatcactgactgaatggatatgagttagagtaaactccgggagttggcgatggacagggaggcctggcgtgctggagtccatggggtcgcaaagagttggacacgactgagcgactgaactgaactgaccgtggaagccccttacttgtggatactgacatttgaatttcatgtatttttcatttatcatgaaatagtattcttttcatttttttaaaaccacttatcattttaatttgtgggctgtaaaaaagcaaaacttgaggatttgacctgtggactgtagtttgctgacccctttattattctgggattccaggtaaaagttgagaccctaaggtagaagtcttaaggacagaa

SEQ ID NO: 45240 - DNA, 1800 bp, Bovine  19866880455053
gacatgagtttgagcaaactgcaggagatagtgaaggacagggaaggctggcctgttgcagtccatgaggtcgctaagagtcggacaggactgagtgactgaacaacagcgggggtccggggcccggtgtgcccttgccttgaaagccaggccattgtcagccattgtcaaagcctccgcgtttgcttggttaactgtagattagactaggccagggtacccaaacctggctgcaagttataatcatccgaaacattcataaaaatgtagatgccagggtcccaccctaaatttacacaattggaatctgccaggagtgggtaggggaggatagaaggaaagtgggatctgagcttctgcctttttaaactgcttcctgggagattctgttacccagacacacagaacctctggactagataatttatgagcacccatcaaatgataacatcctgttagcatttgggatcatgcatggcacataataaatgctcgataaatgtttgctggatgttttaatgggacactttgggatcctacagtgtttttctcatgccctctaggattcttagacctgaaagcactgttattctttccagtaaaaatgatagtgctgactgctcactgagtccttattttacttgctcactgtgttaagtgttctatatgtgcaaccttcttgacttttaacattaaccgtaaaagaaaggtattacgtgcacttcacatattaggaccctgaagattggaaacatgaagcagttttcacacagtcacctacattgtgatcaaaatggggcttgaaccgagcactgtctgataccagagtctatccatccacagagacgtgacattctgtcctgatgatggatgtgaaagtgatttattaactctttggaacatggtgctagccagagccacctcaccccattagactgataacagtaataactgtagccgtactgagctttactgggtgtcaggtgattcactgtttaacttgaatcttcataactaagagctagatactcttatcatatatgaaattaaggtttagaccaggtcagataatttacctaagatcatagcctccatttgtccccattttttttcctttcagacatggttgcagttctgggagagaccacaggacgccgtaccctgaaggtcctcagggaccagaatgaagagggatccagagggtgcccagatcctgcagtaggtcccagctctgcctgggggattgagggcattctttggggattctgatttctctggaatcacatggtgttcctctaagggaactcttcttgataccatgcgccatggatggttgcacaggctgggcactgcccaactccatggatgtcattcacatagacaactctgatgacctctggacagtgcagtatggtggcctcagccctgttccaacaacaagggctcttgtgcgttcactaatgtcccgtagcatatgctgcctgtaacccgcacccctgcagtgccctgtgtgaatacccagatcacgtctgaggcctatttacctaaggcaggaaccacagccttagcttgtggtagtctcttcagtccctgccactggcctggccagtagtagaggctgcattaggacttgaccccgttgctgccctctgccccttcacctctcacacccttaatctagctggacctttcacctgcctttgctgctgccttcccagtatctgagtcctgccttctgcttcacagggagcgtccccggatctcgctgtccaccctcgacagggcaagctccggagtctg

SEQ ID NO: 45241 - DNA, 1534 bp, Bovine  19866880488724
tggcaggcgagacccagccgtggggcccgggggctttgcccccacctgtccctgcctccccgtccctccttcctggccccccctcatccctagactagcacgcggaaacccttgaagaaaggggtataagccccccatccaatgaggggagacaaacaggtgcagaccccttgccatcttggccagggctgtgtcttgatatctggactgttactagttccagagaaacaaagagccagaggctcagttaaaggcagtttatttaagaggcgggccttcttggggagcaggggctccctggtggcctcctcacccctaccaagcagtcctttcagaggggctcatccatcctctattcagaggcactttggggccaagtgccccctccttgcccagcttgacaactgggcagcactctcacaggccttgggacagttgggcaaattgaggctaggcaaggacataagctggtggcggagtgggctccctccccagtgtttatactgtaactgtgtaacattttgtatattctggaggtagggcagcacccccgtatctcagcagaggttggagctggtgaatggggaggaacttctattaaatatttggggctggggaaacttatttattaatagtatagggtagagagagaaggtggaggcggggacgggtttgtgcccgggtgattcgactcctgtttcgtttcactttttatttctgaataaatgaatttagccatactgcttgtcctggtgtgtgccttttttatgtcactgggccctgaggtctgtgccatgagcactgaacagggagcaggtcctgccaacagagggcaggcttctggttgtgcccacctccagggtgtctgggcacgtccagcggggctgagatcttttgaggcctgtcacccactgccgcctggtgaagcctgggggaccccagggggactcccaaggggctctcaggggccgtcctgccttaatagcggagtgactcagaagctggatctgatctcagggaggggaagcagagtgccacagcaccaagtgctgacttctggctcaagtgttgtccattccatcaccctgtccctccacagtgcctggctggctcgtgcctctcctcccgggccccctggtggccagagcagggttcgcaggatcagctgactccaggtgctttcccagtaggcctcggaaaggatggggctttccctgcccccaacatcttaaagcatcgtatcaatagctgggcccctcaatccctcaccccaatgttgaaacctttacctccccccaagcaccacagcgaacacaaggctgcagaggacacgctgttccccatcgtccagaaatgggttttattctcagctgagagacagcaagactggtagcagtcagagaaccatacagctgccagcacggtacccccacgctcgaggagggggttgggatgggaggatggcagaggggggcttggctgcccacaggctgggcatgacactggggctcattggaggtggcacgctttggag

SEQ ID NO: 45242 - DNA, 596 bp, Bovine  19866880589873
ggcggagtttgaggctcgggctccacggtgcgctgctgcctgctggagggctacgacacgaagaacactcgacaggacaactccatcctcaaggtacggggggctctgggccttgtctgcccctcccacccaggggcaggggaagggcggaccacctccctgtcagagtcccctggggagttgcgaagaacacaggttctcatcccagatgggcagcgagagacgctgggaagacgtgggccctggggtcaggaaaccccccttggaggcctgactcagccactggcctcagttttgccctccataattgggcctcagggagtggaccccgacagtctcttgcagtgagaccagcaccccttatctcgtggtgcccgaccacagcctggcagggagtggtgtctcttcctgaccccacttttgcacagggctccaccttcgggtggtcatccacccaaagacacagcaaagctggcacctgaccctgcagcccagctcctaaccactgccgtgcatgatgcgaggccacctgagctccagagcaccgggggtgtgggacggaccttgccgtccctgcacctggcagacctgggcag

SEQ ID NO: 45243 - DNA, 972 bp, Bovine  19866880660907
cacagcggcggcactcacggcagtgccgagcccgcaggggttgctgtgggcacagagggagttgggcctcaacaccgggctcccctctaggcccagcaatgaggacgggaggtcagggctggcatctgggagggcttcctggaggaggggggtgaggccaaggagtctcggccttgcctgagtcctcccaccgaggtccccgcatcacccaccagcaccatgcagtatctgcagcgccgaagggggatggcctgaggaaccatggctgtctgctcttccttggcctcctcctgaaaaacgggggacagaggatgagatgggggtcccttgggaggcagatgagacttgtgggtgtctcccttgggggccagcttagctctgggtgtgcacatttgggggcccatcccatgtgtcatcgaggtggtagagtggggcagggtgccctggactgcgaggttgtgtgacttttgccagttacttcccctctggaccttggcaattttctcattgtaggacggggccctaggtctggcaagacaattccctgggattccctaggaaagctctcagctaggtctagcatgagactccctggagtcttgagttccctggtggagggaggagggctttgggcctcctcgttacctggggctgaggcaggacattcacgtagcccggatccatgagtgacacggtcaggtaaagcagcagggaggccagcatgagcagcaggaaggtgaggggcaggagcagctccccctgctcttcccactgccgaagtgctggagaggccagagggggagagtgaggccaggaccatggaccggcgtggcgggggagggtgcaactggaggggggaagtgtgtccctggctgaacaaagtcctggaaatggggtttgatgaatggtcgggtgtggccactacatagggtgcaggagggagaagttcaggttgggagaagagaaaaaaag

SEQ ID NO: 45244 - DNA, 795 bp, Bovine  19866880697681
ctctgtccccagctcagccaggctctggacaaaacccagatggactcccccttcaagattctgttgaatgtcacctcttccagaaagtccaccatgataacctctatgtcccctcccccaccccctgcaacacacaccctcttccctcaccaaactggactgtaattgccctgaaggcagaggcagggttgggcacaccacggtgctcaaagagggcaatgttgaaggaatgagtgaatgaatgaaggatggatgtctctgccctccttgccaaggtgagcagacatgggctcctttcccctgtggctcatgaaccagcaactcctcagaaagggggactcgctgcactgctgaggacaggagtctactcccagggacctgctcctctgccgggcggggctcaggccgggcaaaactagacccacaccttgtccctcttcctatgcctggctcaggtctctcaggcggatccccctctgtgggaagagagttgaaggttagtgtgcctgggtcacaagtagggattctgagggcaagaaggaggccaaggagatggggtgaggtcttccggagaggcaggagggtgggggaagaaagcagcgtcctgggtgtcagcccaggagaagcagccttgagaggtgccacatcctcccaaccatcccatgactgtgccaagggtgtggcttcatgtggccaagctcaggggacctgggagagaggcagcctgagaccaggggcttaaaaacaaatgctgctgggagggggtcccggtggaccctgctgccccacaaagct

SEQ ID NO: 45245 - DNA, 866 bp, Bovine  19866880748086
gaggctggcagcgtgtctctgcgtatgaaacaggtggaagaactgtgagtaggccggaagccctgccgagcaccacccgccgcccctgtccatcctcccttccctgcttctcttgaaggcgctcactggtcaaggaaggcgaggtggcgggagggcccgtctctggcagcagctttggctcacgagggaaggggttcgggtgaagccgtgtcagctgtggccgcttctctcgttggtgcttctgtgcagccgtgcgttcagagcctggtcggttcgcctgctgttagctttcttactggactagccactgtcagcagactgggcggccggtaccctagtgctcctctcttggcaggaaaccaaatgcctcttaaagtctctgattcttggtaacacgttcctgttttatttcgcttttggagacttagattctattttagatctttttttaactttcaactcagttgtattaagtttgctattttcacatctgcaaggataccaggagttcagcctgttgtattttggttcccaagggttcaagtgttgttggattcttcataagaaatcctcagctaatgaaatgtgctttacgtgatttctccttccaaagtggccaaaacttcctgagaaataagtatattaacgttagaaacagtaggaattccctactgttccagagatactaacaccctgaatgaggctgttgtaaagctcagcgtgcctttccccaccacctgggggctgctggcagaatcatacgacgggagaacaggccctctgcatacaccatgcccagcaagtccatctcatcgggcagctgtggtcgcatggagcctgtgttgtgctgaacgcttggttttggt

SEQ ID NO: 45246 - DNA, 923 bp, Bovine  19866880763090
ttactggagtgggttgccatttccttctccacaggatcttcccaacccagggatcaaacccacatctcttgcattgcaggtggattctttactgtctgagccatcagggaagccccctcaattttcagatattataaaaattcagttgttggggaggaacctgaggcacactgaccccctacccaaggcctctatttgccagtccaaggtctagagcacatcctcctgctctccaccttcagtggaatgagctgtatggtctcaggagtccatctggtggcctgtgtcaccacaggagagggtggtcagggtcaagggctgtgaatgggggagcagaaggaggggtgtggttggaggagcagttgctgtgtgtgtgcatagggggtggtcagcactgaataggggatcccagcttgggttccataatgatatcagtgggggacaagcagagccctctgctgtccagatggagaaactgaggtggagactcctccagtgtttgagaggggaggggcctgccatcagctattgaggttcattcatctttcccaggaaggcacctccacccaggaattgcagtgtctcgtcagtcactcagtgggacacaaagagggacagtagctgggtcacctggctgctcagacccctccactcctaccacgttgaggggcactctcccccactccttctcccagcagctgaggctcaagtgcctgccctcctgccccctttcccctgctcaggtgcctgagaaaggatcatttttagcacctggcctctttccctgcctggagggagcccaggggacagagtagggaagaaagtcgccaagggggacagggagatctggaagtagggccccaggggatatctgactgttctgttctgcccactccaaggaggcccaggcatagagaggagcc

SEQ ID NO: 45247 - DNA, 1477 bp, Bovine  19866880778319
acaaagccacagtccctgcctctataaggcccacacgcttaccctgggagacagagatgcagggatcatgaaccagggtgacaagggggtgagaggtgatggaggtgtgagcagaccggtggtggtggtggtggagggagcaagaaagagggagacatcccattagattccagtgagcctgaggcattgggaagactgacttacagccctgaagaatgaacagggaaaccccaggacgtgagctgggggtaaggagcctcaagcagatgtacagtgagtgatgaagtgtagcagcatgtttggggttgggagggggtcatggagtccccaagacaccctgtccagggttgagggaacttacccacaaacaggagcagcaggaggccggcggccagtgggatagcaatggcataggctcggggcaggaaatacttgtggatgacatgctgactgtcgatgaatggctggcatcaaaggcagagctctagtgagtgttcctcgctctgctcagctccccaagtccaaacagcccacctcctccatctcaggggttgaccccatcaaagcactgcatttgcttttctctaagatgatagcactctgggtgccttggtttgttcccttccttcagttatctaatggttgtgtactgggcacttgactggtgctcgcccaaagttggggctagggacctggcagggaacagaagacaaaggacttgccctaaggccctcacagcttagcagggacaaagcggacatgaggaatcctcgagtgattcccaaccaggactccaaggttttctttactaacatttgtctccaaaggatactgacttctgcaagattttgccctccaaacacacacttcacttttaaagcagtaaccaaaaaaatttcccacggggaaaaaaaaatgctaaacactctcacaaaatccactgggattgtcatgcccaagcgcccgcaggataaccaagactagaactcccatcaaaagcaaagcaaatcaaggacaggactttgcagtggagtggttaaggattccaccccgagccttcccttgagcttctgcttcctcgtctataaaatagggacacctgttaccatcttcctcatagtgctgtcctggagctttcgtgagatatgcagtgacagcacctagcacagtgcctgctaaaatgatgtgaggagttggcttcgagatccagggatgggaggtaagagagggcggggaagcgcacataccaagagaattacccaggcggtgtaataagtgaagatgatcaggctaagggcgacgaggccgaggcccaccacttggtctgttcccgtggcctgcagaaaagggaggattcaactgaggaaaagatcctccatttgggaaggaggggggtagtcgttgcggcccgatcacgtccatttactcagctgactatatgtgacgtgggctgactaggtatcttttctaggtcggg

SEQ ID NO: 45248 - DNA, 1157 bp, Bovine  19866880796310
ggctgcctcccctcagtgggccctggctgcgtgcccccacacaggtcaagatgcagaagggagagcgccagatggccaaaaggttcctggaggagcggaaggaggagctggaggaggtggcccaagagctggccgagaccgagcacgagaacacggtgctgcggcacaacatcgagcgcatcaaggaggagaaggactacaccatgtgagcggccctgccctgggcgcctgcccgcacgccggcccggtccccgggtcactaaagcactcctggttccccgcagagtgcagtgggggagggtatcggggagacctttctggaaaaaaaaacaggagtcccgcaggacagctaggagccaggcaggtgggtgcaggggcagaagacacggctggtcgcaggatcgtgtctcaggaaggccccaaggtgggaagagtctgtgactgagaagtgaaaaaagcaggccagagcgaggggaacagggtgcaccaagggcagggctgccacagaggttggcaggggctcttggtgcccacttggaggcatttgcattgagggcgcttgggagccactgaagggtgttggaagcaagggagcggtgtgaccagacgcggggagagtggaggggagagctcagaagtggatctgaagatggtggctaggtggccttggcagtggccgggggctgcggtgacactggtttctgagagaccagcaggtggcagcacgtcaccggtgtggaggccctgctctggtgaccgcatttccttgcagaaggccacgcaggcctggagggccatcccgccccctcccccactcctgtgccctgaccaggagatgaggctcgcagggcattgtgaggcgagcctcggagtgtcaggtgggcagggccctggggggcggctcacagggtcctgttctttctggccccaggctgcagaaaaaacacctccagcaggagaaggagtgcctcatgtccaagctggtggaggctgaaatggatggggctgctgctgccaaacaagtcatggccctgaaggataccatcgggaaactgaaatcggtaagcggccgccagagccgcccagcccggtgctgggcccagagaggggccacttgaaggggccacgcagtcatcatgctgactttatgacatctt

SEQ ID NO: 45249 - DNA, 1736 bp, Bovine  19866880808893
ctaaacgatgacccccttggctgcaactaagacctggtgcagaaaaataaataaatattaaaaaaataataaggtgtcccctggcaccttcgcactggagattcgggcctgatctggtctcccgccagagccacctctgcacctcccactaagctcctggtttgcccaagagaggacagaacaggtgctcagagaaaagtgtgccaggcccaccagcctcgactgacgtgtgggaggggtggatggggacatgccagctcctcccactcattttggacagatggtggtttcctggggaggccttgccttgccatctgcagaggtaccttcaaacctgaagcacaggggggatgaaataaacacatctcaccacctccaggcaccacatacggcctatctgaactggcactgtcaccccagaggggcctggaggaattatacccagagctgccactcctagtctgacaactgctctgggaccctggttcccaagtcctgctgagctcaaataccaccagaaagtagcatgcttgggctggcgtgcgcccagcggtggtcatccttgtaagtctcttgtttcctggactctgatgtcagacaggcccggcattggatgtctgagctgtgtgactatggataaatcatcagacgtctctgaatctcagtttccttatcagcaaaatgggtttctgcgaggcctatataacttaatgtctgtactcaggcatggtagcaatgacgagaaataaaagttgagggagctgagcacacagcctgggttcccaggaccatgtcatcaattgatgctgcagggagggagctggaagataggtttcctgggggctggccagaagagtgggtggaggccagaatatttccagcccaatcttgccttggaagtggaagggaaggggcccaacagactgtgaggtgccttctgaagcagggagccagggtggaggcgagggagtgggtgggccaagaaatacagtggggaggaggtgagactgcccccaggcaacaagtccctctctgttcctgccgccccaggaggccctgggctggcccatgtcacacagcccatgaatttccagctgaggtttaaagatttcagggcagccctggccttagcttcccctggtattctaatgtcctgagagcagggcctgggttggccctctttaccacggtattcccagcacccagcttggagcctggcacggagcaggcgttcgggacacccttgtcggccaaaagactgattggaaggagtttctccaattttcccatcaccgccctcattgtacagatgtggaaactgaggcataagaaagagggtcgcccaagctcacaatgcgagttggtgacagggtaagactggtgccctgggccctggattccaagcctggcactctccccacaacaaccattcttcaatattaaagaaaacatgccatcttgcttttcaccttatccttccatccctcctaccattcttctttgcctctttccttcctccctccctgtcttcctcccccctccctccctttctttcaagtgttgatgactttatactttcaaaacggaaacgatttcttctgctcctgctttaaaaaaatcatatgctctctcattaaattttttttcagaaaatacataagatgttgaaaaaataaaaagccaccatcacccccaacacctgggcctcagcattgtaaacatttttatcacttata

SEQ ID NO: 45250 - DNA, 1889 bp, Bovine  19866880814458
tcttagaggtcgagaaatacagtgttgggacactcctggtggtccaatggctaagactccttactcctgatgcagggggctcaggtttgatccccgatcagggaactagaacccataagctgcaaataaaagcccaaatgctgcagttaaagatcccgtgtgttgcaactaagacctagagcagccaaaaaaattttttttaaaaaatatggtatattcctactgggtgaggctcaaagctgtggaagcccaaagatggcccagtctcacagagatgggcactggagatggaagtctgtcctaccccagccccctaagatgtcaggtcctccccatatatggccctgctgctgacaaccgcccctgagtccccatccacccttgctgacctcgccctcctcctgagaactcgcagtttcctctgtttccccatatggcctgtgacgtcagagatactggcatacatcagaggcgtgtgtatgtgtgtacatctgtgtgtgtgtacatgtgtacaatctctgtgtatacctgagtacatctgtgtgtatttgtacgtgtgtacacacgcctctgccttgtgctcatgagtctgtcggtacttgtgtgtacatgaacctgtgcttgtatgtacctgtggtcacctacctgtacatgtgtgtgtttgggtgaggtgttcccaccctggagaagatccttctggagggcactcatgccaggcagcccagagccctcctcttcaaggctgtctctgtccagccagacttcctgtggtgcctggaaggggactagactccccccatggcattcaagacctcagccaggcctgcacctccctccccacggtactccgagttgccctgccccacagactctgttctccccacaccccctgaccttccatgctgcttcctgcccctctgactgtgtgttcacggggtgccaagccccacttttgaaggtgcattctctctaacccccatgctacttttcaaggatactgtctgtccccattttgcagttggagacacggaggttcacaggcagaatgattggcccaaggcctcaaacagctgaatgggaacccttggccaggtttgtgaactccccagcctgctgcctcctcttctactcattttcctctagacttcagaaaggcctccaaagagtcatcctgggcttcctccttgcccaccctgccaccctccgatggtcagtctatctctccctcgtctcaaaactgcccatcacggcagctcctgcctgcccgctctgtgtcacagcacccccaggttgcacttaccctccgctcaaactcctccccctgctgcacctcccgggggtagccgtcgatcagaaagcctttggaagtatctaccttggccaccatggcgtctcggagcatgtccagcactgtctcctgggggtgcagcaaaagaagagggggtcatgagcccctcttctccaggctccgctcgagcctctgcacaagccagcccacagttagaaatgctctctgccctaacacagatttcccaaacaagctgccctctccaggaagccttctctgaattgcgaatacttaactgattgatcaggccattcattcattcatccattcatttcttcattcactcaataatatgattgggcccctccttccagcctcctgtctgagccctgaggacacagctctgaacaaagtagaccttccctgtcctcagcacactcacagtctgctgaggggacagaccaatacacagttcatttatagtttccaagaatgacatgggctatatactggcaaagaagcaggggcgggagtctaaagtggggggtgggagtctaaagtggggggcgggtgctggcccaaatactgagggagtcagcaa

SEQ ID NO: 45251 - DNA, 1224 bp, Bovine  19866880824631
ctcccactgcgaacacagcaagaacagctcctgcttgggccccttctctgggcatcccctcatgaacccccagagcagccctgggaggtgagggccacttcaatcccttctactgatgatgcaacaggtccacagagcggaagggattggccctaagtccctctgctagaaggtggaggaggagtggggaatttgaatcccagaggagcagggaaaagcagcagaagctctggctggagggagtgtctgccctcagtgctcaaaggtccaagcctgccagggtcatgggcagcaccaggaagagatggtagaagcagacatgggacctgatgggagcctttattcagacagcagagacccgcctccccctctgcctccctcttcctcaggccttgggaataaagggtagcccttccccctgtgaagactcccccaggctggcacccagagaatgctggcaggcagggaggggtcgggcacatgggttgtggacttgagcaatccctgagcactcgaggttcacttctggctccccaggagctccactggctgctccctctgataaattatgatgagtgacgtccaagggtcagagttcacagaggaacctgggtgctggcacagatgtgctccacccccggaggaagcggggggtggggcggggcctcaggcgctcagggtctacaccaggccctccacacgcaggggtggctccgtgatgcccagctcctgccgcagagcctgcagaggctgttcccagcgccgctcgtagtacacgttgaggacacacggggctctgcggccattctcaactgcccatgggatcagctccgagatcagcaattgtaggctcctgtgaggccgcagaggagagagaagacagagcacccggggtcctgagcgcggggcacgccacctgccctgagccgacgggcgtgtcctcagttaatccgcacagacaagaggaggcagttcccagccccacttttcagatgaggaagcagaagctcagtgaggtaaaagccctgtgctcaaagccacacattttgaacacaccaaagcccagctttaaatcgagggctcccccaccttcagaaactaatgccagactgcatccccaggaacccacaccccccacgcaccgccccccacccctggccccaggtttcctgacccggctgttctcacttgataactggggcctggcccgagaaaccctcaagt

SEQ ID NO: 45252 - DNA, 1746 bp, Bovine  19866880972390
tggtgctgaacggcatggagtcctaccaggaggtgacggtgagcccctgcccgctgcccgctctggcccctcgccctgtgtcccggccttgccaacaggctcgccgatccctgggatgccatgcttgctctccccctttctctcctggctctgtcccgcccccctcccaacccccctttcccggggcatcactcccaaactctgggaccgggcattcagggccccctgagctggccccacccgagtctgtctcccagcccgccctcccccagggccccaggcctttgctcctgcttgttcctccgcccttcttcccagtaatgctctgctgggtgggtgtttttttttttttttttcaatagctgcttttgttttaaaagtaatcaagtttttactggagaaaaattacaattatgggtataaaggaggggggggaaagccataatttcagcacacagagatagccaccgttaacatccttctggcttttagtctatgcgtaattattgagtaaacaggaccaccctgtttgtcttataacatgggttttcatttcagcagcatcttgtgaatatgaatatctcccatatcaacaaacactttacaacaaaatttgaaaagtcatgtttcttttcttgatgacaaaaagtgagctccctgatgcttggaaaacaaatttaagtaacagaaaatgtctcagactaactagaaagtgaaagtgccaatcctagcgctcctcccccagggcagctggttttaatagttcagcttcccaactgttgatgtcagcacctgtgcagcgcctcccccagggagaggctgccctggtgctgactctgctggggacttggaggccgtggccaagctccatccccatggagtagtgggagaggctcccctgacttcgtgggctgcactgactgagtcagccccacggttgaacattttaggttgctgttaacgttttgttatttctttttttttaaattcgaacatgccagctcttagttgtgattaagtgggatctcatttgctgtatgtgggattcagttccctgaccagggattgaacccaggtcccctgcattgggaactcagaatcttacccactggaccaccagggaagtccccatgttttgcactttcaaattaggctttgctgaatacatgtaagccatgcttgttatgagacttgtctaaaaggagaatggctggagcagtgggcctgtgtatttttaaagcatttggtatatactcttgcatcgtcctccagaaaggctctggtggggatgcagcctctgcaggaatgaggaggccccctttcccactgactcccaactccagactttttcctttgttgagatagaatttatcatcaggtaaaagggttgtttctttcccccttggccgtgctatgcagcatgtggaatctcagttcctcaaccagggactgagcctgtgtcctctgccttggaagcacagattaaccactgggtcaccggggaggtcccggggtgctagttgaagattttcaaattaataaactcattcaaagaaatagaaattaacaaaaaccactattggctggggagattgatgatacccattgacgaaggccaggggaagaacacattcccgatttccacaggtgaggtatgaatcggacagcctcttcatggggcagctggcagaacctggcaaaactgtaagcgcacttactttggcctaggtattccacagttcagag

SEQ ID NO: 45253 - DNA, 1137 bp, Bovine  19866880991341
gctactgggacagggagggctccagcagcttcaggacaccgcccaccaggtgcaggctgcctgtgaccagcacgtgaatggcggcagcctcttggagtaccatggccccactgtctgccacagggtgggcgaggaggccccgtgggggactgggcggctgaaagagagggtcccggccttgggtgatccactgcaaggcatgggagatgcagctgaagacgagggagctggcactgtgggtgtggggtgggtgaggcgccagcagcagagatgcgggcccatcctgctcctggccgggggtgctccaggggtccgggctgacctgctcctcatgcaggcgactccagtgctgttggtgggcgaggcagcggagcagcacctggtccagtgtcactgtgaagttctgttggtctgcggggcccagggacagacacatcagtgaggcagcccaggggaggggtggggaagcatgccgtgagcccctgctcaatgccaggctctatccaagcaccgtccgtccttagctctgaggagacggaggctcagaaagttcggtgactgccctttgtcgcagagctggtgagaaacaggcccaggcagtttagcttcaatgccggggcttctgcccacggagcacctctttctgtcctaactcactgccttcccagactatccccatgccatctgatgtggggcctggagatctgtattttttagattatttttaaaaaaactttttacataacccacagtaaaaaaggatacattttataatagtaacccaggactcacatgtgtacgcgtatacgtctagaagagaatgtcatcagacagtacctaccctcaattttgtgcaagacacactgacactctctattctattttatttaaaatgctagttgagactaagctgatttcaagaaccatcactgggttgtaacctgcattttgaaaactagtttccccaataattcctttttagtattgcagtcacacgcaacattcaaaacgtaccaaagggtattgatttatatgataaaacaaatctagttcctacccaagacctccagtttaaaaacccccactgtcacccacacagcaatccacctcagggccctctgccgcctgcccacccca

SEQ ID NO: 45254 - DNA, 1419 bp, Bovine  19866880994136
acacgttcagagctctttatgcttcagaccacagtgggcacacttcacccctttttttgcagatggggacactgaggctcagagaagttgcaagccttgccaactgctggtatggatctctttccctgggccatgatgcccttccatccacccacatccaatctcggccaccctcaccagccccaacgccggcctccatccccaggtccctggggcccagctcaccaatctggttcctcagttcggccaagctggtctccagctcctgagcctgacacacgctgcgctccttttcttccttcaacttgctcatctgctcaaagcaccaagatgggggtgggggcgcacatggaaggagaggtcaagtaagggctggctgaccgtaggcctgtccacccccgcctccagatacacacgtccacctccagctatgcacagcaaatgacacgatgcccaggaagaccaagtgacctatccaaggtggggggcgggggggattgaaggtcacacctcacctgttccaacacctgctgcatcttctgctgccatatggcattctcctccttcagatttgtcgcatactgatctctctctgcctgcagctgcctcagcgaatccttcagctgcaaaaggagtgcagaagttagcaggggctgtcacgggggggcctcacctactcatggtcatctggggactcctgtacccctctgtgtgtaaagcctcacctgctccatgtgggtctccagctgtgccctctcctccagggcctgctgtaactgctggctgctatcaggggtaggttgactagaaaactggatggtgaaaaacaaagttagattggggggcccaggctgatccacacaacgcccacccccaaaaggtcagcatacaactcagggttatccttaatattgttagtaccatgtctactttattttcactaaaaaatagctttattttcactaaatactcaatgtaaacaattctgatagtaagtgttcaaagttctcccagcctccccaatccagtgtgtatccttcttgacccttttccacaggtatgcaaacatgcttcattgatgcacagtgccagggatagtatcatatatggttctgcaacttaatttcactttgctgaaaacaagataactttaagtttttataatggttacatagtactccaatataggaacgtgtcatacccttacaggtggcaggaaggcagaaatttgctgggcatgccaaaacaatgaagaagaaactgacctgggcactctgtctacctggaggcttggcattcaagaggaaggaagcggaaactcacgggctggccttacaactattggttggtcaaaaagtttgttcaggtttttccatgcaatgttaggaaaaactcgaaggaccttttggccaacccaat

SEQ ID NO: 45255 - DNA, 1675 bp, Bovine  19866881049465
agactcctcagaggctccctggacagtcccagtggaaggactcatacgctgagggcacgcggcaccagggcagggagatgagcacaaccccatgtcgggtttcccgtgcaggaggcctcaggacctggcctgctcactgcaggaagagcaagcgatgggacggggctgctgctctcatggcggagtgcttatgagtctgggttctggagctggaaggccctggggtgtgtgctaggcggccctgggtagaagtcacttcgcctaagtctcagcgccatccttggacaagggagggataataacccaggtcttgatgccagcggcaggcctagcatggtgtcaaacagacaagacgaatgtcagtgattcaggattccttatcccgggggctgccagaaccttcccctaaaggccgctgggaaagggcaccatgcacacccctcttagacctacagaggctcccaccagaatcccatgccccagtggatttgtccttgtctggggacaacgaccacccactgtggcgccccccactcccagtggtgtcaatagaacttccggtctcatctgatgtctcacagccgaccctcatccaacctcttcttgcaggcatccaaggggagattttctcccagcctgaaatctggcttccggtccctcccacccacagagcctagctgggcccggggaccaccacgccaacggtgcagactcgggagagccggtcccctatgtcttctctcccccaggttaagctgctctggtccccaccaagtccaccaggctccaggacaggactctgggagtctaccccaggcctcagctgaaaggggagaagaaagagctgggatggggggagaagagaagagagggtagagggaacatcagagggtctatttacaagtgaatggaggtaagaatggagcagtttgtgggctaaactggcctcagaaggaggtttacagatgtgcgaggggacgctcctcattgtttaattaagcagaaagtggatcttttcaaaagcaattttgcacagggactgggaggggtgagggggagaggagggtggtggggaggggatcagcaaacaggccccagagcggagaaaggaacagctggccccagagaggctgtgaaatgcatgctaagcagtttaaagcgcctgggagcgcccaagccacccctgcctcccgcgccagcctccctttaatacaaaggcagggctgagaagcagggaaaggtgaggcggagtctcctcctgggaccagggcaggtaaggcccatgctgggaccatcaaggttcgggatttgctccaggcccctgaccaagcctggtcttcgagccttgagttgaaagaatccttgatgcattaaaaaccaggtcccagttgccaggccccaaagccagtgggtgcctcctaaactcagccactcaaggcctgttccgtggagctggctgttaagaatcctcacctccctgcacaggcagccgctcactggatcaatgcaccctgcttcccagaaccatgtgcttagatctggaagcaacttttccaaactgcaggtgtcaaactgataaccgactcgtgcgcgctcgcactcagttgtgtccgactctgtgaccctgtggacggcagcctgccagcctcctctgtccacgggatttcccggtaag

SEQ ID NO: 45256 - DNA, 1924 bp, Bovine  19866881053861
ctgtgaggttcagaagggcagggctcgcacttttccttacaagaggtgcttaataaatgggcactgagggagcgcgggttcagttccttgtcagggaacagagagctcacatgccgtgtggcatggccagaaaattacattaaaaaaatgggcgctgaggacttccctggtggtacagtggataagaagccgtctatcaatgcaggcaggagatacaggtttgatctctggtcagggaagattccacatgccacagagcaactaagccagtgcgccacaactactgaagcctgtgcgtctagagcccgtgctccgcaacaagagaagccaccgcagtgagaagcctgagcgctgctacgaagagtaggcccttatcactgcagctagagaaagcccgcgggcagcagtgaaaacccaatggaaccaaaaataaataataaaagcgaactgaatccccaagtcctcaaaaagtgctctcatatggagaagataactttacggatgaggtaaccaaggcctcagagaggtgaaatgactcattcaaagtcacccagtcaggaatggcagaaccggggaatcaaacccactgctgtcggaccccagagcctgggaactttcccatcaaactctgctgccctctaaacctgaggagccagacttggctttttatgtaattcaattaaattcagtgtagaacatatttgggagcagctgctctgtgccaggccctgtgctgggcccgggggatgggaggtgatgagtcagacggttcccaccccaaggcactcacagcgtggtgggagagacagacaagtaaacagataatgtgatgcagtgtgacatgtgctggaatggaggtgcaccaggcagcacagagggggcggtggttaactggggggggagggacttcctggttctgtctttaccccttactcgttgacttctttgcaagggtgaccctctagtacttgggacccgccccccaggactagagagatagggcatctcagctcacagaggctggggaggatatggggacctggggtctaccttcttccccaccttctcctcacccagcaataccatggcaacagtggttgccatggaaactgcaggcagggctggaaaggatgggactccccacagagagcccctccccaggcagagacatgaaccttccctggagctctagcctgagagcaccaccccccctcacccctttcctgcacagatggacccacttggccctggcaggcctgaggggtggaggtccctgaggtgccacatagagggtgtggggaacccagagcccagctggaggggtgatcaggggtctgggccagcctgctccgagttgctgcctcccagggctacttaaaggacaagcagcttatgggaagcagagattagagcacagagcatgtgtgggagcagtgcctactcagacccagatttcccaggctggggtggggatgggtgcccaggtggcgaggggccccatcttggccctggcccaggctctcagaattccctgggtggcttgttcaaatgcacattcctcagacaggctgggttagaatcttcagggttggggggcgcaggggaggggaggagggcatctgggattctaaacacaatccccatgttcccatcaagtttaaggctcctggctcggtgatgaggaaccagcgccaggcagaggccctgtgttcgagtcctgacttggccattccccagcctggtgcccctgggcaagttgcttcaccctcagggcctcagggtcctcagttgtaaaccacatgatctaaaggaggcatcataaatgaccacacgtggctgcacaatgattcctagagccttagcccatgcctggaacacagtgggcactcagcagcggagggggctgccaaggagagcctcctgt

SEQ ID NO: 45257 - DNA, 1592 bp, Bovine  19866881075244
acacacaaaacactgccttattcttccttcccccgacaacaaggcctcctctccgttaggcatttttatccctgctgttcagatgaggaatgaggtccaaagaggggaagcccatacctgtagtagcattgaccagctgcaggaccagggggcgtcgcgtgacaatgccagatcctcggggcaagaagtccctgcagtgaattgagggtgagaggagagtcaaggtctgaggaggctccctgtgtcccagggacgcctgtcctgccaccgggggcctcaaagctccccggaagtgcctcaccacacctcagcccaagggattcatgaaggggagagggcagctgagaaaggtggaaaagaccaccctcaagtcctctgggtcacagaatttgtgagtctgaactgaccctcagacctctctcagtctgccctgtgttggttctgagccaacaggaagtccctgccccaactcaatcactgccattcaactcaggagaaactggggcatgaggtgccccaccccaatgcccaaatgtccggtggccacagagtgggtgccaaggaaatggagctgcacttcgtcccctcctttccgctgtggggaaaggcaggatctcacttccccttttctggccccatctggctggggttgaggatgagggggatgagggaaaggaggaaacaaggaaaaggactcatgcttcttaagtgcctaccacatgccaggctctttgtgggcaatatttcatggactctacacaatagcctcactaggaagacagtattattatccccattttacagatgaggaaactgaggctcagagatattcatgttgcccagcctgtatctactagaccctgcagtagatctgtttgaccctctggtgaaggctttctgcccatcatctcccagcagacccagatccctttgaatgactggactgagggggtctcaaagtcacttcctgcctgtagacctgatgtctattcctcagacatctgctatgtcaatttcagcctcagcagtccttctggctaactcttcagggtgccacttctctctgtcctgtcagctcttttcatcactccacctgtttacccacagccccacccaagccagcacaagggtgatggtggaggcctcttcagggatcaggctactgggattagaaacagggggattgccaggattcaggaaagaggggagctaaggggccacagagatctccttcatggtgaggcacatgaaggcccagggaggggaaagcatacactcaagatactatagggctgggacagagccagaacagaaacctggatgccctacccggagcccagagcctgacatggactcacaaagctttctgtgcctcaggttaagggcagagtgtccccggaacaacagaatcagcccaggcttctgggttcaaggcctcatctgggggccctggggagggctcttccattctctgtcctcaccctgccccacctctggggagagcagagactaatgaggaggagtcagccactttgtggggaaggagcatgataaatcctgcatttatccatcatttctaggtgccaggcaaa

SEQ ID NO: 45258 - DNA, 1007 bp, Bovine  19866881117085
cgggtgtggggagccgcccacagccacagccccgctttggggatgggcctccaccccctcccgcccactgcactaggacgtggggctgcttcctcaaaaagagtcctggtccccaggccgcccgctctatccagcggtgcccaccccgggaagctcccccaccaccaggctgctctaacctgcccacacccgccgttcctccagcttcacctgccccctttcccagcacgcacatcactacggtcagcgccctgagactgcctgcttcacccagcctcacgtcctgaccaggctgaacctccgtgtggcccgcaccgcccaagactcagctgaggacctgcctcctcctccatgcccagtgctccgacccgagcccagggctgaggacaccccgcggtccctgcttctggccgtgaccaggggctgagggccaaatgctgggcctcggccacctgctgcgggatgcggagcagagacacaggctggaaggctcacctgccacatgggacggccgcgtggggtggaaggccaggcacatggcggcgctgggcacctccaccaccgccgacggctgctgggggctcaggcctcgccggtccaagttccaggcacacacaaaggacctcagcgtgctccagtccccgtcatccagcctgcggggacacacccgcacgagctcagcccgaggcctgggctccgtcccaacccgcaccaccccagcccacctgctcctactgcctgacccacctcacaatcaccccaacacagatgagtctctgttcccatcacacacagacacttgtgctgggtacccaagtgccagaggcgcctatatggcaccccaaggtcatgactttccccagaaaagggtttccaggaaccaggcacggggccacatgtagcagggggaggaaactgggcatgtctgacgcaggctgggagagacgaggcaggcccagggctcacagcccgctgctgatagcgggcactgggagaaccttccttgt

SEQ ID NO: 45259 - DNA, 744 bp, Bovine  19866881137602
acctgggttcaccttcgaaggttcgctctgtggcccgcttgaagtccgtcctccctgagctgtttaaaatgctaatacctaagacaccctgtaactgtcccttcctttcaaatggctttctggggccacagtgatacatcctagggtttatctcccattgcattccaccttccttcctcaaatggccactgaagtggtcacataaggtaatcaagctggtgcagcagccacaggaaaactggactaaagttgggcttctttactgtctaacacttctcccaggcccctggtaccacatgaattcattcataagttttctcttcctcccccactctccagctttctccaggtcagcccctcacctaggaggtcctctcgacattgccattaccttaggaaattgctctgcaggtccgaccaccagcaagatggtgggtctcttttccgtggcctcagcccttccgtcctgcttccccaaaaagcttggcatctggtctctccgagccggggccggggtgcctctgacttcattcccgctgccctctctggagccttggcacccggccctggggaaaaagctagacagaaaatgccacagcatctgaaacattccggcttactccccacgttgccgccagtgaccgctcacttttgagggctgtgatcacaacaccgaaggtctctggctacacagctgcttggatgactagcctgagaagttgggagggcggcagctctgcctgc

SEQ ID NO: 45260 - DNA, 1049 bp, Bovine  19866881165324
ctgattaaatctttaaagaacaacaataaaaaactcatattttaacaactttttttaaaataacaacattttcccaaactgttgttaagcagcggcattgttttccctatttataaaattttttttaatgtgtgacttagaagacagctggattctcctgtctaactacttctgaattcaatctattgcaatagttgaatttggttgtagtatatgaagaaacctgagctcatacagatatgtagttggaaaatgaagaattgatgattaaaaatcttctttgatacttactacactaaaactcaacaatggcaattttctaagggggtttccaatgtgaaatctgaagacataatggtgaacttctgtaacctgttatattaaaatccattggcctatcttgccttttgaatggactttttattgttatgcatgattttgtaacatcatgcatttcatatctgaaaaatattggctgactgaataatccaagtcctccaaatgctgacacatatcattgtacagtattaaaagaagataatcacattcattaaagtcatcaccaactccatcagaaaagtcttttaagtagttggagcctgtcaagaccatgatggcaaatataagttttacaaaattctaattttctcttaaaagcttgaattttatcattagcaacaaacagtcagttgtttaccaacccttaaaggactggctcatttctttttttttgagaaaatgtatgccaaacaaccaagtctgaataatcataatcattaatcatagttattttttttcaaacgaaaaaggtgttgcactaaaaaaaagtgacgaattcagctgagaatgtaaaacgattatacaagtgtttttcctcaagataactgttgtacctcagtatgcagcacaagtgctttctgggtacttcctgttaaatcacacagaatattaaacagaatgtatttaagatttaaaataatcaatactttttactacttcatcagaaaatttttaaggaacaggcagattttaaaatatttcacctttca

SEQ ID NO: 45261 - DNA, 2098 bp, Bovine  19866881202018
agctgactcgcaaggtgctgagcctcttcgtgcagaagctggggaacctgatgtccttggacatctccggccacatgatcctggagaactgcagcatctccaagatggacgaggaagcaggacagaccaggtggggccccacctgccctgtttgcgagtgggtgccatccaacaagcattgaccaggcacccctctgccaagtgccgtgctgacgaggaagaaataaatcaggccctctcgagtgggtatgagctagtggggacaggcaggttatcactggggctgcggtaggggcaacgcggggctccggagtggcctcaaggatcagaaggaaggaggaggaggcaaggcatccaggctgtgccgaaagctcactcttgagtttgccagaagacgtttaccacggcgctctggcagagggaacagcatgtgcaaaggctggaggtacgagcacggggagtgactgggaggttgcagcactcaaatgggctgagccgtgtggtggtgttcacgggaggctgccgttcccaccactcgttgggtgttaactgctgacaggctggaccccgggttggtcggatgagagagctgattcagaaccccctctagctgtctttgtttttttttttttttttttttaatatttatttacttatctggctgtgttgggtcttagttgcagcatctgggcatgtgggatcttagttccccaaccagggatcaaaccaatctcccctgcactgcaaggcagagtcttaaccactggatcactagggaagtccctggtgtgttttttttttaaattgtagtataattgctttaaaatgttgggttagtttctgctatacaacaaagtgaatcgctgtatgtatacatatgtcccccgttactgtcgttggtcttaagccctccccccaacctagactggaatggagtttggttgatgggcatgtccattcatggctgttgcgggaacctaaaggtgacacgccctccctggaatggcaagcaggattggctgcaacagttatctcccatcccacgtgttctctacaatgtgaccttgtcaccctcccatcaagaggtggggtctatgtctgtctcctgcctttttttttttttgaccacaccacgagacatgggggatcttagttccctgaccagggatcaaacccgtgccccctgcagtggaagcgcagaatcttaaccagtagaccaccagggaagtcccctatgcctttaaaatgaaaaatagacaaggctagagggcctagcagagggtcccaaggaaatgtgcttcaccacccccagggagaggctctcctttgtgctgaatccagggcagccacaggccccacaccactgatgccagcaccctctcccctcagcatcgagccttccaagagcagcatcatgcctttccgggccctgaagaggccactgcagttccttgggctcttcgagacctccctgtgccgcctgacgcacattccggcgtacaaagtgagaggggggcacagggaggggaggaccagggcgccccaggacaagggaggggggtgtctgtcctgggattagagatagaattaggatcagaaatcctgcccctcagccacttccgggatgttttgagcatcctccatctccaggtgagtggtgacaaaaacgaggagcaggtgctgaacgccatcgaggcctacacggagcaccggccggagatcacctcacgggccatcaacctgcttttcgacatcgcacgcatcgaacgctgcaaccaacttctgcgggccctgaaggtcagcaccaaccctggagggccttccaagggtctccagttcattctcccccatctcctcaaccatccccctcctccttcccaggatactggccatcctaccccccgaagcccaaccccatctctcagcacctcccttggcccagccttgaccctgtcccaggaccatggccgaccccagtttctgtcccccaaccccaactcctgccctcagggagcaggatcgggctgagccctgccccagaggacctgtccaagcccccgcaccccaccccaggcctgtccttgcatacatgcggcag

SEQ ID NO: 45262 - DNA, 576 bp, Bovine  19866881205840
gcacagtagctccccaaacgttcactcatctcagggtacgctttgcttttcaaaggcttgcagacacgctcaagtggggaaccaggcaggtaacagcctgcagattactgtccggggagaatctggggagggcagggcccaaggtgccagctggcctcctgagtcaggctggggacaggcaatgctccttgtaagagctgggggaggggaggtaggggaaaaccaacagtcacacaagggccatgcaggaggcacaggcatgcttggggggtggggcggcatgcggagttgggggggaaggcagcagcatgagcagtaccctgcggggggcctggttgggccccaggccttcatggtagaatccacccaactcttcttcactttgcatgccttggcctggcactaccaccccccagacacatttgcctggctccaagctggctggccagcttgcctgtgtctgccccactcctttggggtagaagttcagcagcacccctcttccgctcctagtttttaatcaactgaggctaaaggggaagttgttccaaatccttggcctatgaactctgtccc

SEQ ID NO: 45263 - DNA, 753 bp, Bovine  19866881250629
ggggaagatccccggaagagggcagggccccgactccagtactcttgcctggagaatcccatggacagaggggcctggcaagaccatctataggttcgcagagtcagacacaactgaagcgacttggcatgcacactgttactgggtggcacaaaagaaggacttaagatgagctgaagccacaacccaaagcatcccaggcccgtaccagcccatccctaccgtttgctgctgctcggcccagttcacctcgaagccgtcaaacgcgtggctctgccaattcttgttcagctctcgggtaaccatggcctccactttccggagaaaggccgcgagctgggggccgttgtaccgaggcacagacggcaggctgaccggctcgggggcctcagtctgcacttcagcatccacatgcttccgggcctgcacggacgcttcagccgtggcaatgctggccgtctggcaacttttctggagaaggagattgaaacgcagtcaccagccagctctcctcacagcaccactgcccaggcactcacccacctgcagctgctgtttatccttgggcaaaagaaccactcctcactctgtctgcctgacgaccgtccccttcctctagcccatcttccttgggaggaacccaattggtgtggtgtgggtgggagatgacccacagggagtaaccctgtccagccagagaaatccactcacgtggtgtcaaaaggcaggggaaacacttcaaggtcatgagtt

SEQ ID NO: 45264 - DNA, 1344 bp, Bovine  19866881326362
aaacacacagcccagaggtagcgtccccacctcagctggccacctctgaggccagctggtccaggagctctgtctcccgggctccctgttcagtgaactcactgctcagctgccacacctttactgtgcccttggcatcaccagcagccaggagttgagtctgctggcagttgaattcaagacagtagacagggctttcgtcctcggtttgcttgactgaaactgtgggcttctgggagcttttctggagatcaaacagctgcacgtcaccttcagggagagtcgtggggtgagacaggcccagagccgcagcccccgagccttgcggcctctgagcctcttcggttcccgaagacgtgagaaggctgtgactcagtgcagctctccatcccacgtgagggaaggcacccttgcccacagcctccccagcccacagttgcagggacgcgctgggctcatgccccttcagtggatccaagcctggggcccgtgccttaccttccccagaagcagctgcaaacaccagggggcgcaccggggaccagcgcacagcaaacaggtacttgtgggagagctgcagggaggtcaggggctgggcctgcagcatggagtacaggtgggcgtggccatctgtccctgcgctcaggaagagattcctagatgggacacacggcaggcggggggtgagcgctgggggtccaggtgtggctggggcctttccaccggactcctcatgggctggtgggctccccaaagtaaggagccaattccctggagccaaccacgggagctctgggtactggagctcggtggggaaggcccagggcagactgcaggttcttcaggcagttctgtgtgggtcctggtgggactcccccgccctccctgtgccagacgccctgtgggccctcccctacctgtggaagggggagcagctcacagagtagacggggccgccgtggggggcgaaggtgaactgcgccggggcccgcaggggcacagagctgggcatccgtgtgacagcggcctcctctgccgacagggagcacttgagcgggaagccgccttctgtgcccagcacgaaaaggctggggtcgaagctggagaaagccaccgctgtggcgcccacctcagcctccccacgggaaggctgcggaggaaaacaacagcagggcagagctggggggagtctgctcggtgtccccaaggagccccgggcacgtgcgtgaccgctgtagccctcagggactcccacctgctcgcctgcccccaaggcgcactggctcgggggtcccatggcccagcgctgccttgtggacctacgtacaggctggcagcctcacc

SEQ ID NO: 45265 - DNA, 847 bp, Bovine  19866881405133
cattcttgtctagatcaggggtctccaacttccggccgcggaccggtacctcctgtcagatcagcggcagcattagattagaagtaaagtgcacaaaaatgttgtttagccgctcagtcgtgtctgactctgcgaccacatggactgcagcacgtcaggcctccctgtccttcaccatctcccggagcttgctcaaactcatgtccatcgagtcagagatgccatccaaccatctcgtcctctgttgtcctcttctcctcctgccctcaatctttcccagcatcagggtcttttctaatgattcggctcttcgcatcaggtggccaaagtattggagcttcagcttcacaaaaatgtaatgcgcttgaattgtcctaaaaccatccctcccgcctccagtccgtggaaaaattgtcttccacaaaaccagtcccagctgtcaaaaaaagttggggaccactagtctagacctcatccagagtgcctctgggtggcctgaaccactgcccctgccattaccccagggccctgtatcccctgcccgtatgcctcctgcaggctcaggcccagctccaggagtcctgccagaaactggacctcctgcggctggccttggagcagctgctggagagactgcctcctgcccaccctctgcgcggcagagtggcccgggagctgcggactgctgcgtctgggaacccacagccttcagggacgctcgtgaagcccactgccatgacaggtacctgggagcccatcatacttcaaagctctccttcccttccagggaggagcctggaactcagtggggaagaattttggagaagatttctaatcccggtttcac

SEQ ID NO: 45266 - DNA, 841 bp, Bovine  19866881488898
atcacaggattcacatagaggtggggccgatgccaaggctaagctgggctcttccttggtgaccggaagtggctcagccctgccagcctcagtctccccagctgcccagtgaggggacttactacctgctgaggtgggctctgaggatgggctgaccctgccctgcagctcacttggggtgctggtcaaacatgatgggcaggaactcatccacaggcagcattcggcgcagcggctgggaggccagcagcttgcgggcacccgccaggctcaggacgtatgccagtgtccagtaggagtagccggccgccaccaggtgcggcagcccctccacaactgcctcctcctcggggttcacctgcttccggccgaggtagctgcaggtgacaccaggggtcccagggatcactgttgatgtcccagggtcctccctgtccccaactccatctacagagccaagcccagggcggggcgagggctggccagggcttcctgcaggagaaggcagaccccgggaggcccacccttctccctggcccctggggccccgggctgcctacatcaagtcccaaggaagtttctccgcctccacctcctccatcagctgctccagccgccccttgaaattgctctcaaagcgtacatcgtcctcaaataccacgacctgggccaggccccgggtgacgacctgaggcacaaggtgggggtgggagggtggctctttagacctgggctgtcgtcccctcccacctggctgacactgacagacactcctggcttcagttacaggccaagtgctcagccctggctatgtcgctcagctgctccaaagcctgctggg

SEQ ID NO: 45267 - DNA, 1024 bp, Bovine  19866881544881
gaccttcgacaaggacagtctggccggctgaaccccaggagttcaaatcctgtctgcgctccctgggctatgacctgcccatggtggaggaaggggagcccgaccctgagttcgaggccatcctggacactgtggatcctaacaggtgagcgtgagggaaggagcagaagtggctctgcccgaggctcctgctgcaccctccctactcactacatcttgccccccaccccagggacggccacgtctccctgcaagagtacatggcctttatgatcagccgtgagaccgagaacgtcaagtccagcgaggagattgagagcgccttccgggccctgagctctgaagggaagccttatgtgaccaaggaggagctgtaccaggtctggagctgcttctggggccagggggtgggtgtgtcctttgaaaggcaaaagcccaggcaaggctggccctgagcttgggggcagagctgtctagagtcgcagcccccacccagtcttgagcctcagctgctttgtgcagaccctcttacccattttcaagtgaaactcagcccaggccaaaggctgttaatggcagagatccagaagctcgggcacgaatgtttctgaagtcgggcccactgcccccacagcacagttggtgtggctggtcggggctcggctgacgtgcacctttccctccagaacctgactcgggaacaagccgactactgcgtctcccacatgaagccctacgtggacagcaagggccgcgaactccccactgcttttgactacgtcgagttcacccgctcgctcttcgtgaactgatcctctgctcctaggttagcctggcccacgctgcttgccctaccgtcgccttgctgcatgtcaactcctctctgtgctcttaagaaaaatactccagacagtgttgctttccagtgtaaccttaacttgcttagcttggtttaagatttagtagaaaacggtgcttcagtaaccggctttaggtccagtcgccattgccacgttgctgcggg

SEQ ID NO: 45268 - DNA, 1179 bp, Bovine  19866881564683
acctagcacagccgaaataataatacaaattttctttaaaaacatagaggctgtctagttcatgagttcctgccttacacccctcgccaggccattttacagataaggaaaactgagggcccaggccacacagttagtgaagaagtatttgggagagggcgatcttaatgccttaagaccttgtggatggtagatcaggggtcccctatgcctgggctggcttgtgagaccacctcccctgcaccatcccgagcctctgagacccccccactcactcgtcctctctctccaggacgtcccggggcacaggcagcagggacagcaggaaggcttggctcatgtgctggatctcgccgagccgctgctggtgctgggctcccgacatgtgttcctggaactcctgcagcaggcgggagcgagaaaggggcgtgaggagtgagcccctgaacactggggctagaggaggcctccaacctgggcttcctggccaccccactgctgccgggaggacttctctctcatgaccctgtatgggccagagaaggatggtaaactggggcccagagtgagcacatgccagccagagcctctgctcccgctggagaccatgagcacctccgaggtgaggagcagtgtgatcaaattccaggtccccgtggctctgctcaggccaggcacagaggggcagcgctaacaatagtgacagtaatcacaccagtgtgatgctgttactaaggctgcactcgctctgcgctagcccagcgactcatgacttcaatgtcaagttgctgaatccccagaacccctctgggaggcagtttttctttttctagaggtgggttctaaatgtttcttctgatgcatgcagaaaccgaggcaccaatgcctcagtttggaaggtggaattcactttccaaaacccacatagtcaatcagggctgatttgcaccaggtccacccaactctgaaaccctgccccctgggctggtccggagatgttttgtgatctaaggtacagctgccggaggtggggcttgggggcccaagtggacacagaggcagccctgggaaaggcaggctgggcatcacatacagcccccaaaccctccacccgcccacgagatctcccacccccccaccggagggtacctgctggctactgcagccggccttgcagat

SEQ ID NO: 45269 - DNA, 689 bp, Bovine  19866881572604
ctggaagacaaagtataaagggtggaaactggaacagttcctagaataaaaacttgcaggaacctgactcactagcagacatatttaaaagagggaagtgagaattaaacagagaagcaatgctgggaaactgagaagcctgagaaccaaagtgaatgtctccaccaggtttccatgcagttgcggcagcctctgcctgagagaaatggcagaaaaacagcgagccaggccccaccggccaatgatcacaacccctaaccctctaccttcaagagcagctgcgctggaagaggacacactgctgaaccgctattccagttcttagttatctgcctttaaagggtccacactgcccagctgtgctttcctgcttgcttcaaatcaaaccggctgatccacctccctcttggggctcccccgagccccagccagctgattcatgtcccttttggggagaagtgccagtgagaggtgtgggtcttacattccagcccgccttgctcccaattctgtaggtcagtaaagaagctgttcagaacagagttctaatgccagccagcccaggcagaggggggaggattggcaaagggtgccagttatgagtctgggaaatggagcagttaattattaaagtaaaaagtaggtgaatttaaaaaggagccagccaatcccatatccctgactgtagg

SEQ ID NO: 45270 - DNA, 859 bp, Bovine  19866881702528
tgtactggaatgacctttagaaagccttccactgcctagcctctgtttcctcatctgcaaaaagggttgatgaagtccttggagctgatacaggtggtcaggggtattcctgggtggaggagaaggcagggtggaagctacgtgcccaggacttcctttctttctctcttcctccccctgcagcctctggtccgagagctgtgccgcagctgcgccgtggtgtccagctcaggccagatgctgggctcgggcctgggcgccgagattgacagcgctgagtgcgtactgcgcatgaaccaggcgcccaccgtgggcttcgaggcagacgtgggccagcggagcaccctgcgggtcatctcccacacgagcgtgcctctgttgctgcgaaactattcccactatttccagcaggcccgggacacactctatgtggtgtggggccaggggaagcacatggaccgggcgctgggtggccgcacctaccgtgcgctgctgcagctcaccaggatgtaccccggcctgcaggtgtacacattcaccgagcgcatgatggcctactgtgaccaggtcttccaggacgagacgggcaagaaccggtgagcatgagccggggagctggcctgctggggatctccctggcagctggcggcctgccttctccaggagcctctggtgcactaagggtctgctctgtctggcactggggctcagcagtgatagaagcaggcatggtcctgccctctgatggggacaggaatcagagagactgtcatcatcgaatgaccatatagatgttccacacggcggtgaaagggcgttcggcctcaccagtatacactgtggcgggggtggtggcggg

SEQ ID NO: 45271 - DNA, 931 bp, Bovine  19866881841835
caaaaactcctggaaataagtgtggaccagatgtatatagaacagtggtctctaaaattttctctttaggctttctatactctacactgtctacagagactatgactaactccagcttcctggcccttcactgtcctatttccacctgggcgcaggcttgggggagcggcctgcacacaaaccctaccacctcctcctattcgcattctttgcggagacaagtgatccagatctacatctcacacagataagctctctcttctctacacgttcccttcctctgcttagaaacccgccggagcacacagctcacacctgacaaggaagattcctattaaaggggatgtcggcgagagccctgcctgttcacagaagcccctggggggaagggagccgcagcgtcacctcagaccccccctggtgggagagagcccggtgtcacctcagagagccagaagtcgaagtccttgatgccagtgttgaagttctgctgcttgttggcttctttcagcttctggctcttctcagctgacttctgcaccaggaactgccactggtcagctaaggcggccagccgggcctaggcgagagaagcaagtcgtcagagacaggcagcccccacagccagcgccctgttgggaagccctcctcagcgaggttgatgaagaggctcacaggcgctgctctcgctagcaccatcagcagcgcagactgaaacctggatactttcctaagactgagtttcagagtcaccatcaagcggactctaatgctgacagtgaagtccagcacctcttctttcccggccaggaggaggggagctggggcccataccttgacggcatcctcgctgccggcgcaggccccgcggtcaatgagggagttgcccatgtcgatgaccccacggatccggtccgcatggcgtgcagtt

SEQ ID NO: 45272 - DNA, 1120 bp, Bovine  19866881960821
agtcggacacggctgagcacttcactttctttcacttcctagtctgaggtacacggtgtttcggcagggactcctatgaccaccctgtgggaaggggccaccagccaccccgaccccacctttgccctctatcgggttgactggcgtcctcacagcagcacctacgagaacagaagccccaaaggacaggtgctttcctggtttgattcactgtgtcccagctgctgaggacactggtgtgatttttcttcttttggctgcactgtgaggcatgcaggatcttagttccctaaccgggcactgaactggaaggcagccactggaaggcagccactggaccacgggaaaagtcccatctggtatgttttaagtactaaataaatattttgcctgaattttcatattaaagttttcttcttttactgctttacggtctacccgtcccccactagaatattagttccatgagggcaagaccttgtctaagttgccacacttggatcagtggatggcgcatgactgattctgaagaaatgaatgagttcctcagtagttgggggtcctgacgccctagtccgtgtcctctctggctggggttggagagtgtcacaacttgtcacacccaaggggcacactgtctctacaacaggggacacgatgtgatagttaaaagcataatcctgatttgaatattgcctccgttaatactggcctgtgaaatcagcaagttgcttaacctctctgagccttagtttcctcattttggcagagttgttcgggtggaattcagtgagatcacatgtgaacccgccatggggcactcagtagaggttagtaagtgcagggcagtgtaattgcttggagcgatgttcctggcccacgtgcctgtaccacagaaaatgccaatgccttggcacgagagactgcaaggtagtgctgcccatggtggaagcacaggcccctcgttcctcaggacattactcatgtgccattcatctgccctccctggtgactgccaaacgcacagaagctggtgactcacattcacatccaggaaatggagatacgcgcagccaaaggagccctcgggcagactccggagcttgcccatgtcgagggt

SEQ ID NO: 45273 - DNA, 3273 bp, Bovine  19866880456228
ctgctggccccatgcaacacctatcaacacggtgccaaggcttgattagtgggtttcctagtgggagagaactagtcagagtaaagctttagcagcaggatgtggcagaaacaactgggctgtgaggaagcaagagacctcttgtcccggatgcaccaactgcagccttaaagcaattcataatctcgccaatccacatggccgccctggacttccccccatggctggtaatcagacctggccatggtcccctgggtatacagggccaccaaagttcaactgaccccaaatccaacctgctcccctctcttttggttcagggcttaccatccaggtatgcaattttaacactctcggggtctgaactcaaaaaagcacagatccgcaaatgtaaaatgaggggagttagccgaaggctttgtctagatcattccaaattttatttttctcatgtctttctaaaatgactcaatttagacgcagctcaaggtggtggttgggaaaataacctttctaggggcagtgggtcccttctgccaatgtaagatgggctcctcttactggtagacccttactcagctggacatggaggtggcagacagcagagtctggtgggtaggatgtaccattttcactcacctataaacactttccctcactcacctcccaaccaagtacactcttaggtctcttctgctggaagagggaattcccagtggcccttactgggcctaaaaagaatctgatgaaattataagggctggaacaaataaaaaggtccttggaacagaggtgccagggctgaagacaggaggatcaagaccacagtgcttgaatcaaccatctctcactcctcccagcccgcagtgtgtccactcttaaaactgagacggttccagataattcatctgaccaccagccaggacaccttactgagagcagcccctagaagcccacaagttgtcatcttgggcttattcgcccaaacgtatccttcttcggcaacatgtccaactctgttctccccgcccccctcaaaggcaataagggcccctccactgggttcccacaagcaggctcaggcctttattacaggcacacttaacacactgcaccacggctactcatgttcccatcttactcctgcttcagactcagcactcccaagggcagagacctgctgagttcccctgggtaccatcccttcttctctccatccccaaagcacaggcctggctggcacccagcaggtacaccaaaaatgtctgctggatggatggatggatggataggggatgtgtagggtctagggccatgaaatggatcttctggaggggccaagctaaagcacacaaaaacagactgatatttcccaagcagcagacctaaaaatgagaatacactcattaaaatcttttcaaattaagttttccatgaacaagcatctggggaactgtcctgtacttccaaggccatttacctaaacacgattttgtggctattacattaagtgctgtcgagtgaggacacaaggagatcagttaatgtgacaagactagaagctgatcctgttgcctcatcattaactaagtcgccctctctgtgatgaagtcactcactcattcaacaaatgtttatcaactgctcatcaaatgccagtcacccttccggcagtggggtacactggggtcacaaagtctgggaggagcagctacaggaaactacagaagaacagattcttcgtggggaatgaagtcagcctaaaaagcttaagacccgagcccacaggtcgcagtaccaagtggtactccatgccttcccaagctcagtgtaaaatatactcagtgtaaaatctttcaaagttctaagcaccatcttgaaatccaactacaagacacgtatggagagttgccccacacacagcaggatctagagagctctaccctcaagttcttgcaccacatcacctagtttttcggcctcccatctcaacacatcacttttcacaaggaccagcaactagtggtttggagatggtatggctctctatagcagctccttctgatctgacaggagctaaaaataaccatgcacattaaaaccatgtgaaataagaataccgggttgccagctaaagacagggccaggcaggcagccagcagggaaaggtatggacattgtgataccttcgctggccagtcagaggttccaatttagtctatctgctggttcccagccaaggtcccgataaggaagactgctggacagctgatgtcttaactgtcctgcagataaatgaaccagcctgaccctctcagataagatgcaatgggcaacatctcactgcagcctgacccacgtgcaacgtaataagtcaacagtggtcctggaagaacaacgaagatagaaggccagccatccaaatctcattagtctccagagcattcaatgctgtgcgtcccaggtaggtttgaaaggaggaaataagccgtgtgtgagagtgccagtcaagcgtgcacatccgaggtggtggaaagcatgccatctgggcagagaaaggacttcaggagccttgaaggcacacgaggctctctcccttccatccaccggctccacatccatcagaggctaagtccctttgcacccatcttcagaaggctctctccctcctctccattacggctcaggccacatcacctcatctgtgggccacagcaagagtcccccgagtggtcccagattatcattccatttatcaattattgatcttaagttttataacatatggaaacttgataagcagaaagggacagagggtggaggtggaggagagggtgggagaaggggtagagtctttctttagctctaagtattaaggtgcccatctgatggtggcctcaaaccggttataaatacacacagttgtaccacggtggagccatgccctgggactcttagaggccaaaatgttgggttggaaaaccagctctatttcttttctagcgatatgactgtgactttaggcaaccccccatgccgagtctcagcttctccgtctgaaaaacaggtactctcctctactctgtccaccctgctaagtcacggcattaataaaaaagaaagcaaacaagcatccactgtcaactgcagtgtcctatacacacaaaggaattattatcactttcatccaaactttatttctctcacatctccacaggaataacacaatgtgcttttttgccaaatgctgaacaagtgccgacaaaggtccgt

SEQ ID NO: 45274 - DNA, 1011 bp, Bovine  19866881028515
aatggctactgactaaatgttttcttggtctgtgtgtgttgtgggggggtgtctggggcgtgaaggtgtgacactaccatgtgtcatgaaatcagtacaaccccagtgggctggccactgtgatgacagaccaagttctgaatcttggctctatcccctactttaacctttgtgaggttccgagtaagctgtggcttcatcgtctgtgaaatgggtctgcctcacagatcgatgatgaataattaaacatgagcgctataaagccttcggtttgatgccagtctcaggtcagagtggggactcagtaaacagcacctaccagaccagccaggggaaagctgggtgggtgcaggccagagcccgggctctcagaagacacctttgatttgtaaaaatagagcccgtgcccctgctttgagctgtgcccagcaagagctacagatggattcctgggtggctttcctgctttaacagaaaaaggaaacaggaggccccagtcccaactgctaaaaataggcgatgccaatagactttgaccttgcttcagggctgggcagcgcactatggaaaccaggcttggctctttgcagggagctggggacgcagagagttgtgccaagagccctgccactgccagccctctgatatgaatatcaggggctgggtggggatgtcattcttggcaggagcctctaccgtggtgcagtaagccactggccaagtggaccgtccccttcctggcccccatctattacacctgccaccaactgcttcatcctagaccctagggaaaaaatcagtggctcagcaaacctttccaaaaggtctcatctaaattgctaaggtctctcctacaggcaaggcagccttgagattccagctaagctcagtgcatcacctctgggggccctgatgacttatgagcctgcccacctggaagaagagacccacagccatgacgggttacaaagccctttctcctcccttaactcacagagtccctcaatttcc

SEQ ID NO: 45275 - DNA, 1133 bp, Bovine  19866882122887
ctagataacttgctacttttctctgaacctcagtaggaaagtagctctctattacctgcacgtgcacacagaggggccaggggtctctgttcctactgccatcactactaagtcatcacaaagaaatatacactgtttacaccaggatgtcgtaaacacaaatatctgaaattactgaataaagttaccttgaaatttcaccctgagtgagaaatagcagctcagccctcagcaagatctggtgactcaaaactgaaatctattggtgcaaagacaatgcagaggatccctaatctgctggattgaaggccaggctgtccagcttataaattccacctcccagttgaagaagacttccatgtttaccaaggttccatgaccccagttttcagagaaagcctgagactcagagagatcaacatgaccaagttcctattgctcacaagtagcagaccaagaatcagaacccagccttctgggttctaggacagagatccttccatctcatcccactgcttctccagtcggctcattcacctgtttggctccaaacacatgcaatgtgtccagccagcaaagaagaaatatttcttaagcccaattcaacacacagctgcagaaagcgtgcttcatgcgtgctcttggctacaggtgggagacacggccacccggtcaaacaccagcagacctcctggtgggaggtggggggcaattcccattgtttggaggaagggaagttggggcagaatggaaagtagttgattcattcaaacactaacccagaaaccacaacactttctgtgggggacaccaagagtctgggcggctcctagaaattcaattctgataaaacagagtacgtgttactaatttcctgacctgcctggctaaccatctcttagaaatcggaggaagcaaccaataccactgcccttaattttggtcaacaaggaagtgagaagagtctcagaagaaagtgttgttttggtgtgcgagtcagtgaaaggagacagtgtgaatggggtcttcttccaaccaggggcacagggctctccacatgggacacgagctctgggcgggtagagggtaggcttaacggttcccgcacatagcaccaccacactggcttccag

SEQ ID NO: 45276 - DNA, 842 bp, Bovine  19866880621471
ctaaaggagatcagccctgggtgtactttggaaggaatgatgctaaagctgaaactccagtactttggccacctcatgcgaagagttgactcattggaaaagactctgatgctgggagggattaggggcaggaggaaaaggggacgacagaggatgagttggctggatggcatcactgactcgatggattcgagtttgaatgaactccaggagttggtgatggacagggaggcctggtgtgctgcgattcatggggttgcaaagagtcagacacgattgagcaactgaactgaactgaaactgcataaacgaaatttataaataaaatgaatcagattaccttgatatcaatataaaatagatatgaattactggttataaaatactgaataagtatttctcccaatctaattaaatattatagattttatagaactggacacatacactaatgttactatcatcttttaaaaaattcaagaaataggtaaacaatattgaacacttctatatattttccatccttacatttggctctaaagtattcatcccaagttaagccaattataaaagatattatggggaaaatataattggagtatcttataattatatttttgatataatggcttatagtagaattgtattactgctctcagtaaagattctaataatgatattcagatcaaatattctttcaattaaaaaaaaatagaatccacatcttgttaactagcaacacattgccctgttttctaaggcatccctagcatctaacatacattatacttccaaattaatgcaatattgtgacaagattacttgaaaattactttgtggga

SEQ ID NO: 45277 - DNA, 1964 bp, Bovine  19866880689690
attaagaaactagcattaaaccccatattacagacttgcatgcatgcatttgcacacaaagtttaaagctattgagatgaatttacttttgaaaggaattaggtagtagaagccaaagatgaaataatttggataaaattataatttctaaaagtttttaaaatagttgatttgttaaatgtaacttttagccatcaattgttaaatgtaaacccaacataaagatatggaacataaaatagtaaaattaaaaaaaacccttcattttgggaataaaatacaaattttcagctaaaaagtataaactataaatataatattggatatttagttggaactaatacagaaagagcaaatttctctgtagtacaggccctaagaacagatcgatcaatgcataactgagccactaattatgatacatttgtgacagaataaaatgaacattttaattgcatatctgtaatttgttttaatgattcaaaaatattttaattaaacaaacttaagtaacatgatgaaactgaatgcaataagttaattacaaaaataaatgtgataaaattaaagtgcttgtattaaattagaaaatgtccaaaggaaatatatggttttgtagttacaaagtaaaattggtgttttaatgccattatggcccttttagcaaccatgagactttaaagaaaaacaaataaagtcttataaaagccaaatgaacaacagctatctaagatgctctttaaattctacaaagtagttatagcatctcttatacagtgtaagacatttatacaaatttatgaacaaattttcaaagaaggtaagcatttccatcatttttttcactgatgtatcccagatgtctataacaggtactgtacctggcacataatagtgatgcttaataaatatgagtaaatttttaaaagtacgtttcagataataaaaatgaaataaatgtctacatttcttataatgcttagtttgttggtctgcatgttcagaattttagagtagattatactaaataaaagtatttttagggataatgctccaaaaattaaatatattcaatttattgcctcaaaatctttgaaggtttataattaagtcaagttttagcaattgaataaactgcccctaaaaggaagaatgaaattttcaggaaagccatcttcagtaatcttcattagtgctgtatcactataaatatattatacatatatttttctttgagttcatgttgaaaaaaaagagtcaatattctatttatctgcttccaatatatcaatttaaaatatttactcaatcaagccattttgggggtagggaaatggcaattctaaggaaaacagtttaacatcctgagctgaaattgaaccatgaataatatttaaatcaaatacattaatatttagctattttcatctcacttatgtgtcatcacatgtgcactgaaatataatctagagctcaaatgaatactctaggggaaaaaaaaaaaacaacaagtaatactacttttctgtctaagggaacagtttatatccagataaaaattttttgtcccattcaacattactgttaaacattgaaaatagttactgctaaacagtgcctccagctttagatgagaattgttgcatgaatttgaaagtacatagctctatcctggaaaactttccccaggtttctctatttgtcagactataaaagtaaacatttaatgtttattgagcaggatttatgaagctgtcagagaattgacacacggcaataaaacgtattgaggctggagtctagataatctgcagctgaatgaattacactaattctggtgcttgcatattcatgctatggaaataattcttgtaacagatttcttcattgtccacaggtgccacagcatgactagaagtagagttaattggcactccaggacatgtgggaattcacacatacat

SEQ ID NO: 45278 - DNA, 1213 bp, Bovine  19866880943686
gcagacagaggccaaagttggtgtgccttgtggaaatgaaccaaggctgatgattcacatgaatgttgtagtgagagaaataccaaaaataccactaattcagaacacaccttgtatttatatctatacattttctagattggagcatgactgctgtctccaccccagtttcttcaaactttggtcataaatattttaggacttcccttcatagttgcatccatttaactaagagataaatgatttaaagtagtttgatttataacacatttctctcatggaaattcaaaatccattaactgtgatcaactcagacacagaagttgtagattttaggcacccatgtttttttcttctgctatcaaaattgtgaggaaaaagaaaaaacaaaactttaatgtgttttttaaactatggactgttggatgttggaattatgggtagaattggagcaatcaaagcaaaatggcatcacaattcacccactgcaatataacaatatgtgatatatgaaaagggtttttcctaacaacaccatgacttaaatgaagactgaaaataataaatattataacctgacatttggcaattaagggagatagtttttggactctgagaattattaattacattgaaaatgtgccataacctccctcccccttttaaagaagaaaggaagacacaacataaaatcttcaataggctacacagtgttaggatgacatattgtaataagatatagagcctctcataaaaaaaaaaagtatcaaaaggaaataggaaactaattatgaagcagtgttctgtggcattttctgtgctgtgtcatatgaaaaatgcttgaaagatgaagtaaaatgatgtagtgtggcaaagctagcagttaaatatcctcactttctctaggagttgcctgccagtcaagttactgactgcaaatgagaataatgtctatggctagcaaacctgacagaaacatcctggcacttcaataatgaatatcataaacttgtcaaaataggaaaatgttttcttgagttccataggtcttaatgaccataacccatgcagtgagtttcatacaatgtggcttttaaaagcataaatacactaatgatctttctctgtgtcgtataaaggatatctgttaagtcagtgttgtaaaatctttaataataattattcttagcatcgggatgtatgtaggaggaaa

SEQ ID NO: 45279 - DNA, 1379 bp, Bovine  19866880994650
tgctgctgctgctgctgctgctgctaaggtgcttcagttgtgtccaactctgtgcgaccccagagacaacagcccaccaggctcccccgtccctgggattctccaggcaagaacaatggaatgggttgccatttccttctccaatgcaggaaagtgaaaagtgaaagtgaagtcgctcagtcgtgtccggctcttagcgaccccatggactgcagcctaccaggctcctccattcatgggattttccaggcaagagtactggagtggggtgtgtaactatcacacagggatttaattccttgcatgtgtggctgctcagtggctcagttgtgtccaattctatatgaccttttgggctgccaggctgctctgttcatgggattctccaggcaagaatactggagttggctgccatttcttcttttcagcccaggggtcaaacccaatgcattggcaggtggattctttaccactgcaccacctgggaagcccttaattccctccatctagttaaaattctctcttcatttcattgacatcccaactctatttcctattgtcctttcagttttatttactttgattccctgtagatcatgtgtttatgccctgttgacaatgatatgttgttgcctaatattgtttccttcctatcgtttttttttaaattaataagttagaagttttttcagagcaataaaaatgatttatttcttttatgtagaggtatagcatggatcctacatattgttatagtttacacaatatttgatgaacttattatcctaccagtaattggtgaatcatcaaagttaactttacatcccttggcatgccacttagtaaattagaaaaaagaaagttgtagagaaatgattctgtactgatgtgtgtatctcttccacaataggttatgatatttaaaagaaacagatgagcttagaaggttaagcttcttgagagctgacagctgccctgtcctattatagagagatttccttggcttgctagaataagccccgagagtcagtggactgacttgctcttgtcacacagcgattgaacaagctgagttagaagacatgtgtcaaattacaaggggattcacacagcgcccatgtgccaagttttccatcatagcatgacaaaaacaccatgagagttaatgaggagtggaccatttctttacaagcgtgtgagttttagtttgaggcaaacaaagaatagagtcttgggtcaggagaaaagacttgtgacttcatatgtagataagaaatcccatacattcatgaggtttaagcattctatgaagataaattaatagctgtgtcccctaaaatttttagtctcattgctggttgtaaatctgtaccatccat

SEQ ID NO: 45280 - DNA, 1130 bp, Bovine  19866881134100
atctaaaatgttcttctttccttgttattaagaaattgacatttctaccattgaaactattaccatttttcttccaatctgcctgcaaccttgtttagctaaatagtaacaagtaatttgagataaaattagtctaaatctttgctgtaatttattgataagtgtgtattatacactcatgcacacttaaagttttttgttatttcctactcctttttgcaaagaggaattcagaactaaagcttttccactctgtttattttaaaaagctgttcttggttgctagcttcagttactgtagtcactgccttgggccatctgtgattgcctttctctcacagtatgccctaatctatccttttgctagatttattcagttttctggatcttgagtcaaactattaaataacaatatactatattatgaatattatttaattggaaaggtatatatatatatatatttgtccaagcaaaagacatttcattttgcattgaaaaatacttctttgggccaatttactaggtgatttaaatgatcaatttcactctattaacattagttttcttatatttttgctctgtggagagcaccatcaaattgtagtaacaaatctattacatcatgatgacaaatgataggaagcattacagttgatcatcacatgagagcgtctttcgtgtgataaattacactgatacagtggtaaccttcacattcgctctcaaccaggttcttccagaggttacaaatcagtaaagcctgttaagagcaacttaagatgcacgaataacatggtttacaaatgaacttaaaagttgtggcaaaaatctagggggaggagaaaggataaggcagcacgctgagaacagggtacagatgtggtggaaggggctccctagctgggtccttgttccaccaaccatcttcacatgtcctgtcactttctcacacataagcagtatcctctgatgatgaggttgaaataaggggggttaacagatagaaagtgcctggagccaatacacacttcctatatgagtaagatgcaggagagaaaaaaaaggaaaaacatgtgttgaactgttatggatttctgtagtgttaagggcactggaaccagaatcaa

SEQ ID NO: 45281 - DNA, 3322 bp, Bovine  19866880207619
aaaaaccatagccttgattagatagacctttgttggcaaagtaatgtctctgcttttgaatatgctatctaggttggtcataacttttcttccaaaggagtaagcatcttttaatttcatggctgcagtcaccatctgcagtgattttggaggccaaaaacataaagtctgacactgtttccactgtttccccatctatttcccatgaagtgatgggaccgcatgccatgatcttagttttctgaatgttgagcttgaagccaactttttcactctcctctttcactttcatcaaaaggctttttagttcctcttcactttctgccataagggtggtgtcgtctgcatatctgaggttattgatatttctcctggcaatctcgattccagcttgtgtttcttccagcccagcgtttctcatgatgtactctgcatataagttaaataagcagggtgacaatatacagccttaaggtactccttttcctatttggaaccagtctgttgttccacgtccagttctaactgttacttcttgacctgaatgactgaatgcattacctccagttaaatggtgcttcacccaaaccctatacagtggattcccacacggtgagcattccattcacgcatttctagagtaacagataagactcttacttgaactaatttaattgtagagccagggccagcatttgtccatgcaaccaatcgcacaacatgtcagggcagggattcctagaatctagtttcaaatagagtgtggctctgtgttttccacagatgctgcttcctttctggggcatcctcaggtctagagtccactagaaagctttctaccttccagaggagagagggagtggggggtggaattcataggtagtgaatcaagcagaagtccaccaggctgatcttttggtgactctaccagacactaatagtctctaggaggtgtgagctcagggagaagctttccattcatttcatgtgcccattcctagagtcgggagcatgaatacctctcagagaaattgtaagaaactaattcgccagctgcacaatgccactggagaaggagagagagatacacccaacctggtggccctgtggggttcccaggatgtagcccacctaccttctcatagttagagaagccccccatgacagctgggtccacgatgccattgagcagcatggagaggggatgcacagagagggaccggtcccaggcatgctgctggacacagttgctgatcttctcattggtgagctccatggtttcgatggcattctccagaggactgatttcctcctgtggacagagcacatgggagaagagagacatcgagctccatggtcacttctgggaagaagcccaagccttccactcaacaggaacacaattcccaccaagctatggaggagtgatgttctgcttgttaagatcacgtttattaataaggatagaacacttacttgaaatggtgttggtaagctgcaagataagctactttgtttctcaatatagtttaacacttttgcatgacttcataaatgacagctatttttatttatacattataaatccactgaacactcagaatgtatggaatcagagagcaagatgaaaacaaatggctaaacagtaaaaactaggagtaagtagaattttaatttgtgatttatttagaagacactcattttctttgctaagctgtttaaaatctcagaaagtacaaggatgatttatatattggagttatggtaatgattatttcttggggcaaagtgtctacggaaattttgagaagacaaaattggagctgtaagaatggttgtttcttaggcaaatccttcttaagagattcttgagatgatcaacaacaagaggggagcaatatatgtgacccaagacatttgggcacaaccaacaatactcactgctaagaggtttcatgctcctttcatgagaaaagctaagagattctggaagtcgcacattcagacctacattaactcaccttagtatgggttctattgttcatagaagtcagaaataataagatgtattagagtattcaagctggattttacatgagaatcaagtaagatataatatggattcagaaagagctccttctgtggaaatgtcttccaaaccagattcaagaaaaattgccttcttcttcactttacccatgatcaaccagcatgacctcctactccaaacttgatacaagcctctgtccaaaatcacattcacatttcaaaaatagcaatttatcactagtgggatggaacacctcaaacttcagatttgttcaagacctatttcttaattgcttattttctgcaagcactgggctgagaaccattgttacaaaagtgattaaggtacaattcggctggaagaagctttggacagaggagcctggtgggctacagtccatagggtcgcagagaatcagacacgatggagcaactgagcacatggctggaaggagcatgtgatttttatagggtcaaggtcagaatgcagaggtctcaagacaagtgagcatgggaggtaactctttaaaataagcccaggttctgatagggcatagaaaaagggcatctaactcaggttgggagtttcagagatggcttcctggaaaagctggtatctaaactcaatctcaatgggagttaggttaagaagtagggagagggcattctggatagaaagaaggacccaatatcatagaggactgaatgagcacagaataagcaatttagttccaggcacagaagaccaagtagaagaggcttttagtcccaaagaccctgtctacatgtgctaggagcatgggctttctagtctaggcactggggagccatggcaaggttttgagcatgagaatgatacagctggattttcactatggaattcacattctgaggcagagagggaaagacctaagaagccaccaggcagggtggggccaatcaggagcctttttcaacatcatcagccagagatgaatgagagtagaaacagcgcaccatagtaggactgggggaagaaaaaaccaaaacggacttaataaatattagaaagctaaaaatgacgagctttggggagtgctgaagatggatgtgagagttggactataaagaaagctgagcgccgaagaattgatgcttttgaactgtggtgtaggagaagactcttgagagtcccttggactgcaaggagatccaaccagtccatcctaaaggagatcagtcctgggtgttcactggaaggactgatgttaagctaaactccaatacttggcca

SEQ ID NO: 45282 - DNA, 1339 bp, Bovine  19866880518750
tccacccttaagtttccctggtgcctcagtggtaaacaaaatgccagcagtgcaggagacacgggttcgattcctgggtcgaaaagatcccctggagatgagagggcaatccactccactgttcttgcctgggaaatcccatggacatgggagcccggtgggttgcagtccatagggttgccaagagtcagacaggactgagcaactaaacaacaagtccactctcatcttcagctctgaagttctgaaatttgacagttccatgatccaaaagctcaaagagctgaacatgtacacaaggaataagaaaaaaatactgtcagagagggtggagagcatcaacatcgtattaccatcaccattacctcaagtagagtactctagattggatgatgaacctaaacaagtactttaaggctttcaaagcagcaaaaagcaattccgtcttgctggaatcatctgcatttgccacgtaaaagttcagtaccttggagagtttcctgaaaaagaggagaaagagaaaagcgtcagtgggcaaagcggtattctggggcccaaggtgcacaagacaaaagggaacctggcttctgaggaagaagtcgtaactatagtaactatttcttctagaaatttcttcttcactgcagtctagcttcccttctgcttataaaccaaggatagtttcttttcctttgcaggattcttttttttttaactttttattttgtattgaaatatagtcaattaacaatgttatgatggtttcaggtggacagcaaagggactcagccatacagatacatgtatccattctccctcgaactgccgttccattctttttaaaaggatcaagaaaaagagctgaagggacgcgaattgcgagggtattttaatctctagtatgttacacagggggcttcccaggtggtgcagtggtaaagaatccgcctgccagtgtaggagacatgggttcgatccttgggtcatgaatatcccctggaggaggaaatggcaacctactccagtattcttgtctgggaaatcccatggacagaggaacctggtggcctacagtccgtggggtcgcaaagagtaggacatgacttattgactaaaacaacaacatgttatgccgactttttcaaatgttcttgtaaggatggaattgtctgcctaagtagccaccttaaaagaaatcaaattccctccaatctgccccaactttttagaatctccaaattggagccagatgaaaattttattgtctgagaagagcagcccagagttctgagcatcgaacagataaaactgctctgggatgctctttagcttttctaga

SEQ ID NO: 45283 - DNA, 698 bp, Bovine  19866880612409
acctagattcgcttgacttctgctgtttagacccagaattattaacatcaaaggctttttaaaaatcagctctgctaggtactgaaaaatagaaaggagtttattgatcatcaggcttaagctgggagggacccaaagcaaaaggccagatggaggctcagacgacgctcccaggtctcatgaacttgaatccttttaaatccaccctcacatccacaaggtttgaaggaaaaggcaaacagatatgtgactgtgaacattcacccttgttttcgctgcttattatctgccaagaacaagactttgggtgatacaggctattagctaatagctcctgtgatccatcaccttcttcaagccaagtcaattcctcttaacaaattgaaatttcagcgtggcctctgcagcatgtggggcccagactgcagggagatctgctgctgaacgctaatgcatgcagcaaaacactgccgagggccgggaggttgtcagggagcgactgttcccagtagcagcttttgttcagaacacaattcagaggagccttgcctttagaggttaactcttctgtacataaaaggagttcatctctgtattaagtggcactttccccaggatgctatttaccggaggattcttgcatctaagagacatttaaataaaagccaagtcccagttatcttttttatacccaatgc

SEQ ID NO: 45284 - DNA, 1775 bp, Bovine  19866880674228
atataattttatgcccaaaactatagaataaggaaaaataacagtattcctattttacaagttagaaaggtgaggcataagggtcttatgtgatgccctgaaattcacatggctggttagtgacagagctagtctagataatttattataacttctgaaattattttctctcttagtttgttattcctatcatttttttctatttatataaaaggaatcattatgcatccattcaacaaatatttgtcgagcacctattatttgaccaccccactccagtactctattgcctggaaaatcccatggatggaggagcctggtgggctgcagtccatggggtcactagagttggacatgactgagcgacttcactttcacttttcactttcatgtactggagaaggaaatggcaacccattccagtgttcttgcctggagaatcccagggacggggcctggtgggctgccgtctatggggtcacatagagtcggacacgactgaagcaacttagcagcagcagcagtattatttgacaggggacatctgggaggcaaagacatattgttgaagacaggtaatatctccattcacgtgaagcatcctttctggtggggaaagaaaaacaaaacaaagtaaattgaaaaatcagggacttctctggtggtccagtggtgaagactccacacttccactgcagggaacatgggaatggcaacccactccagtactgttgcccggagaatcccatggacagaggggcctggcagcttacagtccataggggcacaaagagtcaggcacagctgaagcacgcacacacacaatgtccctcactagcctcagcttgtcggctatgtgcctatgctcttctgccttcctgtccctcagtgcaaaggcaatttactccaatcatttcccagctgatggcaccttcctccaggagttggccaagctctgaattcagaccttgtctgcaatgctttgggatttccataaaactcaaacagatctctatattcatgtcctttcagagcctcctattgtattttttcctactaaggctcagcaaaaatgctttcaagagcacgtaaatgaaaggacaggagagcataacacatagtttctatcagaaatcaatggaaactaaaaatagttcatatgaaacaccctgaatgaagcatttctagtctcagcggaagtctttgtggagcacataggctttggctgtgaggtctcctggggacacttcctgaagtgaaaggtatttttctttcaggaaaggacattgcttaaattatgtgctgcactaatacttagatcttctctcagatagatatatgctgaggcctacaaaatgctgtattcacataaccattgatacaagaagactcaagaggaaatctttaatgccaacatggttgaaaaactgccaatacttcagtggttgtcagtggctggtgaatgtcaccgggtgttgagaacccacaaggggaaaaagagtggaaatttctatcacaaacatatatagatccatagagagtttacaatgtcaggcttgttcatctcctaatgatgcccctggttttcatactggacaaaagggagctgttgactagtgtgattatagtcaccagatcctcatttctatgtctgtaatccatttatttccctaatttacatgctctctaagtctccacagtggctatttcaaagcttaatctactctcattatatcatctacctgcttcactctcagcacccatcttttcagttt

SEQ ID NO: 45285 - DNA, 2403 bp, Bovine  19866880751681
aaagaaatgcagtgtttctagcacaatatatccagcacaggctagactgacagttattccaaagccaatctccagaacattcatcagatatgataggttctgagttttaccctcttctcaaaagctgtggattatcgtggaatttttgtatttggtttgcaattctcctgactagaagtcctgattaataggggacatgaagccttgtttagaaaaattcaatacattatgctctagtcgaagacatcctgagcaactcttttgcaagctccacattgtaatgttcacattgactccctcctctgggggtttgaggggccaggagttgagaaggggggtggcgggtgaaaagaaagaaaccagcttcttggcagcttctcaacaatagctccagctccccatcccctccaaaaaaaaccttttttttttccatagttgctctaaccaagaaaatatgcatagcttcctgacagattggataatgcggagatttgagaaaattgtgcaattcaccttattttcatttcacccccaaatacttcgggtgcaagtacagcttccatccacacataacagtagtttcagtttcttaaactggcgagtggggccaggcagcagtagtagtgcgtactaagccacctccgtcgtgcccaactcttcacaaccctatggactgagacctaccacgttcctctgtccatggaattctccaggcaagaacactagagtgggttgccatgccctcctccaggggatcttcccaacccagggatcgaacccatgtctcttaagtctcctgcattggcaggcgggctctttaccactagcaccacctgggaagcagaggcatttttttttttaaggcaagggacattgcaatgacacccaatcttgtttggggattgccccctcttggtccctgttcaactggagtcaatcaatcccagcaggagaaccagctgacccagcttcactgagatgagatattcctggacaacacaaggaagtcttccaacttgtacgttggagaatcagaaggaaccagaattctggccggcggttgccaagaaactctatatgatgcaggtgcaaatcatttttccccctcttttaaattcagactcattaaaatatgtattttgcgaggggattaaattcaaacatctgggaaaggcagggggggggggggtggaatatccacaactcctgaactacttttttcacttggtttcagactttgattgtcccgtttcttagaggcagcgggtgagaggctgcttgcccggtgggatgacagaaaagggcaagaagagagttagaaaatgacttccaagggccccagacttcaacagcagccgtaattgtgggaaagtaacccgaagatgccaaacaacaggaaattaccagaagaatctgtcagcacaatcagctgctattttcattgttctttggcaaatttatacacagtcgggaacacctgggctggcctgaagcccaggtttgactaattgccaggggagaggagtcgtcatttgtcttcgaagggatttcctccgttcgctcctcaaaacatgtggtttcacttttcccctctctccgcaggaaatggcaggacagtgagacgcaaaataaatgagttcacttccaagaggttgcctcctaagaggccactccaaaaataactgtcttgtgagaaggttgttaataaccaagattctatagactgtcctcagaaaacaacatttcaaaggcacaatgatttccacccccagcccctttccttccaaacgcagcatacattaaaaataaaagtcatgggagacgagaaaagtaatcaagttttctggactgagtgaatgtcactcctctcgctcctctgcaagacccctctccttggagggtaacctcacccaaagcgcttccttgacaagtgaaaggtggaattggagtagtaagtgatgtcagtctcccttgctcttccttgctgcccatcacccccttccctctgacacgcagcatctcagccttccaggggggaccaaggggcgatgcctaagacatggactgagccccgttcacctcggctgccctgcgcctggcatgggattggtgctagtcagtatccatcgaatgaagaacactgggcgggttgcacgagtcacctgctttgtggcaagcttcccaggagtaggtgtagatatttttcaatttcttgaacttcaagagatcacctttttacaaaaaccacctgccagagtgacagccttctcccctaacctctttccatagttttatacacacacaacttctgctttatacctcctcgcattatttcagactctggccaagataccttacttgggtagcaaagtcatcttgatatcccttctggaggcaacagag

SEQ ID NO: 45286 - DNA, 654 bp, Bovine  19866880778413
ttgtagggagatgagtaagtcccaaaatgaaattatttccatacatctagttagttttgtattgttctagtaaaggtgtaccttgaatataacttgttagaaatttggacaaatttggacatgtcacttcccaacatcccacccgctataatctgttactatcctagcttgagacggaatttcctttgctgggcattattgcccagcctgataatcaccatgttgctgtgaaagcagttaaccatgtccacccactgagctcattcccttggccattataactagaagcaaattatgtgtccataacatttggagagctgatgcccattttttattcatcagccacccatggaacagccaccagtgtttctaaagtgatcactttctcattagcaattagcaagttgctttggcttatattcttgatgagaaatttgcttacagttctcaggaagacatgtggatctcaacatcctcattaagagatgcaacatataagatccagggaggaaaagtgaaagctcccaaagtatccaccttctccaccaatttggtagaaagaagtaaactcttgatggaaaaaggagaaaagaaagaagtcgctcagtcgtgtctgaccctttgcaaccccgtggactgtagcccaccaggctc

SEQ ID NO: 45287 - DNA, 2802 bp, Bovine  19866880800272
ccatcccttccccatttcccctcccccttggcaaccatgagtcggttctctgtgtctgtcttgacacctgttttgaattgattttactaattgaatcatatcagtaggcagccacttactcaattagaagggcagtactgatacttaggacaatgctgactctgttacaaactcaagcatgttttgtgattccagttaccacttcttgtgcctctaacacaagagagatatgatgccaaccacctgacttacattttttcatagaggaaagtgaaagtgaaagtgaagtcgctcagtcatgtccaactctttgtgaccccatggactgtagcctaccaggctcctccctccatgggattctccagacaacagtactggagtgggttgccatttccttctccaggggatcttcccgacccagggatcgaacccacgtctcctgaattccaggcagacgctttaacctcggagccaccagggaagctcatttcatagaggactactatacaaatgattccaggtccaagtgaatggtgtcctttggagtcgtgctgtgcacaatctgcttggctgtccatggaggacctgctcgaaaaatccatatgaagtatatttgcagactttttgagcaatctaagttaatctaattgatgaatgaaaaaaaaatgagatttggacaaatcaagtaacactttcaaataataaagccaacaagtagagtcagaatcctaaagtctatgcttttctcactatactatatgctatcactatttcatgaattttgtgaaattctgatggtctccagccaaaaaaaaaaaaaaaaaccaaaaaaaaacaccatgagcatacctgtagttgcacaagttgggttgtttgatattttgcgacttggataatattctcatattgcttttgacatgactgtggaatggtttgtttttgtctcagtgcattgcagcctcagaatggcttgtctgatattgatgtttggagaaattgttcatgtccaacgggagaactgccaggcctagctgtgaggccaggtcaactcctaatgtttttttcttcctcaaggtaaaaggcctggagattgctagtataaataccatttgataatgctttaagccttcactgtgtcgctcaaaattgaagccccacgttttgcgatgaaagaaggtgaaggaaatagaatatacagaggtcttgcggagccatcactttgtactttatatgctaagtaaattattgctggttgtaggtattttgtttaattaatttatttttggccacaccacatggcttgcaggatcttagttccctgatcagggatggaagctgtagttaccccctgcagtgtacctccagggaattcctctagttgtaggtattttaagagtaactttgtatagtttattataattaacgctttttctcaaagtacaatttctggtccagatgacagttcctatgataaggtgctattttatttctcttgaatgattcaagtcagcctggatgggagaaagtagcatgatatgatggggaaaaaatgtatgttgggtcatgcagccattgggttgaggtccatgcataacacaaggggatttttctggatcaaggaaatgtgggagagtgctccagcaaacttgatttaagaaggtcaagaatctatgagacttccatgcagagaggttgaccaaaacaagaatttttgagcagagaagcacattctagtaatatacaagagtgggtgcaatagtcttcaaagtatagtcatcatgaaagatataatgtttgtgaaagaagtgtgagctctctgagaaagtgtgtgccctgttgtgtcaggggttagggatgaggcagtgagaaatttttaaagatgagatcaccaacaagctatgggtttaatttatctgtagtttcagaatagtttgtcttagggaaatggaggcagacaagcatcagctgtaaaataaattgagtttagcgaagtccccaaatgtttttaaaatgtgacagccagactggaatatatttccctgggaccacactctaaaatagttatctagtctgcccattgtggataccaaatccttattgcaactgtcaggactcatcttgctctaaaatataattataacagtagtcaaggttttttttttaaattggaactttataaagatgacagaagacccatagaataagttaacagacaagtgacagactgggagaagatgttcacaatgtaaaagtgacaaggtgttaatatctagaatataaaggaacttcagaaaaatcagtaagaaaaaggtagaaactcctaggtggtttaaagaaaagaagaccaggcaatcaaagaagaacaaatatgaattggttaacacacataggaagaaaagatcgacctcatttgtcatccggtcgctgcaaactgaaataagatactatccaacatatttaagttcagcaaaaaaggactaattatagaacacagagttaatgaggatgtagggaaagaggaagcactcctagtgggagtagaaaccgatgcagccattgagaaggggctccttcaggatttactgaaatgaaatacacacacgtctgaagatccaaaaatgtcacttttgtttttgcttcagaaaaactcatgggtttatagaggacctatatgagaatatctgtggaagtagggtaatctgattgtctatcactagtggggtggataagtgaaaagaggaaatgccttctgaggagtattgtgcaatattcagaagaagtgaaataatgatatgtatggca

SEQ ID NO: 45288 - DNA, 923 bp, Bovine  19866880848878
aaaaagcatatcaaaaaggaagatttaacaggaattgaagaaaaaaggtcttgactataagtcaatcatatctaggtaccacccctggtggtccagtggttaagaatccatcttccaatgcaggggacataggttcaatcctgggctggggaactaagatcccacatgccacgaggcaacgaagcctgagcactgcagctagagagaagttcaagtttaagacccatcacagccaaaaataaataaataaaaaatttaagaagtcaattgtatctaacattacttctgggaatgttgcctcaagaattcattagagagatgtatataaatatttatgcaggaggatattgtcaccattatttataatagtgaactatcaaaaaccacaaagttgtgagaatgaacactaggttaacatgcataattgcttaccagtgcatcaaacacgaggaagtcatatgtttcatcacctgacatttccatcatgatgttaaaaagtgcatctagtgtatcttgcaaaaactgaagacaagaaacagagaggttatctggtgagtgcagaaatatgaggagaattagatttcaaaagaagaggtttaaaaatagcattttcctaaaaactggcacacttgcttcccaatgcagactaagggttatgtttacacccactgggttcatttaagatgctgaactaaggatgcagtggctgtagtcttacctgtgaataaataaacataccttcacaatctctcctccatccacctccattaacttcttcaagttgtgtttaatattctgagggcttgagcgccaatttaacaagcctaacaggtcaactgggaagaacaaccacaaaccataagcgttagacacagatgtgcagagcaacccacacacacagctctgcagaggagatcattgct

SEQ ID NO: 45289 - DNA, 1037 bp, Bovine  19866880890821
taataatggacatgaagacatctagcatagtgtcgggcacctgacaaatgcaaaaaaaaaaaaaaaaaaatactgattgaatttaaatgtcaattctaagattactcacataagccctcctaggaaggataactcagtttcctcatccgaaataatcagaagagccagactagctcagagtgtgtagtgcagactatcctagagggacgtgaaagcctcattgtagagttgcaatattaagttgttcttattaaaataagctcaccaggctgcatggggacagaattaaatccaatccacctacagcagggcaggaagcaatcagtctgctcctgagcaaggaacaataaataattcaacaagatggaggcattgggagtcttctgatttttcttctggctggtgataagtcctgctcctagttccaaatcataaatggaatataattccacagactgaggaggaaataaagcatgttggaaatgcaacgacattttgacaattcttttcccaactaattccagtcctcagtgatcttttccttgacttgaatttcttcagcgttgggcttacaatccacacctcatgactgaaggaatgatccgacatcttggaatgactctctttctaccttgagatcaatttcttaacaatcataacagttaatatttattgaccacttactctgtgccaggcatcattttatcatttcattttcacacaatcctccaaatcggtgctatcattatgctcatttcaagggataagtgctgaggcccaaagaggttaagtggctggtccagtgtcacacagctagcagtggcataggaaagacttgaccgaggactgtctgactccagagcacagactctttatccttctctggtgcgtattcccagggtacaagcatctcaaagaccaaaggctcaccttccacctaatttcctaccccatacttcctacaatagcactgagaaggaaaaggtgtcaagtagggactttcatggcaggccactggttatgactttgccttccaa

SEQ ID NO: 45290 - DNA, 1875 bp, Bovine  19866880973637
tttcagtagtcatgtatggatgtgagagttggactgtgaagaaaagctgagcaccaaagaactgatgcttttgaactgtggtgttggagaagactcttgagagccctttggatggcaaggagatccaaccagtcctttctgaaggagatcagtcctgggtgttctttggaaggaatgatgctaaagctgaaactccagtactttggccacctcatgtgaagagttgactcattggaaaagactgtgatgctaggagggattgggggcaggaagagaaggggatgacagaggatgagatggctggattgcatcacagactcgatggacgtgagtttgagtgaactccgggagttggtgatggacagggaggcttggcgtgctgcgattcatggggttgcaaagagttggacttgactgagcgactgaactgaatattctattgtacagccactttgtcacaaaagtcaatgttcttcaacatataaatttgagctcaattttactaccccccttttttttcaacccttttaccctttgatatacccatttcttagtcttcagctatttctttgacaaattcttctaataaatatgtaatcttatttttagaataagattacagtatataaaaatattaacattaccctttctcatttaatcctctatattcttcccacttgaggaaataaaatgttagcaaagctatgagaattgtccatggtcacacatcaaaacaggacatgagttgaggtgttctccatccaaagtatattatctttcactggtccatgttgctacatctaagacacagactggatttgggttcatttttactcatatatttaattaaggataatttaattccttgttttatttcatttatttaacattttcccatgagtttgaatttgtgatccattatgatcaattctttttctttggcatcctgagcaatggcagacttggcagaataaaggaagtaattgctataaaataatgaatgataagccttttttccacatgtaggttgtgcttgtctgtgctgtgcttgagttatggatatggttaagcggcaactggcacaacttcaacagccataatatctcttcagtcacagctgtctgaaaattacttagagtttcaaatgcatgatgtagcaagataagactgtaaggaagagcgatcagtcacacgaatgaatgctactgacgaaatgcaagcaagagaaatctccttgtgctaccaaagcttcaagaagagttgagtttactgtaaaggcaagaaagaaagataaagaagatgacttaaagctgatcatgtgttcggaacaaattgtatgtttctctttttttgatgtacaccatttttaaaaaaattatttatttttaatcagaggataattgctttacaatattgtactggtttctgccatacatcaacatgaagtcagtcataggtacacatatgtcccctccctcttgaacttccctcccatctctcacctccatcccacccctttaggttgtcacagagcactgggtgtgagctccctgcgtcatgtagctattcccactggctatcaaatttacatatggtaatatgtatgtttcaatgctactctctcaattcatcccaccctctccttcccccactgtgtccacaagtctgttctctatgtctgcatctccattgctaccctacaaaagggtcatcattaccatctttctatattccatatatatgcattaatatatgatatttgtttttctatgacttctgtataataggctctcggttcatccaccctcactagacctgacttacatgtgttccttttgatgtggaccattcttgctactgctgctactgctaagt

SEQ ID NO: 45291 - DNA, 1001 bp, Bovine  19866880994981
aaaaaaattatacagacgcagcaatttaattagtttaagaatttttcactctaataaactacatccttaggttaggagttctaaaacaacagaaatatatttggttattcatttttagaatatgtgtttcctcacatctatttctcactcagggtaacaatagatggcaatagttgtcaatagatggcaaactaaatatgccaaaaataacgtttcctaattgcttccacttcagaagacaattacaaggtggtttaaaaagaaaagtaactctaaaactgacccccaatcatcactaccttggtatctagattttaactattttcccttgttacccgaattaaaatttagtttcaatcagcaaaactaagtcaacaaaatgacatatggaggtatgaaaaaatgattggctggaaagcccattattttatatgaaatcatattcatttacatgactttggtctctctcttcgcagtttttggaaatgtaatgggataaacctatacagagagtggaacataattatcttcaaaccctttttctttgtgccttaatttagagcattgggatcatagagcagacaaaagtgagacttatcagatgagaattcattctacacaattcacaaaatacagctgcgagacaatgctctcaagtctgaactgccgtcagtgtcagtcggaagttgaggtgggcagtccccagcagggtctgttttatatcagagaaagataatgaaagggccagagtccaaggactcagctctgagcgccaccactcccgagccccaccagagccccctccccgcttggtacacagggccgagtaccttgtcctttgtgattcacttctttggttgctatcactttattcaagactgacgtgagtggttcattctccccgatcacgtgggatgttatcaggggcgacatgattagctgcctctgtcggatatatgtttccatggcaattctgggaaaatgagaaataactggtaaga

SEQ ID NO: 45292 - DNA, 906 bp, Bovine  19866881077916
atgtaaagtgttattcacatatagaatctgatggtgatgattatgatgatgatggctttgggattcaggatcccattagaatacaaagaatacagtattcagacctgacgaggccagattacaggtcaccatttctgactatcacatcaccgcctccaacttcatgatgacacttctctcaataaataaggagacagaaaggcagacagaaagaaagagaaagagggaaattaatactcagacccaattagatatcctgatctattattattactctattattaattgttaatattatgttatcattcttgatctaaatcctttcttaaagaggaaaatgaaagtcaatgtttagccagaacccagatctcatgacagaactacattctttcctctaaaatagtaagttacatattgagatacatttattttataaagtgggatatgaaattccataaacagaaatatcccctctatatttaaattacagaggaaaaactagaagaaaatacttcaagtactatttctctgaattttaaatttctacaagtataagttaattttaaccaaaaaagtgagttaaagtattttaaaatattatgagactcttgacaatctaagtgaaaagagatgcctgtgacaagaagtccatttcctgaggataatgaaagaatactgcttttttagaatcgctaagatcatggagaaagaatccagtcctggaacaataagacttgttaggtgaggctgctttttgaatttatgtcctgggcttaggtcttctcagaaatttgttccaaagataatagatcattgatctacttcagttttgtaaggttcattttaattaagagtttctaataaaagaattatgcctcttgttaagacaagcctggtaagctaggg

SEQ ID NO: 45293 - DNA, 1255 bp, Bovine  19866881101001
aaaggaaggggactagagagatttgagagacccatcagaccaggaagcaattacttctttaaggaaggaatggagaaatggaaggaagacatagcagaagcaccttagacttcaattcagtttaaagaaattttgacaagttcattggccagtgtccatcatcacaagtcctcgttttctccaagaaatggacataggggttattggccatctaaggaagcagccctaggaaacgtcagtggatttgagcacacagccacgggagcctttgaccaatgacactctgtagtgagaaatcagcaaaaaacatactctcatgaccacccaaaggctttgcaaggtctgctcacatcatcactcttgacccctctgcctgcttccccttacgtcttgtgttccagccacactggtcttgccagtccttggtgacactgagcgtgttcctactgtagaacctctgtgcatgttactgtggctgaacgttctcctgggtttcgatgtggtttgcctcctcacttccttcacgtttttacccaaataccgttttcccaattaagcctgctctggccacactatctaaaattttaatactccttcactgactctcatacacatactttctatctctcttatctgctatttttttcttaccatttgtcagtttaagacataatatactcatttatttatattattagtttcctatctctcttattagagtgcaaatttcacatcaacgggaggtctgacttgattggttattgttgtttattcagcaagtagaatagtacagagaatatattaagcattcaataaatatctactgaataaaacattgaacacacagaagaaaaaaagattgaaaatactaatacttctattgctgatgtgcagatgagtcactacaagaaatccagagggacatcttcttggcaacattttgttcacagttagtccaaattcccatgcgtacctggaaggaagagacttcatgaaaaatctataattcaaacttttctcaagttcagaaagatttttcatgacaaaaaccaaaagcttttaaagatgaaactacgacaaaagggtcatcatcaaagggcacccaaaccaacatgaagtgactccttttgattaagaatgggataatttgtgcatctaaaaatttactgaaagcaattgatttaaacacattgaatttttttaaaactcatagttcttaatgatataaagaaagaaaaggaaaattaaaacaaca

SEQ ID NO: 45294 - DNA, 1349 bp, Bovine  19866881168552
tatgctttaaatactaagctaagtattcatgtttgtgacaatgagaggagcaggaaccatcaaaacagtgacagttgaacttgcaggaactgtgaggcaaatttcttctgtgtctgggacctcgcaaaaatttcttttccaaaaaatccaattttgttacttttattaaagggaaaaaaagctgcagtttggagtggaaagagtagtattgagagaagttcttgtctatgagaccttgatgttgtcatccacagccatctccaggattggcttgggactggctgtcgattaatcctgttctctgttcccacctaacctgttgattgatcttgtttgtacttttgagttctctgaggcagggtcgcttacgtcctgattccctaacttactggatcatgatgagaaagtaagatccagtaagttaaggaatgataaaggagcttgcacctcagtgtatatgaatgcccttcattctttcattttcttgccgtgagaaataccagctaacctaagcagcatgcccagtgacctcatgaatttccaatagggtgcaaactccttatctccttgtggatcggtgtagaccttgcacaagagttatcatccctagggcaccctcttgagaagcattttgacttaactccccaaataaactgtgagctctttcagatatgacggttgctgtgagcacgtagtaagtgttcagtaggaacgtggtggcgagggaggggctgcacttagcctggggaggacggtgacttccttgagacttgagtccccaattgcccttcactgttcatatttaatgcttctccctgcgtgtcctgacctgcagaacaagatcttcatctaccgggggaaggagtacgagaggcgagaagacttcagcctgcggctgctgacccagtttcccaacgcggagaagatgagcagcaccacccccccaggagatgatatcaagtcttcccccaagcagtgtatccttgtctcgcactacagcttaagggctctttttttttttaacgtttattatttactaatttatttggctctgtcaggtcttggttgcagtacatgggatctttagctggtggcatgcaaactctttgtagcacgtgggatctagttccccgagcaggtatcaaacccagtccccctgcattgggagtatggagtcttagccactgaaccaccagggaagtcctggcccggggctctggaacctgctacagccccagcccagccacagaagggggggggttcagtcctgtgcctgcatgcaaggtaggtcctgtcctcagactcatttaaccatcctgactcagtgtcccgtctgcataaaagcttcg

SEQ ID NO: 45295 - DNA, 1419 bp, Bovine  19866881176273
gtataagtataactaaatcactctgctgtacacctgaaactaaccacaatattgtaaatcaactatactccagcgtaaaaaaaaaatctaaaaaagaataaagattatctcaggtcccagaaactgtctgtttctgatgctcagaccttctgcgtttgtctggcagtggagttccttccattcaagccccaggtgccctgctcatctgtcatctccttgagacccgagatccagcacggggcctgtgctggcccatgaagggcactggcagtttcttctacacaattaaatggctcccaaggctgaaagaaagcagtacacactattcttttgtgactccaagatcacaagcccttggggagatatgtcctctgcctgaatgtgactgggtttttccaagttctcagtgagatatatgtcatccctgatttacctgttcccatgatcaatcttggctgtgaccttcttcttgagctctgccagttcatctttcgggagggtgccagacaggatctgggaccgccactctatcaggctgtatgtcatctgctgcagctggcggaagagcgtgaccttgttgttctaaggtgggaaaatgaggcagaggaaaggaccaaaaaataaatggtgtgatgggagatgagaacatcttttgccttgatcctttataaagtgttatttaaccaattattctgccatataatgaactgtgcactttgaggggacctcttttggctcagtggtaaacaaatcacctgccaatgcaggagatgtgggttcgatccctgggtcaggaagatcccttggagaagggaatggcgaccataatccagtattcttgcctacaaaatttcatggacagaggagcctggtgggctacagtccatgaagtcacaaagaattaggcatgactgagcaactgaacatgcatacacagagcaagctgtgcacttggaggcgacctctttacatcactagggatggctttgccctgacccattcccactttctcctctgctgcaacttcagaaacagataaccacttgtaggatggacaggatggagggttggtcctaactcataagtgtaccaatcatccaagtgccttaaacttctgcccatgttcctcctgtggttgaaaccagccacttgggacttccctggtggtgttaagaatctgcctttcaatgcagaggacatggatttgatccctggttggggaactaagatcccacacactgagagaggggcaactaagcccaggtactgcagcaaagatccagcacagcccaaaatagaaagaacaataaaaacagccagcgatttccaccgtcctccagacacactagatcactttgtaagtctcttcccatcttggctcctacccacattcccagccacaccatacactgatcacta

SEQ ID NO: 45296 - DNA, 1960 bp, Bovine  19866881212895
attttcagtggtttaaatagtttggcaatggcttacttaaataaagcttttatctatgagaatttctcagaattttaatgtgctaaagtatattgtgagtttttatattccaaaaaaatataaacaaacactcttgtctaaacttattttactacagaaccattttgtgcgggggagtacttcaagagatcaaaccatcatagattatggtttgagaaatattatcttaatgacactattatgaaagcctgtaaaactgagctatacagatgttcataacaacactgcatataagagcaaaggtagttaacatttcataaatgtttgagtaggttctctataaataaagaattctagatctatttaattaaatactgtagtaataaaatatggtttagaagagtaattaatgtataaagtgtttgtaatattttataaagtaaaaaatcagattgtaaagcattaactatactatcaggatactttgaggtagatgcatgcatagaaatatggaaggagaattgtcaaaatgttaataggtgtaattgctattttgtgattatttgtgactctgactttctttttctcatttgttcttcttataatatacacaaatcacctctactgtaagaaaaatgtttttatgttattgcaaaagatttgtcttttatagctctgtaaattaatgtcaaatgtgcctcttgcacccctccatttcttttttttttttttttggtgtttttagtctctattaaattctttctcactgatatttttttttacttgtgtcttcatttaatagtgtgtacagctgtcctcatactttcaaggtgacatttcatacatgaatatttttacttgcactttatctttggtgcaggaaataatacccttttaaagcatctgttgcattttaaaatgtgtattcagatcatatcttctgctttaattattaacctcgtaactgaggttgcatgaaatttgaacactccctagttctgaggacattatgacatatgtagagcaggctgacaagggctttgactcaggaaaaatgcatattttgtggtaattctttttgctttccaactctattcataaaactgtggatgctctttaaaggaaccactatgcaattgggcaactgggcaactctttgaaggcatcaccaatctccttgttttctttttgaactaggctcacacatgtaaaaggcttcctcactggctcaccgataaagaatttacctgcaatgcaggagacacggattcgatccatgggctgggaagattccctagaggaggaaatggtaacccactctagtattcttgtctggaaaatcccatgaacagaggagcatggcaggctacagcccataggtttgcaaagagttggacacaactgagtactcactcacgcacacgtttaaaaactccttttcactgtttttgcacttctgatgtcagcttttctggcctcattctcattccagttccttatacagtccccatgtccttatcagtagcaactcatgttttgaagtttccttaccacacttctctctcccacgtataattctgtcttttctttcattatcatgaagcatttccctcagttctttgaccgttgggaaccaacctcataaacttctctgttctagtgttaactctcaaggaaaccacaggacaactctacgtttagtgtcagggacatgtctcaggccccagagaatcttctttctctgtaggcatcccagttcgggctgctgctttctctttttagtgatcaaccgtttactgcagcctgggtttcttcactcctcaggactcagattcgggagatggggaggactttccagatttatttaattattgtaatataattgctttacaatgttgtgttggtttctggtgaacaactacatgaatcagctctaagtgtatatgtatatattaatata

SEQ ID NO: 45297 - DNA, 1460 bp, Bovine  19866881285723
acgttccttgctgtgcttgttgacttaattcagaaatcttaaagagggcaccaatagcagacactagatgtagactatagacttccaaattttttcaagtcaaaattttaacaattacagtgcatttccgccccttaattggtaattctgaggatatgattaggtcatgaccattcataaaatctctcccctcgaaaattttactgataataaacttgaataaatgagaatccctggggttccttttctttggtaaatagcaatatactttgccccgtaagtgaactgtataatgctgggaatggctttcttggaggcagtctgaaatcgtgtttacctttatggtaaacaggtaactggaacactaatatataatagtaaaagcatatgggtagaatgtgaatcccactcatctgtcactgtcaccacatttaaaaagtatagcctaactatcatgagcagaagttgaagcccaagcaaatgatgtaatcagaaggaataaaattttctcaatgtgtaatttttaagggagttaagaatattgaagcttatttgccattgcaaacatgttgcctgcaatcctgagctcatgattgagtgtgtagttagcttaattctgttgcctcaagtagccttcaataccacctatttcaaactttttaagaactacagatatagataatgaaattgtgatcagtcactaaaggggggattctatacttgtgtgttacattgccataggtctgcatgtctttattgggaactatttggatttcagtgatagctccaactggttggacactgcatcatatacacacccccgcccgtccatcccgttcactgtaaaggtatgaaagctcttgcacttgcacttgatgtggaatgtcaatgaagttgctgattatcctgtgttgtgcttctgttcttagataattgttttgtcagctaagtttgttcaatatttgttgtttagagacctcttaaaggtcatgaatttaatctggaagcaaagtggtctccatttaaagtttacagatcccatcacaccacatattttgagttaaatatatctcaccaaagcaaataggtaaaatattgctttatctgccctgatgctatggatttgaaccacaaggattctccatacattggcttctgtaaagactaggagttgcctcagaaatcaagcttttcacatttatgttccttatacatgggatgctgcacatggtcaatttcagacagaagcaaattatatgtgaaaaagtaaccttagccaaatggaagtggttggttggagaatttcttgaagtaagaacactgtaccatactctatcctgtgtgccataataaaatactgaaaaatctaaaccgaatggatttggagtctttttaaaaaaaatattcctcaaatgtgataccttggccaatctccctctcccttctactcctctcaaact

SEQ ID NO: 45298 - DNA, 1362 bp, Bovine  19866881592237
cctgaagaatcccagggacgagggagcctggtgggctgccgtctatggggtcgcacagagtcggacacaactgaagcgacttagcagcagcagcagcagtagctgcccaaatgggccaacaccaagtaccagctcaggatgaagtaacccaaagaaggctccactcagaaagggttctggggcttccctggtggctcagtggtagagaatctatcacctaacaacgcagaaaacacggggttgatccctgatccaggaggtcccacatgatgcgaagcaattaagcccgagcaccacaactactgagtctgtgctctagagcccgggaactgcaaccactgaagctcaaataccctagaaagccagtgcttcacaccaagagaagccaccacagtgggaagcctgagcaccacaatgagagtagcccctgcttgccacaacttaaaaaaacctcgagcagcaacgaagatccagcatagccaaaaacataaaataaaaaattttaaaaagaaaaaggtcctcaccctgatcctaaaagatcctacattttcctatatgccaagaacatacgttttcaagatggcattttagaagcacgcttgaatatatctcaaaaggaaaaagaagagaaggcagtctcttttaaataaagatgaaacctgaggtaggggaggtataaattgagagactgggactgcaatatacacaccagcatatataaaacagataactaataaggacatactatatagcacagggaactctactcaatattctgtaatgacctgtatgggaaaggaatctagaaaagaacggatacataatattaacaatgggtaactgattcactttgctgtacagcagaaactaacacaacgttggaaatcaactatatgccaataaaaacattaaaagatgaaacctgaaatgagacttttcaccaactctactttttaattagtttttcttataaacaccctcctactgccaaacatctatggaaaaacacatctcgggaacacgtgtccccaggagtagtagctgaccaggtggccttaaggtgaaggtcaaacagatgtgggaaatgaccggcacactcatcaaaacaccacggggcttattttgcgttcaaggctggaggcaaaatgtttgcacgcaatccttgtcgtaaaatccaagctgttgggcacactgccatttcacgtttgaggaaaggtgattgttttcctaactagaacctggtagggctatggattctgaatgccaatggaagttcccatttactgtgacaaacagggtaaccgaaagtaaacgaaacttacaaatacatcgaatgccttatttcagcttatacccagtcaa

SEQ ID NO: 45299 - DNA, 711 bp, Bovine  19866882213810
atcctaggatagaaagggggtattaggtaaaaattaagaaaacatgaataaaatacaatatatgcagattactttaggaatagaataagtggtatttgatttagtctggtgagttggggcggaaagatttctttgacaaaccagtatataaactaaagcctgaaagatgactaaaaaccacaagagtgggatgatccacatgctaccagaaaaaaaggcatattctattgaagaaaagtaaaccagcccaatatcatatgaccatcatcccactgcttctccagggcagcctcttaagaggctgtgattaatcccagtttatggacgaggaaatgaagactatgttcccagtgccacacaaatgaggaaatagcagtcatgttcccagtggcacacagctgattggtggttaaaacagaattgggatcccatcagactctaaaacctaaatcctttcctcttgtgctcctttccacttgcctataaaagtaggctgtggtcaggcaatttctcactttgggaaacgagaatgcatggagttaacatgcagatcagcaggaattctgggaacggctggccagagcaccgtgaattctaagttgctctcacgagaagccttctcgtacttgccaggaaccagagccctctgaatccagaggtcacattccaacctatgaacccgaggggaattatgtatcatgaaaatatggc

SEQ ID NO: 45300 - DNA, 3564 bp, Bovine  19866880420802
cacttagtcttagggtaatctgtcatgcagcaatagatgatacataggtctactctccctaccagactgagtacctggccttcaaattacatgttactttttctgtccccagcaagatgtacaaagtctgagacacagggtaggcatccaagatgcaggacagaactgaatattaatcacagtttccttatatcctgctaatacctcttacaaatgctatataaattcaatttacaacaaataagatatttaacaaagtataattattagtttataatatctcaaaagtctaaaagcatttctatcaatgtttactaaacagacttcttaaaagacgcttgctccttggaagaaaagttatgaccaacctagacagcatattaaaaagcagagacattactatgccaataaaggcccatctagtcaaggctatggtttttccagtagtcaagtatcgatgtgagagttggactacaaagaaagcagagcactgaagaattgatgcttttgaactgtggtgttgaaaaagactcttgagagtcccttggacagtaaggagatccaacttgtccatcctaaaggaaatcagtcctaaatattcattgcaaggactgatgctgaagctgaaactccaatactttggccacctgatgcaaagaactgactcatttgaaaagacgctgatactggaaaagtttgaaggtggaagaagaaggggacaatagaggatgagatagttgcatggcatcaccgactcaatggacatgagtttgagtaaactctgagagttggtgatggacagggaggcctggtgtgctgcagtccatggggtcacataaagtcggacacgactgagcaactaaactgaactgaactgaaatacatgtgtttggaggatgacaagacagcacatcagttttgtctgctctaagatgcagttgtaggatttctttccctctaaggcggggccgcaatgttatcacttcctaaaaggagccccatccagatggagtcaggatgtatttcactgggtgctcatgttcaccgtctatttattcgctacctagtcaccactttttaaggcctgtcctatggcaggcctcatacatggagatggtagttttggtcactaacaagcttacctgtgaatatgatgtgcatttcagctcctttcattcaaagcacacacagctcctggaacttttcttgtaaataaattgccagactgatgaggtataggaaagagctggtcttttcttggaaggtttcgatggcctgtctctaggcttctgggatttggattttttagcagaagagtagagctcactggagagactgagcatgtgctggagacagttatgtctgcagacaattttgtcatcactgctggagggaggatgggccaatagcatctaataggcagaagccaggcgtgctacctattgtcttatagtgcgcagggcagacactcaaggaagatggtccagctcagggaattccctgatggttcagtggttaggacactgcattttcattgtgggggcccaggttcaatccctgatcagggaactaaaatcccacaagccacacagtgcagcaaaaataaatacataaatttgattaaataaatttttgaatttttttaattgaaaaaaagattgtccagctcaaaatgtcagtaattttgaggcagagacctctgatgtagaggattagcactgagtcatgcattccacatagctacagtctgccgagggtgacatttcatgcaacaaggactccctgagcagcatccaccttcttatagtctcaccctgcagggaatggggagagacaggttatttagggaccatgcgtttagccctcaaagtctgtgggagacgagagtaaatggcactgggattcctcctcctttaatgctcctcttaactcagcatttccctggtgctcacatcagttgatgatgtaagcaaggagactttgaaaggagaagacacgctggaaagctgacaggtgtgtgcagagtgaaggactcttctgttcacttcaccttgaaaagggcctgggtagagggcaggaccatagctttcctgtgtctggatcatagcctttgtctgagatcagctttctgaatcatttaccctccatgccagcaacttggagtttatcttagccaaagcttgggttgtgagctgatggaaccaatagagcatgcttttgtggaggggagggcagaaagaagagattaggagagagataaactcaacacaaatatgtggatttagggaagcaaagtcaatagacctgctccccctggtgggatagatgctgtgatcatgcgtagatacagtctccaccaactcgtgacaagagctttcactcactgggttctatgatgacatgaatttataccaccaacctgaagcactaattttaaatgagctggcagtgaggagtgttttggagagcatgagaagagaataggaaaacactacagtttctaggtaaatgctgaacagtgcttgatccggtcgccatgcctagtcctgctacggtaatgtcaactagtcagcacttccagcgtaaacgggcctagcgtttgctttttggggcagactgcaaattccttgagaaccttcagtctgcctctttctcctcttgcttgtacttctccttagtcctgtgtgcacctgacgttttgatccattcatttggaggcaataaatggaagcctttcacagatatccttacggagccttttggctcctgggagttgatttttgcccctttagaggcctctccaaaccgtcggcggtgtgcatagactctcttttttgcttttgaaacagtggtggtttttatccacaagattgctctcccagttggggcagtctgccccgcagcaaacagatgttcacatccacatctcccctctagatgaataaaatcctcccagaggctacagctggctggaaaaagttcttttgtgcttctgtgaagcgtaactgagccctaagccatcacctttgatgtatattttgtgattggggaagaaaaataaataaataaaagcatttttatttgccatactctttcttgcagataagaattttttgttgactgaagcctgtatccaatgagagctttgcccttacctaataagcaaagggttaaattgagtcgtgtctctttctttatgtggttcttcagttctctatgctttttgggcataatactttctcagcaaaatgggtctggtaactgtcttccttcctaatccccatcttgttggtttgctgagagagttttcattcaagcataaaatactttgttcagagtcacccttcaaaaggtggaagtttaagtctatgggcatgctaaaaacgaaatgagtatacttatcttttggaggacattagttttgcctcagtacctcggatccccatctttcataagatataagatcaatgtactttaaggtagcaacatttgtcataattgcctgatgtattagcatcctttagtaccaaatattaactttgactgtgagatcactaaaccata

SEQ ID NO: 45301 - DNA, 1802 bp, Bovine  19866880449389
ccacaggaaatccggagcagaaagcgcccacttacctgtttctaatcactgagaagaggcatgggctgaatcactacagggctcatgtctctcctgtgcccagaggtcctgctgctcacctctctcataaaatatgactttgtatttcctgcaagtttgccccttgaatcctccaaggccatggggtgttttatccagacacacactccctgccccctgcaggggatcaatgagccctcactcttaccaggagtaaggagtagatggctgtcagtggatgagaggatggacttgcttagtttcacatggcttcctcccagaagggagaagctcaggctagtgaacaaatctttgcttaaaatcctacaaggcatttgaaataattcattgtttactacatttctaagtgctcttttccttatcaagcctaatatacttgggaaaatgtctgggtacgagtcaaacattctttacatcttactaacattgtaactgatggtaggtcatttttgccttgtttgccaaaatagcaatttctaaattaaggaaatttttgaagttggcttatggcattgttgtatttcattttcgattgtaaactccgtggcagggacactatgtcaataattatgtttttacatagcaaccagtgcagtatactcttggtgcttaataaatgttcataattgttaagaataactgttgtcttttgcttaacttgaacggctttgagacatggaaccatgaggatataggactaatgcttaagaaagccattttggaaacaaccgaagtgtccactaatggaagaatgaatgagaaaatgtggtctgtgtaacaatggaatattattcagccacagataagtcatcttgctatttgcaacagcatggataggacactgctaaaaagtcagagaaagacaaatattgtatgatctcacttacacgtggaataatttaaaaaaccaatacagagaacagattggtggctgtcagcggcaggggacagggggtgggggggtgagggtgggcaaaatgggtagagagggtcaagagtcacaaacttccagttataaaataaataattcatagagacgtcatgtacagcatggtgactatagttattaatatgtattacatatttgaaaattgctaagagaatagatcttaaaagttctgataacaagaaaaaattttgtaactgcatgatgaccaatgttaactagacattgtgatcattttgcaatgtgtacaaatgtggaatcattatgttgtacacctgagactaacaaactacatgtcagttatgcctcaacttaaaagtgtcacatttctttttttaaaaaaaagccactttaaactattacgtttgtagttttttctgtaacaaagtttaagtagtgctgtatctaaatccatgttaaaaaaaaaaatcgaacagcctctgtgttcacagggtatcttccttgaggtgacaccatgttacttaatcctgacacctgctgagggctgtgatgtcaaggccttttgaggttccatggcaatttaatggagaaggggtagtgctgaagatgcacaaaaaaggctcctgacataagccttccacttactgaaaagatgaactcaaagtgggtcatgtatctaaatataaagtgtgagacaaaagaaaacctttgtgacctggggtcatgagttcttctgccacagcaaaagcatgattcagaaaacaaaagaactgacaagttgcaatttatcaaaatcaaaaactgtctccttagcggaagatgctggtgagttata

SEQ ID NO: 45302 - DNA, 814 bp, Bovine  19866880484787
ctcgtttatgagcgagtttaattattatttaattatttacaagttttctcataatccaataacttatttgtgggcacttctgtgtgtatatgtaaaatgtcctgttttaaacacataccactaatcaagctaagcccatcatttttgtcttgttttcattttcttctaaaattttaatgtaccagcgcattttttttaattcctgggctgtttacggctgagagtcacatttgcttaccttcagctgctcaggaaagacagcagatactgcaaatatctcaagtgatattattgtgctcagtttattaaatcttcttgtgctactctttagggaattctagcggcaatggctttggactttttatcaacattcgaaggtttagctgctaccctctgatactcacttactgaagattttattgctattaagtgacattaaatcatgcctttttataagtgcccacttcactgcatgcatatgaatttcttttctcaaaatctatttgtcacaagcatttttgtcagatattacacgctgtgcagttctgctaatgtctttgttgtgatgccagatatttttttttaattttatttttaaactttacaatattgtattaattttgccaaatatcgaaatgaatctgccacaggtatacatgtgttccccatcctgaaccctcttccctcctccctccccataccatccctctgggtcgtcccagtgcaccagccccaagcatccagtatcgtgcatcgaacctggactggcgactcgtttcatacatgatattatacatggtttcaatgccattct

SEQ ID NO: 45303 - DNA, 1426 bp, Bovine  19866880486560
cacaggctgaaaactaggaggtaggctttaatggggaactggacagaataatgtattttgtgagaacgaatatattccatatttacaagctgatgggattacatagtttaaagtgatcaattgccactcagaacaaggacatgggaatctttaatgactgttttttgaagacagtagttcaatgccccactgacagcagagagacaatggatgtattgaataatggttaactcaggagaagactcagggctttggagtatggcagaagctcagccagcatgctcccaggcatgacggtgtggtgcatgacataacatataatatttggaggctaagaagaactttgcttaaagtatataaaagcatgaatatacttttactaaatgttcaatgaagagaccttgaaatttgtgaatgaataaaaataagcatattaagcaatgaacatggaattcaatgtactctctgcatatgaacaaaactgcctaagaaaatgttaatcactaaagaaccatggataccatatccattcatattttaatgaagcaaatagttccaaagtacttgccttccaagttcattctctgacattttctaggtttgtattgaaaaacatattttaccttttcagtgaagctcacagatcaagtgaaaacaggtgtgaacctgtttcagttgacaagtaaatatttttcttagacttctgtgacatctcacctctcatgcttcctcataatatactaaacccgatgaaaccactgctagtgctgaaaatcttagaaaaatggtaaaatgctgtttaacaatcttctctaacaaattatgccctgttttcctttcctcgttttttttttttcttttaatcagctaactataatctgatagcaatcagtaaaaggtgttagtctctaaagcccatggcttagctctgcagaccaaaaatgaaagggtgatagataggaatgacctaaaatcttggttttcttaacaagatctcatcagagaaataaaaattaaatacttgaaaaaattagtttcccagactatctaactagttgtgttttatgccttcctataagtcattgcattattttattcctgaaaacaaatctgtatatgtcatgtgacttgtatcacctatttattaagcaatgtctgatatattttgagatctgaacaataaatgcagagaatgctactgatattgcctaagtggaaggcaggctctgagttctcctgttggtcatccccagttaaccaggaaccacttacatgtgacttagagctaccctggtgccatgaaaggaacaaagttggactgcaagacaacagcccaataactacagcttctgactctgagcacatattcttatataaagttttcatgcaagactcatgaaaattcacattcattagataaacagca

SEQ ID NO: 45304 - DNA, 1377 bp, Bovine  19866880617041
tgcccccttctccttctgccttcaatctttcccagcatcagggtctttccaatgagtcagcttttcgcatcagtactggagcttcagcatcagttcttccaatgaatagtcagggttgactagtatgaactccatgcagtctaagggactctcaagagtcttctccagcaccacaatttaaatttagtgattaaacaaccacaaaaagctgtttgtatgctcctttgtctttttttttttttaagtctactctttatgtttactgtaattacaaacagctagaaaaggtcttggctatgccgtagggagggataatttgttcccaatggtataacacttgcaaagacccagtgggagacaaccaacaacagccatagtagctcttctattgaatcctgaaaagcaaacactacaaaagtcttttgagcaaaacgtttttcttccaaatacaactcaatgcttttcactagaacttttcagaattttgggtagagtctcttttgatctgtcagccattttaaagataatttttccattcctgagtttctatgcaatgacttgagtaaaatgtaatacccttgcatataatccacacaactgaaccatccagcctatgcttatcataccttgtctgccaaatgacttgaaaagttttaaaataatacacacttgcagcttgggtagacggattcatgaatttgagaaacattttgagatattggggaaagtttaaatatgaaatatgggaggtgactgcatccagtttctaggctggtgttcatgctgataggatagtttttagggagcattttgaattcaatttcctttattttaacaaaacctatttcatgcacattgcttacagatggaataacttgcaaaaacacaatcagttttatagaccacattctcagagatttgcacaattcctgctccccataaatgctttcctggaaagcataacatcacacgttgctttctttatgtttgctctaggtcactcacttcagacaacacacagttttgtcatgacactaatctctcctctaaaggaactttcactttctttttgggatgctgtttgcgatgccctagggaccccagtgaagtctgagtaattcctctatcccagtgatgctgttttctcaaatatgttcaattcggtccttgagaggagcctccgttagtgctcttgacattttaatatgagctgacagaacatgctccctctgtattcggttttgcccattaaggacaaccctcaagtctttctgggttaattccacaataaatttatcaaacagccgcaatgctacaaattctgaaaggcaatttttttaaagaaagtaatatgcaactatcataaatatatattca

SEQ ID NO: 45305 - DNA, 2118 bp, Bovine  19866880619733
ttatcaatttcagcccccacttatcattctgatcagcttatgaattcctcctgcaaagagctgccctaactctgtcctaattgcagaatgctgcttcttgaccttgacttttctcagtctttatatcttaattgccacccactgctttaagaaaacactagtgccactgaatcacactctgacatttaaaatgtttataaagtaaataatttagcttcagctacatgttttgtttaggtggttactcttttacacactctcatcaggtatcattttcctgcacaaggtttgatgaggacattttatttaaaatgcacatcaacaatgaattataagtataattaaaactagactgtagtagagtataaccatgtctcatgtctatagcactgtctagcaatttataattttaaaggttctttacaactgtttcattagttattgaacacaattattcaacgacttgggtcaattgcaatttggagacagtgaaagtcttaaagagggggcaataacataattcatttccttttctttaggtctttaattcaaattcaatgtggtctgctcttccgctccatacattgctagctcctctcccaacattccctatcccttctcttctggtggctcagaaggtaaagaattcacctgcaatgcaggaggcccaggttctatccctgggtcaggaagatatcctggagaagtgaatggatacccgcttcagtattgtctggagaattctatggacagagaagcctggggttacagtccataggatccgaaagagtacaacacgactgagcaaccaacacttttcttcattttatttctctttaagaaaggtctcatcatctaacaaactgcttacctagtggctttactctctgacttcacttcctacaccccctgcatgattgtaaatgccatgaagacaaggatttcctgagggcttcaatttcagctgtgttcttagaacccggaaaggtgcctggcacacggtagacactcaatgtgtatttgggaattaataaataaaaaggcactaactatcatcaagtttcttttgaatttaatagaggcaagaacaactctgtttctttatatttcaaatgtaattttcaagggtaccatagggaaaccacatttgttttgcttacagagggacaaaactcacacctgacaaatttacatctcagctgctgtccaagtgaaaaaaagaaccgtccgttgacttatgcacatttcaactcatgggaaaagcagggtggaccttacctttctcatacctagttatgtaaaggggtttctaactgcagtttccttctgctccacctcacctctgacctacagattgggtaaatggtcagaatgatgtcattgtattgctactgaaatacatataaaaatacatatatatgtatatgtgtaggtctatatatgtgtgtatatatatatatataacacaaagtattactggagggtttaaattctcattgggagatcttgtggaggagagacaaataaaagcagggtttaatgaactggaagattcctacaacagtgactgaaagtagagtatggggaagaagcaagaatagcccttttattaggaatatcagagtccctagactctacaggtgctttcctctctttccaactgtccagcccataacctgaaactctgacaagcctcctcctgagaagtacttgattttcccttctctctctcctacaccccttcccactccttgaccttggagaatcactttttataatgggacgtgttgatgatagaaatgcgtagtcatgagtaccatactcaggatgaaaaactgctggcaatctctctagtgctgttttaaagtcatttctaagtaaatagatgaagtggttataatggattttaattttgttgtaaaagtagcttgagaaaagctacactgttgttgttcagttgctcagtcatgtccaactctttcaactccacagactgcagcatgtcaggcttccctgtgtcctccaccatctcccggagcttgctcaaactcacgtccattgagttggtgatgccatccaaccatcttgtcctctgtcttcccctcctcctcctgcctt

SEQ ID NO: 45306 - DNA, 1658 bp, Bovine  19866880625801
ccgtgtttccctgattacagtaactgtctcaggtgctctgcagaatgaaccatcacgctggcaggtaaaagtcttgtccttttttagcgttcctgtgttggtaaatgattgttccctaaaaccctatccccaagattcagtcaaacataatccagtagataaaaggagtattttctaaataaaaacatcaacatatcagctccaatttgattccacagacaagacttttctctcatcaatgttagtctgaaagaaaagttaattccaggtccaaggacctctaagagggagaaggttaatgaggaagagtcagatcaaagcttctccggcggaagagggtcgttgtcctcatatgttaagagtgtgactcctgataaatagaaagatggagaccatcatgtggggatcatgacagggaagaaatggttttgccaacaacagaaataattctggtaggaggcaggtcatccgactagccacccttgaaaagttgggaggatggaggccactgaatgctcccaaggaactaaagcaggtgtaggggaaaaaaggaggaaagaggagatgctataaatctgcaaaaaggcaaatatgtgaccttggaagctttaaggaatcttctttgacatacccaaaggaaagaaaaataggacttcatatgaggttctctaaacctccactctataatatgtggtcaaggtcaatatgtttcaacattgtttgggtgaacttttccccatctggttcgggttacagaggttattggcccaggagttttaaacaagctggaaactctaagccaagtttatggccgagaactgaaactgacaaagagctttttaaaacagtctggtaggaataggggagaaactcttaaaggtctgacatgaatgcaaggacataaatatgtcactgtatcacacacaggaatgagagagttcaaataaagccacaagaagaaaaataaatagcctccacaaatgggcatttgtttgttagggcatttgtttgtaaagcacatgcagatagatagatggataaggtcttgattttgcttctaagttcatctattaatattagcatccatgaagtaaagggtagcctggaatacccaaatctaaagacggaaaacttcagttaggaacttaaattataattgagtgcattcaattaatgcatcctgatttttaaattcatttatattttctactggctaaaaatgtgctgatttgcttgattatctaaataaatggaatggagtgctgttttgattttgaaagtaattatctcactactaattaagttattgaatagtacatccatggaaaacactgatttttatttttttgtatcttactaatgtctgatttttttttaattttattttatttttaaactttacataattgtattagttttgccaaatatcaaaataatgtctgattttaaaaagaaataactgattaagcacattttagaagctttgctcacaaattaattaggacaagggagaaacataaagtgcaatgatttgatgactctgataatcgtcactgataatttgtacgtacagggttgtgataaactataaccacattgggatgaaatggtcagatcctcaccaggcagagaggccttgacatagcacattagaaagg

SEQ ID NO: 45307 - DNA, 4105 bp, Bovine  19866880632161
tgagctacagtccatagggttgcaaagaatcatacacaactgaagtgatcatgcatgtatcatgggcatgatctacaaaatctcaaaaatcaagtgtctctgtggaacaccttaaaaaattgagcttaaaactcccctctatatccttttaataccatttgtatctgatgttgatttttcagattgtgaaacctagatgggggagggcctatgatctgtacaagggcccaagcttgaaatgaacaaagctgggtcttcagtgtcatttgatgacacagtccatagcttttctctctatgaaaacacccaggagtggccatttaaaatttcagcacaatcatggtgtgtttgagcccacctactgcccacaggggattggaaggaacaccgaacaaggagccacatacaggatctgggcctttgtgcattctcttactaattccatgctgcttatgcttctgatctttaagattcaaacttttgccatacaaacctgggcggggtgggggggggggcggggaggagtatatacacaggagagaacctgcaattttaaaaggcatatcttaatgctttacaatacttttaagcggatagattttggagagctgattgaaagtgaaagtgttagtcacttagccttgtttgactcttggtgaccccatggactgtagcccatcaggctgctccgtccatgggattttccaggcaagaatactggcgtgggttatggaactggtgtggccatttccttctccaggggagcttcctgacccagggattagaacccatgtctccaacattctgagccaccagagaagccagattagttgtaaaaaaaacaatcaaaattaagaaatcctcctctaagtagttaatgcaacctgcatggaagaatatgtgttaaactgacacctgaatgtaaatttattttcacatctggggtaagtactacacctgaatggagtctactttgattacctttaaattcccaagagctccagtgtcatttatatgcaaatagaggacaaaatgcaaatataaatggctgagttagtataaatgagaacaattattgttttataaagtcttacatttacatagtgctttttaatataaaaagtactttcctgtatatattaagtaatctacataactctatgagttaactggtatccagtttagaaatgtggaatatttttagactaatgcacatcagacttaatgcacataagaattacctgcaaatcttgttaagctgcggtttctgattctgaaagcctggggggggggggcaagtctttgcataaatcacaggctctcaggtgatgccaatgctgctggtctgtggagtacattttgagtagcaaggacctagatatcgttgattcttgggctattccatgctattcctctttgtgactatcaatttgtaagaaataacacagagaggatgtaatgtacctataggggatatatcactaatgttgtgacaactttggtgatggtcttatgtcagtggttatttcattatgtataaacatactgaatcaacatgctgtacacctgaaaataaataatattatatgttaattataacccaataaaaaaataacatggcattttttttctcctgtatgacatttttaagtggtaggtaggacataagcttttgatggatcccacatctaccagctaccaacgggatagtcttgggaaactcatccgtcctcatccttttccacttttgggagttgctgggaggatccagtaagttatgatatgttcgtgtgctctataaagagttggtggtgtttatcatgccttgtgtttatacacaagagtctgtccaaattctcagagtcctaattcacgcattttctgagactgagcacagcttttgtcttttcagtatttgctttcattgataataacgatgatctttgttttgctaagcaaaggatgtcgaactatttacaaggtgaggagtgaatggtgagtggaattggtttccttgatgagctgtgctagaatattaatgaaggggaagtgaaggcaatctgctgtgggtgtgctgctagggcagcaatattcattaggctcaacttggcctccctcatattttccactgagaaaatgatttctcctttaacactaattccaccatggctgcacaacacatatttcatttgacattacatggggtcttgtaaaatccctttatgtcaatcacttaaaattttctttgcttttaaaatgtagctctttaatagttactattctgatatattgttttcacaaacattttatggtagattttggaactcctgaagatggggattgcatcttctgaatgacttaaagcacagttgttgttgctgatgttgttcaattgctaagtcatgtctgactccttgtgaccccacggactgtagcacaccaggctcctctgtccttcactatctcccagagtttgctcaaattcacatccattgcatcagcgatgctatctaaccatctcaccctctgcggtccctttctccttttgccttcagtctttcccagtatcagtcttttccaaagaggcaggaggccgaagtatagtaggtcctttattggttgccttaatctgacttcattagagttaaagctctagttttaaaatagtacggtttgggggggagtattcattcccccctaggatgaatttctgttgtttaattaggtaatcaaattgataccttaatgagaattgcagcactgaaggaatggggaatttcagtttccacaggggaataagatcatttgagaaaaaaaagcagcctgaggatgtagcaatatgtcctgagtgctgatcatgaagcaagtactgtatgaatgcatcctgtatttttttcctttaacttcatttcactatgctaggcctaccttatatatttaccttattttcctaccattggagtagatagcattttttatctttaaaaatccagctctaacacaatatctggcatgaactaaggctccaaaactatttgtttgatgaatgaatgaatggctttctatttataggttggcagattgagaagcagcagctttaagggaactgcccaagtactgactgactggactggcctccaacccacatctctgtgtctccaagtccaatctactttctagtctgctacagtcagtaggggcttcagacagccaactaacgctttatcgatcctgggtaaagaaaaggaggctgggaagggaataagccggattgacattgtaatgctggctaaagcctggggagtgttagaatggtcttgaaattcatccatttggccagccctggggctgctggagagagccaacactggcattaataggattctttgggcagcctgagagcctgaggtcaccccaatttctcaaatcaaaacaagcctctgtagatggctctgttctgtgctcatcctcctccaaagaatggagggaacaggggtcaaaggagaaagaggtaaaaaataggaagaggaaaacaggaatggttaggggaaatgaagtatatcatacaattgatcctggaatactgttctcactgatggactttaaggcacttaccctgcctgcagtaagaaaaaagggtattttcctacttcgagtgtatacccataatgtacacacagccattattgtgacttaggttgtctggtggatgcccttttaaaggaaggctccgaaagcaccccagaggagctctggattatttgtctacatgtacgacactggctgtaacagaggtgtctctttgccatttcagggcttccaactcacccttgtaacctgcagtctccatgacctgcagtgctgagcagcttcttctctttcattttggctctgcgaactccaaaagaaaacactgttgatcccaaacaagcatttatgtttattgtgcgacaaaagcattctggttcaccagggcccatcaaacgtcagcttctgtagcatcctgctcagttatgagagaagccacgagattaggaaaatataacaacaggagagctttcaatggggtcatcaaggggaacagatagaaaaaatctaacgtttt

SEQ ID NO: 45308 - DNA, 1770 bp, Bovine  19866880695765
ttcatatatattcagtgtgagaaatggagacagtgaaaagagaaagtagttagcaagcagtttgccaattagcaaatatggtttcaccaagtacctttgtacaccaggccccgtgaagacagacatttccccccatcgttaaaaatagctatttaattgacttttagagcgaccagagtgaccatgctacagaatagaagggcggggtgctctggaggcctgggtcagtaatggcaagagcccagtgttgaaggacagtttacctggggaagtgatgatgaagccaggtccagggctgaatagggcttggaggggtatcccctcagatccaaggaagggagaacaaacaaggggtcattgaaactccaggttcgcattcttgcaagagaaaggattgtggtgtcagttatctcaacctggtcactttcaggtagaatgtgagagctccatgggaaacagaaaaaaaaaaagaaaagagagggagggagaggggcgaaagaaaggaaggaaggagggaagaaaagaagaaagaaagagagagaaagaaggaaagagacaggaaggaaaaaagaaggaaaggaagggcatgtattgattagtttacttagagactgatacagatgttaattcatgattagcaaaagatgcctgcctactctaaagtatttagcaatatttttgtctggtaggctgtttttaatttcaaggagggaaggctgtggttacctgatttgttgctctcagcttcagtagtttgaacactctcttagagtttgcacaatgagactaaattggaagtatagccaacaggtgatccattaaggacttgagtgcagctaagccttcctttgggatgtatacttttacagccaataaacctggccttactagctcctagtcgctttgcttgccaataacacagccttataatgtaacagagtccagtagagccactcctcttaggtttccaacctgattattgactctgagaagcctcttaaaatggcaaaggattcagtgttcccccagactcccttgtgggactcagagaagaggtgatgatatagttgctatgttttagttagtttgagacaagtgtctgcaggtaatattaattttgaagatatttaaattattacctgaaatcctttaaaaattacattcaaaaatattaattgtctgacaataatgaatatatgttactgggagttataactatgacttgctgttagtcgctccatcatgtctgactctttgtgaccccatggactgtagccctccaggctccaccatccacggacttctccaggcaagaatactggagtgggctgccattcctttctccagtggatcttcccaacctggggatggaacccatgtcttctgcattgcaatcagattctttaccatctgagccaccagggaaacccataactatgacttaagtcctgaacaattgattgacgcatcataaaaattatgtctgagagtgaatatgacatttgccagcagggatgtaatgatgaataatagtctgggaaagctaaagtgaaagaacagtgataataatctgtatgaaagataattcagcattaatattttaagtatgttgtgtgatttttaaggatacatttccaaatgtaataaatgcttgaaagtgctgtgtttcagtaatgggtttacaatctctgcttgcttcattagaatagctcaaaatacgggagccttttaaaaagactaaatgcacttcaaagatcaaaatgtttatta

SEQ ID NO: 45309 - DNA, 738 bp, Bovine  19866880740470
ttgctgagtgaatatttaatatactcgcatgcattggggcaccagttattctataacataagacagcctatctaagaaataccctccagttcactcttttcattttggtcctccattttttttcaatattttgctttactgctgtttgtgtatgtgtgtgtgtataacttaacaacttaacagagatgttaggaaaagaaaaatctgacaaaggaacaactttcaattcacttgaaggaaaatattgacattcatgaaacccaacaaagctcttggtgcccctctatctttaacatgcctctaccagcaaagaaaagcacaggggttaacagatttagcagggaaagcagattgtagttccattgacagctaggaaatgaaatgacatccagtatttgatgactgccctcaattagcctatgcaaagcaagaattaattaccagcattgagaaagctcacctctgacttttctttcaagatctcgcttacactgagtgttcctctggtgttataaatgtaagtctagtagacttgataacttgcttttcccttaaaatattttaatttgaagtagtttttatttaatatggtaacccatatttgatggcagacaactcttagctaacctaagaaacataaatctatatatagatgtagataaagataaataatatatgtgcttagtcctgactctttgtgaccacaaataaggtctgtagcctgccaggctcctctgt

SEQ ID NO: 45310 - DNA, 1566 bp, Bovine  19866880761428
cattgcaggtggattcttcacccaactgagcttacaggaaagccctaagtattgaattttgtgagcatttacatagtttctctttcttagaagttattattaaaaggtaactgtttagtccctaagtcgtgtcagaccctttgccacagcatggactgtagcccaccaggctcctctgtctatgggatttcccaggcaagaacactggagtgtgcttccattttgaaactgcttcaggcgatcttcctgacccatggatttaacccatgtctcttgcacttggcaggaagattctttaccactgagcccccaggaagcccattaatataggctttatataataaatttaatataatattatattttatataaagaggcaataatattatatataaagatagtttaaattttcagagtatcacaggtaggtgaaaacttgtgctctcgaggtagtttttaaggttatcacataaatatagagccagttcagaggtgttccagttaggttccaaaaaacattcttttaaatgtctaatgacacaactgatttgataactgacaagtaatttgtcaccatatagctgacaatatttgtttaaaggctgttcttgaataaagtgaatacttggctatcccttgaaattttcatcccaatcgggatactaacttgaaattagaatcctttaaggataatttaaaaaataaataaatatgaaggaatacaatagtttgacatctaggattttagcaaagtcactgtcgcatgtaatttataacaggaaagaaatcattggaacagaaaacattcaatagcaccatgcggagctctgacttcaattcaatgtcagtctctgactttaccttccttctacttcttacaattttactaccatcttttcatccattctttctattaattccttgacccaacaaaaaaagacactggttttgaataggattaagaagcatctcggagaaggcaatggcaccccactccagtacttttgcctggaaaatcccgtggacggaggagcctggtagactgcagtccatggggtcgatagagtcagacacgactgagcgacttcactttcacttttcactttcatgcactggagaaggaaatgcaacccactccagtgttcttgcctggagaatcccagggacagggaagcctggtgggctgccatcgatgggggttgcacagagtcagacatggctgaagcgacttaccagcagcagcagcaagaagcatcttgcccacctgataactacaacgtatggtttctcagcttatgatgttgcaagaagcagtaaactgtaacttacttctaagttatatatactgtatgttaagcattgttgtgagcataatcatgatgctatttaatcatagaaggtaacttgtacagctgaaaacctgctcatggtttctactgaatgagatttctaggtagggctctcattttattcttatgagtttccctagtgaattttattttaatgcattgggaaaagtaaataaaccatttcatttttatttcccatttcataaaatgcttctca

SEQ ID NO: 45311 - DNA, 1170 bp, Bovine  19866880792586
tgacggacagtcctgttgaagatagtatgagccagcagtagtgcagtagctgatctgtctgatgaagatagaagtaatcttgttgaatttctgggagtgcctatgagtaagggacacattagaaaaaaatcttgtttcaagaaaaagcccagagtcctgtctgtttcttatttgtagtgtctcagtataatcacagatattagtaaacacttccttccttaaacatcgatggtgaaaatcgctcaatatttttgctgaaatatgcagattttcttcctcagcctccagagaagaatgttttcagcacagcagcatgaaacagtcttcctgtctttaaaaaggaggcgggaaggaggtgggggagatacagagtaggcctgtgaatcactgctgtggtctggagatgcagaaaccactcaggagactgtactgcctaaagatagttcccaaattgctatccaaggataaaaggacaaatttcataggcaggcttctcccaggaaaatacacaggccttgaaagagtaaatgtgttttctccccctctgtcaaatggccttcaaatagaagtagttttcaactgcatttactggggttgcattgtgacaagcagagtggggtcaataacagtggcattcctcagagggacttcatcatttatgcaaccctctaaactagaaggcttgagtaaagtcttctgacatctcagatttgggtaggaaaggaaataggtgcatcagaatgcaaagaaaccttaacaaaaatatgcagtcagccttggcagaaaaactcattagctaacacactgttttgcttatgaaggccaaagaaaatggttgtaaagttttagaaagattttagagtgggtagatccaaatggaagtaatctaacaaagatctcagaaatcgttacagagagaataaattgatgtattccactctttctcttcagggggaggacaaaatctatttgtataatcttgagttacttcatttgagaaatgagggggttttaaaaaagttaatcactaaggtacctttctaactcaaaaagatgtggttctttgctaagatttttgtcctttgctaagattttggagaggagtatgaattttttagacacgtaagcctaacttctaaaatataagtttagataatttagcaaagacat

SEQ ID NO: 45312 - DNA, 3426 bp, Bovine  19866880823721
cgacttgatggacatgagtttgaacaaactctaggacatagtgaaggacaggaaagcctgatgtgctgcatgcagtccatgaggtcacaaagagtcagacacaacttagcgactgaacaacaagagcacaaaaagggaattagggccaggatcattttgaaggtgaagtgaagaagcaggagatgggtaaatgatggaatcttaagatgcagagatgagatgctcaagaagttcacaaaagaggacctttctaaaagagagaggtttggaaattggaaacagagagccagattcatatatagagataatgttcccagaagttgttgtagccacacacaggcacccagtgaatggtggcagcagtttacaagggtggcagaatcctcataataatcccaaaactttactttctcaagtctaactctaatattattagattctggagaacttaacgattgttattcatttcaataaggctaatcagaaaccgatttatcttgtggtcctcactacatggtaaactttgtgagccaaagtttaaattttgaaataaactcctagtctccagttcagttcaaggacagtggacattcagtaaatacttgccctcaaggctggccttgcaacaccacactacgtgcattaatgaaagataaaatatcttttttgtgtgtttttctaattcagtaaacaatgaggcttctatttctggaaatagtttctgcagttcattatggaaatcctttcaaatgtggtcagtacctacaaatcataactctgtgtattagggagaaaaattagttgtgactctaatagaggtgtgttcaagccaagatgtctcttggcttatttatacagcttgtatttacttttgctaaaataattaaatttgtaacaattatgaggctgcccagatctctttagcagtggatattgattgttaatgtagaggagctttgcctcattaaaaatgaagtattttagtcattgtggctccatcaacagaacctggtgtcattgttacaataatcatgtgtttgatggatatattagtgtctctttaaagcttcagttgtaatataatgatttgcaaggctttcaacagttaattatcttgtatgtcacagaaatgtctcttaccctgatctaaactgaaatgaaaggtgagattcctctgaagaaaagcatttacagaggctttgctggcttgtttttttctgtgactctgtgtccagtggggtagaagtgcaacccacttcagtttcttgcctgggaaatcccatggacagaggaacctggtgggctacagtccatggagtcccacaagaatcagacacgacttagtgactaaacaacaacagatcccagatagcctctggtctttcctctctcctgtccactttgtcttgaaagatcactcctttactagtgggtgccagttaatcgcaaaacctttctgtgtgttctagttgcctccagatatttttcttgccccctctttctctactttactccctccacaacccctaactccactcactctaacagccagattaatcctgctaagccaacacactagtcccctgctcaagaatcttctgtggttctccaatgactattagagaactttcacatccttcatctggaaatcatgattttctaaaacctggccctgcttaagctttcagacctcattttctgcttttcatgacaagtactcaaatattccataattattaagttactggccacgtcaaatgtttgaataattactctgttgccattcccttctccagggtatcttcccgacccagggatcaaacccaggtctccctcattgcaggcagattctttaccactgtgctaccaggggaaaccccatctgtttgtgaccatatttgatgaatcattaaatatagcgtaggtagggagagactatagtcaaagataatagagtcttgcatttgagtgatatttaaatcattaatgcaattaggtaaaagatatatattttaactagttggtattatgaatgatttggacttgtagacttgaaaataccagcagaaaaagccaacagtcatactaaacagagaattagaatatgttattctacaatacatttctctttgtgaaaatgtacaagggattttatatttgttttgcttgctttttaccatagaattactggatcacacagtatgagaattttcagggttttttgttttgtttttttttttgacaataccaacttgctctctgaagtgcttgtacaaatttaaatttccctcaggcctttataagagttttccttccttaatacttattatcagaatgtttttacctttttgctaatggtaaaaacattagcaaatgtctctttaattgacattccctgattactaataaaagtgagcattttaaaatatgtgtaatggtaattcagggtccttgttttctggatgtcctagtcatattctttgtcagtttttcctatatattttatttttcttattgttcttataggtattctttatttaaaacgatgctaatcctttgtttgcttatgtgtcttgcaaatatcttttctgagtctgactcttttaatttcacaaatgttggtctgtttctaaaatataactttaaatatattgccccaaactctcttcagttatggacattttatcttataagactcacctaatatgtcactccttctatgaagccttctctgatttcccacgtgaaattttctgcactttaatatagagtcattgtagcacctctgatagttatattatatttaccatctcaatctctagattataagttcctggtgactctcttcacctttgtatttctagaagctgacccaaagtccagttttcagtgtgaatccccttgggaaaatgagtttaccatttccacttatttctgagggattttcacctctttaaagccatcggccctatctcttcatgctcatatcaccccacaatgtcaggcctcatatgagatgatgaataagcatataatcttatttaaagctaatcagtacacttgaagcactgtttcccttgactcatcccaaggaaaataagcattagaaaaaatattttttcatgtatatatgtgtgtgtgtgtatatatatatatcttgctgttaaaatataatcagcatattcactagaagtttactataaatttcagaaagaactaaaaagtttatcatgagctttggcagttctagtttttaaatgaagaaatttgatgatcattccaaagtaatttagtcagtttttattcaataagtatttgagatacaaatacatgcctggagagcaaaccattgacaaaatatagagttatttcatttgttaaacttcctgtccttaccctcttaacaatccagggccttccttgctg

SEQ ID NO: 45313 - DNA, 1303 bp, Bovine  19866880903776
aggagatgtaagagatgcaggttcaatccctgggtcaggaagatgccctggaggaagcccggcaacctactccagtatgtttgcctggcgaataccatggatagaggagcctgatgggctatggtccatagcgttgcaaagagtcagacacgactgaagtgacttagcacacacgcacaaggacagcactgtgatttcagcagaaaatacagatgagatcatcacaatgttgctgtcacctcactaggaaatgcacactcctctggtcccagtaaacagatcgaggatccctctgctctcatgtgaacttcacatctgtcttcctcttcactgtccatcctgagaccattttgtacaaaagaaagagactattttcagcacagttaagatgcccacatgctgatttaccaagcagaaaatgaggaataataaagaaaacatctgccatcacctgggcagttgatgttggcatagtgtcttgaatttctaccagggatcatgcctcttgatgaagtcataggacagagcttctgggtgatatatggtgaagccttagcaacaaacattaggaacattcacatttgcaagggtgaacaggaaccgtgggggcgcttactattcatgcatggactgtggttgtttctctgtctagtaggaaagaaagaaacaactacaggatcaaaaggaccaaagggagagaggatggattcagagtcacctaccagactgtgatttggaggaagacccgctggcctctctaagcctcacttcctttatactaaggggctctgataacaagtcataatgaaatgagctaagcatgcacgctgcctatcagaggtctgggcgacacagtgggtaaatgatgcgtgtttgttcctgtctaatgacaggctcccgggaagcagagcttgagacacagattggatacacatgatgtatggaggaaaggcttttaggacatgcagagaggaagatgctcagcagggttgtggtcttggtagggacagagtaaagggacaaagtaggtgattaaatagttaatcccactaggggactgtaagcaaagaaaaaggtatgggagaatcctgttaagttaatgatcactcaggaaagcaggtttgtttaaccataaagccaagcaggcttgcttagcaacaaaaccatgcaacagaagtctgagacatgcacccaaacaataaaacaatgggagcctgagacccacatcctgttcagcaagctcagtaagttaatgattcctaggacacgcttctctgggcactttaaaaacagaatataaggg

SEQ ID NO: 45314 - DNA, 897 bp, Bovine  19866880921195
tacagatatgggtcatatcagagcagtttttgtgaagtgagagatggggtggctggatgggaggggcatgagggccagaggacccccagaattgctcatgatgctaagaatattcaacttgtccaatatattgaacttgtccaatgctgttccagtgcaagttcaatgagaggtgtggtccacaggcctatttcaggaattttaaaggaaaaacacttgatacataatctaagaatgtcatctggatgaccaacaaataactggattatttagaatatctctgtgcccatgttttgtttgggttcacaatcatgttagcttctagctctcatctaagttggtaacactctacagataatgtatcattaagcatcgctgtgtacactcatttcaaggataatagtcatccagtgtttattatagccctgttacattattttaattttcagttataaaaatgaaacctctttctcagggataattactgatggaaaaatatttttatggaatgactttcgtttctgaagttgtttaataaactgagatctggatgtgacattctaaatattgcagagtgtgataaaataacatacacatttaattatccttggctggagagaaaagaatggaggcagacttaatctgtgcttgtgtgccaagcaaatgccaaacaaccacaaggttggccataggaagcaagggatggagatgagcagtggttacaaaggggaaaggaggtggggttggcagaaaggtgccctaaaagcatgtgatggaccttccaaaggggtttaggcgttacctggctctgaaaaactctgatttagagctttaaacaacgctgacccttcattacattttcctgtctcatttcctctgggactactgtcccttaat

SEQ ID NO: 45315 - DNA, 1604 bp, Bovine  19866880944509
ggaaaaaaatcaaaataatatacacatataaatatattgggcaagttaacgtttaccttttttgcatctaaagtaagctggctgagatttataatttatctatttaattgatttatttccatagtcaccactttaaacattttattgagcacagaatcctatatttgtatatattgggcttcccaggtggtacagtggtaaagaattcgcctgccaatgcaggagttgcagaaaacatggattcgatccctgggtcaggaagataccctggaggaagaaatggccacccattccagtattcttgcctggaaaattccatgtacagaggagcctgacaggctacagtccatggggttgcagagagttggacacagctgaccacacacatggttattatacatgtatgcctatgcataaatatatgtgtgtatacatatgcatttatatatctcagtaaaataaataaaaattataggcatggtcctagaaaaatcataggttgataaactgatcataaaaatagtatcaatcaagaattatacagctaaattcttccctaatagaaatttctcagtgaaatcaatgaggctcacatactcatctcaattggaagagctttcattgtactgggcttaggagagagtagcaaaagtgctttgataaaatgtataattagggaggcaaagatcaaggctttaaagagagggcttagcaaaacagatgtccaaggagccttagtaaacccaacctccttaattaccctttggctgaaggaagtttgaaaattcttgcctggcaataaccgcaagtctgttttactctcaaaatgacttgacagttgtaccatgctccaaatattttaattaactatactaagatttagtgaaaatgtttcaatattagcaccatcaactggaaaatatcaggacatgtttaaaaattaaggtggacaaggatttatggatttgagtagtaacaaatctttcattatccatgctgtatccttgtgaaagagggctgatttgtatagtgtttttacaaggtaacaggcagagtttgaattacgggcatatgagttcagctgagaaacttcatcatctgaggaatagtttacatgtatcaaatgtatggctgagtcatcttacttcctgtttttccattaatgattcagacattgaccacgtggattattgtaacaggagaactctgtttcacagctctaaaactgaatgcatgtagtagataattacaagaggggggaaaagtttatattccttaaatgcctttataaaaatccatcctgcagtttagtaatgctgatttcttttggttttcaatacagactacttttcggtgtgtgtctgtgtttgttttattacaatatatttcttatgttttatgttttcacagtataacagggggggtttctctttaatatagggcttgactatgccattgttttatattgttgtttagtcactaacttgtgtacaactctttacaacttcatagattgtagcccaccagactactaaaaaaatggatttttgtccattgttttacacaattactcaatcacatattgtgtgaaagcacagtcacta

SEQ ID NO: 45316 - DNA, 1422 bp, Bovine  19866880988238
cttgctaattttgggaaggttccaaaccattttatagggctctaccattttatataattccatgttcttcatggccccttagccagttttcttaacaaaaaacccaacaaggtctgtgataccttagaattttgtttcttactgtccatctgccaagcataaattatgaatactgatatcactattagcagtaattttattttttaaagaaatatgatgcatttgtattaaaataaattccatgaagttcacagttatatttataacctttgtaaaatttttgaattaaatattctataacataaatgcaattctcacactagaaagcgaacttttaatatttggatggtattctttgccataaaaagaaaactaaactcatttaagaaagcaagttccctctgtgttgttacacaatggcagggctttacaggtgtcacctaacattttcaggttccacttttgccaggtgttcgcaaaaatactgactttactagctgctggtgtgtcgttccccctccacattttgttgatttgttagtatatacatagattttcatagtaggtttcctattctttcccctgtgcataatttccttgatatagaagttccacaaccatagctgtaaaaaatgtttaaagagagaacattttggtatgtttgaaactgggatccatcattcattgacattccaccaagaggctatatttaaacctctacacgacttgccttatcagaggagcagtttggcatttggtatttggagacagctataaagctacaccatctgtaccactctgtttcaagagggacatcaatttttatccttgttatatcctgcaggaatattctgctaaaactcagcacatgcatgactcagttataattcagtcgtctaactgtggccaagggtatacgtggcagacagaagcacttgtgttcatatccttggtttaaaaaaaaaggcagcagttgcctgatattcaatcacagaggcatgagctttctaagtcacactggctgataaaatatctggttttgggtggtgtctcaaaatttacttttggcagtttgcctctaaagaaatattacagacaaaatctgacaataaaacattttctgttcattgataagttttatttgggaaggcaaaatgtagagttatggattacatttgtcaagtatagaaattagaggtccaaatatagaattaaaaattgagttatttttctttcaaaataaatttttaaaatttttctttaaaaaataattgcttaatggaatctttaaaaaatgggaaaaataaatttatttacaaaacagactcacagacatagaaaacaaacttagttaccaaaggggaaggggatagggataaattaggacttggagaggaaaatacacatacttgtgcatgtgta

SEQ ID NO: 45317 - DNA, 1765 bp, Bovine  19866880993427
aatgctggccgctgaaagccagctgaatccaccagaagctgaatgtccaaggcaaggtccccacctgaggaatggtaggtgcctaggggctggttggtgtgctggtgaatgcacaccattctttgtgtgtcacactgctttgtgtgtcacactgctgatcaagactcagctcacttgcctcaaggatggaagggccaactcagcttgaaagcatgcagtggatcacttggggccattgtttcaactgatcagagttcaaatcctcctgttatccttattccttcataccctccataggtattgatactaaggacaaggcccagtaaatttacaacaagcatgttttcatcctatgagccatccttaggaaaccctcctaagataatgagcttggaagaatcctttttactccagtatgcccattactcccacaatctatttcagtgaactagtgatatttgtagctaaacttctcagggcattgctagttataagtcaataaggtcaatatttcctaaacaaaatatactaaagtgttcttctctaagttataactgacttggaaaaaagatcaatacaattaagtggctgtcaaaagggcgataaaagttaaaatcaaaagatagaaaaatgcatcttgcaggaataacatagataaaaatcaatgaaacctacagcatatatcaatagataaaggcgataaaataatctggttagcagcataagacatcatgatatctttgggtaatagtaagttaaaagttcaagaaaatttagacattctctgtgatttccaataagtcagcttatactttgaatatttcttgccttataaaatatttttaaaatggattgctttctttaaagcccctgaagaaacattgaaattgctatgataaattaccaaacatcaatttctcattgatttcatgaacatgttttaccactctaggtaacatatatagatatatgagtttagttctcccagtcacataatgcagttttatttactaccacaagacattcaaattgatttctgtgtattattgcctccagtttttttgatggctctcctcatatcttccttaatcagttctacaagcattcacaaactggtacacaaaaatcccatgttatgcaattaaattgtacatcagtagtcaacacttttcaaatagcagaagcatcaaaaagttaccaaatgttttgcatctagtcacagaagttctgtaaattgtcaaatatccatttgaatatctataatcaaattaccttgagtttaagaaccactgttcctagaattacacaatagactatttatgtgtttatatattatggcaatgccatacaaaaaggagttaggtttcttcactgctatctcattctgagttaccttcttccatactcatcagaaggaaaaagatggaaacacacacatttacaatcacaaagcaaagcccccaaaaatcaatgtgtgatttaatgtagagataagacccagccttaaccccccctctcataccactgtcactgcccaaattccaaaccttattatttcttacctggattatcactactgcctccccatcagctgccccgccaggcacgcttttaatcaatccaagttaatcatcctcaagcgcagctctttgtgtgtcacactgctgatcaaaaatgtttgatgactccctgttgcctccagtaaaatttccaaatagggtggccacaaaggaggatccatacggaggatagtaatcctctcagt

SEQ ID NO: 45318 - DNA, 946 bp, Bovine  19866881011259
cctggaaaattccatggactgtatagtccatggggttgcaaagagtcagacatgactttgcaactttcactttctcagttttagtctaaagggtaaaaaaacaaacaaacaaacaatgaaccgcatgcctaagtgtgaaccaagacaccaaacctgtcatcctgagactcttcaaagcccacagacttctgtctggcctttaatgaagccaaattgcagcagatactccctgtcacttgtgagacaatgagatgatacgggagacaacgccaaaaagtagcactgccccgcatcttcaattagccatgaagggaaaatgaggcaaagagtcatgtataatttagaggctagctctctggttcttcctgctgtgggaagtttttcactgaggaaggaagcgtgatttagtgcaatgaacagacctgggggtcagtcgtcttgggttgtgtttccagtcagctccctgacttactttatgaccttgtaggctgcttcatttctatcgaagagacgaaaacaacttgtatttatagattacatgtttggttatcctgggtaggggcaatgccaacagtcctttgatatatgttactattatgtttagtacaaaagaccttggtgataaacaaagatgttggtgtttgaaaataaaaatgagtttcaaagcctgggaggaaaagatgacaaagagtactttaatgaggttacaaggtatctccttttctacctagagagttgtgctttgttttgtgttttaattagtcagcaaactgtaaaccatgctcacgatgagagctgtttaagtaagtgtcaaataagactgtaaccttatttgaccaagaaagtatgtgggcataaaggatttattttccagtagaagtgggtctttgtctactaagaaccttaaggtgcagtgctgagaaaacttaagaagttggaaagctga

SEQ ID NO: 45319 - DNA, 1289 bp, Bovine  19866881014074
cctcattttctttatctatatggtaaaaatagcaatgtcagaggctcatggtaaatccctggtggctcagacagtaaagaatctctctacagcgcaggagacccaggttcaatctgtgagctgggaagatcccctgaaaaagagaatggccactcgctccagtattcttgcctggagtactccatggacagaggagcctggtggactatagtccatggagttgcaaagagacatgacttaaggactaacactttcgctttcacagaggctcacagtgaagacaggataaaggaagtcaagtgattactattagtcagcaaacttttgaaaagtgtccatagcaacaaaaataggcataaacaacatcttgaaattttcttaaaagacaatagtcaggaaagaaatcaatagccaacaaagggtcactggagctaattagaagcaagggataaaatgatggacatatttcatcagaaatcttcaacctgaaataaatgggttgtgttttggatgattgcttctgagtcatttgctttagagctgagaaatacatttttccatagaaataacatgctagtcgataactcagtttttgaatagccaacagagtgttggttcctgggaatgtggagtaataaagaatagtccatttcagttatcacatctacattttcctatagggtagtgcattctgtgttcataaatcaagcttccaggaatacatgagacactcatacagtagcagagtcactggttgaaacatatgggagaaggcagagaagtttagctgttgagcagacccagaaaatagaacttactggaatcaggtaataagattaaaattgtttaaaatgggcctttatgtccatttccaagatgatgatcaaaagcaaccaagaatcttatgatggaatacttatgaaatctattagatggggaagaactgcaagaccattattattaaatagaactaaattaaaatcctgctggccatgtatgactttggaattggggaaactgaacagaacctcttgagcttcaatttcctcacatgccaaatgagaacattaatatttgacacagttgagagaaagattataagatgtcatttattttgatttattcggaatatctttcttgtatcatttgtctttcattttggaccctttgtctttcgctcacattctatgtaccaaaaatcataaaatttggattggtcactggaaactggttctatgacaaacatctccattattttaagggtttttcttttctacagaattctcaaa

SEQ ID NO: 45320 - DNA, 1776 bp, Bovine  19866881026836
ggacgatttgttcctgtagtacaaggcctcgccacctacacggaatgaatcacaaacctctcccagaaccaataaaaaataaataaatgaaaagtcaggtgtgttgtcagaattccctgctggttctgcacagggtgattagtgggcaattcagcaggcaatgggagcccttttctccgccttgtctgtgtgcttggcattattaaaaaaatatatattttttattattttgttgctcagtgccaggtgaaccgaaaagaaaatgaaaaaaagagcagtgtgtcctgtatcaggggtcgctggacccaaagaaaagaaaaggtgggttgttgaaaaaaagaagaaaaagaaaaaaccctcattttagaaggtgatgagttatctcttctctctgatacattgcatgaaacagtaggggaacttttgttttttcctttgtctttacatcttgcttacatttatctccaaaatatagtccatggtgaaaatgaagatcatttgccaactaaggaggaagagaatgaaagagggaggaaaagggaaggaagaacagaggggagagagacagcgagggagtgagcacttatacagccatttcagtggctgggtccaggcttggtattgttctaacaacattcagcactagagattcatttgatttttctgaccgactacagtctttcttaatggttgtggaccaagaccctagagatggaagagcctgcccagggtctcatggcttgtaaataattaaggcaggtcctattcgaagtaaggtcagaaccaacatctgtacattgcttgaacttgtcaatctagccaaagggtcctgcttgagtctcaggctggtggcctaagcacacgtgtgtacgggtgtgtgaggttaacaggagggaggcggggggatcactgtgggctgcagggtatcaaaatttcatttctctggctttgctccttcacgaggctgcttcaaacaaactagtgcccttgggaacttcagacagcggccttcatcctgcaagctttatcacatttttcttcccgagacttctgttagtgtttagggttttccagaacttaccattaaaagtcacctcattgattatgagagttcagtgctatatcctgcactcagaacaggtaaatgactggggaaggaatatttgacaccaggcataaaatttaaggtaagttcattgagttggttttcagaaagctgtaactattttcttgttagatttctttttatgctgaagaacacagcagctgaattggaaggaaagattttaggcaacagttacttctttttctttttattataaatctactatttatgtccaactttccctggaaccaggatatggacatccagttgctcattggaagtttcctctgagtgtctgtttatgtgtgcttgttttacaaaatttggaaaatacggagcaacaacaaaaaactcagagaaaaacaatcatatacaatctaccaagacagagatcatcatggataatattttgtgacacttccttgcaggtgttaattctaatatacctaacattagggtcacactctgtatgtgctgtttaccatttgccttcagttcaatagtatgtaccttacgtattctctaattcttctatgaaaacatccttttgattagttgtatgatatttcatatcttcattgcactcttgtttctgtaaccattctttaataattggagttacagggttcttaccagatttttcattgttataaaataactacagtttctat

SEQ ID NO: 45321 - DNA, 2051 bp, Bovine  19866881033980
acctggcactctctttatataaagcactttctacatgtagatgcatagttgtattaccagcactattcatttatattcaaataaagttttgaaatttttgaacttgtcaatttagagtcagattacatcctaaagggacctccctggtggctcagatggtaaagaatctgcctgcaatgcaggagacccaagattgatccctgggtcaggaagattcccctgcagaaagaattggcaagccactccagtattcttgtctggagaattccatggacagaagagcctggtgggatatggtttatggagtcgtaaagagtcagacacaactgagtgactaacactacatcctaaggaaaataagctaataataaatcatccactgtatcaacactctcatggcccagctccttcggttaatttgtttgggaattaaggaccagaaagattaactgatttgctaagctctctttcatatgattggattaaagtataaatttggatatgttgtataactttgtagaagttatcacctgataattctacactagttgccttattatgtcagcaaagtcatgactcatttccacaaatccatgtggaattttccaagttttggaggaatccaaagatgattggatcttattctctaggagataatcaattaaagggaacacacataaataagtaaatatgtcattctaaagaagggaacaggtgctgtggtagatgtataaacaaaaggcggaagggacacaaagaatggagcaactaacccaaactggaggtttgggaagcgaaaatattaagcattatcttgatagctgataggagactaaatggacttgttagtgtctgcaattaaagaaatctgagaggcctaggttttcattatagtcaaattaaatgactataaaagaatcagaaggattaatttaagtgagcaactagccagtaccattcatttaaaaccatgtcaatatatgcaaggaagcatgctatgacaaacctagatagcatattaaaaagcagatcattactttgcaaacaaaggtctgtatagtcaaagctatggtttttccagtagtcatgtatggatatgacagttggaccataaagaaggctgagcgccaaagaattgatactttgaaactgagtgttgggagaagactcttgagagtctgttggactgcaaggagatccaaccagtcaatcctaaaggaaatcaacactgaatattcactggaaggactgatgctgaagctgaagcttaaaatactttggccacctgatgcaaaggagtcaactcattggaaaaatccctgctgctgggaaagattggaaaggcaggaggagaagggaatgacagaggacaagatgggttggatggcatcaccaactcaatggacatgagtttgagcaagctctgggagatagtgaaggacaggaaaacgtggtgtgctgcagttcatggggttgcaaagagtcagacaggactcagcaaatgaacaaatctgttactaatgatatcagcactattatttcgaaacatttatgtgtgtgtgtgtgcattaactaatctaaaactgttacaaactcactagtttactaatacatgataatgagctgttttatttgtgtattatctaatatattagtatacttaatatatcttagttattatttacaatttatatattagcattatcacattatatatacagtagttcaaagttaaatgtaaatacataacaatttcaaagtaataatgctgatacaatatattattagcattagtgtatgctaataatagtaatattacatgttttcacacattagttaatatatcaatacatattagtgtatgttaacatacactaaccaaaacttttcattgaaaaaggaaagagtatgaaaagcaaagaagttaaatgaaaattctgcaattctaatttaagttaaaaaatcaattatacttgatttttaaaacatacttaagagaaaaagaaacatatatgtatttatatgtaccaggactccctgcagataccaaa

SEQ ID NO: 45322 - DNA, 759 bp, Bovine  19866881068739
tttttagtttttgctttaacttgtagaactggattttagatatgtcttttagtttgcccatgttctagtttttccatacaatgttatggaaaaaattaactgaagttttggaccaacctaatagatgcaattaaacaagctctttcccttctatgttgcaatatttagttttggtaaagctatagttgagggttctttaataaaaattaaaactacatgtttaatttgtctgctcagcgtcttcatttatctacacaaatatctcatttttgacacaagtatctttatgtgccatctaaggaaagtgctataataaatttgaatctacttctttgttgtaaaaagaaattttcacaaaatttatttaatgatcacattatgcacaatgaatgcatttttggcttttcgagatcccattttactcttctatctttgtttcggttttggagcattcattctgtggtattgttttattatagggattaaaaaccaagtgacaataaaagcaaaacagctttttttattacttatgtaaagcctacttcatgcatcaaatagtgcccagaataatgtcaaaacatgtacagaaagacaaatagcaccacctcctcaataattatgtcgcttcatagccctgtgatgatgtacatttgggattattctgggagctactgaatcaaaacaagacagctgagatcaatcagaatcctgggaaccagaggaggccagcacaattctaagctgcaggaggccccaggg

SEQ ID NO: 45323 - DNA, 1087 bp, Bovine  19866881087020
aaaaagtgttaaagtacaaacagaacttggttgaccacagaattagaaactaaaagtaggaaagaaaataatgaatctaaggaaataaacacatgaaaaggagggacgtctacaaataaatgaaaaagaatgatgatactaactgacctttacttacttcgaacatataaagataataaacgagctgaagcagcatgtgaaattcaaatttttattagtaaggcactctttcctagttgtgacagttgttaaacactggaatgggtgacagggtaaaatagactttcattatctagatgggtagacatgtgatgttgcatgaagagaaaaaccatctctcagtggcctatccaaatttaaaatgccttagatttgagaattactttgagattaaattataagtaactaaaactatttttattacttgacaacttctgagtttctaatggttcctagaggagtttggatagcttaaggttgaaaagaatttaacttgcggttttggggctaaaatctacttaatattacttgacagtgagttttaacttttttaatctcctccagtctttttccacagcaaaaagtatatgtattattcatgtatgatatctatccactataacataatggggccttcctggatggctcaacggtaaagaatctgtctccaatgtaggagatgcaggagatgcaagtacaatctctgggtccagaagataacttggaggaggaatggcaaccccactccagtattcttgcctgggaacctccgtggacagaggagcttggtggattacagtccgtgggatcacaaggagttggacataactgaaaaactgaatgtatgcatatataacatatatattgtatatataagactgcatacatcatagaattgagaacattaaatttaaaatccacataaaataattggcaaattatctgtgttattattctggagaaggaaatggaaacccaatgcagtattctcatctgaagaatcccagggacagatgagcctggtgggctacagtcaacggagtcagaaagagtcagacgtgactgaatgactaacactttcactgtg

SEQ ID NO: 45324 - DNA, 611 bp, Bovine  19866881157977
ctcacatatcatacatacattttttgtgaatttgaggattcttgaaaagctcagattttatgtcagtaaaatattagggtcttttcacttcattcttattaggcattcaaccataattagatattcatacacactcacatataaatgtgtgtacacacctatgcaaaaatctattgacgtttccaagaaaaaatgtcattgcctgtatcaggcaaaacagaacacaagtcaataactggaaattgttctattttccaaattgcaggttataggcactcaggaagtgtctcagactattactgaaatctctcattggctacaaaaacaagcacattttgaaatgaaataaaatattaaagatgaagttggatctgttaaatttgagccaaagatcagactttgcatatggagcaaaacaaaacgaaacagaacacagaacaacagtatagaaggttcccaaagttggggtaaaagataagtattcagtcaataccaaatgtcagttcaaaatgaagggaggaaagcttgtcatctccatagagaagttttacatctcaactcactcttttggaaatatcagaacatatgggaattaaaacaaaaattggaat

SEQ ID NO: 45325 - DNA, 607 bp, Bovine  19866881161606
gagcctggcattttataagtgaattgatcctagaaacccaaatgaggattgcgtatgttaaggatagatacaaatctatacaattctatgacaagctgcttggtattttctgggagtttgggcagcaccagattgctaagtgagtctcaaggattgcagacctttaaatgacttgaaccagtgtcgagtttcaggctgaggcgttggccatgtgcagaacagactgaaatagagagcacagaggctctgcggaaagtcggaatggcagcccaagctgcgatgaatcaggaaagggggatggcctttgaaacggctttcctgctcactgtgttatcgtttggaaaacggttcgagtagggaacaagaagcaccttaagcttaaaaaaaaaaaaaaaacagtagaggcaaggttgaaggaagccaaaaaattgagactaatctttccatttatataaatccaaccctcagggccccaggcttgcctgcctcttccattaatgtctggggcagtagagctccctatggaaagctccttttcaggcttggagatgttgaatttagtctccaaagggaactggtgaaggaaacaattagagtggctatggaa

SEQ ID NO: 45326 - DNA, 1486 bp, Bovine  19866881164227
tttcagctgctgtgtgcatggcccagctagctgagactcatttatcagaagccgactgcgatagcttacatgggaacgctacccttgggagtttgagcacacaggaacaataacaagactgccaaagaaacccagcctctaactgcatctgccgatgctcagccacttacaataaaaacaagtaacaatgcacctatgtccttaagaacctttcttcctttcagtgtattcaaaggggaactttagagactatatggaaacttacactgaaaaacacagttggaaaagaaaatggccacattgtcaccctaggggcatatccagaggccatatctgtggatgtccagagtgcagcctgggggacacctggaagcccagttcagcgccagcccagttatttgttgcctctcttgtttgatctctttgtgctgtgtgctgtgcttagtcgatcagtcaagtccgactctttgtgaccccatggacagaggagcctgacagcctgcagtccatggggattctctaggcaagaatactggagtgggttgccatgcccttctccaggggatcttcctaacccagggattgaacccaggtctcctgtgttgcaagcggattcttgaccatctgagcccctggggaagctatcctgcaagaatggatgcacctttgagcccataatattcttccctttattagaccttgcaccagctctttgatgtgagggcatttttgtaccgtcatggttctgggagacatgggaagggaggagaatgttgctacagagagcccaggttctgaggctggctccacatttaactggggcagggaaagcccagaagtgaccaactggagaggtgtcactatttgccactacctagtgctatggtgtggaaagtaagtggcatccgggaagagtcaagcatagcttcccaattttgttaccctcaattttgtaagaccacatgtaggggctaaatcattggcagtttggcagaattacatatcttctcatctgctatggtcagcttgcttgcattctccccagatccacctgttgaaaacctgatgcccagagtgataggattagatggagaggcatttgatcaagaaggctctgcgctcgtgattgggactagagcccttacaaagagggccacacagggcttcccagcccctctgccaggtgaggatatgactagaagtcttcccagaaggggttctggtggaggatatcactgtgaagcttgtgtgatgagtgacttggccagcacagcaggcatgccggacccaggacgctgctgtcagtgggctcgggatggatggagcattgagaaataccgactcctgctcaagctagagggaacgtaaaatgccgcagcactatggaaaacagtatggcagctcttcaaaacagtaaaaatagagctactatctatccagcaatttcacttctgggtatatatccaaaagaattaaagcaaggact

SEQ ID NO: 45327 - DNA, 1254 bp, Bovine  19866881207794
tgaagcagacaccttaagcagatactgttaaagacacttaaaaaggagtgcacatcaataatcctttcacatttagcgtcaaggttttagatttgtctaccagcaccaaattctacatttggggggtagggagtgggctgttgatttctaattttaattctttgctattagactttattgagtcttcccaaaatactgtcatcatagaaaaaacagattttttcagtattcatagttcatttgtttacatatcatttaattaaattacataattaaagaatattatttttttaaattttattttatttttaaactttacaaaattgtattagttttgccaaatatcaaaatgaatctgccacaggtatacatgaaccctcctccctcctccctccgcataccatccctctgggtcgtccccgtgcactagaatattataactaacattcattcaggaataaaaacaactcactcttagtaagtatgcaaaaactggtgggaagcagaggttttcagaagagtagcccaatattggcaagcattcagcaagccacgggattagtgattgcgatttgcagagggaattgtgaacgtcaattagatatagatgggttagtagagactgtgctggaattctcatcctcagtatgcattactatctgaatcactgcttaattcaatcctggctcatctatccagcaaattgctcacagcttccctctcctctcatgctagctgccttgaattgagctcactgcttctcaagtattctgtgctgaaggatcaatttttccccgatcagtcacaaaccaatattatacttgtaaaatacaataaaggtacaatggggggaaaaagacataaaatgcaagggcatttaaaaagatcagttcagcagacataaaatgactctgttaaactgctataaatgtttctaaacattttctctcggtttctgttctcgtcacctcatgaatctggaatggtttggggaatagcatcggtgtgcagactatactctgggtagtgcttatctagaccatggcattaactaagtttcattctgtggaattactctgtatgggaaatatgatctaaaatattcttgaaaggtggatacagaaagataatttttttcaaaggaaaattattttctttagatttgtttgactattttcttctctttcacccactttagaatctaatgcacaaaaatactgtgatcttgggaacacgtggctctatattacatta

SEQ ID NO: 45328 - DNA, 1213 bp, Bovine  19866881208168
ttaggtatttccctctcaagaggtttttgtaattctgaaaacattccttctttctactgaaattctgttgtcaatgactttgtgcagctgagcagaatttgtcttaaaacaaaaacaggaaattcaggaacaaatttaggttcttaggtgtttagtcttcattggaacaaatacaccgtgtatttccactggtgatttgggttcactcaacagtgaagtgcttaaggtaaatagtgtcactgaagtacctttcggtatcaggcctactttggaggtgagctgtttcacttatctaaccaagaagagatacagccaacacttagttgattaaaaatcagatttctactgtgaagagctagcatattttcaaattattaacagcatatattaaaataataattcaggattataaataagtgtaattgaaagcacactcagaaaggctttataaataagatgcataagttacacagagtttatatagcttccccttgcttgtgaattaccattggatatatatgcgttcaatttctttttgagtgcaaagacttaggctcaaggacagaatactttaataaaaataaagaagggggatttgtgtgtgtgtgtatgtgtgtgtgtgtagattcttttcttgaatttagtttgaattacatgaacatctttggaagtaatttaaaattgatgtgcttaaagaaaattattttaatactcgaataaaagtaaatgttctaaatgctgtagtgaaataaaaatggatactactaaaaattttacatatgtctagaatttgaaagataacacctctagagaacattaaataatacaaaagtatcatggtacagaacatagtcttgggaaatttagttcatatattttatgaaatgttatctagcccaatttgtaagtaatcaagctttcacagacatctcacctttttctagtgaatttggtgaatacgacctttttggtttgtacagaaaccattttgtgatgtgtgtagaagaagaaagcaaatttatgttactatagagaacttccttatctattaagaatgaccatctatcaactggcaattccataggtttgcattccaaattattttatcattttttcttaaatattggttattcctcagatgtttttacttatataaactaattctatatttaacatttctctaagaaaatgtttgatcaacatgaacaagcca

SEQ ID NO: 45329 - DNA, 1111 bp, Bovine  19866881248306
tctcactccaagtccatcatggaaactacactttggccaaagtacatatatacaggagcccttagactctgatgctgggagggattgggggcaggaggagaaggggacgacagaggacgagatggctggatggcatcactgactcaatggacgtgagtttgagtgaactccgggagatggtgatggacagggaggcctggcgtgctgctattcatggggtcgcaaagagtcagacatgactgagcaactgaactgaactgacctagcttaatacctacagaggctgtgtaagtaacctctaaagtgcttaaaacactacaacatttaacagtttcaatggctgaatcaatgattcttctctcttctctaactaaataattttagagcaagatagcaaataaattgcaatttgcttgccaaggacaccaagtttgcaccccaacttagaaaagaatacagtgatggattagctatgtctgccctgggcatagaaaatggcaggtagcagcacacatatttgccaaagaatctatcattttataaaacagacttggggtttatgatgagaagcaacattgacaagtctcttttaagcatcaataaatgcttgatgatttaaaatagataaccaacaaggacctattgtagagcacagggaactctgttcagtattatgtggcagcctggatggcaggggagtttgggggagaatggatacatgtacatgtatggctgaatctctttgctgtccacctgaaactatcaagacattattaactggctataatccaatatgaaatagaatattttaaaaaacaaaaaatactaagcactgtattaggcactgtgaataaacaccaaggagtttaagagaaaggctttgcctgtataacttacaacccaatgtggaaaataagccaaacgcacaaacagcattttagatgttaatcgtctgattctgactgcaaacattgcacagatttgtaaaggggcgaatcacacaataaaaggagtccgtctttgtgaaccgtgacatctttcgagaggactatcaagggaccaaatatagatgggaaagaactttaaggaattcctatatagtttcagagtg

SEQ ID NO: 45330 - DNA, 1955 bp, Bovine  19866881254892
tgatgggattggatgccatgatctttgtttcatgaatgttgagtgttaagccaacttttttcactctcctctttcaccttcatcaagaggctctttagtttctctttgctttctgccataaggatggtgtcatctgcatatgtgaggttactgatatttctcccagcaatcttgattccagcttgtgttttatccagcttagcatttcgcatgaagtactgtgcatataagttaaataagcagggtgacaatatatatgcccatgaacagtatgaaaagatcaaactattgacaaggttaataatttttattatatatcaagtcaaggtaagatgtgagaaaaagcaaagatagcttttcctactccagctactgcgtactctctgagaccatcctgattcaagcactgcccgctctctgtcccccaaactccttactcttggctaattttgaccacatttttattctttgccctcacttcagccccagatcatcagcttttctgaaataactaatgcaaggaaacgataaaggccagaaacattggcacaagatccatgagggtgggatctttacaacttgagagcattatgtttgaaatcctatttatgcaattcttggaacagatttaaacaactcatgggtaccactcaaagaattatttttacagcatgcagagtgaaaattttataacgaagggaactggtagtcaaagtctttatcaggaagtcaaaaacatgaaggaggacatgattgtagcttctttgagtgataagatccactgaagtagaacatgaatttctcacatgttgtgtgaaagtttaaaatttctgatcatggcaccgaataactttgtgaaagaaaagcagcccgcaagacatgaaaggatcatttataataacctttcacactgaaaaatgtttaagaagtgcttatttggaggtctggggaatttgaatttaaagaaatgaactggaacatagatttgaaaaatactacttttctaaattctgccacttctgattagctcatagaggaactttataatactaaaaacagtccaggactattaactccaatttaaattttcttagctatcagaaattcagctaaaagttcacttactcttaactttcctaaacctgtttccttcgattctttgctccagtcaacttaccaggcaccagatgaataaaatgaatggttatttgaggtgacatatcaaatgatgaggagactctatctgggtaccagacatagctaattgactgtggggattctaatagttcaaggatgagagaactttggcatagaacacatgctctgaagagggccaagtctaagacaaatatcgcactctaatcaaatggaatttatagattcagacgttgacgtgctttgcattgtgagctcttgccatcttctttgtatttttgagtttttttgatttcctacctactttctttcttaaaataatcttcagcttgcttctattctgttttttttttttaattgtaaaataattgctctacaatgttgtgttggtttctgccatacaactatgtgaaccagtcataactatatatatatagtccctccctcgtgagcctccctgcctcctacttgccttataggaagtgtcagggtagtaatttccctccatactcccaagctctgtaaaaccaagtgtttgcctgtctgtaggctgtgaaatgtgactcattcagtcattgcatttttgttgtttgtttatttggggtgggcatcctgcggtccccatgtgtcacctccgagggcagtgagtctctggtcactgacccacagaggccggcgtctgtggttaatgaggtcctcctgtctcctgctctttcccaccgtgccactcaccaggtctattcctggaggctttcagacgctgggccctccctggagggagctccatctggcaagcgtca

SEQ ID NO: 45331 - DNA, 2468 bp, Bovine  19866881276607
ctggaaggctcttaaacctgtgatttttttcttccttcttttttggttcttgacagcataaaaggtgaggcgaggagggtcagaaagaggtctgtctgtcattctttacttggacagaaggccaggcagtgctacggagaaatgttgttttcttacaaagattacctgttcacttctattagtcaaatgctctgaaaatgattttgttgtgaaacgctggggaaaattgaagtcagttaaaatatgagccatgaagcgtcagagccgcaggtgtggctggagtctagggagggggagattacctcctgtgtcccccttctaaccttgctgaaatgccctgatcccagagaatacatccaagctgctttgctcagagcagcatgactcctaggacatagatctgttgaaatatgaaccaagcagggtgtgaacaagctcaaaatatgctgatttccagatgttccttgattctctcaaacactgattgcccccaaagaccatcctgagttggtggatggcagcgattactcatatttcttttctgcgatcacggccgtaatttaaaagccccatagtctttctcatgagcctatgtctgggtcttgtctaggtcatatattacttcgcagtatgaaaattgcagagtctcgctggattgggctgtaaaatatctgcacactgatgccagttttttgatttgttgctcttcccaggatgggaaaacttttcagaaatctgaatgaagggttggtgttttatagagtgaccttccttgaaggagaggtcgtggaagatctcctttctctgcaacaacaacaacaaaatcagaaaaaccagaggagttcatgttaacatgttttagggaaagtaaaagaatccaaagcagtgaatttgagtttataagaggaaaaaaatatatttgtaaaacatgcttacaaccaacattattattgtgttctaaaatctcaaccacctgagaacagataaagaaatctggcttgtgaataagttgggatggcaaatgctaaaacttctgggagcttcatttgaatctgtttatctggtatctgggataaataaggcatcagtgaaagccttatgaagggtcttccacaggtttacgagaggaagtttaatatctaccaccagaaagatggtaccataaggaaaaaaggatttccaccctgttcagagacaaatttgaggccaccaacccactgtcccctgagcctctgaactgacacatttcctccccatttcttaggaggagaaatgtgacagaactctccagttgcacggcaagaaggagaaaagactttgatctgggttcctgtgacagcactgactcatacaggaaatgaccttaatgtctcagagtcttcagtgtctcatctatgagaggcagttaataatgcctgaggaggagaggttaagcattccgtctaaaatcacacctggttggggcagaatgaggacttgaacctgctgggctcgcaacaaagatagtgtttaatccacggtattaatacctgatgaggagtaaatgggctaagacccagaaaaccctcacgactgggcgcagggcaggaggagccctctgtgaatagctgctcccattgtctttgcccttactccctgcacatctgctgcatcctctgttgcccccaaagcatctgatgcattctgtgacctgcgatggcacgcaattaagtaggagcaaaggtgattcctgtgcctttaatgcttctgccacaattatggctgctctgtccttgtatttgtttgcctattgcttcttccttgcaacggatttcttctcacgctgtataatattataatctaagttcttcattattgatgatcattttaaaaaatagaaatcattcttaggtagtcagctctccctttggggtcggggatttagaagacaatcgcagtctcctcgggggaagacctcacctagagatcaccagcatctgggtgtagctgacactggagggtttgggggaatctataagcagaagagggtgacagagaatgagatggtcagatagcattactgactcagtggacatgaattagagcaaactccgggagatagtgaaggacagagcctggcgtgctgccgtccatggggttgcaaagagtcgaacatgactgggcgactgaacaacaagcagcacaaaatgcaaatgaggacagagaacccactgctccaggagcagagctcaccaacactgcttgcttacaccatctttgagcagcacagactgcgtgctcttccacctgcctgctctcctctatttcagatgatgtccttgaatccacaccccacaccagaagagacgttcttagatctaccagatcctgtttttagctactcttggtcttgtagttttctgggcatccatgttccctagtctccaagtgcctcatgatgatatccttgaaccctaactgtactctaa

SEQ ID NO: 45332 - DNA, 1616 bp, Bovine  19866881289121
atatgggaaaggatttgaccatttcctattgttactattgacattggtttcattattcttttttaagtaggtattattattttctccttgaggagaggaatatattttaatcaattataagccttcccaaacatatatcacagtataaatatattaattgaattgaactcattggctttatcttgcaagttttacatcattttttgtgtcatatttttaattttagtagacactttcatctttattttatagacaatgcaaacctacacatttatgcccagctgatttttgaagaatgtctttaggaacacatgctcctacaaaacagagcctaaagaagactttgaagggctgactgatttaatcaaagtaagttcttttctgacagaggccttcagtcgaagaggtatctttttatatgttgggcatcagcaggtggcactttttatatcacactttgttctctctggaacacatcctcccagatgttaagggaacggcacacggttttagaagtccaaggtagcaatctactggacagtgttgcaagtagtttgttagaaataataattaaatgaataacatgtgtgaatgactatgatttggagtgaattcccattatctttgtgataactttatacccattgcgtgtgttagtcactcagtcgtgtctgactctgccaccccatagactgtagcccaccaggcccctctgtccatggacttctccaggcaagaataatggagtgggtagctgttcccttctccaggggatcttcccgggtccagggattgaacctgggtctcccacattacaggcagatttttttttaccatctgagccacctaggaagcccattgctttcttgcattcttatatgctcttttgagcaggagagaaaagtgaaaggtacaattaatgcacaggaaattattgacaccacctgagtgaacatcatgtgtcctgtgtgctagggcaggagaaagattgagagctgtgggttgagagttattcatcaagaaattgaccatgcacgtgagtgaagaaacagaaggaaatgactgtgcttgttttgggactgctaagattgcaaacagagaaaacatgtctccaactacatccttccaggagcagcaaatggaatcagaatgcaacttctagggcagccccaactctcagtggttttgttcactggcatatccagcaaaataactgaagaacagtaattcacctgggatcaagttccaaatatggtccattctgaggtgattagaggtgggcatttgtaaagctgagattatatagtgtaattgatgatgtcagagttatttttggattcttgattctgattccagatgtttttcaatagaagtaggcagggtgaatttaaatgggaagcttagttgtcagtaatattacctagtacatctttagttgggtgggtattttgaaaaattgtaaggtgtcatgtacctttgagtgcaaattggtcttgtgaataaccattattcatagccagggtgatcatgtaatttgtcattcagaccagggacactctccagagagggaaaggggtactattaataattacattggaacaacaggtataactggg

SEQ ID NO: 45333 - DNA, 870 bp, Bovine  19866881298211
attgatatcatcttactgcttttcatttatggtaatagaaaagggttactggtttcacatgattttagttctctggaaataaatgacacaaaatgaataagtcatgcactactgtaggtttgcagacggggcacaatattactaaattatgtgctatgtaaaagaggaagctggaaagaaatcaatctttaactaagcttgagtgatccatatgatatgattctaatgtatggtttgggggggtggggggtgggaaaccctcctgtgcaagagttctaataacctagttagattggtaattaggacacagggacaaccaaaaggggaaaaaataagagtgttgaacagcagccaagtgaattttagaataatgaagaaatatcaaatagggtaaatcaatggagttaaaggacacaaaggggaaatgaaaaacattcaaagataaattaatgtagacccaagggttgtgcaagcaatttactataaatatactaggaaaaaagagacagatgtaggtgaacaaggaagtacaaaattggtaaagccttgttagaagtagaaatgcatagagcacatagtgtggcaaagcagcagtttggtgaagaagaaagaaaagcctttaagaaaaaataaagacattcttttgcagatgacatgctgttgagcaaaagctcttgctctcaaatcatgtattataatatctttataaattggatgtgaagtaaatttggccagcctcatttttagttaataaagacgaagtttcacgtacagcacagtgactatagttattaatattttattgcatatttgaaagttgctaagaagtaaatcttaaaagttctcatcataagaaaaagaaatgtataa

SEQ ID NO: 45334 - DNA, 1884 bp, Bovine  19866881303578
gacacaatttttgacatactgggaagatagattaaaagcatagaaggaattcaatttaatggtaggtaaaaaataatgtcaagtgctatgtacatagcaaaattctgagcataataatttttggaggtaggagtctgagcaaatccattttccaagactatcagataaaaaatgacatatgcttgttgttttttttaaacattcttaattcgataattgttcagggttaatgggcatcttaagtctcttaagctcagtccaaatacctgaatacataaaagttgcatgagtgtaccttcggatattacattctgttcttaggactgtcatcgtttccctccagatcacattttttttttaacctgcttctgtgtagtctgatgatatactagtcagtactcataattgcagcttagcagatgtttctgttctaagactgtcttgaaaatgtgcattcagaaagaagtgttaagtctatgtgaaaaagccaaagaagtccacaagtattagagatttcctcagtcattccgtctaaaagtgcatgtgcaaactcacaaaccacctttaaatgaaggctccatgttcctattgggtaatatagccccaggacatccagatgagatactgaaaatgcagaagagtattctaattgttttactttaaaaaattcaaaatatctgcatgttttacaaactattagtagtgttgccttaatttgttttcattatttgaggaaataaagacaagctttatagattctgaaaatttgctgtgttggatcttttatttttctttaaagagaaacagagaatttactgaaaagacacggaactggtctgtttcaagtatagctaatcttcaggaggttgagtggtgtagatagaccttgagggcaaccacaaccagggacttaaatgtcacttttctcctttgctacacagtggctttcttcacagtgtataaatcctggctgcaaattcctactagcttatattatacagattaagccatcagaaagaggcaaatagctctttcagaccctaattcagaattcctttaatgcaatttgttcaaccatagacacccagctcattccaagaggaatgtatctgaactaggtattgcatatgaaagtaaggagcgagcctgggtgtccagtctgtctgagtggtaccttgttccacaggttcagacacacacatcacttcacagcctttcaaactaaaggctaaatcaatggttctcaaaccttgcgcattagaattccctggggagccactaacaaacaccaatgcccatattccattcaagaccaattaaatcagactccttcagcaaggggcctggaggtcggcatcctttaaataccatgccaggtgattgtagtgtgccctcaggttgagaggcactgggctaaatgatacatttaaacttaatggaggaaaaacaagataaccccatgtgtgcctgctcaggcccttcagttgtgtccaactctttgccaccctatggactgtagcccaccagtctcctctgtccatgagattctccaggcaagaatacctgagtgggttgccatgccctcctccaggggattgaacccagggatcaaacccgggtctcctgtatctcctgcttgggaggtggattctttacctctgacgaggaagcccataaccagcattaaactccagtttaagaaaaggaaagctgtatagaagtcccaattgatctcagacattttaaatttgttacaacagactttaccaataactgtctcacaagaaacaaattaaaaatatgtctcaccttttcccatttgtctaattaaaagattttatagagacacctgaagatattttcctgtcttggttctaatccatg

SEQ ID NO: 45335 - DNA, 1157 bp, Bovine  19866881312801
aaatgagatacaactgtgaagacaggatgagagaaaaggcataatattccttcttcacaaatgtattgctatttgaccccacttacgtaaaagtatacatgtaaatgtatgtataacaaagaggtacatgaaaagacagtgctcacaatatcaacattggttgtctcatcaactgcattccagtggaccttttccttcttccatgacagttctgtgaatagttgcaaaagctttacaaagaacacacatgacttaaacgatcagaaaagaagtgattctatcttcactccacatgaaaccccctaaaaaggaggacaatgttttcttgaccatagaaaatatttcttagggtgcttttatgctatcccatctccctaaaaaatggctacagaatgcttcatctgtcatttcttgaaatagagtccctatgtggtattttacatcaccagtttgatctttccatggttgaagcagtatcctttgttggcaaagaggatacattgaggaaacagatttaaatttgaatctgtacttaccaggtgcatgaccttataacctaatcctttctaatcctcaaatttcttctatataaaatgaagataacctctgcctgataggtttgctatggaaaacagataacattcctagcacaaagtaattacatggtgattcatcatttattaatcccatttttattattgttgttattatctatgctacctttcaaagtgcacattggcatactctccaaagatgtgtactattgtacatgcaaaagtaagtgcttttaactttttttgtgacatagacccttttggcattctcctgaagactacagacagcttctcagaataatgtctaaaaaaaaatgcctaaaataaaatacaaattactacataggaaactattatgttgaacttaaccaagatattttaaattgtgatagatgtagttctttattaaaacattaattgttaaggtctgggagcagatataattgctaataattattgggaaatactgatgagtgtaaatgtcactttgagagatttgcacctacaaatgtaatgcactatgaatatatgtgttaatcctattggtgataaagctatagttattgataatcctacagttgcgtcttgtctactttcataatt

SEQ ID NO: 45336 - DNA, 1258 bp, Bovine  19866881337081
agggtatgaaaatttagtatatcttatcatcaagttgcctgaaaggacagtgagccttgaaaacacattgcttccaagtgccgtggaaattaaatgtggaacagggaataatattattatcttacattttgttcattcaaagactctatagagtcttctttagagactccatcatacttgtgatgaatgaaaatgtttctaaaattcaaggtatggtaggaaaagaaacagatgattcttgctgccttattaaaactcttatttccctttagagtttagtgacaataatacatagtgattctttctacctatgaaagcagctaaaaataacaacaggcgagctcaaagtgcttttcatttaaaatccacatttcactgtgcatgtgaaggaaagctatgcactgcctgctataaagatttattcagaagtccctcctactaatgggtggctttggctccactgcataagtcctgactgatcttctaaaggtaatgaccctcctattccactaagcctgctggatttagaggggcccagaggaaggtaagttaccagttcctccattcaatatatcagttccctctcctccccctgttctgagaatataaggaagtataacaatgtgaaataaacatctacttgtcttcactttgttttgcacatgataacacatctaagataattttatcctgaaagcattttttcttcctacttctgtagctaaatgttttcttatttcccaacaccaattcttcctgtcattctctgggtttgttcagaaaactttcactggtgttgacagcctataactgtcccttgaaagatgtacccaggatatctctaattaccagtgctccacttcctggccaaatgctcatggtaattggacagtacaagaacttcactaacctgggtgattctccctgcatgttccagaatcttttgattccaggaccagatttgatgaatagattgaggtcactgtcttccttattcgggtctttgctcttatatttgatgttaagcataagacataagcttgctaataaaacatggaaaagtgggtgtgtgatgtagaacactacccatctggagagggttgagagcatcagagttgggaagatttctcctttgatgtgaagccttaggtctacctctgtcaactgcagatgctggctgcacttctaaaacacattaagacttttaagatcgcaaaactgctgctgatgaatttttcaatggtgtatttcttgagta

SEQ ID NO: 45337 - DNA, 1557 bp, Bovine  19866881413596
aatgagtgtttgaataaaggaatgaatgaatgggtaacagtgtacagtattatgaatcatgaaagccaaaggaagaactgcaaaaaaaagtgtggccactggtgtaaatggtgagggtgactgcatctaggacttagaagcccatctgggtgatttttaagttaacactggaggattatttgttcaaaagttggttcactttttaaaatttctttaaaaattttacttattttatatatttatatttatttttggctgtgctgggtcttcattgctgcctgggcttctctctaatttcgatgtgcgggcttctcattccagtggcttctcctgctgtgaagctcaggctctagggcacatgggttcaatagttgcaactctccatctctagagcacaggctcagtggttgtggtgcatgggtttagttgctctgtggcatgtaggatcttcccggaccagggatagaacccatgtcttctgaatgcgcaggcagattctttatcactgagccaccagggaagcctccaaaagttgattttcaaacaaggaaataacttagtgactagagagggaattaagattcaaaaaagatattttgtttatttttacagaaattagaagacatgagcatgaacatttcttacgccaacatgaataataaataaatcaaattgcagagacagtccaaaatagtaatagttttttatgtagtactttgcagattccaaaatacttgaattcatgtgatctcatttgagacttgcaatgaacccttaagattcccagtttatctctggaaatggaaagcagaaaggccaaatatcttgtccaaagtcttgcaactaggaaaatgggcagactagaagaaatctccaggtttatacctatttccatggcagcattatgagaatacattcagagcaactacatgtttgtttttgaggactgagtgacatgggttaatttaatggggattctgttttcaagtgccagctttgtctatgtaaaaatgttcaaatgctgaaatttggtcctatctgtcatgttcatttactgtagctattaactagagccaaacaaacaagtgggtggttaatagcctttttacccttaggaaagaaagaatttcaatatcatttgcatttctaaatcaaagcacctcagcacaatatgcctttaaaaaaaaagcagacgctattgaagattattgaaaaaaacagatataatttagacacttatcagaaataaattatgttctcagaaagtgtttattttaagaagatatacagttttccttgagaaaagacatcagaaaagccagacatagataagttggatagaatggattgagagtgaaataataaaacagtctaatcttctagagctcattttcctaactgcatattttgctgaacacttgatgcaaaaaaatgagactaaaggaattccagatgatgaaattgagtcctgggaatgaagtgacttttttatatcttgtgactgattagttacttgtacaactaggaaaagagccctcatttcctcgtctatttttt

SEQ ID NO: 45338 - DNA, 1346 bp, Bovine  19866881414155
aatgatgaaaccagactgtaacctgatgctcttgacttacatcagacttggaaatagtaatgtgatagcaagtcgatatttggctgaaattctaacccagcttttatttgttttcagtggacgctggctaaaaattactgattttctttcaacaaggaaattgtgatattggtggctaaagaatctagccatatttttggaaagggcagcatcagtgtttaattgaatattgtccctaaattaaagggacatgagtgttttgtgcaaaaaaaagttattgaatcaatgaaggcatattatttattctcctcacctcatgaagccctggtagcttctatcctgatgtaagcacaagcaccctattctccagagtcatatatggaatatggattattcagaaactgaaaaatttagttgaagggatatattactttggcagttttttctttatatttatttgagctggtatttattcatctgaatctcaatatgaggttttttgtttagtgtattcttggtcttattattttactttgcttcttggtttttatttatgtatttttatgatatacatttgtccagagatcttggcagcaagtacatttttaaaagcaaaagcaaaagaaaaaaaaaaaagttgagcagtaatttccatcctccaaaagaacttattccatggtaacaccctcagaattctcattttgactgaatgcggaaataatttatacatggcgccataatatttttacgctgcaaatctgcttgtgttttctttttaaatatcatttctcatctatatgctgtagagatgacaataatgtaatgatatctttaaaatatggcctaattttctcacagaatatacttatttgaaaagcaaaaatccctgagtagttttccttatggtagcagagtcttctaaatttcctatcacatgggtgctgtgtgtgtgtgtgtgtgtgtgtgtgtgtgtgagtgagatttcaatttggaaacatttattcagaacctattgtatagagacatctagctaagggtctaggtctagtacatgcaaagatgactaataatgacaaaaatatggtcagtccatcacagaatttaccttgttgggggtctagacatccgtataaagctaactctaagggagccacaattgactctgccatatagtggaagtccagagaaaactggaaggagtcatgtattttattgagacactagtgaagaaaatcaaaaatataagtgaatagtgcttgctatgatagggcttccctggtgactcagtggtgaagaacctgcctgccaatgcagagacatgggtttaatccctagttgcgaaggtc

SEQ ID NO: 45339 - DNA, 947 bp, Bovine  19866881446189
ctcccaatgaaggggacctggcttcgattcctgatgggggatcccacatgcagcaagtaaaatctggtgcagccaaataaatcaacagaaagatgaccttaaaagcatgaattaaagggatatcagacctggaaatctgaagacatgtgagggccagcttgtttggaccaatgaaagctcagggcagtctccctccagccccttgggcatctcacttctgctgagagcgctgagttgtcactgggctccagtgctctcaggcaactcctggcacatctaataggacaaggacagtcacttacagtcttttactcaccccaagaggtgatttgtcagcctgttggctcctaattacttggcattagcatattcatatttctgtgtttggttttaattaagatgtttcttccctaaatcagaaacaacataagaatgtaaataagatgtctcacacactttgattgtctataatagtatatcttctttttttcttgtaatacatagagtaatctgttgaattaaaataaatgaggactcctagcttctggtgggtgggatattagttctagttttaaaaagcgacaccagagcagatagcagagctctgtgtatgggggttgtgtgtagggttccaatagtttgggttattcagtttcagctgcctcttaaaaagtgagtcagagaaaatttgatgtctgcttttcaggactagaccacattttcattccattatttttataataatatgtgatagtaaataattctaaagagcccaagttcattgctgcattttgctttctgtcagagaaaaagacagagagactgctatctgggcttcattgtaggatcagttaatgaattttcaattcccattgcattcatgctttattatttaaatttacagaagcttgtgctgtcgttcccaaatgatgtgtgtttttttgcag

SEQ ID NO: 45340 - DNA, 1473 bp, Bovine  19866881447066
tgcttcctttgagaatgctatggaatggatatttggaaaagtcccattgaactgtgagagaggcttgcaaagagatttagaaaacttcttcattggctccttctgcctgacttgagtgttcaaaatggtcttgaaaactcagaactactggagtgtgtgccttgcagctcactctttgaactccagttcaacactgttcttagaagttgtgcccagctctccttaggatttgtcatgcagctttaaaaattttttaatttatttttaattggaggataattgctttacaatgttgtgttggtttcatacagcaacatgaatcagccacaagtccacatgtatcccctttctcttaaatctccctcccaacacacccccatcccacccctctaggttgtcacagagcaccaggctgaactccctctgttatacacactagcttgctgtttcacacatggtagtgtctatatttctatgctgctctctcaatttatcccacctctccttccccagctgtgtccacaagtccgttcatgacatctgcgtctccattcctgccccgaaaacaggttcatcggtaccatttttctagataccatatatatacgtcatgcagccttttaaaaattcttattgtggttaaacaatattttttaggtatatagagcagggttggtaaccgtatgtacactgttgtacagcaaatctctagaactttctcatctttcatgagtgaatctctctatccactgaaaaactcctcctccagccccaacccttggcaattatcaatctaactttctgtgtctagaagtgtgactacatcagataccttgggtaagtgaaattatctaatatttgtctttctgaatagtttatttcacttggcataatgtccttaaaactcatccatgttgtagtatatgaaaggatttccatttttttcccagaggtatgttacccttcaaaacatatatattttgtccacacaatttaagtatttctagtgtctgtagttgatgatctctttattttctgggaaggagagaaacttccctgaaaattttgaataaaggagttactctcctaggtcaatgtccaagtttggatcccatagtttgtgagataagccttaagaggtttatgactaatgagaacctattgtacagcacagaaaacgctactcagtgatccgcggtgacctaaatgggaaggaaatccagaaaagaggggctacatgtatacgtatagctggttcactttgctgtagagtagaaactaacataacttggtaaagcaactgtactccaataaaaattaaaaaaaaaacaatacttgggtcacattaatgtgttatcacttgtacctctaagaaagtaacaaaaataatgtaaaaaaaaaaagcaaatagaagatacactctcttctccctcaatttcaacatattttcaggacagagacaaattttggctt

SEQ ID NO: 45341 - DNA, 1256 bp, Bovine  19866881453266
ttttgcaaactgaaagtatttagaagctctcttgctattgtatgcctaacaaaatatggaacgtaggattctgagagactttgtggcatcttttcatttaaatctttaagaaattaacacttaatctaattcggcattccatacttctagaaaaccattcatttcactgccaaacttcagcttcccagcaccaattacacataaagcatctctatgaaggaccaattatttatgttgctcattgcattttatgttcggaaatcagtattgtctttctccagtaattaaggtgcaatacaaattaaatcaatcttgattttccagaatatttgagtcatcacttgttttcatagctttaagctccaagtctttccttttgaaaaaatatttctgcattgctttctgtgaaatagatcagaatgccttgttttccctgagctttctccccccagagggttttgtgcatgtatgtgaatacaccttatattaatgaatgtgaacccatgttctgtacacactaaacacaccaataacatataaatgcctgcttcatttgtttccatacctttgttatcaatattattcatattggtgagctatagtgaactatatgagccaggcagaaagctgacatcactatcagttaatgatgccacagcagtcatcacccacatggatgtggtcaaaatattattcaaattgtactcctgctttttatcatcatcccaccccatcatatgattttttagactaatttgacatgagaatttttttgtatcctaagggaattagtttactctagttaacccattccagtaagtattttggaatttcccctttcctgcaccaccaaattaatttctctcacattagcatagtaataggggatgcgatgatactccattgtttttcctgacctgccctcttttgctttgaagtcccccaaattctgtaatcacatcataacctctgttatgagtagagaagaacagactcactgaaatcggacgctagaaacagttgggtgatgctcataactgcaaacacttagcttattgaagtgcctctatttacacgttctttagttataatatgtatttttctaacagaaatacacgtctgtaattggtgtatattatactttgtatatgttataacaaaagctaaacagaggctaaagtcttaagcagagaagaacggattgcaaattcatgagttcgagctccgcttatggttctgtattaaaggacagacat

SEQ ID NO: 45342 - DNA, 831 bp, Bovine  19866881486013
accttccagacccatcactcagctctaccagctcagtccctctggcactcttcagaggttgatcttactggcatgaataaattccgagagcccgagttaacatggggccatttcaatgaaacgaatggtgaaggtcatcaagtatgaaggtttgatttccatccaaggaacatgggttgtttgaagtctactattctcttttttttggttgtgccatgtagcatgttggatcttaggtgcccgatcagggatcgaacccctcaccccctacattggcagtgtggagtcttaaccactgggaccatcagggaagtcccaggtctactgctccttgcactggaaagggaggctaggattggaataactaccgttgccattgcttgtatgttaccactttctggttgcaaatcatgtgactgtgttttatttcagagcactcattatttcctgggggcaggaacctgggtttgaagaaattagcatgcttttctcctgcctccaacagtaggagtgccaaaggaaagctctttttcatcaactctgggccacaaaataacttgaagctgcgactatgccagtttatccccagaggtctcgcctgcccaatgtcaagtcttcagttctcattcaattcccatcactctgaagcaaaagtgcagtttttcattttctctggaactgcgaatgcaggaagatgctcaaataggagtctccagcaacattaaagtgggctcagcacagcagtcttttccacccacgtgacctgtcggaagcgcctctgggtctccagagagtgtgaataggattcaaagagaaggactttctgtccaa

SEQ ID NO: 45343 - DNA, 1392 bp, Bovine  19866881507851
agtcagatctattaaatgtgtgtatgtgacacttacttgacctactacgcaagctattcctatgatcaaatgagatactatgtatccaactgttttgtaaaccgtaaaatggcataaaatgtaatctcttagtaaaatttttatcattatattcacagtaggaaataacttttataaaattagaaaactgtaaactaagcgttttatttgtattcctataaaaatagaaagttgggcatttgctctaagatgtttgtatcaattcttttcaagccctttatttatttatttttttttttaatttgtttttatttttactgggctctagggaatgggatggggaatacctgtgttaagttatgccccactagggtccattctaactttcctgggatagcttttggagctttttctttttcttggagccgctgctcttgctggcagcagcctcttcaggtccactgctgagtggctcctccttgggagacaatgtccgctttttcttggggaccctcttgttttctgactcatcagggtcagtaactggttcctctttgggaaaagatttcttcctcttgggaagacttccagtaccagctgtctcttcaagatcactactaactagctcttccttggaaaaagatttctttttcttgggtttggaaaaagacacagaagggtcttccattccattctcctgaagaacctcctggggcttttgctttttcttctttttgggtctttcacttgtctcctcacactcctccggggcactgctattttctgaagaagccagggcaatcacagccagccttttcttttccttcttcaagcgtttcttctcctgtttctcgagcttcctagtaaactcagcagccgcctcctctgcctgaaccattgcctccttcatgacatccacattctttcggggaatctctccagtctcataggacagccactcctcaacttgttctcaaagcttctccccaaaaacactggtgggcacctcagagaagcaatcaattcgtgaggcaatactgcatttcataacaaaaatcttatgtacagctttacaaagataagtttggattgtatttacattttattacaccgaactatttggctacgctttctagacttctgttaacatgttatacactccagcttttgggcactacctgcctgtctctccagccttctgtgttcttcagagacaagcggccacccccacctcagttgctgtgcttgctgtttcctcaggcaggtagagtggcaccacacccttgcacggctgcctcattttcctggtgtctgaaaggcacctccacagaggccttccttgaacccagtctgaaaaggccctccatcccagtcacacgctctcacatcatc

SEQ ID NO: 45344 - DNA, 880 bp, Bovine  19866881584236
ctgaacttatatttatttgaaaaacaaatgtcaaacccaaggctgttagaagttcaaatctagaggatgtattttttctgtaactattgtgtgttaatgatgtttcacagagccctaaaagcaggtaaatctgacctaattagaataatgactgaagaaaaagcttttattaccagtgatatattctcgtttcaaaactgattaggtatgccatataaggagaaactgaacacacacacacacagagaaatggcttattgatttatgtattttgttgttgcacttttgtaggctttatttggcatactaaagcagtcacacctttgctctaaaatttagaggatatatttatttcttattgtgtggaatgcacataactcttagaggctgccctgattctctggggtattaggtacattttttccacatttgtttttggtttaaactgaatagcttccctttttgtttatcagcttaaagtatttcagtatcacagaaagctggaattttgtatacagaaggatttgcccaagttttgctgtttgctttctctttctctttttattctttatcacttaaacccatccctttccagaaaaagaagagaaaaaaaaaaaccccgttattttctccagtgccttagtaggtttaaatttattggatacaccttcaaagttatatgtttaattgcatgatacagataaagggacactaattttgctgagaccttggtgaaaatggtggagtgaattcatactttaatgcatcccctctctgtctgcaaacagagcagtgacagaaaaaccataaaaaggggtgggggaagccatagagaggaagtgataggaaatacggaagaacagttacaaggtataaggta

SEQ ID NO: 45345 - DNA, 1617 bp, Bovine  19866881725027
aaatatttcattgcaaatgacactaattagaccatttttttagttcttgctttctcagagggcagagttcttaggcttctttttccatttaaaccttgttactttctgtgactaatccccagggtaattaagatcattttaaaagttatctaagaaaataaaaaaaaatggctagattgggcactatgcagttttaccccagaccttactaaaaaaaaaataatgtaacaatgtaactagaactttggtattcattgttattccatttttttcttgctttgccttattttttaatttatcatgtagttaaagaaattgacttattaaaaaaaaagaaattgacttattggtttacaagtctgtgaattttagatgtatagatttgagtaatcactaaaacattcaggatatagaaggagaaaagttttctgttggatatgtgacttaagaaaaaatttaccagtctgctcctggtcctttgattctctagggagtgtctttcaaggcacaaaagattttccatttttttctcttacagatcatgagtttggtgtcatattaatgtctcttcctaaccccaagtcatacagatttgttcctatgtgttgtagaagttttatcattttgtattttatttagatctatgatccacttttggagaaggcaatggcaaccgactccactactcttgcctggaaaatcccatggacggaggagcctggtaggcttcagtccatgggggttgtgaagagtcagacacgactgagtgacttcactttctttctcttttcactttcatgcattggagaaggaaacagcaacccactccagtgttcttggcctggagaatcccagggacgggggagcctggtgggctgccatctatggggtcgcacagagtcagacatgactgaagtgacttagcagcagcatgatccactttaaggtgtgaagtttatgttggggtttatttatttatggcatgtgactgttagctgttcttacaccatttgctgaatagaccaccctttctccttttaattgtttaagtatctttgtaaaaaaatacaatggccatcacggggtgagcttatttccgggctcactgttctgttctgttggttaacgtgtatatatccttctactaattccacacagttttgattgctgtagtttgtagtaggtcttaaggatggataatgtaattgctccaactgtgttcttcttttctgagatattttactaattctaggctctttgacttttcatgtgaattttattttacttaaaaaattttgttattattattttggccacactgaatggcatgtgggaccttaagttctctgatcagaagttgaacctgtgctccctgtagtgcgagcacagactcctagcactggatcaccagtgaagtctctccatgtgaactttaaaatcagcttatctgtatctaccggagaaaagaatcctgcagaggtttaattggaattgtattaaatcttttggtaattcaaaggaattgacatctttactatgtaagttttctgattggtgtatgtgatatatctctccatttatttggtcttttgtgatttctttcattaatcgttttta

SEQ ID NO: 45346 - DNA, 753 bp, Bovine  19866881794640
tgagctcagccatcattgtgaatttattttttccaatctctctgtatttgaatgacccctggcttcgctgaattgtaaaacaaccaaacaaacaaaaaaaaaacagcatataaaacaaccccctgaagccttttttaaactggtacacagctttcttcattattaaacagctgggcctatagctatatgaaattttattaaattgaccttaatggcttagcacaaaaaaataaatgtttaagttgtaattttcaaccttatctaagaccgctcctattaaagatttgatattgtggatgtttgaagcaagtcttagagcaattgaataacctacattttatctgtatctttgaatctttattttggaatcacctttatgtttgttatactacttcttattatcatagtaaaaatttattaacacaaaataactggattttgtttgatatgccagaatttttatttctgtttgattgcaaccttatcaactaaaagcttgcagtttgatgacctatgtgtgtgaagcactgttataggcacagcataaaaatgtgcccataaaacaaacgagcctattgtcaagggttttataggctaaaaaaacatatagtgatactttcttcacttgtttcttgtttttttaatgaaagactttcacacctctgaggcccttgagcatacagaggtagagaaatctccatttttgtaacacaccccagctgagtaggcatttttcagaccccttccccaaaa

SEQ ID NO: 45347 - DNA, 764 bp, Bovine  19866881880003
ctatggtttattttttgttcacttgatctgtttcaggatgacattgctaaactctttttcctatccctactccttttttattcctcttgtccctaacagaagtggcccgttttctgtgcctatgcttaaagagacattctcaaaagctgttttaaattcattctggtatgtctttgtaaactggaattatagtcaaatcaatattttttctattgaaaagggtggatgattgtgttatgatgcctcaacccagatgcaaataaccttcatagagacatagcttgtgtctgaatgatgcttttgaggatgaggggaggccattgaaagtgctaaggctatctttcaaggaggatgccgatttcatttaataaatatactgaatttaagtgaaaatggcaaggtacctggaaaaacctgagcaaaggcacagaattataacagggcatatgtgtttaagaatagcaagtaatccaattctcttgaggagaggattttataggtgttaacgaggtgccttaactaacaagatgtcattaatatctaggagtaaaagagtgcatttcactagaaagccagtggttagaatgttaaacttaagatccaaggtgacaaatctggcagcatcaaaagactagaaaccagggaatcatttttgattatccagacataagggataagggcctagattagagtagagggaaagaaatatatcatagggaatgtcataaaggagtagaaagaaggataagtctttcaaacatttt

SEQ ID NO: 45348 - DNA, 875 bp, Bovine  19866881900386
ttgtttttaaagaaaacatgtatcttgaaaacaggctaagaaattttcgtaagaaagaaaacatattttgaggctactaaaagaccattcacatgaatgggactaactttaaagaaaaaccaaggggaagtattctagaaaccaaagggtgatatatccatgcatgttcagagtactgcttgctatgcttttaaaaaatgtggctgtctggtaaatgctaaattaataatagtcaataaatttgcaaaagttattttactccaaagtctatgtagctctgaattctgtacttgggacacatttgcctaccccaagaacctcttagaacagtcatttagaatatagcaagatggaagatataccagaagatgcatctcatgtcattattctccattcttcctgattattgagaagtttagatctaagtttgaagtcacgatttaacaaccccactgatctctctactgttagctgtttaacttcatctgtttaatttctgtttatttcatatttcttctctacatattcccagatgccttcaggaaatgggcccattttgaatacatcacataaataagctgcagtgggtgaaggcctcctcatttcaaaaatgccatgcagcacaacagctgaaaggaaggttcattgagtaatattagcttgcgtttctatgggagtactgtaagtgctttttccctatagcacttaacataacaaaattgcctcagtcatcagggcaaagcagtcacctttagagtggtacaccaagctgttttcaggatggagtaacacttcagatgggacgagaaatgaagaagaattctgtgtaggggggaatttaagcaggcaggatgaaattacttagttggaaatgg

SEQ ID NO: 45349 - DNA, 1006 bp, Bovine  19866880398629
acagggccccatgatcacaccgtgaatgatttctggcagatggtttggcaggaggacagtcccgtgattgttatgatcacaaaactcaaggagaaaaatgaggtatgaccttttcccaagtgcagaacattgtatttttttctgttactctagaacagagattgtttaaggacaattaccatatacttcctaacaaatttaagatgttaagacacttaaaggctaggtcagtttatgctcccccaaaatggtaattggtgtcctatgaatgatagctttctttcagtgaaatcaatgtgcttggcatacaccattcacatttgtatccatgtatctatgtaaggaaatgaggggccctgaatcatcactctgatttataacagggaaataaaaaattgttcatttacatcatgagcaatttttgagcacctactaagtgacagatactattctatttgcttatttatttatggctgtgctgggtcttcattgctgtgcaggcttttctctggttgtggagagcaggggctactctatagttgcggtttgcgggcttctcagcatggacagaggagcctggtgggctacaatctgtgggatcgcagagtcagacaggactgagcgactaacgcacacacacacacacatgcacacactgtgggggtgtctcttgtggtggagcaggggctctagggtgctcgggcttcagtagttgcaacttgagggctcaagagcgcagactcaacagttgtggtagacgggcttggttgcttcacagcatgtgggatctccctggaccagggactgaatccacatctcctacatcggcaggtgagttctttaccacttagccaccaggaaagccccagatactattttagttgctggcagtttattagtaaacaaacacaaagattcctgcccttggtagattttaactttctagtgagggggagacagacaaaaagcaagaagcagaatttcataagagtatagcatattagga

SEQ ID NO: 45350 - DNA, 1320 bp, Bovine  19866880443818
atagtaagcagctggatgaacaataactatcactttttctgttaagaaggtctacgaaaatcagctgccatggatagagttaagtccaggttctctgataaactccatgctcagtaattcattacagttatcttacctagagatgttaattacacagcattgtacccctcttcctctttttgctcccatagacgttgcaaacagattgcaatacttgtccctgttaagtcatcagaactcagggttggtcagaatttttttttttttttcttgcatagtgactcaggcgatcatgacccaacagttggagagggcactcaaggtgaaaacagtttgctactttaccattaggagaatgactatggaagttaacggtttctagtatagctacgaagagcactcacatcctggcagccaatttctcccatcctgaaagaggtctaacctatcatcagttctgccagcataaagtagtggctggtacccggggcacaaccaaacagatcaattagcttttcagccaaagaggcttgactacatagaattcattctccttctttataaagcccactttcctcctgagaagagagccttctgtaagagaagccaaatgagacattcaacaagtagagactatcactgacttcttgatctttgtccttccacttactcacttttttattacccaaatctacaggagctgagatctagaaagctgattcatctaagttctaatgaaaagtcctaacaatgttatttagataactgtgatgaattttaatctgatgacagcttgtgacccacaaattgctgtttaaattaagatgcattcaaaatgaaactggcaagacaaccacaatattaaacttgcaatctgctgtgaaaaaaacacctatcaaaagcactacattaaaaatatgaatgtaattaatttctatatggcatcttgcaacttaaatctggagacagccttcaatgccttgtgactaaattcaattgattaatcatcttccttttttttttttttcttcaaattaagaagtcaaagtagagttggattggtttgtcttggtaatacaccctttggcagagctccaggtataatctagggctacagacttttaggtttctcttttgatgaacagaagtcctctatttcctcatcccaaatgttcacctacaacaaatttataaatgttttccacctgcttagttttaagggtatttatagcttttaagttataattactcaagatacattaaatgttatctttagaaatggtatatattagtttttaaaataacaacattaatattttt

SEQ ID NO: 45351 - DNA, 1271 bp, Bovine  19866880509042
taatactggtaactgtagctatgtattttcgtccaggcaccaggttagtaaaagtgaattctctggcatctctgggaagcaacttatggatgaataagaggtctctgtcgatgagtgagacgatgtatctctcccattctgctgcaggggtctgccacatgacgctcagcgaggtttcattggcatgtttgacacgaaggtgaaggacagccagggggactgaggaaaaagcagtagacatttgggtcatttggatgctggaggagactcttgagagtcccttaaactgcaaggagatcaaaccagtcaatcctaaaggaaatcaatcctgaatattcattggagggactggtgctgaagctccaatagtttggccatctgatatgaagaaccgactcattagaaaagaccctgatgctgggaaagattgagggcaggaggaaaaggggacgacagaggatgagacgattggacggcatcactgactcaatggacatgagtctgagcaagctctgggagatggtgaaggacagtgcgtggtgtgctgcagtccgtggggtagaaaagagtcagacatgcctcagcaactgaacaacagcaatgtctgggtcattgatttactcggatacatttgagtattctttagagacctgctcccttccatccacagaagtgttctagtcgaacatttcttttctgaatacttataagcatttagcaaaaaaaagaaaaaaaaaaaagaaagctaatcacaaaaaacattgtttgtgtaacataaccagaaataaggattcaaaagagtactcttggaaattactgggtcatttatttttgatcatcatccaggagatattaacagttggaaaatgaagagatgacttggaagacacagttggcaagctaaagacatgtcttggtccttttctttgacattcttctaagaacactgcatcagtgtagttatttccttattatcaggcaagactaggagagaatatatttgaatttcactctatgtgtggcatattccatgtcacagggatttgcatagaaatgttgagctttagaggtcaactttcttatttgagaattgaggaaatggactcagagaggttgtgacttgcccatggaattacagtgtaatggtgacagcaagaacactgaaatccatgtctcagaaactctcctcttccctaaaatctgaatatatccctcattgctttaacaactcttctggggtacctgaaactcccccattagtcagcagtggg

SEQ ID NO: 45352 - DNA, 1344 bp, Bovine  19866880534901
aaatttggccttaactccaaatattattgccactattacattaaaaacttaatatttagggaatgggatttttcaaagtcatctttgtatgtcattgaaaaattagaaaaatattcttttaactcatcaaatttttaagaagtccatgcttatttagtgtatagaacttcacaaagatttaaaagaataattttccccaacaatcttttgaagtatagagttcttcgactggggggaaaagaaactcccctttagaagcaggatgtggaaattagcatgacccaaactgtttacacaaaagcagtctacacctccctgattagggcaggcaattttgcctttacctgtgacagctgccttttattagtactggaaacaaattgtacaatctatgatcactgaactatgactacctttttattctcaattttctgttcaagaggaccagggtatacagaaacagagtcagtggagagaagtgttgttagatacagtttttcagaggaagagaagtacagtgcccacctttaaaagcaactgagctatcagaatggctacatgttggaaaatgaccgcagtagtgacagagagtaactcttgagaacttttccccttttacttcacaaaggaataaaaattaaaaagctgaacagtcttaggatggacagggcagcttctccctccccacttcccttagctgcaatgcatttaaggcagcttcatgggattgttttgatttaaatttcaaagctttggaaggcaggtctaggtaatggttgttctcactcttctggggttaaggataaatgattgctgtagctaagcctgaagactttgcagatttctaaatgcattttgttgcattaagaacaaattttgtactcttgagaaaaggcagtgcaaaaatgaggtgacacacaatgtccctttatcttagggcaaaacaatcttatttccctgtagtagaagtagaagcagggcaagtcagtttgtgttacctgaatccaacaatgttgtattacggctatgcccttctctccctgctccagcccctctcccttaacctagtagttactttaggggaggcagttttggaggaaggatcataaatattctgacccaataccccaggagccatggcaagcaaaagaacacacctgcctagagatagtccttgtgatatttaaatgtgtaggttaatttttttatccactttaataaccagattatcactctcccccctccacttctttgctttctatttttgctctgaaggtgtgaatgcagaaatctctgcaggcaaattactccagagccatcacagaacaatcctagaaggaacag

SEQ ID NO: 45353 - DNA, 1009 bp, Bovine  19866880552616
gtgataaggaaatgaagagtcatgagatgtggcatatatccccccaccttctcagaagttaaaatcttgagagaaagacataaggaagagcaacactaggtaggatagcattaaggtgtggacaaaagtcctggatcagaaaccatctgcagtgtccatccacaaacctggagccttaactgaagactgtgtaagcaactgaggttagacatttctccaaatgagaaataggacaattcactaaaaattaactcccaaaaaatcaatttgttggaattgatgaattatggaagactttactttatagttttgctaaagatggcatcaccaactcgatgaacagttggtgatggacagggaggcctggcgtactgcgattcatggggttgcaaagagtcggacatgactgagagattgaactgaactgaactgaactgaccagcattttcacctttttctaagaattttttgtccagttcagctggatgctaatttcatgcatattttacatgccagatgcctaatatttttcaaatgattaatgctttatctgtgaatgtgtagtcttttcttcaaaatatccagtttattgctggactatttaaggttcatctgttattgggccataggggttaattttctttcagatccctccattcctcttgagatctaagttaagaaagtggaaacccaaatgaaaaagggaaacttatttgaagttgtgaagcagacatcactgaattgtttcagcagtgttttattgtcagaaaaagattcaaaagataaattggtatgggctgcttggggattatgttatgggaattttgattatcaaataactaagaattactccaagaggcatatttgtagtcattccttgctaaggatgaaagaagatgatgtaagcttcaagagtaaagtaacgtgatatattttggaagaaatagctggaaaaaaaataacaagaacttctcactcaatgttccagaaatacggttaaacaggccaa

SEQ ID NO: 45354 - DNA, 2145 bp, Bovine  19866880578834
acttgaacagacttgaattatccattggtatccatacaagtgagtggtaaagacagcaaatgtttccctagaaaatgcatggagtttgcaaaacaaacaaacaagagttatgcttttttacatcacagaaataaacaattcctgctgccaggagaaagacaagtggagattagtgccagaacctaggtttaattttctctcagttaaaaaaaaatgaattttaatgctcatgaaaaacatgtgtcatgcactgtaaaggctgagccaattcataatttcatgtctctggtatcagacacatggtggggatgtaactgaggatgaagcaagagatgccaggattctgcatgcaattagaagccaagtgtggtgcctcttttcttccagttcacgattatataactagctcctccctcctttcagagcccatctgaatgacacagaggaaggaaatttaatgacttcctccatcaataccgaggcaggattgccaataaatagtctctgaaaaaaaaagcattctaaaaatgctcttttggcctttagaaaactgccaccatgaaaaaggcaccgatttcatgtgactgtaactgactgaaatgttctctcatctcttaattcattggctgattagagcataataccaataaaattaaggtcatggggcttgatccttctttagaccaattttgtggggtgtgtgttttttttttatccttgggtttaaaggatttcccctaaagcccaattcaaaaaaataataaagtaaaaacgttttgagctcacttcctttttaccctaattttccctccccctgcctataccactggcaaaaccacacacacacacacataaggagttggtgttgttttgtttttgaaataacatggctgatgctatagaattacccagtgtttaagactatttgttaagctagaaaaagaatgggacagcagaggtgatgctgtaattgcatatgacaaaagaaaaggatgggtgaggtactgaaacacattctaaaaccgacccaccgacagggcagatcagggatgcaaaccactgtctggaaacctggaccttactaaagcctgcagcctcataaggtttcccaggtggcgctgctgctgctaagttgcttcagtcacgtccaactctgtgcggccctatggacggcagaccaccaggcacccctgttcacaggattctctaggcaagaatactggagtaggcaggtggcaccagtggtaaagaatctgccttagatgcaggagatgagggctcgatcccaggtcaggaagatcccctggaggaggaaatggcaactcaatcccgtattcttatctggataattccacgagcctgtcgggctcaaagaggtccatggggggacctcatgtcccaaagagttgggacatggcttagcaactgagcagagcgcagctcacggaccacagtatctcaaagaaaatagaaaaagggatttgcaggaaaactgtcctgacctagttctgacccagtggcagagtaatcagctcctcccttcatactcccacagcatcccgtatttattttctgttagtagttttgttttttttttccacaacttacacttaccatacttccctccgagctctgtttggcttgaagcttcatctccctccctctagttcccactggcaacggtgaaggccaggatctccaggagaggatcagagaggcctgaccccacctaagggaggtggcggctgcctatccggcgccagggccttgcccagctcagataacaccactcagaggtctcagaggccagcaggccaggccagcagcccctgagagagggccagtgaaggcagggctagccagaaaagggctggccctgctgtcctgtcaggagttggatgtagtattcagcctgtgggccccagttccactgtctaggtggccatgtggatgaggggcagggctctgtggagagacaagcagtggaggcaacacagcagtgcactcctctacaggcgagaagctaacgccacctccctccacaagtgtcctcggtaacccttagcacccctggagcttccaataccagacagaactgccctttgcaagcaacttcctcggttccatgtccttcccctgcatcct

SEQ ID NO: 45355 - DNA, 1734 bp, Bovine  19866880619531
aaacaggatacagactattttgtctattttgtacttcacacaaggcactgaaaaatagttttggatgacttgcttctctctcttattctggtttattatttaccataactcttctctgaagtccatatcccatcttttctcttgttttcatcttcatctgtttctcctttgctatagattccatgcagactctcagctttgtcatatctaactgattgtattttctgcattctcagttctgttctttattgcttaaaagaagatttacaccctgctgctgagttttcagttctttgaattcttttcttcttaatttcagtctaataccttctcatcttagattgttgtgtttttgtttcatcctgattcttttttttataactgaagtagaggagttatcatcaagaaaggagaaaaaactatgaagccattatactgtacatcttaaactttaaacgtatacaatgttatatgtcaattatatctcagtaaaactgaaaaaagactatattaaaatatataaaatataaaattaatatttttaaaagaaaagaaaaaaaagggggaaaggggcttataaaaaggaaagcctgaggacaggaaggacaaaccttgatctcttcacaatttggtccactggcgtgtcccagcaaagtcagtcctattcttttaaaagttttaaaactttctgaattgagttagccattccagaaaggactctgagaatgaagaaacatgacactttggctttttttcaacacacattaaaaattttaaggagcaagaagtaaataagaaaattctgattgtccaaattattctttaacatgggccctaaattttaattttttcaagtatttactagatactcaaattaatgtgactaatgcatttcttacattaagaacttgtggcttattgcattgctatgctttaattaatactttatgagactttcttcttacacattgtagtggttgcagatctctatttctatagaagtcataagtctctatatcatggctattctttctataagttttccatgtcagtcgttttaaattagagtttacatgtgatcaaactgacatctgatacttttataaaattagccatatttgtttttgagttctatttgaaaagcagactcatgtacatatatgtttaatatgtttgtactccttgtgagggcatgtttgctcagttacttcagtcgtgtctaacactttgcaaccttgtggactgtagtccaccaggttccactgtccataggattctccagggaagaatactggcacgggctgccatttcttcctccaggggatctttctgacccagggattgaactcaagtcttctgcattgcaggtgcatttttaaacacttgagccaccagagaagccctttgcactccataactggaaacaaactgtatctttttgaagaaaatcctcaatagtataaaactgagaaattttcctaggaagctttgctcacttactttggtttgtcttctaagttgggatggagatcatattctgttgttgaacatgaaaaactgacggaaattttttgtatctccttccatagattctttacagattaaaagaaaaatttcagctttctctgagacaagataaagagaaaaatcaggagatccacctatcacccattgtgttacagcctgcacattctgaggacaagacagccaacagcatggtccagcctgaacagg

SEQ ID NO: 45356 - DNA, 1625 bp, Bovine  19866880625554
tgtgggttatcttgtttactttatggtgtcctttgaagctcaggagtttttaattttaattaggtctcatttatctgttttgttgtggttgcttgtgcttttggtgtcatagctaagaaaccatttcctaactcaaggtcacaaaaacttcctcctatgttttcttttaaaagctggatcattttagctcttacatttagttctatgcagtaattcatttttgaagtgcactttaagcacttgaatttgtttattcaatgttgattttcaagatttaacaaaccaacataatcatctttcttttaaagtggttaatattcctttttttggatatatgtttactacgtttctttactggactatgttcaatttttgctgtataacaataatttaaatagggaagaataatgtttacaaatcccatacttaacattaacttgtaagcaaacacatctaaatcttcttaactgtgttctgattcctttttggtctgaaaagtgggagattatcctatatttggcataaatagatgggagtgtttgtgaagctgagtcatcttttgtcatgcagcatgagagactgttttagctctaaagaagaacttcctgagaccaagcactgtgaaaggctgggtacagggaaaggctggacagataatggtaccaaagaacaatgtgctaaaaaataaatctattctcagcatgttggaactattccaaatcagtgcagtgcagaagttaagaggtcaggcagaaagtgctagaacccagctctgctatcttgggcaagttacataaactcttggtatctcaaaccctcacctttaaaatgggggatggtaatagtatctaccacaaaaggccttagtgaggattagataaattattctaagcacaatgcttaaaactgcagctccgcagagaggacaaagagtcaatattagctactattattattcaggggcttccctggtggctacctagtaaagaatccacctgctaatgcaggagatacaggttcgattcctggttcgggaagatcccctggagaaggaaatgacaacccagtccagtattcttgtctgggatattccatggacagatgagcctggtgggctactgtccatgagatcacaaaagagttggatacagcttagcaactaaaaaacaacgttattcagactttccttccaacacagtttagaaaagtttctttcagaaatttatgtaaagccaagttaacatttttttttatcatgtaaaagcaacatataataaacaaaaggaaaaaagttccttctagtcttttttttttcctatgcatttctatgtatatatttcatatacacattcccatttacaacttgaaagctttttatacccacttctgttttggcctgtgtcaactcttgatctgaatgttcttcatccactatttttttaaaaaatccatttttaatagataaaaaaatctggtacctctttctaccttcttgacaagataactcctttcagtccactctgctacagaagttgtacaatttctctaatctacatcaaatcatgatcctataaagattacattccaaggaaaaataaatgatcctcccaccatcagccaagtcc

SEQ ID NO: 45357 - DNA, 1584 bp, Bovine  19866880638816
tgagattctatgcatggctctcctgggaaggatttcaactttctcagcttcctcagcctctgggacccctcaagggggagcagcctagtatccttttcgtacccctggattagtccatgttccagtggcccacctcccagaagggtgcatctctttacccctttgctggaagtcctggaaactggaatgaggtgactctctcctcttctaaggtgcaccaatcctcacctgttattgcctctctgctgccaaaaattctgtcaagtcttctgccattgcagaaaatatgctggctgtaaaaagtaacaggattacttcctcccaggagctccccttccatgctctattctggttcaagggctccagcagtgtaagatggtagtgaaaaatgagattcttctcctgcatttcattgcccttatagagctccatagacacatcttggcatatctccatggtgggcagaattctcaaggaacccccacgacttctgcctcttgtgtacatgtgttgtgggatgttctcctttgggtaggttttgttgttgttcagtctctcagtcatgcttgactctttgtgaccccatagaccaggtggtgctagtgacaaagaatctgcctgtctattcaggaggcaggattcccacggttcaatccctgggtctggaagatcctctggaggagggcatggcaacccactccagtgttcttgtctggagaatcccatggacagagaagcctggcaggctacaatccatagagttgcaaagggtctgacatgactgaaatggacttggcacacacgcccacacagacttcagcatgccaggcttccaggttcttcaccactgagtgggtggaatctgtgaacaaagggatattactccttcaatgtgttgttaatgggttgagttcatcaaaagagaaatatctggatggacctgatctagttaaattagcacttaaaagaaactgggcagagagattgtaagtgcaagagggccattggcagggaccacagggtaaggacctgagagtggcctctagaagctgaaatagttctaggatgaagacaagtgggaacctcaatcctataagcactcagaaatgaattgtgcaaactctcagaggtagcttgaaagcaaatctttccctagttgaaccttcatgaggatacagtctggctgacactttgattttaatcttgtgagactttgagcacagtactcagctaacctgtacccagggaaacaaccagataataaatgtacattgttttaagtttgtggccattaagtcatttgttgtgcagaaatagaaaactagtataccccccttccctctctgttcctcttacatcatctaaaaatgggtgtcagtgttgacatgatatctaggaggtagcagtcaacaacctcacaacaagcctagaaatatctggcttaattttttgatgactctcttcagaatggaaaaatgtgggatgactgatacctcttaagtaggagccttgtaatccaagagcatcaacatactcagttcagttcacttcagtcgctcagttgtgtccaactctttgcgaccc

SEQ ID NO: 45358 - DNA, 815 bp, Bovine  19866880640426
cccctttcaggatgccttgcaaaaaataatgatcacttcttggcaattcgtcagaagaagagtgggaagccagcattcatttatcaccactcacaagacattgagaagagcctggatatagctccacaaaagatacacaaaccataactaccattcctcttctgaagctcaaataggcagacaccacccaaattgttaattcagcatttcctaaacccgcatatgacccatctctcaatctgttggccatggctggtcaagaccttgaagtggaaaaccgcccagtcccagcagcaaatgtgattgtggtggtaagtactgcatttaactgatgctgatgctttcctctgtggttgatgctttcaaacaaatgaaacctaatggtgacaagttatcactggatctcaatgactatttaccatagcatttcttattctctggtgtttcctttttgttaattgattattatctgttggcttcctcttgaatgtaggcccataaaataagaaactctgtctgtatcttctctgcacagcccaatgcaaggtgcacagtaggtgcttaataatttgaacaaaaaattgtatcaggaagtctttacttatgttgattcatatcctgcagttttggatcatatcctgcgcttagcctcctgccttctgtggtaatttgctctaagtagattggcttgagtctcagtttatatatataaattgtttgttgttgcttagttgttaagtcatgtccgactcttttgcgaccccatggactgtagcccaccatgctcctctgtccataggattttccaggcaata

SEQ ID NO: 45359 - DNA, 2157 bp, Bovine  19866880648889
tatatactataatattttattctgatattcactactgacagtactatttgttgtgcacttatttctaatacagggaataactattattcagcatcacaatgattaatttccagactgtactagtagctggggaactcctggaaggcatccgcatctttcctatttttgtacgattatggtggacaccagagaagtcattatctccatgacaggtctttgggcccgcaagtctggtctccagactagttgcttacggaatagatgtttaagtttatttctcaccactagagggcagaaaatgctttgcaaagagaaatacacccctttcacttgcgttcatgattagacaccccagaaataaataacttaatcacaagaagatcaaagctatccaatgtctgagacttttagaaaagccattgtatcttgagtacctttcccctcaaacttcttttctttatcaatgggtttggattcaagctcatacatttaagatgttaatgtttgttccctgtcctacaaaggaaacctcctgacacactcacatataaatgcctccacttaaaatactctgcaaacagtcacaccatgaaaattcaatagcagtatccttatattaatgaggcatccaaaatacttcttgcgttttcattttggttagccttctgaggtaagaactctgagcttcccaaagctaacgtgaaatccttacacttccttgacacttcctaggtaatcagatcttctgagtccatgccgtttgtgctgactgcagtaaatgattcacaatttgactgtacttttctttttaaatattcttcccctctttaaaatcccagtcccttccagtgtgagtggagtaacggtaaacaactctggccgcagtgactacctcagcatatcctggctgccagctcctggagacgtggatagctacgtggtgacactctcccatgacggcagggtggttcagtcccttgtgatcgccaagtctgtcggtgaatgttccttcagctccctcaccccaggccgcctctacaacgtgaccataactacgaggagtggcaaatatgaaagtcattccttcagccaagagcggacaggtgaggctttcatgagatacagactctcttagaaccagccgcctacgtggttcagggcatcaggcatgcatgtgtgtgtgctacgtcgtttcagtcatgtccaactctttgtgagtccattgactgtagcccaccaggctcctctgtccatgggattctccagacaagaatactggagtgggttgccatgccctcttccagggaatcttcccaacccagggattgaacccacatctcttacgtctcctgcattggcagatgggttctttaccactagcaccacctgggaggccccgtgtgattgtcatatataccatacagtaaggttcaacatagtgaataccatgcgtgcagcagatacagcatgcatgcacacacagcacagcagctcagcgtgaggaggagggctcctccaagacgaccttttcttctgcaactgggttattctgagtgccctgcttccctccggagcttccttccaaggtctctgcacgtctctgagtgaagaggggacgggagccccagctgggatcaactggccctccagttgccctcccttttctctctgctcagcttcccccatctccccgggactcccaggcccctggctgcctgggtgtccaggctgtgcatggtttcagggaagagcccagaccagggccagcagccctgaaccttgcctttgctgtgaccttgaaggtgaccttgggcagctgtgctcccagcgcttcgcagagcctggcctgtgaaagggtcgggagaaggtgtcagtgcccacttggggactggccttcgccgcccacccgggctcttcctcctcccggatgctgtcctcttccccgcaggactacaggtgaagaccctgctcagcaagcgctgtgcccccaggtgccccaacaccaacatagagttcaaatggccgtcgaactcgggggtgcccagcaagatcgtccggcactgctgctccaaatctctctgcaacagggcccccgccccgcaggagggccccagggccctctcacggggggctcctgcttcgggtagcctcggcctc

SEQ ID NO: 45360 - DNA, 3251 bp, Bovine  19866880656766
aagtttcttataaaaaatttgtatccagaccacaaggacctactgtatagcacagggaactctgctcagtgttgtgtggcagcctggatgggaggagaatttgggggagaatggatacatgtatatgtatggctaagtccctttggtgtccacctgaaactcacaatgttgttaaatatcaaataaaaagttaaaaaaattattaagctaaaagccttttccccagttttagaaaatattctatgggaaatacatattttctttatatgaagtgatatagaaaataaagatgtgtgtttcccccaaaatattgtgtctataataaaaagaatggaattacaaatacatccacttggaaaattttcataaaaggtattgagtggggcagctatttccttggttttgcttggtgtagttcccacactggggaaaaagatgaccccttgcatttatggtaactagaaaaggaaaggcgagcttacagtgggtttagtcactaaatctagacacgttatcatactgcattctggggaccctgcctttgtgtgcagacttcatgaaaagactagtcagtatcttccattgtaatcggatgtgggggaccaataaacgacagttggtgacaggagatatcctctgtctaattcccaaccgggacctcagctttgttgttttctaccagtaaaccaagaaccttattatgaaagccgggctgtcctcataagaattagggctctcattaaaaattatgtatgaattcattagctaatctgtacagaaagtgctatcctcaggtgaaaagactcacaaaatatttagttcacttaagtttatttcaaaaaaatatgtatcacgttcccattgtattctaagcattgtacaaagttctgggtgtacaaggattaaaaataagaatttatgttgaatgtttaaagataatagagtgattttggtggttggtacaaaattatggattatttctgatttatctgtggtctgtgatgatgaataacaatgtcagaaaacagtacatctgggtgtttccatccatcttaatcataaaattggattaacttcctgtctgattcaatgttgcagaaaacaatcatcaagacgccccaaatatatcgtttgattcaagaaatcaacctttatttgccacaaaatatagggctgtcagatttttttaaagtatgtttctagcgtgaaacatgaggagattataatgccgaacgatggtttggcaatcatttcaaagaaggatttagggtttagcagcaagattttagattaaagagaaataaaagtttttagtgattttcttttaatgtcttttaatacgaggaggataacatgtttaaatctgccatttaatagaaattaaagctttaaaggagacatggcttcttaattctgcacaccaaaatattgttccctacagcttccacagtcttaaatttatattttaaattgctagcgtgaattatccagttgataattgatgctagattgtgttgtatgaaatatagaaatcagccgtttctatatttagctgtaacaaggaggaattagatatatatagtttcctttgtttttctgaacaatccatgtacttctatctagcaatttaataattagttcagagatatagcaatcctaataaatatcatgaccccaattatgcttaaaggaaaaaaaaaggagtatcactaagaagattgagaagtaataacaggatgaaattggcacagtcatgctgtgcattaaagttatgctgcagacaacatcactcagaacctttattttccagaaatgagatgattctcagcattctaatcaccaaaataacacattgtgggaaattatatgcttattattttgccatctccttccacagatgataaaaaaaccacaagaacactgagtaaaacttattccaccttctctctttattcatttttagttatgcagaaaattattacttcccactgtgtcagaaaaatcaagattcccgagaataaaagttttgaaagaacactaaatcatagattttttatttgcatcccagaacacatgccaataaacctcgctttattttaccatacttcttgggaaattgggtggttcaccagaatagtgaaaaacagaatcctgttacagtcattgaagtgaaacataaactacttcatggagggaatggaaataaaagtaaatttataacatccttccagggatgttagaccacaaaccaccctgttgatcagactgatatttcagagcctgtgtggtcctccctgccactcacagctcaagatttcacgtgtgaaaaaagtcaaaagtccccaaagaatatattcctgttgattgcacgtaagcccataaaaataaaaggggacagtctccctatttaacccacagatggataaagcacccggggtctataacgattgatagtttcttcattttttaagataatatttatatgcttgatggcttgggaagcatcactttctgactgggaagcaaagtgcttgaggagttaaaggattattactttgcctggaatgtctatttccaagcatccctaaatgccacttagaaatcagcctgatcacaattcttactgcattcagtggtcagatgtctcctccgtcttttcagaaaagctgcgtgaatggagcggtcatggctgtgatgattagagttcatcctgacggggttgaatgtagaaacctgaattagtctgacctcatttttcaggcaacattcgtctgagcattgggcttttgtctgtagagtttctgcctggccttgattctagccattttccattcaagcttttggttactgtgcctgcctgtagcataagagatgctgaaggacagggagaagaagtaacaacagaggggagattgaaagacaacacaggaataagaataatggagaagaaataataatcagtacaaggtagaaaacattatcagggggagttgaatatggaaatttctgttgactggagcatataataatgagacttgaaaattctgttaaaagcaagtaacttgctattatatttgtttactgtactcagagtaatatctatttgtggataaatcgtgatttttctcctgtctccaaagaactttgtgttaaaactgtattttcttctatcttacccatagatggtgtctgtgactttacgagacagcaaaagagacactgatgtatagaacagtcttatggactctgtt

SEQ ID NO: 45361 - DNA, 698 bp, Bovine  19866880743017
cttcctcaattcaaagttggagaccagaacctttaccttcatgatgcttacaaacacagaaatatgattgagcattatccctgtgttaataatagccaattttaaactaaaaggtcaactggaccctagaaagaaagtcagatttagttgggaatttcagaagtatccattttcactcaaaatagcctataatcaaatctgcagtataatgatacactgagttgactgcctaccagatccttttgcttatatttttttctcacatttgtaaccagaatacattggttgttcaacactaatgtaatggttgtgatggtcaatcaaccatgttcaagaaaaatacatagaaagaaagtcccaatttaagtttggcaagatttcctaccatttgcttcactaatattttgtggtaggaacaaagctcaagaaattctctgtggaacactcagctcattaaaatatacactaattatgccactaacagtggcatatacagccattacagccattattatggccatatacagccattaacatattgccctatcagtgttggaaaggcagattgattggaaatgtctaaaaaataggggtaacaccaaggatgaagtaaagtctagaggcaggtgggtccagatctgagttcggttcaaccatctactagcagtggacctcacaaagtatgtccacttcccaag

SEQ ID NO: 45362 - DNA, 1338 bp, Bovine  19866880747435
ctgattttgaaatataactggggctgggtaaggcattttccctgttcttcagtaattttcttctctttctgttgtgtttttaaccatagcccaataaaagtaaatcagtttgaagggcacttcatgaagctgcaggctgactccaactatcttctatccaaggaatatgaggtacaactcagatgcaatgatgttttagcgtccctggttcttagcagaatttcccttcagccctcactatggaatcacatcccagttgggctcaggagttagaatggcacttagggtctcactgagtgttctttcatgcccgaatccattccctgcacaatataccacctagtctcagaagccagtttgatctccagaataaccaacaaagtgctacccagatcgggtggtaagaaagaattaacagacttcaaatgcaaactgatgctgtcagttagttaacctggccttttgcttgcttgggagataatgtggttgggtaaaaagtgcccaggctttggattcagttcccagctttgcaacctgtgtgacccgaggcaaatgaattatcctgtctgagcctcctctgtaaaatggagatgagactacctcctccagggctgttgtggggatgacagccgatgcccctggtcgaataggagacattccacaaatgcagctagtgtaacatattgttatgttattatgtatctcaaggactgtccagtttgccatattctgtttcacattattcacatgcaaacttatttttgacctaacaggatttaaaagacgtgggtcgaaaccaatcatgtgacattgcactcttgccagagaacagagggaaaaatcgctacaacaatatattgccctgtaagttgtgtgttgaaatctgtaataccgccttcctctcgccatttctttccttttctgtgattaaaaatggggctaaagcaacttggtatagctagatatggaagacctgaagttctaaatgtctttaaaaacaaatgacttggacgttactgtacttctttccagagggtaaccagctgaaattctggctgggagagagagacctctcatgctgttgacatttcatcacgtggtcctgatgcttcttcttggagggttaagagctgtaacagggttaacagtaagggtcaacctgggtttacttaaagtctctagttagcaattatttcatatataaagatatatattacatatattattcttattatccttacccaattgggtgaagcaattgaaggtagcttttctgaactgcattcgttacaacaatgaaaaggagctggccactccatcagacaaatgttgttagtg

SEQ ID NO: 45363 - DNA, 1007 bp, Bovine  19866880798532
ggctctgatttaggagagctacaaactctgcatcaaagacttgatgttttattctggttatctatatttatccaaggttaatggagaaacttgaatgttttgagcaaaggaataataagatcagagttatattgctagaagattaatcttttcaattggaaaagaaagaaaagttttgtgaccactgtcttccaaaagataccacatccatcaatgtcactgtcattagaagcaacatcaatattgtctctagggctgttgtataattaaaaaaaaaaaaacagagcatttgtatcaccaggttattaatagtgttacaaaagatcgcattactgatatattgctaaaatgattttagcaaacatttctcacatgtcagatggctccaaattactcatttgcaattcacaaacatcaggaggagatagaaatgttttgaattgctagtattagatttcttatctactgttgcccatgaaaagtgaacaagtatccttacctttggattttagtatctccttgtgacatcatttcactatttagttccacagaaagttggggacctggaggcaaatagcaatggttctacgaagtccctggtagtaagctggtcgccccctgctggagactgggagcagtatcgtatcctgctctggaatgattcttcggtgctactcaacatcaccgtgggaaaggaggaaacacactatgtcatagatgacgtggggcttataccgggaagacggtatgagatagaagtcactgtggagagtggaaatctgaagaattctacgcgttgccaaggcaggacaggctaagcaaatattatggtgttaatgactgacagaaccttaatttggaccttcgtccaagtaactcaggtaaccatcaatatcttaccccagcattccctagatttgagacattttaggctggtagactgaaataggttggtaatgtttaattttgtcaaattagaacaatataaatcacttccgctagtaagt

SEQ ID NO: 45364 - DNA, 1033 bp, Bovine  19866880808815
tggggttctagataggactggaatctttgggatgcttgctctctagaagtaaaaacaatagcaacaataccatggcaacatccctcagcatttgctgtccaaaatttaaataagataaattttctatgacataatctggtctgggaaagtccctataaatgactgtaactccaagttttggaagatctcaacaacacttcaggcttttcttgcctcccacaaccacccacaagtgcagattttccctttcacagtttccaggccttacttaaatctgctgagacaaagtgacattaaaaaaagaaatcatggtaacatctccagcacaagcctttagtcctttagttaaaggtgttcaaaaggttaaatcagaggtgttatatatatgcaaattagaagaccatagcaccctacttagtggatttctttaatgtctacttaaattaattattccacagagtgatagtagctgacaacaaaatacataagggagtaattagaatttcttcttgatcttgacgttatttaacttgtttaaattgaatctgcagttcttaggacaaaaaagttcaaaataaaaatgcaatcctctaacaccttccactttgtagacagctacagctccatattcttacctttaagacaaggtttcgaacagtatagttatcgcattcatttacactgataaccagaacctcaacttttccatatattcctctcttttctggccaataaagcacacatttctggaggaggggaaagaagaacacggcaaatattaacggttttcattggcctggaagcatttgtcattcaagcatctcaaaagtttctatttagttaaataaaataaatcaagtatcaattttaaacattctgtaaatgagctaaaaccaccgaactatacattttaaatggataaactttatagtatatatatatatgcatgtggcactcagtttgtgttcaactctatgcagcccaactctttgtaacccaccaggctcctctgcccatggggattttccaggca

SEQ ID NO: 45365 - DNA, 834 bp, Bovine  19866880829931
tacttgacagttaatatttatggagtgagatatttcctttaatgctgttttataagcaagagggaaatgctgcaaacatattttggaaaacatacaagtttgtcaggatcttgagttaccccatgctcagagtgcaggagtaacttatgttaatatggaactttcacactttatataagcaggacttagggaagtttttggagaaggcaatggcaccccactaccagtactcttgcctggaaaatcccatggacggaggagcctggtaggctgaagttcatgtggtcgctaagagtcggacacgactgagcgacttcacttttattttcactttcatgcattggagaaggaaatggcaacccactctagtgttcttgcctggagaatcccagggacagtagagcctgatgggctgctgtctatggggttgcacagagtcggacatgactgaagcaacttagcagcagcagggaagtttcaaaatatctggaaaccagtttcaaaataacatctttgtataaagatgttaatactggaatgataaaccccttacaatgtccccagggaacagttgagtggacaaggctggtttagaggcagcctttaacataataaaaagttgttaaactttgtagtctactgttgcaggagtactggacagtaaaatcaagaatggacgacatctcacattctttccaccttgtttaaagctcaagcacttctttcaatgccagaccagggaacaaagcctagacccgagaggggagctgtggatagaaacattaatcaaatttgccttgagggaagttactcacctggagcacaaaacatctg

SEQ ID NO: 45366 - DNA, 1827 bp, Bovine  19866880865968
ttatctccttacaatgagagattcatgaatctctatcactgctgacttttctcttgagttttagtttttggtatccaactttctgttctttgtttttagcctcaactttaaaattttcatgactaagcttatctttcctccaaaactgttttttcttaccttcctgtccttcactgtgaaagtagctaacgttgcctccatttgcacattcatttcagtgctcttgacctacgtatggtctttggagtcttttttaagttgcttgtaacctcttaccaactccttgattaatgattaattaaaatctaaatgcatgcttatttgatatctacatgaatgtcatgacattattatttttttaaaaatgctttaacagtaaccaaaagttgtcttggatgattgtcttatcttggatattttaaaataccttacgtgatggtctgaataagatatactctagagatgatctgaaactgtccttcctatgggatatcaatattatcatttaagattaatagaacacattagtcattcagggtcaagtttaaaaccttttgtctaaggagaggcctgacttcaggctaaaacttaacagttcatctcctgccatgaggctgagaacaaagacaatttttttttaaaggtatgtagaggaccatatggggcccttatggggctctgggcatatggaattagagatgtggaaatagtcctgaggattatagaaaggaagatttggcagaataataaaggaaggaaaattacatcttgaacaccctttcaatctttatcaaattataacaatttaaaaaatcatttaaccataaaagagtataacttaattagatccactaacttctggaaaatgacaaagtatgaattttaaaaatctgtgaaaggaaagcaggtcaatttaggactggccacacaaataactttaatttggactaaccaaagaaaagaatctgtctcagtgatataccttatttatggcaaactttgacaagaaagataagtttaagaaggtcaagagttaaagagtaagatcttaatgtatcttgctttaatgaaaaagtccatcatttgtaatcaacacattgattgtatgcaaatgtatgtggttgcaaatgttcagaaacaaaaggtttccttaattaaacattctacctccttatattttgattacattattcatttgctttacagaacaaatgtgaattccttaattatcattatattaattagtgaggtttttcataatatggaaatctagagaatgattaatgaagggaaaaagagaggaaggaagctgaatttctcatgagattttctgttttgtaaaattttctgtgtatttccctcttgtttaaagatgtaactgccagtgcttattttttgagtatctgttagggtttagaagattagtcagtgttctgcaggtctttatggactggctaccaagagaataaggtcaacagtcatagcaattacaaatatgatcacttattgagaatttacaaaatgcagtcttgtgctgagtgctttatatgtagctatcttgtgaaagaagtaaaatacctttccttttcctgaataatccccccgtcaactctttgtatgactgactccttatttcttcacatcagctaaaacactacctcccaaagagtatcttcaaagcagattcttactatcattgacattcttgataacttgtccttttctttcattgttattgttgagttgctaagttgtgtctgactcttgagaccccatggacttgtagcctgccaggcttctctgtccatgaaattctccaggcaagaa

SEQ ID NO: 45367 - DNA, 1569 bp, Bovine  19866880869308
gctaagctctgtgaaagatattcagtacctagcacagtgtctaatatatacagtgttgataatagctaatccacacctagcctctttttagacttcacctgttttagcttttttaagttctcataactctaagaaaaagttactgttattatccccactttacagatgaggaaaaggtgactggcacagacaggttaaatcactttaacctcgagttcccctaatgaatagtgattcgaattaagaaagcccacacttttaaccccactgtgtaaagctgaaaatgataaatgttgaatatattaattaattcttcattttaaatttgtgaattgggggataggagtaggtttatatgtgttctgttggcaattcaccagaaggcactatctcatttttttggacccagcagacttaatgggctaataatcaccaatcaatagcctaggtaaagtctcagttgagctctttcagatattattttggcattctctgttacaaggagccaaactgcagagaaaagtgaaaggaggttctctgagcccacccatgggagaagatggaatcagaggaaatgagggtttcccaaccctcccttcagctgcggaatgctctggcttcactctgggtgaagaattctgttgttacaaatgctacaaaatagagcaacccacacaagtggtaccattttcgttttggctggtgttctgcaaagctggctctcggaggacagatggcaagctgtcacttcaggcctgctttttggctcacctgcatgtagccacatgaagctttctgtttcttaagaaagcatttcttttctcaggtcatatttatagttcctgacacctcattgctcctcctagatctcttaaagtcttaacgatcaggaagtcttccaacatggatcttcccacttaaatcccaacgtttcttctagtagcaccctaatgccattcaaacctgactctgcctgctcttgctcaccaacattttagttttaatgctcacattctgaaacaaaatctttcttgcccaaatttagcgtctcctccaagacctaaatagatacaggcagatctcagagatattctgggtttggtttgaggctaccatgataaaataagcattgaaatgcagtgagtcccatggattttttggtttcccagtgcatataaaagttgtatttatgttatactgtagcctattaagtgtgcaatagcattatgttttaaaaaacaatatgcctacctcaatgaataaaatactttattgctaaaaaatgctaaccatcatcggagaaggcaatggcaccccactccagtacttttgcctggaaaatcccatggacggaagagcctggtaggctatagtccatggggtcgctaagagtcagacacgactgagcgacttcactttcacttttcactttcatgcactggagaaggaaatggcaacccactccagtgttcttgcctggagaatcccagggacgggggagcctgttgggctgtcgtctatggggtcgcacagagtggacatgactgccacgactagcagcagcagcag

SEQ ID NO: 45368 - DNA, 1630 bp, Bovine  19866880887590
atgttgttctctgaagaaattgcaatttggaaaacaggttagggtcacagcaaatggaaatggtcaggaatgtcgtaaacatgcaagaaatcattaataagctcatacctggaagctataataattggcaatcaaatctcttttttttttcataaccaaaagagaaaatcttatctagagacaggcaagtcaaagaaaactaagcccaataagtactaagaattaaaatgagtatcaaatgtgtataaagggcattaagatatgaagactcggtgacctgggaaaagcacagtctcatgggtctggaagctggagctctcaggctgtgggtctggctttgtgtgatgctggctaaaatcccaataccatttttatcctcattaattatcccccagtggttaaaattctggattttggaaagtactttccaaagatctaaagatctaaaaatacttagatagaaagagaaaatctctgatggaataaccaactttcctgggcagcatccagccatatatagtctaaaaatatcttggaaacaaaaatattcgagacacataaagcagacatgttacttccttatgctcagattactcttatatataattatcctatatctttatggttaaatggtagtaatgtgtgtcctggttaaacaactgagaaaggggaaaaagaaagaatggtgctgggattacaagactgctaagtctccaaagaaaaatagttattcaaataagcttttctgagatggttgggttaaactgaagtgttgaattacctgttgtgaaaaaaatgttggtaaaataattaaaattctttgggaaacttacccaatcatcctaggaaaaggaaagaccacatcatatagagatggaaactgggacaggccccgtcatctatctagtagacaccagctatttgtcaggctcaaggctaggcactttgcatactttattccaagttgatatctcagtaccagtgcctggctcctatccctcgagtttttgaattaattgatgtgcattgcagttgagaaccatgtcttcagaggaattcagtgagaaccagtttctgctcctagtaccccctttaaaaatttttttaatttattaatatactaagctgcatcaggtcttagctgaggcacaagggctcttcaatgaaggacaagggctttttgggttgtggacttcaggctctagaaggtgggctcagttgttctgtggcctgtggagatcttagttccctgaccagagagcaaacctgtgtgccctgcattggaaggtgaattcttaaccactggaccatgagggaaagtgaaagaaagtgttagttgctcagtatcttttctgtgtgctgttgaattccaaaaattttgccaagcacgttcccatcagagcacctgcaaacacctacaatatgcccagtaactcctaaatgtcaccttgacatgtgcccagtaactgctaaatattttctgctcttgagcctgtggataagctttataaattcaacattagtttttccatgggttccatctcagccttgtttcagagtgaaagtcggggtagcgatcaaacattattctgtcttctattgtctaatgggaatgactgccttcctacag

SEQ ID NO: 45369 - DNA, 1652 bp, Bovine  19866880961170
atatcagactttatttttttgggctccaaaatcactgcagatgttgattgcagccatgaaattaaaagacgcttacttcttggaagaaaagttatgactaacctagatagcatattgaaaagcagagacattaccttgccaacaaaggtacgtctagtcaaggctttgctttttccagtggtcatgtatggatgtgagagttggactgtgaagaaagctgagtgctgaagaattgatgcttttgacctgtggtgttggagaagactcttgagagtcccttggactgcaaggagatccatccagtccattctaaaggagatcagtcctgggtgttcattggaaggactgatgctgaagctgaaacgccaatactttgggcacctcatgtgaagagttgactcattggaaaagaccctgatgctgagagggattgggggcaggaggagaaggggacaacagaggatgagatggctggatggcatcaccgacttgatggacatgagtttgagtgaactctggcagttggtgatagacagggaggcctggcgtgctgcagttcatggggtcgcaaagagtcgaacacgactgagccacgaaatgaactgaagctgcccaagaaaggtctttgaggtaagctgtttcaggctcaatataaaatctagtgatgatggtccgtaaaacttgaattgctctagctgttataaacaagcagaggatttaatttttcaaagtctggggaaacagaaaacttctgtggcaatgaactttattttatttttaaataacatatttgagtggagattactgctgtagtcatcatttttaatctgtgtagctacctcacaaaactcatggattgttcaagacaagaaaaaaatccaagacaaaccaaccttggatgtcattcaagtgacgcctttgaagtgatgttttaagtaattttagcatgtatcaccctttctgtgcccaaacctgatatgtaatattcagaagtcctgggaaatattcaaatcctaatatttgaaactaaaagcagcaatcaatagagacgattaggttagagctggttctgatgagacttgtatgttgggacaggtgtgtccttgatgttggaaagtaaaattctttcttcataatatttatgggatttgaagtgatataagcatctcacatctattaactatcccttgagcataaacaaattctttttgacaaatagaccatcataaagactttcaggagatgtggatccttgggtttgaaagatcccctggaggaggaaatggcaacccactccactgttcttgcatggagaatctcatggacggaggagcctagaaggctgcagtcatggggcatgactgagtgagtaaacaacaacggcaacaaagaaaggtatactaatatgcattcatgatttaatccagttttcaaatgtcctcagttcgttcacttaaaaatttggcttaataaagtacaagggaccagtctcataacagctgggcagaggaaaatattctacttttaaggttaatttgggccttaacatgtatagaatcaaatgagaaatcagttttctatgtgttttagatcagatatttggagctaggtgttgttttaaaggccttaaatatttctttggcccaaggcca

SEQ ID NO: 45370 - DNA, 1061 bp, Bovine  19866881014275
actggagtggaatgccatttccttctccaggggatcttcccgatccagggatcaaaccccagtcttctgcattgtaggcagaccctttaccatctgagccaccagggaagcccttgggattgttttagcattatttacactaacgaatatattctgtaattaaaaattttaaggctctatagtgttagttacatattcatagtcaagatcattatcagctcttttttagaagggcataccattcctgaattctttattttgatgtatctcttacttagccgtatttcattatcaagtaggttctttaaagcaggcttcataagcgctatgtttcctcccatgttatgtgtttgaaaatgtagttatggtgcctttaacaataaattacaacttggctgaatattaacttcttgattcaatccccatttttatttcttgcctttgaactctgctgctgttattccaatgcctcttggcattgaaaattgctgtgaaaaatgctctggcctgaggccagcctgtcttgtagataatttgcttttctgcctgcaatctcatagtaatctttattttttaaagttaaaaagtttcaccaggatgtttctttgatttgatagtttttgcaacatagtatgctcttgatgtctacacatcccagatgtcttgtttcagaagtatttcttcctattacacatccgaatgatctttcttctaaatattttttggttcaactttaaggatactaattatacaattttatattctttctttttaaccactttatgtacttgttttctcttaccacttctttatctttagttcatcgaaaatttctcaggtctattctgtgtttttatgtgttttcaatagaatctaatctaattatttggtttctagtgtgattttgattctgtaaagtatgttttattattatcttcatttatcttctgagttctgtcagtgtattctttgcgatgcttcagataagatacgttctctcttaactgtttcagacaggaaacggcacaaaatttcgtttatagtttcctaatcttctctat

SEQ ID NO: 45371 - DNA, 3495 bp, Bovine  19866881029386
tttgacccatgacactttccgagactatctaaatgaaagggaaagaagttataaagtaataaatataagctgttctttccaaagtttggtgccaaagagaaaactagagatggcagaggaatgtgagcctgggaggagaccattaaaaaggtgaaagggaagggctgctgctgctgctaagtcgcttcagtcgtgtccgactctgtgcaaccccacggacggcagccccccaggctcccccgttcctgggattctccaggcaagaacactggagtgggttgccatttccttctccaatgcatgaaagtaaaagtgaagtcactcagtcgtgtccgactcttagggaccccatggactgcagcctaccaggctcctccgtccatgggattttccaggcaagagtactggagtggggtgccattgccttctccgaaggaaagggcaggactcactaattggagcatctagcttagtataataagggctacgaaagacggagttaatgtatcataaagctaatattttgaactcttcagagttcaagctccaccagatttttcctatcctctcataccctttttaacagcagcctctatccactagtgatccaaagctggacactacatcttctttatagtttatcccccaccacttttacctgcctcctctgagaagcccaaggcctgactaacagcaaagaaaaacagtgatttggatactggagatgggttacatgactgataaatcaagagtctgagcattgagtaggatcaaaaacctaatccaaagaaaacaaaaaacaaatgacaatgcttgatcattgttgtccaagataacataaatcggcaatttgtactcagatcacaagtctgcattttagcaataaattcaaatggtctgatttagaaatgagtgtgttatgctgaatggatgcttccagtgtaacaacagtgacaaagccatttggtggattcctcattctctggcaagacattatttttattggcttttgggcaacatctattaatagatgctatagttctccctgaagattcatgagtctgtgattctcctattaataatacttttgagcatattttgaactaaaataggatttctttttttccaaatgggagttcaaattcagtgctgggcacccacaggtgttttatttagaagtgcattcatggatcattccttcattgccactgtgttcattttgattaaaagatgaagtcggtaacaggcaactgggacagagcactggctggtgcatctcagggtttcccgggtagcacagtggcaaagaatctgccaaggcaggaagacacaagagacaggggttctatccctgatttgggaagatcccctacagtaggaaatggcaacccgcttagtattcttgcctgggaaatccatggacaggtgaggctgatgggctacagtccttggggttgcaaagagtcaggcacgactgagggaccgcgcatttgtgcgcgcgcatgcacacacacacacacacacacacacacactggtgagactgggaagcaggcaacaactagagaaagagatggcagggattgctggagcagatgtcaaggagcctgaagcttgtcctagctctgcccctaatttcctgtgtgaccacttgtcactctaggtctctgagtctccatatgtagaaggagaagtggtgtgtcagaggtatccaacctgtttctggtccaaagatctctttttaagagtagaatatttcatggacctcaacctgatggttatactttgaatcccatagtgctttaaattatcctattttattatttgctgctgctgctgctaagtcgcttcagtcgcgtccgactctgtgtgaccccatagatggaagcccaccaggctcccccgtccctgggattctccaggcaagaacactggagtgggttagaaagcccttattatcttatttagatatcactaaattgttgtgacaataccacctaattaaaaattccagttgctgttaaagctaaaccaaccagatttcaccatatttagagcctgctataagagattcatttagacttgtttataccatgttttgggcttccctggtagcttagctggtaaagaatctgcctgcaatgcaggagacgccagttgagttcccgggttgggaagattccctggagaagggataggctactcactccaagtattcttggacttcccttgtggctcagctggtaaagaatctgcctataatgcaggagacctgggttctgttcctgggtcaggaagatcctgtgaagaagggaggagctgcccactccagtattctggcctggagaattccatggactatatagtccatgggatcacaaagagtcagatataactgagcagctttcacttcatacaatgtttttgtggtatgagatagtgaggaaggtcatttacacattgagtatgagagatatttgtcctttaaaagaaataataatacatagtaataaaatggcctaggatactcagagaccgcctcatatgcatatggagaatgactaaggagccatatgtgaccatcagaagacatctaggcagggagggaaggaatgtgctccattgcaggctgacgtcaggcaattttttcctcattgtatttcttttcatcccacttggcacctctgaactctggaagaacttgaaaacagagtttgggaagtgaaacacataaaataatttgtgatctcaaagcctttttttttttcttcttccccttctccccccttttttccttccccagaaacaggaaacaatctgtctaatcctcccttttgagagtcagtagtgaaatctgcagttgtctttgtacatccttaccttggggaccttaaattgtaatgacatccaaagtccttacttgcggcttcccagacaggatagaaaaatgcttccagtgtgcgtcatatcattgtttaaatgttttgattaatcactttagtttgatggttttttttaaactataacaacctaaaaggaggaatacatatgccatcagtttcctttgctaatatgtgtccccagaaaattctttgtttccaaaacttggttaaaataattccaaagctaaaatttccacctcttggtatattttttttttaactaacttttgtcttgcattgagccatatccttttacaatcccgactcatcacagagatccccttaattagtgaatttcaacaatctcattgggaagatcaggaattggacactttagtttacttattttaagaacacttgaagataaagcttaaaaattggtttggatttccttgacatcacagttcctaggccgtaacaagatgttctcttgtaaaacagattacgctaactgaatcttccaagtggttgtcaggacaaccttttccttcttctcagctaggattcaactgagtgttaacctggatgttcagaagaaaattgaccagctttaa

SEQ ID NO: 45372 - DNA, 1535 bp, Bovine  19866881076901
tggctcattttgccccaaacatatggacacctgcagcgataggaattttatttttttagttctggtgaaatactggacagcttcaagaagagtgaatgggaggtgggaaagagggaatgagaagtggttagatgtagaaggggcctgtttgcaaactggaaggtggacaggacacttctaggtgttttacagggagtgaataagtccgtgacaacaaacactcatacgtctgccttggaaagcagggcatcatcactaagcaccgaggaaaaaattatgatcgcgcttttagggtttagcattcattcatttataaaatatttatgaacattgacttaatgccaagcactattctagacatacagaaggtgctaagtaaatgagtatgcattttacaaatgagtgtgtatttgcataaatagacacataacctgtctctcagtctagtctctgttaatgatctcaaaaactaacattttaaatgaaattttgccgttgaattcagcttccccctcctccagcattgggattggggatttttggattatctccttgaccaagaaacattcttggttctcacgtctctctcttttatggggtggagggtggaaatacagaggaaataaattcacatttactaagtgttcactatattcgcagtactgtacattgtccttttacatcaattattttatttcatcttctccagaaacatatgaaaccagcattactattctcatccagatgatgagaaaactgaagtcagaggcatgaagctgcttactgctcagccagagaatggcagagcctgaagtggatatggattctcccactccagagcacaaactcatttcattacagctttcttccttacaggctttttcttcctgctattcagagaatattcatgttagtattagagaatattagtggtaatttggcttaatactgtaattttagaagtggatgtataattggcccaaaggctttatcttcaattggaaatttgttcaaacccatttcaccattttaagctgtggggcaatgttgtaaagggtgaaataaaagatgagatattgagggctcatagataaagttgatatatcacaaaaataatctctgttctctgtgaacactgggatttggaagagtttgaccaaagtgtttggtcaaggtattggaccaaagtattggatgacttgatactctcatttcacaccctgactccatccattagtatccaaaccatgttagtgattattctttgggatattgagtggggaagaactggctaaggctctaaagaaactttctatggtttagggagccattaggaaaaaactcattgtaaaaatgtcctgaacttttagggctggatttctgcggctggccaagagtcagcctcagttaggatgctgccaaattgagcatcagcagctcatttggcttggaagacaaagaaatgaaaaacaactgacatttgtatacttgaaattacgagttgtttctctaacaaagagaccaaacactttcgg

SEQ ID NO: 45373 - DNA, 652 bp, Bovine  19866881088457
atacagatcctgactgtcagcggaggcctctttagcaaggaagcccaaacagaaggccgaacaggtaattcgcacagcttactgttttgtgcaagatacagccttgtctgccattccttaagaaccgcagactcaaagggatgaagtaaccttgggagatgaagtctatttcttggtacagcaggaacatgcacgatgatcttccacttccacaccagctggcctgttcacacagccttcagctcaccacactccaattcaagattcttcatcaaaactggctctgttcatttcttactgttgctgtaatatattgtcactaactttgtagctcaaataacacaaatacatcatcttacagttctgtagatcaaaatcggaaaataagcctcatggcgtcaaagtcaaggtgtcaggtcacagaagggttgtgtttctattctagagactttatgggaagaatctattccttgccttttcaattctagaggtcactcacatttcttccaggagtgacttcactccaacttctctgctcttccacctccttcttccatcttttacagactcttgtgattccatgggtcaccacctggacaatcctgaataatcttgtcacctcaagatcctgactcaatcacactgcaaagtc

SEQ ID NO: 45374 - DNA, 1196 bp, Bovine  19866881185656
tttatatgtcatcggaaccatgatgctttttataggaatgtgaggctttcaagagtttcctgccttctgaaaatggcaggcgtgttcacccaataacccccgaaaacctgtttttctttatcttataaatacctgcatcaaaaacccccaggttatgccatcactttagggagcaatttgacaattcctggtgatgctgaaggtgttcatacaatataacccagcagttctgcttctagatatcaaccctcgagaaatcccacacgtgtgcacgatgatgctcactgcaacacaatttgtaacagagaaaaactaaaaacaatctcattgtctatcagtagggaacggtggtttatgacctctgtaaaagaaattatgtctacatgtaacaaatgtagacaaatctcaaaaacaatattgagtagaaaagtttacataagaatacataaaacttgtttagtaccattttaataaaatttggaaacacgttaaatgagtatattgtgtatagatttacatgaatgtgggaagagtatgaaagcatgcttgaaaatgctacacagaaaatccttacccttgatgggtggagaggtggaggaaggaaggagaaaaggatggaagttcagaaccctgggtttcatttctttgagagaacacattgagagaaagaagtgtcctatattcttctctaacttggaagggaagggaaaggaaagactgtgccagagtcacgggatgcagtccagaaagtccagtttagtgaaaaaggtggtctttcttcactctcttttctagtgctggtgtgggtaggactggaacctttattgcattggatcgaatcctccagcaattagactccaaagattctgtggacatttatggagctgtgcatgacctaagacttcacagggttcacatggtccagaccgaggtaagagttcagctgaaggacacagatcaccctgtctgtctccctccgcccccaaatgttcagggctttaatctgataaagggaaagaactatgactcattaagaggagaaagagaattgaatattgatgttttctaagactttttattttaaaagaaatttcagtgaccttgaggatgatgtgtattcttatctttactgaactagttgtccatcttctttaggtgggtaggaagaaagagaatttttttaaaaaaaatcaata

SEQ ID NO: 45375 - DNA, 991 bp, Bovine  19866881372268
atagcataaatgagaacagactgcactagagaaataggaggaggaggagaatatattttccattgacttgttagaacgtgtttgttctttctttggttatttcagtattgaaaatgagacaacgaccccaaaaagtgcacctcaggttctgtgcggataggcatttcataaatattttggtattgttataaaacaatcacagaggaaaaaatatcccttaactaaaggacagttcttagttgtatatcacatagttttccttagtttaaggactctgaaaaatctgatctgattccaccgggagcccaattccataattctaatctttacacctgggtttgaaacagatgaatggtcaagtgtaaagacatcagaagaggatcatttattttcaaaggtccaaagaagaaacaatggtcattctaaacttgagagagaaacaataaaattatttaatcatggaaagattaaactaagccactacttttgaatcagaaatttaaagctagtattttgatgtattatcacctcatcttttattcaataaagtttgtgttttagccaactcttacatttctcttgaaagtctactgacataagaaataacagattgataaacagcatctaacactgaaaaatggaaaaatgagatatcgattgggatgttggaaaattgatgttgtcatttgtaatataagtggtgccattaaagattgtttaaaagtaagtcagtaggaatagctcaaaatgcttaaatgaaaaaattattttgtgtactatattgaaaaatgacttatacagtataagcagaagaaagttctgtttttttttttttttccacctggcaaataggcagctggtatctacatgttggtaaatttctatttcctattaaaataataatattcttaatcaaacttaagtagatgtataccgtcttactgcccagaaagactttcaatgtcagtagtcctaatgagtacaagtgata

SEQ ID NO: 45376 - DNA, 1203 bp, Bovine  19866881437340
ttgctatgtgtaacaaaaagagaagctttggtcaaatatatgatgaaacatacttatgaaacagaagccaagactcaagaacagaacgctgaatatgaaaaggcaaatttgaaaatacccagaaataacaattatacacagtatcaataaatatcttacctgttcacagtaaaaggttgtcgagaaggctgctgctttggcatacatattatgctcggcgagcttctgttggggctacctaaccctgaactgctcatgctatttgtcctgctaggaattccaatgccctgaccaacctgggagtggttcatcatattcctaggattcataggcaaaatacccctgaaaaagaagtccagtatactaaataagctctctataatcactcattaaaattctctgtaaataatcagttgacctaaccctagaatttcagatatacgttcaaattgcattgtaaatttttattcatttaattcttttatctggtcatttgaaaagaaaaaaagctttttgaaaagtcaaagtaaacaaaccaataagaaagggcaaattatagaagaatatatggtgatagcaaagatgagagaactattggtgtgactatcacataaaatacaaacatatttcacatatatattttgaataatttcatttcaaatgtatgtcattctatcttaatactaatatgcatcatttttgtgatctgctttattttattctcactagaacaatggatgtgtggtgagggagcaataaatagaatcatctgaggagtgatttgaaattgcacattctcctttgagaaagagagttggcttttttgaaaaaaagctccccaggtggtgattaatccttgatacccatcccagctgataaccagtatgctagctgcaagataaaagcatcctacactatacttatcaatttgcaatgaaattaaatgagcatagggtatcaactttcttttcctcagtgaaaggcactgaaccagaaaatcaaataaagagttactttattaaaaaattaaaaagctcgcttactctacaaagatacattttgagaaatattctggtccatcaatataaatacctgcttggagatggaggcgtgtgaagtgacattgttggtacccctgttgttggcgtgacgtggctcggtaactgagtgccttgtgataagctgcgatttaactgaggggta

SEQ ID NO: 45377 - DNA, 1177 bp, Bovine  19866881469452
cctggaaaatatggcggccaagctgaacagggtgccagtgaggctgaagcaccaactttgtatgtttcaattcgtcctttgaaaagtggcatttataactcataaaatttaagcattactctttgagttagaaaaatgaggtggtagttttcttttattgacaaattggctgtgaacttaatgttcctaaaaaatgagtcatttgaattggaacattaatttatttgagcagctgggtccacatcactctgagaaaatgccattgctctgtccctacacagatcatcccataatggtcccagcacctgcctatagtagtaatagttcaggcttccttcttgccctcccacctggaatctcagatgctggaggtaataacacctttttagaagagtgcatttgagagtccaccttgccacctttgccccacttggagacattaagttttgcctgcaactgagatttaatagtaccgcatgttgtattagagacaaagtctgtcctgtctctgtaagatccatcctataagaaaaagtgggaggaagatcaagccttcagctctgaaataaccaacagggccaataagaactgcaaatacgtcacggctggggaagcataaagggacacactcacctcccatagagatgcttagcttgagtccacgggagccaaatgtaaagttctgaaccagctgttaaacacagccattattaaaaattatataagtttgcaactttataaatcatattaaaaacaaaggcaagaaacactcaaagctcattgcttcctcattattttaccaccttttactattatcccttctcttcaggttatttctgctgccagatctatatgattggacaactgtaagagtgtgccactgaatagctctctcaaattctgagttcagcagtggcacactgatggctttacaatcagccatggtgggtgtatttattccacagatgtcagtaaatcctgtgaatgagggcatctatctcacccctggctgagtgtcaaacatttaccagcatatcacctcccatcagtacatctttccaccctgcaccacacaaaacattgcaacctgctcacctcgtgaagacatgaagacatcagctacatcatttcatccaataattataaagggcaaagtaaacctctctaggatattttt

SEQ ID NO: 45378 - DNA, 1310 bp, Bovine  19866881616482
gctaggaggtttattagtttgtttaggccgcttgaatatagttttaacattataaagccaatagcactgaacatttggaagtagtctggaacttcagtgaatgaaaagattcaaagattctaaatattcaatggtcaacaagtttttaactcatatgaagaggtctcttaaagaccaaaaagaaaaaaaaaaagtcctctaaaagacagcaaaattatgaaattacatctcttaaggttccttaggaaaagctaataaaaatgtagaggacctcaaaattaaaactaagtttgctttttccacttctgctctatcttcaacttaactttcctcctggtcccccacttcttcctttccctgatctgctccccctcctcctcttgcaccttcccttaacccccttctctactgcccatttctaaatatagtcctgtcagtgcagactattccctcacaatatcttttaatgtagatggaaatcattcttcagttttaagtcttggtcaaaacagattttcataatttagcaaaggactttctgattcttcctagggaagaaacagaagttagttgaagattttaagccttgtcttaggaatttatagtctgggcttccccgatctctataaattagtttatctctttgtgggaaaccagaggtggtagaaattcatttgaaaatgagaatggattgactaccgaaatgatacaaaatttaactgtagttaaattttttataaaaagtataaaagtaggataagatctcttagcagctattcctgaggtctttctgtcaaaattcattcatcaaaaatccagttatgtaaggagggagaaaatagatccattcttgatttcagaaacagcttaactaccatattctagaatattcttttctccatagggatgaagatatcacaactgccttaactaccttttttgctgatgatcttaaacctcaagtgacagatttagttaggaaacagagtatgagatagtatacactgctttctctgaattataagggctcagtgagcactttgaagatactttggctcagaaaaacaaaattacagatcaaattaataacttttcagataagccattagagaaatccaggaacaaaaacatctctatggctacacgactgagcgacttcactttcccttttcactttcatgcattggagaaggaaatggcaacccactccagtgttcttgcctggagaatcccagggatgggggagcctggtgggctgccgtctatggggtcgcacagagtggacacgacgaagcgactagcagcagcag

SEQ ID NO: 45379 - DNA, 1082 bp, Bovine  19866881798646
aaagagtgaacagctgtttgcatctggatacggggtaagaaggagagaacagctgctggcagctgtggcagacaagaaagtgagcaagtgagcagctgcgggtaattcaaaatctaccagactgcccagaataattgaaatccagaggaagcatgcaagactcgacttaactgctttactgtatcctgctcttcattagatcttacttgtccttcattagatacattgccatgagagcctcagaagggctccaagcaggaatatcagccccaagctccccatccaccacccttagagaatcaaaccaagagacttgaaatggcacagacttttcttccagtaagtccacatttattaatacttttatgagaagaaaaagcctatggttggcaaggattgttgttgttcagttgataactcatgtccgactctttgtgaccccatgaactgcagcacaccaggcttcctgtccttcactatctcctggagtttgctcaaacttatgtccattgagtcagtgatgtcatccaaccacctcatcctctgttgtccccttctcctcttgccctcaatctttcccagcatcagggtattttccaatgagtcagctcttcacatcaggtggccaaagtattggagtttcagcttcagcatcagtccttccaatgaatattcaggaccgatttcctttaggatggactggttggatctccttgctgcctaagggactcttaagagtcttctccagcaccacagtttgaaagcatcaattcttcagaattcaatcttctttatggttggcaagagaaggaatattaactgaaatggatctaacatgagatggagcaaaaagagttctttctatattacaagagatagtggtcatttggatgatgacaccacattttagaatttggttgctttttagtcactaagtcatgtccttttcatactgttcatggggttctcaacacatgaatactggagtggtttgccattcccttctccaatggaccatatttagtattattatgatcaaagctagtggaggtgaggaattccagctgatctatttcaaatcc

SEQ ID NO: 45380 - DNA, 1554 bp, Bovine  19866881887049
ttgtatagcaaggcaagaagcccattacagtactgggattttaccccaagatcagagtagatcagcaacaaaactgacaacctactgattatcatcatcccatcactatcattaccatgattgcaacagcagacatgatgacaatgtgttatgctttacacaatacattcactggtcctggaaaaaagcaaagaaggtagccaggtcacatattaaaattgccattaaaatgaaaaatcagagactcagaaatgttcattgacttgcccaagatctcaatggcggtcagtggcagaacagtcatgtaaacgtaggacatctccttctaagggaggaagggagaatcagggagtttgggattgacatgtacacatgtcatgctatattaaaaatggataaccaacaaggatagcccagggaactctgctcagtattatgtaacaacctaaacggggaaagaatgtgaaaaagaatagatacatgtatatatataactgaatcactttgttggacatcttaaaaataaacacaacattgttaaccaactacattctagtataaaatgaaaagttaaaaaaataaaaagtaaaagcattgtgttcctactggctcaagccactcatgataagaatgaatattggcccatgatattggattgggctgaggctaagggcctgctgagcagtgagccaaacagaccattatgcatattataatttttaacataaattatatttccttatattttcaagccgaagggttaaacaaattctgcctgtaagggagaacatgtaacattcagactcaactggtccatactgattggctatttccttgtagtgactatttgtttagagagaatatattacacaaaagatttatggcagcttacaaaaacacaaataacacaaaataaaattgaataaaaactaaggaaatgaggaaattggattagaaaacgagtgagaaaaagtaaacatccagccaagaatgaggttagttcacaaaataaataaggcactcaataaagttctatttgctagaggtggaccacaaatttggccctcagctttccagctgtcaagagaaagagggaaatatgattcacagtatttaaatgatataagccaaccaagggctcaggagcaatacaagtgttcttggtactgactagaaaactgtatttctccactgttttatataatgctaataatgtgtatatgttaagtcacttcagtcatgtctaactgtgaccctatggactgtagcctgagaggctcctctgtccttgggattctccaggcaagaatactggagtggtttgccatgccctcctccagggtatcttcccaatcaagggactgaacttgcgatcacttatgtctcatgtctccttcactggcaggtgggtctttaccactagcaccacctgagaagcccagtgctaacattttgctgtgttgttgctgctcagtcactcagtcatgtctgactcttggcaaccccatggactgcagaatgccagacttccctgtccttcaccatctccgagag

SEQ ID NO: 45381 - DNA, 1073 bp, Bovine  19866880486211
tctatgttgaatcaccctctttttcttttactcaagttgttccgtctgccatgaacccttggtctctcacactctgttgaaatcctacttttgttcaaaggtgtggtttaaatgccacttcctccatgaagcctactcttatctttatttttgtggaattaagctccctaacctaagcacgcccatggcactttttataaacctggactggagcacttataccatctccttgacgtacatctgtctctgctttgagctggtgatcaactcagggttgaggtaggtgcatcttggtcatgtctgtagcccttgggactacgccagggcctggcatacaatagaggctcacagcaaaaattaagagctgaaaacagctgattcatgtcagggctctgctggaaggacttgatctcagtccacccgtggaagcaggggtgggggctggggagtcactccttacaatgtcaagtcttcgctccactccacctcaggcccagccctcgtgggcttggtccacttctgttgcatggggttgtcaagctcagctacacagcacacttccccagtgcctgtgaggaaccagaaacataaaaatgctcatatccaagttgagaggccattgagtagtagagaggtcataccctgggcagaggggccaggaatgcctgcagccacagccttggtagcccaccagaagcttctggctctcaccttccagctcacctcccagatgagatgctcgaagctgccttaggaataaccggataggtctggggatggatggctgggcctggggtgccatgggtggcttctcactgggaacctaagagcaggaggaggtaaaaagagctgtaagaatcccaacacagtaccctgaagacaacatgcacgcaaactatttgctttgagtgcctactcaccaggcccccaagggcagagcaagccctaaggttgaccatcatagctggctgggtgctgactatggcatcctcaatcagctcctcaatagtagagagctctacttgctcctcacctctctgcggggaggggaacaaggaggtaggccctcagct

SEQ ID NO: 45382 - DNA, 2228 bp, Bovine  19866880629496
ctcccccagtttgtggccctgataggtgcactccttgccatctgctgcatgattttcctgggcttcgcggatgatgtactgaatttgcgctggcgccataagctgctgctgcccacagctgcctcactacctctcctcatggtctatttcaccaactttggcaacacgaccattgtggtacccaagcccttacgcccgatccttggcctgcatctggacttgggtgagtagcacggccacttctgcccctatgacccctacttcagggcacccttgccccctgtgagatatccggccgagcatccttcctggtgctccacattctccttcctgttttgtccccgccttgtcttcttagatccttctgttgacctttcatcccacacttggtcctcaccacttttgtcagaatatccttaaatcctcgttccacaggcggcattacttttcttactgtcttcttcccgcagggatcctgtactatgtctacatggggctgctggcagtgttctgtaccaatgccattaatattctagcaggaattaatggccttgaggctggccagtcactcgtcatttctgcttccatcattgtcttcaacttggtggagctggatggtaggtgggattggaatagggagagaagtcttgagtgttaaggaagcggcctgatctttggctttggggaattcagaaaaaatgtgatatgtgaataattatggaaaataaggggagctatttacttattaatagtaagttacaaatagtaactaagatttgttaaatgtgagaaagaaagccctagcatttataaagggattgtcactaataggtaggccatagccttctcctattgagcataaacaattttataaaaccccaaatcagatagggtaactgtgaccaaaaccagaccccctctataacagtctgagaatagacaaaaccacaggaacacagtacatctcacaatgaccaagatcccgtgctggctaaaatgaatggttgctgcttccttctgataacagctcagttctcacttcttggataaaaattattaagcttctcaatcatggcactaaccctgctgacagcacccagtccagggcaaaactctgtttccttgtatcctccgcagaattacttaaaacaaatcctataacaagtcctcctaacacctccttactgaggcatcctaaggttccccacagtgtgtgggttccaaagtgtcctttgttacacctcagtaaacctagctttgactccaggcatgtttttagtggtctttggctgaaggacctccataagtgcttattaaagttaagcactttgaaaatgtaatctcactttaaattctgtagcagctctatgtggcaggtattttttatcaacttctttcacagataagaaactgagactcagagaggttaaacgtgtcatgttaggttaaatgtgtcatgatcatggtcactcaggaagtaaagctgatattcaaacaagagtgtgaatggtctgaaccaaatgtaagacagtaactagtttaggaggggttcatgaaagaggtgaagtattggaaattgcctgggtgatataaaaggggtagtgagtccttgagactttagagaggtggactgtatagcttgggaaagaacttaagagacagaggaaaataggaccatgatgtgcaggggaagtggacatcaacttttccttctttctttttccccttcttccaaaggtgattatcgagatgatcacatcttttctctctacttcatgatacccttttttttcaccaccttgggactgctctaccataactggtaagtaggcctgtggatggggggacagctctttggacatgtggcaggtattgtcctgattgtgacccatctcctgatacagaggctaaacctgcacatctctgtattgttctctgggtctttagttggttatattcttaagtcttgggcttccccagtggctcagtgctaaagaatccacctgcaatataggagacctggttcaatccctgggacaggaagattccctgaagcaggacatggcaccccaccccagtattcttccctgggaaattccatgggaggctacagttcatgcggtcacaaagagtcagacatgactgagggacttagcatgcacgcaattcataaatcagtcactgaggcagatgctgtgggagcccccaggaatagaaggaatcagggc

SEQ ID NO: 45383 - DNA, 871 bp, Bovine  19866880789803
ctgggtatgagacatggggccctccccgaggacaccctcaagatggaagcacctcccagaggagaagctcagcccaaacccaagcccaagctcacaggctgcttcccctgtgtcacccgcagaccccatccctccctccctggagtccccatctggccccaccccctcaccgaagatcctcaggccccaggaagcccaggtcaccatagttgatgtggaagttgaagtcatggctgtagcgattaaaggtgatgactttgcgttgagggtagggtcccatgcgggagaagaggacgcgcttattgtgcttcaggctgcggaccccagtctcctcctccacctccctcgtgaactccacctatatggcaggagaagggaggcccggtggagaagcacagcagggtctggggtggggaatgccgatggcaggaagacagagggataggcttgagcagacagtggagatgaccctgggagaggtatggggagccttccacccagcacacaggcttactcaccaggatggggtagatcactgcatcccggacgacgaaaggcttcaccttgaaggctttgctgagcgcggccgcctggtacacagcccccatagcggcggcttcgtcggcattgatgttcttccccagctcctccctgtgaacatcccaaggctcaggaccatccatctgcagcctggcctggcccccctcccctcagccctcctgctgctcaggccccacactcacttgcccacagccttcagcagcacctcttgcactttggggacacgagtggccccgcccaccaggatcacctgctcaatctcatcctgtagggggagaaagcgggggatggggtcggctccgaggtcacc

SEQ ID NO: 45384 - DNA, 1274 bp, Bovine  19866880851753
tggggaaggagtgctgtctctataccttctgtagaaaagtttttttcaactgtgttatgacctattagtggctagtgaaatcaatttagaggattgcaaataacaatttctttttaattaaagagaataaaatagaacaattcagagagaatttaatcaaggcaaggattgtttttagtatttcttaacttctctatacagggttgtgacataaaatgcattgctaaattttactgcatttcacagtaaaaaataaataaataaataaaaacactgccagagtgaaaaaagcagactgccaacagcttgtacaatatgatcctttaaaaaaagtaaaatctaatttatatatatacatgcagagagaggtcaaaaagaatgttcactaaagtactgtcagttaattgacttttaatggcaagaggaaaggttcattccatatatccttgctgaatgagttttccagaatgagtctacaatgtttttataaacaaataaaaaaagcacaattaagaaaataaaccaccactctcactggctgcctttctccctctgtggcaaggagagtcagattttccaccatcccttgggctctttccccttcctgtgtcctgcttccttaccaagcagggtcctcctcctcctcttcttcctccccggagccctgcaggtgctgctgcaggtgctgagtgacatgctcgcagaattcctccatggccgagcacacaaaggaacaggacccccactcacactgcagccccaggttctccttccggggaactttcccaggtggcggcatggccttcaccctagaggaggaagaaatcagcacctgtacagattccacccaagtgctgctgggggttaacacgggacagccaggccagcctggagccaagagatgtttttcagtgaccctcaagaaacgctgtgctttttcagtaaggacagagtagcagttcttcaaacccctggaagctgtttggtgttcttgggaatggagaatacaaactgacattattgagcacgtaccaggctctgagctaagaactttaacagacactttttcaaggagcttcagagcaacccatcaagaaggaattactcctacaaaaggcagaacaatgctcaggttcaaaaagatgactttgaagacccagagctcagattcagactcctttgttcaccacctacttagctgtgtgaccttgaacaagtaagcttaacccttctattcctgaacacccttattttcagaatggggataacaaacc

SEQ ID NO: 45385 - DNA, 1608 bp, Bovine  19866880918196
agtgccctggaggttgggggccttgtaggcagcatcgcagctggctacctgtcagaccgggccatggccaaggtgagtgggcagaagggacaggaaggaggagggtccctttaaatcttcccagcatgactgggacaccagaagtgggagccctggggcacatgcagcttggcatgtgctggtttaggctggctgaagtgggaatgtttccaggatatttttcttcattaagaatgtggagatgaagttaaatgatgtcaaggagagccagcatttctctctgcctagcttctccacagccccaggaaaactgggtgcagcctgccagcccatgtcctcgagcctgccccaggtggagaaggggatgttgtggagtttggcctcagaacataataagcaggtctcagggcctcccagagctgccctgggccaagaactgcagtgggattgccaaagaccagccagcagaggcctgctgtgtcagagtccaggggtgggggttctctgctgctcctggggcctgacattgccaggactgtgcccacaggcagggctgtccatctacgggaatccccgccatggcctgctcctgttcatgatggctggcatgacggcgtccatgtacctcttccgggccactgtgaccagtgactcccccaaggtaaagagggcctggctcacagcagggacaaggatgagaaagcaagggccactgactctgtctccctctccctggcctttctcggactgtccttttcagcggttcgttcctcagttcccctcttctatgctctggtgcccctccttgactctgggcctggtttcttctccactctgtgctcctctaggatactgctttctggactccggctcttcaccctcttgctgagatcacaggctttacagagaatgaggtgctccatctttatctctggtttctctcttggtgtgtctcacctttatcctaccgcgctctgcctcgtccctagccaatctggcttgcacaaatcttgagaggggacagcatctaactcaagagggatggcttccgtacctccctcacctacccacacaggcccctaggtcggttcagtgtggcccctgctcctccagtcctgtagtcacatgtactgggaagtggtctgtatgcaggagccactctctccttacaactgtttgttcccagggccaagcactctctcctgtggcaggggcaggtaggtggcagtctttctcaaactctaattgccaccctgcactgcctttacagctctggatcctggtgttgggagctgtgtttggcttttcctcttatggtcccattgccttgtttggagttatagccaatgagtgcgcccctcccaacttgtgtggcacctcccatgccattgtgggactcatggccaatggtaagtgatacccccactgatgccttgcactcaggcagcgaggggctggattaagcccctctggctccagcctcacagtgacacaggctcttctcctcctccatgacagtgggaggctttctggctgggttgcccttcagcaccattgccaaacattacagttggagcacagccttctgggtggctgaggtgatctgtg

SEQ ID NO: 45386 - DNA, 1257 bp, Bovine  19866881014380
ccactgaaaccccgagcccagacgatgcagcaaagtgaatgtctgccctcctgtggggcatagaaggaatccctgcttcctgaccttagttctcgtggtgagaattccttcagaacaggaaggaggtttgaaaaaagtagaggatacagacataatattggagcaaaacagaggagggtgtttactcaagaaacaagcaagattgccaactcgggttgaggtgggtggtcgtgaatttgtagtggaaccagtctgtccttttgtgtgacttattcttcaataacactcaactgcaccagtgtcgtggtgaagaaagcttggtgcagatttcctgggcccttgaaccaaaagtggagtctttgttttaaccaagcaactgtaaatatagaccactgacttaaggcagattatggaggaaattatctgtcctagagtaaatcaagtgcctataccatgaatataggaaactggaaagtcacacgcatcagatataggaggtcatgctgagggtggtgaggccggaatccggagaggccgtggacagaagggtccgctgccctcacttcacgaccggcggctgcagcctggatggcactgcccagcagagccagagaccagtgtcgggtcggggggggagcactgaggctgctaagtgggcacgtggatggggagccccccgcgggacagtgggacaagggcagcggcttttgacaccaagcagtgacaagtgtttaaagaaggggacggagcgagcatacgccagcggagacaggacagaacccgcccgggagcaggcgaggtctttgttctgcttaatcaggtctctttgtccctgacttcaagcctaatccagaacagaccagcttagctggcccagacccagaataaggaagttcattattactgggtagaagggaacagttaccccattaaaggcagctcccaggcccctctgccccagccgccttcctcacgcagctgctgttttgactgcacggttcctgcacttgatattcaagttccatagtcatttcaggaagcaatctgtattaataaaatgcaaatgtatacatcgtggcatctcagtgacaagacaatttcctctggcacttactttgtcctaacctttttgcaaggttgagaaggtactatctccaatattccttgttaatttttctaggcaatgccaattaatttgctgaatggattttaactttatggctttctttttactgtttggaagcaaacctctaatca

SEQ ID NO: 45387 - DNA, 1106 bp, Bovine  19866881033541
ggccgctgcgaggattcactgagacaagagccgtggcacagcgtaagcatggagtgacaaccttttaatgggtgcccatcagcagacactgtgccaggtgactgagccctcaagacagatatagctaagcttcagataccttcaggggccccctctcctgagaacgtgcccccagccaccaccccaagtaggacagcctgcacctatgccccttcttcaatcgcttacgatccaacgaggactggcgacggatatgatctaagaacttggtgttgttggcaaacatgcccccacaggtgggacaggccaccaccttctcctgggtatggctgcggaggtgctctcgaagcttaaagcggtccttgaaggtgcaggtacagcctgggaaggaaggcccggtcaggtccagccacaaacccccagagtagggtctgcacccccaagtctctccagccagcacccaaccctgccctgcaggactggtcctacccctagctgctctggtcccttagcaaccccagagtttctttagaagccataaattaaggagtggccctacctttccagccacagagcaccacattgttgtccttgccaactacttggtattcacaacacaggctgtgcgcttccacgtgccggtagaaccactcggggttgtcgaaggagttctgtgccaggagcaacttggggtaaggactgaggaagggtggagggactcctactctcaggtgtccagaggggggcttcttggttctctcccaaattaattggtgggataggaaagtttgagcaaggggctacccagaaatgaaggaaagctactagcaggaacttcaggaacatagcgtatcccagaaaggattaaggagtcttgagataagatccccaacccctctccatccctactcctggctctgtctgctgacctcacagtgctcccacaggcacaggaagtggtcggggatgtcagggatgaggttgcggctctggaagtccaggatgcaggggctgaggtcagcctggctctgcagggccctgcagtccccactgtttcagcttggtgtggtagcagtggaagtagacatggcggatgagatcagcag

SEQ ID NO: 45388 - DNA, 1653 bp, Bovine  19866881173577
gctagcggccgggacctggctaattcctcaaggcagagagcaaggtggcattagggagcagaaagctgcttagcttaggtgttgtaagagcttcctaattcttccacggcagttgaagcaaactgctgcagccccatccagggagcagaatgggaagaactgaggagggggcacagactgggcacagacagaaacaaatccacagggctcatttccctggcaaaccggggaaagccaacttctctgctactgtagcagtcttgtccgaaggtcaggccaaggaagatggatggttagaaccccaatctccccaccccctccaagggaggctaatgtccagctgagtcagctgtcctggggagtcagtcgtcttggggagtcagtcctgacagaggaacaaggtacagggagagctgggtggaagactgagttcatggtgcagactgacagatgccatctggctttctggtcagctgagtgaaggaggaagagcaatttcttgtgtgtctactgtttccaggcatctgggcagctagttgagtgaagccctccaactagtggtggctggaaatggagaaccctctgagcgaggcggttcataggctgtgaaggccaagatgagtggggatcccaagacaaggaggtctcacttcccactcccacctcagtcttatgaccgtgcttcctgccccacttcctaggaggccagctgctggtggtgcaatgggaggaagtaggctgggctggtttgtgactgaccctcaagggactgctctaggcttatgtgctgggagggccatgaattgtcagtctcctttccacctgaacacctttccttccacacagacatggcagggagcatgaagaaggatgtgttagactggagcaatgaaattactgagggatggggggtgggtgggattcaggcttctcggggacctgcctggtcacaccagggatctggggcatgaagtgctgactgggtgtggtggcaagaggaccaagcagattctttcacaggtgcacctcttttctactcctgccagccctgctctccccccactgcccccccccccccacacacacaaccagcacccaggctaggcggaagtgccctggggcacagggattagtgttgctatgagaacagcaagttgtgcaccggtttggagccagagagtacctagaccacaggaatagaaaattgggatatagctggatttccacaacgcccaggcacacctgcacccttctctctgaccccagaggggaggagatgccacggggttcctcagttgatccccacccccatacagtcctcctggcctgagcagtccttcctcttaaaaaaaaaaaggcagagtgggggggaccatctaggtcctgtcctactcaccccatccctgcaggcctgctcgttcagcgctcgcacccaagcccgctgccagttctcccggaaagacttgaaggcgaagagagatgccagaaggccccggacgcctggctcctcgggtgcgccggcccgagtcgcccttagcctcagcagcgagcgccacacgcccagctcccgcagggagacggcgggctcggcagcgaaggcgggtccctggccccggcccccgcgggcccgcgccagccacaatccccgggcat

SEQ ID NO: 45389 - DNA, 1695 bp, Bovine  19866880340941
tgccatttatggggtcgcacagagtcagacacgactgaaaccgacttagcagcagcagtaacagcaggcacttcagagaggagttaaagaagaggttatgggggaaggtctgcccagggaagaccccataggatcctgttcagtatctagaatagtgcaaggcatttagcaaaaatttcatgaacatggaatttagaaattagcccattcaatgaaatggtcttaaactatacttggaatgctatggcctcaaataaatgaaggcagtttggtgtctatgagtagggaaggtctctgagcattgtcttcttgggtcagaatcctgctttatgtgactttgtacaaattacttttctatgccctagatctctcaacaggcaacagaaataataatagtgcctttcctacagggattttgtgagaattaaaccaaatattgcacataaagcattgcacatggaaagtgctggacaaagtaattgatcacagattattactaatatcatgatcattttaattatgtgataagaaaaatattcatcttgtctttagctttttaaaatttacattttttccctcaatttttcaaaaggcaaaatcagggatgtctttcatgaaggtaccataagctcatctgctgtgatggtgctggtgaatgccgtgtacttcaaaggcaagtgggagtcagccttcaccaagaaccagacccaaagttgccatttcagatctcccaaggtatggaattctgtttaatttaggaagatttttgccaataatatgcctttacagggcttccctagtgactcagacagtaaagaaatcacctgcatgtaggagacctaggttcaatccctgggttgggaagatcccctggagaagggcacagcaacccactccagtattcttgcctggacaatcccacagacagaggagcctggcgggctacagtccatggagtcacaaagagtcagacatgactgagagactaatactttcactttcacacagtaatcttagtatagtagaaacatcaaagactttgtagtcagacatgccacgttagggttcttaccttgcttcagaggaattgccttgtcttagcacatgaaccttaaaaccatagtctttctcacaagtaaaaccaagtgattccattagttcacctagaacattgctttcaatactttggtcacctgatgcgaagagctgactcattggaaaagaccctgatgctgggaaagattgagggcaggagaagaggattacagaggatgagatggttagatatcatcaccaactcaatggacataaatctgagcaaactctggagataaagaaggacagggtagcctggagtgtggcatttcatgatgtacaaagagtcagacacgactttgtgactgaacaacaacaacaaattcctttcaatcctcagtttttcatgttgaagcatagaaattcagatttaacgtttaaacatagttttatttttaagtggaaaatgctattgaaatgttctttctgcatctttccacatcagaagttttagacacaggagtgctgagagctcctggaaatcaaagatgactgataagtgaggagatgcgcagtaagaagttgtctagcaggccgtgtctgtgggggagaggagcgctttgggtggaaggagaagaaacttgagcacagagtagatca

SEQ ID NO: 45390 - DNA, 1070 bp, Bovine  19866880454627
atgggttgccgtgccctcctccagggaatcttccagacccagggatcgaacccctgtctcctgcatcccctgcattgtgggtggagtcttgtactgctgaaccactggaagacctgccctcccatccccgatttgcctctcctgattgcattgtcatcaggtttcaagccctgcaattggaacatccaaattgcgctccttatctactggaaaaatgtgcctttaatttttaaagacagttcttttaaagccctgcatagctttgatcatttttttctctttctaacaggtggtgctttgtatatcagttgatgtatctcaagactatagccaagtagagaacgtcataaaacaagtaagaggttgggtcagttgaagttaatccactcgccttttgattggtccttgccggtttgacgtgtggcttggagttggcatatcttccctgtaggtctgatagttttatagattttatttactggcttgatgggctactcacggcttctttatttctcttcctcgatgcccaatttgataaacttccaggcgcaggagaagctgggcccggtggacatgcttgtaaactgtgcaggaatgtcactttcagggaaatttgaagatcttgaagttagtacttttgaagtaagtaaaaatttgtttcttttctcactgtggtggcccatacactaaaagggagaactgctgctgctgctgctaaatcgcttcagtcgtgtctgactctgtgcgacccatagatggcagcccaccaggctcccccgtccctgggattctccaggcaagaacactggagtgggctgccatttccttctccagtgcatgaaagtgaaaagtgaaactgaagtccctcagttgggtccgactcttcgggaccccatgggctgcagcccaccaggctcgtccgtccaggccagactactggattggggtgaacggggaactagttcatggctaaaactttatgaatgaagtaggtgaaatgcattccagttcaacagaagcttcagcaaactacaggaaggctggacagggttttagtcccagtgatcatc

SEQ ID NO: 45391 - DNA, 1682 bp, Bovine  19866880467316
attatggtttcagtttgtctgccctctgttgccctctcgcaacacttatcatcttaacttgagtttctcttaccttgggcgtggggtgtctcttcatggctgctccagcaaagtgcagccactgctccttacgttggacgaggggtatctcctcaccaccgcccctcctgaccttgaatgtggagtggctcctcttggctctcctgcgcctgcacagccaccgctccttggacgtggggttgctcctctgggccgctgtccctggcaggcctgagatttcctggaactaaggaagtggctcttagatttcccccacccccgcctttatccctgcgcttttcagcaatttgattttgatgtgcctcagttaagctttttcacttgcttttgcttgctatttgttgagcttctggtatctgtaagtttgtcattttctccagatttgaaatatttttatctattaattcttcaaaacgtttttctgcctgtctcttttctcttctgaagactccagttccctgtgtgttaggctgcctgaagtcatctccccacttattaatgccctggcttttcatttctcccacaggtgtttgtccgttttggagagtgtatgggacacaggcacccttcatggaagcagtctaagtggagagactgcaggtctctggagtgcctgtgcggctctcctcccgccaatgcacacgtttcctttacttttcccagtgttttggttgtgactccgtttttgctccttgtggaagttttccttaataagcattttgtgaaagaacgtggacatacgcattcataatctggtgttattccctgtgcctcttacactctttcagtgctatttaaaaataaaatcttcagcagaagagagtgggggaaagccatgaagcataaatatgtgcttatcatttttcttcacttataaaaattggttgatgtaaattagctggggtttagttttgttgttgttcagtcactgagtcatgtccagctctttgccacatcatggactgcagcacaccaggctcctcctctttgttttctgaagtttgctcacattcatgtccattgagttgatgatgctatctaaccatttcatcttctgacacctgcttctccatttgccttcagtctttcccagcatcagggtcttttctaatcagtggctcttcatatcaagtagccaaagtattacctattcttaatctactcagagtcacgaagaaagagacaagactggattaggcgaatgggagaagagccacagctgggttgggcatggagaagaaaagatgagttgactcagcacagaagcgtttttctttgcaggttgtgtgtggcagccctgtcggtgaataacttctgcgataaccaggaggccctgtacggtgtgtttgacggagaccgcaacgtggaggtgccctacctgctccagtgcaccatgagcgacattctggcagaggagctgcagaaaacgagggacggggaggagtgcatggtcaacacgttcatcgttatgcagaggtagagcttccggcactgctgcggcttcatgctggttcccggtcacgctgtaaaaggccaggagtgaaggcattctccctgtgttgtgtgtgtgtgtgtgtctgtgtgtgtgtgtgtgtgtgtgtgtgtctgtgtatgtgtacata

SEQ ID NO: 45392 - DNA, 1685 bp, Bovine  19866880476095
cagtgaccggggacacttctgttgccacaagtggaagaaggcatgctctggcatccagggttccggggtgccatagcactgcccccctgcgcccctccccctggaattatcctgtctgaactgccagcagcgctaaggttgagcagccttgctctctgggaaccacagagcaccgtggtctctgtgtcagatggtcaggccccgtccccaggaggctggccatcgccatgtgtcctccgccacgggagcaggcagtgcttcatgggtgatggggatttttttcttcacaggtccttcattttgaaaatgtcaaagatgtgccctttggatttcaaacagtaacatcggatgtcaacaagctgagttccttttactccctgaaattaatcaaacggctctacgtagaaaaatctctgaatctttctacagtaagtggctcagtggaattagcaagattcagctgtttaccaggggtgacgttttctcatggttagaccaacgactttttctagatgctcatttatggtttatttaaaataaattaatcccaggggagaggttgaatacagtgggaatcaactgcagttacatattttaacttaaaatacagaggagccatgagcttccttttttcactctcaaacacccacacaccccaccctttctcttagcttcctcactgagagaggtgggaaatggggttattaactctctaacaaatgcgtctctatagatgtaagacagcccgtgatttaaacctctttctccttcagcgtcagggcaggtgacctgggaagatttcaacttcttcaccttgcttgttcatgcacacagtattcttctgatgtttcccaaagtcagtaaggaaaataataactgtacgaagtgacagttttcgtcagtcacagaccattttgtttgttttgccaggctggtcaggtgggtatccaaggcagtggtggtaattttaggagtttcttggaggaatcatataaagaccactgaaatgtccttaaatttgatccagagtgaatcataatattttaaaaatcttcacttgaaacacgcagccaacttcctcaactacagagatgctcattctctgctttagtaatatcgagttcagtttgcgtttggatggtcagaatttcaagctttccaaatctaaaaggtggactaccagttaaatattttgccttagttttactatcttcaaataaatgtttgtattctggcaagaatcttttggggatgtagatcactagatactgttgtgagtttgtttttgttgcttaaagacacacacacacagccttcttcttccaaaataacctgggggaattaaagaaatattgagatgtgagttggggcccaagaatgaaaacatttaaaaaactccctaggtggtccttaaagatacttaaatgcattttgatgctggcggtgaagacagtggaggcccttcctcttgcaaggtctctggaatgttctaagctctgtcagtaaatggtaactcagtcccaaggttgggttgcagtgaagagaatccaactggctaaggttctgactgctctgaaaaaaatccagggagtcctgtattcagaagtaaagtgacatggcatttaatcaatctgtgtttagttggttaacttccattcaacatttcgaatatttcaaaccaggag

SEQ ID NO: 45393 - DNA, 744 bp, Bovine  19866880514109
ttgggaggggttgcaggaagcctggggctttgctctcattacagggacagaatctaaaaaaaacaacaacacccgagtgtgtgccttgtccgccagctttgctagtggcctggcaggccgtcagcaagcagatgtgcactcaaaagaccacgcaggtgcagctggcaccgcaaacagcaggtgatgcaaaggagcaggaaattcaggatgcctcaactcctggctgacttaaactccaaaaaatgacgcgcctttatattcctgacgttcgcccaggtttgagtactataaaaagaactggagaagaataaaatcagaaacacaccttttggcattcttaaaataaaatgggaaaaaaaagctctggggactgacaggaagaacaccagagcaggcggcattactcactgccatttagccttggccgcgcccgcgcgggtggcctgtcccgtcccactgagtggtttccatgaccccgctgtcttcttttgttcccttctgtgctctacaattttatcttaaatgcccagtattctacaaagtctctaatagcttggacgttcattatccgcaagggggtttcagttcactgctgctaagtcgcttcagtcatatccgactctgtgcgaccccatagacggcagcccaccaggctcctctgtccctggggttctccaggcaagaacactggagtgggttgccatttccttctcttctgcagttcactacctcccctaaaacaaa

SEQ ID NO: 45394 - DNA, 2071 bp, Bovine  19866880554286
acactaagttggaaaaactctgacaatccaaatcttgttgagtataagacgtagcctgcaccaccaggctagggaagaacattagaaattcaaggctgcatttcgcttcacccagctaacatttaagttgtcattgcccagttgctcagtcatgtccagctctttgtgacccccatggactgcagcagcaggcctccctgtccttcaccatctcccagaatttacccaaactcatgtccattgagtcagtgacgccatccaacaatctcatcctctgtcttcccctcctgccttcactctttcccagcatcagggtcttttccaatgagtcggctcttctcatcaggtggccaaagtattggagtttcagcttcagtccttccagtgaatattcagggttgattgacatctaagtcacactggtcaaaccaaagctgtgtcactgaatctaggatttcacctcaatcattgcagaataatgtagtatttaatatacaagaagatgagtttagatagaggtcaaatctaggctttgtcactttatgtctgtggcctttatagaatctgcttcatgattgtagaactgataacaattttatagctacatcttacaggactgtgtgaggaatacgtgagattgagtagaatgactggcacataataaacactcagtaaaactgtatatgtaaatgccactggaaaatggcatcattcgcgttagaatttgggaactagaaagaacgtaggctaatcctctcattttacaggtgaaagatatttgtccaaagtcatgcctcaatgggaacagctctcttggctcccagcccagtgtactttccattaactctcaatattctgccattaaggacctttaaaagagagatgagaaatatgttttgttttctttctggctcataagggataattattaccaaatttgttttgtgtttcatccatgaccttactcttgggcaacaccggcgatttgcaggaagttatgtgacatttcacaaccttaaataggagtttggtaaaaaccatttcactgagactctatttccgctcaaatgtaatctcttgaagatgaatatcatgtgacacttcttatccttcattttattttataatgtgaaattcagaggatgccaagaaagctgttgacaactgttccagagggacttacctcatggagtgccatcgcctttgtcccgtagagtctgttggcgatgctgagggtatagttagagtctggcctattgatctgggagaaaaagactcctaagtctgagtgaatccttccagcttggttgcactgaagcaccagtaaataaagaagggagtactaaattgcttgatttcttgccattagagagtataaataatgtgaaagcaataactagagagcaggacgtttgcctctgaatagaagggcagtgagtatgaacaaagcaagagttggcagcggaaagccttctccttctccaggtttcctctcccacaataatctcggcactctgggactttggctacagaccatgtgcagaattgtaaactaccgcaaacacacaaggacttgtcagctctcgtggtttaacccaaaaccggacattttaatgaagagatcctagtggggattttcagagcgatgatccgagtgtgattgttgcctttgcgcctaaagaatcactttccttctctctctctcatgctcctttcaatgtctccattttctatgtgatcatttaatcaaatactgagctctttattgaactgacctgacacacccatctgtccatcacagaagcaattcacttaagcatgttttttttttttttaattgaaggatagttgctttgctgacttttgctgttttctgtcagacctcagcatgaatccgccacaggtacacatatatcccctccctcctgaacctcccttctgcttccctccccatcccaccctcgaggttggtgcagagtccctgtttgagttccctgggacatacagcaaattcccgttggctatctattttgcatacggtcatgtaagtttccatgttactctctccata

SEQ ID NO: 45395 - DNA, 1590 bp, Bovine  19866880556987
tgtagccgaatgggcctggattagaggttagggcagagctgtccagggagaggacctcacatctggacactcagacctcaggacgtgcgggcaggagttgcatcaccactggctttagatttgcatttacaggaagttcttgcctctcctctaccctagcccgtgactttgactaggattcttactgcgctgccggatgcagttgagggcacttgaaaggtgctttagaaataacctctcccttgtcctttattccaggcccacaatggaggccctgcgactggcaaactcggcctttgcagttgacctgtacaaacagctgtgtgaaaaggagccggcggacaacatcctcttctctcccatctgtctgtccacctctctgtcacttgctcaagtcggtgccaaaggggacacagcagatgaaattggacaggtaaggcccgcagcttgcctctgctttgagtggaagagagtaatcaagacgcaccggtggtgcctggggaaaggcagtgaggctctgtggtcagattggctcagggctgagtattttgccacttctagcactctctcaatttactttttaaatgtgaaagctcatttatctggcctgccacccacgtttagaacaggcactgtgttgcgggggagaacccggggattaactagacaatcaaaagcatttccactaacaagtggcctttgacaagtcacatgacatctttctacctgttagaatgtaagtgtcaatcaaaaggatgttcgttaatgttccactgcgaataccccaaccaggaagagtgatatctaaaccctctgtcttatgcacagaatttattaaagcatcatgctgtatattaagatgcagactccactatattctactctatagtatattctgccctattctatatccttactggatagatagaatgtacccatgcttatttcaatggagaatttacacttgaaattgagtgggacttgaaaaggacacttcctttgtggggagaggagcttcatcttttcatccctctttctcccaccgcaccatccctaccccatctccctttcctcacgcctcacctaccattagagaagagacaaaagagcgtttctggtactgcgcctgctattgttctcctacagtgggtgcttgggttcttaactttctggtctgtttgcctgtcaataggcgtaacagtaatgtaccactttggaccagccagtttgaccctgcaggactgaggctgtgtgactcacgggtgcagtgtgcccataagtgatgtcacccgaggtgtggcatcagggctcggttattatgggtcaggatgtggagagaagcaccttatcctgatgtcatgttttgggcaccatggaggtgaaaagaggctgggttattggttggaacaaaaaagttacgaataaaataaaaggttttaagacttccagaaaatagcatcctgattttaagtggcttattactataaaaataattattaacattttgaatccatataatattctaggtgttttacagatagtgtctgtaatcctcacggcaatttagacaactaggcgttgtcagtccat

SEQ ID NO: 45396 - DNA, 1218 bp, Bovine  19866880601042
gtaagagatcagttatcctgtatccacatgactgctggtgtatttacatgtttgtcacagtctgcggtgacataggggcctcaaaccccaacaggctgcgcgtctcaatcagggaggccagaggggggcagagagaagcagatggaaagacaacaggaaaagacttgtttttaacaaattacttttcctcgtcagtagtcaccttttgtcatttttgctatcttctaaaagggtctctctctccacgtcccacacacacacacacacacacacacacacacacacactgccatccaaagtccttttgataatggtgacgggctctgcgctggttcacctaagctcactgagcataaaactcagcattttcaaatggactgaacttccaggtataatataaggctgagaaacaaagtaaaagtaacagctttccaggaattaaaaatggaaatttagtttttaaattaaattcttctcagatttcttctatgagaagacagacacattgagacaatagacagaaagtaaagattcttaaaggactaagattaccgaggtgaagcagccgtatcatctgcggagtctctggacatttctttggcttatttgagaaaggactaagattaccgaggtgaaccagccctatcatctgcggagtctctggacatttctttggcttatttgagaaaggattaagattaccgaggtgaaccagccgtatcatctgcggagtctctggacatttctttggcttatttgagaagtcccaccgagcgtcagcctccacacagctttgtcacgtctggctagcagtcaaagcttcagtcaacctgtcactacatgacgaaatactactccttaacagtcccacgagaggtaagagatgcgaaataaggtttgaaaggaaactctttcaggggttcataacaacaaattaaacactgaaccagcaattttttccattgttcatcttatttgagattctctaacttaatctgtgcttaatactcaccgtgcaggaagttcacatatttgattatggccaatatccaaaacttctagctttcggctttcacagacccactcaggtacgttttctaaacagttcctaaatgtaagaatatacagtttcttctttggttggaatgtggctcaaaacatggttcacaagtcaaaataattacatacaacaaataaaacttcaaaggaaatactcaa

SEQ ID NO: 45397 - DNA, 1576 bp, Bovine  19866880652925
ataaagaacatgcctgccaatgaaggagacatgggtttgatccgtgagttgggaagatcccttggagaagggaatggcaactcactccagtattcttgcctgggaaatcccatggacagaggagcctggtgggctacagttcatggggtcacaaacggccggacgtgactgaagcaagtaaacaacagcaacagagcagacaggctgcaggcactggtaagtttccgtggtagcctaaatgtggatgccctgcaccagcctgtggtcattatgattattccccgagactgtgcctgcctaataggccaagtgctgatcaccaccacgtgctctgcgccagacacttcttatttaccgtctgttcatgtgccgtgtgtctcattttacaggtgaggaaactgaggctagcgagattaagcactttgcctagggtttctcagacgatgaatggtaagatagagtcattttccaaatttatgatttgactcttaaacccacatttccccactacagctgaatggtgtcattttccaggggtagctggccagcatcactctctgatgaccttgttgcctctactagttcccctgatgcctgaaattctactttcagagttcaactcatttagtttatgactttgacctggttcataataaaacgcccagggcgtggggagaagggaagctattagtcactcttcgtcactctcattcatatagccaacgagcgttagttgactgcacatctgtcaagaccataccaagtgttggcattacaaaaatgaatgaggcttggtccttacttcaagattctcatagtgagatagaggagattgtacagtaaaatagaagattatgagataacgtggtaaatgaacaacagaacatcaaatgagcatagcagataagcaattggctcagatttaggtcctttcctgagaacagattcagttaggaagggagtagctcccagcaaaaaaaggagctgcctgaaagcaagaaaactctggaaaacacaaagagattttctagcaaagatgggtaatcctaattgccatatttcatcgggaggcccgtcaacagtttctcccaatctggtattacatattttgctgagtagaatgtattcatagattctttttttgtgtgtaattacttttctcttttctggcatctagcagaatgagctatggaggtgagaatactttctgtggcatcaccatatttgaagagtatgaattgtcagaaccatcacatactccttctattttatgtaatatgtcaccttccggccccacgtggcctactaggggtgcccttctgtgtgtatgcatgttttcagcctcaggggaggatccaccgacagtgtcgtcctgcctgagcacgttggaggccttcagaagctgtgcagacaacagcaacttcagtctgaatcattcttttcaatcgtggacaagctgccaagaggcgggagccagaagagcaggcgcagaagtgggcggggcggggcccggtgggcgtggccgcgggcgagttcaggtgagtcgctcctgcccagcagagctgctctcacgtcc

SEQ ID NO: 45398 - DNA, 1535 bp, Bovine  19866880666171
caggctcccagtgctctcccccacccagcttcctgctcagctcttgtcacttgataagttcatccagttccctcacgaattcggtgcagtcgtgttctgcaggcaactttctccaggtccctgggctgagctaaataatccgcagccagtccctgctcactgtattctctgaaggtcatctgtttacatgtctgtctcccctcattcagctattagcacctggaggtgcagggaccatgttttatttatccttggatccctggagcatgtttctgtcacatgtcaggcactcagcgtatgcttgtggagctgaaatacaccttactgtagaccaggctttccaaacacactttaatagatgatgtttttcaaaaggagcatatacaaaggacaaataaactttgcactggaacaaaatcagatgcctttttttttgctgcagcagcttctagtgtcttccggtgaagaactcaagttcagatcgttcagaatggtcagcgctggatgtcactggtcggtgtccgtgccacattggtggtggcaatgtgatattcaacagttttgaacagtatcccacccgaacgccctggagtctccacaggaggtataagctgtggggcatttccaagcccactgaaccatctgtccctctgtcagggagatccctgtcttgtgaagactgagaatgcagagtggagctaacaaagcagtaattctgcgcacggcggtagaggcagcgctgatgccccctgtacaggacagggcagatggtcaaaggtgtcaaggcgatcctagaccttcatgggaacatcaagaccgctggtggctccttgtcttggaatctcctaagaggtatgagtgtgtgtgcgcacactcacttgctcagtcgtatctgactctttttcgaccccatggactgcaggctcctctgtccatgggattttctccaggcaaggatcctggagtgggttgccattacctcctccaggggatcttcctgaccaagggtcggacctacgtctcctgcattggcaggtggacgcttcacctagggccacctcggaagcaaggggtgtgagccttgttcccagtaaacaggacccatggtttctccagtgcccagaggcaactgacgtccaagccccacgcgagcaggaatggtgggaagaagaggaagccacgcagggagggagacacctgcagagcagagagcagggctctgcctgaagccgggaggcagcgatgcctggacgcccactggggctgagatcaaagggggagtggtggccaggccgctgggcatggtggcctgcgcagcacacgcgaggaagccagggctgtgtctacctgaacacagcagctggtgaaggaagtgactccacttcccgccttatcattggcccggcaggatttcctctgcagccactttgtgctgaatgagtctggaaggttccgtctggagcagagagccacggtgggcggtggccaactccagtcccctgagcgcttcctccctcctccccgccccgccttta

SEQ ID NO: 45399 - DNA, 1968 bp, Bovine  19866880687646
actgtatagaagtgagactgtatgaggaagacaagagccgttgtgccgaagtgagactgtatgaggaagacaggagccgttgtgccgaagtgagactgtatgaggaagacaagagccgttgtgccgaagtgagactgtatgaggaagacaagaactgttgtgccgaagtgagactgtatgaggaagactggagtcgttgtgctgaagtgagactgtatgagaaagactggccaaacgtggaaccgatcccagcacccctgctccagggtgggggtcccgctggcggagaggctcagccgcagctccagcacagggcagcgagctctcaggccagagactcactcttcccaccagatgcaccatgcacgccagctgtcacgggaggcctgagggctttatgaggctgcctgttcactcccccggcttcatgtggaagccagcggtgcttggcttttagaaacatatttctttctctatgagtaatttaaaagtgactcatgctcagcttcaccagccagtgcatgtgacccgcggtgctgggtgagtgtatctatagatgtgtaaaccgaagcagttcttagaacacagcctccccctcccacgtgctgtttatttccctctacttcacaggcactgagcgatgatacagatgagctgctggggaccgcccgctccccactcaaggctggaatgggcccatgaggaggaaacaaaacacagcttccaacaagagcaaagactagaccggaggaggcaggagcggggcagacgggccagcaaacttccttcgcatgagcagatgatcatggagctctgagcaaagcccaggaagacgcaggacgacgagcgttcacctgagcaagcagcaccctctctctgcgtcctagtcgagatttcagacgtaaaaaagtagagaccgcggcctcaccacctccaagcaagccaccacggcctttcctaaaacagaagagtgttcctggggtctgtggtggctggtaactcacgtcgggggaaaagcctaatgcctccagctcgtctttgtcactggaggatgcgcagggcccggagtggggacgctgcgggaagggcctcgggagacacagctgccaagctcgcagagagcctgcagagagctccttctcacttccttttctctagacaaccacgtctgaacactcatttgcctgctctgtgaagacctccgcagtctggcctctctcgcttgacttcccggtgccgtctgcgctcactgtgcggttcgccctcggcctgggcctgccctcgctgcttcctcaccgagccgagcccgtcccccagattcccacccgccccctccgagccccccaacacacttcacccctgcctccaccgcccaactccctgtcaccttaccacctccatcccgcaagtctgcaccctgtttccaaactcggatcatccttccaggagcctggcttagccacccaggccagctggcttaagtgcctccatctctggaaggcctaccacacgtcacctgtctgccctccagctccacttgaggccagacagtcatgtttgtccagttggactgcagagtctttgaggaggggcatcctgctttttgttcccatttatccccacagtactgaaccccacagcaatgggcatgcaaagtccccagttaaaagaaatactttattttggccaaaaaagtattatatgtgaggtcttaccccaccttaaaccctcagctgggaggtcaacttcactatgcgtcctaagtggaggccatgtggagaggaacaaatgccccgaatcttcaacaaaacgacaaacatcagcataacaggtactccagagcactgtgcccaagcatgcatccaagcatttagcaaacgccagtttatctagaggcagcagatactgttagaaccccgcttctcacaggagaagactgaggcagaataggtgactcatataaagcca

SEQ ID NO: 45400 - DNA, 1618 bp, Bovine  19866880712257
tgtacagaaaagtgattcagttatatgtacatgtatacatacatgtatattacatgttcttctcacattatcttccattatggttcaaaataaccctggtgagtgacagccagaagctaaatctgataacactcagattcgttggatgcatggccgaaagggcgatcgctggcccaagacttaagcatttcacgttcaggtgctctgggaatagaaagcatttgtggagagcacttaaataatgggaagtcagagaaggaggttagaggcggacgacccacaatgtaggtgaacggcaactttcagtgatatctttggtttgtggcagaaattagtggctattggaccaagaatactgtagctacttccctttgtaaaagatcatgttccttatgcacgcattgttatttttctaaattaaagactatatttggtggcaaatcctaacatctcaccatgccacactttaagaattccatgacttgggaatgtattccaggtcaaggaacccagaaaagaacaagtttgacctgtgtttctaaatgggtcactttatagagctgcattacaagacaactacaattgtgtagtgtctcccaagttatgaaaacagaaactccgcatgccatctgtgtggtgtggactcacctgacggcaggtcctagagtaaaatctaacacaatcatggtacaagaggagacctcttagactcagactcttgtaacaatgtctgtctgtctgtctgtatgtgtgcactcagtcacagctgaccctttgcaatcccatggaccatagcccaccaggctcctctgtccacattaggtagctggagaatcaaaactttctgagattggcagccatgacatcaaagctatgcgggggacaaaacccacttccttgtagatttagcatgaagataaagcatgtgtgaaaacagtgtatgctccaccagacactgagaggtccctctgtttataaaattgctccctagttatgtaagatgttgaaattttggagtaaagaatgactttgggttaggcaggccactttcttttatttctcatctttgtgttgtgtaaggtggacatttttattcactttgtatcagcttttaaaaagaggaaacagctagcagttcatttagggagaagaacaggggaatagtctttagataaagccttcatagaaaatgttagttttctgtgaagttgcaaaaagttgcagttcacctagattatgggtcatccgcctctaacctccttctctaactttctattatgataatagtagagaaaatgcagacctatttgggtcaaatgatgatttggtagtcccctcaaagtgcctatttagaatcattattttaattgagacaaggaatctaccagaggctatttatgcatgggtgtctctgagtacagtgggtgaatgaaggaatctcttccttggaatcaatggaagagtctctgtttttcatctgttcccaaggagagcataaggcaaagaaactgtttagatgacaagctctggaagatatagtgggtgtagtaagtgtctctgttggctgtctatcaataaagtaagtaagagttggggaagggacattcttcccatttct

SEQ ID NO: 45401 - DNA, 1476 bp, Bovine  19866880895841
gggccctttataggagagttatagattcctgttataagtggagattagggtctgttttttccccctggttggagcaaaataaggtattttcaggggatgggaaggaggagagagtgtatatgtacaaatgaagtacatggtaattattaaaatatccccagaatattagtcacattacagaccataagttttagtgactcagacagaatgggtgtaaatatcaaagggactaaaagggaatagaagatttgggaaagtgtgatcaattgaccatgacaactggtgccttttggcaaagatagaaaatttctgacattttgaagagctagattgcctgtattatttttcctaagggaagagagctatcttgtgaagttctgatgttttgatagccatagtgaaataaaatagtgtttctcaaagggtgttcaggatcccctagattacctactaaacatgcatttttctggccattttctcatttctactgactcaacttggccagtcaccagaattcttaattctgtatagatttttgaagcctgtgtgctgtacttagttattcagtcatgtccaactctttgcaacccaatggaccactgtagccccccagattcctctgtccaaggggattctccaggcaagaatactagagtggattgccatgccctcctccattgaaaccttaccctgacctaattaataagaatatctgggaggtaaagttgagaatcacagaacttccggaatgagaacatcacttttgtgtgtttttgctagaagtgcattacattattctaatgataataaaacatcaaacaaatctaaattgagagacattccacaaaatgtacttttttaaagtgtcaaggtcatttgaaacaaattacactgattagaggagacgcatgagacacggtaaggaaatggaatgtgcagtcctcagttggagtctggagcagagcggggacgtgtgtggggtgactggctgagtcaggagaagggctgagattagcttacagcgttgcctcggtgttggttcttaatataattacactcaatttttaaagttaatcctttttgagttcttgttcagcaggtcttccatctgtatgacctttgttcccttgccctgtaggcttatgatctttattgcccaagccaggcacattttcagaccttgccaaataataacgtgtgcattctgttaggctgtacgcatgtactttctcttcccatgcagtctcactattaagcggcattgctatacaatgaataataggcatccttttttcaaactggtaagtggggatgtagtaatttagtgggtttctaccagcacttaaaaaatgggatagaaaatatcagtgtaagacagagtaaggttaaatactgttgcaagaaacttttgtttatatgtgtgtattttgcatcttcactaggcggtcatgtaaaatgttgtactcttagttgcca

SEQ ID NO: 45402 - DNA, 1462 bp, Bovine  19866880900426
gttttgtttagcaaagtaaatgggctcctctgattagtgtgtctagaacaatccaggtaacatgtctttttaagtcagtcattccaaagctagcttccaagaagtgctactccagccttgagaagcaggcccacattagttatttcatcagaaccctggcagctctctgggtaaagcagacaggaaatctcgaggagagaaagaacctttcagagcccgcttcgggcccccttgcattccttttttaaacatcacaagattgatcctaggccacagactcggcatttggacatcagatgcaggcagatgttttcccttaaatccattgtctctccctcaatctgtttattgctatttccctctcggcctgcacctcaagctctggctaactgcatatccacgcacaagaggcatctttctagcattgcttattttctgtaaggatgcgtccactcaggaggtaacctacctactcgctaccagcgtgtgtgcatccttggccatcctcaagaactgctacaggagaagtctctcagggtttagtcttccctggtggctcagacggtaaagaatctgcctgcggcgcaggagacctgtgttaggtccctgggtcaggaagatcccctggagaagggaatggcaacccattccagtattcttgcctggagaatcctatggacagaggagccaggcaggctacagtccatggggtcacaaagagtcagacatgactgagcgcctaatacacacacacaagattaagtccccaaagttaaatcaggacttaatcagtaagggttttcttgttagaagtgacctttggcggtcacatgagctggtgtcagcctcttaaatcaactgatatcaactgacaggctctctgaatgaggtcagggctatttattcacatcttttttcttctgggctgatcagtgctcttcctacaagtcagaccaaggatctccatctgtaagtcagttatgcagatcccatggcagccaagccaagtgacaggtttcagagacgtatccaacctctctcactgcagactcacccagaatatgacccagacaagaaacagggtaacatctgctgctgcttctcacacccagaagcgccatgagagaagggagtttcttgaaggagatggaatagttctatatactgatcaggggggtagctctaggatcctagacatgggatacagtacacccatacacaaacaagtatgtctaaaaactggtgaaatctgaataaggtctggcgattacactaatgtcaatgtccccggtgttgctactgtatatactataaacattagactagatctacaattacactgtactgtatgcaacacaccactgggggaggcgaggtgaggctacctgggacctctctgtgccactttgcgactttttgcatctatacttactgcaagatataaagtttaaaaagtgccatg

SEQ ID NO: 45403 - DNA, 1293 bp, Bovine  19866880912480
aatataactgtaaaagtgacaaacattttgaattagagagatgataagaaatttggggcagtagactataaatgaattttaaatattacatgtcatttgagaatgctaaagatatttagtaatataaataatatataaataaaaacaaagctaattgtaagcccaccgacacttacacttccttttttccatattctctctttttacatagttgacctcacactacatttgtagttttgcatttttttcatttaatactacaaagaaaatatttctccgtattataaaattctgtttataaaaatcacttttcatggttatgtgaacctgccataaactagtcacctcttcccttactaatcgggcttcccttgtgactcagctggtgaagaatccacatgcaatgcggaagacccaggtttgatcccctggataagggaaaggtgacccactgcagtattctggcctggagaatcccatggcctgtgtagtccatggggtcacaaagagttggacacgactgagcaactttcactcccttactaattaaacatttcggaggtttccaatttctataaacagtgctattaaaaatctctagtggacttccctggtggtccagtggtcgggaatctgcccgccaatgcaggggacaagggttcaatccctgctccgggaatatccctccgtaccccgggacaactgagcccactcggcgcaacccttgtgccggtgctcccgagctggtgctcccaacgagaggagccgccgcagcgagaagcccacgcccctggagcagagccgcctagctctgcaggtagagaccccggagtgcagcaaccaagacccagcgcagccaataaataaacagaaattcttttttttaatctttggtttcagccttttttattggaatctcagatactttctttagcagagagatctaggtgtttaattaatggctaacactcgaacattttggggtttgaccacatcaggtcaaatgttctccactagtgcagagaaggggttgcctttccactgtgacttactaaccagtttttcctcctctaaaacctggaaaccaaaccttcaccctcctaagaaaggcatgaaacggccagcactctccacagcgcttctccgttaatcacttcagtgcaggactctgtgggtggctgttcagagtctgtgattctctcaagtcagctttggagcctccttcaactaatctctctggggcagggacaggggagtgaccatctaactttctgagtattcttaagggaacac

SEQ ID NO: 45404 - DNA, 1852 bp, Bovine  19866880919452
ggatcgtcccgacccagggatcaaacctgcgtctcctgtattgcaggtggattctttaccatttgagccaccagagaaggtgctgttagagatgcaaagttttactcgtgaaaatgagaaatattgttagctgatttgttttctgtagtggttgtgtgtgtatgtttccttgttgttttttgaacaccttggcactaagcaactggtttccctgatcctgaattgactgttggctccaagtcagaaagtcgcagcctctggttcttgcccctgatggtcgctccaagctccccaaggaggaacgcactgcctcatctttctgtcagttcaaaccacatcctgcccgtttccactctccagaagacagctcgtgacaccggtggttttacgatgcggcgggcttctccgtgaagccatagccaaagcctttttcacagaagtgaaaataattcatccaggggttaatgtgtcaggtctaggcatcgactgaaccttctcctccccacccccgcatccctcaactggatccgaacccctgattcaggggagcaaacagctcctcagcctcctctcattgtctcaactcttacaactttctagacagaaactaagctcaaggcaggaaagacagaggtgttcctgagagagggctgcacacagtccagctcgggcccaaatccagccgatgacacagtctgcagttgttggaagggacctgggcaatcttctagtcactttacaggtgaggaaatgccttcattttaaaccctgagaaaacagagttcagggatggttagtgttttgaccaagagcctattagagcctactataagcctatgaaagaacctgcttgccaatgcaggagacgcaagagacgcaggtttgatccctgggtcaggaagatcctctggaggagagcacagcaaacccactccagtattcttgcctggagaatcccatggacacaggaacctggtgggctatagtccatggggtcgcagagtcagatgtgactgaagtgacttggcacaacacacagaacccatcagaggcagagcctggattggccccagggtctctgggctcctggctcaagggcatggtaggtaaaccagttgtccccgtatctgtagtttaaggactgttggcattgctagaattggtgacttcatcctggggactggtttgggtcctggtgaccaaggggctccgctcacacctggaagctctttgctgagagccaggatggggccagcgccaaatggcagacgaagctcttagaacagagcaggtgagtagggcccgcggtgagctcagccacgtccggaacggggacaccaagggaaataaacgtcctgaaagaatctgacactggaggaaggagagaagagggaagaggagaagccgcgacaccctcatctaagtcatcgtccgagaaaatcagaactctgggattctcaccccgagggtggggggctgtgtttatcttcaagcacaggatggccccgcaggacttccaggatcacaggactccggggcaggaggggagcgccgaggcctcgcgcagggctgcagaagggacgggccgccgccacccccgccgcccccgaggcgcgcgggcgcgggcgggattctgcgtcctcccgcgagacctggcgaaggcgcccgtgacccgaggaaagagcgtttgcagagacacctgcctcacagcctcctgacctcggacagtgtttatccccaggctgaggcctcccttatctctcaggggtgcacggtggcctctcaagagttaacttattaactcgacctggacttcatccgggacgccaaggactcataggctccgggggcg

SEQ ID NO: 45405 - DNA, 1697 bp, Bovine  19866880931140
atttatgcttagaaatgcattcccattctgaagtacatctatttgattttggatttgggagggcattaatttctgatccatccatagaatttctttgggagtgtggttaaagataaaagaaagactcatattttcctaagtaattagccagttttccagcttcatttgtggagtggtcctttctttcctcacctatgtatggtgtcacatttatcatatattaaatgcctacatgtgctaaaaataacacgtgctttgagtggaatgcggtgcataaatctgaggcgtttgcaacacgtgggcatccaaccttttccctctgccctccccatccccttcctccccagagattgcaaacagagggaaggaagccagaaaaacataaaacaaggtctgtttctctggataatgtctcagaaggaaaaaagcaggctggggttttatggtttaaaagcgatgacctgcttcaagaaccccaagagaggcgccaagtggccacgtactgggcgctcacccaactccaggcatgcctctgagcacctacagcccacccacaatgtgggtgctgtcatcatgctagagatgacaaaacaggcccggaggtctcaggtcactccccctcaaatcacttggaaggacagtgatctaaaacgtggctataccatccaactgacagaggtgcaaggagcgtcaccttcttcaaaatggttcctctcagcagagatgtcaagtatcacaaaccctcggtcagaaaggtccctgcagctgcgatgcagtcttctctggtgggagggagtggtcctgggtggcaaagtgatcgagccaggtgactggtacagttctgggaactgtggacctccagcgatttctaggtactcattgaactcctgttcttttcacatcaacgcttttcctttccaggaaatagaagaaaaaggcttttcatctctctaactgactaagggaggtgcggcagagacctttccaccacaggatggtgtagtagcccagagaattctgtatctaaatcttaggagacgagtggcctttgagtgtgtgttttcattcatcataatcaatcgttgagtttgtacttttgctgagggactcagtacactagtaaggtgactgtggacacatgccccggaatgtggccccggctcacagcagtgaatatggtacaagctgtgatgactcgggggctccccttgtggctcaacgctgaagaatctgcctgacaatgcaggagacacggctttgactcctgggtcaggaagaccccctggaggaggaaatggcaacccactccagtgtttttgcctggagaatcccatggacagaggagcctggaggcctaaagtccatggggttgaagagttggatgcaacttagcgacaagacaacaaatgacaactcggggggcctcgaccttaggaatctgcttttctctctgaaggggggttctgtttacatgaattcagaagcaccagacaccaggtttggatcgaggatcaagagtcctggattcctggtctgctttgaaacttccgttttcataactaggccctgttcaatgtttttatccagaaaataggaatatcaacacgactgtgtgtttctccgtaggttacgtcaagcgttacacgtatttgaaagtgtcttaaagtgtgtaagctgctgcgtaagtaagcaggtaa

SEQ ID NO: 45406 - DNA, 982 bp, Bovine  19866881014401
agggcaagtggccccctagtcgttctccccggaaaacaagcagcaatggaaggtgggagtcagtgcagctcagtgttcccaggggagagagcacccgggatttcatttccccagacactgaccaccaggaagaccaccccaggggtggcagggagcagcccactggcctggcagcctggggctcggttctctgttatggctgaagcagacatcacagctctctgtggtttctaagaactggtggaatttgcatgttgagaatcctcgttccttggcatgaagcagactcaaaagcatcgttgctcatcatttgtcatctgttggagaaagagcgtgtgatttgtttacttgtaatgaagcttgaccatacttctccaggggcctttgcaagaaggatgtgtcagcttacagacctgtccccatgaataaaaccacaggcaaatgctccccccatcttcccttctcccctctcatttctgtgctttatgtccccactgccgggccctcttcaagggcttatctgtgggtgagttcagaaacttcagatgataaaggacacccagataattggccggttctccaaagtgtctgtcccctcagctgctgccagattccctcttaatgagtccgtgcagtgacggtggggtctgagctcctccagctccgtgggaaaatgagcttccctgcattgtaacagcttgtggctcggggggaaaatgacagccattgcacaagtttcctttgaatgtagttttctttcccataaatgatacttggagaatacacttaaggggttattagttttctatttcatgcttggcctgtgtgtgagaataacacaagctgtcactgcaaatcagcagctccacacgctttgtcgggttaatgtgagcatttaatatttggctcgattaaaaattaactgatgaaagtacatgtccaatggaatttgaaaatgccttttgtagggactgttggaagg

SEQ ID NO: 45407 - DNA, 1202 bp, Bovine  19866881016753
ctgttcatgggattctctaggcaggaatactggagtgggttgtcatgccctcctctaggggatcttccccgaccaagggacccagccgacatctcaatgtctccagcataggcaggcagattctttactgtgagtgccacctgggaagctctgtatatcacagtataactagctgtatttgttagttggaataagagaagatatataaaagcaatactaattctgtttctcatttaaaaactagtattgaactttttcatatttattaattggttgtaaagaacatactgaagtaaaatccaccttatgacccaatattaaaaaacagaaattttccatggagaaaatcacaccccaggctgaggaggataggccagtttatcctgagtccttgcttgtctgtgtctgttttccagccccaggccccacttgccagcaaaagaagctgtctcatggactgcacatcccatcgctctgtatctgactggttatgaatgactttaattcaaacttaaaatatgtagtggtgattggagaaggatgaggatgagagcttgaccgtgacattatcttatgaaggctcttctccctgcctccctcctctctctccattgctgttcttgtggtgaccctcgtttcccagatgtgagtttgcagaaggccacccctagcagggattgttacctcccaggcactctccttcaggagagttcaccctcctctaggaactttacagaaaatgcttttttattgttgctatgtaatacatttttagctagctgtattcgttttctacactgagtatgtactacctaattaaacaaaagtaatttaacactatcgttatactgaagaaaaaaatacctattttcaatgaataatgtgggatcttagttttagcaaattcattgcccacttggttaccctcaccccgtacttccatactttctaacttacacttcttgagcattcatgcagcacatactgcttatccatcgctgggttaatattcctcaaaaatgcaagtaggattctggaactgagagttcgaagatttagtcagtctttgccaatcattgggaaataccatttttcatcacagctcctcagttcttttcggtaaaatgaggataatagcactgatctgtttccacaattttgatttaaaaaaaaaagttaaacacctacatgaaaagatgtta

SEQ ID NO: 45408 - DNA, 1066 bp, Bovine  19866881107240
tgttttggtgtcgagtctgagacccctttgcccttgatgctgaagatggctttgttttgtctaaagatgttatggtttaagtccatgatccattttgagttagtttttgtacaagtacagagtttggtttgcgatttctccttctctctctattttattttggctcatggatgttcagttgctctggagctggttctgaggcctgtctctctgcccttacccgcctttctgtgtctttgtcagagttcagttagaggtgtttgtatggatctaattctggtagttgttttttgtttttttaatgctacccaaaattgcccgtttcattatagaatttttgaagtttccaggtcttgttttatttgttaagacttctctggttactctttgctcactgaatcttttagttaattacagagttaaaagatttgggtacttttcacactatggtttcattgctctgttgcttctgaagggcttttcccccatttaaattttactactgtcatacgctttagacataacagcatttggtttttgagaatttccgtcaacgtttttaagttgaattttcatcttactctattattccatactagccctgagcttgacttttgttgggtgaaaaattatgtgagacttagtgattggtactaggtaaagtggtgttcagatagcgtttacctatgtaacaaacgtaatttgcatttataaatagtcaccatttgtaacgtcatgcagttgtgatttagagaaaaaaagatttgttttaaagttgcttttatttttaaagaaagctttcaatatggttattgacttcagagttatcctgtgctttggttttgatggtatggtttttgtctcccttcaaacagaaagccatagatcttgctagcaaagcagcccaggaagataaagccggaaactacgaggaggcccttcaactctaccaacatgctgtgcagtattttctccacgtggttaaatgtaaggtcatcgtttgttttgttattttaaaaacaataaaatagaaaagattattcatttctgttccgagaaatagaaa

SEQ ID NO: 45409 - DNA, 4145 bp, Bovine  19866881234592
gagaaatcaatcccataaaaacaatgagaggggaaggtttcagggaacatcattcatgttgaatactatgaagaggcagataagataaaaactgcaaagtgttcatagcttaggtgtctacatggaaggcagcagtcaacttcataaaaaaggatttcaggggagcatttaacatagaagccggattgcagtggattgaggagtaaaaggggggtaaatggactccgagaatacatattactctttcattaagctggatttttcaagcttacattttcagtctgagaaacaataagatgggaaggagaatcattaagcagcttaaaaaaaaaaactttagaaaaaaggtaccttgtacatacatttatatgctatgagaaagaagaaagtaggttagtaaaagcccaataaagaatattgttggaaagataacaccaaggaagaagtaggaggcaagaaagcagtggaggaattgaccgtttaggaaaactgttccctctgaaattgatggaaagagggggaaagatcagcaaatgggttgggatatgaatcccgcctctattttctttgtcaagaagacaagaccttcagttgaaagtggtggtggtagtaaggggctgttgggaatctgagagaagtaggagagttttcagaaactgccgtcaggaatgaaacaccaaagctggctgttggacccacgaagaacgtctgaccgggacggcagggagaccgccacgccgtggtggtaactgcacacctccaggcttcccgaaagcattcccctgtagcccaggcacaactgtgagtgaagtcacggcactgctcccaactcagggctttgttgggggaagagaatggggaaggaatggctgagagcagttcagtgtaggaataaagctaggcaaggagagagctgatacgctgagagaaagtcgagagatcaagagaatgaatagctcagtgcagctgaagaacaggtggagcagtgatgaaagaatgagacgcacgcggtgctgtgaccacactggaaaaccggagctgtagacttcaggttgttgatgagttgcagggtgtggctcaggtatctatagtggtgtagagagaaggtcaggaaactgtggaagcagaatcttccatagggacactgagtttattcaaaacagtggcagaatcaggtacggaataacatgtacagcggtcctaaccaaggcacatttagcaaggattgggggaggagagggaacatggggtcagagatagtggttgagtctcctataataccatactttcatataataccatacacagagactatttacatattattatctttatcaattctagtagaatatgtatcctcttatttgaacccatactcaaatgtgagttaaaagtgttataagaagaaatgtaagcagcttggagattatctatctttgtactgatctatctgattgaaatttgatgataggtacatttaaatcaaaagtagtttttagaataacttattatacttataaatgtttgggagagaaaaaaaaaaaaaacagctgtcttgttttcgaagatcttgattagacctcacctttactgtgcttctgggtgcattgcaagcagagtcagaaaaaggaacacaaaaaacaagatgctataaatagcaccatgatagagtcatcaacatccaggctacggctgagggtccctcaggaagataacagcatctgtggaattgagactcaaaccgtggctgaacatcatggtggcccctgtaaaacttgtgtaggatacctttgggaggattaaaagcaaagtgacctaatgcttcataattgacatgttgccaaacaattcgggagtggtgctggaaagggcaaagaatctgagtgggtgacagacagacaaagcattaatgactgggcggaacacagagagctggaaaagatgccagcggagaccagcccagagacgtcacggagtggagttttatagttgtgtgagacgtggagaattaaaagggagaacagacttcccccagagaatcgcagccactgtgtctgcttaaacaatactaccagcttctggttgtcatagcaatgatgggtcaggcataccagcatgcaagagtgcattctaggacttgctggtctttgaatgaggagaattccatgatgagggaaatcagtctactggcctcaagttattcacctcctgtgttgagtcttagctgcaattctaccactggccagccttactatgtctcttaccaagaactcttttataagtgtgtgccacatgctcagtcatgcccaactctttgcaacaccatgtctgtacccaccagactccactgtccataggattaggtaagaaaattgcagtgggtagccattccctactccggggatcttcctgacccagagattgaactcatgtctcctgtgtctcctgcattgcaagtggattccttccaagctgagccattggggaagcccccttttataagtgatcttattgaaaagataagtaactgctggcaggagagatggaagggcatagctgagaaaaaaaaaaagggaggtgaaggcactggggatgaagaactgtcctagaagacagaaaactcaaaggaaaagtgaataggctttttctctgctgcccatagacaaccctaaatgcactgtctgctcctcccaccccaattctaactccacatcactgccagtggacaagctttctctgtcttggagcatgtcaatctagtgaccctgaatatgtgttcactcaggtgaagaaaagctgtactttggaaataaagtgataatattgagaaggcatctgggaacctaattaatagtgacaggaaaacaatatatcaccttggtatggccccatggaaaggcgcaagcctttattcatatgataaattgggcaagactcaggttcataacagaaataaccatctaacataggagcctgcacttaccttccgaatatcagatactttttctgcaaaaagtccattggcaatgctgaggtcataatccttgtgggatgtgtttatatcagacagaactcttttcagttgagattggagtcctggctgctgttaaaaagatttataaaaaattattcttgggctgcaaagatatgtctactctttttacacatgaaataaaacacgtataatattatcataaaagaatttaaaagcaatgatgcttattaaagcaggaaacagtgtcacatacatgtaaaattttcaccctttttctcaaaatagtgtctgtgatcaaagttaattaaaggagttagtgaaataaataaataaccttaaaataaaactattaacagaagataatgaatttgtctaatgcatgtactaaataattcattttaccaatgtaagttgactgtgaatatcaaagtataaaacgcaaacatttagttccatgctatcttgccaaattttagctaacatgtaagtaaaatattggcttacttgataatttacaaataaattatcaaaaattgtatctggaatacccacaatacagaaatctgaaacagacatgatcctttgctttaaaggggagagaaaatagaaatatattagtgagatggggatttttctaaattgagtcttacagtctctttctctagaagaacatattgtctttacctgagtatcagaagagtttccatgtcttgagaaggtattaaagtgaagcacctgtaaacaggcaacaaggaaagcagtcagcaagtagtggcaaacaggaagagaactaataaaaaataaagtggagatgtcactgctggtggctgtgtttgtgagtttgtttgttagcacatagggcggcaatgaactgtgcaactgtcctattgatgtgtttagaacaagactattcattggggaaagtatcacaaactgggagaattcataaatcaatggctacaaagtgaaatatgtctaataattttggtttgctcattcttggggatcaatttaataatcactcactgattaaacctgaaccagaatcaaaaatagtctcataaaaaaaagaaaactttgtttaatgaaacaggaggcaagattggggttaactacatatacaccaagacacaaaagcaagaggcttccc

SEQ ID NO: 45410 - DNA, 1114 bp, Bovine  19866881265147
ttcaggagaaagcatatcttcatataagccttccccgcttctcctctgtatccccttgaggtctcagggccagtacaaagaaaccctactcttaaactaagctcgttaaagcacatatactggattaatgcagacttttgaccaattcgagtaggattttcactgcagttcagactaagccacatagcaaagtgattgttgtcaggatatcttaattcacacgcagagtaggaaaaggacatccgtttttcttgttgttgccaatttaaagagttgaagctaagactttttgttttgtagtaagaaaagtgttagtttctcagtcctgtccagctctttgcgaccccatggactgtagcccaccaaactcctctgtccttggaattttccaggccagaatgctggagtgggttgccatttcctactccaggggatcttcctgacccagtgattgaactcaggtttctgaactcgggtttcttgcatctcctgcattgcaagcagattctttgctgtctgagccaccagggaagcccctgtagtaagaaaaaaggtgttaaaatactttgatcctcaaaaacagtagtgaaaaagtgattcaacaaatcatttgttaaaatgattccgagtgaatctttaaagaatcttcagactaaattaccctttggttctcattatctattattagtattttctttttaaatttctttctagttactttgtgatttgtccaccttggattttctcttttttttagtaaaatgacgaaactggaggaacttgaagagatcgacctcagtgggaataaactgaaggccgtgccgacgaccatcatgaactgcaggcgcatgcacaccgtgacagctcactccaactgcatcgaagtcttccctgaggtgatgcagctcccggagatcaaggtatgtggtccgagccgtgacccccagcctcaggctgaagacgtgcttcctgtgagtcaccggctcaggatgccgggcaccctccgccgggttccttggagtgaggacgcctctgttgttcttgctccatccctcctcgctgctgggccacgctgctgagttggccgaggtgggaaaccagtaaacaagaagcc

SEQ ID NO: 45411 - DNA, 871 bp, Bovine  19866881328355
ctccccagcctgggtcagtgggcacagggggaaaatagcctctgtgagctgggctgaggcctcccactcggggagccaggccctggctctctgctgagggctccgctaatgaaaccaccactgctgctgcatcttgtgtttccacagagaaaagtctaagaatgggatgaacttgtaaacaagaggaagctgagccgccttccgtacttggtctgcctttgagcaaagagcggtcagaagcatgtaccccttggtacctgctctgtgcttcctaagagcgtttcatcaaccctgcgatctctgtctctctctctgcctcctgtcataaatctctgtttcaaaggaaagaaaagagagggttgttaaagcataaacctctgggtcagctcttattacatcacactctacgatgatgtcccaaaccttttgttgaactgaaatgctagattggtttgaaataaacggagccacccgtcgcctggggataggaaatctttctgttgtaaaagggtggctgcatggctggtgtatggtgtgtttgcctgtgcaaaaagtggggtgggctccggaacagtgtctgccccgtggggactgagcacagagagcagcaaccccccagccccgcaaatgcccctaaaaaacagagaaagttgaatgggggctcttccatatttgtggaacagctttcattcaggtataatttctttcactggcttgaagtttgtggtgtcagatcgcgttttctgtcttgcaccccaatacctcacatgcttgtttgccatctgctcgcttccattgcaaactgctctttacacaatgttactcggtgttaattagaacatgtgtctcttgtcattcatctggggaaggg

SEQ ID NO: 45412 - DNA, 1573 bp, Bovine  19866881352324
tggtctctaaaaaggaaataagtacatttaagacatattcaccttagattgattgatttaaattgtgtttcatcctcctgccagctttagagtggaacctcttcatggtatgcttcacggtggatgacgaagttaatggtcttgaagttctcatgttgttttttaatacacattttaggcaagagaacgccttggaggggaatcctgttatttgggccacctggaacaggaaagtcctatttagccaaagctgtagccacagaagcaaataactcaacatttttctcaatatcttcctctgaccttgtttctaagtggctaggtgaaagtgaaaagtaagtagtaaattgatttttttttaagttttctttgcttggtggtcattctatctgtaaagtcgtaggtttcttacatcattaataggcgttccaaaaagtgctgtggtacaggcggtattgatttctctgtcaaactgttccctagttcaaaattcgtttcagagggagaagagagcatacgtggcacacgtatggtttagcacgtgacacacgtgtggagaaggagatgacagcccctccggcactcttgcctgaaaaatcccagggacagaggagcctgatgggctacagtccatggggtggcaaagagttgggcacagctgagcactcttagagttcctattgatacattgttttattttaatgttttcattgtcatgtgttattggctaatttttagaaattgaaacttttaatttatttttaggctagttaagaacttattccagcttgccagagagaataaaccttcgattatcttcattgatgaaatcgattctctgtgtggttcaagaagtgaaaatgaaagtgaagctgcaagaagaattaagacagaattcctagttcagatgcaaggtagtgctcaactgatttaatttctgcccagttgtaatcatcttggtatagtagtaaagagacttatttatatgttcacttataccagaaacaatatcaatagaaggaaaaagtagacttcaaatttaaatcttttgagaaatattttgaaaagaatattaatagtattttcccacagtttaggagattctactgttgggaatatttatatcatattctggtagtatgaaatatgattaaatacagtgttttcagagagagactctcaaggggaagcatttttaacaaagaaataccacattcataagagaagatacagatgaggtttaaagaacactgaaatgacaaattacctgaaactatatctattttgctgtaggggttggcgtggacaatgatggaattttggttctgggagctacaaatataccctgggttctggattctgccattaggcgaaggtatgacaatacagggaacactgtatttctaattacagtgtagtaagtgagtgtcaattcccattctgataactctagaatgtttttcagtgtacgtaagccctgctgacccctgacttggccaggggaggcaggcatttgttgttaatgtgttctgggtatttttcccttattaccctaaatatatatgtttaatta

SEQ ID NO: 45413 - DNA, 1936 bp, Bovine  19866881437338
attaatttatgtgatatgcttacagataaaatgtagaatctggagtcatctttgagcaaatgtacatggtatgtggcttcccaggtggctcagtggtaaagaatctgcctgctagtgtaggagacacaggttcgatccctgggtcgggaagatccccttgaggaggaaatgacaacccattccagttttcttgcctgaaaaatccattggacagaggagcctggcaggctacagtccaaagggtcacaaagagtcagacgcatctgagccactacacagcaacagtgatatatgtgtatataaataaaatgctgattcccaggctctggtctttagcatggtcgtaggttgagcaaattattctggggagtccccttggtggccttccgccccttgacgcctcgagctctgctgactcgttgcagagcacaagcaagtctgtgccgatgatgacacagcgcccagtcctttagcttcaagaccctggaggacgtgccggccaaaattctgggccttccgtatcgaagccatgacctcagcatgttcgtgctgctgcccaatgacatcgacgggctggagaaggtaaagccttacctcttcctcgttctgccttcatcttccgaggctctctgtcccagagcttgtttctgggtgagtctggagttagggctctgatctggagctggtgaaatagaaaatatttctgtctctgcagcaggtaaagatgggtatctaaagaggagcattacatggtgtcaggtttattgagaagaaccagtactaaaatatttggggatgagataacatgaacatttgaggtcatataggagttctaaagataacccaccattctccaaagtggttgatctctgtagaccctcttccccagggaagaaagtcacctatgcacgtggacagcaattttgaattctattcacaggctattggactttctgagttccttttttagacatttcattttttaaaagacttttttagggcaattttatgtttacagcaaaacttggaggcaggtacagagatttgcaatacaccttgtgccccacatgccacagcctccccataatcggcatcactcaccagtgtgttttttttaaccccaaataaacctacctccactcataataaaagtccataggacccttaatcataaatcccttgatttagtcctgcccactggttgctcagacagtaaagaatctgctgtaatgggggagacctgggtttgattcctggggtgggacggtctgctggaaaagggaatggcaacctgctccaggattcttgcctggaaaatcccatggacacaggagcctggcaagctatagtccatggggtcgaaaaaagtcaaacacaaccgagtgactaacacttaaactgaagctgctttgtagttaaaacactgatgtggcgagtagcctgtgctttggagaacagggaggttgttttaagtccctgttctgtttagtgcctttcgaccctttgacgtttcttcatttcttggaacctcaatattttctcatttataaaatgagttccacagttcttaatgtgtgtgttgtaatgattagaatacacacacacacacgcacacacacatacatgtacatcctggaccaactctaagggacctcctagaatggatctgaaaaatgaagtcgctcagtcgtgtccccgtggacagtagcctaccaggttcctccatttccttctccaggagatcttccagacccagggattgaacatgggtctcccgcattgtaggcagatgctttactgtctgagccactagggaagtccagaatggatctaggacatgaagacttgcctagaatggttccagttcttggaaagtgctcgataaatcgatggatgctgtattattaagatactagaagctctcctgcttctgtga

SEQ ID NO: 45414 - DNA, 1507 bp, Bovine  19866881439895
gtttctcctaaagaaatacttagatactgttgaaaaacattaccatgcttctctggaacctgttgattttgtaaatgcagcagatgaaagtcgaaagaagattaattcctgggttgaaagccaaacaaatggtagtgtatggatgaattgttcatcataaaaacacttctgagtatctgctgtgagtgaagccctgtgctggacgctgcatagggtataagggtgtacaagctttgggaggggacctgagatgggtatttcagcttggagggactggagccaaggagtgggggaatccactgcagacagtggaatggcctcagcagatgtggagagagccaagggaattgggcaggggaccacaggaagccaacttcgtggagacaagtagtggagaattacttgcgcatagctggggatcccagtgactttggggctcctgatacctggctcatgtctgtcgtgaggtcacatttgacttttacgtgagcacctttctttctgagtctgggtccataagtaaaaacgtcagagggctcctttctctcggtcagtgagaagcatcagcccactaaagacgcgcctgggccgtccgcggctgggctcctggcacggagggcggcagccttgagcctcgtccgcagcagggactcgacaaagccccgcctcctccgccccgcctcacgccccggtaggagccaaactcgcaggaaatagcagagagcaatgttaagattttgcagagcagtgctgatactttagtgttagtatttcagaatacattaaaaaaaaaaaaagggtttatttaaggatttggctgtgccaggtcttagttttggcttgtggaatcttccgtggaggcacgcgaggtctttaactgcagcatgcaaactcttaggtgcggtttgtgggatcgcgctccctgaccagggagaatacatttaaaaaacaaaattccagttatcagatagacagctgtcatttcagattgcattttttcttcatactcagttcaaaggaaatgaaaattttaaaagggggataaaagaggatctatcaaagggttggttgagggcagtattcttcagaatttcagtgggatgggctgaacccagagataaaacatcagctcctttgcaataaaataagagatctctaaacctcacgtagctataatgagtgggttaaaaataataatagctaactccgagtgcttattatgagctggataatattccaagtgcttctctacatagggaatcattgattcctttcagcagctctgtgaggcaggttttattcctgttttacaggtgtggaaactgaggctcagagagcttaagtaacttacccaggacccctcagctgatgagaggcaaagctggatgccagcagtggcaatctgactccagagcctgagctcttatccctcacacctcagtttatcctatgggataaattggagatgggcaaagtgagaacctcctatgatttctgccagcgaact

SEQ ID NO: 45415 - DNA, 1140 bp, Bovine  19866881622720
tggctcacccgggaaaaaaatctgcctgcagtgcaggaggtgtaaagaggcgtgagttcaatccctgggtcaggaagatcccctggagaagggaatggcggcccactccagtatgcgtgcctgaagaggcccatggccagaggagcctggtggcctaccgtccacggggccacaagagctggactcgactgagtgactaagcagcagcagcagcctgagaagcagttttgtgatcgattttgcaatgagaccacttaggtctatgagagtcacaggagagagcggaaggttgggtgttaatgacaagtgccttccacatagtgggatgatcagtatttgctggttgttacagacactatcgtagagacgtcgagctagtgtgcgtgctaaaacaagtgaccgtgcggaaagaccgacaagcccagcttcccctcctcatcttttaggacctgttttatggtgggactttgcagaagtgaaaagttcaggttctctcttaaaagagaaagtatatacttctattgaggcaaggaatacgccccaaagaaagtggcttcagtgtgccagtgagaattccagaagagggatattgtaaaagcccctaccaagtagattcaggtcagggaaaatatataccttggagagggatggagacatgaacttgtttagaagttggctctcttcaaagaccctagagtgtaaagtatcatgtaattgatccaagtggacaatatgtcaatcaacaaatctaaactgagctgactgttacgtgaaaggcatctcaccctccaagctccttctaaattttcccaacgaaaaaggtgagcattgtgcactgatgtctaagtaatgggtattacaacacaaatatgtttgagaaatgccaaaagagatgctgtaatttttctgtgtggtctcagcacaccgctgtgtggtagcaagagctccctctgggcattaagctttgactctcggggttctaatcccaactctcccgctcaacagcttcctagcatttctcagcattaggagaggagctggaatgagactcggtgtggtttcatcagaagatccaggtgtgtgctcagctatgcccttccattgctttcgactactaggagagtcattattgtttctgtt

SEQ ID NO: 45416 - DNA, 1290 bp, Bovine  19866881829792
cagtattcttgcctggagaatcccatggacagaggagcctgatgggctacatggggtctccgaaagagtcggacacaactgagcgactaaataacaaccaaagtggaaacagcagcagtgggtctcctctggtcttgcctgagaactcattattctgaagcagagcttctccaggtggagcctacagatcccctggcagcccgaagatcctttcaatgggtccatgaggttgaaactcctttcataatagtacttagacatcaccttcctttcactcttaatctcttacaaatacacggtggagtttcccagagactatggtggtggtggtggtcgtttagtcgctcagttgtctatgaagccaaatgttagagagatttgcggaaacgaaaaatgatgttactcttctctttgtatgacttcactttaggaaacagttatttttcataaaagtacgttatccatgttactatgtaatggttccattattgttaatgagtttttaaaatatttcagaattttttcagctttaatttctaacttaatatcaatagatataagcaacatgaaaaaaaacctctttgggattctcagttatttttaagcgtgtaaagggatctggaggctaaagcctgacaactgctgtgctaatgaaaggcctgcctatcctctagccctagtgcagcagatactgactgatgaagcctgaaggctcctgggtaaatccagcggtcagggcatagtcccttctagaagccaagctgagctgcatgaaccctccgctctgcctgaccccaggatagcatgtaaggggcatcattacccctggatgaccatcccacggatcaaggtttgaagcattcccccaaggcactcaagcactgtgcagtcgtgtattcagacagcaagagcgaacgtggcactgaaggccctcgggtcggaagtgctccctggcctcagacgaagcatcaccactcgagacagagggcttccgtcaatcaggagccaatgcattagagtcgaatgcacgaacaggatctcaactttgtacctcatccctgaacagaatttcaaaatgccaagacaagagactaagatcaaggaacgtgcccctggtcttcaaacagttcttcagaattctcccttttatgagacatgtggcttgtgtgtaggacagactttaaaagatcataataaatctcagtcacaagtttactagcaaaaaaaaaaaaacttttctgttgccccattcatgctcactgatcttctccagtgactgctttctcccat

SEQ ID NO: 45417 - DNA, 956 bp, Bovine  19866881881735
tgtttcgtcactctggtcgcgtggggtcaggtgttcatgtcagtcacctacttttcttggacttttctcttttcagccccctcatactagcacactttgtaagctgtataaaatacgtaatgtgcttcttgaaatcgaacccacgtgtagtgacttctaaggtttttgctcctgttaggtcctataaaatagtaatagtagtaatcctcctggagactgtaaaaggaagcactgcatggcatcctttttcaaagatagctcttcagattaaaacaaaaagtctgcaaaaaacttgaaccagagttattcctcttttactctttcacaaattaatcatttcagatacgaagtatagatgtcaatgacacttcttcagtcttatgagctgtactcctcccccaaagaatcacgctcacaaaagaactttatggtgacatgacagagactgtctagcgcaacagtaccaggagaaaaaaaaaaacagctcacagatgttcttcaaaaatacaagcatcaatcacttcaactaaagtcacagcatgagaatccacagctaagaatcaattcttctatctttataaagatactctggacgcaagtttgcccagcagagcatcccaccaaacggtgtgcattgtaggttagggtggaaaataaaatagtctaaaaattccagcaaacttctaaatcatacacaagttatagaagcagaacataaggtaggcggccaatgcgaaatctgtcagtgatgcaacaaacacccatagcccagggttcttcaagacacaaggtcatgcccactatgaacgtgccacaaattggaggtcagtgtcaacagactctggaagtcaacttaccttttcacaatcatccaagttttctagggaaaggggctacaatggttttcctctttgggtagattttaccaagtgagtcagagaagacaggcccctggg

SEQ ID NO: 45418 - DNA, 1796 bp, Bovine  19866881014860
aacctggaatcaagattactgggagaaatacaaacaacctcagatacacagatgataccctctaatagcagaaagtgaagaggaatgaaagagcctcttggtgatggtgaaagaggagtgaaaaagctggcttgaaactcaacattcaaaaaacagatcatggcttcgggacccatcacttcatggcaaaaagaaggggaaaaattgaagcagtgacatattttattttctgggctccaaattcactgcagatggtgactacaaacataaaatgcaaagacacttgctccttggaaggaaatctatgacaaacctagatagagtattaaaaagcagagacatcaatttgcccacaaagtatagtcaaagtctgtatagtcaaagctatgatttttccagtagtcatgtgtggcttttgtgagagttggatcataaagatggctgagggctgaagaactgatacttttgaatcatggtgctggaaaagagtcttgagagtccctggactaaaaggaggtcagaccggtcaatctaaaggaaatcaacaaccctgaatatttattgaaaggactgatgctgaagctgaagctccaatcctttggccacttgatgcgtatagctgactcattggaaaagaccctgatgctggaaaagatgaaggaaaaggaggaagggaaaggcagaggatgaggtggttaggatgtatttgagcaaactccaggtggtaatggagaacagaagatcctggaaggatataatccatggggtagcaaagaatcagacacagcttagcgagagaacagcaactgcacttcagtcccttttgttgactataaatcttcagctgtctttggtgtaatcaaagttgaatttagttctatactgaatcttctctcctctacttcaatactttaactagaatctatcttgtttcttgtttagtgcaagatttttctattatactatcctttcaaactcctatacagtgattttccacaacaaccaacgtatgctcctcttcatagttttgctctatcgttcttgctttgttgttgctctcaatttttctcaaacatgttcttaataacctgaatataaatctcttctaagtctattaaatagaatatcatcaatgtttcagctcataccacactctcccttcactcaaatagtctgtgtaccttgcattgttattctgcaaattggatcagcaaactttataattccattcacacattaaccaagcccactggagtacatttggcaacaaccttcagaatctccccaaagttgggaattcctgcaggttctactttgcactcttagatttgatcttctttcttagtctagattgtcatcttttatcaattctgtatcccacagagaaagttacatcagagacatgtttacattacttgcacaaatgaagctatatatcatcaaccctaaagaaaaaaaaaatgaaaaattgaaaatgtgttaaataatggggggtagttctagcctctgtaacacctaaagcatttctctctagaatgtaactctcacttttaaattcaacataactctaagaacaagccacctactttatgtgctgattcttgaagaaaaagtaaactgtccctatgctggggtaaaagaaaagaacaacattgggtattgttagttttattgagaaatagtatagattattggcttttacagtaattttctaagtatctttaagaataactttgacatatgcaaaaattgccttttcaaaataaatttagaaatgaccccacaaaagatatgat

SEQ ID NO: 45419 - DNA, 1471 bp, Bovine  19866881563624
cttttaaatcctagttgctggataaagaatatcagctactaccagaatgaggttttatatagtattgcttatagctattttagttgcacttatatcattttaaatacagtttatgaacattgtactactccattatattattcatttatcttcagtgatatttatagtatcaatttaaaagctgtaaaacttcatgaaaagtagcctaaacaaggattttgataaaccaaagctttcagatttagaagcaaatcatgtacttcttaaggaagatttgaagttttttgatgttgatgatgatagaattatgaaccttataaactcagtattttttagttaacctaaatacataaatctatttgaattcatcttatgaaaagagatatgtcattagatatatgatcattatatgctttagtgattcatggaccttgttacatacatgctttgtaatgtatgaattatttagcaagaaaaatcacaataattttgttgttactcaaaaatttataggttggcagaaacaattatgcagcccctgaagctggtatgttaaggtaacatcattaatgctacatatgatgatttttttagtagttatttgacataacctttactgctttcgctagaatatatcagtaattttataacaatctgtctgtaagcagaacattgaatttattaaccacagagtgattcatttaattctattttcatgtaagtgtataacttaagtgagatctaaaatgttgtctccccaaactctaaagcaaaaacaaaaatgtacaaaataaaaatcagtattctaataaatacatgtgaattaaaaaaaaatagtaactgggaaaagtggaatggctttttctgtccactaattgtctaagggatcagtttctaattttgttttgtttttccaagcttgcattataaggcttcatattattttttttttctttttcttctttagtgattagatcaggtgagagacatatagttgttgctgtcaagtgtttttctggaagatgaccttcatttatactatgtacctgtagggttcttgactagctgagcaaactgatactgctgtatcattattaactagattatatctagatatttttagtaagagcctaattttaaattttatttcactccttttcagtgttttctgtagtacttacaacacagagtctatgatttacctctgtaccgcacatatgtgaatgttctgacccaagggtcagatgcagaacattatttaaatatgttctgtcatgcagtaatgcataaggattacgaatgggcaaagatcctactcagtaaaaaggaataacatttacattgaaaagattaataaattcttaaaatttcagccacacaaaaatgataaaatacaatgggattttcaaatgttaaataaaacatctgtgctcaatagaccattgctccgagctaaagcaatctttctctg

SEQ ID NO: 45420 - DNA, 1243 bp, Bovine  19866881014875
taagatcattatgtgtggtggtataaatgttatatacatatttaaattctctctggtgcagagttttgagactgcactagaaattggtgatggtggccaagtgaatgcttatggaaggctcactgaaatggaaccacttgcactgtgtccccttcatctccatcttctccatagaattgagttcatagtcttcacacagtaactccttaactatttgttgagtgattcagtctaataggcagtagaagctttgacacacatatgtattgttttattggcttctaaattgctaggtgtaactaaaaagtatcagaaagttccctcataaatatatactgtatttttccaaagccaggaataaaattaatattgaataattttatttatgtagaactcaggcagttttggtttgtttttttttttttttttcttagtaaatctctcccttagctctgtagagatagcctattggttttattgtgaactgtgttttctcttttcataggcttcctcatgtatccagaggatcttgtcaacattaacattagcaatatttcccacactgtatttttttaacttcctttattatacagaagcaggatccatgttttttactctttttgcctacttgatgtgtctttatggaaatcataaaacttcagccttgcttggattttgtggcttcatgtttcgtcaaacaaatatcatctgggctatcttctgtgcaggaaatgtcattgcacaaaagttaactgaagcttggaaaactgagctacagaagaagaaagaagagaggcctacccctattaaaggaccattttcagaattcaggaagattcttcagtttcttttggcttattccatgtcctttaagaacttgagtatgcttttacttttgacttggccgtacattcttctcatgtttctattctgtgcttttgtggcagttaatggtggaattgttattggtgaccggagtagtcatgaagcctgtctacactttcctcagctgttctactttttctcttttactctctttttttcctttcctcacctgctgtctcttaacaaaatcagggcttttctttgcttagtttggaaacggagaattcagttttttgtgataactttagtatccatatttttagtttggaaatttacttatgctcataaatacctgctagcagataatagacactatacattctatgtgtggaaaagagtttttcaaagatatgaaatt

SEQ ID NO: 45421 - DNA, 1278 bp, Bovine  19866880345289
aaaagatggaggaataacatatcaatgataaaggggtgtacatggccaaagaaatgattcccttttgataggtgtaccctgcactccaggccctcctcgttcactgacctgactctgtgtgtagatgtgccttctggactgacagttcattgattaggcgctggtgctcctcttccttacttttcacttcactcagttggtcctctagtgtacggcacattttctcgaggtttccctgcggtgcgaagtagaaaacagggaaagataacatgcttctctttgtaagtctggggagctgtaactctttgcacaaaggggctgagttttctttaccttcctatctactgcaaagctctgcataatgccttggatgcaaagtcagaggcacctggttttggctaaatgaataaatgaactattgtaaaagttagattattgtcgtttggaaaactagaacgtcatttaaattctgcatcatggagaatatggtttttacatacgtttttttttttctgtattttcattctttcgtggtaataatgacaaagtttaaagtgatttttctacgaatgagataggaagattaaaataattcacttcaatatagtactatctattaataataattttaaagtttgagataacatctaaaggcttgtacagttagattagatcatatagaaactcaaatcattttgagtcatggaaaataagatgaaatgggacaggttagtacatactttggctttggagacagtctccatgttgctggccaggtcgtcgatctccatcttcatctcgctcttctccttctccagcttctgcttgaccctctgcaggttgtcaatctgctcccccagctcggccacactgtccgcgtgcttcttgcgaagagcggccgccgtggcctcgtgctgcagggtggcctcctccaggtccctgcgcatcttctggaactcggcctcccgcttcttgttcatctcaatctgggcggaagtgaccccgcctgcttcttccagccgctcgctgatctcctccagttcccgggagaggtctgagcgctgcttctctgctttggcgcgggaggcccgctcagcctcgatctcctcctccagctcctcgatgcgggcctggaggtgaggagaagctcattgtgagctcctttaagctaattggtaattttgtcgtgatggatgagactgacagaaaccacggacttacctgtaactccttgatcttcttctgcagctgcatcgcaagggcctgttcatcttcaat

SEQ ID NO: 45422 - DNA, 1789 bp, Bovine  19866880353593
cgctatgaacagttaacaagcttctgactagcatattttccccaagactttttgctcctttgcccatgagttgttacagttttctaaaaacaccttctcagcacctgttttatctcttctgcagttctgttttccctagtgaattcttttttatcttggagatattcaacaatgtacaaggtcattttggtgtgtgtgcttggtggtaatggtgggggggtatggagattctgagtaagcactttagtggagcaagtaatgtgagggtgtgagggtgaggaagaagggatagccatgaacaggaagcctggcattaaagacttttaactttgaataggatcctcagccattttctagtattgtcttctttacgaatgaggaaactgtggcccagagtgacactgtcaatgccatacaattaatcaatagtcttctaggtctggtcccttgagagaataaatattattcccttattacatttgtccaaagtcttattgctctctttcagcccacactcataagcaggatgcttcctctgcaaaagctcatcaaactctctcattgtttaattctgacaactgctgagataaatcaaactttagaaaacttccttcactagaatgtattggttattttccttccatgtgtacctcccatgagttttattccacagcgtgtgtaattagtaagttcattggtactggttgttagttaaatgatgggaaagtatgatagtcttattctgaactaatagtactccaggtaaggataaacggattgctgttaattataatattcataataatgtactaggtagtctcagtgcctctgtttctccttatattaaagaaaatgaattcttcttaattcataaaggatatgctgatagttattaattcattttggtggaaagaaatttaagctgcttttgtaacagaccagaatagggtgagggctctggtcttggcccgttctctagtggacatactctgggctgacataaggagaatatggtggagtccaccactctacataaataggctgaaatccttcccctatctccatggaatagtctctttcttttatttttccttcactattttaaagcatctatttctttccacccgccttgctaagagctcatacttggcctcctccagctcctccgtgcgctggatggcgtccgtctcgtacttggtcctccactgggccacctcgctgttggccttggacagcgccctctgcagctcggccttgccctcttgctcctcctcgtactgttggcgcagcaggtcacagtcgtgccgggaggactgcagggcgtgggccagggcgttcttggcctgcggaagtatgagttcactgacttgaaatcatttcttcagtgatatttaacttatacacttaaagtagaatctaactgaacatgtttagatttgattagtcaagatctttggtgaaacttactttagtttcttcctctagctgacgtttcagttcctcaatctgctgagtagatgcttgcttggtccttgaaagctgagagaccaaagcatctttctcatccagttgtcgggaatattcacctaagaattatagaagtaaaggaatttgctagtggcataaaaaaataagcctaaaggtttgtatatatattatacataaaattgacagatatatacttcaaatattgttatagaattggctgctgctgctgctgctgctgctgagtcacttcagtcgtgtctgattctgtgtgacccctgagacagcagcccaccaggctccc

SEQ ID NO: 45423 - DNA, 1019 bp, Bovine  19866880424080
tgtgtgactcaaatttttaatatttcaggaggactaccatgcccataagtcatctgaatagtacagtaattcattgaagttttgctgcacacagtcgaaaaaacagcttaattcttaaaagcccagggcagaatttactttgtcatctgaaaagaagacaaagtgatgagcggtgacaagacagaggtagtgataaacgattttagctacataccactgcacaaatcacttcacttacgtggactgcatgtgtttaatgtataaatagaaacataatatgtatatctctatttatttaacattgataaaataagaccattttattagttcatctctaaggatactttcctaatgcaaaattgtatagctttattcatggcattgtctttaatgactcaggatctaaaataatataacatcacgttcttgggtagaactgccacccaagctacaaagaatttgtctttaaagagacttaaggatttttcctgtccaatcacgcactcagttgtcaagatcaatgtgtgtacgtgaccctaaagttgcatttgctttaactggagcgtgtgtaagagccctttgctccatctgcacaggacactcagctccacttggatgatgccatcaggggccaggatgaccttaaggagcagctggccatggttgagcgcagagccaacctgatgcaagctgagattgaagagctgagggcatcgctggaacagacagagaggagcaggcgagtggcagagcaagagcttttggacgccagtgagcgtgtgcagcttctgcacacacaggtgaggtttgggactatggttgagcaaatgcactccctgaagctgaagaccattgcagaggataagcttgttcaacagtaaggaggaaccttggccagggtccctcccaggagttcaggaaaatgtacagcagtaaatatgcaccggggtccagcagattcacaaatacacttataggctggcttaatcattgttgatttgaaataatttactgttcta

SEQ ID NO: 45424 - DNA, 1589 bp, Bovine  19866880467728
atttcttaggtatattctttgagaagtcagagttgctttattttttacatctcagttaactattaggatataaaataagtaatgtgagtctctaatcctgaaaatatgtgtaagagtgtgtttggggagatagtgcaaattggtagtgagaaaagaacagggccattttcttgtttaggttatatgttatatctacgttttagttttaaaaggaatgagacttagctatagaagttcatagaaatcctgacaaagcagccattagatcagatgctccatatgtccccttttagaagaaccagtttttaagccatccaagagaatcacattatttgtagtaatgttattattactgttatttaattctttacgggtatttttctatcttaataatccatttaaatcacgagatttggctttaggtaattttcagctatcacaaaaaattatattctacctcaaaagacaaagatgcattttggtggaaagatgtcctaaaggatgtgtctcaggcttattctcaaagagggactcaggaatgttctcaaagggcaatattagtggaataaagatacggctttccgcagggagaccttttgaagttcagctgtgcttcctcaaaaatcagccttattatagaaccagaaaactcctaaaggcatttttggagttcctgaatacatgagatgagcataataaggagtagtgggtaaaacattcggccctacagaagtaccctgaacaagaggaaatatttgaaataattcctattaacattccattccctcctaatttattctaaatcctataattttaataagtcatagagaccatatggatttttgaattaaatttgtactttaccctgaaaagggctgacacagtctggaaagaagagcccttcttcttagcacctttctttgcaccgctgtctaagataaaaagaaaacccattaatgaatgtatcccagaggctggaatggcatgtaaactttctgtggggataggttaatttaaatcaggggcacagaaagtaccagcttcagcactagcatatgtggaaaagagactggccagagtcttcatggaggacttctggtacagcccaaccactgtgtcgttcagggggtccttgttcttgtccagccagccggcaatgttgtagtccacggtgcccgcgtagtgaatcagggagaagtgggcctcggctctgcccttgaccaccttgggcttctggaagttggcagacttgcccaggtgctggtcatacagcttgttcttgaaggaggtatctgtggccttggggaacatgcactcctcttccaggatggagaagatgcccagtggctgaattcagaaaagcagacgttggtgtcagtctatcttgtctcaaaaggtatagtggctgtcatttgattgaattatgagcactcctaattaaatatacttaaaaagtaaaccaggatcaagcttatagtccttttgttatcactagaatgactttccaccattctttctcacattcgatccataacattatttttaagtaaaaaaatagctagatacaaactccagatgtcagcacagca

SEQ ID NO: 45425 - DNA, 1493 bp, Bovine  19866880488373
gatggggctgggtgggagggaggttcaagaggggagggaatatatgtatacatatagctgattcactctgttgtacagcataaactaatacaacattgtaaaacaattatcctccagtaaaaaaataatacatggaaaaaaatttctgcactgctgtattgcactgctcttgtctcttgtgattgacacatttgttttatttttttatctccccgagtaaattgtaaactctgtgagaagagagactatggtttttacttctttgccacctccctccacagctggccttttgcatagcattatgcaaattgtaggcactcaacaaatatactttgattggttacgcagtttcatctgtgaagtggggataatgtttgtgttataggagttctgggaggattaattgagacagcgtgtattaaagagcttcttaaactgcaaagtccaaaagacattattactgataataatcactttatttttaataaaataataagttaatagccatatgctaggttatctacaatctggatgaccaaggatgtaccccataaacatttcattagtacttatagaatcattaggtcctacacaagatacgagagctacaaggaggatggaacatagtagtagccttcaaggaattcttactttagcaaaggagcaaaaacagaagttcctgccatgttgtgtgaggctacagaaagctctataatacagacacaaagtgctcggagacacttaaaggattcatttatcatgactggggcattaagaaaaacttcaaagatgaactgtcacttgagcctaccctgggaggtgaataaaagtccagtagatggagaaagaggacaagaacatcctagggaagaaaaagagtagaagtgcagggtgtttgtagaagaggacacaggattatctgattacaacctaagaactttgtgaaccgtgttaaggaacgtgaacttgattccaaaggcaatgcaaaaaccacagagaagcgaaatgatgagacttgtattctggctaaatgacgatcagggacaatgcttcccactgcaaataacagacattcaatgaaaactaacgtaaaccataaggacattgatcatcttactggaaataaagggcaggcaagctacaggcatggtacaaccagccccataaacacccagaatctctccaagtctccaccgtgcaaacactagttattgcctttccctggggtggctgcaaaaaggcagtgccagtaacacattcaggcacaaataaaccctaaagcgtcttccctacaggtgcctctcccctcatctcattgggtcacatggccctgtcagaggagagaggcacatgccatgcctggcttgggcccatcatctgagctggaatgatactggagcacccaccatgatgtccaccacaaagagccttgctgccagcttacagatgggctccaaggggagactaaaacagggagacccattgaggagcag

SEQ ID NO: 45426 - DNA, 1269 bp, Bovine  19866880504028
ctggcactctactaagtacttcaaaattgttacctcatttaatcttcacaataacccaagaaggagtaacatacttctaattaaatgtggaggaacagatgcaaaaaaatcagcacgcttgctaaagatcctccagccacgtaaggcaaagccaagataggaacctggatccgtagtgtttggtccatacacaaggctccctccgtcccatggaggaaaaaggagctaaaaggagaagcacagtgacagttcatagtctttcctcttccagcttcatctgacacccaccatttcccctctgggtcattagcttcatcatctataaaaacgaaggtgtctataaagtaacgaagattactataaagacttcatcagatcttcaatgctagaccacacaaggtccctactttcacagatgtgacaatgagaagttaccaaatgtttgatatgaagagaaattaacctattaatttcactttgtacatcaaataaaggtcttaagaaaagctttccttaataaagtgacagccaaaagtgaaaatgtgaacttcaccttgaattagagagtggggtggtaaaaaggtgaggctttgcaataaattactttcacccttaaatctgaacccattactcactggattgtacttttgttgtacttttaatgcacattattgcccaggcaatctcagaaggggaaggaggtccattctaccagaactcttgctgtgtggctgacagctgtaaacaatgcccagaaatcacaaaaagggctcatgtcaaaaatgatcctttctttcctgggatttctgaataaacaataattagttcataattttatttcattactgaattacacatattttcaataaaagatttttcagtaatgaattctaccactttaaaaatccatttaacattggaaatttgcttttgtgcagttcaacagcctggaacagctgtgcatcaacttcaccaatgagaaactgcaacagtttttcaaccaccacatgttcgtgctggagcaggaggagtacaagaaggaaggcatcgagtgggagttcatcgacttcgggatggacctggccgcctgcattgagctcattgagaaggtctgtttgacttctaaagtaaatctgaactgtaagcataaccttcccaagtgtcttaagcaacttcagaaagtattacagtaatcttaaatagactgatatcagaacaagttagagaattactttagaaattatttcctcttttcagcttttacagaag

SEQ ID NO: 45427 - DNA, 1551 bp, Bovine  19866880593892
gcagttttgaattaacaaaaatctactttgcagagattactacgatgcagtgtatccatagaactcagaaaggatgcttctcatttcagtctgagataaatcatttcccaacatgagggtcagaaacccccaaggatccccaaggtccttgaatccacccgcacagtgataatggtctcaagttcaaacaagcaacattccccaaactatgttttctcttcttttaatgaatatatctaatatagctgctatatttaacataaactcattcaaaatagttattaaatatatagtatgtttttatcattatgtatattttatatttctagtgtagtagtaaaagtacacgttccaatacatggagtgagggagatccgttaaatgtttcagttccatggagaagtccttggaaccactgatttagatcatagtttataagagctggaggcccttgagtagtcacgtaggattcagcttcctttattttactgatgaggaaaccgagtcccagaaaggtgaagagtcatgcagtgttccaaaggtgtgagtggtggtgttaggatgtgagccctgttgtcttaagtccaggttcagtgctaattccactgcaacatgctgtattttaagatacacaaagccaactggcttgacccaggcaaatagagttggtgcaaagcctggattggcacctgggaattttgacttctattgttgcacgttgttgattttatccctcctgataatatcctcagaggttaagttgcagtaatagttcatattaaatattagatgtgatccttacattctttctgaagttctcacatgtcaaagagaagagtcactagattttgtgtgggtaagtggcctgaaaagccagaattttatgagaagccagttttaaagaagaactgcttcttgtatcctattcccaatactaaactaggaaataaactggtagctctttaagacatagcaatatagaaatctctttattctttagagtgtaataataaattactcttacctcttgtgttaccagatgcagaaggtagcaggctcaaagcagaaactactgttgaaagacaaacaagagaatgcagattctttgatttttttccacttaatcacaaaatattagtaactgtattgtgtacgatgtcatcttaggagtgtcggagagagaaattaaaatttgggaaatagtagccatctcccttaagtgaataatcatttttatcaggagtgtaagactagccaagtgttcttccacgtatacataccttaaaggcttttgaggaaggacaggacagaggcattccaactctacttttatagagaccgttttgcaaacacagcagccacctcagctgtcccatctgggaacctacttggcaaaaccttttttggcaatctctttgcacaatattcactgactgtggctgtgaatggatataattagaaatatttcttgacacctataaataatttgacagaggatgatctagggttctttataggtattgatagggatggggattcaggcttctaagg

SEQ ID NO: 45428 - DNA, 1805 bp, Bovine  19866880675038
tgggggagacaggtgggaggtgaggattaggagaagaacgagatccgggcatttccacctgctccctctctgtgggctgtggttggttgcaacatctttctatcagttcgcccctccagctgcagacctctctccagcttcctgtcaccactccttccccttgcctcccagggcctacttcaccatcccctagtccacctacatctctgggaaaactcccttctttaaactcctcactgcctccacaattaagaggtttctttgccctccacactctgatggatacaccgttcagtggtgcaattcagacacggctgtcactgaggacaggttccttggaagaacattctggtgaccaccttccctcccccaccccccaaccaatagctcctttagaaaatgacagctgataagacacagaactaagtgaggatgtgggtgacctcacttcccccccccagtagagcccactctttgtcacaaggccacatgtgtccagcttcgtgatcagacagatggggcccgaggaggaggaggaaatactgggtgggccaaaaagttcgttcaggtttttccgtcagatgttatggaaaaaccctaatggactgtttggtcaacccaatacccaccacttataagcctacagcaaaaccagactccttgcccacaaagggtggggcgagacctgaagctctaaagcgcaagataagtcaaccttgcagtttaccagggaaattttttttttaaatcccttgctgtcaactgccctgggaacctccacgcctgcaccagcaccctcgcctgacaatatgaggatcagtctgacaccagcatggggaactcaaagccacacttcctctagcagctgttggtcaaatctctttatgaatctaatgattttgagtccttctgctggactgacagtcattgtaagcaaagtcctataactggaaatgattagaagataaggctttgagtgacaagcttcaaattttcactcctccacctggtttttggatttcttaacatatcagcatttccttgttggaaagtctcatagggtatgccattcagttaatggcagacaccttggaatcatattgttacaagaatatactcctggtacccctgccaatcaactggactccttccctcatgggtcccccaccctcaaattaaaagtcatccttagacatgttaacgggagagggaaccctaatggcctgtaagtatcttaaaaggtgagaagcatcattagtcattgggaagatgcaaattaaaaccacagtgagattctagagtagaaaaaaaaaaaatcagagccaaggttgcttctggtgggtgagggtgagggccgagagaggaaggggcctgtgggtgacagtcatgttctggaacttgatagggtctggggctgcacagatgtaggcagttgtcaaaactcaacaaatgactcttagaatatccgcacttgacagtatgcaaatttaacctcaaaagaataaaataactgccaacacggtactgtggttagtagtgttactaaccacctcagtatgctgaggtgcttagggtgaggtatactgatgttctcagcttacttggaaatctttcctcaaaaaatagcctctggatggtcacaaaccacaaataagacctggaacatccttgccatccaaaatataattcccttccacccactgtggagtatgtgtgcacgctcagttgtgttgggctctttgcgacccattggactgtagcccgccatggacttcctctgtccacggaattttccacccaagacc

SEQ ID NO: 45429 - DNA, 1274 bp, Bovine  19866880686619
tttgagaaactatataactcaataaggtttttataaatgactaaaggactcataaaagtcagttcagccactgacttattagattatctgatctggggaatttctttaacttctcagtgtttgtttatatcttaagtttttaaaatgcttgaatgaatgataatggggacttttcagggttcctttgctttcaagtgatacgcttagtacatatttactcactgactaacgataatacctatgaagagaggttaaaatgaagaggctgtgatactgtgctttaaggaaaatgtaactcatataagttaatttatcaataggaaaagttgaaaatagcttaaaaattttaagaaagctatcctttttatggatttcttcatgacattgttgggcttgcttgacttggactaaggaaatgggagattgtaattggccagaatgttgatgccaagcctgtcccactttgatttcagcttcttcttgaatcaataaacagaggagagaccttaagaactcgggatctgtatcaaaggaagaatcacagggttcactagctctgccttttaccctggtagttcagttcaaataactgcaagtcaatttgttgggctaaatcctgggggttgggaaaaagagatccagagagaaataagaatgactgtcttttttgagtttaaatgcaatcttatacatgtgtattcagaaaatagggctccacttttaaggctgggttgaagcattaaagcagtcattttctcagaaaaatgactgagatttgagggcttgcctttaaattgcttccttcatggctgttaaatttgtgacattgttaaataaattcttcaatttcccatttgcaatttggaagtagttcttgccttcttcataggaatgttgaaagttaagtgaaatactgaaaaaagcaattggaaatattctttttcaagaaaaggccatttgtaaatccaaggtgtttgtgaagtcaagaaaatggtgcaattgaagtcactgacatggtgcattcagcacagagggtactcacagattgaacctggagctgtaggtcatttttctctttcaagagagtcaccattttttcctccagttccttccttttggcctctgatttggccagttcatccttggttttctgaaactcttccttcattgtggccatctccttctctgtctctgcactcttgaggaggggcttgatctgaaaaaaagtttcatccaaggccagtgcttgacgttcatgaaggctcgtacgttat

SEQ ID NO: 45430 - DNA, 1060 bp, Bovine  19866880696069
ttgctctgtgcaaaggctcgtcgccccagcagaagaatgctatggaaaccttgggagctcacccaacacccagctgcaggagtgcctttgggggatgcagaaggtaccctccaaaggagagagctgcaaaggcaggcgacctaccgctgtttgaagtcgccatagaggatccggctggggaagcccttcctgcagatgcgaatgccctccaggaccccgttacagcgcagctggtgcaggaccaggtggtggtccatcacgcctggggagagaggagcccagggcctgttagcggcatttccactgctttctctgatgatctgggcaccacgagacccctggatacccagactcgaatgggaaggtttggtgccagtagaaataatctcaacatcctggggagactctagcaccccataaccatgggactaaaagccaaaatattaatctttgccctgttcatcgttcttgactctggtgaagacagaatggttgtcttggtctagaaatgtctctcatcattattattctcatagtaacaacagtttttattattactataattgacagccaacatttgcagagtgttcataatgtattttccctatattggttttgtttttattattttccttggtggcctaataagtaatcatgtgtaagggtttcatgagaatatgcaaagaagaagcctcctctgtcattgctgtgtttgatattttgacgaggttgaccgtataatttattatattgcatgcactcctacatattttcgtctgcctcatcaatcatgagctgacagagtttatttaaattcacctacaactactgttgtagtgctatctactagcacttttttaaaaaaattgaggcatcattgacatataacattttattagtttcaggtgtacaaccatatttgtatacaattatgaaatgattgctgcaagaagtccagttagcccccatcaccatacacagttacaattttttctcttatgattggccctgttttaaatgctgtacatgtactggcttatttaattctcacaacaaccct

SEQ ID NO: 45431 - DNA, 1555 bp, Bovine  19866880701808
ctggagatcgaacctgggtctcctgtattgtaggcagattctttaccatctcagccaccttgaacggtgctctgtaattctctgtagtaaactaggcattgcctctggagctccctctctaagtcacaccgcagcctagagagttctatgtgcaatattcaccaatccagcagcagtcttcatccatctctcccttcaatagtccaacctctttcaccaccgccttcccctttccccagagcaaacctcacaaaaactctcaaagctcaaatccttggagaaaggaagagacaggggcaaaggtgtgtgtcaaagcagtgttcacctgccgtgtcaccataaagtagatcaatggaagtcttgttctgttatcaggttgccatggatcagcatgcaatttctaatattctactccagaggatgaaggaggatgcccacgttagcaagaacgtctgagatcaacacttacccggtcatcgagggtcttgactgtgactttgtcgttttccctgccctggatcatacccttcacgtacaattccttatcatccactgcaaagcaggctttcttggagtcgaacgggcggttctgagcctcgattctttccttctccgatttccgcaggtagggagctgcttctccgaaaatggccatctccgcatcagaactcatggctgcaggggctggggacaccaggggctgctgaggcgggggctgaggggcccggcctattatctctattcaaacaggggccagattcaaaagctcttgggattaacccagttcctgcggaatctaggcccaggtttgggggcctagagcaggcaagtgggggcaagctaaaggggatattttactccaagaaaaatttttgaggggttgctttcaactctgagtgttgattttggaacagctctaagtccagctccaagtgtggaagtctgaaccaattagaggaatctaagctgagctcaataaaagagaactcagaaaacgcttccttaattcaatatcatatttgagcctcatgatctctgtgtcattcccaaatcttaaaggtgtctaagaagaatgactgttgataaatcctagtagaaattatcacaattatgtaatttggaagaggaaagtattttaattgtcctttcaaatgattgtggatattctttttagatactgtaccaaaacttacacatgatagtttctgtggtactttcttaaaggctagtcgcagcatagaattggaaaccacatcaacaaacatttggtacctgttaccttataatctgttggtctgtgttgaactttgaatgaaacttttacctatgtataaacatcatacatcaatcatttgagaaaccttgttcactgaattctacaacacttccaaatatcaacatatttcattgcacaatataaaaaaatcacagtcattaatatcagcactcattaggaaattcaaatattaggatgttgtcaagctaagtggtggtagacacaagtctttcaaaatttcaatttttgctgaaagctcaactctatcattagtaacaa

SEQ ID NO: 45432 - DNA, 1639 bp, Bovine  19866880907083
atcctcctcgaggatcttacaaaattccaaggaaatttatcatgttcttatgagataaccctctaaattccatggttgaacggagacatataggcttgaacctcaagtgaaataaagaagcccatctctactgttgatcacatcagcaaggtgagatacataactctgaattgatcacccctctccttgtctattccccagttcccttctaaaagtatcaggagagagagcactctctaaccccacatccccaaacacacacatgcacacacagacactgatggacttggtacatctaggcccttgtgatagtctacttacatcgtccacatgctgttccagcttgaccttggccttggtcagggtgttgaccttgtcctcctcagcctgaaggtcatccagggcctgctggtgggcctcttgcagagctttcttctccttggtcagcttggcaatgatctcatccagcccagccatctcctctgtcaggttcttcacctgttgaccaagaaccccatcccctctagggtcagacatcaccaacctggagacatttatggagacctccaaagccaagggccaggaccacactcaggtccgaggatcctgagacttggtctggattcaaagggagctgccctcaccttgttctctgttgcgtgcttctccttctccaccttggccagtgtcagctccaggtcatcaatgtccttcttgagctcagagcattcatcttccagcttgcgcttcttggcagtgagctcagcgttcatctcctcctcgtcctccaacctctcagtcatctccttcacctttgcctccagctggatcttgttcttgatcagctggtcacagcgctcttccgcatcattcaggttgtcttgttcctgagagaagaggacagagaggagagctggtgatgaaacagaggagagatccagagccttaaagagagctgaagcttggagactcatagtccctgatgatgagatgggttaggatccaggggagggggaaagagagatggtcttaccgcctgcacttggagctgcaggtcgttcttctcctgcagcagggacaccatcttctcctccagctccttgcgccgagcctccgatttctccagtgtctctttgatgcgcccaaactcctccttcatgttggccatctccttctcagtctctgcgctcttcagcagtggtttgatcttgaaatagagcttcatccagggccagttcttgacccccatgaaggcccgaatattccactggattaccagcagggcatccctggcaaaggagcacggaggcagggagccgcactgtgaaggagcactttccagtcatggggccagctgcactgggatcccagcacatctgaacaagtgtgtgggcacctgagggcaggaacctgctctggcaggcttgataggcaaccccaccccaacattaccacactgaacatggagttgtctataaatgtttattaattgatcaattcaacaaaagggcagtttatatcttcctttctggggtagtagtagctatggaagcgaccaattatagcacctctactgtgttcagtgtttctaatctcctaagaacctcaaatatgttaagaatatagtattttccattta

SEQ ID NO: 45433 - DNA, 1591 bp, Bovine  19866880927225
gggctgatttaaggaactgttgtcattcctggtgacagccttggagccagctctcaatgacattgccatttggaacagggttcttgggtcactgtcggcatgctgggttggatgaagtctctgagaagtctggctccgatggggtcttgcaggagggatgagtgttttggagtgagagagcctatggggagagcgtgcctggaggaaattgggtcaagatgtttggttttaacacctctgattttcttccaaatcggagaaggaaaagattctaacttaagggatgaagggagatttagagttttccgtgaatagagctcagagctccttggagcctaggttcttcatggctcaggtgaagctgcagagggaaaagccatgcctggcatttaggagagccatgtgcttggctgggcatattgctgagcttagaaaccacatgaactggtagggttcatgctcagccacagaaagtgccactgtctttgagttgttcaggaacctgtgtatatgtattgttggggaggtggaatttttaagcttagagatcttccccaaggtgacagaaccactgagtatagttaaagggcacttcctgcccattggaatccttaggcgtgttaacaagataagttcagggcatcatggactttgcattctagtgtccatggggtcacaaagagtcagacacaactgagtgacttcactccctcactcactgaaggcagcagaccataaacaaaactaagcagggtgatgactaagaaaatttgaaccggatgggcaaggaaggtcttattaggagaggacatttgagcaaaagctctggaggagggagtaagactttggatttctgggagaagattgttctagccagaaggcagagggggaacagccagtgcaaaggccctgtggcctgagcatactttgagttcagagcagcaagatcagggtggctgggccaggtgaggagctgggtgtggggtagggagtattggaggtggagggcatcagggcaggtggaccttggagaccctcaggaggtcctaatttttactttggtgttctagggggaactgttaagtagagatttgatgtgacctgatttatttattttccccccattttatttatttatttttgactctgctgggtcttcactgctacacgagcttttctccagttgtggcgagtgggaacgctctctagttgtggtgtttggacttctcattgccatggcttctctcgtggagcatgggctccagggcatgcaagcttcagtaatggtggagcacaggctcactagttgtggctcccaggctctggagcacaggctctcgttgtggtgcacgggcttagttgctctgaggcacctgggatcttcccagaccaaggattgaacccgtgtctcctgcgttggcaggcgggttctttaccactcagccaccagggaaggcctgcttttctgtttacaagagtcactctgctgctttaagaatgggtgtgggggatgcagatggaatgggggggagagtgaaaagaaggagatgagtaaagacatcatcgcagcaatacaagtgaggggtgatga

SEQ ID NO: 45434 - DNA, 2784 bp, Bovine  19866880955862
catagtgtcaactgtagctttgaaagtctgtgatcttagaatgatcccatgcttattaaatatacctctttctattagctccacattggccagtattttcaatggtagattttgttgtatctgtctctgataagcaatgtatttctgttttgagactcttaaggatatataattgatcttaaaaataaccttcagcacttggacctccagcgaagaggaaagccagagtcttcattgcggacttctggtacagcccgaccactgtctcattcagggggtccttgttcttgtccagccagccggcaatgttgtagtccacggtgcccgcatagtgcaccagggagaagtgggcctcagccttgcccttggcaggtttgggcttctggaagttgttggactttccaagatgctgttcataaagcttgttcttgaaggacgtgtctgtggccttggggaacatgcactcctcttccaggatggagaagatgcccataggctgagagaatgaaaagcaacatgccacttgaattgtctgcctgcagaagtaatgggtagcattctgatcctacttgagtaaatacatcatatcattctttacagttagtgaaaactgatttctttggttagaagttgttaaatggcaaggattacttgggtgtctatcaatacccagatgtgtgctgggctctgggatatgatggagataagatgaaaaaggaaggacctctggtagaggtttatgtctttgccccaaagccttggagcaatgtttctccaagtgtgactggcaaatggggttatgtcagaaacacctggtaaaaatgcagattccgaggctctaccccactcttcccccaaaatgtttctaggagcgagcttagggggaatgtacaggtttactcagtacctgtggggtctttggcacaactgagagcccctgctttcaagtactaggaactccatcttcaaatgccagcaggaatggctccaaaactgacaaagaaataagtgaatcatgctctcctcagagctctttaataaggaaagatggtttaagaatcagacttgtcatcagactatgaggaagggtagagttctggactctaggaaagactcagtctcctttcatcagatcatctacctcagagttggccaaaggaccttccctgatcttagttaccaatagaaaccttttaccagagtgtgcagtgagatttgtgattttcctctaaatacgggtcagcagtgtgacctgtggtctgagaaaggaaggcgaaccttctcgatgagctcgatgcaggcggccaggtccatcccgaagtcgatgaactcccactcgatgccttccttcttgtactcctcctgctccagcacgaacatgtggtggttgaaaaactgttgcagtttctcattggtgaagttgatgcacagctgctccaggctgttgaactaaataagtagaaaatacaagtgaacattcttcttgtgataacagcttctctttgaaaggactcttctgacatagttagcctaactgcttcctgcatgaaaatacaacctgactcagagtgatgtccccatacacagaagccaaagaggttctaagacacgggtgaaccttgcaaatactaggctgagtgaaggaagccgggttcaaagctctaagtagtgtatgatgtcatttacatgaaatgtccagattaagcatatccttacagacaggaaacagatttctagggggtgaagtaagagggaaatgggaaagaggttgcaggtttgcactgtccttagcacttttatttgaaagcttgtggattactcttcatattattgcttggtactagattattcctttcttcccatgttgggttgaggatttctggaaatgcttttgttcctaaacccagaaaatctcattcagtgtccatgaatgcactcatagagaaaggtgtggaaatcagacctctcgatcagacacacctgagacactgctgttggggagaagacttgggtaaactgtatgggaggtattctgtctcaggcaaatgaatttgagcttatttaccatgccatttccatcccctctactggccatggagggcaggtgagaatctctggattctgctttgaatttgtcattaacttccccatggccatcttttctgccactgtcaccctcatcacgttctttatcatttactaaatgctaaactatgtgctgggggacagtgcttaggtctttaaatccagaaatcttacaatggcaaaagatttacagaaataagcatgttatgtggagctttctgtacaggtcctaggtgaatttaccctgtttggggtcaataccattttcattatctaagttcacagaggtgcagtttgagcccagatctgtctcatcccaaagctgatgtccgttcatggacttttgatctcccttcatgtgtcagttcagtttgtagtgtagttattttcatggatctttttaaacatttactgtggcagcaagatttgtaagttttcctcctgctaagtttctgcttactcacatcaaagatctcaaagccagcaatgtccaagaccccgatgaagtactgcctgggctgcttggtgtccagctgctggttgatgcgggcaaccatccacaggaacatcttatcatagacggctttggcaagagcacccactgcgttatataccttcatggacaaagtaatgatcattgccattaataaaggcatgatgtgaaggtcctgggaaggatgtattcacagaggttgggca

SEQ ID NO: 45435 - DNA, 1826 bp, Bovine  19866880973132
tctttatcctaatttttctttccttcagagaatttatcactaattgacacttgatatctgttgttcccacatacacacactcaaatagaatttccaggaaggcaaactttgcctgttctgtcctctagcacttaaaatcttctcagcatgttgtaagtcctcagtggttgtttggtgaataaacaattgaatgagtgtcttatagttttaaaattatcagttccacatgtgatttttatcactatcctggcttggtgacagatctcagctcgttccattcaacctcatctttactatcataccttcaacaaccttttgggtagggtgataaatttatctgagtttgccaaggactgtcctgattttaaaactgaaagtctcaggaatctcttcaaatccaagcaaattagggtaaagggtcaccctgcttggagatatccaggcttcatcttccttcttttgatttattgttgtgtgtggtattgaggggcaagcgataacttaagaatgttctgaggggattccttggtggtccagtggctgggattctgcacttccactgaaggggatgtgggtttgctccttggtcgggtaactaagatcctgcatgctgcacagaagagagaaaaaaaaaaagaagttttgtgccatatgaacaagaaaatgggaagactggatgaataatagtctggctgtggtcagctggtgagcctcaccaaacaacaataaaaaagacacgagagaacaacatagaacacattgtcctgacttccagagccgactggcactgccagtggttggtacattctctagagaaagctcctggcttctgagtctcaggcttgcctgttgacatggtctcacccactctgtgtcactttcaaaaaggagcctatgatgcattcattaactcagttgtcacgagaagcccatgagttaggtattattattagccccattttacagataaagaaactgaggcccagaaaagcagaagaagttttgccttattgcccaaattcacacagtttaaaaggtgaagtctggatgtgaaccccaacattctgactctcaaagtccactctaagtgactaaattatcatgcagattttaaccatgtaaatatacatttgggctgtgcccagcaaagtttttgatcatggtttagaaaaatgtttttattatagaataaaacggtatgaatttttaagaaaaaaggtattaatcatgaacaacaaggttctactgtatagcacagggaactatattcatcctgtgataaataataacagaaaagaacatgaaaaagaatgtatgtataactgaattgtattgctgtacagcagaaactaacacactgtaaatcaagcataatttcgatcaaataaaaattttaaaaagtaatcaatcatgctttcctttgctctaatgaggctttaagcaactgaagtaatcaaagcgcaacataaaaggtgaaatgatggagaccttaactctcacagccatcagtcaaagttaagaggccagattgagggaggtcttcagtttactgagcagactaattggtagaatttcttctctggacacaatgttcccaggtcatgaacacatgctctccaggatgtttttggagaaggatgcctggtttgtgtgtagttctgagaagcatgtataattctgagaccgttcgtgtcttacaggatcttgcaaagccagaagcagctgtcttgtagtgaaaacacaaactggacttgttctagttcccactctgccacttactagctgtacgactagtcactaatctcgccaagcctcagttttcccac

SEQ ID NO: 45436 - DNA, 1533 bp, Bovine  19866881014947
ctcccacaatcaccatcaccatcatcattgctatcatcaccatccttggcaccataatgcctaaacttaaagactgaaaaggtccattaaaaaatgatctccttcaatcctctcaatttcatacacaaggaaaccaaggtcattctcaaagtccccagacaccagatcctagccctacactcctaccacgccactgccccaccctcccgattagaatgataatacagtttcagctacgaataaccattctataagatgctgaggatccacgtgccccattttcgtcttttccacaagggtctcccaacaatcctgtcgggaggtcaggcaggtattaacacccccgttttctagcagacggactgtggcttttctgacgctgagaaggagctgagctggaagcccttcagactcacggtacagcagagtctcccacggtggcctttccctgcgcatgtggggaaagccctgggctgaccttctgggtcccagtcccaccctaccactcgcagctgtgcgatttggaacaagttacttcgtgactttgagcctttgctgcctcacgtgtaaaatggggtgtaatgatgtgcattagagggctattctgagaagtaactaagaaaatgcaagacatgcccttggtctggagccagacacatagtttatactctggtaatgtgtcatcacagtgggcaggggtgacacgtgacctcagagtgcaggtggaatgtcagacgggggttcagagggggctgggattgggctgtgtctccatggggattcctctcgtttaaggagctaatataccatgcacttgaggggcatcaaaaaaatttcctgtggaatcacttctttctgacattccaaaaaaaagcagatatgaattccatctgctccaacactccccagttcacttagagctgcctagcatctctgcattcaccccaccctggtcccccagatctctagcatgtcacacttttcagaaggccttgggaaagtcagggagtgtctctgagcctcaacgtggagcaggaagtcctggaatttcctacgtcaggacagaactgttgaaagattcacacctgatgcgtgtaagagattttcctagtaactatccaaattggagatgttttactaacaagaatgataataataacgatactgttggctgctgctgctgctgttattagtttgaaacctagccaccaaacctgggcttcaagttctgggggccttggacaacagagcctaccctgacctacaggcctcttcaaaacagagctttgctgccacctcctggcggtgggaagacaggcttttcataatgcagatgccccagaggtcttaccccctcgagtcttgacaatagacattcagagtcaggaggtgtccttgggaaacaggatcatcccatccaggcccccggttttgcagatgataaaattcagattcgtgattgggattctggtgacccccacaggatgaagtgtcagagccaaacacccaactctcagggctcccagaccaggg

SEQ ID NO: 45437 - DNA, 1172 bp, Bovine  19866881025134
agacttttctctctaggaaagccataaagtctggaggcaaaatattattctatatattatgtaatatcaataggctgtttattagcctatgtttccagactttatggcctcctataattatgtaaagagtcaaaataaatgattacaagtatcaataaaatatgatcccaaataaattattcaaatgtatattaaacccacagaatgataagaatttggtgcaaaagctagatatagtagcaacctgaattatttagaggagtttcccaagagaatcaagattttttttaagctggatttaattgcaatgcatagccaaaaatataaccttcttggacagcataaagtaaagactaaatgatgatttcccatctgaataaaaagcacatcagtctaaatggccctgcaagagaattgacttaatcatatgtgcggaagtagttgcacaggtaatttggatccaccactgtcacactggctcaggaaggatgtggaatcacttctcactgccctggcccctttcactgtgttctcacaccacctgtaaatacttgtgtgcctcagaacttggcagtaatgaccaaaaaccaacgtctattttctacttattggaaactctatccagagtagtccaaaggctgtcttaaaattcccacagaactctattgagagcattattaaaatgttctctcttcctgaaattactcaacattttcctgataaagtgtgtaaaaaagcaaaatgatgcacctgtggttacaaagcagatgaaggctaggctagggaagcccctctcagactcaagtctccaaagacccttcctaaaggttttaaccgacttcagttaccagcaagcacaccagactgcgaaacaggtgcccagtgtctacactgctgtgtcatttgtgaactctcttctgttcttggaatctccgttacattattagtgaagtaaggaatagcggttagatagtccattacagcaataaaatcatgtgactgttacaaacagtatctccagatatctgctttcataaggcagcctctttgcactgaatcaactgaaatatcagtacaataatacaggaatggttgccaagcagggtatattaagcaaattttgtctcagtcccagataaacaatgctacataagagatgcaagaccatcaag

SEQ ID NO: 45438 - DNA, 904 bp, Bovine  19866881042931
ggtacagaggaggggcacaggggaacaggcaagcatcctaggggcaaagtgacatgttaatcactcagtcatgcccgactctttgcaaccccatggactgtagcccactcctctgtccatgggatgctccaggcaacaatactggagtggattgccattccctcctccaggggatcttccccacccagggattgagcctgggtctcctgcattgcaggcagattctttatcatgtgatccactggggaagcccaggaagccctatcctgtgggcagcggacctccaggtgactgcgcggtgcacatggtcaggagctgcgggcatcatcctcactgctggagagctcagctctccctcctctgacctcagggaattggggcccaagctctcctggcacccccgttcccacagaggccgtcagggacccagggcctcagagccagagggaggggcttcctcagcctcctgccccttcggccttcccttcaggaggagcaagccaacacacagctgtccaggtgccggagggtccagcatgaactggaggaggccgaggaacgcgccgacatcgctgaatcccaggtcaacaagctgcgggccaagagccgagatgtgggagcccaggtgagagcagactccccactccaaacaccctgagactcaggaccaggcagcagccgcagagctcagagagtgcttgtcagtgtccctccctggctgccggctgtgccttcactgaggtactgctttagccaggtccccgggggttccagctcacaggagcagtgaggggctgggagccagatgccctactatccctgcccctccctccctgttgcaaaaggcagtgcccaagaagcccctgattttggggggattcgccccatctaccaggggctcgac

SEQ ID NO: 45439 - DNA, 2233 bp, Bovine  19866881214538
attccgcaaactccgcacgagctggaggaggctgaggaacgggctgacattgccgagtcccaggtcaacaagctgcgggtaaagagccgggaggttcacacaaaagtcataagtgaagagtaattcattctaatgtgaaaaggtgaccaaagaaatgcacaaaatgtgaaattctttgtcactgtcaaatgtaattttaatatcaaggaaataaatcagtagagaattttgcaatctaaaaatacgtgtgtctcttaattacaagctcaacagtgctattagaactaagtcatttcgttcaacatttgttatgctcctactgtgtgcagtcagagacaatgacaaaaaatgaatgcggtcagtgaaccaactttaatagaaggcaaatgaaatgaagcaaaggtgtttaatggaccctcaattccattcaaccatttttactgagtaccaagaatgtgtctgtacagaaatgggcaccatggatatgactactgtgtccctgctcttgaacttcaagccagcaagtcatggcagttcagattctggtacagcatgcatactctgcgagaagcatgaaaacaaagtgtggtaacaacagagaatgagatgcgaacctagggaatccaggaaggcatctcagaggagacggagttagctcctaaaagatgagtagatagctatcatgtgaaagagaaaaggagatgagcattctaagaagagaaaacagcatgagatctcagaatagttgaagcagaggctccatgagcaaagagcatctgagaaggccagagatggaagctgagatctgactgtgaggggcacggccccacacgcaggcctgaggaattaggacaagcatctaactggtcacatttcatgtggaggagagttgatgtaattctggtagtagcgtggaggatgcagaagaataggaaagaacagagcctggaaagactgtggagctttttacatgagacagactgcagatgacagtgacagaaatgaagaagaatgcagcatgaaagcaaggctccaacactgctataaagaaaggcctgggagagcatgagaaaggtaggcagtttcacaccactcaaacctcacagttactttgtagttacagattttatttccttccgagggaaaagcttttcctcggaaccacctatctctccaagaagaaggacagaacttttaaggtaaatcttccttttgacccaatttctacatacactcctgcttaccaagaaacctaaattttctcagtaccatacatatttcaaacaagaactagaaaaaatttcttaatatcaaaaagaatgtgactgaaattttatcacagccattgccagagtactttttaaaaatacttcttaaagcttacaatttggtttcactctgtagacatttaaaaacaagctagtcgaatcccaatttactcttttacagggcatccctctctcaagaggaagctactgtgagaagtctcctttccccagtgtgggaatcctaattagcaataaggaacctgcttcatgagaagagaatttaaaagcagtagaacataattataaggaatattttacctaggtcatgatgaagactaatgaaatattctgcctggagtaggcgtttattatcaaattttaattaaattctgtagagtgaacctattgacctcaaaagcactgggcaattgctttattatcctgtctcctaactatttaaataattgcttatgtagagagttgagagtggatttcattatctaggggtcaattactctggggtccttgattaaataaggcagcaaggatttagctagttaatattcttcttcatcttcttcatagattaactgatttatagatttatatccttatgtcttacaataaaaccacacatgatcatatataaatacttataatgctctttgtattttctttaactgatatgagggatcattgagatttgggaactgtttctaaattattgataccagatacaagaatccaaacaggatgccagcaaggagaaagcagaaggcagtctccatgattaatgttaaatcaggaaaatgcaggcagtttaagtccaattccttcctgataagtgtcgcttggacttactaggatggaaagaatctaagactggaagaagactgtgaaatgttacaaagagcaaggggcattttctctaacttacagatgaatctatttaaaatgtatgcaag

SEQ ID NO: 45440 - DNA, 1499 bp, Bovine  19866881311041
attcttaccacccaagttacagaatctccttcactggagcaatctcacctctacaaggaggcaaagctgttaagtcattaggaaccaacgttagtaaccaccttaactcaatttttctccttacccttgttgaccaaggctccatttggttcttggctcagtttacttacgagaaaattatggttctattatctaaggctaaacacctgtaagtgtaaagcaccagaggaaaaaaggacaatagccaaccaataattacaagatttcagaacacaattgaacagcctcaaaacttcatttctctgtaataagtcttgttacccactatttgaggaggcaggaaagtgctttccctcaatatgcctccatactcttacaatttgaaatagttttaattatactagaatcctattaatgaccttgaacaaagttctatactttgcacacgggatgtttgccaatgacttaaaatttggtcgcacaaacctcaaatgccttctttgaataccattttaacctgttgagtacccaccattaccatgtaatttcacaacagacaccaaaaatgcatgcaacaaaacttttattaacattttgaacaggttcagctattactgaaactggtaatttctaaacttaaattggggtaaacggctagagtgcagaaggatgtcatcattgaacattatgaatagaagactgaagaattaacagccacccctcagacgaaggaccaggtgcagggtcgactctttctggatattgtaatcagaaagagtgcggccatcttccagctgcttgccggcaaagatgagcctctgctggtcagggggaatgccttccttatcctggatcttggccttcacgttctcgatggtgtcactgggctccacctccagggtgatggtcttgccggtcagggtcttcacgaagatctgcataccacccctcagacggaggaccaggtgcagggtcgactctttctggatgttgtaatcagaaagagtgcggccatcttccagctgcttgccggcaaagatgagcctctgctggtcggggggaatgccctccttatcctggatcttggccttcacgttctcgatggtgtcactgggctccacttccagggtgatggtcttgccggtcagggtcttcacgaaaatctgcataccacccctcagacggaggaccaggtccagggtcgactctttctggatgttgtaatcagaaagagtgcggccatcttccagctgcttgccggcaaagatgagcctctgctggtcagggggaatgccttccttatcctggatcttggccttcacgttctcgatggtgtcactgggctccacctccagggtgatggtcttgccggtcagggttttcacgaagatctgcattttgacctataaggttaaaaaggaaaaggttaaaaaggaaaaggttaaaaaggaaaaggttactgtatcattttcacaatcttttaccgctttcatagttca

SEQ ID NO: 45441 - DNA, 1117 bp, Bovine  19866881453445
ctggaaggtttattgaagaaagaatgaatggttaggaagatgtgaacatatatgaaagtcaaatgacaccaaaaagaaacatcagtaaaaagaaagaaagcaaaatagaaaacccaattgtccatattggtgaatccatttttccacgagctaatgcatacttccctcctatttgtaagaaatgccacctcctctagcctgtattctgttctaccaccacaagactatattatttgacttacttcataatacccactaaacagggtacatagaacacaatgaacagaggacaacagtaaaaatgattaaacaagcacagcatttagtgaaatacaacaaggagtgactggcctttgtttaaagtccccatagaggattctgctggggaagcccttcctgcagatgcggatgccctccagcaccccgttacacctcagctggtgcaggaccagctcatgctccatggcccctagaaagagatcacagtgcatactgctgggcagttcaactgtcgcacttgtgcctgtttgattatttcgtgctcttagatcttccgggagttttggtttcattgggaatgatacagcgtacgaagtgggggggtgtgtgctcctcagattggtcatcaatttatttaaattttcctagaaaaccagggagaagggacttgatgagaaagttctatttcaggttgctttttttggcaattatatgaaatgaacctaggcactctcttaactattaagtctatgaggcttcagttgctctgtgttttaagggtctcaagagttgtagcctgccaaataactgaaaggccagagtgctacggagaaatatagctctctgtggtattcatttatgacacctaggatctgtcctgtaaacaaactgccaattcaagtggcattgaggcacatgaagtgttcttgagcaagaatcagaaaataaaagactaccgtcttgctttgccactaacgagctgcttgaaatcccttttgtctctctgggtctcatctgaaaatggttgagatcacctctaaggtctctcttgcctctctcagtgctaataattctcacagtactagtctacagtggtgacctatgtcagtcactgtcc

SEQ ID NO: 45442 - DNA, 1283 bp, Bovine  19866881521852
tgagtgatggatattgaagcagaaaatttcctcccaggtccggatcttggaaacactagtgatggattcttttcagtctcctaaacatgaaggagaaagtttaggcagattctcagagtagacagtagtgacagaccagtgggggagtcatatagaatttagagtggatataaacacgtttgtccttttctggaggacatagctgtcttcagttcacatgttttcactgaagaaacaacaagatgccatgtgatactccatgtatgtttccactgaataatggaaggagacataatacacattcctagttaacaggcaaatcttcatgactatttgttgctcaaatgaggtgggtagtacacatttttattgaaggtgggaggaaagctatggtatccataagactgtctctctctgagttgagaacatgagtgggctgtcacatatgcccatagtacatgtaaattgggttttggtggttttgctatagacagctgctgctgaacatgacaggaaacctatctacttggtgtgactgagatctgatgtgatattgttggctatcatctgctagcttaaatgacccatcagtgtgattactgttttcaaatgtcctattaacttagaatttctttttcatacatttgcagattgaatcttttacaggttttatttctttgatacactaccgtggaagagttggtcagtctgttccccgcctcccctcccccagtctccatggaaatgattcacagaaatctagtgacttacccaaaatgttagtcttgaagccagaaagaagagccaacttttgatttttttctcaaatttaagattttcacaacttatttagttttactttttctggacctgaatatctaaatgatagacataaatgttatcaaacacgtgtactagttttggagctgaaagatgaaagaagaaactatggatgaggtcaagacatataggctgagttatacaggtagagctactggggattctctacctaatatcacagctttgcccagttgtagatagattgaccatgcagttcttaaaaagtctaaagcaaggagtaggtggaaggtgaggaagtagagtcggtttgtatatataacacttttgagaattcttgtaaagaaaagcagagaaatgactcaatagctggagaaaaaaatagggtcaaggggagagtttaagaaaggatatagtagagtgggagacattggaaataaaactgaaagaaaaggatagttcatcgtagaaatattcccaagtag

SEQ ID NO: 45443 - DNA, 1994 bp, Bovine  19866881525147
aacgaaagcctttccagaagttttgcatccattgttctttctcaaatgccttcatttctccacccttctcatttgcttgtcagatgcacagagaactccccaaattcgtcaacaaaaaaaactaattaagttgtaaaaactcttcagagatgatattttaaaatttctacagaaatgaatccttgtcctaatttaatcatgacagaggctccttattttagcgatggctcatggaagagtgtcatttgtttttgattcataatataaagtagaaatagaaataggaagttggaggccactcttctcatttagcaagtgttttactgataaatagctacaagcttttgttgtgtttgaagtgaaaaatgaaactgttgagttctgaataatcaaggacatacttcacagaaaatctgctaatctgatgatggtgtcggtcagtccctaagtcgtgtctgattctttgtgacctcatggactgcagcatgccagcttccctgtccctcgctatttcccggagtttgcccacgttcatatccattgagtcggtgatgctatccaaccacctcatcctttgctgccctcttctccttttgccttcaacctttcctagcatctctaccagctaatcttgtactcaatctagtattttcgtatttataaagaaggttttggatgcctggggcctcctgcttgctgtgggcacatggaatccacctgtgcaacataccatgtaggacattaagccagcacttataatattaatgtgcatgcatatcacagggggcttttgttcagatgcagatctggcttcagtgggcctggggtggggcctgagactctgcattgtctaacaagcttccaggtgctgctggcctctgagcctcaatttgagtaggaaagcatttgagtaccctaaggggtttttaagtttgcaagccatgattaaattctggaattagattggatttagtttacttttctttcttcatgggttatgtaagactacatagggtcatggaaagaacacaggttttggaattagacctcaatttgagtctgtttaatctgagaggtttgaaggtggtaaaaaggatggtgggcgggagggtggtatctggtgttcctatttgcccagaggggtctcttgatcgccatcatgggttggaggtggggcttgggaatgtttcaccctggctaggtaaggaagagaggtggctgagagctgaatggtaggcccagggtcttaactacagcatgcatgaacttgacagcatacagagagcccagggtggtcttgccggataccagtgtgttaggaaaaacatgtccccacatctcaaggcacttgatcccattccaagggggaatgctggatgtgttgtgtggtttggtttgtgggctggaatgtgagccctgtggctaccatcagtgtggacactctgctcaggggcagggacagaacctcctccaaatggctgaagagtgcagggtcagggtctggcagctctgggttcaaatcctgactcagaccctgctgcctgagagaccctgggccggttgcagaatctgcgtaagtttcctagggctcctgtgaggtagccaggcaccttgtacacactgttagtggagtctacaccccccatgttctggggatcatgccaagaccaatactgagagctaccgctttactggacttccatttatgggggtgcggctggggtgagaggaaactccctctttccctgggcccctctgagatcaagtacagggctccctggttgcagtcctgtggtcagggccttccgacccacaggcagaagtcaccagagcctcttactgaatgtagatttggattctgagggtctggggtgggacctgagagtctgcatttttaaaaaggtctgacaaggagatgctgcttgtctggggcccacactcttagaagcactgccggagagcacttctctggatttttcaggacccagatccta

SEQ ID NO: 45444 - DNA, 1383 bp, Bovine  19866881699602
aatctgtctgcttgggccagcggggcctggaacataccttggaacaggacacagagaggctcctgcagagaacacagcctccaaaaacagagtcctgggagccagatgcctgctggtcccaagccagggctctgaaggcgagggctggggctagacagagatagccccccttgagcacacaggctaaggatgaagcagggcccatctctcctttcacacaggtattcttcaaagctgggctcctgggcctcttggaggagatgagggacgagaagctggtgaccctgatgacacgcacgcaggctttatgccggggctacctgatgcgggtagagttcaagaagatgatggagagaaggtgatgcaagctctcgcctccctgccctcctcccgggagctgaccatcgcttcgtgctttaatcttaagatgttcactaatttgtcccacatttactgagccacggttctgttctggggcctctgcttgacactggggaagcagaaatgatccctggcctccaggagcccacagaggagtgggaagcagacacctgctcggctagttttgtggacggattgggggctggggttggcatgaaagggcagcaaaaaacaaagagctttccaaaggaggttttgcatggctggaggaagggtggcctgtgggttggggggagcaaaagcaggacacttgactgaagcgaggagaggctggcagtggaggtccccacctgccaccttgaagagcccaggttaaatcttcctcttgatggggagccatgaagatgagtgagaggatcggatttgtttcaatagctcagacaggtcacctgggggactttcctggcaagccagtggttaagactccatgcttccactgcaggaggcacaggtttgatccctgttccaggaagtaagatcccgcttgccacacggcgtggccataaaaaaaaagcacacatactcagagaggtcactggcagccgcaagaagagcaggcctgaaggcacaagaaggggaaggccaggctgtagcagaagtccaaatagaagatgacaggacctgaattagcaaacaggatggaaaggattgaatgaagcttggagggccttcgtccttcagtaattcaacaggaggaacagcagcactgtgggccagtcctgtgcggggattccctgcgaccccttccccctgattccctgtattcccctgtccttcactacctcccgaagtttgctcagactgacaaccttagggtgagcattttcagtagggtggtggaggtggaagccaggtggatggcacctctctcacctcctaaatttgcacatgctgtttcctctcctcttcatttccagaatagactctggagctcatgggatg

SEQ ID NO: 45445 - DNA, 1629 bp, Bovine  19866880389291
atccgggcagcctggggcaccagtctgtccaactggaagggggcagagcttcttgctgagcaggcgctcttaagccccagcagatctaggaattctattttatttcttttttttttttttttgcctttaaacatgcagattggaatatcagacctagaagttttccgagccgcacaatttatgctagttcattacctcctgctacactccacggctttgtaacggaaattggctctgatttctgagatgggcattacatcatggtcttcttttagcacattatgtcatccctgctgagaggcattatctagggttggctcagcagtagcgatttttgtgggccgactgcagtgttcccaaagagctgctgggaaccacagattgaaatctgaaacatttatcttctaaaacgctgaaaagaaggaaagatgttcacatcgtaccccatttattttccttaaccctctcctctctcagttcctttgagagtacagcacagcaaatgccagagatcaatgtgtggagcctacacagggaggatcatcttgaaatagctgctgctagaggtacctgaaatactccttccatacacctgacacttttggttctatctcaaggggtgctacaaccccccctgaaaggaatcaccttgtacacttacactgataacacagagcatcctgcctaattcctgggttatttaagaatttccatcccatgatctgtttataaatatgtgtaaatgaaaactatatacaagcacatacatatgcttatcctcctgaccacgttgcagccacaaaggcaaacctctagaagatttgtattagaaataatttttatgcagggaactgagctgatatgatctcttctcacatcaaccatgaaattagaagcgcattttgtatctctccatcgtaggcaggattagaaaccactgcacagagggaatagataggtgctttcaggataaagcaaagatcttcccaaaccccagagaatcccaatgcctccctcatcacaaaagcataattatgaaaagaaagaaaagtctctaaataccaaaaggaaatgggatacattcaaccatgactcaattacaatttccctcttatataccaactaatgagattcactgggggtggggggaagtaattgctgggagaggggctaggaggcaggttatgatagtcccttccccaacccagggtgcttcatttctcatccactgatttttttctatagtaaatatggttgtgccctcagttgctttttgtggctctcaaatggtaggcacagccaaacaagtaacttcataattaaagtagaagtggttaaacctatcgtttgcaccagctgaagagccttgcttctacttctaccctaaacgatttttcgtgttctttaataatgtcctcccctcacccccaggggatcataaaacaagatggcggccttcatccagggcacagccatgtgagccgtctgcgtgtgctgaaagggggtcgggacacccggccccacactcatgatacagaaacttactggcgacattagagcaaacaactgatagcccctcttcagcacctcttctttcacatttcacatccatttccatctgctccttat

SEQ ID NO: 45446 - DNA, 2771 bp, Bovine  19866880396426
agacagagatatatattattggattggatgttgggaggaagggaatggaagggcaaagaatgagttcaaagcttttgattcaaataactagacagatggtgataatcgtctattgagatgggtaagcctttggacatgctatatttgattgcccagaaaaattctgagtgtacagttggctatttaagtcaggaactcaggaaagagcgaggctgaagatataaattatggagttgtcagtataaagatatttatgggattggatgagatcatctagagatggagtgactatagaaaggagaagaatgctgagtctagggcaatgcatcttttataggtcagtagaggaaagggctagcacacgagactcaggagtaattggtgtgggaaatactgaagacatgggttactcaaattttttaaaaaatacacatttatttggctgtgctgggtctttagttgtggcatgtaggatctttgaccttccttgtggcatatgagatctttagttgcagcatgtgagatctagttccctgaccagggatcaaaacttggtccctgcattgggagtgtggagtcttggccactggaccaccatggaagaccctgggttacatgacgtttagctagtagtttcataaaatcacttctatgggaaaaatgggatatggaagaatgtgcactggagagaggtacaggtaggtgggttaggactgtgtgtaccaaagaagtgtcaagcaatggattagtgggaatttgaagatctgtaggaagatcccctggaggaaggcatgctaccccctccagtattcttgcctggagaatcccatggacagaggagcctggcaggttacagtccatggggtcacaaagaagcgacttagcatgcatgctcgtaggagagaactttagttcttgtccctgtctcatgaatctgcttaaaaaaaaaaccctcttgagtagaaagaatttgggtcagacttacagtaatatgaagatgaagagatggttatcacatcagattgattagtaggttttaaaagacatggtgaaccatagtagatgctctgtgtctattgtgctaaaccaagcatgggttgatgggggcctggcctagggtggtggttttgagagtgaaggattagaatctagacatatttgaaaggaaagtggtggcaggattttatgacttatataagtgactggttatatgtgatgagatcaaattgccaacatctgttggatcatagaaaaagcaagagaattccagaaaaatatctacttctgctttattgactatgctaaagcctttgtgtggatcacaacaaactgtggaaaattcttaaagagatgaaaatgccagatcatcttatctgcctcctgagaaacctgtatgcaggtcaaaaagcaaaagttagaaccggacatggaacaatggactggttccaaattgggaaaagagtgtgccaggctgtatattgtcaccttgcttatttcacttatatgcagagtacatcatgagaaatgctgggcttggatgacgcacaagctgggatcaagattgccaggaaaaatatcaataacctcagatatacagatgacaccaccattaatggcagaaagtgaagaggaactaaagagcctcttgatgaaagtgaaagaggagaatgaaaaaaatggcttaaaactcaacattcagaaaacaaagatcatggcattcggtcccattacttcatggcaaattgatggggaaacaatggaaacagtgactgactttactttcttgggcttcagaatcactgcagatggtgactataaccatgaagtgaaaagatacttgctccttggaagaacatctatgaccaacctagacggcatattaaaaagcagagacattattttgccaacagaggtccgtctagtcaaagctttgttttttccagtagtcatgtatagatgtgagagttggactataaagaaagctgaggaccgaagaattgatgcttttgaactgtggtgttggagaaaactcttaagaatccctgcaaggagatcaaatcagtcaatcctaaatgaaataaatcctgaatattcattggaaggactgatgctgaagctgaagctccaatactttggccacctgatgcaaagaactaactcagaaaagcccctgctgctgggaaagattgaaggcgggaggagaagaggacaacagaatgagatgtttggatggcatcaccaactcgatggacatgagcgtgagcaagttccaggagttggtgatggacagggaagcctggcatgcagcagtccatggggtcgcaaagctcgcacatgactgagtgactgaactgaactgaactgaaccttgtgacagcgaagtcttatacatagtcctggttagggttcagggtataatttccggtgtggtaggaagaaacatttatgggtttgctcttcagaagaaagcttatttcagttggatgtgctggctggtgctgcaagatagcaagagatctggtaaatctgaaaatgctgccagttagagagcaatcaggcacatgcaacttcgtgatagggactcagaagggaattacaaaggattaaatggaagaatctgcactagaaaatgttggtgatgcttatgatttcacaaaatgaatttgctttatacaccttaaagggtttctgaaaatggtcactgaagtgaggtgaaaggaaagatgatgttaagaggtttttctaacttgactttgatattcaaaggaagg

SEQ ID NO: 45447 - DNA, 1563 bp, Bovine  19866880478715
ttaggtgctaaagatttagctaactgggaattgaatggaggaaagagtcaagcagggaaatttgtgcatgaaatggatttttttgttcctctgaggatttgttgtaagcagatataaagtgtttttctccctcagagtacctccaagggctttcataaatcaattagtcactggcagggcaagatagaggagggggagaatgagccatgtggtgacagccagagaccctggctgctctctctctctcaggcatgctgtccttgatcattagataaccacagtgacacttcaccccctggagactgtttccattacagtcagaacatcagagcaaggggaaggctttcaggatctcactctgctccactaataaacaaacacccacaagaagagattgaggaagagggaggctggccatccttttgagacacaaacccaagaaaatgaaatgaaaagaaatcaatcttttatttgctcacttgggttccagaatacttatgtattctttcagcctttgactcttaatgtggaattcggatgtttctttcagttcaatagacaagaccagcaaagcaccaccaaggagtcttcattctaagaggataaggctcttgacacagtgcttctcagcttacaaagtaggtgcagcgtatctcctgccagcttctcagcaggcagagcctacagcatatgtcttagggacccatgagctacagagtgaggacggctctgaggaacacctaaaaatgtgtccagtggagctgtcagaacaattctccatcagtcactctgcaggaacaaatggagcatctgaaatgcacgtcattttaggcacatgttttgaacttggagttcctggcttgtggatgttaaggccacgggggaggtaggagtctggatgggagaacagggtgaccattgcaaagggttcaagagagtaaaggtgaattccataatttataagatctggagtctttcaggctactcaacaagcagagggattggaaagaaaaaaaatgcttcttatataagagctgagagctcttatctcattcttgggaacaagctggggggtaggtggcaactattttggtcttcagtttcacagttggcagagctgagatacggggaagagagttggtctgtctgcccactgagccagatgtgcatgccaagagtccctgtaaaatcctccatcagtgtcgttcccaacctctgccccgagtcctctggcagcctcctagagacagagaatgcacagcatcactgaggtcaccccacagacttggaggcagaagacctgagcttgaattctggctcttctacttactagctccgaggtcaggcaggtttctcaatccctctgcagcaaatctctcagtttgcttctctttaaaatgaggatgacaacaacacagggcactgggagaattaaaagtgcttgaacgcacttaagccccctgtctcatacaactcagcaaatgctaagtgggtctgaatttaaagaagtaaaacaagccccagatttccttctctgacttcttttgatctcacggatgagca

SEQ ID NO: 45448 - DNA, 1632 bp, Bovine  19866880509742
ccctgggaaagagtcaccaagatggtccatgcaacactccagactcctgtgagagaaacacataaatgcccaagtcccttttagttcccaaactacctcaacctctacatcaaaatgcatcattcaaatcagctagactcaactgcccaaaagcaactggattgcaaatcaatctcttgcaaatgctttggaaaatgtctatggaaaaagcccctcttggagttattctcagccatccccacaaggtgagtttcatggatgtcattcaacctacattttaagtcaggtcatgtaaatgtatttgccagttaggatgaaaatccatccatgtgttcctccattatgtactaaaagcaaaggcaaacttctatatatgtgagaaagaacaataggtaaatcattaccatagaaatttatcagatcaaattttaggaaaataaaaatggtggggatgatagggaaggttaggcaaaagcataattgagatgaggctttttagaaggaacaaatttcagtgcatgggggagggggaaggtaatcctcaggtcaaattcttaagcgaaaaaataccattgatcaacccagtctagggactgattcttccgggatcagatacctactcctagtctacacactcagctgtgacctgaagagggctgagtcacacaatccactgtctacactgctccaggagggggcgagctgatttatgagaaggggagttgggtgggagggactcatacagcagaacctgtctttagaaacctaaaagacaaattgtagccctgcgacagttatacaatgatgtctactggggaagaaactcctctccccaattcatctatgctcagataaatgctgtatccactactctgatcctgtgcgactcgtgtgagtcaagatgaaaacagagtgtaaataaatggcttcaccctggcttccgtattaccattaatattattaaagataaacagatttggaagaaaggaagcttcctgggggctatgaatgaagatggttccatacctgtcaccaaaatgctacggccacattcagaatgtgaggtttgcatcaagactaataccttccttcaaacgacagcaagagtgtcctattaccaacagaacaaaaacaacatccccatgagagcagtgaaactcttggccaggaataccaagcccacagcaggtcttcgaggactcagcttgagaagctgagggcaaggccttgggctgggtgcattttgatcggaaggatggagaagcctctggaagcaggcttcccagagatggtccagttaggatctgacttcacagatcaggaaactggagccccatggggtttagagtccagggtgtcttcacagaaaatgtgggatttccttccggtccgaggcttttcaaacattgacagcaggctctgagtttgaggtgggaggaccagagagaagaagacacttaactataaaagccacatctttctgaggttagactttcaaactgaaggtatttccttttgcgactcatcgaaagtgtgcagtcggcatctttaaatacaatgattgaagggcaaatgctccttgacttgacagcctgtttataattacagcattagtacagacacagtttaatt

SEQ ID NO: 45449 - DNA, 801 bp, Bovine  19866880589462
atttggctgtatgcactgttccctcaacatctaagaaatcacctgacttattattgcctgggcacttcagaatgtcagcatgaagcacgccaagcaaaatttaagggatattaagtaaacacctgatattcctagtgctgaaggggaagagaagtactttgttcctattttaaagctacttcagagggagaaaatagtgatagggcctggaaactcaagtgttatgagcaaaacctataaatatgatgtgaaggacggggtcccacccactcttcccccatggaagtgaagagcgtgactttggcagcaattaaaagctaagggcttgccaatgatgagttcttccaccaaaaagataaattagagattttgtggggtttgtttggttttgacttcacccattccccagtgaccacaattaaaagtgggccaaacatcatgttcctcatttatacaaacgaaggtggaaaattatggtatgacccgtgtatagactgacctttttaacaggtatgatatttgaaaaactaggggtggagacagagcttcctatttgatgactccccttctccctgccacgccccatgattactaaactctcagactgtgtggagacacttccattagggagtagtttaaagaatcttgaagttggagccaggcatttccatctttggacttcaattttgtcatctgtaaaatgaaaatgttgcacttgcagtatgccaagaggtcttaggatttagatattttatgctttcaggtgctgctaagggaactcaaccaaggccatccccctaa

SEQ ID NO: 45450 - DNA, 1312 bp, Bovine  19866880634640
ttgaagaattggtgcttttgaactgtggtgttggagaagactcttgagagtcccttggactgcaaggaggtcaaatcagtcaatcctaaatattcattggaaggactgatgttgaagctgaagctctaatactttggccacctgatgcgaagacctggctcattggaaaagactgatgctgggaaagattgaaggcagaagaagaaggggacgacagagaatgagatagttggatggcatcactgacccaatggacatgagtttgagcaagctcgggaatttggtgatggacagggaagcctggtgtgctgcagtccatggggttgcaaagaaccagacacaactgagcaactaaactgaactgatggtctattcatgttcaggactggtacaagagcaagacttacacttctgctgcatgcatcatgataaggtctatttacagcagtggccaggttgctctagtataagcgttgaaatgatttactgaaatggaaagatactcagtgtacgtacgagggtagaataagtcaaaacactgttatagtgtgatatcactttttaaaagattgtgtttaaaaatgtatatacaaacatgtaagaaacttctagacatatatatatatagcaatgtttcagtgtctgtctctgggtggtggtggtatagcatggcttatctacatttcctaatatgaaatatgactgtataatcaagaaatcaaagctatgtttaacattaaaaaggaaaatacgtcttaagatgtaaatacagggctttcctgctggctcagtggtaaggaatctgcctgcaatgcaagagacatgggtttgatccttggtccaggaagatcccacgtgccacagagcaactaagcccgtgtgccacaactactgagcctgtgttctataactgggagccacaaccactgagcccgcacaccctagagcctgtgctccacagcaagagaagccatctcaatgagaagcctgcaggcaaccagagacaagcccgaatagcaacaaagacccagcacagccaaaaataaataattattttttttaagtaaatacaagggcttagcctcccaaagtggataaagctctcctgagggaaattagggaaggcttctcaaaataagtatctattaatgacctctctaacacagaaaatctataaattcactacagcctgagaaataccatagttcaattataccgcacacctagttcccagacttcacacattgaggcttgtcagtgaaatccgtttcccataaaggatggaagaaataaattatttgcctttacaaag

SEQ ID NO: 45451 - DNA, 1520 bp, Bovine  19866880862349
gtaggatctgtttccactcttctagattctgggttgccctgcgacttctttgaccactgagatatagcagaattggtgccataccaagtctgagtccagtctttaagagactcactgactcctccttttcctttcagagtcctaagcaaggcactgtgtaaaaattcaattgccttcctaaggagagcaggtggagatgctaaaacggcatggagagggaaaaagggccaaagccattcctgtcaagacatcaaacatgtggagaaaataatctaaaccctcagcctataccagccaccaactgaagagcaccaagtaacctctgtcaatgccaggtggagcagaagagccatccagccaagcactgcccaaatttctgacccacaaaattatgagatgtaattaaatgcagcaacacataaccagactaccacactagcagctattaaacactgacctcttcaaatagttcatactcaaaattcagtctttcctaaattaccttagaataatgatagaattatctcatgccaggcagccaccactactgggagaaggggccaggttccagttgagagaatagcaggatctcctcccctagcatctcttcctacgattgctagagatgaacctacatggccaaggtgaagggccatcatctgtcactgaggactccagagatcacaggccacagagcctgaagtttgccagctcacacaggatccccatccctgagggtatcctttgaccaaccctatccatggcactgctcgaccaaacccatgtccgccacgtcatggtggtcacatgtggttactcttggaggtgggatgagaaccagttctcttactgcagcccttgcccttccaggctgagctgagaggaaaagccaagtcttggaaggagagattcctggattaacttccccaaaccacgactggcagctgccacccactccaatccatgcgcctgtcctcacccacccacagggttgccaaggcctgaaggaggtggctctgtcagaaaccataattagggattccatcatatactttagctccctgagaacaaattcttccctacagcatgcaaatctattgttcaaatttcaaacacccaaatgaccttcaaccacattgttgagaattcattaggtggacaagtaaagataccacctcttctgaattacagacatggtctcaaaatgcagaaaagggcatttctaaggttgaagcaagaatgagagactttaaaacaacatgatgaaggaatacaatgagactgacaaatataacttagcagggtccaggttgtacagagagcatgcacagagatgctatgagagcggagaaaggggaggtgaaaagagggtcttctcccctcctggttcctggcttcaaaggaatgaagttccattcaatgtcactgaacaccttcccactgtctgtagagacaaatataaatagtgagctgaccatctaataatctattattcagaaagtcggatattactagggaag

SEQ ID NO: 45452 - DNA, 5279 bp, Bovine  19866880975122
atctagacgctacgtcacagtgtttactatgaagatccctaaacattggccacaaaagtagagaattttcagatttagaaaatataatttaagtaatgacaacttttaaaagaataacaaaaattcttaggtgtctgagaataaatctaacaaatatttatgacatcttaagaaaaaatgataactttattgaaagacattaaagtagacttgaatagatatatcatgtttatgaatggcaagattcagtattctaaagatgttaatgctcaaattaatataaaattcaaaatcccaatagcttttaaaaacttgataaaattattctaaaattgattattgttctaaaatatgaaaagaacaaagggtcaacgatagcaaaaaacaagtttcaaagtcagaatgaggcaggaggactttccctctggaggtgcatgcatgctcagttgctcagtcatgtcgactctttgcaaccctatggaccatagcccaccaggctcctctgtctatgggttttttcaggcaagaatcctagagtgggttgccattttctcctccaggagctcttcccgacttggatcaaacccacatctcttgcatctcctgcattggcaggcagattctttaccactgagctacctgggaagcactggataatcagatttattaaaaattaaaatagtcaaaataggaggttagcacaacataatagggattttacctttgtttgaataaatacttaatgcaagatggtagtagctttgtaaattcgtgggggaacaggttttttttttttttaatggtgctgaagcaactgattatttctatagtgaaaaatagcattataactattttattccatatataaaatttgattccaagcagactgaatgtgaataaattgtaaaactttaataaaagttttactagaaaacatacagaaaaatctttatgatttgaggtagtaaaagatttcttaaccaaggcatgaaaaccatgtcatgaaggaaaatactgataactttgatgcttttaaaagtttacacagaaaatacagcttaaatgacgattcatgacatgaggaaagatatttgcaatacatgtaactgatggaggaataatatctggaaaacttaaagaactcccccaaacaaaaaggaaaaggcacatcaacatgtaaataggcaaaagataagaacaagcagttcagagaagatgaacgatgaatgggcaatatgcttttgaaaagctgttcactttcctcagcaacctgggtaaagttcattgaaaccatagtgaagtatttttcacatccaccaggtttgcaaagattgagaaatgtaccaggtccacgtgtcagtgaggaactggggaaagaagacattcatactcttctagtgaggtgtagagaaggcgtgtacattgcaacagccactttggaaagtgatttagaatatcagataaaatttagaatgggcttaattttcactccagcaatcctctactacgctaggaaatttttttcacgtgtgaataagaatgctcaatttagtaccatttgtaatggatggaaatttgagatagctttaatttccattcactggtgaatggaaaagttgaagtatcttcaatacaaagacatattgtagaagttaaagtaatctagaatcacatgtctcaatgtggaaggaccttaaaagtaaaatattgaaccaaaaaacccaaattccaaactgagttacagaatatttaaagtataatggtctatgtggtttttgaatttatacacattacatgcatgcagttcatatatgtaattgcacatattgcacatgtcacatatatgtgatgatacatattacacaatgtagtacatgtattatacctttattacatatattttataatattttattaaatattataaaacatgaatgggagtgaaaaacaccaaataaagatgctcattccttctgtagaaaggagtatgagaaggagaagattgggattgaggagagggctttcatcctatctgcagtaattttttccccttaaagaccctaaagcactcaaattataaggcaaaattttagactttgacaaagctgagtggtgggtacatgaatgtctgtgatttcattttctactttttggtatgtttgaactacttcagaatttaaggaaaaaattaagtttaaataaatgaattatctaagggaaatatattattgtgatctgattaaaattaaagttataaatcctagtttttgaccagtgaaacccaactttcatagatcatggagtttagtctgataaactctatctctgactctacagggactctgaaagaggatagctagattaacccaaatagatcaagcgtcctgagggtaatcagaaaggatttctttagctgtcttctctggggactttgaggatgggctggggagaagaatgttggctcagggaaagcctcagagatcaggaacttctaagaagattcagcaactcctatagaactttgtccaaggcatctctgtttctgctgtcaggatcaagtttcctggccttcacgtgacctcccacccctgcattcctgcatctctgtgggcctattaacagattgctgtgggtgtcctggccacagccatgacgctgtgacgttgccgaccttcctgttagaggaggatggaggctacacaactgataacatcccctgtctgtgcagtggaaatggagagattgtgctgtgcggggaggattggcaatcacagccatggggagggaaatcttggcaagtcagggttggaagggattttagagatcactgacttattatcttgtatgtttgtgttcacatgttttgttgcaacataatatgtaaagcaggtgactacagagctgctctggttagagacaatgtgtgtgtgttttcagtctttcagttgtgtccaactctttgcaaccctatggactgtagcccgcctggttcctctgtccaggggatttcccaggcgagaatattggagtaggttgccatttcctcctccaaggcatcttcctgacccagaaattgaatctgaatcccttgcattggcaggtggatttactgctctttactgctgagccacttggaggggactccaaagaccccattaaggcgactccattaagctcctgtttccccccttcatccttctcctctcactcacacctgtgctagtccctgaccaagctctaggaagcacatggtgtaaaacactggttcatgcccaagcccttcatttaacggatggggatcttgacgtctggtgggatttgctcaaggttaccctcagctggtggggatagatccccttggctcctgctaggatgctgtctccttcacccttcaagcagttttcttgtaatttagccactatattcaggctatattgatttgttttaaattccatttaataatacatttaaaaataatcataaataaaataaataataaaataataaattccatttatttaaaaattcattctctctattctagattaaaaaaagacaattttgagtgtttctattacaatccatgatattagcatcctgctatgttacaactttttatttcactgacctccttgtgaaggaatccaagttaatttctaagtgttatgatgatggaagaggaaagagggatctagactaattccatatgaggagataggagatcagtgttaagtagaagaggaatatctcactctgcctgttctcccaaacagttttctcataaacctcactcttttagataaaaatttggttcatgaagctgcactttttaaatacccatatcttccctccaggtaaactccactgatcacctgtaccacaaactgaatattaatgatgtttctagagcactttctacatgctggcactgtgctcagtgctccttatataatccccatcacagcggtatgatggagaaggaaatggcaacctgctccagtattcttgcctggagaaccccttggacagaggagcctggcgggctacagtccatcaggctacagtctacggggttgcaagagtcggacatgacttagcgactaaaccaccaccaccaccaccgcagtgatatgaaataaatacaactattatcttcatttacagaagataaatagaagtttatagagattaagtatttcactcaaaagcacacagctaataactagcagaaccaagatttgagttcatgctcttaggggctgtgctctcctgcaatggatagtcagcttcataaccaatacttagagaatgggtatttcactgttggaagaggggataaatgctctaaatgctctcaattctgatttcctgttgcctttgtagactttagattctttaaatcagcttgatagtgagaaaaaactgttagggacatttaagtaatataaaagttaattaccaatcatctatttcaaagagaggtgagctgggtatttgaaataatacttaaaaaaaaatctctttttgcaaatggtgtcagtcttcacatcattctgattcatttgcaagaaacagatgaccaaactcaaacgggcttaaacaacaaggctgtttattaggtcttatgctgtgctgtacttaattgctcagtcgtgtctgattctttgcgacctcatggactgtagcctgccaggctcctctgtctgtggggattctccaggcaagaatactggagtgggtttccatgcccttctccagggaatcttcccaacccagggattgaacccaggtctgcactgctggcggattctttaccatctgagccaccagggaatgggttttatgtttgattggttcagtgactcaaaaaaatgtcatcaaaggggcaggttctttccatctctttattctgttttgaagatttgtcttcactcatgagttggttttccttgtgttcacaaaatggttgacagcagcatttgagggtagaatcccccttcttcacatatagtgaagaagagaaaaccagcttcctgttgctctgtcaagaacaaagaactttcccagaaacctcctttccttctcgctggccagaatcaagtgtcacaggaccatttcttagcctatctctggaaaatgggttgagattactcataggcagttaggtctgtctctttaaatgaggtcattccctcagacatcattgctttttctccgtaagaagaaagtgggatgtatgttacagaggcaaccacgatctccagtgtagaatttgcttg

SEQ ID NO: 45453 - DNA, 1423 bp, Bovine  19866880995270
tatttcaaatcaggattcagaccactggtttgccacactggctacccactagaaaagacaagactgggaggtacctttttaaaaatactgatgcccagctcctcccacctctccacctccaagaaactgatttaatcagacctggtgtggccaatttttttcaagctccccaagtaactctaacatacagccagagttgaaaaccactgctcttgatgtttgatttttatgcctgaggataaagatatatttgctcctaggggcaaaatggaattcagaaacccacttgcccagcctctgtcaatcagcgctgtgtatagcagaggaatgagttgttagttttagttgtcaaagaattttcttcatggaaaagaagtacattaaaataccaaatcacagtatttacatattgcatgttttttttccaactgtgttcccatagcaactaaatccatttgctccctactttctcctgagttattttccatcatgagccatgctttattagtgaggcaaacagtttgccctctgaaatgactgttttgctgtttactatttctttgccaaggaacccaactctagttagcatcttcttccctcttgtgctacccacatttgataagctggctgctggtttgggcagatagtgtccctgccactttcctcaatctggagccacccttgagatctttctgatgagctactcaagaatacacaagtggagagggaagcttccctcaggaaacctgagactggaaaacgatgcgagaaaggggatccattgaatcccaaatagtgactcagtcacttaaattgacagtgggcagagggtcacccagctcccgcagacttcactaggcttggtcaggcagggtcactggtggaaaggagtcatggctttgaagctggatgcccactagctagggagaaagtgagtcctgctcctgtatgaaagcattactcagtcccctgagaggaggccccagcgaggtgcaggacactgagatttctttgtgatttcacccaggccacttggcagaccgcacggcctgtttgtttgcatgtttgaaactatgacatttcacttgctaatggggttctgcttttcaaggggacagagatgccaaagaagacggcaggagggaggcaccaggcgcggtgcctcagctcagctcctctcactgacgtctgatgccaggatggacctgggccgccagcaccagaggagagacgatgggcaccattgactgggtgatgctttgaaatctcttctcacttgctgcctcctcctgtgccagcagcataatgaagaagaattgtttcctcctctctctcaggctcctattaaaagccagagctgtggtggagctgccctccagggacaaggaggcaggtacccaggcagtctcagaggcagcgacag

SEQ ID NO: 45454 - DNA, 1233 bp, Bovine  19866881016041
tgtgtcttgtgatggcagaaatctgagcctgaatgtgagtgtgagtccgtgtgtagcttgggctgtcctttgttcacggggcggtaatgaagaatctagttcttttgtttccttttaggctttgctgcaatgtcatgtttcttctcttcctccttttcctcctcctccttctaaaccctaataccattttttggaggctcaagtaatacaggtcccccatccacatctttgcaccccatagttattttgctcctcagactaattaccacgaaatgcgggtggtcatccttccagtttcctgtgaagatgttccttgagaccatgtcacactctgtttctcacccaactatcacctgctggttttaatctcatcgatgattcccgcctaaaacagttattactgcagtggttgccagttagtgatgtaaactcttatgtagacctcgaaatgacctcgagaaatgcactctattattaacattgtgagaataaacaaagtaaggggaattaatgaccatgaagagctagttgttatcatctaacttctgaatcctgactcaatatacaaaaaaatccctaaaatcaaacaacccaatctactggaattagattaatccaccattgcaatgggctaacgctggaaatattcaaattaagattaaaagttgtagaaggggtactaaagtctctttttacatcttcaagaatatgactatgagaatttaaagatgtgtgtctattattctgtaccttaaaaaaaaagcacagtgtaattcagcataacactgttccaacaacttgtacttcatccgaaagaatttatttgctgaagttgttaaaaaaaaacaaaacttatcttcagaggtgttcagcagcagaaaggcccgtcggtatcttctggacccaagatccaaattcaaaaaagcttaagttgatattttattctaataggacctgcgggggtcaacttctcttgaaaaggaaggttatagtttcagcgtgcatcaagagacatgttcctacttctaattcttatgttttaaaaacatgtatattgggggagagaatgcttcatgtccttatcaagtagggcataacaaaattggaaattggttcgtgatttattgcacctccagcgacacactgaagtgcgtagtaaaattaacttcgggcctatacagtagctgcttgcacagcagactgaagaaagaccctggagcaggagaggtctca

SEQ ID NO: 45455 - DNA, 1738 bp, Bovine  19866881090332
ctctgtccactccatcaccctgagagaatttctttagaatacccttcggcttacttgcttcttgtccccatgttcctccctcatcaatggcagggtacttttttcttataattttgagagagaaacattaagacttagacacagttgcacctatcaaattcttattaaattaggtggccctaaagcattattgccccctgaactgaccaatttacataaaagaatctatatagacttggggaatatgaaacgcgagttaacgcatcttaaatctgacgaccggcacactatttccaaggcgtttgtttatgaccatgcctttcacacatcttctgtggtactacaggactttcagagttggggggagagcatttttaaaagattctgctctcctcgttatcggctgattttatttaccattttagacttttcatctctaaaatcagctgctgaaatggatataatcaatgaataacaaaaaagccatttatgctaaaatttttctgaaactgtttggtggactctagtaaaatgtctatgacagatcatgaacaatagattaatgctattcaacaaagaatggtccacagactaaacaggtcctcaatatacatgtatactcacttagttgtacccaatgctatcgaagtgaaagaagcatttgtatataactgacaaaaaaatttgacataaaacataatggcaaaaaactaatattcaaaatgaagaaacaaaaacactcaaaacacgcatttctatttaccttagtggtccacaaagcgtgaggccaaaaaaccacaagagtgaaatgacacacccagccatcgcgtgtttaaatattttgatccactacaaatggaaacaaataattagaaatttcagtcatgtttcgccagatatctcaacatcttaaacaaaacacataggggaagataatggtaacacaaatattttaaaggccaaataattacatattttgaaatgaagcagaaattattaagatgtcttgactaaatctagatttgcaagatattactctgttttgcattttctatattcttctctggtgctagatcctgaaatctttttctatatagtacaattttctccattttttacattagttctcaccagtttgccaggaacataaaatgttttagtcttcaaattcttctccagcaggaatagtcaattctccaattatttgaaaagagggcagggcagggcggggggtggggagtttaagatgggggtttaaaaaatttaacctgttttaaaaaatgttcttggtcctctaaaacagaggtacttaaatttctttctaataaaaaaccacagcacaggtttctaagttgtggcataaagcaaacatgtagtagggtataagtgctgtccaaagaggtggtaatgtgagatgattatgcagaatgtaggacatttctgggtatgcatcctgaacctcagatgcttaaagaaagtaatagttatgacaagggagacggctagtatgcactgcacactcactgcttgggttttcccaggtggcaccagtggtaaagaacccgcctgccaatgtaggagatgtaagaaatgcaggcttgataaaagagtttggaagatgccctggaggagggcatggcaacccactccagtattcttccctggagaatccccatggacagaggagcctggcaggctacagtccactgggttgcagagagtctgaagcgactcagca

SEQ ID NO: 45456 - DNA, 1513 bp, Bovine  19866881127254
tgcttttagattttcaccattgagaataatgtttaccatgggctttttatatatggcctttactatgttgaggtaggttcctctattcccattttttgaagcatttttataataaatggatgctgaattttgtcaaaggctttttctgcatttattgaagaacatcttcatcatttaagaaatatttcatagacatgaaattgtgttctagatactttaacttcattgacattttgagcttctcagagtgacaatttactgagaaatgagattatgtcctttcaggtttcttaacaccaaccacaaggtcaaatagctaaattaaaaaaaatactattctctttaacttttctatagtatttgactatgttgagaaattttctttctagatattctctatttttgtcttctctactgacactgccagaactggactcttatcttctgtcttctgaggtaccatctgaaattttctctccccatctctgccatttcatccttcccattgccattaaaatgatctttgattaattcatatccctgcttagaaaacagtgatacttcccagttacctataggaaaaattacaaaaatccttggccatgtatctaactccagtctcagcagatgcgggataatcagtctgccctctctccattgggcccagtcttccttgtcctccttctctgcagccacttaagacatgtggctctccaagtgcttcctatgaccaacctaggtcttggaaggagaccatagctgtggagacctgaacatcgttgcaatggagaagagaggaaaggttgaaaaccaagaggcttgtctgaacagtcatgatctcagctgtctgggcaaagtggtttaccactctgaaaataacactgctgcatgtgtacagagacctcagtggagaaattccatggcttgagagcatagtggagtgtattggtgtcttgagcacgttggtactgttgttttgggatgggagaggggtagctgtgggctatgggaaggcaaaaggatgcaagtgcaagggaagtgacaaatgcttccatttgtctgaacttaccctgaaccactctaatcacaagaatcaggtttcctggagaacaggctcatgggttaaagagaggcttttgtgaggctatttttggccattattgtggatgctgttacccatagtgtgcttctgtatatatcataaccatggtgaccatatgtttttcaggttagcacatgtcagggtggtaaattttaattttccttgggaaaatatggtcaccatagctatgaactgaaaagaagaatgattcttagacaaccagtgcataatatgcctagtcagtaaagagctatgaaaaatttaatatattgaataaaaacagtacaaagcatggagagtccaaacgaataagaatctgatttctaccaccatgttatcgtcttctgatctgttttgtaaattttgtcttctttttaataaccttgaagtgggggccaattctagtgtcaa

SEQ ID NO: 45457 - DNA, 1827 bp, Bovine  19866881188501
tgggaggaggtatgttcaactttcttaagggaaaaaccctttcaaacatttatataagcactcatttacatataatcgctttcctcatcctactttgaactcaggtatgtccttgaagggaataagtatcattgctttaaaaactctcaaattttgacttatctagtactccctaagacattagtccgagttcacaagttttaccacgtatgtcatttcatgcactttatgcctgatttgcttatgtaagaacatcagccacttaaactgagagaagagttttttatctcttcttgccaggttctgaacataatgacatatatttagattagtctaataagtattagaatagtaggaatttagagctggaatagaatttagatatcatctcatctacttcctttctcatatggaggaaaagagatctaaagaggtgagttatttgattaagttcatatacttaacatatagaaaacagtatggagcttcctcaaaaaattaaaaagagaaatacctatcttagaaattaaaaatagtacaacatggtgattattacaacatggttaatggtactgtactgtgaacttgaaatttgctagaaaagtaattcttaactgttctagccacacacacacacacacacagtaaccatgtgagatgatagatgtattgattaacttgataatggcagtccttcacttgatatacaagctacatgtatatcaaatcataacactgtatactttaagtatatacattttatttgtcaactatacctcaatataaagcttgagaaaataaccaaaaaggcaaaactacctgcaaagaaatactaaatgtatctctatctagaatggagaacaatccagtcctgtttactgtatttcaactcaatcactctgtatttcctttcttaatttctagttgcttctttaaataaccacttactgttgttttatcatttttatgtgtttttgttgaacaattttgtattcatccactttaaaaagtggaggttatgctgcattatctttctctttttttgaagagctcaatgtttctaacttaaagtctttgcgaagctgtctgtgaaattaattttccagaatgaatacatgattgttatttgtgttaattttctttcttagcagccaattattgttttggaattttgctttaccagcaattttagaagagacatttttgtttttcatttttctttctcccatttttctccatctgcctctgtgtccagcattttggcagtcccctccactgccaaccattcttcacatccctcatccataatcaggctttaaattgctccttggggctccttccacatgtgatggtggagtaccaagagccagtcaaatggtcagttagcagtatggctcagttcttattggtaaggcagtgggatttaaaactacagctcatgcatttgccctcaataaggtgaaaactgattcttgaagggtgaaaaatcttagatagtatagtggcccttcaaaactcaactcttattccttagcatttaatttttctctttagggaaaatttaaattcaaattttacttgggacttccctggcagtccagccattaagactccgtgcttccattgcaggggcacaggtttgatccttggttggggaacttagatcccacatgctgcaaggtgctgcccccaccaaaaaaaaaaaacaaaagacaaaaaattttttttcattggggggataataatgaaaaataagttgacaaacatgattacagctctagacagaagtcagctacattttgttgaggctcttagtagcctattccc

SEQ ID NO: 45458 - DNA, 772 bp, Bovine  19866881196316
tgatctgagcttattgagagctgactttttgtcttataccacttcatttattcatgtcatcgccaactttcttacatatccctaggactttttttccccaacttctcctaagttattcttgacatattgttctacttccagtggagtagccctaggaaaaatgtaactgtcaaatgtgtaacaagacacgctttttcttggtatatatcttttttgttctgttgggcgatgctaatagatccctggagtctacagcaggctgaggcaggaggtgtgctgaatgacctctccagacctttctcagctttgccatgctaaggaaagggtttcaatacagtcttgtcccaacccttcactacagaacatctatgtaatcgttcaatgcttttccctttccttcatggttcaatagaggctgagtttgttggtcttcagctgaataaccgactaatttggtctggaatgtcatataacttatcattgacagtaatttgctttctgggatgcattaaaatctgtggcgggtgggtgcattacttataataacatttaccacacagagtgaccctatgtaaacgaggcgggcataaagctgaactaggcaagctggatctgatcctggttcactagaatcactgtagctttgcagcctagggaaacatgaccaaggactcccatcttctcccaggtgcttcttggcagggcagggtttagctgtatttatgggggtagattaggaaaacaaacccatcagttggcaataagtgtggag

SEQ ID NO: 45459 - DNA, 1997 bp, Bovine  19866881220063
tgcatgaaagtgaaaagtggaagtgaagtcgctcagtcgtgtccaactcttagcgaccccatggactgcagcctaccaggctcctccatccatgggattttccaggcaagagtcctggagtggggtgccattgccttctccatatcatttatacacagtatctaaaatatgatacaaatgaacttatctacagaacagaaataggctcacagacatagagaacagactcatggttgctggggtgggggttagggggtggactgggagtttggggatggcaagatgcaaactattatatgtaggatggatacacaacaaggtcctactgtacagcagggggaactatattcaacatcctatgataaaccataatggaaaagaatatggaaaagaacacctttatgtataactgaatcactgcgctgtacaccagaaattaacacaacattgtaaaccaactatacttaaataaaaatacaaatgtttaaagggggaaatcccgtaagtggtccagtggttaggactccaagctttcactgccaagggcctaggtttgatccctggtcagggaactaagagcccacaagtcatgcagtacagccaaaaagaaagggaaaaaaaattcttgcttcaagctggagaatggattgcagataagcaaggattaagccaaggaaataagacagaacattcttgaggattagagatgatgctggtttgggcaagagcgttgaatacagagatgaagttgacacattctttgtgtattttgtagggagaaccacaggatttcataatgagttagatgtgaggaataacaagaaaaggaagcattagggattgttcctatgtttctaatctaaacaaagggtcaatggtattccatttgctgggttgaaaaacagtggagaggacattcagtgaatgtacgactcaccgaaacacctgaccaaatcctcaatgttttaaaaaaaaaaaacagtcatgcagataggctggacgtggactcaaccaactcaaagtctcatgttttctcccaattgaccactactttcattcttcagcatactcagagtattcttgtggttctggggcagtaggaattaaactctatgtataaaatgttctgacacaggcaggatccgtagttagactgggataaaggtttgcatgggaagacacatggagcagtgcagaatagtttggggagttggtagctaatagctgtaaggaacaacagtgataaaaaataaagtcatttgaaggtgagagactgagctctgaaaagtcacaggaatttaggactgtggcaattcaaagccccgtgtttccattttggcacagcaaaataatcctcgggtcacctactctcacgcctctctccccctcacctctctctattcactgccaccatcagaacacttgctagaattagaataaaatgcttcttgggttttatgaaccaatagttcaacgataaaatgatgccaagagcaaaaatgcagattattatctctttataaacacgaatactattagtcatcagcctgggagtcacctagaagaacaaactcaaaaaccactgctctgtgctgtaatccctttgacaaataaataaaccaacaagaatttaaaagtccaaagagacagaaagggaggccatgcctgtgccgtgcctttcttaagcaatcagaactcttagaatagctctgttgctggggcagaatcttttactctccccaagcattaaatctcccaatgtctttagcactctccatgggcatactggtgccaaagcagaaaaagatttaatttcatgttgctaggttttcactgttctgcggttattaaagaggcaggtgcagtcagccaggctgttaaaaaaagagaggcggggtgggggggtggcgggagttaagattgtttatttgaccaacttcaaatcttgctaaaccacagtataagacaactcataactgttctcagctcccgtatct

SEQ ID NO: 45460 - DNA, 1808 bp, Bovine  19866881344132
gtaggagagagagaaatgatgatgatgatatgatgatgggagagaggagacggaatgtttactttctcgtttctactcttagaccaatctcttctgagtttctctttagcattttgatcttttcatcagtaaggtctttggggtccatcgctgctatccagtttgcctcctacgatgctctccttggagtgcagcggtgtcccatggaagtgcctcaggagtttgtgaggggggctgttggagcaggatggctccttggaaagctgtacaaatcacccccagatgttgtcactttttggttgtggatcctggcgagttacctttctaactcagttttctcatctataacaatgggcataataaaaggcctactgaaggtgggaaaagagatttaaataaataatggaagtgaaggcatgttgtgaagttctgttcaaaggtcatttttttacaaagccctactatgtcatttctaatggagtttgtgtgtactgctgtgtgtatttagttcattaagtgggaaagggtaaatgatcagtgtccccaaagcgtgattttccttttaccttctcagaaacacagtttcctctttctctcacttagaattggaataaattcatgtacttgcctttggccataagtcggcaggttccctaagtggttgaactcctgcttttgctgtattacgctgagcgtttttccagttgttgagaaccccctcaccccaatatttccatgaatcatctgagcatgaaggaaacagaaggttgatctgaagcccctgtgcggcacccacttcagggaggcccgtgggttggggagcctcagggctaggatttggctccccagaccatttagagtcagtttgtgcctcaggccccttctgttgtcaggaggatgtatacaaacaaacagaaaaaggccatttgagacggtgcaggtgaaggacacagaggaaggtgccagtgttggcatcacaaaggctaggctcttaatgggcaccaaagcagaatggacacccggccctccgtcttttcagggccacagctgttttggatcagaaaaactgtcagtgtgcgtgatggatggtggaatggatccatgctcaccctgttaggagaaagaaaacactctgccatgttatgtcttcataaacattattatcagatccactcacgtttctgtacatgtgcggaaaccacctgccaggatccagggctgactggatatggtctctcagatgagattaacatcttaccatagaaatcttttaggattttagtggaaaatgcctgatgactctattactgatggcaggcaagctatacatggtgaagattgcttacccatgcgggtgtttttttccactttgatttctccatgaagggcgggacctgtacttgtccactgacacctttctccgtgcctaccaggtacccactttgtagcagttgttccataagtgtttctggaatcaagtagaggcaaagagtgattataatattaattaaataggctgaggaaagtctatgaaaaatccagaattttttaaaagtttttttttcattaaattagtgctatcggggcaaattttaccacaattccttctgccctggggcttggaaaagcagatgaaattttattagaccaataggaatgggccttttctttttgaagtggagttaggtaaacagtcagctgagaggtgacctgcccaggcggccagctgagaggaggacgtcaggcaggatgaggtgaggagatgtttctggcttggctggggtgctggcatggtctcagcagggcca

SEQ ID NO: 45461 - DNA, 1729 bp, Bovine  19866881349274
tgaacagagatgctggtttgtttctccttagggtctcccagcacacagttttaacacaacattaatgaatttggctcaaatggggacttgaatgcttaatttgaatccataaagtttaaattcttctcttttcaatacactgtaatttgccttatagcagtagattacaaggatcactagagcactacccccccttcataagccatttaagggcttaagtatgagctatgaacatgataagatcataagaaatttaaaacaaatttgtatgccttggatgtccctggtggtctagtggttaagaatctgcctatcagtgaaggggacacaggttcgatccccggtctgggaagatcccacatgcagttaggtcctgtgcgccacaactgctgagcctgcgtgcctatagcccatgctccacaagaagtcactgcaacgagaagcccactcaccacagctacagagtagcccccgttctctgcaaccagagaaagcccatgcacagcaccgaggacccagagcagccaaaatataataaataatttttaaaagtatgccccaatgcacagcactcctttcaaagttttccattttgtgatatagaggtggaggggtactcacttgcacaaatgatgctggcaatgctaagaatatttttgaaacaatagaaatgatttagttggaggactaactaaccaggtgctacccttccttctgtgagacaaacaattcacagatgtttctgtaagtccttattaattggtctaaataggacataaattatttctgttatcttcagagaaagaaagatcaagtctagaaagttggtataagaattaggacagatggtggatgtcgtgagctactacatcatagtctttggtttagatcaaattagtagaaaggacagttcagaaaacaaacagaacaacctgagtcaatcagatattgagggcctggaactataaaggaccaaggtaattaggataaatacttggaataggtgacaagaatgccattacaatggaaaatttagtcataaaagaatgagtatgaggtttctttctttttttttttttgcatttggtaatcacatactttttttgttaattgaaatatagttggataaaattttatacaatttacaggtatacaggagagtgaaaaagttggcttaaagctcaacattcagaaaacaaagatcatggcatctggtcccatcacttcatagcaaatagatggggaaacagtggaagcagtgtcagactttatttctgggggctccaaaatcactgcagatggtgactgcagccatgaaattaaaagacgcttactccttggaagaaaagttatgaccaacctagatagcatattcaaaagcagagacattactttgccaacaaaggtccgtctagtcaaggctatggtttttccagtggtcatgtatggatgtgagagttggactgtgaagaaagctgagtgccaaagaattgatgcttttgaactgtggtgttggagaagcctcttcagagtcccttggactgcaaggagatccaaccagtccattctgaaggagatcagccctgcgatttctttggaaggaatgatgctaaagctgaaactccagtactttggccacctcatgcgaagagctgactcattgtaaaagactctgatgctgggaggaggagaaggggacgacagaggatgagatggctggatggcatca

SEQ ID NO: 45462 - DNA, 650 bp, Bovine  19866881897940
cctttctagctgcttctttgaagaaggaaccgttttattccctaacacccagtgtggtctccaaaggactttatcctatttactagcaaagccccaaagattagattacaacttggccaagctcaggttcctgtccctactttctattatttttatgtgtaggactagactggtcattgctgcttgactgggtcacggtgtctgtctgatgaaggatcttatcaaagatgcctttcaggaaagggggtctattcattacttgtcccagcataacactttaactacagtcccagtggagtaagagctaactagataaggaacaggagggggttccttctcccaaagctgaaacataagcttaaatgatgttgccttataagtggagcaaatcttccttattttgaaagagaaaaatctactagcttcaccagtctatgacttagagcccagtaattagcaggtgacacgcgttcatgccctttcctcaaggaggcagttcaggttccctctagccctggaactagtcctaatcttaatggtcttgggtctcttgttttccagccccactcccccaccccagatgttagatgcaacaagcaaagaaaagagaagggatgaaggagctgacttccagaggggaccaggagaga

SEQ ID NO: 45463 - DNA, 2335 bp, Bovine  19866880456049
cgtctcccctctgccactgaaaggagccgtggagccatgaaaggctgggacccaacagaaagccacgtcagccaggacgtgtgtgagccacacgcactgacatgacgcacggacgggatgcgggggacacggttcctgatggggaccctgcgccggagctgggcctgtcttcccagcggagactcaggagccaccatggctgtgggaatgtcccctgcagggcaatgcctgccaggaacgcaggccccaggccccacaaacgctgctcacaccacaacagcagaggccagcggagggcctcagaggggtcctcccctccgagtaagtcagaagcgaggacagaagaccccgagacctgggacctggacgcaggggccacccaagcaccccaggccccgccctcagagtgactccacgggagctgaagagccacctcctgctgggaagccagcctggcggcccgcgggaccacgagcccatgcagacgagtgccgagaaccggcccccgagccccctgccccaggtgtacggggtgctccccacggccaggaggctgccctcaccctcccaggctgctctcacggggacctaaaagcccgtcccaagcaagagccgcgtgggtcccgggcgaagacccctgtgggcgtcaaagtgagctcatcacccgcccacgtggcccagcgggaggacacgagcgagtcccgagccactacctgctttggtggacatgccgatcatgctcttcttcttcttccagaagctgatgtcgtttttaaacgccaggaaatcaaaaagtagctggaagaggacaggacagcaatgagcccccatgctgtgtgggcgagcacgggctcgactggagacactgtccactcagggagaccccagccccagcgcggccctgccaagttctagcttctctggtggccagtgccctggcctgtggacccactgttacagccgggagccgggcctcacccccgccctctgccctgagcacagctccatgcaggcttttctggcagtcgccagccactgcgtctaacggggaccctcccggcaggacccgaccgtaactcttggaatcaccgtgccagacctcacacaaggcaacacctattttgctaacctcattttgatttgttttcaaaacggctccaaacagacgaaacctagcccttcagctagttaagcctgagtgtagacccctctcctgcggggcggggagagaggaggctgcactggaaaaccaggagcactcacgtgaaatgcagccacgaagaaggtcagcgccaagaaatacaagttggtgtcgacaaagatcccctttacttcgtcagcatctttttctgagaatcctgaaggggaccgaggaaccgagtgaggggcgacatggacccatgctacagaggccccgaggggtcacctcgtctgcaaaggagctcctcggaccccacagggcccaagggggacagcctcacgggcggacgggtgccgagtgccgggctcccccgactccccactcccggggcacgcccggcggcctcaccgaactgctgcagtgagtacacggcgtcctgcatgtggatccagaagcgcagccgccccagcgagatcttgtcgtaggacacggtgagcggcagctcagtgctggagcggttgatgacctgcgggggagcggtggcggtccgtccctgcgccaggctgggaccccgtgggcccggcaccacaccgtcctctggtgacctgcaggcacctcctccaggaagtcctcattcctcaagctcctctccatcaaatgaaccctatgtgtctcttgtgaccacagccccggcgctggcgcctcctgggcaggcgcggggacccacgttggcagctgagtcgagcagaggcccacgggagtctgagcccctgcccggggaccagatgccaaggctgccctgagaagaacacggcggggcagccacactcacgggggcggcgggagctgcagggaggggtggcccctcaatagggccctcgaggacacttggaattgacgtgtgactgtgtgtggaggggaggtgtcccatgacacccgaccctgcggcccccatagatgagctctgcccagagacgctaagcagcaggcctccgtggagagagcacctccctgaccctaagtgaggccctgcaggtcggagacactgtgacacagcggtttgggtgctgcgaggtgcccagcacggtgcctgcggcggtaagcaacctcaggcgtcagctgttagtgctgctgccagcccagcccaccccgggggcgcaggtgaccgggcgccagccggaagaggcaggctct

SEQ ID NO: 45464 - DNA, 2520 bp, Bovine  19866880810415
gctctggggtgaccactggccactgagaggacctgggactgcaaggaggcaggagcgccctccccccacgccaccagcccctgccttcagaagcctgctggccaacgaccagcacctggaccccctgcccacccagccactccaggcctcgagctaacgcctgctcgtcctgtcctcagtgctggggtgacccagagcctctggaagtgctgcccaaaggactgagcccccctggtcctggtgtaagggctccgtgtccagccccctcactggctcatggtcaggtcagctgccctgtgcccccagctggggactctggagtcacggctggggaacctggcccacaggcctcatctcaggctgggggactttgggaacagcccccaggaccctcccgtccccacttttcgcacagcgggcctggctgctcccccagggtgggtgtccgctgtcctcatcgccgccctaggctgtgcagggcccaggggcgcccacgtcatcatcaccgggtcgtagggcggtctctgcaccacctgacctgagcaggtcgtgtccgaagtctgaaatagcgccttggtccagtgtcgaccgcacggcccattcgtcatgtgtcagccgcccgggatgcgcctgtgccacctccagcgagtgcagagctttggagccacctctggctccatgggcctttctgcgtgtgccgcggtgggctccccgtgcgctcgccgtacgctgccgcaggaggggtgggaggtgggtgtggaacggaggcaccatgtcctgtagcaccgtcacggtgcctgctctccccggggcacgggcccatgaagtaacctcaggtcctgcaccaggacgcagcccccttctcctcaggcccctcaggtttactccctgaggtgacgttcgctcactgacagtgatgccaagtttaagtgtgactctgttcctcagagcctgtggcactgagggcccaatccacgaccctgcctctccccaggctggccatgcccccacagggacctctccccacggggaccactcaccccctctgtctccccacgggggccgcttaccctgctctgtctcccctcgggggccgcttacccctctgtctctcccctcgggggccgctcaccccctctgtctcccctcgggggccactcatcccctctgtctcttccctcaggggctgctcaccccgctctgtctcccctcagggatgtctccccttgggggccgctcacccactctgtctcccctcgggagccgctcaccccgctctgtctcctctcagggatgtctccccttgggggccgctcacccccctctgtctcccctcgggggccgctcaccccctctgtctcccctcaggtacctctccttgtggggagcgctcactctgtctctgctcctgcaggtctggatagatgcggccatccagatatgcttctcgctgggcgtgggccttggggtgctcatcgccttctccagttataataagttcaccaacaactgctaccggtgagtcccggccgagagaggcctgtggcgtcaggcgggcgggtgtgcccctgggtgaggggaggggacaggagccgtgcttacagccccttaaccgcacgtgaaaatgagacagggaagcgacaggccaacgcgcattcctgcttaagggaggctttgaggcaggaagacgctgccccctccctgggaggaggcccctcctctgcctggcttggccaccccatcctcccagcatccggggtcaggctcctcacacctgtctcccacgaggaaggacctgtgcgtgtccccacctggccttcactgagggagcgggggccccaggcgcgccctggccccacggagccccccgcagactcagcgccaggacaggtgggagcacggccgtgccacgtgcccagagccccagcagcctgcccgccggcgctgcccggcccaggaggacctgagtgacctgcagccccctgccggcccgaaatgtcgttctaaagacagagaaaggggtttcctccgggactgcttccttgacctttgagccagtgtttgttttctttcatatcatgaggataaaaatgcggttaaaaatacaaaggcggtgtgcgcagcagaatggcccgaccgaccctacccaggggtccacacagagctggcgtctggatggcaggccagacagcggctcccgagcccaccctgtgcccatctgagtctgtgagggtcctgcactcaggcaccccagagggctggccccgcagcccctcctccctgctctgaattctcggccctcagagcggggtccccgggccagcagccctgggcccccaggcacgtaggggaaacacagcatctgggccccaccagacccaccccgtcagcacctgcatcttaataagttccccgggaggcatctccaagccctgcctggcagccctgtgggtcagggtggggaccccgtggtcagtgggctgcccacccgagcctagctttgcctgtgggatcatctcg

SEQ ID NO: 45465 - DNA, 745 bp, Bovine  19866880930532
acccttgcggcccagttccagggtgttcgggaacccaggctgctgtccaggaagtaaactctccgtgacatcggtgcaggggctcagaaatggggaagcaccagagctgcggggtgtgcttggcccggggcttccagcgggaagtccccaaacccaggggggacaggagaccactgcccaactgcgaagcagcaccatctccacgcgcaggcccgatggcccaggagtcgcagctcctggatctcaacttgctggtttctgtcccaagagatgcttaagctcctcactaaatctgccgttaaatgacagatgggcccaggggtcattaatccccagataggcgccagcccctcccccccagcaaaggccaacaggtaaacacaggcaccagactggtcaatcccaactcaggatgaagggaggcgaatttccgagtggccctggatcgtctcggacatcgaggggtccgtttatgtgctgatttcgagaggaaggctgcccttgcgtggacaggccagtcggctctgcaaactaagcacatgaaggggagaagctgtgcaagacgctgctggtgaaaagcaaaacgttcctgcggactggcacggggacagtccgcgaccgcacaccccgcgtcaggcctggcgccacaggcctctggacagaaacatggacttggccccaaccctgcctggcgaccagggacgcacaaaggatccctgccctgcccggtgtagaacacggcccg

SEQ ID NO: 45466 - DNA, 1046 bp, Bovine  19866881016904
ttccacacatcttgtgcctacatcccatctgctgccagagcttatactgatcacagctaactggcaggtgggctggggaatgcagtctatccggctggccaagcttccctctgaaatgtgtgtgttctattgctaaggagctgaggatagatgtggcctggcctctgccccctcctcacagtgaatcgcctccttctggagcatacccttcttctgaaacgtgaggtctctcttcgcaacttcgagtgtaaaaatatttcgacacagtatttctcagtgccaactggaaagaattaccgtaagcaatttttcataaaagatcactcctttgagaatatgttttcatattttgctttttttgacattttcggaagcaaaattacatgcaaacatttgttctgcaattgcaatgtgtgaagaagctgtgcctctgagtttcaaaatctagtttgcgccgaggcccacagaagagcgtgtcatctcggctcacgttccaaaccggggaacacttgctccgtgccaaaaactggaacaggtgatgctgctaaggaagagggtgtggtgatgaccaaattcccagggcctgcgtcttcgtgaaaggggtttcagatccccagccacagcctcagggttaccccacgtgggctgaacattaaatgacagctggaaactacacatgaggtgtagcatcccgtcaagtatctagatactgacttgaggtccagggtctttatctttgaggaaaacaatcttgtctggaatccacgtgttgtagagataggacctctctctggaaggccacctgcagagacaggtgacccaggacacggaccaccctgactcgtccacaggaggaaacagcttcagtcttcactggtcccggatcggatctcagccgctgtctcctgtgccgcgattttcctgtctatgaaatggctctaacctggtccaggtgagagggacgtggaggaggggcaggcgggaaagagaggccaggagagtcgagggagactggggaaggtgctgtcgggggtggatgaggcggg

SEQ ID NO: 45467 - DNA, 691 bp, Bovine  19866881553620
tgtttcctgaggtctctccccgcctgcgcgctgtcctgctccctgtgtcagggatcccgcaccggggggctgcaacagggcgggaagggggcgacccggggcccggagctagcgggccgggattgggccccggggccccaggcgtggtctggttcctccgacagtggcctggagacccccctttcgtccggtggagaataactgggcggggaggggaaggagccccctattaccgttctttgcactcactgccatctttttctaatggttttggcagtgccctgctgctcaccttagctcggcttgtcctcccaccttcccggacgtcagtgacctcccggtgtcccctcaccttgggccgaggtgccgccggctgggtagcagtgtgtgctgctgagcggcctccccaagctcatacggtgaaggccccctctgtgtccacagactatgcagacaagcccttagagaagcccctgaagctggtcctcaaagttggaggaagcgaagtgacggaactctcggggtccggccacgattccagttactacgatgacaggtcagaccatgagcgggagagacacaaggagaagaagaagaagaaaaagaaaaagtcggagaaggagaagcaccttgacgatgaagaaaggaggaagcgaaaggtgaacgagggtggcccaaatcccctgcaggg

SEQ ID NO: 45468 - DNA, 1897 bp, Bovine  19866880485767
tgttcccctcagcctcagccctcagactttgctaggttaagtcttatgctcagggacttccctggcagtcccatggttaagactttgccttctgatgcaggggtacagatttgattcctgatgagggagctgagatcccacatggccttgtggctaaaaacactgcaacataaaacagaaacaatgctatagcaaattcaataaagactttttaaatggttcacattaggaaaaaaagcttaaaaaaaagtcttgctctcggccttagcactatcttttgagaaacctctgcaccatgagagtgaagtggaggaaaaagctgaagcttctttgtgctgaagcacaaaagaagaaagatgaggcagatgtcccagtaaacttgtacacccatggaagtcacagaagcggaaacaaggggagccagaggctgggacaaatcgtggactgcatgcctattatctagaacttctcagtggatctggaacatctatggccgctctgaccgcctcgaccacctttgagagacccaccttgctcgcctcaaagctgtcccttttggtcttttgccctggatctgtgatactatggactagctctgttctcagttgtggctgaatgtaatgtgtacaataaatcatctcttttgctgccttagctgaagaagaaaaaaagtcttaaactctgactgactcccaccttccagcctccacctctcagagcctgagggaattttctggaaccgatgaaggtcacgctgtcatcccgtgtatggctggcttgaagggctgggaattattattagaccctaggagcagccctcaaccagtggctctcaggagctagggaataaatatctctgccctggggcaggacgattcccaagaccagtctgcactttttcccagagctttcctgggagcctgggctgcagttacccacagagatgacttgataatcgcacaccttatcttccctatctcaatgccccttcccctctgggggtcactggggtcacttcccaaactttatctggaagctttctttcaggttctgcactgcaggagcccagattaagagagggagcttccaacactgctggttcatgtttagtgactactcttggggtgtctctggctaggaggggctccaggaggaactaaggtggctgtgatgcagctcctgaggatgaggacagccggtggggatgggaaggtggctgcaccgggacacgttctgcacccgaggggctaagacactctccgagatgcagccccagcagcagccaggcaatcagcctgggagtccttggcatctccttggtttcctcaagcaaagaatatttttggaacaagagctcctagaggccgggcctccttgccttttttggccagggcctgcgtgggagtcatcccatgcatggccatcagagttcttaggaagctctgtttaccagtaactcagtcttcacacactgaagccaggcaggtggggaggtgtccaggccctggactgcttaggactagcaggccaaggcttcttctttatttcagatacagaaggagcacatctccccatccttgtgacccccaacccccaccatcaatttcaagtccatctcctgtgagggatttaagtctgtgttggccgcccagcctctactcccactcctctgccatcacttccagacccttctccttttttaaagaacagaacaggtatatttctattggacttcttgatacagaggctagtgtggcatggatggattgcatgaatgacaaataatacaaatatattttatttgaaacaaacaaaaatgctcacacagttcaacggttcacttagaaacaaactcttgcttgatagtattacgagcaaaagcaaaccgaaacacaga

SEQ ID NO: 45469 - DNA, 2754 bp, Bovine  19866880814992
tcagatgctatcatttcccatcacaggctccaaactggtagcccaaagactagatctgacccataaacatgtttagcttggactacagtgtttctacaaaaactgagccaaagtttaaaaatagggacacttcacatttcttgaatgataaaaatcagctgaaactggctagtgaccaccccccacacccaggggtgccacagtttccatcattgcctcccatatccctgaggacaaggctgaacatttgtgagatagtagaaaaaaatagagattattctctgcccccaattcctggcacagagcccctaaaactcttgcaatttcctaactgataagaacattagaagtattttttccaatatttggtctttgaccctgtctctgacacagggctcctaaaccccctgggttttcctgggtgacagcaatatctcttgctccagtgaggtgactctgggtgggctcctggatgggggcaagtcaccaggaaagaccttattcaatgcctggtttcatttactgatacttgtacttgctatgttatttttcttgaagtagataaatatttatctgggcccatgcctttattaagagtgagatagcagagacttctctggtggtccagtggctaagactccttgctcccaatgcaggggcccagggttctagatcactggtcagggaactagatcccacatgccacagctaaaagatcccacatgtttcaactaagactgcacacagtcaaataaactttttttaaaaaaagagtgggagagcaaaagataaactcagaattatatttcaaggaaaacaggaatgcacaaacttcttttcaaacttgaggaatattcttgtatcttcagtacgcaaaccctatgcatgtgttgaaacataaccaaaaaccctggtgactgtctgggctcttgggtcaattgaatgagtgaccttcttcatctcccagatttagactagcaaccaagttgccagtgacaaaaactaaaataagtttgcaaaaccaccttgacatagtgcataagatatgtcaacaaaaatgtgtcttgaacttggaggagccagctgtgttcagtggtggtgggcagggaaagcgtcatgatatcactgtgtctgcctttctgggggaaaacctgacttcagctcagacttcaatcaggaaataattcttcatgtcaaaagcagcagaataaaggtatctcccaccctcccccacacccatagcatatatggtgactgaaagagattgctgacttcgatagtctgtttgctctggtataacaatgtaccacaggctttgtttatttatgtctcatgttactggagctggaagtctgaggtcaggttgccagcaaggcctggtcctggcaagagcgctctcagggttgcagatgacaacttctcattgtatcttcacttggtggagagcagagaggagaagcaagctcctcaggactcctataaggacactaatcccattagtgagggctccagcctcatgacctcagctgcatgcatgctgagtcgcttcaatcatgtccgactctgggcaaccctatggactgaagaccccccagtctcctctgtccatgggattcttcagccaagaatactggagtgggttgccatgccctcttccaggggatcttctggacccaggaattgaactcgcgtctcctgtgtctcctgcattggcaggcagattctttaccactaacaccacctgggaatcctcttgacctcagctagttctaatcatgtttcaaatgccccacctcttaatatattatatggggggagggttttagcatatgaagttgggaggagctcagacctgcagtccataacgttgacccttgcctgcccagggtagagagaaaagtagttgcaccttgaaaacggaggacaaatctacctgaaatgtgtttaacagcagctcaaagttttaaagcacatctgtaggttcccacctgtgaagaaagcaagtgacaaagaataacatgtgaacttcaagtgtatcagcagctctggaagttgcaatattgcagggggagacaatcagcaggacctcacagaggaaaattccagaccatagcagaacagggcaattcccttgtctgagataccttgtccattcccacccttcaacaacagttcttgagcagaaggaatcagaaattgctagactgtccatgatggggtgccaagtgcagcagagactgtttctatatgtattagtccagaagggagtgggtgcagggcggtgcggatggccagcatttttactttccaggaagagcccccaagggcaaaggaaagtgggaggtgtctgctgttctgcatccccacaccttccagagctgttttcagagggagaggcaggaaaggttcatagcaacagaggaaactgctgttgtgacagccctgatgcccctttgaggttccacactttgagcatctttcttagactgagatggatctactgccagatgctgtaggaaagaacctttaagaagaggccaatgagcagagagggagaggctggggagctgcgtaccagtggggagaggaaaggaagggctgccatcgcctggaacagagctaaggccgacctcacccccacatcccccccccacacacacacacgcgcggggcagagaaacaccagtgggacatgagggatgtacacacaggttaattaaaagtgtttatggggaaaggtagatacatgtacaa

SEQ ID NO: 45470 - DNA, 1511 bp, Bovine  19866881200983
attactaaaagataattgtgtatctttctcagggagaaagactttttccctaccctgttcatgctcagtggaaaatgaagagatcaagaagagagaagacagaacaagcatgtgaggaggaaaagatgaaagtgatggatgctcttgcttattcaaactagaggagaaataataaacagtgcaccttgtatcggagagaaggcaatggcaccccactccagtgctcttgcctggaaaatcccacggatgggggagcctggcaggctgcagtccatgaggtcgctaagagtcggacacgactgagcgacttcactttcatggagaaggaaatggcaacccactccagtgttcttgcctggagaatcccagggacgggggagcctggtgggctgccgtctatggggtcgcacagagtcggacacgactgaagcgatgcagcagcagcagccaccttgtattcaaacaatgaattcattcattaaagtcttacaattgactggcataagggataaaactattcccttcattatttgtaccaaaaaatgttctttccgaattacatatatcttttgattctccttcaaatggttacacgggtagtctgctttattggagtattgatacagttgcttttggtactatatcatacttgaacatgagttctctaaagaactccaaaagtacacacaagcatggatcacacaaaatgggtttaaagtgcatatgatgtatatgaaatcatcttttccttaaagataccaaaaacatcacttttggatactttctccatgttgttggcagtggcagagatacagatactcatttcacatagaagggcagagaatcagagaattaaaataagctagttgtagtgggatttttgaattcccaaagtcagatatttatattcaggctggatagtttatcctcatatttgaatttctttttcatttgccctggaattgagctacaaatcatgattaatagtgtatgaatataaagctatttatcgtaacaaataaagagggtaaaccaagttccaaggcagacttaaactgtggtagacagatcccagtgtcatgtcctgcatagttttctccccttttgagagaaaaatgaaatgaatgaaatgaaacaatgaaagatcagaaagagaattcaaggaaacaattcaatttaccacttcttcaaaaagaacaaaatatctaggaataaatctatgtaaggaagtaaaagacctgtattcagaaagctatcagacactgatgaaagaaattaaagatgattcaaacagatggaaaaacacatcaaattgttgattggaagaattaatgtaaaatgaccatactaccaaaggcaacctacagattcgatgtaatccctataaaaataccagtgacatttttcagagaactggaacaaataatgttgaaatttgtatggaaacacagaagaccctgaagagccaaaacagtcttgagaaagaaaaacagaacggaagagtcatgctc

SEQ ID NO: 45471 - DNA, 2615 bp, Bovine  19866880098891
tgagatgagtgcaattgtgcagtagtttgagcattctttggtattgcctttctttgggattggaatgaaaactgaccttttccagtcctgtggccactgctgagttttccaaatttgctggcatattgagcacagcactttcacagcatcatctttcaggatttggaatagctcaactggaattccatcacctccactagctttgttcgtagtgatgctttctaaggcccacttgacttcacattccaggatgtctggctctaggtcagtgatcataccatcgtgattatctgggtcatgaagatgttttttgtacagttcttctgtgtattcttgccatttaaagaaagctgagtacagaagaattgatgcttttgaactgtggtgttggagaagactcttgagagtcccttggatggcaaggaaatccaaccagtccatcctaaaggaaatcggtcctgaatattcattggaaggactgatgctgaggctgaaactccaatactttggccacctgatgcaaagagctgactcactggaaaagacccttatgctgggaaaaagattgagggcaggaggagaaggggacgacagaggatgagttggttggatggcatcactgactcaatggacatgggtttgggtgaactccgggagttggtgatggacaaggaggcctggtgtgctgcagttcatggggtcgcaaagagttggacacgactgagagactgaactgaactgaactctttgccagggactacagtaggacattaggttccaaggatttttataatgaagaaatcactcttaactgccttctagtataatgggagagaaagacctaagcgtaaataattctaatcacatacgataagagccaagttaaatgtgtggagtgttctgagagcccagagccaggacatggaatccagcatggtagtgatcaagatagcttcttcaagaagagtcttgagttgattcttgaagggtaagtaaggaatagtgagggaagaatggaaagagaatccagacagtgagagactcatagcagaagggctagccaggaactggaggaagctccagagattggtaagtcgggggaggggaaggcgggaaggagagaaggctacaaggttaagtggaagctggcacccaactccagtactcttgcctggaaaatcccatggacggaggagcctggtgggcttgcggtccatggggtcgcacagagtcggacacgactgagtgacctcactttcactttcatgcattggagaaggaaatggcaacccactccagtgttcttgcctggagaatcccagggattggggagcctggtgggctgccgtctctggggtcgcacagagtcggacacgactgaagtgacttagcagcagcagcagcaaatcttggaggctagagagcctcttgatgagggtgaaagaggacagtgaaaaagctggcttaaaactcaacattcaaaaaactaagatcatggcatcatggtcctaccaccttatggcaaatagatggggaaaaagtggaagcagtgacagattttattttcttgggctccaaagtcattgtggacagtgactgcaactatgaaattaaaagaaagttactccttggaaggaaagctatgacaagcatattaaaaagcaaagagatccctttcttgacaaaggtccgtctagtcaaagctgtggtttttccagtaatcatgtatgaatgttaagagttggaccataaagaagggtgagtactaaattgatgctttcaaattgtggcgctagagaaggctcttgagagtctcttggactgcaaggaaatcaaaccagtcaatcctaaaggagatcaaccctgaatactcattggaaggactgatgctgaagctgaagaagctccaatactttggccacctgatgcaaagagccgactcactggaaaaaaccctgatgctgggaaagactgagggcaggagaagcgggtgacagaggatgagatgtctttgagcaaactccaggagatagtgaaggacagggaagcttggcatgctgcagtccacagggtcacaaagagtcggacacaactcagcaactgatcaaaaacagcacctggaggcttgtggatttgtcgctttcctctttttttagttggctccactgacatactgctattggtgggccctaggtttcccacctgctttgtttttcatcttgggcattcacaaccctgggtaaacccttctgttccgtcactgcttctgccgcagggcttctaaggacactcaggaaaaggaaaataatgacgacaaactggtatctgacacggcatgccttcctctcattccgtttctttttagaaaaatctaggttttgtttctaaaacatagacttatatagtaaacctaataaaaagaaataaaagacagagatctgaaaatatttattttagaaaatgccttacatttactaacttctgggactaagagtcagtttttattttcatggttggcttaggtaaaaggaatggccagtcatccaaatagggtgaacagctactttcaaattttattaacataggcaaatgcatagagtaatgtgtcataattt

SEQ ID NO: 45472 - DNA, 1410 bp, Bovine  19866880445961
atgctgctattcagggatgaggaaaacaccccgggagatttttatgacccatttaaaactaaatttattggcatttcttcatcagggaccaggctgtaattttataaatctttcccatggctgttagaggagcagctctgaaaaagaaataaagggttaagttaaaaaaaggttaagttcaaattctctctttttgtttttttttccttcaagaaaatgactagggtttcctgattccaagtaagaaactgccaactcagtaacagcaagtgaacagttacccgcttcaaatgcatgtgttgtcagaggtgggagtgagggctgggtctgccgcagtacccagcagggtccttggctgcactttgcaggcagtttgatttggatcctcagctcccatgagttagagggtataagggccagcagtagagagtggtttcaaatatgtggatgaaaagggcttgagacggaggatgggtactagagtggtgccagaaatcaaggccattatccaaaggaaaacaagtccatctgccctgtgagttgtccccggtgtgacaagggatgggagctgacagtggaaaggtgctgagatagagggcaggaaaatgaactttctgggcccatgtctggttttgttttttttgtttttgtttttttttggctgtcatgggtcttagttgtggcatgtgggatctagttccctgtccagggattgaacccaggtctcctgcatcgggagggtggagtcttagccactggaacagcagggaagtcccccagccccatgtctttattgcttgccatacaccacactcatgggtcctctggtcagatttgcttcttcagtaaacaagattcttcattttccccggcctctgagaaggcccgtgggagaagcagacaaataaatttcaggagggacgtctttgaaggacaaaaccacgagaggcccgcaatccccactatccactttcctggactcacagtgcccgtctttcttcctttctcagcccctgtctgaaccccgctctctgctttctttcggtccttgtaatcgcatcatctcgtccgcgcctttcagcggctggccggcctctgctccccgagcggcgatatcggttctcaggggcaccagccggagaacagacgctgcctctgctgggagctgagtctcctttcccacactccaggcagggaagtgggtgaaagggaggtgaggaagggcctctctttcgttttcaaaaccctggcatcaaaccctgctaggatttccatgcggtacttcctcgtgcattgtggactgcagcccatgtcctttctatttaagctagaattgattcactaggtaacgaatggaaaactcctccccaggcttcccagagaaattacatacgctattagtagcattca

SEQ ID NO: 45473 - DNA, 1965 bp, Bovine  19866880489996
catgtggaagaaaagagatcatcccaaagagatgccattcccaaagaaaccaagtcacactgtcatcactatgctccaggaaatgatcttgaaaaggcccagactaaggaatataaggaatatataaggaatcctatataactggggattaaaagggagagggcagcaatatgtgagctgcccctcgtcaactattgaaatacccttctctttttttttctaatttaatttccctctggtctttgagagtcagctcaagttctaacctcttttagtaagtcttccaagaccacgcacattcatgagattctattttttttctttatacccaatgtcaccatttccttactaccactcgttcctgaaacttggtaaatgttagatgggttagatttgggggtccctgaccagaaggctggacagctgggtaacaatgttagagagcccagaaagtagctgaacattacaaaagctcaggaacacataaaaatgtgaatagaaaggtgaaattaaagaggatagaggttatgaattaaagcattaaattaaaacagaatttaagaaaagtaaacaaaacatctgataagtaatagggaaatattatggtgaggctttctatttcttcttatattctaatccagggatcagcaaactagagcctgaaatccagatatggctgctgcttgtcttttgtaaacaaagttttattggagcaaagctatgcccattccatcatgcgtgcctacaaccgccttcccgctgtaacggtagagttgagtagacgtggaaaagactttattaccaactcttcttctaaactatacatagctatcttaccagtcaaaactggcagccaaaattttttttttagtgattttgcactagctttgtttactctctactaaacagtccaggctttgtaccatacatagagaataccaattatgtgattctgaaaacacacaaagtaaatataatatcatactgaagatacaagatatatttgtatcttccaggaaaagcaatgttaaaataaatttctaaaaatttaaaaatgaacaataaaaagatgccaagtacaataacaattaacagtaccaataacagttgtacttatgccaagtacaattagcagtgctgtcataaataatttaaaatatactatttaattatattatttttaaatgagttaagtaccttaactatacagactgttttccaattgctcacttttctacataattacaattactaggtaactatttattagtatgtttatctgattaaatactaattctcagataaaggtaatatagatggttccatgttctttgaacacatagaagatacatgacttgaagtaacagaatggactcaaatgggaaattttgaccctaggtaaaataatttctccaagcttcaagtttctcagttaaatggggatcatacttattctacaagtgacattgttataaggtcaacttatcactgacattttaaaatgatgttatataaagctgtttttaaaaaatataaagcactataagatatagaggcctccttattagttacatcatttatttttcagagagaacgagaccaattttaaaagaaactacagtaagtgatcataatcatccataaaattggctatcattttccacataggaaaaggaaattttctaatgtctcttttcataaactattttaaaagacattaagagccatttgcaattttcctggaactatgaacattcatggaatgggacagtacaatcatttccacaatttcatgcaatttcacagttccattttatgccaataatgcataatttaactatacatcacatgatgaataagcaattttgagtaatttttattttttctatgaagattttcagataatcttgcctgcagataaaatgagaacaattctacatcctagtttttaaaatgctactccag

SEQ ID NO: 45474 - DNA, 2330 bp, Bovine  19866880509304
ataatggtcactttgatgtaactgcatcaagatgtctgctttaatggtcttccttctgtcagaaatgtccctgaatggccagactgtctgtgtgaggcccttagaagcccctgcctctacagtaggaggctgagctgggaagcagtgacatttcctcctccagcctgcgaacctcaggcgatgcaactgggcagagctatggacaatggaaagtggacacaatcatgttccaaacctaggcgtttttcctgctgaccacgtcctcaccccacattcccctttccttctacccaggtacaatgtacaagcttcctagctctacctggatttccgagttatccactctgtttccccaccctccctgttttgttttttttttttaattaaatgaatgaattaatttttggctgtgcttggtcttgctgcgcaggcttttctctagttgcagcaaaccggggcttttctctcattgcgatgcgtgggcttctcaatatggcggcttctcttcttgttgcagaacacaggctcaagggcagccggcgttagtagtcgcagctccctggctctagagcacagcctcaatagttgtggcacacgggcttaattgccccgcggcatgtgataagttcccgcttcaggaatcaaatccgtgtctcccgcgttggcaggtggattctttaccactgaacccaccagggaagccccttcctgttgtttttaaaaacacctttattgaggcataatttacagatcatgaagttcactcattttcaatgtacattacaatgatttttagtaagcttactatcttgtgctaccatcaccacaatacagttttaggacattttcctgacctcactgagatctttcatgcctgtttacaattaatcccctttcccatcccaactccaggcaaccactaacctacattttgtctctatgcaattgccttttctggacagaaattaaatcatatatgcctttagttttgacatcgcctcttatctccgatgagaaattccagattcaacctcagctctatggaaacttgctggccagacgtgggttcacataactggtaaatgacagagctctgattcaggtccaagtctcgtgattccaaattctttccactccctcctgctttcctgatctggatacaattgcaatgatgaatggaaaatttagtgatggccatttaaaaaaacctcagagatcactggccttctgggtctgaacgccgaactcgtgactctgctcagccaccagtgtgttagtcgctcagtcgtgtccaactcttcacgaccccatggactgaagcccgccccaggctcctctgtccatgggattctccaggcaagaatactagagtgggttgctatttccttttccagctcagccaccagagggtgccgaaaagatctttaaattggcttttgcttgtcacaattgggcatcttaggaaagccgcgtagaatttttcttataatattttccctgtctgggaaattgcaaatatcaatggagaataaaagctaggaaatgtttttggtgtacgttgaaggttttttttttcaggcttctcagaccaagatttctttttttaatagaataaaaagggaaactacttaaaagacttggtttgggaagctggtgaaacattaagttatgacaatccagcatgacagatatccaattaatcataacattaaggtaattgtgttaatcttttgcatttttagagaactaaattgatggagggaagggaactggaaacatgttttcaaactgttacccaagtacattatctatgtagctagaattaactggataataattcaatatgaaaattgaatttatctttgagtagtaatttttttgtgatgtatccccacctatctggatggatggatgaatggacaggggctgatcaacagccaggatgggagctcctgggaggatcttcaggggaacgtgatgcttgtcctgagcaccacccctggcggctgtcaaagtcactggagccatatgtctggtggtgctgtgccccctgtacccaccacgaaccacgtgctccccagaacctggactacagttatggaaccaggattagaccagagccagtcaaaacctttcattaacaggaaccagaggttgagaactgacttcaccacaaacgggaagtagtgtctcttacgcttattcttctcttgacagctaagccagtcctgaaaaagtgatgacattgaaaggagggtgcttagaatttcaaaaaaggcaaatcttcaagtacttctgaagcatctaaatctgtgcaatgaattcatatg

SEQ ID NO: 45475 - DNA, 2987 bp, Bovine  19866880536533
tttaaggggatgcctctcaggactcagcatgtagctgtactcacagctatgatgtattatagcaaaaggatacaaggacaatcagcaaagagaaaaggtaccgcaggcaaagtctgcagaaaaccagactcaagcttctgagtcctctcacacagaactctccagcaaggtgggacaacgcatgtgaaatgctgtctaccaggaaagctcatgagggacccagggctgggtttcttagtgggcgccagccacacaggtacccccttgattagtatgttccacaatttcagactccaagaatgagagcatgtgttccacataaaccatattgtctagttaaacagtttaggcacagcgagccgctcttatcaggaaatggcgagaattctcatgaaaatcaacttccagacaccaggcaatggccaattttgtaccacgttttctaagaatgacactttcaaggctactgcgtcatctcttttctgcgtggatttttctgtatattcataccctttctggtaactaagtcatgagggatggtgaagtcacttttagctaagtgttctttaaaagataaaaggatgctggagaaagattatttggaaggaggatggttttagcttaggctcagacataaactagctgtgcaagaactagaaagcttttaggaaactgtcaagtgctattatataaaacatgtaacaactatcattaatacatgccgacatgaggtggtggctaagtgccttagggtctgatatctgagacctgaattcaggcccgactgactcctcctagctgcatgtgcttaagcaagtattaacccctctgggtctccacccctcttcaggaagatgggtacagaaatcaaaccaatagcagcactgcaggaactaaatgaaaaaacaagtgtaaaataccactgcagtgtcaggtaaacacggtaagaaatgctaacacttatttatcactatatgctcagatgcgtctcggttcctaacactttatcgcacttaatcctcagggatattacaagatggatcttattaggttggtacaaaagtaactgtggttttggactgtgaattttaaatcattataactaggctcaaacctatctttattaatcaaaatagaaactattataatcaacacactttttccaataaaaaacaattttgtttattcctgtagcataaaaatccatgtttcagaattcaacgaactcttggaaagtattttctgcctcctgctggttatgggagcattctccctataaaaagttgttgagatgcttgaagaagtggtagtcagttggtgagaggtcaggggaatatagcagataagacgaaacttcatagcccaactcattcaacttttgaaatattggttgtatgatgtgaggttgggcgttgttgtgcataagaactgggccctttctgttgacaatgccagctgtaggtgttgtggtgcatctcattgatttgctgagcgtactcctcagacgtaagggcttgccgggattcagaaagctatagtgggtccgatgggcagcaggccaccaaacggtgaccatgaccttttctggtgcaagtttggctttaggaagtgctttggaacttcttctctgttcaaccactgagctggtcgatgctggttgtcatataaaatccacttttcataacacatcacagtctaattaagaaatggttcactgttgttgcatagaataagagaaaacaacacttcaaagcaatgatttcttttggtttttggtcatctcatgaggcacccacttatcgagatttttcacctttccaatttgcttcaaatgccaaatgatcacagaatggtcaactttgatttcttcggcaacttcttgttgtaagaagatcagcttcattaatcctctcagtcggtccctgtcaacttctgatggcctgccactgcactcctcatcttctttgcaaaacttctcaaaccaccactgcactgtacattcattagaagtttctgggccaaatgcgttgctgatgttgcgagttgtctccactgctttacgacccattttgaactcaaataagaaaattgcttgaatttgctgtctaatatcatttctatagtctaaaataaatataaacagcaagtaataaatcattaacaaaaaacaaagcaagaaatgcacattacaataatgtacaacataaccacatttatttaagaatgtattccaatatcaaagttcaacaacgtaaaaccacaattacttttgcaccaacctaataccttcatcttcaagtgagcggcctcaggtatagcctttgggacctaagaaaaagcagctagtaagcaaagggctcagtgttaaggccccatctgtcaggtaccttgctttttctactatataattactgtctgtcgtgtattacaattagcaagcttattacttaattaagggcaataataaaacaaaaaacagatcattttcccagggaaggaaactgtctccaggagaataagcgctccaactaatgaggcttcctgaggagaaaccgatgttgttgtctgatgaagagacagctcaagatcaagggagtgtttccatgatggctatacaaagtagaaatgcctcatatcaatttaataaactacagcccctgtagaaacttttatgtatgttactctgtgaactgagattttcagagtgattaggagatagcaactaggtcattatctaggtcattatagaaaatccaccaatttataatacaatgcgaagctgaagttttactcaccatctgcagttttttcttatccctaatcgcattactgtggacagcctcaattgccatgtggtgcttccaagctaattcttccaaagtcttagaatgggcctcattcagctgagccacctccccttccagtctactttgcaggttttttagctccatctcataatattcttgctgagttttctttgcctcatt

SEQ ID NO: 45476 - DNA, 1851 bp, Bovine  19866880565574
ttttgtgtagaatcggtattatttcttccataaatgtctggtaggattcaccctgaagtcatctcagcctgtatgttgcatcatttttaactagagagtcaattttcaaagtagatacaggattttgcaagatatctattcctttttagataaactttgtcattttatatattttagagaatgtgactatttcctctaagttagaacatagagttgttcattgtattttcttattattaatgtccttagtctatagtgatgtcccctctttcatttctgatatttttaactgtgtcttctatttataacttttcttctttttcctccatcagtctagccagaggtttatcaatttttatcaacaataattattataattactcactcactgtgtatcttacaccttttaaaaatctttatttatattctatttgaatatccaagaatctttaagtaaaattttctgtcatatccttttttttattgataagtaaactgaggcctggataaataatatatcctttttttttttgtagataagtaaactgagacctcagagatactgcaagttctagaccactgcagtaaagcaagtctacaggaagttttttgggttcccaattcatataaaagttatatttatactataatgtagtctattagatatacagtagcattacatctaaaaaacccatacatatttaattaaaaagtactttattgctaaaacatgcaaattgtcatctgagtaagtcataatcttgagtaagtcatgatctttttgctggtggaggttcttgtcttgatgttgatagctgctgactgatcagattgatggttgctgaaggctggggcagctgtgccaatgtcttaaataagacagtaacgaagtttgccacaccagttggctcttcctttcaccagtgatttttctgtagcaggcaataatatctgcccacagtagagctttgtttaaattggagtcaatctctcaaatcctgctgctgttttatcaactaagtctatgtaatattctaaatcctttgttgttctttcagtaatcttcatagcatcttcagcagtagattccatcccaagaaaccactctctttgctcatcataagaagcaactcttcataaagttttatcatgagattgtagcaattcaggcacatctccaggctccacttctaattctagttttcttactatttctaccacatcttcagttacaatagtaacagcaaagatcactgatcacacattactataagaaatgtaataatcatgaaaaagtttataggatataagcttcatagttataagacatgctttccaaataaaagctaacacagcttgctcatttccttaggtctgacggtaactgctgtaaaagactcaggagaatggaatttggaggcgggagcattagtcctcgcagatgctggcctctgctgtatcgatgaatttaatagcctcaaagagcatgacagaactagtatccacgaagcaatggagcagcaaaccatcagtgttgctaaggctgggtaagtgtttcttttctctagaatttatgggaatagtgagattcgttcatatatgattatggggagatgtgaaccacattgaactgcaagatgtttgtttggtcctctaagagatttatcagttaaccgccactttagttttcccatggagatatgtgaagaagtaaagacgagctgttgacaaaaagaaaaggaccactataaatgtaaattgacttaattcttggagggaacctatgaagaactttcaatgcagcattcaactcattctctcattcaataattgtgtatctgtctactctgg

SEQ ID NO: 45477 - DNA, 5873 bp, Bovine  19866880617072
acagaaggactagcaaactgtctcttccttctttgtgcaaaacctcaccaccaccctgcccgtcaataccgcacattagcctcactggttaaataaaccctaagtacattttaagtactggtcaccttgccatctatttccagatggataactttgtgacttaatgaactgttggccaggagctgcaaaattttatatattttaaataccaccactaaaaatccatctagtctcttttctttatataatgcagtagagaagaagaacataggtatagttgggccagtggcaagcagatttcactaagaatcaagacaactgagttccagacttggctatagcattaacttcctgtatgatttgaaacaagtctttccatctcagtttcctcatctgtaaaatgagaggagtgatcagcccaggtggagcagctaggctgtcccttcagtaatgtctgttgtggatggtggagcaggaaacgcaatacacaaggaaggaatgttccatgcatggacttgagaccaccgcacccaaattatgagacatcaaaaccttacttttctcatccgtaaaatgggaataataacacctacatcatgaggactaatacagctcacatatgtatgtgttcttatctctgtacctggtaggattatgcttcaatccctgaatcccagtccctattttctagctttataaagagctaaagagaatcatctcctgcaaaagaatcatctctcctctgccttgggaagcctccagcttgttttgttatgacaacacgtttgctattattttgcttgcggtttccaactaccctaggcttctttggatgccgtccttcaatcagactgcttcaaacacatgttattgctcatcttccaaggtcagagtttagctcttattttctaagatgagaacagaaatatccagctctttcttcacaccagtgtgctgcactaattgacttttccacatactttttattaaagaacaggcggttttctttcagcatttgtagaagaaaagaaatagagatcaacctgcttgactgccgcactagtaagcgcactattatcagctgtgtcattgatgtattcaaataatgccatgaaaataaaacagtgactgcaagttaagaactgcttttaaattgaagtatagttttgttttcatccaaaagtagctttggaaaccaacaaaatcaatttaatgaactcggaaggattgctgaaataatttctgaaagagccagtattgcttccaagatcagcttacatgtttgtgccctccaaaagtcacatctgtttcccccagttcctcggaagtcctgtcatcaaaccctgctggctttcaaggtcagattccctggggattcccagtccctttgccagatccccaggctgggaagcctgacttggggcctagaaccttcacagtgggagaacctctttggtgttattgttctccagcctgtgggtcacccactcggtgactatgggatctgattttttcgtgattgtgcccctcctaccatctcattgcatcttcttgtctttggactggggtatcttttttttgtggattctagcaccctcctgtcaatggtggttcaacagctagttgtgattttggtgctctggcaggaagagatgagcacacgtatcctactctcccatcttgaactggaagctcctcagcttaaatgtttgaaatgtacttatagtaatttaaaactaatcacatcctttcaaagacaaatgcaaaagtgattttgattgagagtcctgttatctgtcccccaccttcaaaaaaaaaagaaaagaaaagaaacagagtttctatagcattgaggacatgaattatgtcagagtgacatttgccttttcatctagtactccccaccagtgaagcagactgtgcacttctaaagaggggcttgcgtttctgccctagaatctgcctaacaaagtacacgcagttcccctctcctcccctgccacacccctgctgactttcacttttctggactccacctgaaatggccctccctgtctgtattctactcttcttggaaaaatgtctactcacctttaagtctcaatttacatgtttgtaacctgtctgcctctctcttcccccaatttgttcttgcttcttgtgagtctccaaaggactttatgcaaactcctgttcacattcatcacactcttgggtcattattttttactcattcattccacagacattcattaagctcccagagtgtttcagacactatcccgggttcctagggattctgcagagagcaagttagacttgcttcttgcttgaacagagctggaggctagaaaaggggcaaatatgcaaaaatatataagattttaaaaggaagttgccgtggcttattaatgaataaaaatacaagatttaatgtggcatctggcatgtatttgtcttcaatctggttacatccttccatcctgcactggaaggcactcagagaacatacagtaaagactgaacaaagtgttaagagcttccctggtggcactagtggtaaagaacccacctgccagtacaggagacataagagacagtggttcgatccccgggccgggaaggtcccctggaggagggcatggcaacccactccaatattcttgcctggagaatcccacggacagaagagcctggagagctacagtccaaagggtagcagagtcagacacaactgaagtaactcagcacatacaaacaaagtattatgaaggaagagtctcaaacttttgttgaaaagatagaaacagaattttcatcttaagtttgcctgctacagaacatagcctctgctaggccctactaacaccaagtggtacttctttctgcaagactgaatgcggactctatttttagtgggtaatctcatgtttaccttaactgtgagatacctaattataatctgtcattagaaaattctcatcacagtacttgcaacagtaaactcaccaaagataggacagttttctcatctcttagcatgttcaaaatatatcagttgtctcagggaaaacccacaggagcccaagccgtattcctccattttaattgattctggactacacactgctggtaagatcagcagacacaccagatactctctcatcattaggattaagcttgcttgtttattttgttttagaggggatggggttttttttttgtttgagccatcatagttaaaggctgctcacacatctgagactggcttcttttggtcagtgaaacacgtgggagacactgtcagtgatgtaaaggaagaagaacgcctctgtagctactgcagcctttttgtaatcctctctagaaataggatcaaggattttaggagtcaagcaaatcccttaataatgacattgttatattcttcctagtaagttcatcttccttttcgcaagctggcctgtcttcagcgataataacaggtgacagaatggctagctagaattttcactgtcgtcaaccttatcttcttgtctctttatttctggtggaagtgctaatataaatgagcaaataaccgagagggagagtaacaagagatctcaaagagattcatcagtccctgaaaatctgaaagcgacttttgtcgttattatcaatcaatatacacaatttcttttaaacactagataaaagcatataatacatcaaaaacatgattgaaaggtaaataaatataatgaattttcacaagatcttggatttatttttctgttgtaaaaacggtatagaatagatttagttttctttctgtctcttcatacaatgatgagtgcattaagggagaagtttcaaaatttccacattgtgtatctgggcttttaacctctcccaaagatcagataaagactgccaaaccaaaaagcattcttggctcatgtacacagcttattctttaaataggagattcagcacgtctgagcaagagcaaagacttctccagagtctttatctattgattaactgtagaagctattctgtttaaaatgagtcttgaatacgctgtaaaataaatgttttattctattttggagtaaaaggtgtgaaggaaaaaatgagacatacatactcctcccttactctacaaatatatgctgtattacctttttgcccatgatatttttataaaaagttggaagcaagaaaaaaaatacatttggcaatgagattgtattttacctcatgagaaaaaacccaagaccaagtgttaattactgctccactgtacagaggttacttggtggctcctcagtacattttaggagcttccctgagacctttggtgaaactgctaatatgcctcacatctcaaaggaagttggcaaaaccttcttttttctgtgattcttatggttacaatacaagatccctagattctcagaagcaggcatcaccttgtgaagagatttgtttaaagtgagaaatcctccagtttcttctctggtcattatctttgtaattattacaagtgggaaccagaaaccactcagtctcaaaaagaagaaatttaacacaaagaacgtgttacactgctgatacaagagctgagacatcaaacagtggatggtgaactctgatggcagttcagaaattagcaactgcaatatgccactctctgggcaggaggaggaaaaacacaagctggaggtgatgctacaagagagcagaaaaggccagagcgtgagctagatcagcaatggaggactcagcagaagccgagaccgcagcgggaaggaatggtccaggagaggctggaatcatgaaggtgatacagcaatggctaggcagcgctagaagcacaatgaaaggaaaataccctggcttcttcctttctcctacttcacagtcttttaccaatgcttcccattggccaagacgaccaagactaccaggaaaacagaacaaaggagtctgagaactgtagttccctgagatgcagagttacccttaagaagcccaaggaatagataggagaggaaacaggtgaatgtcaccaaattagctatagctagactcaccgtttggaacctccgcttagcttgagagatcctcattgaaaaaaaataagccttaagactaccagctgctagaaactaatagattgaaagccttgattgcaacagtccatgagtcctccctgagctgcagagcaaaaatattgaatgtatttttgagccttcgtatctcagtgatgaacttgctggtgagaagtcacatttacttatccatgaaagatccaagaagtttagcatgtgctttcagtcaaagaataggcttcagagaaggaaatatgtgagtccatgaagcacctgttctcagagaatagagggacagatgaacctgaaataaaacctgaaaaaagcttggccatcaaaatgatcatttcagatgtcagtgattaaactttggctaccctgctttggatcacaattgatcttaactccagattttctcatgactaatagtagcacttttctaagcctttatctgccaacccatatacatcagcttagttttatatcctacttagtggaacataaaaatgatgaaagctaaatgatcttccaagagaaagaacttagatttttttcaaaacactgactctattagtttaataatacttcagttcagttcagtcgctcagtcatgtccgactctttgcgaccctatgaatcacagcacaccaggcctccctgtccatcaccaactcccagagttcacccaaactcatgtccatcgagttggtgaagccatccagccatctcatcctactgtcgtccccttctcctcctgcccccaatccctcccag

SEQ ID NO: 45478 - DNA, 809 bp, Bovine  19866880645167
ctttagtatagtcatactaaattgattcccacaacaaaattttagaacattttgttatcacccatcctaaagaaacaccatgttcattagcagtcactcctcatttcctccaaccacttcagtcctactcaacctctaatctactttctgtctctatagatttgcctacttttgacatttcataaaaatggactcatgatacacgctctttggctgtctgaagcttgttgcttggtatatccatcaggaagggctcttggaagcaatacttcccaagttcctgcatgaagataatagtttgtcagtgcccttcacacctgaaaagtcagttttgctgggtataaacccttgtttctcattcttgctacagctgccagaattgcctttgagtttgtcattaaaatgggagatttgtttataacaaaaagcaatctgcattcaaattttgcataagaaaggagttaagactgtgggtgttcataagtaaagaaccagtgcatattcctcattgtttctgtgtctacagcagtttattgttttccttgcagagcttctctaattttcagcatctcccttccactaacaaccagccaattcatcttccataggacacaaggtttttccagagcataaagaggccaactttcctatttctattacacccccaggtatttacatatctggacaacctaagaagcacaaatctgtatttcaccagaaggagttactgaatttataccccaaaacaagaagttgtgagttatgaggaggaaacttctcccacacacccactcctccaatttacaaca

SEQ ID NO: 45479 - DNA, 1490 bp, Bovine  19866880659142
tgaaagaacaaagtgcacttcaacctaaatgtgtcttcctgtgataacacataatttggtttgatttaaggggcaaatttccgttcttttcccggcatacccttaaagaagggatttgaagtaaactatatgtgaccaagaacttcaagatctagttttccaggccactttgaagcctcttatgtctactattcatataatgttagacagcattcagtttggttctaaggtaacaaatgtggttaattgtttataaggtcctctgcctatgatttttgtttttataacagtttaggacatcacaacagttcttgaatcatacatcatcattacccagtgaattcaacatgtcagaagcagatacaaactccctaagtttaagaatagaagggtataatgactttggttcattagatttataaaaaatactatgaacataaccctttaaaactgttttgacaagtcatctgttgttggcagcatttatataaaaacagtagatttggaaatatatatttagctttatcatatgaaactatatatatttccacataaagtacttttctctgaatctcccgacactcatgtacaatatttgtggtagacattttctagatagctttttcagatgaggttttttaaaagcaatcttgaaaaggaatgcattaactaaacgggacaaaaggttctttttctttgatgagagctatgtccttcctcaaaaagtttcttatgttccagtaaattaagtgtagaatattctcatcactcttgctgctaatcaagacattagccatataatacagaattatgcagtgccttcatagctaaaacttttatactgcactttttaaaagcatttattttgaggaagggaaaggggcatatgtctgaatatggatttgaagctgtatatatttcctgtcattctacaaagtgactttgtgaagcaaaattttgctaaatgttaaactctgaagtttagtataccagataattaaaatactgtccactaactagttcatagactttaaaagtaaaatacgtacgactgttaaaacaacatgaagaaaatttcatttttgtctaattgcaattaaaagaaaatgttaaaatattaaaatgaaaataaaactaatactttccaaccaagagctcagtgattaatataacaggaacacaatacatgcttattagaaataaagcatatataagccaaattaccaaatcagttcacagctgagtttttatcctgattaattatgattgatttgtactgacatcaaacagttaggtttttaaatcaatttgtaaactgacagccaattttcgcagaagtttgaagcttaaaaactattctctcttatttaacattttgatggttctataattttaaaaaataaagagtattcaaacattagaaactaagaaactagaatgcataggttgttttttattttttatttttagctagacactgcctgaaataa

SEQ ID NO: 45480 - DNA, 2192 bp, Bovine  19866880709872
acatcctgtgtgtgtgtgttcagtcattcagtcgtatccaactttatgagaccccttggatggtaccccaccagacccctctgtccctgggatttacacctggcgagaatactagagtgggttgccatttcctcctccagggaatcttccagacccagagatcgaacccatgtttcccacatctcctgcattggcaggtggattctctaccactgagccactggggaagcccacagaggcatcctgggttttactaattcaatgccttgcctgagtccaaaatggaggtgcaatatacctaaaaccagaccattcccactcctggttcattctgcctgggacacccgcatccctccctgatctcatcttctagtctagaatccttgggtgaatcatctaggacaattcactccctgctcagcgagctaatatatcttctaaatatcttcagtgacacatgtgtcacataagtaaaagatgccagtgagtgcctttacaattatgttcaatacgtacatatgcatggatctgtgggcatacatacataaattgggaaataaatttgactatacagctgtctcccttatagccttgaagctctttagatgagggactataccatgtgcattttggtttcccaagggtctagcaaatccccacatgggatatgtttgtagaatgatgttattttggtagtaatataatttgcaagtcactttctcagaggataatgaagaaacgggctaaattcacctgaaaccaataggatcacttaggcagacagaattttagtatttaaactgagcattgaaaagtgtctaaacataaagacagcctaaagtcatttcttaaataccatttcaataacatcaactaaagtcccttttaacaaccattctgaaacatcataagaacagaacattttttcttgatcctagcaagatattacctagtatctgatacataaagattaataatattcataattttattccagtaagtgtaactgcaggtactattttttcacctaaatcaagtatctggtatttttttgaattttaatttatctccaaggaattctatagggactcctaatctttctgaaatcacagcattcatttttgggtttttttttttttttttccctttttttttggccaggcagcatttgggatcttagttccctgaccagggatcgaacctgcatcccctgtattggaagcacagagtcttaaccactggacttctagggaagtcccacagcaattgattttgttatttataaatccccatctttctgaaatgtagtaaatacttattttcaaacaaaatggcacatctgttctctaatcctagattgcaggaattcaaagacatagctttaacactacaagttgctaattgctccactgcaatttctttaaacttaagaggctttgtctgttattcattccaaaaaagttactgagggcctgataggtgcccagcacaatgctaatcttgatataaaaaaataatgaattttatcactgggtagcatctaccaaattttcttattctttgaattacctatacttttattgtcagtagtcacaaaagctcagaaagctgtattagttttatacacacatacatatgtgtatatatgcacacaaatattctccctcctctcagttggtatggctagtagccagcctagccttccaaatgtccagagaaacagtatagaatcatgattcttctccaaaagtgaccatcaattacacaatggatatgtttttaagtatggtggcttagttgctaaattgtgtctgactcttgtgaccccgtagacagtagccctccaggcttctctatccatgggattttcccaagcaagaatactggagtgagttgccatttccttctctaggggatctttctgacctggagatgaaacctgggtcttctgtattgcaggttgattctttactatctgagtcacctggaaagcccattttaagtataaaaatctattattagtgcttaaactcaatatatgttggggatttctcaaaatcttcctaaaaaacaatatggcagtaaaattcacctgatatcctggcatgaagattctgcttcatggagagaccttcaggctgagaaagggactggagaatcgtcaaggctgatcttctcagtgcattatcaaa

SEQ ID NO: 45481 - DNA, 1575 bp, Bovine  19866880734008
aaattgttttagcctaatggaaacagatgtggggagcctgaaggaatcattcagatcttttactatccaacaaaacatctaactctatccttatttcttaaaagggagagaatctcttgaatgcatcagaggatgcttcatttaacaaattaacgtgctttctagattttgatgtggtccttcttcagtaatattttcaagtaaaatgcaaagtatccccaaataggacctttcattattaatggtttcctatcttttaattattattgctcattcttagacagaatattctagttccttctcattttgctatacaagtagccatacaggtaactaataaattagaaagggaaggttccacatcagaataaaaaacattctcgccttattatcagaaagaagaacattccattccactcccatgtaatgtttcttgcatggtctggtaagatagtgttatgttcaatatcacaaaaatcaccagttactaaatattatagttcccaatggaaaatcataaagtacttggtatttctgagaatatcaagtcacagacttcaggttcacactcagaaacttagctgttttcaccaccagataatatttaagacctgtagtttaacctttgagaatagctgatgaagcaaggcatatgggggatttgagataacaatgttcctatgaaaaacaaaacgtccccctacaattttgagatgttacagaccaaaatattatggaataatcagtacaacacacaggaatttgaacatcctaaagacggaaatagatagaatcatgatgtatggggaatgccatacagggagccattaacagagacctgctggaggcactttcagttttctaaatcatcagactctcaaggtgcctgaccaacattaactgctaatagctaacctggaggtagctttgaagtcatccatggtaagggaacaatgattggcttgtttagttggcacaaggacctcaaatttattttgtctcaaagccactttcatagtgtactatgaaatggcaactgcttaaaaaactgtacagtaaaatgaatgaaaaaggaataatgaaaaggagtattaccttagaaaagtctggttttactggcggattttcccttaattctgtctcggtatattcattatttacataataaccaactctaataaactcttgacctcgataggtgcacgttattagcacaactgttacacctacagcatctgcatctggaatgagtcccgggttaggtgcgtcagcctagaatcatgtaaaaaaaaaaaaaaaaacacggcacaaagtgttgttaaccataagcaaaactggagttttggttacactgagcaccttcagtcaagggcacagcaaccaaaacttggaaatcatactgggaaggcaaatgctcatttttgaaactgacttatagctagaaaatatagctcatacatttctccacaatatgcctaattacctgaaaacatcaccatgtctagaggaaaatacatgtggctactgtgtgtgcggctaccgtgtgtgctggttcatgacggattatgcaatatt

SEQ ID NO: 45482 - DNA, 796 bp, Bovine  19866880773302
ttgcttcttggacaggctcaccaaactattagatctgagaaattcaaaaggcaaagcactgaccttgagcagggcactttgcaaaaccatctctcaatatcttcggacagaggaagataaatagaatttaggttctaagaacacattgctggatcaataactggttgaacagctgtaacctgtaagtgactgatgtcttgctgaagatatatttatgatgatgtttgacatggctcagtcctctactttgcaataatttttatcagatatttatagaaaagtcccagttatccaaagttttcaaaggaggaaaagagaatgtatagcaaatgaacccaaagctagaataagaatataaaatcaacatgcttcaataggcagaaatgtggaggactgttcttaggtttaaaaactaaaaaccacaagtacaaattgagagtgataagatttgagggttttatttattagattttattattagacattacctttagacataagaagtatggctgtgtgagcaaaaataaattaataatttccttcctttttccttatcagtaattttgtggaatattaaagcttctaccaatatttgtatgatactcattcagagtgatacacatcacagataaactattactatggtaaagttctctaatcaaattaggtattaggtacatattagaaattagggaatacaactaaatgaactcaccagagagtcatatattatggatgatttttcctaactctaacctagttattggctcttataagtaatttttcatgatccttc

SEQ ID NO: 45483 - DNA, 1995 bp, Bovine  19866880806052
tgtctgactactttgcgaccccgtggactatagcctgccgggctcttctgtcctggaattctccaggccagagtactggagtgggttgccatttcctgctccagggcttcttcccaaaccaagtattgaacccaagtctccggcattgcaggcaggttctttaccatctaagccaccagggaaccccaaggcatgttcactatcaattgctatttatggaaccccatgtcactgacaagtaaaattggtcttgaaatttttcgtttcatttcttttataaattgaaaatgttcttggctattcatagccttagctaatcagtgtttatggaattaaagatgacagtcaaagaaaattttaattaaaaagattcttgtctgttcattcatttggtttaattacctggccaatgaacaagttagcagtcatgtacagatgtgagagttggaccgtaaagaaggctgagcactgaagaactgatgtttttgaactgtggtgctggagaagactcttgagagtcccttggacagcaaagagatcaaatcagtcaatcctaaaagaaatcaaccctgaatattcattggaaggactgatgctgaagctccaatatttgaccatctgatgcaaggagccaattcattgacaaagcccctgatgctgggaaagaatgagggcaggaggagaagggggtgacagaggataagatggttggatagcatcactgagtcaatggacatgagtttgagcaaactctgggagatagtgaagaatagggtagcctggtgtgctgcagtccacggggtcgcaaagagttggacatgacttagcaactgaataacaataaaaatggatgagttaaattctggcagagtttctactactccaattcttagccacttccttaaagactttttatatatgtgtattaatgatgcaaagaactttacagtatcaaaattcatcttataagttcaacaacttttattgactggcaacattttatgaaatttttggattaagttagttggaacttaggatagcatctcttgaatttttaaagcaagacaaaaatgattataactagccaatcggcttcaactttgtgctagtgactgtaattataataaaaaaatctacatttacttatgaaattttacctgggggtgtaaaaaaacctcatagtctattagaaagatgatagttttatatgctattaaaatgagtcatgctgaaatgattgcttacaaggggtccatctaaatgataatgggtacaaaatgtaggttatgctctgacagtagaggtcctatttccatctggcaaatctaatgatacttgaaagatgttaagtcatgaacaaactaatagcccaattagaacatcaaataatccatgaccctactggtttattttatcttacacctttaaagtacttttggtaacaattactaatctctatgttccaaaaagatataacctcagaacctctatagtactgtagttgtttttagctctcttggggttatgtatctgaggagtattcatgcctaatgttgcataaaaattcctgggattcatagctctctagaaatcctgttctgttaggcatagaaaagaatactaaatgaaatggagttcactttactaatgctttgaaaggtatgatttataaatgattctttataaacattgctgtgacttgatatgcagaaattttaattcatacccaggccataacatttattaatattttcttaggataaaccttcagaaaatttgcatatacatctggtctaagacttgagccagctttattctatcattcagtcagtcagaaaatgtatggttaacaattactgttgtggccatctataaggaggtcacaatacatgaaatatttccttcaggtttattctcttacattcattgaagagctagttataaattttagatggacacaccaatttgctcatcagtgtggggatttttacattt

SEQ ID NO: 45484 - DNA, 1528 bp, Bovine  19866880899386
tttgtatgcccttgggtaagttactcaactctcagtgctctgtttcttcctatataaaatgaggataaaaccaatatccactcttactttatagggctcttataacatctggattaatatttgtcagcagagactacttccccttgttcactgtttctgcagcaccaagtgcagtgcctcaaagtaggtattcaatagcatatgctgattcactcaatacatgaactcaacagatggtaaattatcccaattctcaggaattttctaccagtcccattaaatttaaaattctttgctatagctgcctcatgatacctttctaaaggacatcatagtaatttcaaaagaaaaaacatacacagaaatattcctggaaaaatatagcatttgtttaaatcacacacatatatacacatacaaattgagtattagaaatccatgtcaatataattcaggcaataaaaatgatacgaagcactggttttaacaggtattgtaaattatgaaatgattcaacataaatctaaatgtaaacatattacctcatttttacattaggttttacaaaacaagaagtacctggccttatgaaacactttaactgaagagaatagtggctggacgaaaaacatcaggtccacaaagagggctcaacacagcaggtgatgccaaagagcaacgaccagctcacccaccagacaactcagggctggtgacaggtgcttctgttctataaagtactttacgtctgtttctcaactttgctgtttgaaatttggaaagttagacaagtctagaatgatgtttcttagagaaacagaatttttgcagacatgtgctagaagagtagccttttacttgaaaagttagtgaagatatgtattcctatcccacgatgattcctattcctatccctatctctacttattaccctagggccacaggatagaagtcttttccttgtggtgcaggctaattccagtttgggaacccttcaaaaaggtctcctcctcacaaattcctgtcttcttcttctcctggcagttgggaaggctacacagtttaacccaagtcagtggccactggggctgtcattaacacgatttactccaggcaggcagaggaaccagagatcaaattgccaacattcgctgcatcatcgaaaaagcaagagaattccagaaaaacatctatttctgctttattgactatgccaaagcctttgactgtgtggatcacaatcaactgtggaaaattctgaaagagatgggcataccagaccacctgacctgcctcttgagaaacctatatgcaggtcaggaagcaacagttagaattagacatggaacaacagactggttccaaataggaaaaggagtacgtcaaggctgtatattgtcaccctgcttatttaacttatatgcagagtacatcatgagaaatgctaggctggaagaagcacaagctggaatcaagattgctgggagaaagatcaataacctcagatatgcagacaacaccaccctta

SEQ ID NO: 45485 - DNA, 998 bp, Bovine  19866881017328
ggtctgttgggccattgagccttgcctttttcctttttaaattactgttgtatttaatctttgaggaaaaatatttcaagtttgactgtgctcagaatctctgttttacatagaggcaaaaagaggtgtttttgttttttgcccttttccttcttgatattggaaaggcatcgtcatcaggaagatgcttctgaccctgagattgtagtagatacccagttagggggatacctggagggccagtggtgaagactgctcttccacctcagggggcgtggattcaatctctggtttggcaactgagatcccacatgccaggtggtgtggccaaataaataaattgagataagaaaaaagaaaacctagttaggctggaccttggtagcgttggttaaagcattgctctgagtttttatttgatattcaagttaggtttcagacatcagttataaagaccaattcttatcacaaggattctggctatttgatgttgatttaaacaaatctgtaaatatccacagggccaacagcatccaaagggctggattgctaattttcatcacaccacttgggttttctaacacacttttctgtaaatcaatccaattactttcatttgattttaaatttctttctatagggacagaatttgttaaactctgttaatccatgtgccctcttttctttctttaattttttaagctgcttgtgtcggggccaatgtgacagattgcacaggacactatggagacatctgggtctggtagcaatcggatctagagcatttatttctattccctgggtaagatccacaggaatcaggcagtctttcatgaaatgcttattttcgaaacagtatactctttactgatttggaggttccctaaaaatctcatcctggagcttggaaactttatcctaatggtagttctcagattttcctttgattctatgtaaatcacatagattatatttattaataacagggaattagcaaa

SEQ ID NO: 45486 - DNA, 1834 bp, Bovine  19866881018124
tggtatgaaaaagaattaattagtatattatttaggagtaatagtttgcaagtttacaaagtaaactaaacacccatatctccatagattttgttttgctttttgtttaaaaaaaagtgcaaaatggaagccactcctttttcattttatctaagcaaatgtaaacctatctggttgtgcatctattcccattaatcgggcgttttttgatttctgcatgacctgcctttatttattatacatggatacctccacagtacctatgggcacagagttcataatttcatgtcagttgattgatgaacattttaagttatcaaaaggtacaaaatttggaagcagtgctatttttgtcttatgcttgtgtccctctaagcaaggtgattaatttcttttaacctcagtttccttgtctacaaaatagagacatatacagttgcattctagaactcaagagaatttttttcctattctttttcccatgccaaaactaaaaattttaattttcttattatgcaataaaactattctcactattgaaaaatcataaaattagacaaacaaaaaatagagccccattaaccctatctgcaaagagttggacacgacttagtgactgaataaccacattcctatccacccaaacacaattattcttaacatcttaactacctctcttctaaatggaattgattgcatttcttttgagaaatggcatctttccatatacactattttgtaatgttttaaattcatcctcagcaactaaatcaacattaaatacatcattcaacatcagaggtcagcaaacattttctgtagagtgtcaggtagcatttcaggcaggcacatatctcatgtcgtgatttttaaaaataatcttttaaaatgtaaaaccattgttaactctggtagtacaaatcaagtctcagactgaatctgtgctgtaggttgttgacttttgttttatatcagtggatagatctctgtatacaggtgtatggatatgtcagaacttagatacaagtcccatatcatctgacacttaggtttccactgtctagatgttgccaacagtagtgaataaacatccctgtacatacgtatctgtatgcatgattatttcctcaggttaaatatttgagtgtggaatttctggtcagagggcatttgctccttcacttactcattaactctagctgtagggtcaaagcagccatagacaaagtgtaaatgaatgagcatgtctatagtttgccaatccctggattatactaacttgattgaaagcatcaagcattaaacatttttcatttaaatgaagagatttaaaaatatattcatatatcctacttcaggacaacactactgtttttaatagatcagtgttatattcttatagtaccataaataattcaatgaaatgtcttgtattaacaataatcagaccagaatacaaaatgtcacataactcaatacttttcttattagaagacttttgaaaatatcaactgaaataattcaggacgcatttcctctttaaaatatgagcataaataataacactacaaaacataattcatcttgtgaactgtggtcactcttgtactatgtgaatgtttttaaaaataattacacacatagacacacacacacagatacacacttcaacacagcttaaacttcctaaattatgagcattcaaaaaggaacctgtactataattttgaccttttagagatgtcaagtcatttattcaacaaatatttattaaacgcctatgaactacatgtcaagtttcacaagggacttggaataccaaaactaaactttg

SEQ ID NO: 45487 - DNA, 871 bp, Bovine  19866881088272
catggttcctccttctattcaaatagttcctcttgctacagctcagggccctcccttgctcctgtctgcctctgcagaccctatctgtcaagacccagctacaatccctcctcttctggaaagcttcctcagcccgttccagcccacaggtatcttgtcctcccctgaactgccatggtatttactgtcatttaatcattaatcattgtcttgcctgtcccagctctgcacacttatgtagaaccactgtttatatcttctgaggttatttaacttatcacttttaatttgtcttctaaaccagactgtacagtgataagagcaggaatcttaattttattcttccttatttgccctgtaaaaccttcccgcagtacaggaattcatcaggttattgtcaaataaatgattgaaataatttagaaccaagccttgaaggaggaacaggtacaatttttcagttatctgttctaaaggatgagagcttctttttgttgttgttaatcttttagtgaaaaatagaataacagaagtatttctgaaaaacagaaagtatttcagacagagtgccgtaagttaggaacagtagaaccagcgtgaaagtaacacggaacagacttaatgaccgcaatagaccccatctgcccaacatccatttactctccctcctggcaaaccctggctttgttcaggtctccattcttttctgcacagtcatgtgctttaggggaaataacttaagcctcattgccagggactgaattccaaatctctaagttaagagaatcccactaaccttgcctttagttgttttaatcattctaaccaatgagaactgaggcaaagtctattgagggtttcgggcaagact

SEQ ID NO: 45488 - DNA, 915 bp, Bovine  19866881104881
aagattatacatcatattcagcaggaagagatccatgaaatgccaggataatccaaataacacactggacagatagaaagcttacagatattccgaggattccgagacctgtgttagaatattcatgtacaaagtagttcttctataggtactgtctaaaagttagatctaagtagctcatttgctctaattaaaagcatatattaccactatgatgctcaaagactaaaagaaacaatcatacagcggtttcttgaaacatacaacaggtaagggtgactattcccaagttgccagataccctttgtgggattaactggtcaatgtttttataaacatgagaacttaattttataataggtctttccagattctccttcaataccagaggaggtatatttatatacaaaaaacagagctgaaggcagggatgtgggatgacttaactgaaaacactcagtcttgaatggaaagatggctggtcaaagctttaagctctaagaatcataggagagttaatatactagattgatagggatcactgagtattttttccacacacatattcccataagaaacacaagcaaactaaaacgtcacctccacagcttcccaggcccatttcctgtactttggatcatgagtcagtcgccacatgtacatgtaagtctcaacaacttctggccgtaagatgtagtatttctcattttgcctcgtagcaatggcttcaacaccaccatcgaatctgaaagcttctggtcccagtttcacaactaaaagacatgcagtgggggacaagggttattgtctctgacaatgcttagtgtctataacttaaatgaaattaaaagatactttagaacactcaagaggggtgccaaaatgatcattttaaggaatagctataaacactgt

SEQ ID NO: 45489 - DNA, 3033 bp, Bovine  19866881174580
tacagtagagagctcctggccaagtagccgccccagcaaaggcaccacatatgtgacagaagctcccttcgaagttccgatcccagctgagctcccagctaaatgcaggtgtacgagtgaccccagctggtactatgtggaccagaaataaacatcccctctaaacgcccctgaatttctgactctcagaaagtaagcactaaaagggtacggtggggttttttttttttaagccactgagctttgatggagtagattatgtagcaccaagtaactgaaatctcctacatagattttccacttactttacacttctttcatttcactaaatgccaaacaagcatgttccattacatgcctttcttggttttcttttctcacctttcaagtcttctcagttcttcactcaagaggttgggcagctccagcttttccagaatgagttcacactgcgtctggtactgctgcagagggttttcgggaaaggaagtgtggagtgcattcacacctcctagcagcgcacctccctgacaggatgagaaaatggaaaataccagggagagtcaccaggcctccacgctagggaccactgatcccaggtgcttaagaccaacccctatacccctgtcacggctctcagagtcatctgggagcctgattcaaatttcagtagtcctcttccccaatttccagtggcatgcattgctctgggaagccacactgtcttgagtggaaccatgagcatctctcaggtgtgttgaggagaagaaggattaagacccactactttacaccagtgggtaaaacaatgcagactgtttccatgacaatttttttcgcttcttttaaatgggtccctttggataaatttccaggaatgaataggtctaaaatatggccatttttataactccagatatgttataaattgtcttttttaaacaatgtttgcaattacggttcaaatgttaggtacaagatatgctcacctgcatggaggactccattaccgacaccactgtaacagcatcttccagagtcactgtatcacgaaacatcaggcgagcatgagctatgaaaggtgcactttgaaatgatgaggaaattatttttatgaatatctgaggtgacaaatgtcattggtgccccctactccaaaactgtatattattaatgtgcttctaataacaaatacattttactagaacaagcacagatgtctaagttcaatagctttaaggttctttctctaataaagggcctaattcttctgcacagcccatgacaattctgtgtattcacatgaaaaagtactctgggctccagcaaacaaaggggctatataagcatataattgatattcagtaactgttaattcttactctctaattaattcttaattcttcttaattctaatctattataatctaaacaagactaaaattgatttctcatctctggtacatctctttatctgtcagcttttcaaaagtatcaaacttgcaagcctaaatcttaggtatttcttgccttaatattaattataaatccttgaaaaagtgaagcagttttgttctatggaactttttagttaagcatatatcacatcattatatcatacagttaactcatgtgaaaaaaatttttaggattatttaagtaagtgctaaatgtaaaagccagtattaagggaaaaaaagtctgagggtgcatattagctgcgagtatgcacgcaagtctcacacgttagggatgggacagaggacggcattgctaattcaacgttactgtgttagtggcggctgtgagtagcaactggtgagaaatcacccaggatgccatacagaaaacagttcccaacaaaggcatattcagatagaggccatcgagaaggaaaacatacagcaagcaagactttttaaatggatgatgtctgaagttacaggaagttatgaaatgtcacaaagattccttttccttaatgccactacattccactcaacatctataatccgtgtaggtttcatagcttcaagcttttactttttaaccaactgtgagcaagcatctcagagatcatccttactcattgccaagtcccaagccttgcttactttgtgtgtttagtcttagtcgtgtgagactctgcgactccgtggaccgtagaccgccaggctcctctgtccatggaattctccaggcaagaatactggagtgagttttcattcccttctccaggggattttcccaacccaggaatagaacccaggtttcctgcattgcaggcggattctttacagttggagccaccaggaaagccctagctcacagtgagcacccaataaaagtatatgttgagtgaaattaaccttctgctagtcgtatcaagctctccagcaggcggatggtggtccgggcagcgttccgggagtcactctgcctttgcatctggtagtaccggagcagaacttgattaccctcatcagacagtgtgggctgtagtttcctaatgaggcagaagtaggatttcatcttttccatgctccagagcttctctgatttgcttgggtaacctgtatatatcaagtattgggtcagtaatttctaagaacaggcaaatatctcattttgagggttttgacaaagttcctgtactcatttttaaaaggataaccttctggttttctggccactgaaatctagacctatctctgcatatagctctataataaatagtcttaggctctaagcttaataaaggtaagcttcctacaaaggtttaaattattcagaataattctgttctgccatatacaataataaatagtacttggtaagcctaattttttgacaaaagatccacatttaggattctgctttataaattcagtccagttttctttgtgtacaggacgtgaaccacgtggtcattatatatcataaagttgcccttttcaccacaaaggacatacggcaagcaaaggaagacccttttccttctgtgcatgttctaggctcgctaactaggttcac

SEQ ID NO: 45490 - DNA, 3927 bp, Bovine  19866881240486
ttattgaagaatatttactggcaaataacatgtttagtaaaaaaacttaaaagcatatgcaatatgatcttaatttttttaaaatgtatgatacatctataaaatgttggagaagcattcagaaaaatttttatttatttgcttattttgaggggttaaattgggaggaaactgttaaaaccatctgatcatgtttcaaatccatcctaaggaacatggtaaaaagatgtgggcaaatggtgctgtagaccactggagatgggaatatgaacaaatatttcctccatattctctcatgtgcaatatcggtttttgattttgactatcttatttaaaatttatatatatatatatatattattttattatttatttattttgctgcaccatgtggcatgtgggcatgtgggatcttagttccccagccagggatcaaacccgcacccctgcattggaagtgcagagtcttaaccaatgggctgccagagaagtctcagttttgactatttttaatgaagagttttctacatgagttgacacagctgatcctaaaagaatggcaggcggggagagagccctgctctgccatgctgaccctggtggagcatggcactctgtggataatcaggctccccaaagcagttttcaactgtgctatgattgtttatctgtattctgcattgtacagcagtacattatttctagatgggcatatatctgcagaaagacagggtttctggctcctacatggaaaaccccagacagaactctctgccattgtcactgaacaaagggctttggaactggttcgaggaggtgaagtcaagtttgttcccttgtttctgtctgtgtcatatagtgtgcgggcacatggagggaagggtggtcaccccgatgtcaccacatgcttgtgtatgcgcgtgtgcgtccgtgtgtgtttgtgtaggcgggtgcactggttgtgtgaagaggatgcagatggtttgctctatagggtcaaagggcttgagccatgtgagtggacattgtctgccatgatcccatttaatagggatagttttgtttgtttgtttctgatggtggagggaggggacggattcatttgagcctctttgtgcttccaggaatcaggcagctcggggagctgggtcctgataatcctgagtgagcaaaggagtggggcgaggtgttcacgcatgcgtctgtaagtgtgtgtgagtgcttccagattccactgtgggaatcccctgccaacaggccttaaataggacatctattagagatttagtccagtatccctttcagatatgaatgaggagaaaaagttgggaaacccacatccagctggcagaaaggtccttccctttgctgattcagatggattgaaagctgcctctacagtacagtcctttcagctgccggttggaagctttgcctcatttcagctgttcatggagaaattgatttttctaagaacagaaattgtatgcttgaagccaaactttcctttttctctttaagatttcttgaaaagacttaagaaggttaaacagttactacatgaccaaacggtgaaaggcataagacagtttagagtaaataaggggtcttatgaaaacaccaggatgcatacacagtggtttctgtacgaactaaattgtatgttttcaaaacataattgatattcttagctgggatgatggttgggtcccgtcagccaactgaatgtactggtgccagcctgaaagggataacgattaaatcaaaagaaatgacaccagcagagatggacaaataatccatattaaaataccaacatgaactggagtttaggaattgtttataaccttgaaattcaacaggaattgcacatattagcacacatataagaatacacagatgatggaaactttactttgcactggtttaggaaaatggtaattcttaggtggaattgtgtatctctgtttaggaagattataataatttgcctggtcttggaaatagtatgaataaaaagagcacaattcataaatggagatcctctttttcccctttcactttttcttaacatatattttttaaaaagtaactattttagaaagtaaaatggatacaatttgctgatggagtatgttgttagagaatctatatttttgagttaacagttcctatggaaagaaatgcaaaattctttcagctattgaaaagcattggagtgtgatggcaaagcttaaataatgtcctgggttttttggtcagggaggggcttcgagatgtctcttgtgtaccatggtaagaacaaatatatacaaatactttcatgacactggtctatctttctctaaatgtttttgttctactgtcaagtgatgtgaaggaaaaagagaaaactgcaaactcataaaaatcccatttcttcatttcaagtataagttttgttctagagacatattcaaagtggagaataggaccaaagatgttttatgtttccattcatctttaaaatagcctctagacactgttaagttgagaccggacaattacttggcacataacccatgcagacagcaaccttgatagaattagaggaaatccttctccaaggatgaagtgttcttgaacaattcatcagaaacattaggcacaaatgcaccttttttctacacctcatgcacgccaaccttcctgcttgcccattttcatgtattatgaatggttttgtttgtttcatgttttctgggttatttccacagttatcccttcttcaagactcagatccagcagataaggaggtattccacacacgtgtaattcctacctcctccgagcatttttcttgtccccccattccctgctccagggtgcttacatggcattaacaattaactacataattgttcaagtgtcataactatttagaaaaaaacccaaaccctttatttagcttactttttttccttttgctgaacaaaatacatgctctgagcatggattttagaagtaaaaaacagcatgccagcacagcgctgggtcttaccttatgctcaagtgatagaatgaatggctttcctactaggggagactgttagatgccattgtgaatatttcaggggccaggcagacagacacacacacacacagatactatatgcttaatataagatctaatacaagcttaatataaaatataagcttataaagaaccagggctatgatcttaacaatgtcctgatgagcatgatgccattagctgctctgacccaagctcctgcctaagaaagcatgaatttttgactcctttccacttcagttctgtgtcaggggatattctggggctcagtctcctgaagtcactctctaggttttgcctgtttgaattcttctagattttgagcttcagattccattttcctatctggccttggccttaatactttagagtttcccttgctttccatcatgtccacatgtgatattttgatttataataagaagtatatatttgatcttcatccctgctcctgacacagagctcctaaaactctgtaactttctaaccattgagcatgatcaaggtgtttttgttgtgttaataatgtgatttttggaaagtccctaagtaacctaaggtggaggctggcagtccatggaatgaatcaagagattagagggctggaattttcaggcttttcaaccctcccctcccgctccagggagggaagttgttgttcaatcactaagttgtatctgactctttgtgaccccatggactgtagaacgccaggcttccctgtccttcactatacctcagagtttgctcaaattcatgtccattgagctagtgatgttatctaactatctcatcctctgtgactcccctctcctcttgccctcagtcttccctagcatcagggtcttttccaa

SEQ ID NO: 45491 - DNA, 840 bp, Bovine  19866881247380
aatcagaaactctgatagtggggcccacaaatctgcattttaataaggtttcctgggaaatctgatacatagcacagtttaagaagcactgacctaggtgaactcaggtaattcaataagaatgggaaataaattgattggaacgaataataaaaatatttattgccatgggtatgatgtacactgtttctgtagtgaactaagcaaaaaaatctttaataatcttcaagtttagcaaataaaagaggtattaggccatgtgatgctgaatctgcagtttaacagccaactctccatttgctgcttgcctgatatttaagagcaaatgggacagccaattcctaaacgaatagcagtcatcgcggcataatttcagtcttatgtgcttgccactgtggtttaggagcttattttactagttaagtcatgtctctaagtcacttaatagcattagaatggaaagacatggtcaaatttatgaggccaagaatgaacctcctgtgagtactttacaccacattgagaatctaattattggttaacaacacagcatttattagttttctctctcttcatacagactctgaggcaaatcagcacacaatagtattgttttaaagagccatttatatgtaaaatagctcttgtatctgtttttggtagttcataggttaaaaaaaatcccccttttagggtaagactggtcatacaaggtcaaacacgttagaaaacaataaaacaactattttcaaccatgagagctatgccaataccgtagatttgaaatcacataattgaaaagtgtttgtaaaataaggcacagtatatgaacaatgggaa

SEQ ID NO: 45492 - DNA, 1189 bp, Bovine  19866881323195
catttaagaaatgagaaagccaaggctgagagaaagaagagatgtgatcccattatttttaaataaaagttatactcagtaaacacagcatcttaaacatatagtttgatgtatttttgagaaataaatcacactgttaatgtagcagaattgggacttatgttcctattccttctgctgccattttcttacacacaatcagccaagttatagaaactggcagtgtcagatactaaaaaattatggcacatatgtaattcataattcatttattttccaaagtccatttgtagagtgctggccccaaaaaatcactactctgacagcagtttgggacagagagagtgggacaggacattccctagctctctaaggagagagggtaccaaccccagggtctaggcacagaaaatacaagtgagagaacacaagaatgtataataggtttgtccaaagcatacagaagatcatttataaaatcatatgctttaagggtctggcaagtagattcactgacctttgaaagaaatgcagtcatattttaaaagaaagaaacacaaaaaatccaagctctttgtacagtgtattcacacacagctatacgaatgatatccaccttaaaatagcttatgtaacttttattgtacttccagggggatagaatagatttatgcttaaaattttggaaaaactgctcactgataaagccattatagtaattgcactgggtctgtttattaatttgtcacaattaagtcaataagagctttactaatgtcctattacttgattagttttgaaagtgattatcttaagaactagacttaattggaagcctctcaatttacaaggtacattaaactctcagtagcatcttaagattattcaacatatgcaggtcaattaccagtaatcactgttttgtacaaatgttccataaaaactatagcatgacatgacaaagagggaaagtgagatttaattaataatgccagactccaattgacatttccaggataaaagggcaacatgagcattcatataaagtcttcctgaaagggggtctgttactaaaaatcaaataatggaaagctagcaactctacaccttatggatgaagataatttgtcatgattgctaaatcaccaaattgcactgcctctactcatgcccagctgcatattaattt

SEQ ID NO: 45493 - DNA, 998 bp, Bovine  19866881507924
tagtatttgcatatcagagcttaaaatattcacatttgctctctgtttttgtagtacagtgttaaaaatacaatatgcatttttcagagatttggctgacaacaaaagaaggatgaaagtaatctacattataacactacacatagtaacatacatttaactaaccaaaaagtctctaaacacatctgaacagaattttttcagattctgttttctaagaacctaacctcgccattacatggaaagaacacagcagttctttaagcatcttttgtgttagggcgcttcgctacgtgttagagatgcatcagggaacaagacagtctctgctttttaaagtgagtctattatattttggttgctcatgccaaattttaaaaagtactattagattcccgagtcctgttgtggcaggtttctggaattgttaatgactgagccatctcaagatagagaagctggatgggctgaattacgttttataagatcacatttgtgtacttctctgctctcccccttgtcgactctttagtgcgtttggttgaaaagcagggcttgtgggatgaaattctaaaatggctttatttttgtcattcactgcccctttcagtttatggataaacttgacttttctggttgctttgagataatgcaaattgtccttcagtgactaagtcacaaaaatctcaatttggttattaaaaaatgtctagtgccaacaaattaaagccccaaactgaacctgaattaaaggtgaagcttctcccccatgcccacttcctagctctgcccattgcaaggggggaagataataatcgaggattttttttccttctgactgggctttttctgtttctcctttgtcttgccagtccttgtttctcatccctcccaagctggacaagggaagaagggaagagaggaaagaggagcagcaactcactcactcgtgcttgagtagtacctggtgatttaacttcagtgctgttgtaaacttg

SEQ ID NO: 45494 - DNA, 1261 bp, Bovine  19866881931455
atgcaatggtttgaagagtttatattaagattgtatatcaaataaaaagtgtgtttttgttgaagatagtaaaaagtgcttttctgccaatataatacttgaggatgagagtaaatgtgtaaaattcagtatggccaattgtcattaataaagcatttataatgataaacatctcgaagtacgtgtatagtgttttgtttatgataaatgctgagtaatttttatgcctgacagaacatttacttgtgatggtttagttgggtgcacagcatttgcttcaagtaattatgtctttagtcatgcatgacctaattccaacacagattggaataaaatggtgaaaaaaagctgaaataatttcagtaagtaaagaggatgctagaaagaagtttttaaaacaaactggagaccagagcctaggtaatatctttattggatatgatgatttctcaagctgaactgtcaaaataaattggggaaattaacaggggacatttttatttgcaaaagcgtggaaatgaaagtttcagtaaaggtcaagaaaaatgtggaatatggtcattaaagtaaggagatggccatgttacctaatatacattccagttacctatccctgcctttcataccatccaaaaccatgtataaaaccactgccattttattctcttacaaccttgtgttaggaattcagagacgagacagtggggatgatgtgtctgctcgataatgtctggattttcagatgggagaactagaatggctgggtgtgacttgaccagggggagttgaaacaagtggggtggagaatccactttcaggatgactcccttactcatgtgatacctagcctgggatgacttgaaggcctggctcccctggggcagttgactagaggacttgacacatatgtcctctccacagagctggggctttcacaggatggcagtttctggagactgggtgctccagacacatagagagctgacaggcttctactgagctgggctcggaagtctcagtctcacttcccccacattctgttggttacaagccagtcattcactcaggccgtcgtagatttgagagaagagttgaactctacttcttgagaggggagtggcgcggtcacactgcagaagagcatgtggaatgggaaatgttgtgaccgttttggaaaatatagtctgccccaacctgcactttctgggagtagaggggaaaatttaaaccacatttacaggcttttcagttagccacacac

SEQ ID NO: 45495 - DNA, 1682 bp, Bovine  19866880380036
ttacctttcatgtgtgtgggacagtgcttggttaacaatttctgtgatatatctgttaccttccttcctatagagtaacatattagtttgtatgcctgttttttctagcctgtgagcctagtgctggtacatgtcgatactttagtgcttgatgaatgaatgaaagaagtttcctggtctcctccttctactccaggtgtttgttactgaatttcaaagagcattttgtggttcctttggagggcagagctgtacacacattatgcacgcatgctcagttgtgtccaactctttgcaatcctgtagactgtagcctaccaggctcctctgtccatgggattatccagggaccactgctggagttgctattgccttccccagacacacagtataacttctaccaattagaggtgctatgcttggcccctgtacccttcagccatgcagggagtttctagagatcaggaaggaaaagtggtcaggggactaatggctgattcacattgctgtatggcagaaaccaacacaacattgtacattaccctccaaataaaaataaattaaaaaaaaaatctctgaatcatggtgcctcaattactttcaaaggtgcatttgtttagccactttctttggagttttggatgtacagtgagcctggaagatacactgttatcattacctacaggtcacaggggaggctgattgagagactatgacatttaaagcaacttaggcttatttcccaggggtcttgcgactaaatgcaaagggcatggttattgttttagagccacatggaagagttcaagccactctaatacacagactaaatccaaggtgttttcaacttcatttgccaccagagaaatagctgaaagttgatttcagattaaagcaatctagtgaaaaatccagctttcttaaatcttggtcctggactactcaatcctggggattagatacttggagtctcagagaggtggggatttaaggcattctgaaagattctagatcagagcttcacaaacttttccatggcaggagatctctaaaaatgatgatatgtgtcttctcatggctacaggtgatggtttagggaccgtggcttatactagaccccatcagttaccctaaggtaactgaacatcacagcacatctgtaatccatttgtagcataccaatatgatatgaaggcttcacaggtggcgcaagtggtaaagaacctgtctgccaggtaagagatgcagattctttcctgggttggaaagatcccatggaggagggcatggcaatccactccagtatgttttgcctggagaatcccatggacagaggagcctggtgggctacagtccataggatcacaaagagttggacatgactgaactgggaaattcttttctaatctaaaatgtctttgtgggaaggaagcagaatctcattataccctatatggattccttatgtgaagtgagagatcaataaccttcctaagatcttccctgggacctgggtttgatccctaggttgggaagattctctggagaagggaatggctactcactccagtattcttgcctggagaattctatggatagaggagcctggtgggctacagaccatagggttgcaaagagttgaacaccactgagtgactaacgcacacacacacacacccctc

SEQ ID NO: 45496 - DNA, 2043 bp, Bovine  19866880406614
gaccgtactggatgacggtacaagttagacccaatacttgccttcagggagcaacaaaaaatatagaacttgaagattctgtaatgagcttaaaagaataatgttctctccctccctctttctctctcacacacatactcacacagaactttactgacatgggacctcataggctccatcccctgagggcccccagtttacaagtttttgctgtgtgataagcagcccttcactcatcaaagacggattcatctgtcagtggcagaagcttcagacttgcttgccaggtgtccttggcactttccttggggagacaagttaactgagagcctcacccagagcctcatgtgataaagcctgggtcactgtgtgcagacccgggaggcccctctggcccagaacttcccttgaggtcacagggttctccagaagagagaaggcaaggcagaccagaatctctaagcaaaaagctgcacatttcaaagcctttgaaacctgatctccatgcagattaaccttcctcaaaaccacttccatgacactccagtagctccttgtgcctgagaacaaacctgtcttccttcctcccccaggcactgagcccccatcagctgctccacagtggaggagtaacgagtagagaccacagagccagaatgcctggcttctcaggctggctccacctctcttggctcagcctcctcaactgtttaaaaaaaagaagaacaaaataataccgcctcctcatagggctgtgggcattaaatgcactaacatttgtaaaagcccgaaaagtgcctggccctggtgagtgctgtgtgtgttcactgctgtttcttccaaggcgtctatataggtttttgaagcccaagagtccagagccaccaccgcattcaatgagccaccacctcattcaatgcgggcacattgtttacaggtaggaagcctgggaagacaaaatctctgctaaaaatgtgtcctcatcagccctccagggtctctacatgtgactccagtggcctaactggtcctcttcccccaacagtctctagttaatgacagcagaggtagacaggccttttgcccttctctgtggcctctgtcacttgacctctgatagtccggccatgcgtttcaccatacactcactcctgtcttccttttttctctgtaagtctatatctcgcacatctttgagactcatgttctccaaagagtctgtcaacactagcctgtgtgttgattacttgcttcctttgccttcctacagtctttggtctctgataaatttgcacctgatcagatcatggaactagaggcaaggagtgagatcctagagattgcctggccccagtgttctcagcagcctggagtgtgtgtgtggtatgtgtgctggaggaaggaggagtggcatggagaaaaggaaggaggagaagagaggaataactgatatcttgggttggggtgtatttctatttctatattttataatatttggaaaacctccaagaagattttgatgtaactctccaggctgagccactgatggaacccccttcacattgtttgattgataagaaaatgtagggccacagaagttcagtgagttacaatccattattcaagatttgggacaaaaacaggacatgaacctgggtttcttagcactaagcctagggcacattttgtctttatatcacttgtgtcagaagttaattgaaattttaagaagctgaaatccataaattccagagcttccgtcatcattgacaattatgttttgataccaattattatgtgccagacattgatctaaaaactttccattcattggctcacttaattcttaaaacactttatgaagttgatgttgctgttatgcccatttttacagaggaacaaactcaagaacagagaagtcagtgatggtatcccaaaaatgtcctttggacagtgtaaaccacctaagatccatagatgttaatcttataagggaactgtggccacagaaggttatactaaattcctcttggtcaccctcat

SEQ ID NO: 45497 - DNA, 1573 bp, Bovine  19866880410534
tcgtgaaactgagtctattttccttttggttaaaaaaaaattcaaaaatacaccatgtaacaaaaagtacttttgcatttctggaggtcatgatttaatcaaacagattaggtttaacagattaatccaaacagattaatccaacaaggaaagtgggggacttatttaagccctctgtctcactaactttcactagcaacaagaacatgcctgcgaaagcagggagaaaggaaggaggaaataccaaaaggaaggctgagcttcaggacaaattagttaaagtgagtttgactcctaagggagaagaaacactgaacttcagaagagagatgtggtcagcaaattcccttccagattcaacacaagtcctcctagccttctgcatgccctcatgactgtctaaactcctcaaatagctacccagctccagagttcttagtaatcacctcggcacagaacctgggagaacataaaactgccaggcagctatgtgatttagatggtgacctgaagatgaaggcagtttttgcatttctattggggaaaacccattaactggataatttacatttccctctccaatctccctctggtatgaacatttccaagtttttgtcaatgtccagtcttaggaagaacattaacttccgtcatcaccaccataatcatcaatctatattgtaatgtgaggattctagggaagtcagctttgctatggagatgggcagggacattattctagtcttgaccatcgtcagcttactggatggagagcgcaaatcactcaggggtggcactcagaagccataaagcctgccctgggaagccagcatcccaggagtgactcccaagatagtaggaagacagaagtaaattcttaaaatgtctaagtcatgcagttactttgacagagagtcccaaagtcactcattcaagtaatatcttcctgatttaattttgccatgtccaccaaccacctaaaatggtagtcactttcatgtttttaaaccaaaatttactttaaatttttttgcttaatctgaatttttgtcacaaaaatcaatgaaattatgagtttgaaatgcattttattttataatatgcatatgttctaatacatgcataaatattatatttttaaacaataggccgtgtaccacctaaaaatattctcataccaatgaatgctaatttcttaattttgatcattcattacacttgagcaacatgtaaattaggagaagctgagtgaagggtgtatgagcattctctgaattattaatatttttgcaactattctgcatgcctaacattatttcccaaaaataagttatcatttattgggcagtgctgacattgaacaaagtcccacaggtaaacaaaatgtcaagtttcttttcctttaggtttggctagaactttttaaagtcccaatggaaattatgggttattacaagtttccacagagtataacttactgttgatgaagtcttgagaaattctggagcatggtctctaagctagattactggactaaatatgaacagtacctaaagctgagaccaaaacaggt

SEQ ID NO: 45498 - DNA, 834 bp, Bovine  19866880429295
atgcatttaccagtcaaagggaagtggcgtggtctagagttatgagcaggagacttcaagtcaggagccctgagtgttatttctggctgtgactggctacctctctgaccttgaacaagtccaactcactactttgaaccctaagagtccccacctgcctcacagggctggtgtgagagcagatcacttaaatgtttattgtactgagggctagagtggagcaaatgtgggcatgcaggggtcacaaatggaattaagagacaggatctctgctcttacagctcttaccactagcctgttaagagacagtgtctgagaagtgggctgattgctcagatcttggtctgacaggtcttgaggagttgctgagaggtcggctaatggaatttaaaagctgaccaaaaattgagtaagatggccaagccccatcctgctatttagaaagttttcacaagtatgtatatcgtctcttttctcataatggtgcccctgagactgttcatgttagccctgggaccagggagctggcagggaccactgactcccttctgtaggacacctcaaggcaggcctgctcagttggctatccccgactttagaagaaaggtcattctctgtggtgactctaaaacaggctggaaataagctagctcttcatggtagtccataagaccagtaagagtgtgccccagagaagatacattcattctccagttgagagagagagagaaggaattaaggttaatacactttaaaaaagaaagcacgagggacttcccttgtgattccattgtttgggtctctgtgcttgcaatggaggggatataggtttga

SEQ ID NO: 45499 - DNA, 2042 bp, Bovine  19866880435450
tcaactgtcagcatctcagaagcactgccctctgtatacccctccctggtcaaattcccatttctccctccagtccaattcacttcttgtcttgttgaaaaataattttcctttcccctttcgctcatgccaccggctcgtctctggcctttttgctgtgcctgtgcctgtcacttgactaagattctgagcgacacgtcattcacaggagaggcatgaaaccaagtggttcggcagcagggacacacgtgcgtgcgtgcgtgtgtgtccacacctcccacctctgtggagagcagccaaccagacatcctgtgagacatgtcttaaccgcaaagaacagaaggacaagtggactgacgggagagaggcttgcaaacatttgggctgcttcctagcacttgcactgtaccccccctcccccagcctggaccaaatccggtgccttcagtggtggcggatgctcattacattacagccaccagaacttgattactgagtccacaaggttttttttccctttagaccccagattctatcccacctggaatttccaggtggcgctagtgctaaagaacctgcctgccgatgcaggagacataagagatacaggttccatccctggatcaggaagatcccctggaggagggcatggcaccccactccagtattcttgcctggagaatcccatggatggaggagcctggtggctacagtccatggggtctcacagaggcagacatgagtgaagcgacttagcatgcacacatgcaaacggacagatccatttccaatttaaatgttcccttctcaaagacatcttcctcaatcactctctcctactgtgctctattttgatgcttttcttcattatcagcacggaaaatatctcatttatttgtctacatatttctctttatggatatatagtaataaacaatatagactcagtatctaaactgggttagaatgtcagccacctcttactagctgtgtgactttggacaaatggtttaacctccctgggcttccaattcatcatctgtaaaatgggaatataagatttattaaaatgagaatgatagaatcatgacatgaaggcaatgagttaatatacgtaaaaccttcagtatagggcctgacacataagtcctactaaagtgtaagtacttctgtgtaagacagataaggactacacataaagtacctcttttatcagccatgccaatagtaatcatcatcatgattatcatcctctagagtgtaagcatcttgatggcagggtttttatctgttattcactgcagaactcccagtgcctaagaagagtacctgatacataccgtatccataatattctgaataaatagttcctgacaaatgcatcttagaactccaaccccaacagtgcctctgagtacaggagagggccataggaacagataactatagtgtgctgggtatagtacaaaaacagagtttgagtgagacgtgcaggggtgtagaagaggaggcagttaattccttgtcttgggcaagtcttctcttccataaggagagtatccttacgtagtgttaaagcttagtaaccctcaagaaacagaccacagggcaagggaaggttctccacaaaagcaacacagcacatctgacagcttgggatactgaggaaactgcctggagttcaggtagctgaactgagaaggggtaaggaaacagagacatggagaggctgctggaccagatcgtgaagggcctcctctttgtgatgctaacaaacttgggtttttctcctgatagccgtgaggagccacaggagaaccatactaaaggaaagagcgtaatggtgtttacccgtttgaaagatcactccagccagaggctgggttggctagtccttaaaaaaaggagacagggagaccaagtacagggcaaatccaggtgagagggatgagagccagatagataggggctggaggaggagggaaggggaggatgcctttgagagatcagcaggaggtagatctccttaagtccaaattgat

SEQ ID NO: 45500 - DNA, 919 bp, Bovine  19866880442752
aattatcttgccattttgacccatgcttcctttgagctaaatcaactaatttagtacctaaaactggatgaagagtgggcgggattaattagctgcttgtcaactcccaaatcaaattagctaagtaattgccaaatttccatttctgtgtgaatcatatgggaataattatagataagaaaaatgggaaaaaaggtcaggagaggtgcttactgaatcaattgcttaaatttgatctcaggtaatcaaagataagttacttgaaactcagaaaaggttttcagtatgcttcctttcagatgctcttcttttagggcattaagctttgtgatgccagttttacttctgcatactctggcttttagcctttatgttaatcggagaagcatataaaggaaattctaactttacaagtataagactgcagtcacaggcctccaaggtatgttttcttagagttataatgtgcatgttttgtaaaattgttctatgaagcacacgttctctagtgatgctagctcatcagcttgctgctatttcagaaactctattaataaaaagatagcaagcctgataaataaagattgttttcaatatatcagaaaacattccctttaagggaattgtttcctagcaggaaaacaaaagggcagggaatcaggaggtgggacctggccaggggatctagtggttcccagcactgtatctgtaaagtgagcagctgagctgagatgacccctggcctccttttcaattctgtaattccaatcagtgtgatttggggctcggcaactcatttctttcagtttttgtatctgaaaaataggggataatagaattcatccaggctactttataggtaggttatcaggacaaataaagttacaggtacaaaagcccacggagaaaatataagcat

SEQ ID NO: 45501 - DNA, 647 bp, Bovine  19866880463501
actcaaatgttaataaggagcaggtgggtaacataaatgtatgagtgtggccctgcttatagtaatgaaggagtcatagggctgggagtgaaagtagaggcccatcttaccaaaatgccttcaatgagaaaacaggctttgtgaaaggcaactgtaacatgtatttggcctagagtcacccactaactagatatttcctgaatcacagcaaccagaactgacctcaaaagtctgggtgtcatttgaccagctcaaaagaaatgatgttaatctctcattggagtaactatacttctattaatgctgcaaacattacattaaccttttaggatgtgacattctgttgactcacatcaagctctctgtgaagtaaagcctggaattatttttatagggctgttattagttgtttttcttgaatgcagttttacgactctatgtttattcctatgaaatttgaccttgtcagattcatcccatctttccaatcatcaagatttttctgagtactgactttgccatttttgccatccaatgcaaatattccccttgctagtttcaagtaacctgtaattatgataagcacacatttttattgagatataattcacataccctataatctacgcttgtatattgtaccatag

SEQ ID NO: 45502 - DNA, 2711 bp, Bovine  19866880516574
ttgcctggaaaatagtgaacagtctttaatatacatttgcaggataatgctaagatgtgccagcaagagaaagcccagaaaggagggactcgtacacgggctgagggagaggcgcgcaggtggggagcccgtcagctccgaaagcagtggagtcacatcgacaccagtcctcgatgacgtctccggttcccgagcaccagagggagctcatggtggcctccagcaagagctgcaagggagggcagagacaagagtgagtgtcagggtgccagggccgggtcatcagactctagagacggagttatcagggctctgcttggccctaaataagtccagccagccagctgcagcaccacgtctccgtgtatttctaccccaggggcgtgtttctgggaaagctggacctcagaggacttgtagggtgtccctgtctcattagcatccctgtggttgagggccggaaccttgggagccagtcttattccaccttgcctctccctcccattctgcaccagcattctatactctagctccagcgacacaacctcgtctccatccactcagcagggttacccttggcccagaggcactcagccttttctcaaatgcctctcagggcatcctcctctgccctcttcaccccaccccagtatttcctctgtactccttcagttgatgtcttgtatctcacttacaatatgtatgcagttctgccttgggctgtgactacgcatcatgcctctctttctaatggaaggtagaagccacgtgacacacaggctgagacccgggctctggagcagtccctctgggtgagaactccagctctgccaacccctgctctgtgactttgggcaaatgacataaactcattggtaaaatggtaaaatgggataaaaacagcactttccctataaggatgttgtgacagttaaatgaaacaactctatgccaaggagcacagcagagtgcccatgctaatgcccacattgaattgaaggaagcaaaagttgctcagtcgtgcccgactctttacgaccccagggactgtcctctgtccatggaattttttttcaattcaatttttttttcagaaagttttcaagtttacaaagcccttgtagatgctaactcctttgtatcagagtggagccctgtagagccttccccttcatccttcgctctggctcctctctgaagtacctagataatatatctgatgcacatttcctgagttgttttacagatgtcaatcccccaccaaatggaagatgtgtctacttgatgaccaggcttcctagaacctaaggactgcatcgataatgttaacccccgagacactatcctgttccctcaccatcagccattcagagaattgttcaccacgaattgatcacataccctcctccttcacctggcctttaaaactgttttgctgaaacctttccaggagtttagggttttggagcataagccactgtccttgtattggcaaccttcacaatgtaagctgcattttccttcatcatgaccgggtgtcagtagattggctttaccacatgcaggagagcagacctgagtttggatcagtgacactttaatttgagctccatgattaacatgattcacagtggaagacacttacagagtccaagaggttgggtcaccatgagcttgctcatggtcacaggttagtaaatgggcaacagaatggatttggtatctcaggctagatggacacatcaagctgtcttgattaatgccatatccactagctcccaagatgaagcctggtccatactaagtgctcacttcatgttttcctggactgaactatattaaaatatgcatatatatatatatacacacacacatatatataaatatgtatataaagatacatatatatatatatatatatttttttttttttttaaactaggaaaacagaaaacctttgagatgagcagaatggagaggatttcatggctgctgccttagagtctttaatcgactattattgattcagcacctataaagaccatttcctgtgctaagcattaaggatacaatgcaaaggtaaatacggcccctgcttgcattaagtcttacagttaataaacaaataataaacaaaagttccataaataaccacagctgtgacaaggactccagaaagggctgagatggtggcaggaggcacaaggagggggcccgtatcacagacgagtgcgggaatgccttcgagagactggagggataggtcaagagtaatcgagtcacaaaagttggagaagtgttccaggtggaaaaaaaccaacattaagaagactttagcctgtatgagactttacttctaacatcaactgagaaaaagttcacctggctgtgagagaaagcaggggcaaagagatgctgaggaagtgggagggcggcagggttgattacagagagtccttggacactgcgtgggaaggtgtcatgttctaagagcaacaggcagtcatcagaatgtttcacacaagggagcaacatgaccagattgtcctcccaaaggcgtgacgaccgtcacttacgatgacaaacattctgaatgccatttcagaccattccctgcaagttcctcctctttatgttctgtgcgagaggtaactgtgaaggtaggttgagggtaccagagaggaattgacagggacagaggaaagggggaa

SEQ ID NO: 45503 - DNA, 1225 bp, Bovine  19866880529845
ccaaataccactaactggtgaatggcagagtgaattgtgatatatacatgctgtgaacggcttctcagccataacaaagtatgaagtactgatacactgtacaatatggatgaacctcaaaaattttattctgagggaagaaagtcagacacaaaagggtcacatcttgcatgattccatgtatatgaaatattcagaataggtaattcatagggacagaatgtagagtggtagtgcacaggttatggaagcaggggagggaagaatggagagagactctttaatggatgtggggttttatcttggagtgacaaaaatgcggtggagctggagacaggtggcagttgcacagcgtggtgaatgtgctagatgccactaaattgttcattttcaaaaggttaactttatactatgtgtatttcacctcacttaattatatttttaattgtggcttttgaagaatatgtactgatataggaaaattcacatcatgtacgtattgttaaaagctggacttacagtataatctcaattttgtaaacttaaaaatgtgtgagcatgtgcatatgcatatgtttgtatatatatatatatatgcacacatatatatttaccatatatgcaaatatttttatatgtatatacaccatcctcccaccaaaaaaacctaagaggaaattcagaaaggattagtgaattctaggttatttcacttttacactgtttttcatattccataaaatgagtccatgccaattttataatttgagagaaatacatgttattgaataagaattgagttttaaagtatctctaaggttttctccagcctacaattctaggagtccaaatgcattacatctaagtgattgcccattagatgttgggtcagagcagataagccttttgggtaggtacctaggaaatggtgatttaaggcaggcaggcaatagaggagcacagagacatttaatatgcaaacagttgtatcggcaatctgcatgcagaacttcagtccttgtcacattgttcataagtgggactgctagaaggacatacacatccgtcatccagctccataacccattctctttgatggctccttcaagaattatggtaacattcatggctctcatgtggactctttccataatatgtgcatctgaaaataaaatagatgtccctatcctgcacagctaccctagctgaatcccactcgtaaaag

SEQ ID NO: 45504 - DNA, 718 bp, Bovine  19866880557884
tggtactagatataggtctcactctctatgtatatatatttatgtatgtatacacacaaatatatatatatatatatacagcaactacttcattttctgtattatatttatttataatgccccaccctacatcccataaacacagtaaatggtaagattcttccgaataggacttgttcttttctgcatttatttccccatcacattgtgttaaacatagctgttagatgaatggataaaagaccaaatatatattagtaataatactgagtgtgactaatgactaatctgattactttagtgaatctaggtaataaaatagtttttgtataaaagtgcaatcagttgaggcaactttcttctttaaggatgatgggtgttatttttcaattatcaccaattaatatgcatggcctgttcacaggatgactggtgctgatcctagggggggctctatggactattactgaggtgagcctcgctctccagtgctctgagagaagtaatttgtcttgatattcttggtgtcagtatgcaaattagtatatccctaggagcataaagaaaccagctagttaaagtaaagaccactaaggtgggttcagaacagggtacgtctttctttaaaaaagtcattacgcagagtcaaactaatggtggaatgtcttaggggagaaagtattctaatccccaaacaaaaggcttttcaaacagttca

SEQ ID NO: 45505 - DNA, 2676 bp, Bovine  19866880572078
tgaaagttcttgggggcagtctctgattttgcagatgaagaagctaacatttgctgggaccataacttgggttgccttatacctcagcctgtgctttccattgatttttttttatgaggttgggtcagtttttcacatgtcagatgtgttgcaaattgggtgaaactcagctaaaaaacagtgaattcttcagtgtcaggtctgatgttctgtggaactgatgaatccaaagctatctgtagcactattttaactcattctgtttttgttctacatagaaaaagggctgtaaacacagcaaaaagcactgtgtgcccacacacggtgttgtacactggataccatcaacaaattaacatgcatcgccttgaataaagtctcccataactccctctattctgcgtgtgctacagactcctggtggagcgcgctcaactcaatcacactgggtcaggggcccttctgcgacattgttttgccaccttcatggtgttctatgggtggataggagaattatatgtagatttgtgctgtcattggcagacctctatttaaatggcattttcaatgaggtttgaggtggtaagagagggagatgcagtgatacattttgaagtttttagtgagatcccaaaaagaaatatatccagccacatacagtacataaaactacagtctgtttcccctctaattggtaataaatgtaaatgtttagttatgcctgactagggagctatgaacaacacatctgtctgactgcttttgctgtcttcacaaggactgcagcatttataccatctgtagcttgcgaaggaaggaagagacagagagaaagtgaggctgaaatacagagaatggatattactagaggtgcatagggaattgactcgttcaacaaatatttattgaacatctattatggcctgggaaccaggcaagaaaaagagggagataataaatatcttcccttccaaaattctaaataaattgatggagtgaagatcaggaaaatgaagatataaatgcttaatttgttactgaaaacaaattctcaagtatccattattgggttggggtaagaatgggtttcctaatggtaaactctaggattagacaagtccatctgccctgatgcagacagcactggaggacagcaagcttacccacaagggcagagccctgactgtttatctcaaggcctctccaggagcagagcaggtcagcagggcaggggaggagaggacggctaggagtggctacaggccagtcttcctcttctactcagatgagtgagagagtaacagggaaagaccagaacatacacacaaacactctgactctctgacccacctgtaggttaggatcacctgggagctttagcaaaacatagattcagtcccccaaaccagagcttctgattctatcagacattgattgtgcataggtgtgaattttttaaactcccctcataattctatgtgcatcaggggttgagcatcacctaatagggagtgaggggaaaagagcccccattctgcacagcctgcctgcaagcttagttgtgtctgactttttgggagtccatggaccatagcctgccaggcttctctgtccatggggttttccaggcaaaaatactggagtgggttgctattttcttctccaggggattttcctgacccagggattgaacccatgtctcctgtgtctcctgcattgcaggcagattctttaccatctgagccatcggggaagtccagatgttataaagatacatgagggacagtccctctcttccagaatctctcactctcctgagactaagtcacaaaagcaaccacagtgccctttgctgagtgcactggcactcagagggtagaaagacaaaagacccaggatttcagagaccttcccaggaccatgggggcccaggttcagaaggtcaccctggcagttgtggaagaggcaataagaggaaggctgatgacccaagaggttactatagattgagagagaataaagtaaaaaggaagccaggcagctagggacacagactgctcattaatgagcatccttccagtttcagacttggaataacaaaccttcctttttcaagcaggctgtctgtggtctgccttggccacactgggtgctggggttctgcactgaggagctcaagttccctggggttatactgaggattagaggagaggatgtctatcagggccacagcctagagcctggcaaagaggatgtctttattaaattttgctgctgctaagttgcttcagtcatgtttgactctgtgtgaccccatagacggcagcccactaggctccgccatccctgggattctccaggcaagaacactggagtgggttgccatttccttctccagtgcatgaaagtgaaaagtgaaagtgaagtcgctcagtcgtatccgactcctagcgaccccatggactgcagcctaccaggctcctccatccatgggattttccaggcaagagtactggagtggggtgccattgccttctccttattagatgttagatgctcctgtttgtttggggaagccacagaaactacagcaacaaagccttagcctggctagtttgctgtgagctctgattcacctgcgtgaaagggagatttacaggattatcacaaactaac

SEQ ID NO: 45506 - DNA, 1959 bp, Bovine  19866880617521
ttacatagtcatttaacaaatgctttttttgtttgttttttagccttgcctgtactcccacttctgaaagtatcactgcttactattcctgggcttttctaggcttcaggggtatagacctgcttgcttctgaacttttcctcatggcaagctctgtttttgccctcctctgacatgctaagtttattaccacttgttcatctattccctctagagctaaagttttgtggccttcttccccactttatttttcttgactcttatgaccaaatgctgcctttaaaaaatcatcttatttgtgggttttcaggaagatgcagaaatatgcaagtgtgtttgtctgccactcttcacaattatacttctcaatgcatttctcatgattctggttctgcctttttgggctataaataatgagggctgccatccagataattaataaatgggttaccttagtctatgaagctgctgctgcaagtcattggtgagggatttgagctatgagtcttgagagggaatttttctgatcagccgacaggctctcggtgtgtgatcagcagttcacacgtgtaaactggttagcaaggctcaggggaacagtctgttttcccatgatggtgattcatgtctctgtgaccttggacaattaaaacatctgacgtcagttctttccctggtgaagcaaacacacctctgcttccatattttgtgttaggcttagaaattgtaaactgtaattgaaactgaaagtgttagttgtgtccgattctttgtgacccatggattgcaggctgccagggtgctctgcctgtgaaattctccaggcaagaatactggagtgggttgccatgcccttctccaggggatcttccctacccagaaatcaaacccagacctcctgcattccaggcagattctttacccactgagctaccaggtaaagctctgtataattgataggaaacattatattttcattgctcccctttcttggctcccaaacttatcaatctatacacatttatttattttacaatagaaaccacactagagtgaaatgcctgttttctgtccttctcctatgttagactgagcagcttctgggcaggcatatcggtcatgatttacttagcctggtatcatcaagtcctagccctgggcatggtatataatagttgttcactaaaatgttgactgaatacagaggagacaaagctatctgacaccaggattgaacccataaccttgacctccttagttggaacttctaaccatctgctgctaagtcgcttcagttgtgtccgactttgtgcgaccccagagatagcagcccaccaggctcccccatccatgggattctccaggcaagaacactggagtgggttgtcatttccttctcaaatgcatggaagtgaaaagtgaaagtgaagtcgctcagtcgtgtccaactcccagcgaccccatggacttcagcctaccaggcccctccatccatgggatttgccaggcaagagtactggagtgggatgccattgccttctccgtctaaccatctacatacagccttatgagaacccacttccatgacagagaagatccattcttcgctggctctgagcagtggtaagctgcttcgcactgcctgccttgaatacctggggggaagacctgaaaaatgatcttcctgctaagcctgactccacatcctattacccatcccttgagccatatgtttagcaacttatatttaataaatacagcagcagaatccgattagagtgagcccagtgatagttaaactcgattgccagggaaatcaagttagaatcctgaattgtttttatgtattgcaatgggcaactggaatgcctgttccatatggcgcggactctgtctgcgaattgcacagcccattccctgtcagatggtcccatttggggtcagtgacgatggcaggaa

SEQ ID NO: 45507 - DNA, 779 bp, Bovine  19866880682690
aacgcataagcttatttaagaaaaggaaaaagaaacctagaagctgagagaactaaataactcctgggaactagccttaggaatgtcttttcaatttgattgtggaaatacgtttctgtcagggttttggccttggatttccagctttgtgtgaatccagatcaagaaaacccctttgagatgcctaaggggaggagaaagcccttcgtggaaagacagtgggttatgtgactttgtaagcagcggggctctgggcaccaacagccttctcaatgcctggtttccatactgtctttatgtaaaatttcccagtgtttaactttcaccagggtagttgaggatgtattgagtatcgatgttgcagctcagcattttaatacttcaattaaatatcaaggaatcacagaaacacttcgaggagactttccagcacgagaccagagacaggagctttaaactgctgctccctgttccagctctgaggccatgctgctgctgcttttggtgtagcagggagcaaacacacatcagcaaaacatggctgcttcctggtgcctcacagaaaaggaggagaaggaggagcctgtttcctggaagacttggtgagtttttgaccatggatcgtgcaacaaagcacctggcttctgaaccagagaacggggttctttcaacagctccccatggcctggcctgccccattgctttccctgctattttaggactgaggtgggtggcttctggtagacaacgagaagattgttagtggacatacttggggg

SEQ ID NO: 45508 - DNA, 1110 bp, Bovine  19866880689272
tgccatatcttgtcctccaacatgccaaaagggtctcctagacactgatttctttcacggtgcagttttaaaaagcctctttcctgaagtggcatgtcattttcctgtattagcgatgagtaaaatgaagtagaagtaattacatatctgtagaaagtaggaccaaaggcaattccttgtgtttctacctggggaaaaatggactttgaatatgcacccggtgagaaaatgatatgctgtgctttgagatcttataaagccacctgttcaactgaaaatccagtgtcatccatgctttaaaaattgaatttagagtaagcttcccacacggtgtgtttgctcacttggtcctcttgcaagcatttatggaacatctactttgtggaaagcattattctgggcaccatagcaggctgccaaaaagaaaacaggattctactggtttccaggggttcagctgtccggtttgagtgacagcacactcacgggaaaaacacattagaatgtagcatcccaggctctggggagaagaaggtatttagcacactctcagtgagtgatggatagatttggtccatgaatgccgtatcagaataaattctcaggatgtcagtcccatgctccccaagggcaaaatgactcttgccccaaattttctcatgtcttctggggggctatatccaggtcattcacatgggattgaaataggattgcacaggtggtctgtgaatagaaaatgtaaaaaaaaaaaaaaaaagtgcaaaaaaggcagggaaaaagccaggaaggccagggggagaaagccagttcagttttgttttcagatgagatttagtagacagatcttgagtcagtcaggcagagaaaaagaggattaatttttgctttgagaaataattaattttattcatgaatgaattgctacttagaggcgcgtagatgtagaaaggaatgaggtaggcttcatctagaaaccgtcgcgacacagatgtagacagggacactggctggccacgtggtcttttcatttttttttttttttccctcaagagaaaagctttttctgggtcagggattcttccgtttttcttcctgctattcagcttctgg

SEQ ID NO: 45509 - DNA, 1607 bp, Bovine  19866880706238
tgcatcattaataaaaacagccaccaggatttatgtagggtcattcttccaaggatctcaaacttggaggaatgcatcaatcagtgttatttattgagcattttcagataggagaagtggggagttaaaaacacccatgtatttagtatgtacattcccttaattcaaaaattgtgcaggtgaattatagaatgaaacgtgggagagcctatgcagctaagtgaaagcagaagctgaacttagcatgctttcggcagtcaggctgctttggttcaaatcccatccctgtcctttacaattgtgaagggcgggatatgtcatttcatctgttttagcctcagtctgcacatctgtaaaagaggggtgataactttgtgtacatcataggatgttgtgatggtcaaataaggtaaatcctataaagggtagagtaagcgcacagcacatatcgcattagatgtgcattgtcgtttagttgctaagtcgtgtcctactctttgcaactccatggaccatagccccctaggctcctctgtccatgagatttttcaggcaagaatactggaatgggttaccatttcctcctccagggtatcttcctaacccagggattgaacctatgtcttctgtatgttctacattgcagatggattgtttacctgctgagccatcagggaggcccaagctcacagcacatatagatagtctccgtgtttagaggaaagaaaggaaagggaagcaaaggaaaggtaaaaggaatattcatactactcacagcaaacttcatcctcgaaacagagaaatttatcatctggggcccttacatcagggtcactggctaatataatagaaaggtcttcaatgacagttttgtggcagacatagataagtcattcaaacagatatttcttagataaatcctctaaaaaggcagagaatataatattataacatcacctatcaccaaaatgcccgtgtctgactaggttacatggcccaggtacattgtttctgatgatataaattattagaatgatagagcttgaagcatcagagagaatggctagttaacattcccattagaccatctctttcaaagatgtgcgtctctttcaagagtgcacatcctaagtgcacttctagcgagtaccagattgcaggcaattcctagttgaattccgtgatggaaaaccagaatatagttctaccataatatttttagataccgacatgagggaggcagagtgtctcctccagttccattagaagtagaagacatatgtgaatagacagaaaggtgggaaagtggtacctaagaagtggtagcaccatgagcctaggcccatgttcctagacacaatgacaagtcagcctgatgttcacatcccagacccatcctcctgccctccattcttttctttttaaaacaccagctctgggacttccctggtggttcagtggctaaggctccatgcttccaatgcaggaggcctgggttcgtttcctggttggggaactaaatagatctcacatgccacgaccagaagatcctgcatcgtgcaatgaagatcaaaggtcccatatgctgcagctaagaccggcacagc

SEQ ID NO: 45510 - DNA, 460 bp, Bovine  19866880723062
ccctccacaattcagaggctggctcctttcataatttttgttgacttcagtagccattaaaacgatctttccaattctcaaaccattcactgccttgacttctctcctcaaacgatcctgtcccccactctcactcccatgatcgtagcctagattgccaatatctgcaacctctccttggtcacagcttcaagaatccctatatctgaccaacacttcctgccctcccagttcattcttcctatacccacagaatattttctatccatctgagccttaaaatgcattcatctaaccaccattttattgaccctcacccacctcatgtaccctctttcctctttactcaaattaaattctgtgatccattattgtaatcaccctttcaaggaacctcaactctcttgccctccattgcttcatcatacttgtctgaaacactccaacacggttaaactca

SEQ ID NO: 45511 - DNA, 1099 bp, Bovine  19866880762677
ttacagttatttaaatcataggaagtattgagcttttcaaatatacatgaaatcccatcactcctctgcttgttttctactgtgctttgacttatattaaaagtcttatcccagccatgtgagccggctccagcctacctctgaacgtcatcttgcaccagcatctttcttgctcacctctctggagtcacagcagtcctggctttcaccatggttcctgcctcagcaccttagcacttaccattccctcctcctgaacaccctttccctcagatctacacacagctggcttctaaggattcagaccccagtctaaaccccaagtgccctcccctgcccctctcgcctcagaagtctgcacctatgaccctgttttccccttacatcataacctggagtgactctgctgacttttacaagtttattatgttcattcccccactataatgtgacctctggaaagcagtggccctggttgcctttcgctgaggttccctcagtgggagcctgccttagggaagatgccatgtggctctttgctgcagaaggaagcgcctgcccaggctttagggctggtttagggctgtgcccacatcagaaagttgctttccgactaccttcagtcaggcccggctgacgtggagctggcgaagacccaggcctccgcctggtgtctctgcctgcctgtctctgcctgcctcccccaggacctctcaggcccttaccttgatggcccccgtggctatctggatgtggtgcagccgccgcagggtgctctctctgtcgatgaagtaggaggctgccagctggtgcagggtctccaaggacacagcggagctgttcccactgcccccgatcacagaggcacttcctgccgtctccgacttccggctcagtttccgcttgtccacaaagatggtcagggactcttctcctacagcaaacaacatgggtgtcctggtgaggcccccagctccccaagcccctacccgtaagaacatgaaaaccctcagactgagccttactgtggcccctgctgacagccttttcccatccctaccatgctcggagcactctcatcaaactgcaccacagcaga

SEQ ID NO: 45512 - DNA, 992 bp, Bovine  19866880892084
cagatgatgacgataatgaaatttcactgtgctggaaacaggggaaatgaggtcagttagctggcatttggtgatgcttttgttaaggcagaacatttattattctctctctctgcatattaaaaaaaatctatgtactttgctaaaaaaaaaaaagccttaggcaactaaatatcattcattaaaacatttaagacaagtgacagcttctagtaatacatttccagaacagaacaagcaggataaagatagcttagaaactgcatacatagagaatttttccacagataccctaatcccctgctggccaatttttaaaagtgggcttttattgtaccataaaaatgaacgggctgaggctttcacatccggagaaaggttggtacctgcacgaaaaatgttttgcctttcagagtccaggatgagacaaaatccttgttactcctgggtgaggaaaactaaccactgtgatagaattgggtattgaaatgccatttgtgagtagcatataaactataactgagcaagataattccatttctaagatgattactgatgccaggttgatcccagggtcctttcccagtgttaccactaatatgaccttgtcttttcaaaaccaaagacccagctttggagaactgtttgacagtagctttgaaagctaagcactttgtatccagaaattccagtcatcagtgtatacctaactaatatgcatttgtatatgagtcaaaaaacattcacaagaatactcatgacacccctattcaaaactgccccagactggaaactacccaaatggccatcgtgagtaggatggataaatacattgtgttatagttacacaatggagtactgttttgcagtgatagtgagtgaactagagctactctcaataacacaaacaaattttcacaaaaacatattgtagagtaaaagaagccacacaaaaagtttgaaccctatgattctgttatataaaatttcaa

SEQ ID NO: 45513 - DNA, 1402 bp, Bovine  19866880926721
cccacaaaactccttcagatactcgaacttctatcattacttctagtccactcctctttttttcactactgagctgcaaaagatactgtggtcctgcttctgcagcttgcatgcacaggtgcatgtgactttgttatccaaaatttccttcacttctccctgtgcagatccacctcaccttgcggtgcaggccagccatgcagtccatttctttagtgctgctataaaccaccattcttattttgccaaggagagaattaacagacagccaccagtaagtttctagatccaaggaaaaaaatgtgaaaatgtccaggaagctttccatccgtttgactaccctaccaactaaagttcactttgtagggacatggcttcctgatggctgtatgtaggttagaaccacaaatggaatggtatttcacatccctttcatgttctttccttatgagacgtgaaacattaagaagtggatgagtaaacccccactctccagtctgtggaaaaacaatttcaaaaactgcctggtcctttgaaaagttggtttatagttcctggagtagagctcggtagatctcattaagcccaacctatagtcttgatggtgtttacttttgcattagaaatgtactaataatacaaaaactgggggctggctgggaatgctgacattgtggatatgctgttcattgaaatgtacaattgctgggttatttggtggatgtaaattttgtgttggaagtcatgctgatgtgcaagtaagtacacagtctgttcatcatccagtgtaagaacgagtgtagggaattatatgtttctaaagagcctatttgggggctctacatgcagtgcttactgtgcatgagaagggacatgtgtggtacatgaaaaaaggaagattggatgagcagatattcaacgttccacttcattttttgcagaatcccaaaggcagggcctgaagccatgatgtgcctgctcagatccaatgtgtacagcaaaagcccacatgttaaagaatgggttttctgcacctctgtgcaaagctgcccactgcagcatcctgctggagttgctatggtaaccttctgcaacttggcattgacacacaggagcagacacacacttttatttcaggggcagatgcatttgctaaatgcattgattgtccccagccctcccagtcagtgggggtatgttcagagccagagatatgctggtacctccccttttggctctaaattcccaggggaaataggagtgaatctcagctggggcagtgggccaaagcaggggacaaaaggagaggagtccaagttcacagaagtcaagtgtggttgcttttgaacttaatttttgtagtcctgtatcctgtcactcgtggtcaatagtaaggtctata

SEQ ID NO: 45514 - DNA, 1470 bp, Bovine  19866880999313
ctataatgaatagacatgattaatctgagctataaaaataattataataaaaccataacctcttgtattggcatagagttttcccttagttttgtaaaaaaaaagaaaactgtacacaatttttacacaagctcaacaattttagaaatgcaaggacttcaaaaaagaggaaatggatttatcactacttgactttttatgaactttttagaggttaacaaacgaagagatagaaattgagaaaaaggaccaagtctccattgatcggctgtagagtttggtgagcacccacgtcatggcacaagtggttttctacctttgtctatgacctgtgttcaagttcaaagaccactgtccctctttgtcatgttgacacttcccaggaaattcttttgtcccatttaccactgtggctgggagaaatttccaggcagaaaaactccagtccagaagcatttggttaaataatgtctcggcccctgcaactctaggaggcacagaagcagaaagaagtccagcccaccccacatgctccagtgcccccagtccacccactggaagaattcaagaagcctggcatggaggtaattcagcagcctgctgtgttctcaaacaacggtccgtaaacaatgattggccaatttcattctaatcttcccaattttgctctaattaaaatcaagctgtagctttcaaacagtttaattaaggctgattgggagaaatggggaggggagactcaagtttaaaggaggaggacgggatccctggtgaacctcgcaccgcacagtccgggctcaggggtgtggagagggtgctgagagtggttatgcttgcggaatcaataagatatacagcagacacattgaaatgaaggaccagtggatctaggagactagaaggaactgaaaatggagctaaggcctgtgttttccaaggcacagaaacctcagctctgccctgacctccaaacctgctccccacagctcatctttttaactgaggagaaaatggctttgttcaccactcttcacctcctgttgtggttgtctttgctcagcaagctgacagcccatgccaggcttctccccagcaaacacccacgggcttccaatcatctatttaaccccaagagaaatccccctgactggcagttccttctgttatttgacaagtttattcctgttgcaatgagaaagcccttctggtatttgggtgcatttgctttttatacaggtcactcttctttggattaactatttttagttccttcaatacagcttccagatccctagactgtctagtcaaagctatggtttttccagtaatcatgcatggatgtgagagttggaccataaagaaggctgagtgctgaagaattgatgctttcaaactgtggtgctggagaagactcttgagactcccttggacagcaaggaaatcaaaccagtcaatccaaaaggaaattaa

SEQ ID NO: 45515 - DNA, 2248 bp, Bovine  19866881000742
atgtgagcagtgatgacctagcctccaaatgacagagacatctcggctacagcacacttcacagggaccacagcccacttgtttctaaaaagagaaattcaagacccaacagctatgaaagatggcacagcacagccagagtggggaaggtgtgggcactgggctggacacagacatctggtcaccacgctctttccatgactgccctagagtctgcaggcctcacttttgtcatttataaaatataggctcagattcagtgacctttaaaatacttccagctttaacattctaaaaatttgtcactctgggtacacccagggcccagcaacacccatgtgtacagtgtgtataacgatagcttattagacatggaatgtcctggtccctaccccggaagtacttaaagagaccctgcattttaacagtatctccaggtgattcatatgcacattaaagttttacaattattgttctagaatatttgatcacaggtttatagagaatcatccatcctaagttgagaattataaagcaaaacaaatgccagactagatgacctgtcttctttaaaaagtatcactgtagctcattaataggacccgacactgtgctttaaaacttgtcatcgaattaagccttatcccaggctttgactcgctattttactcagagcaagcgccccgtgcctcagaaggcatcgctgtagtcccagtgcttctcaggcagcgtgtcctcttttgaacatatctccgctgccttgcttaaaggtcttagtgcattcggtaactatttcaacagaacagccttcacacacgtgaaaatacaatattatatgaggtatcaaatagcagttttaggcaaacctccctttccggatgcaactacccgattgtaacaggactaaatctgcaggtggagtggctctgtttaccaacccaggggttcgtgtgtctaacagtaatagatgattcctctctttcttgttaggtagccctgtgctgcagaacattcacgtggaaatggacatatctggcccctgcacttacagaattaaaaatggttatatgagagtgtctaaatgccagcactactgacgtttcggacctgacaattctttgttgcgggggctgtcctgtgcattggaggttgtttagcagcatctctggcctgtatccaccagatgcctgaagcagtcaccgttcagctgtggcagccaggatgtctccagacactgccaaacgttccttgggggaaggggggtacaatcacccctggtggagaaccactggactagaaaacactagtgaggactacccggaaagcataaggaagacgtctatgaggatgtgactgaaaacaaccacaacacacacgctgagcaattatattaatggtgaaataaacaatgaggtattcataacacatgcaagtcaacaggccggggaggacaggaggaagaatcaagtgagatccatgacccagaaaggagaacccaaggggaacaggctacctctacttccagcaaacacctcatattgaagagcagagttcctgatcacaggctgtttctcagccacagacattattaacaaagatggaagtaatgtcagagacaaagaagagttcaaggatgtcagacaagaagggctgtaacagtatactgttacagtatttgaagtatactgttacaatactctgaagtattagttctcagaggcaggtgtgctgcacagagattcataaaatctacagctggaatgggccttagattcacctcctccaatgccatcatcctgcacataacccagagaggcaaatgcactagtccaagttacagctacctcgaggcggagtggggacacttgtctatggaggcgcaggcttggtgttggtctctgttgcccggcacccagagcagggcctggagaatcctgaggaccagggacggttgagtagtcaaagtgaacctggatctctggccgcacagcctgatactcttcctgccatgcccctctacctgctgggacttaagaggctttttagagtatggcaagtccgttggtgaaatgctaattaaaatagcattctagtgtactggaaaacataaaatgtgcatctgtgggtcttccaatagaaaatgagaggaatagggttgagagaggttaagatacctcacccaggggagagtgagttgtatgccttccagggtatagggcagggaatagaggctagaaataaaaagaag

SEQ ID NO: 45516 - DNA, 1085 bp, Bovine  19866881018351
ctaaccactcttgcttgtctgatgttgaaaaaccaccatgttgaaaaacatatcagtagctaaattatatccagcacatcaaaaaccaaagctgggccaaggcgaggctgtcaagtggagccatagggtctccctaggtcctgtctcccagagtcccagctgttttcccctttctgcttcccaggtctttctcctgttatgtctggagactgatctggcttgtctcatcatctcccagtgcactcccaccctttgaccctgcattttggatcatgaactaaggtcaacatctttctggtactctagggcacacctgaatatcccatagtgttgaccttatttctgtgtaagcctgggcaaggcagcttctctttcttccagtgataacatactctgactctaattccaaccagctatcttacagcattggtcacaagggagaccaggagagtatgtttctgattctgcgtaaaaccatcctggctgctagaaaaacaaagcacaacacatgctgtatgaagaataagcccatcacatcacgctcctgtgtgagggcaggccaattcatttttaaaaatcgagacactttatggggaagcaaatctcgcagatttctcttgttctttgccctcaactaattcttcgaaatggaaagacagcaccgtgggagaaatatgtcctggtgttactaacacagagagatcctgggaaacaagaggaagttttgttaccattgaggtgatgtccattcagagctgtcatgtctgacactgcttcctgtctctttgccttaataatgagtttccagaaatcaagtgatgaaggctccctgagtaatgcaactggagaggaattcatctgtgatgctgcaagtgacaacatagactgcttttcacgttgcttaaagcatgcgatatgccattcttgtagtacaacacctcacaaaacctgtccatagaaatgacgctggaggagcctatcagctctagaataccaaatcttcctccaataaactacccttgcagatggggcaactaattaggtcccatgtgctgaatgcagaggaactttaaaataatcttttt

SEQ ID NO: 45517 - DNA, 1114 bp, Bovine  19866881026842
tttggtttatgttcaaggtcaaccttggaactgacagattgggatttcagaattttcctgctccagaaaatctctctgctaggggagcactcttatcatgagaccaaagtttcttataccaccataaaccaaaaaggcttaaaacataactgctggttgggctaacacattagctaaaatccaatctcattcaagtaccatcagttaataaaaaagcattaattggggcttccctggtggctcagtggtaaagaatccacctgccaatgcaggatactcgggtttgatccctgtccaggaagatcccacatgccacagagcagctaagcccatgcgctacaactgctgaagcctgtgctcgagagccagggagctgcaactgcaaaagcccacgtgctgcatcaactgaagcccgcatgccctagagcccgtgctctgcaacacaagaagccaccacaatgagaagcccgtgcacctcaactagagagtagccccatttgccgcaattagagaaaagccctcagagcagtgaagccccagtatggccaaaataaataaataaaaatcattaattgcgtcagatcctttacagtttttgtggtgggatggaagcaaagtcatggaggaatctctggttgctgaggaggggaagaaagagggaaagcacagaaagaaaaggctgtggatccagataaatttagaacacttggtcattttgctgagccaacagggctccctcttcaactggactgggacaaatagctgtgtctcaaggtggctttgtcatgctaatgaacccagacagctctgcttcccaagatttagaggaggttttgtgagtttgttagaaccaatctgagcttccttagaaagcttttcattaatcaggatatcactgaacagaaccagtacttgggagccacccgattaaaggcagaggagaaggtgcagcctgggtggcgtccaagtggatctacaacatgaagcatcgcctcagtgctggacattgtgccagcttccttacaaaagtgatttctagcactcttacgagaaaagcattatctggacaacgcagatgaggcagccaatgtttatgggcttgaataaaactggg

SEQ ID NO: 45518 - DNA, 2356 bp, Bovine  19866881175776
ggctctgcacccagtacatatacatctttgatggagaacagctccctgcacagagcaggtgctcagagacaaggaagtggggggtatgaaggatggaattggcccagcatcctcccagcttgcccctgctctgggtccctttacaagagcacagctgccagactgggaagcaagatgaagcttatatcctccctagagctggaagctcccagctctgcctggaaacactgcataacaatgtgtctcaattaatcacctcttccactccttcatgccaactttgtgtacagcattcctgtctctcttctctgccccattccctttcctctctgtgaggactgcatcattccatccttaagagaagggaaggctgaaaactgatagtgttgatgggcaagaaaatgatcaatataaaggcaccagcaggcttgcccacctgctcctgcctccattcacctacgcaggtccaccagttttcacatccatggcatggcatggagcttagttcactccagcccagtctttgtatgtcatagcatcacacagcttatacatcgtcaaagcccatgaagtgaaagtgaaagtcactcagtcgtgtctgactctttgcgaccccatggactagaaccaataaaataggaaaccatctttggtgaagcaagagttcattgccatagtttcaaaggggatgtatttttattgtttctctgccattcctggcataacttacttcttttatcattttggacttaggtaggtatcttctaaaatttcctattacagtcaatgtaatttgactctaaacaaaggtaggcatcttctagaatttcctattgtagtaaatgcagtctatttcctattggagtcaatattttaccattgagcagttaattagttctcaaattgtttgaggatatcgctcatcaactagagtgcaagactattaagaaagaaagaaccatgctacacagttcatgacattttccttggatagttgcacacagtaggtgctgcataaatacctctagattagctctgcataaatacctctaattagctccttagctctgtcaaaagaaaattcataacatagactagacagtagttaaagctagggaggaatcactctcgaccctctgttttactcacaatatgtttccacctctatcttcattgtgtcttatcctgtggccccactttctgaaattacaagctcaacagggcagacgtaccacgcagccggtcgaatccagtttgcgatctgagatgcaacggaagttcttactgcagcccccattgtccttgctgcaatcacggactggtccaaacgagtctaagaggacctccaggctgtcgaaggaggacgaggtcatcagctcctctctgtgggaagaagtggcaggaggtgggaggaggtcaggggacgccaggtgcaacaggtagcttcacatcccactttcctgtctggccgaccagatcacgtctcactctctcttacaaatactaaagatcaaccagtcttggagccttgaactaacaaattatagacgttctccatctctgggaaataagccaaggcagtaacacctggtcaaagaaggaggtctaaactcaggcaaagaaattaacattttattgcctgtcagtcctgaggggccgtaggaagtgcttacaaactctcattttatgtcctctctcggtgcatcagccttgcggtgtgcaatattgacccagatagagtagaccttggcactgcatctggggaagcggaaggcagcctgccagcttctccttccagcttgattcctctcccagcgctcgggaccttcgggtagtttctcacccagcctcccaaactcagtgcgtgcctcgggccccgaggctggactcaccggacctccacagcatcttccatcactgtcatgtctgtcttacactttgctgatgggttgatggccagttcagcaggtggaatcacaaagcttttgctgagcggcagccacatgccctccccaagcgtgtaggtgaatctgcagggacacccaacaccacctggttagggctgggggataaacaccaccggaggacctggcaccctaactccagctgcttccttctcaacccttgtagtcctctccaaaaaggagagcatattcccattttatggatgagataattgagtctgatggaggcagagaggctgacccctgctcacgcatccagaccattggagagctcaacatgttatccactcgccagctgctaaaagtgtctcttcttcaaaccataagacatcgagttccagtttccttcagatttgaagctggcttccatgatcttgctgctgctgctgcta

SEQ ID NO: 45519 - DNA, 843 bp, Bovine  19866881201833
atacatacacacatgcatacatacaagtgtctgtgttcatgacacacacactcattcacaaactcacacaccttgccacactactgcaacacttcctttgggagcccgagcgagggctggtcagatggctggtaggattcacagttgttctctgccacctctcttaaccccctggcagcttctgtgggcactgaaagcagacctgggagaggagcccctgatagcagagtctcctgcagacacatctgggccttcagtcgttcacataaattaccccaaaaggctcagattttgtgggtgggctctggagtcagatcccccttcaagtccaaggtctggacttgagctccttgccagaggtgtgaaactgaccagatatttacccttttcagccctcactttctttcgctgtgaaattgtgataatagtaactgcctgttacttctagggctgtagaagaataaatgaataaacacagtttcaggacaatgactgacatacagttgtcactttctaaatgtaagtttccttccttatttgtctctggactgtatctacagactcagttgatttttcactctgggctaatgcagccagggtctaaagttcaatcctcctgaaagcttgttagtctctcctactcctgccttgtgggcaaagcctgcaccggatatcgctggacacccatctttgctcacaaatgcacaggacaggagcttagtgacggatctgcgcaaatccatctctgcacaagaaaaacggctcaacacttacttgctgtggagtgtgacctcccggtaagagaagggcacaaacctgggagcccctcctcctccacagatg

SEQ ID NO: 45520 - DNA, 1694 bp, Bovine  19866881217147
gatcttcccgacccagggattgaactcggtcttccacattgtaggcagacgctttactgtctgagccaccagggaagcccctgctttgtccatcctcagactcctcagcaaggcagagagcccccaccaacttataaatccttccatatcgccaacttgattgtgacatgtctgaaagcataattctacttctatgtctgaatgtacatttatatgaggtattttgctttaaggtatactctaacatgtatacatacaactctactacatatggcaaagttgaagccaagcaggagacacagggaagagaagatagcatgtttgctaatcggtgtcctgtttatatttcttttgtcaagttttaagcacatttttgttttcatcaatgtttatcttcacgaaacccagcaataccactcaggaaaggctaatgtgagtgtatttcaccttaatttgtaaacaccacatgcctgtattatagcaagagcaatctttatcaatgtcttccttaagtgacaattgtaatcaatctatgggagtctaacaaaaactagcaaaccattatctttcactctgtgaataggaccttatcacttctaccaattgttagagtctagtctgtttgggatctgcaggcaaaatgaggagaatgtactaatcagggtcactagactgtggcctccaggccaaatgtggcccactgcctgtttttataaataaagctctattggaacacagccacatacactattcatacagtgtgtatggctgctttggcactatgatggcaagagttggatagttgcaacaaagcttaaatggccttcaaagctgaacatgtttaccatttggccctttacagatccttggcctaattttctgcctttagccatgctaggggtctctctgtgggcataagctggctctatctactacgcataaatctagccttctccaaccaagccccatgggtgtgagtttgtggtcataaatatgggcaaacttcaggtctgtgagagaatcccaaagctttagggaggggcagaaggtgagggaagacagcaagatctggaggaaagataacatcattaggaataagaatctgagtttttccgccagtgctgacctgaatatcccccaccattatgtatatgccttcttttggctgttgagaatgtaataacaatctttgtatctgtggatacatgggcagaaaaggaattcccataatgacatcatttggtttgatgaaaaaaataaatgagggaagttcttccagggaagtttggagttgagattatcatgctaaactacaggatagctgctaggaaaccctgtaaacaacaaaactgaagttgacttaacaatgccctggatgtatatgaccacgtcccagctttgtcacgggcacctcctgtggccctgatggccctaattgcctcagtcttctccctgagccaaactcctcgaggactcctctaagaggttgctatgatcccacctgctttcctggctccccaaggcagagggcccctgggtaacacactgcacacagaaattgttacagctagcttacatggcatcgcaagagtttatctaggtgatatttactaggcatctcccaggggccaggcacataggaagtgcttaataagaatcatctcatttaatcatcataccagccctaagaggta

SEQ ID NO: 45521 - DNA, 921 bp, Bovine  19866881219845
aacaccacctccccctccgtggagtcacttttgtattctttttaaccgatttcttaaaatggcgctgtttcgtgatttccccacgttggttcttactcttttgtatgctgcctccactgagctctccagacacggactgcccctcaagctggctcccttgggaaacaaggcgacagccccccccccacccccggcccccgcccacagaggaccgctcagggcaggcaggcagccgtgtttcccacccgctcccttagctcctctgcttcctcgacctccccagtttcagggcctggctgcctccatgttctgctcatggtccagtcagagcgcctcttccaacagcatctgttctgtccaagaaagcagctctgtcaagttagagaccatgtatagggaaatgtttttcttttttttaagaaaaaagaaaaaaacaacaaaaatatttattttgtgattgtttttcttgtcaatcagctccagcaacatgaacatatgaggtaaaactgatgtggtttaatacatatattttttaaaaagacctttttttaggggaaaaatgagagtgaaaagaagaaaaggatagtttcctgggctgcttggatttttaaaaattgctctgtgtgtgacatgtgggtgtcccatggatggaggatattgctgtgtaggaggctgggtgattagtgaacacacaagtgaagacatgtctggcttgactgtgtgtgtgcaagagagacaggttgagatggacattcgataaagaatggagtgaggcagaactcttccagagaattatcggctcatcccacaccttttatcccaggtgtgagggctgacacaggtcctagaaccaagacctcctactatccagagaagagtagaaagctcctactctctaggaaaactgcagctatggtctag

SEQ ID NO: 45522 - DNA, 2352 bp, Bovine  19866881247792
ttgaaatgatgtgtgattaccccagttccatttttctttcaccttgaacgctgatcgcagcagacttgtccctgtgctgctgagtgaagcttgctctaagtacttactgcacctcagtgaatgaatgaataaataaatgggtgagtgatggatggtgacaatgggaggggtcgacgcctcttggtgggaggagctcacctgttttcactgtccatttgctgtcctccttcccagggtggcatgatcgcactgctgctgtctatcttatgcctggtgatgatcctgtacactcgccggcgctggtgcaagcgccgccgggtcccccaaccccagaagagtgccagcgccgaggcggccaacgagattcactacattccttccgtgctcattggcgggcacgggcgggagagtctgcgcaacgcccgtgtgcagggccacaactctagcggcaccctgagcatccgggagacgcctatcctggacggctacgagtacgacatcaccgacctgcgccaccacctgcagcgggagtgcatgaacggaggggaggactttgccagccaggtcacccgcacccttgactccctgcagggctgtaacgagaaggcagggatggacctcacgccaggtgggtggactccgttctcatctcgtggctttagggggcgctagggaacagctgttctctaatttcatggttgattgtcatacgtacatattgagatgagccagggccctttcccaagtgggcaagaagaataagctttctcttgctatgatgggagctgtcttctaatatagaaaatcagtacaaggataaattggattcctctccatttccacttggcactgaaaacagagatactttgaaaaaaatttttttaatttattttttaatcgaaagagaattgctttacaatgttgtattggtttcttccatgtaacaaggcgaatcagccataattacacatttattgcctccctcttgagcctccctcccctgcccccagcccatccctccaggtagttaaagagcaccaggctctccctgtgttatagaacaacttctcaccagctatctgtttcacacatggtagtatatatatgacaatgctactttctccattcatcccactctctccttcccctgctgtgtccacaagtttgttctctgtatctgtgtctccattacgtcctgcaaataggctcatcagtaccagtttcctagattccatttatgtgcattaatatatgatgtttgcttttctctttctgacttacttcactctgtgttctaggttcattcacctcactagaactgactcaaatttgttctttttatggctgagtaatattcctttgttcatatgtaccacatcttctttatccactcatctgttgatggacatctaggttgggaagcagaggtactttaatatccaacagaagagtgggttagaagctttttcatatgcaatgagcaatcctcagggaaataagagatagcaagaaagatgtgtatgacatttttgcaggtcgtatgtttgtgtgggcaatttaattttccattgacatggaggggacagaggtatctgttcttttctatgactcctgagactttggcctgggaaagttgttctgccttgcctataacctctgtggtctttacaagagatgtacttcttcaaagaaaattgaggaatgcaagcaaaccgtttgaccttagacactttgtatatctgtgaaacgctgagtatagaagagtcttggacctaatgtggctgagcaagaccaaggtcgataaaatgcagagaggaaaagactgtacttttcatttatagcctctctctctcatacttctataaataacaactatctgttgataaaatcccaaggcaatgatccttcaaggaactgcccaattatctttggagaagacattttttgaaatgaatcttgcttacagtgtatggactttcagtggggcttgaaaagagtgaaattgcatcatggaggtttccattctgcttatctagagaagattccctaagactaggaatgacttaataagatttaaagtcagaaattcctggagagtaaggggacatatctttaatacctcttatttttcatagcacctgccatagtgctaagcccaccgagtagccatatgattagagacttggggaacagcagatagcacgaacatgtgagagagccagctgtcagacgatagggaatggtccagactgggatgacagagagggggcaagttctgtctgaatgcactgaaattcaaatttttgtcaaacctgttcttaccaaaggaaagaaatctgcagtctctctctc

SEQ ID NO: 45523 - DNA, 1587 bp, Bovine  19866881251815
ggtgtgcttcaccttagggtgtgagcaccttaaaagacaatgatttcaatgtcccaagcaatgtcaaatcttcactccagtctaacctcactctacgtctcccctttctcttgaccacacagtggacacgttagggatgatgtgattggagactttaggggccaggtccatcttcagactagacctcaggttggtgagaaaggttctcatccaggctggtatagatatgtagattctaagaaagaaaccttggagcttctgcacacaatagagaacgaggaagacaggaccttaggcaaggaaagtcatactacagaataacctgggacgggcaaaggcagagaggaggagagtgagatgaactcactcttacataggccttagtcattgttctaatgttagcctgtgtgctctgagcttgccacactgtctttctgaggggttagcttaggacacccaaaactcactgcagaaatccctggtccttctttaggcatcgcttcacactgagtccctgaactgacctgctaagacgatgcatcacatcagagtatcagaatctgcccaaaggacaacttcatcgaggaccagatgcatgatttcctctttcaaagaatctggcaatttaaagtcaaatgtggattttaacttgggaaattctcaaagatcctttaattcactgaataacttaagagtagcttagagcagacctggcattctgggtcccctttccctctgctggcaaggccgagtttcacgctaaatccagctgagtagtaatgaggtggctcaggtgttgacgtcaagccagaaggaagcattaacttgtccattcttagcctcttgttaagggcacctgatgaactgaccccgcagtctttcaagattgagggtgataccccctgatggccatgactattagaagactttgcttagatcaggatttttaaattcattgttaatcttaaaaaccttgcctccaaaccaaatctaatatggcttcggaaggggctccccagagcagagttagaaaaggactggatcaattggaagacaaataaaatgcacaaccatgaaattccctgccattaggggattggagggggagtgtctatgggttattagttttgcttggttgttttttcaattctattaagtgtggtattgtgaagagcttcatattcttcatgaaagaattacaagcgaaagggaacatctctaaaaatagtatctagccacccattcaacctctgctatctacgctgccattctgagttgttctctgccacagggattgagctcagaactttagtggtgataagctaattatcccaaactaaggataacaagtgggtcttgtccatcagtgactaacattaaggcgaccaaaggtaggcctgtgatagaattacacctttttcttccattctttttttaatcgcccccgcccccgacttcagagtttgaaaggtattaatggtaggtctatgtttcccacatgctctcgttatggtcttcggagggaaactgttaacaatggcagtaactttcaacacctctgtaagaaaataacctgctaaaggtcag

SEQ ID NO: 45524 - DNA, 843 bp, Bovine  19866881259294
taaataactggacaagtgtgcaaagatgtgtgtaaaagactgttcatcacagcattgtttaaaagagcgaaaaattggaaatagcttaagtgtccattagtggagaattgcttaactacctgtacatctgtctcccgtccagtgacttaagatgatactgtagatctatatctgttaatatggaaagtagcccaccatctattcaatgggggaaaatgatgttataaaatagaaggtacagcaggatgccatttttaaggagaattttaaaaaaacctttatctgcttctgtatcagaaaaaagacagggtgcattcatcaaatgttcacagagtctttctctgatttagaggacatcaaggttgttccttttatgcgttttgggatcttttgacttttttctctcttttccacattgaatatatattaaacctagaaccagaaaaaatatagatattaagacatacagacatgtgccccttaagacatgattccaatttctatccaccagaatcatgacgtgtaatgaagacactttcccttttccccttgtccacctgccatccacaccgtccttctctggcaggtggccctcctcggtaggaggatgggctgggtggagatagggctccagtgatggccgtcacataaagatccacttctccaatacatctgtgtatccggaagctctggtctctgtggctaatcctcccagactgtcagtcaccctgctctcgtttttcccttgagcttgcccagtgatttggtgccatgaagacaaaactgaagacactggttctttgctcttggcttttgactacagctggttccgccttcctgacc

SEQ ID NO: 45525 - DNA, 1781 bp, Bovine  19866881277781
aaatcctgcacccagaggcagccaagactgtttttgagaaggaaggagttctgcttcaagattctaggggtgatagtaacaagcaagaacaggtgcagtgggtatatggggacgtgggctgagaacacagaatctctacccttggcttccagtccagccctctgaacctatctatgagttgatgccaaattcctttggaaaattatattctgtttctgtccagaccagaaccatcatagagagcaaagggcaaaagaaggaagttaccatacctgccactgaaggtggctgtcattttttagattaaacataattacagaatgataggttcctccttggctttttcccacctctcctggcaacatctggcatgggagagctaaaacgctaaaccaggaagttatttacttaggctctatctggcctgggttaaccaaagaaaaaccacacagggacagtaaatgtcttgtgaatttcatcacaggggggctgagatcaaaggcttggaacatcagtgtaatcacgttggtctggatgtcagcaaaatggctcaagaacaataaatgctcagaaattgcttgatcaatgcaaacctgacctgggactctgaagcagcaaatatgggacgtgatcaaatagttactttagtccaaggcctcctgagggctgcggatgaggctccaacagagcctttgccagtgtactgaataaaacaagtgtcaagaggagccagtgtcatctcagggtaccaccatggccatctatcatagtgtggggctgagatctccaaagaggtagggctgccctctcttttagcgttccagtccttccaagcttcccctccatgaaccttatggatctcagcacctccaaaatttttgaatgtctgaaacacacagaaaccaggatgccatttattcttgtattcagccaagatccttggagcacaccctgttattggtgtttagttgcttagccgtgtctgactctacatgggctcctctgcccgtgggacttcccaggcaagaacactggagtgggctgccatttcctcctccaggggatcttcctgacccaggaatgaaacccacatctcttccactggcaggcagattctttaccactgagccacctggaaagtccaccctatttgccacatttagcaagttgtgctgcaggttttctactctcagggaggtgttggtctagtaagaaactgaagacagagccatgaataactactctaaacagtaacagcagtgctgggtgagagggtggaacttggctgggcctgttcccttgggaagggataaaatgggaagaagtgttgggaggcaattcgagatgaagagaacagtgtataaggaacagcaggtgctgcatgcttgcagaaccgcgggaggtctggttatgctgcagagtgaagacacgcagagcagtagtggagaactggggctgaaaagccagactggggtcaactgtaaaagctgtgaatgccagtttaaggagttgagccccagtgcaaagtcacccatggctttattaaacagaaggatgaataaagccatgattatagagatgaagaagaacagaaagagcagcaacagatgagactcggtcacagtctcaccgtcatgctgatcctctattccacagagaccacaatactaagacctcggtctggaggaaccttaaatgagacatcaggcttgggttttcttctctgtatacggaggagctgcgtcgatgaattttaagatcctttttaagttgccagtcca

SEQ ID NO: 45526 - DNA, 954 bp, Bovine  19866881284817
atttataagacagattgtactttcaggaacattcaatctatattaacacttaacatttgacgatgatcttcagcagaactgtgtgccaagtgctttcccattccatcccattctttataccctctttataattctgttcttctctttcctgaagctcacagaggccttcagttaccctcatttttccagacagcaaggaaaatagctaagaggccaaattttcactaggatactaatatcttttaaggatactaatatctgttaacaacttgatgtaatattctcttcagcaatttagcttagttttgatatagatgccaacaatttacttttaaatacttagtttcaaaaatccctgatgatctatttgaaagcaagcatcatgatctccgtggggtttaactcaatattaagagttggtaatattcatagtaaagaagctgtcccttcactcattctgttccagacaatgtatgggattatcttcaggaacaatagcaatttctgtagcagctttgtgaaatagacattaattctcccatattttggatatgaacactgagacagaaagtaaattacagacccaaggtcacgcaggtggaaccagttttcaagacaagtacatctgacttcagacttgactctgacattaagactgcagcttggtggcatgagagttggctggcttctccagttttgcgggctgtggaacaaatgtgcttcttttgggtagcacagcaagaaacctttacttaatggaggttaggaagacacatagagaattgggcaaggtattgttatgctggagtctctaagccacttcaaagagtgaagaactagattgggccacaagaccaagcattatagaagcctgaggttggatctgagcaaaagtcattgagaagccaagaagccagtgaagacggtaagtcctatgtgtagtactgtgtagtt

SEQ ID NO: 45527 - DNA, 1477 bp, Bovine  19866881297175
tcagaatgtaaagtgataatgccctgagctctgccaaacagtacagagctccggagatgttacagatgcagctgtgaccagcaaacaacagtgtttccgggattgtgtttgtaaatacatgagttgcccgacagcttgtggaattaaatatagatgctacatcacaaactctagctaaaataaactatatgctgctcaatgaatgtcaataagtacactgagaaagaatcattatccctttctgtagcagggtccaagaaacccatctctaagtgatttttcagttgtttgttttttgatgaaggcaaatttttttctccctcgggccttggactggtattgcaggcagctgggggagggtggtgtgaagagacaaagtggatgccatcactaagtcaggtatgttgggagcagtgtgtatggtatggtgacaggagccagctgggaggttaccaggtagacaaagaaatcactagtcaacttttttggggactgatgaccaaggggcaccatttctaaaagtatggcgtgaggccattggtggtttggaaagattgtttaagggaaacatgcttacccatcactatacatctgctctttggttctcaaactaaattattcaccttcttttgctaggattactacaggtggctcatatattaccaacatcttgtattaataatggcaggttaacagaagcaggtattcccacactaaaatcagcattctgcaagagtttactgagcactctctctccatctggcttaagctgacatggcttattgccatgcaaccctttgtgctgatgcaaagctcactgtgccctacccagatcaccaaacctccactctaggaagtggtacagaaggaggggtgctttgaatctagggtctcttcagtattaccctgaggacttaaggtttttacttgtgttgatcatgtcatgtaactgctgcttttatttgtttgcttgcttttttatgaagttcctttgcttccctggtggctcagatggtgaagaatctgcctgcaatgaagaggaccctggtttgattcctgggttgggaagatcccctggagaagggaatggcaacccactctggtattcttgcctggagaattctatggacagaggagcctggtgggctacagtccatggggtggcaaagactcggatacaactgagtgactaacacttttactcaattatttaacagcaagttctatctccactgaaaggagaagctatatacttagactgtagcaattctggtactatctggagatccttgtgcaaaaagttttcagagacttcagtggaagaactagagcaaagcttttaaagtcttaattcacaattcattctgtctcacactgctactgactatctaaactatttttgacaaattaagccttttgtaaaatgtggtagcaagtttcccactttcttccttttaggaaagttaataaatatctg

SEQ ID NO: 45528 - DNA, 2879 bp, Bovine  19866881319008
cggacacaactgagtgacaacactttccttcttcaccaggtctcaagtttcttgttcacagtgattaaaaataaaatactttttttggctgcactgggtctttgctgctccactgacttttctctagttgcagagaacagaggctattcttggttgtggtgcttgggtttctcattgtggtggcatctcctgttgcagagcacaggctctagggtgcacaggcttcagtagctgtggcacttgggcttcagcagtttgcagttcctgggctctagagcacaggctcaacagttgtggcacacagacttagttgctccggagcacgtggaatcttcctggatcagggatcaaacccatgtctcctgcattggcaggcggattctttaccactgagccactatggaagccctcaacagtgatttttatagacagtattctgctaagcactggagttcaaaaattgtatcctagagcattcttacatccaatgcagtgaagccttctgtcccctgggatagtgtatgtgcatgtgtgtgtgtgaaacacaatttagctcctttaaaaccactttgagagttttatcaggtgtgtctcaaatatcttctaacaatgtgtcacaaatgtaacatcagcgatttcatgcacactttcctagtaagtatctatattcctctactatttcctgaacaaatgaattccttagatttactacctattttctgtgagcttcaagtaaatacttttaagtgtagcaaactatatttgaaaagtcaatatttgtaatttaaagaatttcacttatgtctattctcaattttaatttttaccaaactgatgaggcctgacatcctctatctattctagatgttgtgcagaatcaaatagccccacattttgttgaatttcttctcatttttccctatgctgttctatctccttttcttgctcatcattcttttgtggtggtggttgttgtttagttgctaagtcatgtccaactctttttgtgaccccatggactgtagcctgccaggctcctctatccatggcattttccaggcaagaacactggagtgggctgccatttcctgctccaggggatcttcccaacccaggggaggaacctgtgtcgcctgcattggcaggtggattctttaccactgagccacctgggaagccctcatccttctctacctcaccaccttcaagactcagtcctagatcttctgcttgttctccataggttatctcatttactctgttgattttattgctacctaaatgcacacaactgctaagtctagtcctccagttcagatattcttctgaactcaaaagctgtatgtatagtatttgtatatcaaatatgagcatttttatatctcagaggcacagaatgttaacatgctccaaactagatttactgtttctccctttacctgccatccctcttccttctgtttttcccaacctaataattggcactgcccattattcacaataaccaaaaggtggaaagaacccaattttccatcagcagatgaatagataaaatgtgttatacacatacaatggaatattattcggccttaaaaagaaggaaatgctgacacatgctacagcatggataacccttgaggacgttatgctacgtgaaataagccagtcacaaataagccagtcaatgattccacttattcctagagtgatcagattcacagacagaaaatagagtgatcactgccacgggttgagaggaaggggctataggaaagagagggttgctgtttaactggtacagagattcagtttaggaagatgagaattctggagatggatggtggggggtaatgattgtacaacaatgtgaatgtactttagtgtcctgtaaatgccgacttaaaaatagttagagatgttaaatttcatgctatatgtatctcactacaaacttttaaaagacaaaaaaagtaaggcaacatgttaaaagacaccacataaagcaatcccagaatgtggaacatgctctaggacaaatgaccaggttttagtaaaaaatcaaaggcataaaaaaggaggagagagggagggaagaatgattatggaataaaggaggcctaagagataaaaataaagaaaggagtaaacaacacccaccttccatctggggtcttaagccaggaacctagaggttatgcctgaatcttcttgccccatgtatccatttctgtttgcacatgtgctttgcttacagaaaccccctggtttcaaacttagaagcaagcaccaaaaagaattttgataaaggaggaatttttaggttttaaagttgcagggaagacttacaaagaaggagcctgctaagggccttgaatgctgggtgacttaagaaccggttgctggtgataagattctagctagagggacagaatgaagatacggtaggaataagcttgacacccgagtggcagttatggatgggcagctgcaggaaagccttcttacctgaccagtctggtcatgctgactccttgtagaggtgggccctctggagcggtgtgggccaaactccactcagggagagtagcatgtggttttgtagataggcaaatgcatgtacacgtgtgacagtctgtgatgtaaaggagtcagaaagaaattagatcgtatctaatcctggaagctcctgcaaaataggggtcatactaaacaaaggaatgggggacctaaacacgttgattgtgagaggataggtcttacagggaaagggcgggcttatccaatcaatgctgtactttagggagaagggatggagaggggacactttcaagagatgacttatcttcaaaggctgtttgtggatgcaggccagatgagca

SEQ ID NO: 45529 - DNA, 1167 bp, Bovine  19866881367941
ttttctatctgtgtagaaaatgaatataccatagttactgcttaagaagcaaaagataataaaatgatgctcgatctttgtttctcagattttaggctccccctttaacagatgagaacactgagcctaggaatagataagcgagttgcacaaggtcatgtatgttggtggcagatttgggtctacctattctggttccgctagtatttttactttgtgcaccactcacatgatttacagctacaagaatacacaggcttttccacttacaagtttgttcccttgggagcaagtcacttcgctctgagagcctccctatggtcatccgtgaaataatccctatggtcctgcccaatgctgaaatcccttaattctaagcagataaaaggaggacaaatataagggatgaggctctgagattttagtcttctttgggaggaggctctttgtttttgaaagggagtgaagcacaagagaagcgaggggtaaagcagagattcttgcctgttggagcagtgacatttaataaagtgattaggcagtgacattaaataagttttcaagtcatttgagtggttaattggccaactctattgaagagatgttttcttgaataaatctgagggcatccatggtacaaactcacagaaaatgttattcttttaatctacggcatcttgatgtaaaacctcttttaaatcctcctgttttgactagaaagggagagcagaccagaaaaatgacaggacatcctgcagtggaggttccccaaggggaggatggtggaagcactgtcagttcagatgaatgacttgcattctcctctcttgttgggatgatctgccagcttcaacacacactaaccatggtgtttttacccttataacacactcctggtagcacatcagagagcttcaacagtgcccatcattcctcatgtgcacccggggaaagatgtcactccccaactgccactgtcccctccaggctctggatgtggctttcagtgtcactcaccccacccccaaagtggcatggaactggcagggtacacttgatgcattcccccactgctaaacttaacagaagcatagggacagcctccctgcacagaatcaggttaacagtgttaacgatgatgtgtgcaaaggtaagtgctaatcatga

SEQ ID NO: 45530 - DNA, 1006 bp, Bovine  19866881369102
ctctttgcatgaggtggccaaagtactggagtttcagctttagcatcattccttccaaagaaatcccagggctgatctccttcagaatgaactaggggtagttcttgtctttggaagggtttagccaaatggggcagatgggaccttttcctttgggtgatctaaactttttcttttttttaaccagctatggaaagtgtgaaaatcaccacagggtaccttaccgagcagctgcaccttgttctctggactctgtaccagaacagagctgactgagtccaggttgtcgtagttgctgcagcccagggggccagttctggtctccgtgacctagagaaggaagggcgggtttagacaacaagccaaggctttccctttgccctgctctcttccggtcagccattctcaggctctgtgtcctgtcctggactggcccaaggaaggacatggctcgtcctaccctgggagcatgaagccacttttccccttgttctgagacagggaatatcagtggtgtagggctggcagcagcagctgtccagaagtgcaagcctttcagagaagccagggggactttgtgtctgaaaaaaagaaactcagtgtaggaagaggaagctgagcctccacactggagttcccccatctcctcccccagaggaagaccggaggccagatgcagatgctgtcagcccactggccagcccagctgtagccacttgatgtggtgctcacaggctttagggatcccaaagatgaaacacactagagaaatatgagttatgagtattattattaatattaaacatttaagttccacctcggcactgagacgtccttagagaaaatcagccgtgggcttactgcatattttaataagtatattaaatatacataatctcttatagctatgtaatattccaaaacaccacagagtcatgttaaaatattataaagttggactatcagtttttccctgatgtttaaagtataagataaaaatggggag

SEQ ID NO: 45531 - DNA, 1006 bp, Bovine  19866881502891
aattgattccctttttatttaattttataaaaagtcttctttgggatgtgtgatgccaatattcttttacccctggtgataggacagaaaatggagaagagaagagatgcttaagaggagaagaggaaggacacaaggagtgtggctgttgaacgttttacctgccaaattgattttttccctaggtttaataactccaagatggaaattgacatttttgcttgagcattaaacacataacattcacagcattcattggacctcaacagatactggctgttgacagaattcgaattttgacagcaattttatatagtgcagggagtctaaaattaaatataccggacagagcaatagagagaatattcgaaatagaagcatcttagaatatttttaaaaaccttttcaaatatttttttgagaggcagtataacagaaagagattctttctctggatttcttatgggctaatgctctgtgtgaccttgggcaaaatacttaactaagtttttgtgatgttttaaatgaggggtgtgtgtgcacatttatgcccttgaaggattgggcatctataaaatgaggacagcatctctgagttcctttgtagtacatgtgtctttaggttttatgatggtggggatactcaagttggttcccaggcacctttagagcataccaggtgatgtggcagctggaagcaagagaagggatcagatcagatcagtcgctcagtcgtgtccgactctttgcgaccccatgaatcacagcacgctaggcctccctgtccatcaccaactctcggaattcactcaaactcacgtccatcgagtcagcgatgccatccagccatctcattctctgtcgtccccttctcctcctacccccaatccctcccagcatcagagtcttttccaatgagtcaactcttcacatgaggtggccaaagtactggagtttcagctttagcatcaaatggggcccagataataaaaacaagggaaaatag

SEQ ID NO: 45532 - DNA, 807 bp, Bovine  19866880540158
aacattcgagtgggttgccatttccttctccaaggcatgaaagtgaaaagtgaaagtgaagtcgctcagtcgtgtccgactcttagcgaccccatggactgcagcctaccaggctcctcggtccatgggattttccagggcaagagtactggaggcaagagtactggactggggtgccattgccttctctgttgctagtaaatattaatttaaatacttactattggttacagtccaactaatatttaattatacatacacactttaattatactactgaaggcttgggcatgacattagaattccttcaaatacataattttttgtacaatggaaacaattttttactgaaatatttgctattctgcatgtattgaggctaaccatataggaatttattaaaatttgttatattttgctgcttctgttgcgtgaatgttgactcatatttaccctgtctgcttgtgctaggtagaaattcattcaaatttattgcatattatgccttgctttttagttaccaccgttagtcaaatatagtattagcttatacagggttttgtagcctagtatttactagtatacaaatacatgattatttctaagtacataactcaaattatttttcagtactagtataatattaatgcttatataaaacttatgcatttctatagaattatgtttcatattgtattatatttacatgcataagtttttttcaacaaaataattttaaaatttctttcaaaacctatttaaaagtgttgatattttatttttcatcagaatttttgctatatatat

SEQ ID NO: 45533 - DNA, 1716 bp, Bovine  19866880596981
cagagcaaggggctggcttcatactcctgcatcaacagtggctggccatggctttctgcagggaggggctctgaccagggcaaggtaagctccctttgtcaaaggcaattcttggaaaggaatcaggtctgagttgttagcagcagatgtccccaggagctagaactaaatgcttcagtcctgaaggaggtgtgggtggccaccatagtgtccactacgtggggcaggacaccaggggaagtccaaccttctctaagtatgtggagatgaactaacaaccatcaggtaaagcatgcttcctcctccttcccttacagagagaactccccagtgacgtgaaaagcaacgttttatctggatattctcagacttcctcaaaggaatgtgacagttccggggagagctaactctggccccagacccccacctacctcctttccttcccacttacagctccatcgtacaccccagcctgagtgagccaagctccatccacacccatatccagccacccctttattgaaaccctttatccttgcttctcttttatggttatttgttttgtttagtcactaagttgtgtctgactcttttgtaacccaccaggctccgctgtttgtgggatttcccagacaagaatactgtaatgggttgccattttcttctccaggggatcctcccaacccaggggttgaacccaagtcctgcttggcaggcagattctttgccgctgaaccacctggaaaggttatatgtccctaataattatcccatctgtctgatggttaaaaaaagaaaaagaaaaatgacaaagaactaaaacaactaaggcacaaaggcaaacttcattaacattctagtaaaaagtttactacgtcaatagtaaaagaattagataaaattaggatttaatggcttcaatgatcctttcaattttattatttttaggcatcaagattactgtatttttttagaaggagaaatttgctttaggaaaattgggcactgggtggtatagaccattatgttcaagctagactgggtcttgttctaaaatcaattatctgtgttcaacttaccatcttattaagttgctttaagtctcagttgcttcattcgtcacacatggataacaaattatttcaaaatattgttgtaggaactaaataactttatgtataacctacttagcttgcagtttctgtcatgtattacaacagttcagagccagatgcctgcatctgaatcctggccatgactcagaatattcataacattggaacagttacataatatagttgagcctgaattattttgtgtgtataaaagtgaggacaatagtatatgcttcttggagtttttatgatattaagtagggtataaataaaatatttaaaatagagtctaaaacaaggtaacaataaggaaacgctaagcacttttttataggtagtaatatcaataagtgtttctctttacttcctccttgtattagaaaatagagttttagaaaacaagggtggtcagaaatcatagagttcccaggtgactcagtggtacagaatctgcctgccagtgcaggagacttgggttcgatcccttagttgggaagatcccctggaggaagaaatggcaatccatgccattattcttgcctgggaaacttcaggacagagagcctgctgggctgcagtccatagggtcacaaagagtcag

SEQ ID NO: 45534 - DNA, 1062 bp, Bovine  19866880616804
cctctgtagctgaaaaggcagagagctgctcttcaattacaccgaaatttttaaaaagtctcaaagctgaatttggtttaggtctgatttttaacatttcctacatcttttcaatataggctggatcaaggtcaagagaaactggagtagattttaaatgaggaactgtataattttgtccttaggctattctctatggacaatatttaaatgtgatactttttttaaaataatgcagacacaggcaaaggaggagactcctgtactgctattcacttactatgatatgggcaatttatataattcaatttagatagatatacttttgctaacattttcataaagcaaggcatgagagtgcctgtactctaattttctgataaattatttcagaataatttgcatatatttctttgatgcatacaactgaataatcagtgcatagataaattattgaatatgatatttaaatattctttttaaaataaaatacctggtagatattaaaatggtatttcatattcagctaaatttacttttgtgcttgaaaatttaattcaaaatacatgtgtctaaaatttgtagataataaattattgaagtattttttattgcacccaaatggcaacttcttataaatgatagcactctacaaaagcctaatagtttttcttttatgggagatttaattagtagactctcaattcagtgatatatagcctccaaatctgttctctcactgaatctccacaggcttcctggattctacagatgtacagattaatctagatgcttcaggggaaattgtgtaacagatttcctcatttctgattgaacactaccataaaaaccactgcagtttctgtcttttgacctaattattggttgaagtcacatggttagtattcttgatatgaactctaaagaattatacccaagaagcacattgatgttactcaaatagcaggtaggctctaacttgactgtgggactgacaagccacaaagttaaacagggggagaaacaagttcgtcacttatgtgtttctcactttcctatttt

SEQ ID NO: 45535 - DNA, 795 bp, Bovine  19866880633624
gagccagagaaaaagagagtgaaccttatagaaatcagtatccagaaatagcatattagccatcttgagggaagggtgctagttacaattataaatatgcctaatgctttttgaagagaaatctgacattagaaaatattttaatcaggcattaagttactcaattcaatcaaatgtcaaaatgtgtgtgaaagagtttcttttcaaaattggaatataggattacgtaagagttgatgataatacaaatactgaaaatatcacagccaaagcagttcttactagtaatttattgtgtaggtgtaagaggatgttattaagatttaccaaatatgtactgcagctgatatttataataaaaatgctttgcttgttgaaagagcccaattcggaagcaatggcactccttttcacatcttaagtgagtaaaggaagaaaggagatatataaatattttgggaggagtgttgattatataacttgtcaaaaaatgcatctcttagatgcttcatctactgacatcatgaaggtcaatcccaggccttggacatctatacatggacataataaacactaataggaaatgtaaattttgctctctgccttgcctgcttcagataaaatgtgcttttgctccattcatatgcaccttttattaactgtttctcatattttcaatcaaattctttcttagccttattctttaatggtcattttcagtttatttttttaaagatttatgattccattttattgataccctcttagaaaaataatctcctagagaaacatttt

SEQ ID NO: 45536 - DNA, 962 bp, Bovine  19866880667157
atatcaggttactagagacttgtccttgaaattacaaaaatgtgtgaacaatatataatgtgtcttcaaatagatttattagcgcaagagtattcaaaacccattaacaacctaattatttctgtgtccacatgacaatattttattaaccatcatttacaaaattttgaatgtggaaaagaataaaaagagaagctttttaaaaagccatagggcaatttactgatttttaggttatgaatgtgcattagttgctcagtcgtgtctgattctttgtgaccccatggactatagcctgccaggctcctctgtccatgggagtttttcaggcaagaacactagagtgagttgccattttcctcctccaatgtatattcccaatccggggatcaaacccacatctcctgtgtctcctattttgcagacagattctttaccttctgagacatcagggaggcccttttacattttgagtaatatgtttttatgaatagaggttgcatgcttttcttaatttgcttttggaattgtgttttgaatataaatatgtacattcatttcagtatatttattacatcagttaatttgaacactctggatacttttattaataccatttaatcagcgtttgagtgatttgctgtcatcaaatcactcaatttccttcagatataaccagtttttctctggtattaattcagtaatgttaaactactcaatttcactttaataataacacagtacagtcagtaattctatatgggggggggaacctatctgtatcatgaattattttaaaagaagatagatttctatcttgttttaattcaaagatgtactgaaattcaaatgagtcaatagtatgttgctatataaatccttattaacatcttcaaagataagtagatgtgatagatagtaattagtgtgtatctatattgcctccaattatttaagggaga

SEQ ID NO: 45537 - DNA, 1617 bp, Bovine  19866880811512
tgatgaagaggacatcttttttttttttttggtcttacttctagaagaccttctagaagtcttccagaactaaagagtagaactggtcagcttcagctctttcaggatcagtggtgggggcatagacctccattactgtgatggtttaccttggaaacaagtcaagatcattctgtcatttttgaggttggacaaaagcccttcattttgaactcttttgttgaccatgagggttactgcatttcttctaagggattcttgctcacagtagcagacataatggtcatctgaattaaatttgctcattctcatccattttttattcccactgcttcctaagatgctgatgttcaatcttgccatctattgtttgactacgactcatttaccttcattaaacatgttttttcctgtgccagtctctgagctgtgtgtaaatggaatccttaaatcccaaaactattgctatctatttcagaaaatggaactaaaattaaataaatttcagtaacctatccaagatagctcagtggcaaaattagaatgtaaatcctgcaaccaaattctgaagcattctttgttgtaaatcagtgtacgtttgtattacttgtgtacttctgcatacctgttgctagggattcaagaacatgggttctgcctatatgagtgggaaactattaaaaaaaaaaaaaaaagaagagaaaaataaccttaattttttgctttgatgatatcaagcatatactacttgacttatttttttccttgctttttcttcttcttcttcttttttttttttccaagcaaaaatattgtctatggtagaggtcagaaagaaaacagggttactgaactctactaggaaaaagaagccaatgctggtatacctagattctaaacaatacgtaatcaacatgtatctgccaaatgttctaaaatgataatctcacagcactgggtatttcggtaaatgatagtctaaagaaacaatattcacatgtcatagctcgttaataaattttagctatacagtctaaatacttggatcacagaaatacttatttccatttttcaaactctggagcattgtaacaaactaaagttgtgtgcatgtttgaaaaaattaataaattattttatttatatttttgcttatttattaaagtctttataactgatatacaggtactgtaagagtaaataaatcttatgaattcctaatttatgcccagggattaatttattcactaaatatgtccaatatattcttgctttgaggctgtaacatgtataggtaatgacaaagcctaattcttctgctatttcctattagcttatcttcatttctttccaatatcctaatatttcactaactatttttgcactcatttataagtcaatttattttgattaagtaaaagaacagaattcttaggttgttttcattaagagtgttaacaaacatctgtcttactaatggagacctttggatgacccagtaaaatgctaccaattagtattaatattatccaaatagacacaacagcaggaaaatagagcctggtaaataatttctaagccagtattgataagaggtaagaaaaaaataaaacagat

SEQ ID NO: 45538 - DNA, 654 bp, Bovine  19866880837874
tttctatatatttctattctctgaaatggtcgtgaaccatatttgtgttgaatgaaaaacaagcaaggtaaagatggttatcatcttgaaacttatttggtagaatacacgctgtaagaaaaatatttattttttaggcttgtaatatttttgattgatttttaattaatgaaacatattaaagggaccatttaaaggaaaatttcttgtttacttcttttatcaactagaagcagcctttgtagaatatgaaagtgtgaacattaaagctctatttcatgttttcaaagctatatattcataatcgttttgtagatacatgctgttttcaagaaacaccggatacatgtttgtaaattatattaatatggatatatatataatatggataatgactatattctcaacttttctagtgctattttgatggcatatttatttttaagtgataggtttaacttacatgactcaactaatttctttccagcaactgtggtgcttaggtatgttttcttaagctccacttggtggtaactttaaaaatgtaatttaagcataagtcatcaactggtatacttttacaatatttctacctgaatcagtaatcattattaagcaatgattgaattatacttatacctagaattttcgtgt

SEQ ID NO: 45539 - DNA, 764 bp, Bovine  19866880857734
ctttaaatgtgcaatattttagtataataattttaatttgcaatggtcagcttgtgaaaactaaaggataaaagaaaattaaagttgtcatcctaaaaaccatatctaaacttcaattaattctggaaaattgaagattggattgactctgcaattgtctgtgaatttgaaaggtttcaggtgctgaatttcaaatctgttattctttgtttctattcaatatataattttaccaacctttaactctaaaaatgcatcctaatgtagcttcaaaatagtcaagaatgcatattaaatattatgttcatgtttacaagtaaatcccgatttagtttggtatttatgagccttgagcaatacagcaattgagttactatttattttgccataattttctattaaacattttttcatgcagggcaatttacaatcatgaaactaaaccaattagtttttattacaatgttgaaggaaaataggaacccaagtttaaacttaatgaaaatgaataccattaacatattgtgttgtgtgctctcattttattcttttacatattaattcaaagtttatttcatgtctagctgttcaccttacagagaaaaataaatcaaacatcatcaaagtgacataatgtttttgatgaatatgacagatgacatctgattcattgtactttaaatctaacaagggcaccctccctggtcagttatctttcattcatgagatataataattttccatgtttgcattttgaagaaaaa

SEQ ID NO: 45540 - DNA, 932 bp, Bovine  19866880975808
caaaaactggctgtggactggaaaacaaagcaatttcacgtacttgtggatagaccagtgccccagagtagattgcttgttgcagaaattttaagatgttgtgtcaaaaacactgttgtaaagtggatgtggcaattcaaagcaatgcttctctgttgattttgcactgttatatatgtggaatgcctagtataaacaccatggaagccttgcagtattttaggagacaaagtattaatcaaccactggggagcttaccccatatcagaccccctgaggattctgaaagtattttcagcagagcaattccaaagcctctggcaaaggaagggttttggtatattaaactcaactgcaattttcaatgagtgcagataggatgctctggaatgcttaatgtttcagcatatagctgctaaaaaggtgtggattctgttgtttattcttacatttatcttacctgacagaatcctacttatgtcctagggttttaaagtaatgaaatgcaaagagtgtctgctttttggcagttgggcagaatgcatatttacaaatagaactgaaaacaaaggacaaccaaaagatgtcacaagttctgaaattattttgtagtaaactggttttgaactttgtctaatgttaagtgaccatgaaatgattggattatgtttttccttctattatcaaacactagttggatttcttgaaacagtttttccattttaataatattacctgtcttcattactccaaactatcatttaactaggcatctatatttttcaaaaatcacttatttcctttgtttggcttttgtactggtcttttccccttaaagttaatctttaatgtgtacaaatctttttcacctacctctattcaactttgcatatctattcttcctttcctttcctctcaacatatttgttagt

SEQ ID NO: 45541 - DNA, 1744 bp, Bovine  19866880998611
acataataaggaggttgacttcaaaagacaaaataattatttattttcctaaaaagaaaactctcaatgtattattgccagtcaggttaaaatgcttatattttttcctcaagtaaatctttattttttgaggtattaattgaaattaaatttagataagaaattatttcctgagctttagatttttagcttctctgaagctaagactatatttctctctgtgctatatgattttctaagacattcttaggggcttataattattttattactttattacaaattacacctgaactctatcatttaacatattttattctaggtgtactcaattttcttattaggtttttaaaattgcaattagtctcatctccattactctccaaatgtctcgatttctttctcccatttttttttttttcccttcaagacaagtttaaaatattagttctgtagcttggctactaaaaactcatcattaattttatttccctcctaatttatatgaagctattatccctgctgtctcattcccttctgctacatttgttccctgtagttcttattttatgttctcactgattttcacttgctatcaagccttaaccaatcaatgtgtgtgaatttatatatatatgtggtatcttatcacttttattctgtaccaagcagtcaatgtttcttgagctattacatatttatgtcttctttgtgttgtatgtctatattaaggattatatttcaggtatgcatgcatgctaagtcacttcagtcatgtctgactctttcagaccctaaggactcaagcctgccatgccctcctccaggggatctttttcacacggggattgaactctcatctcctacagttcctgcattgcaggcagatgttttaccgctgagtctactgaggaagcctgtattttatgtatgaaattaagtactatacaattttaattaataaacattcctcccaaattatcttataaaaagtaccccctcaggaagacactactttcttcctttccctttatgtttctccccaaacactataacacagtgttttcagaatttctttttaaacgatgggggagcttagaagttaaagttagatggatggtgatggaagtgatactataatgagaagaaaactagcaaattattatatccaaaaccagattttcttttccattatgtgtatgttattgctacacatgtgggcaaaaactatcttcaaaatttttgcaaaacaagaaatactgtatttatatacacatgaggaaaaagagtgaaaagaaaaaaagaaaatgtagaaataaagatgtggagagaaatcacgatttggaagtttcatactaaacaggagcatttgtaattgaaaaatctatcaactaatacctgatttaaaaaaatatatattttgttttattcaggaaaaataatatttgctgtttaaatttgacttctgcatttatggatccattttatttgtgtggtattttcattaattttcagtaataaaaaaaagaaaaagatcttttctgtaagaattttccagttgaaaactggaaaccaaatattcaaacacagcaaatacaaaccctgtggaattgagtagtggatattcaggtagaaatattccttttatccaagaccaagttttggaaacaaactgacattagctgcatttcaaaaaatcatttcactgcctcattatgcgtagcaaacggctgcaagtgtcagg

SEQ ID NO: 45542 - DNA, 860 bp, Bovine  19866881018848
cccacaaagttaatacgagtgcttacctagttaaaaagtgatagagaatattcttatctcaagtgtatatttcccattaagtagcaataaccaatgtagcaaatgtggctatacctgaaaaaaagcattttagctcattttaaatcaaactttctttggtctaaactataacataacaatcttcaattcaaatttttatcgggttttgacacacacacgtgtcataattactggatacttaaacaaaagaggcaactttttttttttacttgaaaaagaaacactgaattttaatttgttattatatttgtaattgcatacttcttcaactacactggttgaggcaatatgtgaatttaataataaagataatactaatttctcagactatttgaaaattatataaaatgactaataaaagtgaggaaaaataaaaaaatatatacctttcagtttatgtccaaatatttggaaattttgtagtctatagggtggtaaaccaactatgtgttacaggtgtttagacatctttgtatctggagtttaatcatcaaggttaattggaatatttgttgaatttataatgtatgttgttgtttataagactctgagaactactatgggcttaaatggaatctgtttggctactaggcattattatgttttagtaatgttattaaagaaaaacaagagggaaagagtaactcatgtatttttattgaaattgttctaagctatttggcacatatgtcagagaattataaagaaggaaactaacatttctgatggagatatgaatcatatcacacaatatcttcacttcaaatacttataatcagaagaaaagtagaaggacatat

SEQ ID NO: 45543 - DNA, 1116 bp, Bovine  19866881077963
ataatttaaggaatcctaaaagcatttcctggtggctcagactgtaaagcgtctgcctacaatgcaggagacccaggttcaatcccttggtcaggaagatctcctggagaaggaaatggcaacccactccagtattcttacctggaaaatcccatggatgaaggagcctggcatgttgcagtccctggggtcacaaagaatcaaacatgactgagcgacttcactaaaagcatacttgaaaatcttccagttaaatttcttcatctttatataggtctttttatttcctaaaaagatgacattcatcaaatatttagggaagtagctacaggtcaacatagctcttttcttttcctctttttacaaaacatgctatttaaataaaagagaatcgtcacttcattgagatagatctcaaaagttgaaaattacctgtaatctgttgataattataataataagcgggattttttttctaataaacaccatcaggcagagactactatagttcagacaattttaagtctcaaaacttctgcattgtgcttttaaaaagttaaattaccatttcctctggcagaatcaaatgggatgggaatggaaatgtctttttcttgcaagacaatcagggtgtgattgattatgcttgtccatacacatggctgatggattttaaagtgatagcatctctaattgcaaatccaatacctgaataatgttgctctgagctttagtgaccttttaaaatagaaaaatatttcacatcaatccctctattgttattcatctgaatatctatttttactcatttgggatatgttctgctattgggcaatgtgccactaggtcataacaactggagctttaactactaaattgcttttacctgggcaaaaaagaaatgcagatgtaaaccatgtaaactactttgattcacaatattcattacaagtagaacattcttttggaaaaaaggaatctgagtagagcagtctataacaggtttttttcattttgagctacgaaatgccctagaccttagcaatgtctctgacaagataaagaaaacttcacaggtgcatgagtgacacacacacaataggaattcattaacag

SEQ ID NO: 45544 - DNA, 1990 bp, Bovine  19866881114799
acagaagcccaccaggctcccctgtccctgggattctccaggcaagaacactggagtgggttgtcatttccttctccaatgcatgaaagtgaaaagtgaaagtgaagtcgctcagtcgtctccagctctcaacgaccccatggactgcagcctaccaggctccgccatccatgggattttccaggcaagagtactggagtggggtgccattgccttctccgagtaaatggtactaacaacattaaaatcacacttccttatccccaaacacctgcaagctttgttttcaaactaaacaccccacactatctattgcttgattacatttttcttaattaaatggtgtatataacttgcattttcagttaacacagcaaaagaagccggcattctcataagtcatttttatgagttgggcccctatcattttaatgtagcaattaattaagtgtttaataaaactgtgttttattatagcaaagcctggtttcaagagtctagttacagtcgtgtcagcattttttgtttaccaactcctttttaacttctcaataattgttctataaaaatttgctttgggtacaagctatgaaatgctgtaaattgcaataataagctattgtttagatataaaaatacttttactatgactctaagtataaactgaatattttattgtctcctcccctggataattgtttacttatcaaaacatatattctatctgactgtacattaatgatattgctcacattgacagattttcttaattattttgactgaatggttatatctccaatgataatatgaacctaaagaaaattggactttcaaaaaccacacaaacataggattataatttaattatatcttgattgagaaaatgtgtatatacccttatgattacatggttcttattaaaatatattacaaaggaaaatacttttatagcaatgttttcaaataagcacataaaatacaaaaaataagtttgttacattttaagaattacatcttaagcaagtgtttagaaacttgagttttcagaaacgtcctatgaaatattacctaaatgttatcctgttccaaaattgttaagtaaaaaaaaattgtctctggtattctggttttcctatacaatggtagaaattgtttcaaaatatacaaaaattaactaatttaaatatttattatgatatcagatcagatcagatcagtcgctcagtcgtgtccaactctttgtgatcccatgaatcacagcatgccaggcctccctgtccatcaccatctcatggagttcactcagactcacgtccttcgagtcagtgatgccatccagccatctcatcctctgtcgttcccttctcctcctgcccctaaaccctcccagcatcagagtcttttccaatgagtcaactcttcacatgaagtggccaaaatactggagtttcagctttagcatcattccttatattttctaggaactcttaaaatatttcaccagagcattctacagatgaagaagctgaacctcaaaagactgagtgatttgcgaattttaacaaccagttagttgaaaaagccaaagactccttcaacaataccaacttctaatagcaaatgaaccttgtcaatcttgtcccctggagatgaactggctacctttgcactcacaggtattggttcttacctctcaaataacatctgctactctagtttctactggagaagaaaatggcaacccactccagtattcttgcctggaaaattccatgaacagaggagcctggtgggctacagtccatggagttgcaaaagagtcaaatacaacttagagactaaacaataacaactctagctcctgtacgatcctgtctttcctttacaagacggtttggtccagagactgctgagcttctgggtcaaatacaacttagagactaaacaataacaactctagctcctgtacgatcctgtctttcctttacaa

SEQ ID NO: 45545 - DNA, 1228 bp, Bovine  19866881173746
ttactatttcccctaattgaagggcaccttgctggtacactaaggaaaaaatcattttttgatggattaatcctattaagagtagcagctaaaatgcaaggtggggggaagaattagcaggtgaataagaaattattcacaattgagtatacacatcttccttgatttaggatgaagttacatctccacaaacccattttaagttgaaaaaatcctaagttcaaaaagtttttaatacaccaattaccaaacatcatacttagcctagctttctttaattttgctcaaaacacttgcattaccctacagttaggcaaaaccatctaatacaatgcctattttataacaaggtattggatatctcatgtaatttattgaatactgcactgaaagtaaaaagtagaatggttgtataggtacagaatggctgttaaatgaatcagttgtttatcctcatgattgtgcagctgactgggagcggtggctcactgccgctgcccagcagcaagagagaatagtatactgcacattgctagtccagaaaagatcaaaagtccaaagtccaagtacactttttttttggtcttttttttttttactgaatggatattgctttcacactctcattaacttaaaaaaccctaagccaaattcttattaagtcatggactgtctacatacatgctggtaatggaaaaagcaatgactttggagtccaaaacccctggggttcaattctgcctttgtcattcaattgatgtgcattcataaattcattccaaaatttatttgatccccagtgtcttcatctgaaaaataggcacaatagaacctacttcaagttattactctgagaagacaatgcatcagtggtgctcagggtctagcatggagcatccacatattcttagatcacttttctccaagggaaagtggaaactaacttatttagcagttgaagaaggtaaaataatacatgggcttccctgctggctcagatggtagagaatctgcctgcaatgctcctctttgtatattacaagcactttcagcaatattcactagaataaacattgataaacatttacctgatagataactataaggtataattatatttaggaaactataactataaaataggaaattaaaatgatagatctagtattgtctttactattttccctaattgaaggacaccttgctggtacactaaggaaaaaatcat

SEQ ID NO: 45546 - DNA, 943 bp, Bovine  19866881296583
tgtgcacttaggaaccagtaaatgtagtgccttgttggttaaagaagacaacattatgctgtagcttataaatatttatttaatttaatctctaacaggacaattgagtcatgtaaaataaatgaaatatattttagaacaaagcttatgtgtaaattaaactagttttcagtattaagaaggataacaattatttttattttagcaaagtggtttacaatgtgttatataccttttacgtggtgtaaattcatatgcttaatttcatgaatatagattcatgtacaacataaacccatatcagaactatagtaatggattgtcacattacagaccataaaaaaaaatgtttatgataaacataaacacaaacatcaactttctgatgtaaatctcatatagatttttttttttttagattttttttattattgatctgaaagcacaaatttttagtaagattggaataaaatttataaataaggatacttaatggaagtttgcacatatactatagagtgaagatgtcaaagagctgcattttacagtgataaagggatatttaattgaagtggaacatatacaaaataagattatgaggaagaatagccggaggtgttctatcaatggggtgggctgtttgggaaaacgtagtttattaatgtctctgaaaggtggtgctgaactgcaaattacatgagcaagcgttgtgcggtggcatcagaagctgtcagtgtatatgtgtctcggtattcagagtttgtcattatcagatgcatttctattgcttttcaagtactcctagtgagaactaaattacatattttaaaaaatccaaggctcttatactcatgaaatataaacagcattaaacagctaaaagaaatgcatagtgcagaccttgtaggaaaagacgtatcagtaaaatctttaaaaattaata

SEQ ID NO: 45547 - DNA, 1636 bp, Bovine  19866881378692
gggaatatagctagtattttgtaacaattttaaatgaaaattaatctttcaaaattgcataaaagttaaagaaaattaatagcctttgttaacacgagtgtggatgatgaacaaactacttctaaagatttagtacagaggaaacaactcaatattctggttgcagtgactaataattctaaaatatttttttaaatttcattattcaaagcataaataatgaattgaatcatgtgagggcttaggtaagaattcctcatcttactctcctcagtaatttttaaagactttgtaaaatcagtagttatagcagtatggacatattgactcctactatgtatctatccctgttacaaaaccttagaattgactgtaaattataataaaaaaactactataatgaaattcaataatgtcctagaaaatgttttatgagtagaaacattttttttctaatagagtaaagctgattagctctaaaatttatatcagtaaaattacgtactatccttttatccataatttttgtttttcactttggtacttattttaaaaactatgttattcctgtataaaaccaagttgctagtcagttcatctggccacagctgccaatcaaaaagtttggtatcaaccaagaaggcaagggcaccccactccagtacttttgcctggaaaatcccatggatggaggagcctggaaggctgcagtccatagtgtcgctgagagtcggacacgactgagtaacttcactttcacttttcactttcctgcattggagaaggaaatggcaacccactctggtgttcttgcctggagaatcccagggacggggaagcctggtgggctgccatctatgggatcgcacagagtcagacacgactgaagtgacttagcaatagcaatagcaattctcaaacttactatcactttataaatctgaattatttcaagaataaaggaacagtgtacaaagtattatctaacatagagtcataaataattacgctaactaatcagaagaaggaagcaaatatcaggggtatgtaagtatgcatatatatatatatacatttgtatgaatgcatgtatgcatttatctacgtatttgccttccagttattcagctaactggattctccattccatctctctctttcttttaactgagtagatatggattgtgttgtgtgctcagttgctcagttgtgttcaattatttgagacctcttagactgtagcctgccaggcttctatgtccctagaatttttaaagcaagaatactgaagtaagttgcaattgcctactgtagaggatcttccccacccagggattgaacctgcatcactagaatctcctatattgtccggagggttctttaccagggcactacctgggaagccctaatgggttactgagcattaatctatggcttttcaatagcttttatttagccatagattttggagtgctttcttctctgaactatgtaaaacaaatgctcaaagtaagcaagaacatgtgatattgaaatgacttctgagcaaacctcaacctcaaatatagcctttgctcaaaaaagtctattactcaaactgctaaaataaaaccaactgaggaggaagcctgtaaca

SEQ ID NO: 45548 - DNA, 1232 bp, Bovine  19866881412870
cagaaatacttagcagtctctatttacttcagcagattcttgtgaattacttgttaaatattattctgtaaaaagaagaatctattctgttggaaatacttagcagtctctatttacttcactcttactacctatgaatcagcactaccaacacactcaatgctgcccaggagtcagttaagaagaatcatgtgtaaggctgcattacttcttcacattataaagtgtattttattgttaacttatgatctggcatggctattgaaataaatttagtcaatggtaatatttgaaataaataaacagcaaataggttaaaaattgtatcaaattaaacgtattttgaaattaatgataatgtgaaaattctaaggtcatttcactcttttggggcactcttagtgaaataaggatctcatgtgaaggataactaaatgtggctcttttctgtaattggtattggatgtcaaaacagttaaatatgtctcagcataaatatttacttagctacctcttaaggatatgcctatggtttaggactccagcaggtccaagaacttggcagctctaagcctttatgcctgcaggtgacaggttactgttaatgacaaatgggtcgtctctaacaagcaggattgtcaggtagaaaactcagcatggggacagatttaaagtggcttaattatacttatttagaagggcttataagaagagcttattatacttatttagaaagtatttactcagtgtcattattatctatcacagtgaatgaagagagcatttggtttacttggtggaggcggtacataaacagccgttttaggatctcttctagttatgataatctgaacaatgaagatgcagaaaccaataagagatgtttgtacgtgtgattagtcacatccgagtttttgagactttatggactgtagccctctgggtttctctgtccattggattttcccagcaagaatactggactgggttgccatttgctcttccaagggatcttcccaagccagggattcaacccatccttaacattgcagggtgggttctttattgctgagccactggagaagcccaataagaggtgtttactgttcagcagacagaaaactatgaaaagggaaagaaatgaataaatactttgagtaaagtgaaagacagtggttaggtgatgaagcaactgctgctccaaggatctaatatcttaggcaagtattata

SEQ ID NO: 45549 - DNA, 1274 bp, Bovine  19866881536970
ataaaataaagctgatcccctaagaagggcaggtaaaatgaaattcctcaggtgtaaaaggaagagtttgcctctgagactatctcaaacgtctggtctactgctgccttagaggtcaaatgacatgattaatttatgctccaaactcaagtcacttgtccttaacgtgtatgtggaatctgtcactcccatgacactgggagtctgtggggccaggtattagaaaaagtgatggtggtggaaggtgtcagatcaagaaaatggcaatgcttaaacagaagctaggggatcgtaaatatgtccagatgctataggatgaatgcttctattgatttcttgggcatcttccgacctgactttaattctttcaaagtaatatgtggaatgccaaaaatgtcagattgactttctaaatgaggtgaggggaaggtgagtgcaaatggtttcttaaaagttttatttcttttgacacatattctgttttacccatctgtaaagcagggtgggtggttccaatgcacattttatgaatttgaacttgaaatgactctggtttaaaaataataatggtaatgtgttaaaagggtgacaggaactccagtggcaaagatgaaagtctgcacattgacaggctaattaatacaaatagtagttaccatagccaatccacattcgagattttatttggaacaactcagctaaatatgcactaagtgagttaaaagtaaagttaacatacactgtagtgaaggctggtgttaccaacagaccaggaacacattgtgaaagggaaaaccatagtctgaacctataaggtgttctttccagagagactcagtcaccctccagcacatgcacaaacttgctgggttttatttatgctggaatatttctatattgaaaagcaatataattgctgaaataccactactgttcaaggtaatttaattcctaatggtttatttacatagtgaaatttgcattttatttcacagaaaatgttgtgactccacctgccctcagttcagttcagttcagttcagtcgctcagtcgtgtccgactctttgcaaccccatgaaccacagcactcctggcctccctgtccatcaccaactcccagaatttattcaaactcatgtccattgagtcggtgatgccatccaaccatctcatcctctgtcatccccttctcctcgtgccttcaatctttcccagcttcagggtcttttcaaagagtcagttcttcaggtcaggggccaaagtatggagtttc

SEQ ID NO: 45550 - DNA, 919 bp, Bovine  19866881649703
ttatgtaatttgacataaatcgagggagattaaaagtgagtggcataacatgagaataattaaagtcttacttgtgtattggttttactttttattttgatgtgcttaattcttgtgagtagacagagacatgtgacataaaaaaaaactgtatatcagcatgacaactctatatgttgagtcagaagaaagtattttgcaggtgctgataatgtaggtatttgcatttctaattgaattacacttgtatttgattaagacactgactaccaatgtgtctactgcaacttaggctctattcttacatttagtcctgaagactataggaaggtaatcttggaatttctggacccctcataaactattctgagacagttggctgctatttgtttaattgtgttgtctccttaaatttaggcaatcaaatgagtcctcactcatatttccctcacatgactaaattcataaagattattcaaaattcaaaccagttgtcatcttgactacacatagtcgactgacagaaggatctcattttttgttttccaaatatcagtgggtttcaattaaattatgtaattatataaagtaaacgaattttaaaaatccccacagctctctctcaaaatatggctcttggcctccaatgaaggattgagtgagaaatgtggcagtaagccaaatctgtctttcttccaaaatcagccacaatagaatctgctgagttgaaacagacaataggagtttagtttggcactcagtacttttgaccagtactctatttgcaacatgatttactgggccaactgcccagggaagctctgtgtctagttgcccaattttgaaataatggagaagagttcatgaccaccatgctttgtaaacctacatttctgaaaattatatttctccatttaaa

SEQ ID NO: 45551 - DNA, 703 bp, Bovine  19866881657811
cacacacatttgttttttaacgacctttcaggtctgtcaggtgtgaagtattcagctgtatcctctgcccctgttacatgtgtgaggagataaaaagtagcagtgatgtgatcatgaatttaataaaatttaaactcacttaagcaaccagcattcacattatggcacttcaaaaatattcagtggcaatctggagaaaaatatgattttatttgtaatgtgtcaggaaaaataagaaaattttcaatttgaaatgctgtatagtcaatctctttgatttaaaacgtgttttataatactgcctagaagtgcaaatctcttccaaaatgaatgtattgccttgttcactaagtggtatttaaagtaactacccagaaaaaatagaactgtcatatagtgaatggtataccatatagcaactgtacttagtgttatctatttttatactacttttttccatggtgcactgttttttttccttctgtaattgttcagcatttcagcatggaagtatgaagtgtgggcaaatgttagagggcgaaaatatggctgtctctgtacattcgaagtctgcgtttattactcttatgttaaccatgctatcatcccacaaggacataccaactgtaaacttccctatgtcttagtttttatgtaagaaatgtatcatgcaaagtgagaattagcagccaagaggtaagtg

SEQ ID NO: 45552 - DNA, 713 bp, Bovine  19866881910614
acagacaaatagaagtgtgtcgcatgtatatcaatagattctctcaaacactgtctgaaaccaattttacagtctatcactggaagaacacagtgcacaagactgaaaagtaccacccacactccacaactttgcatctgtattttgctacatcttttttttttttgctttactttaaaaatattgaatttatacttctgcagtagcaaggacacaataacaggcttctgcttagtcacaggacagaatgttgatgccattaagaacttctttattataagataatttatttcaggagaccaaaggatagcaatacatcactgtcaaagctagtggtgaaagctatgactaactgtaaaatactgtgtgcctttgaagggaattcttgtcaatgtctcctttgctaaaacaggttgacaataggttagtgtaggtccaatgaagatttaaaagcgttttgtagatgggtgtcagaagtcaacactatcttcaaattgataggcaagatgaccattatgttagtctctaacaaatagacagtcattggttgaaggaattcaataggaaaaaaaaaaaaaaacaccctctccctaatgactttactaaaagatggctttaagataatgcccaatgggatttattaaacagaagcatcactgaggggaatacattctgaagcaatgactaaaatcacaattaacaggtgcatttgt

SEQ ID NO: 45553 - DNA, 1371 bp, Bovine  19866881985242
tttatgagatgctccaatcttgaaataatctaaactgttaatataaagcattggctcaggtgtataaaacagaaatttagtaccataatttgagcaaaaagtccccaaagttggggtaattaacagagctcgttatatatctggataatcaaaattaaactaaaattattcattattcatagaaaaatataaaacttcatggaagtacatcttgtttattagtcttatgagttcattgagactgtatatggggccttcctaggaggacatagcaattaaaaagaatcctgatagaacaagctcaggaactgaatatccttgccaatgtttctgagatgatttcctgcttgatattttataattttggttttggtcaaaaacttagtttaatggatggattctatttatatcctatggtgaagattaatgaaatggtgtcttggaaacagaaggtcagtgtatatattttacaattatgcacactctgcctcttttccacttgtaaaaatattttagtattaagctttattatattgcaaaaaaagaaatcaccataagaagatacagctacaaaagctatctaaaaagatataaaataatattctagtcccatccattaatatatcagagctatacactctgatttaataattttagagcacatgattagagtggctaatcagaaataagggtgtagctattcttctgtttgttatacgagatcttggatatttcttaaaggagaccaaaaaaataacaacttgattcaatcgtgcaactttttaccctcatttattgtatgtgaacaaaagatgagtgtcattcatttctattcagtttccagattcctgttgatatattgcaggaacaaggcaatattgtaaagtaagtatccttcaattaaaaataaataaattttaaaaagattaaaaataagagttgagattggctttttttttttttgcaacctagcacattattgtattaagattcctgctattattgcaactaagtgccacaaatagttgctttaaacaaataagttttactattgcatttttgaggcaagaagtacaaaattagtttttctgggttcaagaatcagtgatcacgtgattctatttttctggaggctcttggagaaaatccatccccttgccattttcagattttaaaggcttcctgcatttcttggcttctatctcccttctgtcctcaaatccaggaaaataacatattctcttcctatcttaaggaccttgtgagtacattggaccaactcagataattcaaaataacctttccattcaatggtccttaactcaatcacagctgcaaagtcctttgttgatatgtaaggtaacacataca

SEQ ID NO: 45554 - DNA, 1740 bp, Bovine  19866880068462
ttctgacttacttcactctgtataataggctccagtttcatccaccctcattagaactgattcaaatgtattctttttaatggctgagtaatactccattgtgtatatgtaccactgctttcttatccattcatctgctgatgggcatctaggttgcttccatgtcctggctattataaacagtgctgcaatgaacattggggtacacgtgtctctttcccttctggtttcctcagtgtgtatgcccagcagtgggattgctggatcataaggcagttctatttccagttttttaaggaatctccacactgttctccatagtggctgtactagtttgcattcccaccaacagtgtaagagagttcccttttctccacaccctctccagcatttattgcttgtagatttttggattgcagccattctgactggcttgaaatggtacctcatagtggttttgatttgcatttctctgataatgagtgatgttgagcatcttttcatgtgtttgttagccatctgtatgtcttctttggagaaatgtctatttagttctttggcccattttttgattgagtcatttatttttctggagttgagctgtaggagttgcttgtatatttttgagattagttgaagtacagttgatttacaatgttgtgcttaatttctcctatacatcaaagtgactttttaaatagtcttgtcaaaaatcaaaaactttgactgtgctagtgaaagtaggagaaagcagacactcttgtacattgcttgtgacagggtaaattggtggacaaatgtatacatataactgattcactttgctgtatagcagaaactaatacaacattgtaaatcaactatattccaacaaaaattaatttaaaaaataaaaaaatggataaaacatgtgttggtgagggtaggagaaagcaggcattcttatacattgcttgtgacagggtaaattagtacaaattctaaaaagggcaatttggaaatattgatcaaattacaaatacacatacattttgacttagcaatcccatttctagaaatggaacttgttaagtataggatccatgtgatataacatgtatacatggttacttttgttgcatttcctttacaagcaaaatgttgaaaatattatgaatgtccattcctacctccttagataatttaagaaacatcaatataataaactattattcaccataaaaagaattagggagccctttttttcccactgatatagaaggatcttgatcactgctaaggaagaaagttaagtgcaataagtatagttcactaccacctatgtaaaaaattgagaaatatatttgattgtatataataaatatctctaacagagggggaaaaaagacagtgaactctgtgattgggaaacctggataggaaggaagtttgaaccatacgaatcttttttttttaagttacatattaagtatataatctggtcatagtggaaattaggcttctaggaactcatcatttttttaaagtatgtacaatttgaaattaaaagtaagaatgaacttaatcacctccacaccttagtcatgtcagtcttctgacccaggtcatcatgcacttcacctgccaaaaccaaaactgagaattaaaaatagatgaaattgaaactagatttacacatttagtttgaagaaatatacttgtttattaaagcaccactactagagaacattagagttcaaa

SEQ ID NO: 45555 - DNA, 1217 bp, Bovine  19866880412578
ctgaattagaagccttggctccttaagtagtggttttcaaccttagctgcagattagaatcactggagagctttaaacaaacactgatgcctgggttcttcgtgccttcacaagagtctcctttaactagggggtggtttccccagtaatctaatgtgatccccgtggttttgtagccatgtcaggattatctggggaacttttgaaatttctgatgcccaggctgcaccccaaataaaatttaatgagaatttttgtggatggaacctggtatcagtattttttaaagtttcccagctggtttcaatatctagttaaggctgagaaatagaaaaatctagaaaagaaatcccttccacatagatctaaaaggtggcatcttacatcctcttcaattcacctgggtctctgaaagctctaaaactataggctgaagagttgtgatacaactgagtcacaaggtaaagtgcatgatcagatactctggattgataagaaatgaaagtgatgatcagttcaaataagaatctataaaataaataagaaatacacctgtggcaatgagctgttgttagcatttattaaacaccagacactggtattagcctaaaaacagaggaagaccataaaatggaaaattattcttaatattagagttttcaaagaatagctaatatttccaaattgagctatttccaaatagctgttatttccaaatcttccataatttaaaccttgggaacttaaggaaatgcaggtcaccagttctataggattccattttgtcagtaattctacagttttcattaaattccatagatatgtttgtcattgtctattttttttaaataaggttgttgtgatttttttatttcttcctttgacagtgtgagttatttttttcttttagataacctactaagaactcattgaagcataagcaagtttaccatctttatatttagaggagatatgtatatttgttagctactagcagagattcttgttgagcaggaacttatccaaagaattgttgacaattaaatcgctgaagattttgtggtcaaagtcaaatccaacaacagtgtgtttattttctttttgccgattgttaggccatatcccatcacagtctaacaatccaaaagagaatattgccaaatcactggccagttttcagaatggctaacccttttcttactatggaactttcaatg

SEQ ID NO: 45556 - DNA, 1656 bp, Bovine  19866880431431
aggcctccctgtcctaccactcctggagttactcgactcacattctcgagtagtgatgccatccagccatctcatcctctgtcgtccccttctcctcttgcccccaatccctcccagcatcagagtcttttccaatgaggcaactcttcgcatgaggtggccaaagtactggagtttcagctttagcatcattccttccaaagaaatcccagggctgatctccttcagaatggactggttggatctccttgcagtccaagggactctcaagagtcttctccaacaccacagtttaaaagcatcaattcttcggcactcagccttcttcacagtccaactctcacatccacacgtgaccacaggaaaaaccatagccttgatcaacagggtccaaatgaggctttccctcaataatcatagcaatttcttgatttgatatcgaagagagaactgaacatagtgatttgctgtctttgatgcatcatattgacatgtatgaagtggaaattctattacactgactttctctattatcttaaacaaattattaacatagtatgtgccccaggctccccctttttaatgacgggttgataatatctgccctatatttctcataaagttgttcagtaataaatatgaagatgacccaagaggatctggatagtgtggcaacaagagttggatagaacctttcctgcctattactgactaagaaacagtcctcttcatctggacttctgggcctcctattccaaaagtaaacaaatgatctcttactaaaaggtatcatcgactgaaaaagatacacaatctaaaatctggtgattgtattttatttggcagacttcctgaggacttaagctcagatagctctgagggactgctctgaagaggaagggaggagccaggatatacaggggtgtttgcaacaaagatcaagtagttggaacaataaaagattactgttaattaaagaaaactagacatctcaagctaatgtttagcatgcttttctctgtatgggaagctgcaagagcctgggcccactgaaatcattcctaggatacgcaccttaactatacaagggtcagtatcatgttcttttccatcctgaatcccctcagggtacactgctggaggtggttgccgtggctgagggcttgatggcttcaacatcattaaacaatatggcaggcgaccttctccatccttagtatatcccacacactcctattgggtatactcactgttgttgttgttcagtcactaaattgtgtctgactccttgcgactccatgaactgtagcacatcaggcttccctgtccttcactatctcctggagttgtctcaaactgatgtctattgagtcagtgatgccatccaatcatcttatcctctgtttcccccttctcctcctgcctttcccagcataagggtcttttccagtaaactggcccttcgtatcaggtggccaaagtagatgctgagcttcaacttcagcatcagtccttccaatgaatattcagggttgatttcctttaggaatgactggcctgatctccttgatgtccaagggactcactgtatattattatatagatcggatttacggtctttattttctttggctaagtattacattttaaccaaca

SEQ ID NO: 45557 - DNA, 1610 bp, Bovine  19866880471017
ctttctgggaaagtttcgccctgaatatgtataaaatacgaaaaaatttttcctcattaaagatttcttgttactttgttaatttaagaacataaaaatgtgcttcacttaaaagaatcatttacgcaagttataattataaatctctattgtgtttgccttgaaatgttttaaatttcagttgaaatgcctctaaagactctaactttaagtgtatctacattaattagttttgggaagctgttagaagaagagcagggaggaacagaaagagagaaggaagacataagaacagaagaaactgtgaacattaaagcaaaacaaagaaaaaccatctttattggtttagtgtcctttcctgtgctatggagactcaaaaaggtactcatttttcaaaaagggatcttgggaaaataggaggggaaaaataagtagtacttatagttttgccatgtggagttctacctaatcagtctcattttcaaagctatcttgatttatcatttctccactgacccttcatttttattgtctgaaagcagaaagtttactcagattaagaaaagcttctttacttttttaacatgagagtttatttcctgatttaatgagatcatttccaaataaaaattatattcattcatatgttgctgaaaacagaaaggtggcaccatattataaggaaaacacgcttagccgaattccagtctacattcactaggcataagtatattcttaacatcaacatctatctgcatagcttatattagcagttttctatattaccaataaattttatctttattcctcttttgtacatatatataatgttagattctcatgatttgcagcagcatgatttacaaaatattctgcatcttgataaagcccttcaattttctttcctccacattttaaaagagagaaaaattcagagtacttaaaataatgagttttatctacatcagttggaaggagtgtgtggcagaaaatcagtttcactgactaaagtccctctaaaatgcacgtggcattatacagttaaactcagaagagtttataaacagcctcaggaacaaaaggttctgcagtggataaaggttttcagctacctcttaccaaggagaaatcctttttctactaactgcaaaaagacatgcccccatatcccattctgacaacttttcactacagagattcagcaccacaatattatttctctttttcttcttgtatctttggaaaagagtcattacaacatgaacccacttcacatatcttgtacttgttttcgctctcctatggatctcatagacgatatctaatttcatgataaaactctgaaaacaatgttgtgtatgtttgaggtctcctcaggaaggcagcacttactcatctatctcaaaaagtcaacaggaataagcccttaaacaaataagacactaatttcttccatctcctgaaagaagaggcttgccctaaaaagggaaaaacaaaattcactgaagtctttgacactgaaaggttaactgcactacttctcatatatgcactgatcagaagagttcaatattaaaacatttctcactaaaggtcttcagtgaatactt

SEQ ID NO: 45558 - DNA, 1219 bp, Bovine  19866880598608
attatactgttgtctgttatgtgtgcaatagcattatgtataagaatatacatacttaattaaaaaatactttattgtgaaaaaaatgttaataatctgagtcttaggtgattcataatattttggcaatagtaacatcaaaaaatcactgatcacagatcaccatgagaaatacatgtgtttgtcactagtcatgtctgactctttgtgacccccatgcactgtagcctgccaagtttctctgttcacgggattgtccaggcaagaatactggagtgagttgccattttttctccaggggatcttccccactcgaggatcgatcttgggtttcctgcattgcaggcagattctttaccagctgagccatcaggtgaaaaagtttgaaatattaaaagaattacaaaaatgtcacatagtgacacaaagtgagcaaatgctgttagaaaaatggtgccaataaacttgctcgatgcagggttggcacaaatcttcaatttgtagaaaacacaatatatgtgaagtggaataaagtgaagcacaacaaaatgaggtatgcctgtatttccactttatactggtaaaacgtacgaaaatgttatgcgacttttgcaagataacacaccagagtgatgatgcagacatcccaaattcctcttcagtctgctactagggatctttttatgaaaatacatcaaagaaatcccttgaaatataaggaatcaaaccaagatattaatgactggtacctgatattgtgtatgtgctggagtgggagtaagaggagagaagagaggaaaagaatgaagtgcggggaaaaaaataaaaatacacttaaaacccagcatgaataaagtaagctcttctatataaaagtatctttgtatgtaaaaataaattagaaaaaattaggcagagctagatccatatttactgacttataataatgtccaagataaattgttaagaaaactggttgcatattaatctatgtactagaattttttttgttaaaaaaaaactacttacatatctatccatatatatgtgcgtatatgtataagcaagtagaaagtgtgaaatcatgtacaccaaatgttaacattagttacctctctgctgctgctgctgctaagtcacttcagtcatgtctgactctgtgtgaccccatagacggcagcccaccaggctaccccgtccctgggattctccaggcaag

SEQ ID NO: 45559 - DNA, 1517 bp, Bovine  19866880616123
ctttggcccctcatgtaaagagttgactcattggaaaagactatgatgctgggagggattaggggcagaagaaagaggggacgacagaggatgagatggctggatggcatcactgactcaatggacgtgagtctgagtgaactccgggagatggtgatggacagggaggcctggtgtgctgtgattcatggggtcgcaaagagtcagacacgactgagcgactaaactgaactgaactgattcataaaggacatgttataatggttattcttttgcttccaaactttcagtggtataccctattaaaagcaaaacaaaataaagcttctttttcttggaattcaatgccctccaaaatttgactccagcctacttgtacaattttctcccattattcctctacaacttacatgggcctttggctccaaactgatttgctcgttgtctttctctcccatacaaattgccagaaacttttcttgcatctgcccaccagttcccgtaattacatagagtctctatttcagtattttccaagtattgcctcatggactggctgcatggaatcacatgacgaactctttaaaaattttcaaatgcccagttcctactcctaagaaagtctgatccaataggtttgaggggaggcttaggaatcagtattttaacagcttccatttagcaacatatttctttcaaagccaaattaaaattcaagtttctccataattttttacagttttctaatctgtcatcatctattttactttaagaatgcattgctatactacaaaagcaatcacctctattttattgttcctcataattttagcctattttttaaatctgatttacaagctatttgaggagagattaccttacaacttctgcaaatctctagtacttattataaggctttgtacttggcagactctcattaagtgctgaaggacagaataatgcataaaccccatgttaactagtgtgtcatactttaaatcagcaaatgtaaattgttaatactccaggattcaaagaattaatgtgtgtcttaatcatgctaaacatcagaagaacctaagggtaaagattgattaaccagaagtatttgttaaatttccctttaattttcattacatttttggagatcatctaattagataagaagcacaaaattccatggtttattcaaactatagttcatctcagatcatattttattatgccagctcaatcagctccatgtttgattccaaacatctctagttttctaatcagttataggtttcatttttagttttggctaaacctctcttgaacctatttatatttttcgcatgcagtacttacatgtgtaacaactcacatatgctttctgtttgctgtgtagtatagcacgtctatttctctgccttgctcctagaacattaaggctttaggtgcatgctagttctaatatttcataagttgactaacaagtctctattctgcttctccatatttttagattttataga

SEQ ID NO: 45560 - DNA, 1237 bp, Bovine  19866880622857
cagagaagtgaaagcaggtaaggtgaacgggaatactgctgaggctgggtctcaaaggggcaactgtgaatgctaaaatgagcaacaacatcacctgggaacttgatagaacttgtgccactcaaacttcctgagttataatctaggcatggggctcagcaatctgtgtttcaacagaccctcctggtgatatctatacatattaaaatttgaacactactctaaacaagtcattttgatcctgaaaatatgtccattcatcaaacttctgggcagtcagacaaaatggatgtataaccaggggcctctgaaatgggccaggattcaggctgaagaacagttagctagacattggcaatgaggcaaaggtttaccttcctctcccgtctaaagataccatgtgaaaccttccaaattctcaagagaaaggtgtctctgatgtatattgtttgcctttgctgctgctgctgctaagtcatgtcagtcgtgtccaactctgtgtgaacccatagacggcagaccaccaggctcctccgtccctgggattctccaggcaagaacactggagtgggttgccatttccttctccagtgcatgaaagtgaaaagtgaaagtgaagttgctcagtcgcatccgactgttcgccaccccagggactgtagcctaccaggcacctccgtccatgggatattccaggcaggagtattggagtgggttgccattgccttctcctgtttgcctttagtcttactcaaaataaaacattttcaaaaggaaagtaaatgtgaaggaaaggtgaaaaatgcaggagccacacatatcacttagcattgctcttgggaatgccaggccctgcttcctcacctggcattttcagttacctcccacagagcttgctccaaggcctgcacccagaatcccctgcagtttcagaatctatagagcaggggtgtggatcaaatggagtggccataaggacactactcttcttctgtagtggactcagtcaaccaggaaagggttctagtgagacctgacgagatatttagagttcttcaatcactgcagcaagaggatgggcagaccaggagtgaggcacatgggtgaattcagttctgcgtgacccccagaagggacctctgtgggtgtttcagtgtgtacttccatctctgagcctcagctggctcatattcaaaatgaaaggtgctgtgtgccaagtcacttcattcatgtctaa

SEQ ID NO: 45561 - DNA, 3519 bp, Bovine  19866880740050
aaatggtatggatactgtgaaaaagattgagtcatttggttctcctaaagggtctgttagtcgaagaattattatcacagaatgtggacagatataaaatcattgttttccatagtaaaatttacctgtatagaagttgaattgaggcctagctgttttgacaacatggtaattaattatgttcagcttttgaaaatggacatttccaatgtacaaatgtaaaattgcagcttatagctgttgtcactttctaatgtgttataattgaccttgcatggtgtgaaataaaagtttaaacactggtgtaaaaaaaaaaaaaaaaaaaagcattttgaccatatacagccttgactttcccaatttggaaccacttttatgttcagttgtaactcttgcttcttgacctgcatacaagattctcacgaggcaggttaaatccaatattcccatccgtttaagaattttctacagtttcttgtgatccacacagccaaaggctttagtgtaatcaatgaagcagaagtatatgttttcctggaattctcttgctttttctatgatccaatgagtggtggcaacttgatctctagttcctctgccttttctaaatccagcttgtacatttggaatttctcagttcaggtaatactgaagccttgcttggaggattttgagcattaccttgtgagcatgtgaaatgagtgcaattgtgtggtagtctgaacattctatggcattgccctttatgattagaatgaaaaatgattttttccagtcctgtggctactgctaagttttccaaatttgctggcatattgaatgcagcactttaatagcatcatcttttagaatttgaaataactcagctgtggatggtttaagactatgcaaatattcttctcttcatcaaatctttcccacatacttattagttattgatgtttcttgcctgatgcactctttactatgatgattcaaaaatgttaattttccagctcccattccctctccacatttataagttggctctcagtattttttggtaagcatgggccctccatgctcactcatatttattcatgtattactagtatggatgcatggcttttaatttttttcaaaagttcatcatcaaacttaagtatattgatgatcaaattattccacgtttggccagttagaaccctttacagttactaccttggtccttgtgacatgatcccttttttttttttaatgctttcttacttttaagaatagcaagatgttccaggctcacattttacctacacttccccatccctggagttagctatttatccaaagagccttggttccttttaatagataatggtattagagaccaggctctgggtcttaggtatgatcattgctactaagtgggtctttggttctcagccatttcaataggcagagctagggaatagttacatgtaaatatacctgtacatatacatatacctacacaaacatgcatataaacacaatacataatgacaaatactcatatgtttgcttgtgcatattatatgcatacacataattataagaaaacattggttcacactgatttctccagtctcaattcataccactaaagttctttcttgccttctctcattctatatttgcatgtcccttcttccacagtaggaattctgactttcatcaacattaacccatttgctcaatctataaggcatctaaaacaatttcagaattgctttgctcatatttctataattgaaaaaagtgctaaaaagagttcataatttgcaattcttctccactcctcatgctcagctttggccgagattgtgggtatatggtcaaaaaattgcgttactagccactatccccatatatgacaccctaatacgttaaagccccaaggattacagtaaggaaatttattggctaaagatctaaatgaattcagggtacctaaagaacccatggttttgatgtgtattattatgagagacccacaggtctgctctataatggggactggtgtccccatgtccccatgtcctatgtttcaattcctataaaaaatacaaatggaattgatttgggctcagagactaagagccatgctcctccagattggtttctctttgatgtagtcaatcctccactatttgcagagtgaaccataaatttggtcttactacacttcttaaaacctgcaggctaccaactcatcaccaaagtgagaatgtagcttcccatctccaagttcagcttccagagttgaatccatgtcctctggacagagccagtatattaactggcagacaactggagaaagcacagttttcctataaccattcggaatccctcctttgatgtggggttacagttctctcctgcatgctgtagtacacacaatttcatctgaatgaaatccagctctgataaccctgggaagccacaacatgccaggaaagagagatttatacgggtagttcttttccacagcaagaaaataatcaaggtagaaaagattgtcattgaaacagcagtgcttccaagagccttctgctctatgttggaggtggtcctattcagtcttgacccctttagttacagtcttctgtttgtaatcagctcatgatgaatagagagttaataaaataaatgttaagtccttaatgacaaagtccccgatgtgatttacatttctcttgactttcaaaagtgactaggaaaggaccatagagatagtgttggagtgtggcagaatcaagtgaggactgggaacaagggactttgttctaaatgcttatccctggtctcagagcatgaatttgattagtacacctatctcaaaatcctgcctttcttctcccatatctttttccaccatttgttccctctgtctcagaggcacttccttaagacagattcaaacacaaaagttatgtttggcccaccacttctccttccacttgaatttctacaatgtataagaatgtgagccatgctctcctagttcacgtgatcttttatacctgcaaattacctggaacacaattcataaccctcaaatataaatgtaatggtcttgttcttctttccagttctagctggcagtagcaattgtagattgtggtaggcagtattggaaatgccactcctctttccaatgatcttcactttctgtgtaattccctcaagtatgatctggatttgaggacttgcttctaactcatcagatcagatcagtcgctcagtcgtgtccgactctttgcgaccccataaatcgcagcacgccaggcctccctgtccatcaccaactcccagagttcactcagactcacgtccattgagtcagtgatgccatccagccatctcattctctgtcgtccctttctcctcctgcccccaatccctcccagcatcagagtcttttccaatgagtcaactcttcacatgaggtggccaaagtactggagtttcagctttagcatcattcctcccaaagaaatccca

SEQ ID NO: 45562 - DNA, 1660 bp, Bovine  19866880749799
aacctgggcaactcacttcccctccatgaaaaccagggttttcagagccataaaaaggtgacaagccacccaagcagcatcacagctgtataaagacttaggaagtgttcagcatcctgccttgtcagctccagaatgtttggcacttgtttcagttcagttgctcagtcgtgtccgactctttgcaaccccatggactgcagcacaccaggcctccctgccatcaccaactcctggagcttactcaaactcatgtccattgtggcagtgatgccatccaaccatctcatcctctgtcgtccccttctcctctgccttcaatctttcccagcatcagcgtcttttccaatgagtcagttcttcgcatcaggtggccaaactattggagtttcagcttcagcatcagtccttccaatgaatattcaggactgatttcctttaggatggactgattggatctccttgcagtccaagggactctcaagagttttctccaacaccacagtttaaaagcatcaattctttggtgctcagctttctttcggagaaggtgatggcaccccactccagtactcttgcctggaaaatcccatggacagaggagcccagtaggctgcagtccatggggtcgctcagagttggacaggactgagcgacttcactttcacttttcaccttcatgcattggagaaggaaatggcaacccactccagtattcttgcctggagaatcccagggacagaggagcctggtgggctgccgtctatggggtcgcacagagttggacacgactgaagcgacttagcagtagcagcagctttctttaaagcccaactctcacatccatacatgactactggaaaaaccatagctctgactaaatagacctttgttggcaaagtaatgtctcagctttttaatatgctgtctaggttggtcatagcttttcttccaagaagaaagcttttattccaaggagcaaacaatgtagtataacctcaataataattggggttatgctacattaactcacctaaatggactttaaattatttaaaaacatgcttttatttctcaccacacacacacaaaatgataactgtgtgatgtaatagaggtattagctgatgctgtggtggtaatcatattgcaaaatacaaatatagcaacatgttgtacaccttaaacttacacagtattacatgtcaaatatacttcaattaaatgtatatatactttgtattacaatgactagaaagagggtatactttttctgaaagaggatatcaacaacaaggtaaaatgaaataagtatagaaccattaaaccttaaccgttaacttcatcctttatccaaattaaattttttcccctaaatgctaacaaatagctaaactgatatgactttattttcaactcttctttgttcatattcgtcagttgttggaagtacaaagaggcaaaaaaggccaaaaacaagttataaggagaaaaagggacatgtatatttcaaaaactcaataacttctttggtatttgagatgttacatgaaatatgaaattattttaatatggctctgttttggtaggtgtatcctgattgtttggcacaagctatctacgcaacattccaggaagcatttccagaatccagtaatct

SEQ ID NO: 45563 - DNA, 1091 bp, Bovine  19866880770363
gcaggataatacattgatttgcagtctccatgcctgagttgttattcacttgacaggaaatgatacaaatatttttaaaaactataattctttggtgacatgaagttatcattttatctacaactcctggggtattttattaaccatgacaggatggaatggaatgggactgactgataaaacggattccctaaaccacattttagggagcctaaagattgggtgtcaggcttctttctcaggctgatgccacagctaatgggaagcttatggtaaagagtgcctattgatccataaatcagcttgggacagaaatttaatgatcctattaaggtggctcatggcattggtccagttaggcttccacagacttctgggctatagaaagacaccatccaagtaaactaccagtcattctgaaaacagttgtctcaattaattccaacatatagtttgcaatcattctattattctaatcagtttgtatatgttaggctacatccatgaataaaagtatggatatagccataaatgaagaggatatgcacattaagctcacaaacaggacttttataattactaaaatcactcaaaaaaccaaagaattttgaaactgaaaaaaattacttgaatcgatacttcttaaccaaatttaccaaaattagccattaactaaatccttaatgcagttaaaatctgatttctctctacagcgtcctatctcagaaatcctggagacaggtgtctaaatgcagacctcgtaagttccctctagagatgatgaccttttgattgaatcagctgtataatatgtgaggcccagcataaaatgaaagtgcagggccttttgttaaaatattaggaacttaatgatagcagaacattcaaccaagtatgtttgatgacacagggtataaacccatgaagcaggccctgtcctcagggcaaggcctcaggattgctgtattccagctccccttctgttgagccaccaggaacacatgacatttcactgtgcattgccaactgttctgtgagaagatggtccggctatctataggacatctgcagggacagcaacaggaggaaaa

SEQ ID NO: 45564 - DNA, 1979 bp, Bovine  19866880815877
gacgagcttacaatttttcatataaaatccgtaatactttaattctcccctcttagatgataatagttatatctgacaaaaagtgttagtgaataacatatatcaggaaaacactagtgattatgacgtgtgtgagagagagagaggctacatgcaataactcaactgtccattcaagtgtaggtacagatagaacatttccaaaaattttctgcatactaagtcaaaaataaaatcccaacaatatatagatcttactaacccttcttcttccctttttacctaactactgtagtcagtagttctagctacttctttgtattcatccccaactccttttacaatttgccaactaaaaatagttaaaataattaaaaatcattctccatctgtacacatctgaaagtgtgcagctaaatgtacacagagaacacattcaaccatgctaactagtctcatttttaattcagaagtacacaactccagtgggcctgaattctgtcaggtaatcatacagtttcctctggtcctttatttctaccactcatgaagccaactatttcccccttttatcttctcatatctccaacactctctcccctatactcaatctcagatagtgattttgcttcctacttcagtgagaaaattaagacaatgagaacttccactaactcccaccaccacagtatacccaggtaccaacattattttccattcctctgctttcccaggcttcccaggcggcacagtggtgacgaatctgcctgccagtataagaaacatgagagacacaggtttgatccctgggttgggaagatcccctagaaccagtattcttgcctggaaaattccatggagagagaagcctgatgggctaccatccatgttttcacaaagagtcagacatgactaagtgcacatgaatactctttcccttctgtgctcctgtctaaggtcaactttgccaagcacttcacaaacataatgttcacttactctcctagtgattctttgagaccagtgttcatgatactgttttacagctgagggtacaggttcaaagtcacatcattagagagtaactgttgcaacgccgtgttacctaccaccttattactcaaaaggcaactccatggactgtggtatagcacaccaaacacctgtggtgttattaaaccccatacctaataacaaaatcaaaaactgcacttgaaaaagagtccccacaattatttccttcaatgaagaacactagctatctgtgccattctcttctttcccatggattttccactgtagtataatggtaccaattattttagtaataaaatttgttcttagatcatattgtagtagcactcagtctttccctataagaaaattttattaagaatgacatgtcttcccaaggtactaactaattcaaaccttccataaattctattagtgctttgtggtcttaaaatgaaacttctgacggtgtctgttctcttggtatgattgattccattaagtttgaatttggttagtctcagtagtcaggataggagcttagtggtagtagatcaaagaatttggaattaccagcattaaaagagccaattcttattctaatcattcattttaactattaattcctcattgacatagaaatcttggtttaattaaaagcataaattaatttttcaaatttgatcttgcaatatgaactttctttaagacatattattggtgtttactgggattaatgttgataatccacccatggaagaggtttgagagcctagaaatttttttaatggtggaataaaatgctagttcctttgtttaggaacgaagtctaacttacagtaattattctaatggaaagattttggtgaaagggtggggaagtgacactgcatcactaggacctctgctagcatttttcccattagagcacaatgactctaaacagagtagaaattatatgggtg

SEQ ID NO: 45565 - DNA, 2200 bp, Bovine  19866880940367
attttgattttctagtgactggtcaaactgtacagcaggaggaggcaaggctcccatatggtgacattgaggagaatgggtcaaccagactaagtaacatttcattgttatttaatgtttcataaataatgtttcaaagtgagaaaggattttaacaaaaggacatggacaaaagtacaggcatagagatggagaatgtataaggttttgtttcaggctgaccaccatctatgattcattttgagaaattgtaggaaaagtatctagggatgatggataaagccaaactgtgggtggtggtgaccttgaaagcaagacaaaaaactaggattttcattactaaatgctataaagtcatgaaaggttcttaagttcttaagaaaatcaaagatatcaccgtgttgaatctaagtaggaagtcagatgtgaagatggtcagatgtgaagatggatcatgatgacccaacatttttttttttagtgccaaaatatttactgaaaattttcaaatctttcaaaactgttacaaaaagcaaacaaacacagtgaagctgataacagattagacactaaaaactaacatttggacaagtacacagacatgtaggagataagggaatatctatgagtattaactgtgattaaagcactatctcatttgatccctatcaaatgagcactatctcatttgacataagatctgcataacttatatgcccagtaagtcatgtgaaatgccaggttggatgaagcacaagctggaatcaagattaccaggagaaatttcaataatctcagatatacagatgacaccacctttggcagaaagcaaagagtaaataaagagctcttgatgaaagtgaaagaggagagtgaaaaagctggcttaaaactcagccttcagaaaaccaagatcatggcatcttatcccaccacttcatggcaattagatggggaaacaatggaaacagtgagagactttattattttggctccaaaatcactgcagatggtgactgcagccatgaaatcaaaagagcttgcctcttggaagaaaagctataacaaacctagacagcatattaaaaagcagagacatcactttgccaacaaaagtccatctagtcaaagctttggtttttccagtaggcatgtatggatgtgagagttggcccataaagaaggctgagcaccaaagaattgatgcttttgaactgtggtgttagagaagactcttgagagtcccttggactgcaaggaaatccaaccagtccacctaacagaaatcagtcctgaatatactggaagactgatactgaagctgaaactccagtactttggccacctgatgcaaagagctgactcatttgaaaagaccctgatgctgggaaagactgagggcaggaggagaaggggacaacatacaatgagatggttggatagcatcaccgactcaacagacatgggtttgggtagactctggcagttggtgatggacagggaaggctggtgtgctgaggttcatggggttgcaaagagttggacacgactgagtgactgaactgaactgaactgaaattattctctttacaaaaattaacgttttcatcatgttgcatgtatgttttcaatttgtgagtgtttaaaaaaaagttttttttaatttttatttatttacttttggctctactgggccttcattgctgtgctcatttctctctagttgtgctaagtgggggctactctcttattgtggagcacaggctctaacacacaggcttgagtagttgcaacatgcaggctctagagccctgggccagtagttgtggtgcacaggcttagttcctcagtggcatgtgggatcttcccagaccagggatcaaatttgtgtccgctgctttggcaggcagattcttaaccactgggccacagtggaagtccccatgactctgtttctattacagttcttttcacttatatcatgaagatatttattttattttcaaaaatatcagtaatttaaatacttttgttattttggttgtgagaaggaaaagggggaaggatattatgactaatattcttattaagagttaaatattcctttaaaatattttactaattatgaaaatagctacaggtatttcaagacaaacttttctattaaacaatttgaatatttctaaagatattcaccaaa

SEQ ID NO: 45566 - DNA, 1445 bp, Bovine  19866880994266
tctttttctggtgcttctcaaaagctgcttctgtgctgggccctggggtgggtgagtctgcctgtaggcactttaaagagctgtgcttcagtttgccgtagtcctgccctgttggtctttgaagcagatgctttggaggctgtctctcaggtactcatctggaaagttggggtatgaacccttcgcttctcaggttgaagctctgggttttgagttcccttctcctttgtgtggggatgagattgtgtctcagactttcctacctgctttgattggtttccctcttgtttgcctgatgtgaagggcatcacccagctagtttttaggtgtttttcagaggaacttgttccaggtatagctgttgatgtggtgtgtctatggggaggagatgacttcaagatcttcataagttgctaccttgagctggaattctgcatttgctttccgaagagatttgacttttttggccatttccagctaagggccggtctcagtgtcctgaagatgtcaagttcctctcactatgcatggattgtttagacattttaccattggctccataaccattaggtcagtgacctcactggccacttcagtatggttttgtttggctatattacgtcttacaattctatagcaaaacaaaatttcctttccagtgtggcatttgacatagctttttttagaaactttttagaaactacctgaagttaacagaaagggtctttatggagtgaaagggatatagaaattggcgacacatactgttttgctttatggctggcgttagaaagacaatgaaaaacacttcagctttccatttggggacttttccgatacgtgttccaacatttaggctggaaaaaaaccaatgcccttcaaatttcaaaagaaagaattcttgcaaccttgatgacaatcaaagtaacctatgtgatgttagtttaatgagtcgtatgtttcttttggttgaaaatttaatttcttacctgatttctctttctctttagaagtggaacggatagtaaaagccaatgaccgtgaatataatgagaagttcctgtacaaagtgagtaaaacacatatcccgcacacaacctggggtaggtcttaagatagtaggattcataccttctagaactttgacttcactaaaaactttgttggcccattttaatagcaaggtgccatatgtttcagatttttaaaaataaatttagattttagtaatgtttatacacttatttttttacacattaagaatgattggtattcatattggtatgggaataagatgaagtatcttcttaagaatgatgcttagtttattctggtgcccattgggcacttgaataatgtaaggatactatgaaaacaggcttctatggtagtactttgtgatagaagtggtgaaagtggctgatgggggatgaataacatttggg

SEQ ID NO: 45567 - DNA, 1066 bp, Bovine  19866880995090
aaaaatcccagaacaggaattacttaattcttttcatataactacagaagacaggtaaaaattctactagcattcactagcaattatattacaaacttttactaaaaataagtaaatatattttatcccacctaagaaaaatcttcaaatatccaacagtccattctgaaggagatcagccctgggatttctttggaaggaatgatgctaaagctgaaactccagtactttggccacctcatgcgaagagttgactcattggaaaagactctaatgctgggagggattgggggcaggaggagaaggggacgacagaggatgagatggctggatggcatcactgacttgatggacgtgagtctgggtgaactccgggagttggtaatggacagggaggcctggcgtgctgcgattcatggggtcgcaaagagtcggacacgactgagcgactgaactgaactgaactaaactgatgatattaagagccctggcatattcatatgtcaaaaatttaaaagtaaaagcaattatttcagaactaattttaacttaaattacaacaaattttagacgggctacacataaagaaattgatgagtcagaaaaagagcttctgtattttttccaactctctcttctggggccattatctatatttattgctgtattactttaaacattcttttagttccacataatatttttgatatataatctcataaaacagaaattttaaatacctctatatccttctttgtttccatttcatctgaaagctggaaaaaatttaaaataaaatctttaaaattctaaatttaagaatttttagactttgtaactctactaagtatgtgtgtgtgtgtgtgtgtgtgtatgtgtcttactgagacagagaatgctgttgctatataagatgctgagaatacaaaaatattccttgccctcaagttagtctgggggtaagaagggagtcagctacatatacaaaacacaaagacataagagctataacagaaatacataccaactacttattgcagttgatttttctgggaaacagactgtg

SEQ ID NO: 45568 - DNA, 1218 bp, Bovine  19866881032511
atttccttttggattgttaatgaaaagatacttttatctcatattaacagaagtcttcattacactttgccatgggctaagtactttacatgttttgcaatgctttatttcatttcatctttgtaacaaccccataatgaagattctaatatgattctcaattcactaatagagaaactgaggcttacagaggttggggatgctgctgaggatatagagataataatggtggagctgtccatactttcaatctgagaactacaaacatcagaggccatactcttcctctatcttttaccacccacgcccctagcatataaagacatattatttccctttgctaagcagtgtactgtgacaatgtttgaatccagtagaagaaacgtacttgatatagaattccccagacactggtatagccagtcagatggttcttatcttttgcaaacacatcttttccttcagtttcccccaccagacctgccaagtttgggatgggtatctgttatcaactcctggacctgtccagttggtatccagattggtccagaacccaaagaagcagattttaaatgacttgtttttgtgttgcacattgcagcctaggagaaaactggatagtcaccagcttataaaagtaaggaaatgagaaccatgcttaagaggagtaaggcctgccagtgagcagagacagggattaaactttcaaaatatgatgggcgattagggtggggcaggggatggttaggcagaggatgaatcagagtttgaaggcagccttagccaaagaactgaccgacagacagaccctgggcacttaataacctctggtaacttcgtaaaagagtggaagatatcctcaaggtaatttttcttcaattcttgtccattggagactgaggagcagtcatcactgggggccttcagagttgagataacatgctgattggggtaagaccaaaggcaggatgaagtcaaatgtacctgctgctgggacccagccacctccttggccttagagcagcactcaacccagtagcctcccactgtattgttaatacatgtcctgataatcactgtcccaggttctactaaaggcctgagtctttataatattgcttacacatggtgagtatcagatagcaagagaacaccacagtccttgctgagctgaagaacacagcctctgaggtcaggaaactaattaattaatggcgg

SEQ ID NO: 45569 - DNA, 1959 bp, Bovine  19866881041927
tgactggcactattctagaaacttgggatacactggtgaacactgtgaattatgtcatggtgctgctgctaagttgcttcagtcgtgtccgactctcattaaaatctcctctttccttgactcaacttaaggttgctacatgggcttttaagataagttctaagaaagataattggtagaattgatgctgcggttgacatgcagcctataagacctggtatgattgagttactagcacattaaccagagtctgaattcacagaggggtttgatgactattaagatgtagcaatgtgagtttcttgggacaaactttagcagtgtccatccaggaactagctagaggagagagaattttggccaatggattatttttagtatttggttccttttgggaggtcatttccatatgtgtagatgaaagcattggacggctctagctcaataccaacagagatagctaaccactcctcttctcatgctgtgctaattacctaacttgtgattctctacagggagattctctacagcacactgcctctatgacagatttctcattagaataatacatggcaactctgattttattcatttattttataaacttggttaaagtaagcctccccatgagagaaggaatctctctcagaaggctaatgaatgtgctttctagcctggagtgggagtgggaggatgactttcttcatggtgattatttccactctgtgcagcctcctgccatctggtcatttagcctggctggtgatcactagacttggccccatgcctttctatccattttatagccagttccttaactcttaaggatgacccttgaaagccttgaccaccaaatcctaaataagaggagtagaaatctatattttaagatctcgggggaaaagttcagtaatctactactgggtaatcatgcatttacatatttggctatatccttatttttccaatatgtaagaagtattttcattctgtgagtagtgactgtataaggaaagccatattttttatgttacttgtaagatgatactgtcctttatagttatttttacttaatttatataatatttaaaacttagagaaaagtacaggaaataatatatcacctgtatgcccactacacagattaaataggtagtaaccatttgccatgcttgcttcatctttcttttactattaataataatatgccaatcataacagaggtttttattttcttgagcttgcatgatattgaacagaagcacacagatgtgtgtgttttctattggtcttcttaacagtgacaaggcagtagaacaatattctgcagctgcagcagatggaataaggcagcttcatctctgagtttaaacatactaaggaaaaaacaaagcccattaaggtctaggaaaaccaagaatgacaccaagagttgagagaaggaagctgcagagcagagaggggcatgagtgtcctgggtctaatgacccttcccatggctcaaaggggataagccaggccctcctacagtgaacaagggtccctaccagacctggctgatggtgtgttgatttgggaactcccaataggatgtctggccacacatgagttgtaggacttttctcagcctcagtctattcagataaaaattacagataataagtgtagtgatttcataaacttattgtatggattaaagcagaataacaaaaagtgaccccatgagctattctttatagagatagtatttgaatctatatctatctgattttaaggatttttaagcacttcatacgtgggctatccttttaggtaaggcagaagccatgggcctttcgctcagtctcgcgtagctttaaaggatattacctcaaatggaaaagggttttttaaaaaatgtgcagatctcaggcactagtaaagtaatgcttaaaattctccaagccaggcttcagcaat

SEQ ID NO: 45570 - DNA, 811 bp, Bovine  19866881407149
aatcatcttcagctgcccctctcaaaattcatctcagatttgtagctaggaaagttccagtgatagggcaggagagaagctgccgaagacccccgcccatatgtggtttatttcttacatttgcttaataatttttaaaagaagcaagaaattttcaaaaatcacaaaattgtgaataatcttgcaagtacatacgtttggaattcatttgtaatatagttcttgttattcaggccaattttttttcccctttaatgctgtttttaatgtggatgttcatggcttggcctaaaactgttatgtgaagaaatccaaggttttttcctctgggtctactcaaatatcttaaaagtgttccttttctttggttgagcacatactttattcattctatcaaatggtactttttgaagaattaatcaaaggaaatgaaacatattcaaaagaaggcagaaaattctggaaaaatatcccccaaagatgtagatgttgtcataatgtaatatagatatcaatagtagattaacaaggtaaagatgattcctgatgtaccatggtttaagatttatcagctttacaacagtgcaaaagtgatagcattcagtagaaactgtacttggaattttgaattttgaccttttccatggctagaactatgtgattacgtattcccctgatgctggtcagcaacagcaagacaccgctcccaggcaaccgtgtcatcacaaggcttcacaactgatacactgcacaaccaccctgtactcatacagccattctgagtactttcttcaataaattatatgggata

SEQ ID NO: 45571 - DNA, 1067 bp, Bovine  19866881937299
aaactaacacaatttgtaaagtttaaaaataaaataaaatttaaaattaaaaaaaaataaattgcatttgactataattttattagaattgaattagtatctaattcaccccagactttactacagggtagttgttcagtaaacactttattgactaaataaaagaaagatgacaattctaagcttcagaacaatgagcccattataaatattctgtgctcagaattgccaaccaattttaaaattgagcaaaataaaatttaaaattttactgttgcagatcatccaccatataatgtagtccaaagatattagtttttcagggcactgaacttagtgattcagatatttaattatgacaacacatattaagtgtctagtacattagtcttgttatacatggtaacagcagatggtatgtttgaataagtcccttttgaaacaccactgttctactttattaacaaagatcattttaaagtagcatgatctttaaaaaaaagatcatgttgcccagggaaacaaaaagtaaacatcaatgttttatttgttactttaaaaatactatgtaatacttttaaagtttattactactatttattttttaatataaatttatttattttaattggaggttaattacttacaatattgtgttggttttgccattcatcaacatgaatccgccaattactactatttaaaatcctttaatttgagtgctgatagtccctaatccggagaaggcaatggcaccccactccactactcttgcttggaaaatcccatggatggaggagcatggaaggtgcagtccatggggttgctgagggtcggacacgaatgagtgacttcactttcacttttcactttcacgcattggagaaggaaatggcaacccactccagtgttcttgcctgaagaatcccagggaccgaagagcctggtgggctgctgtctatggggtcgcacagagtcagacacgactgaagcgacttagcagcagcagcagcagcagtccttaatcaaactacagctacattcctatatgactttttgactgcttg

SEQ ID NO: 45572 - DNA, 2350 bp, Bovine  19866880179559
ttttgttgatcatgatggctactccatttcttctgagggattcctgcccgcagtagtagatataatggtcgtctgagttaaattcacccattccagtccattttagttcactgattcctagaatgtcgacgttcactcttgccatctcttatttgaccacttccaatttgccttgattcatggacctgacattccaggttcctatgcaatattgctctttacagcatcggaccttgcttctatcaccagtcacacccacagctgggtattctttttgctttggctccatcccttcattctttctggagttatttctccactgatctccagtagcattttgggcacctactgacctggggagttcctctttcagtcctatcattttgctttttcatactgttcatggggttctcaaggcaagaatactgaagtggtttgccattcccttctccagtggaccacattgtgtcagatctctccgccatgacccgcccatcttgggttgcctaatggcttagtttcattgaggtagaccaaggctgtggtccgtgtgattagattgactagtgcaactttaaatgtgagcactagagagtaggtgcctcagagtctagcagatgccttgttatttggattaaatcattgtagttttttaaaatgtcttattttttaaattttaaatatttatttatttggctgtcttgtatcttagttgtggcacagaggatctttgctgggtcaggcaggatctttccttgcagcgcacaaagtctccagttgcagcactcaagtttagttgctccgcagcatgtaggatcttagttttccgaccagggttcagacctgcaccccctgccctgcaaggcaggttcccaaccactggaccaccagggaagtgcccatctataatttttaaaattgtgataaaatactcataaaatttaccatcttcatcatttttaagtgtgcatacagttcagtagtgttagtatattcatattgtgaaagagatctccagaactttttcatctcacaaaactgaaatctacacccattaaacaataactctccatttcctgcacactctgccactggcagcctccgttctacattctgagtttaactactctagatgcctcatgtaagtggaatcatagcgaatgtatatttttgtgactggtttattttaattaacaaaatgtcctacaggttccttcaagttgcagcatgtgtcagactctccttcctttttaagactgaataatattccactgtaagtatatattccattttgtttatccattcatctattgatgcacatttgagtagcttatctgtaatgctttcagggtgtaggagccatctttacaggaggtggaccccgcaggcaacattatagtttggcttaaatcttcacctcctacagattctagccaccaactgcatttctttttcttttcctcatctttatttaatttttttatttgtatacaatttttaaaggttactttccagttacagttattacaaaatagcggttgtattccctgttgcatacaatacatctttgaacctgtcttactcccaatagtttacacctcgcactccactaccgctactactgcattctaattccgaaatgacaaattcgggggtttaggaatggtagctgaatcaaagtaggtacagaggcaaaataggtattttgaaaaaatacgtgaggagtcactagtaaatttctccccacattttgttattctgtgtataagagaacaaatctacacacacacacaaaaaagtttgaaaataggagtaatggaaagcattactataaaatgtaaagcctaaacttgacatcaaaacaccccaaattatattcattattctgaaaatttctatttgcctcatgctgaagcacagaatagaattttagagctcttttatgattatgcgtagctttttggtctattatccaaataggaggcctataatttatgcctcctatcttgaaaaaaatgtttttcaactttacattaaaacagaaaaagaatctttcaaaagccaacttaggtcagaagttagagttgtttcttcaactcaacaacgaataaaatttgggtatttcgtttttaaaaaagaacagtgacactctacgatggtgtctatcccatagaaatgttggcaatgtgtacaaggttgtacgaacaaaaacattcattggattgttgcctgtataaagagaatagaaatgtcgtaaacatcgaacgacaagagaatagttctataaatcacggtacatcaatactatagaataatatgtatccatttaaaagaaagtagtagatcacta

SEQ ID NO: 45573 - DNA, 1967 bp, Bovine  19866880344429
cacaaacaaaatctttctctaataaaatgctcagcccaacaatcagcatgttaagaaaaacaatagcaaaaaaatctgaccaaaggattacttggctcatctcaatgtacatttatgattcaatagaatccatatcattgtcacagaagatgtctcaccataggtatgttagtgtactgcttcaacattatttttcttcctacagggtttgtctattgagtctacagtatggtcctggctcagtaaatggtttggtgggtaaatttaaaccaatatctcaaataggaggacccagaagcccctgtatgcttatttaactgaagggtgcaattctcctcttcacccccgccccgacccccaagcaggcaggattcagggcctcggtcccatttctctttaaactaggccttggtaacacaaatggccctgattacggacacttccttgccaatacacaagaatatgctcccttgccagtaatcgtatcacatccatatcactctacaaagccccctgttccacagccctcagtctctataggccaccgtttcacgaagaaaagccaccaactaaactgagcagaaagaaagctaaaccttgcacctaaattcttgacatactttatgctttgtcacctagagaaaattacagggtcaactaataaaatgcaaaatctctcacctagagagagttttcactttatgtccttttgtaacttttgagtttcgaaacatctatattgtgaaattcaatccattttttttcccttaattttcttcctaggattcagttcagttcagttcagttgctcagtcgtgtccgactctttgagaccccatggactgcagcatgccaggcctccctgtccattaccaactcccggagtttactcaaactcatgtccatcgagtcagtgatgccatctaaccatctcatcctgtcgtccccttctcctctcgccttcaatctttcccagcatcagggtctttccaaatgtaaacaaaaccagtcttcctcttcggggacatggacgtcaaaaaggaggtagggggtgaggggtggggagtggggaacaagaacagaacacatcacaactttgcacttctctttgtgataaagggtttggattcttggtccaaagagagaagggaagttacctgggtcttgaattaaatctgtcggcaccaaaactagggctcttatggagcaatggatattaaagcaacgcctgggccgcacagggaggggggttatgttgaatatgcatgacacacagaaggaaaatgttcatgacttacagatgtgctctgagtggcgctttcttccttttttggaatatcaaacagagggaagagagaggtttgctgccatgttattataagcactgctgcctctctccctcccgaactaaaatattctagtatttattttgccatccatatgaccacagtttagactagagtaaaaatagaagccgtgtgggcctaacctgaaaagtcccaagggctggagagggtcaggattaatatattctaactgaaataaccagattctgtttcctggtggcgtttggcaggggaggaggggagaaaagagatttggaatgtatttctcattcagaagtgttttgtaaaaactaccataatggaacagactccaagtcaagcacaggaagccaagaggctctggtttagatttaataattcactctaaaggcttttcaactgctacaattttaagccctgaggcacagccacatatattctctccactatacgggagctgacggagtgccccaggatgcctatgggacaggaaaataggaaagacctcaggtccaaagggcagaccacaccctgccaggctccaactaatgcaggagaataaacctgctctcaagagatgaggggcagtcggtgaatggaatttccaactcagcctatttcaggtctaagctagcactgaga

SEQ ID NO: 45574 - DNA, 1866 bp, Bovine  19866880397940
cgggttagttttttttcctctcttgctatgtttctccatttttcactttttctttaatgagcatgtgtttccaaagtttctgcctcccatttgctcggtaagtaatgacattcatgtgcccttttgactctcttgtaatgtgttggaatcgcccccaggttcctccaaagcctggtttctcactgtggctgggataatgtgggaaagccacgattcagatgagggtctgaccttaacttctgtagttaagaatgagggtgagtgtgagcctgagtcacaaagacattgagaaaggagaaaagtgattcagaaactacctcgatagcttctattgctcacttctaacccctccgcattttagcttcagttcacatctcatgttttcccctgaggggctcgcaccactgaggtcagctccacgctttccaagtctttgaaacaagccgcatcacatccttagtccgagagtgtatactgttctttaacagaatccagaggcctttggggtccaaatacatttgctttattgcccgttttctgccactcctgttgccttctgccctcttttactaaagaaaatattttatccatgtattcctaaggaaaaaaattagaaagatacagacaacagctctgaggtcgacttcagtgactcgctgctacattcactgtgttctgtccaagaactggatgtaaatacaaaagatggctcatgccttcaataagatcaaagtctacaattaaaatatcctctagatattttagaaatattgtagaaataaggtctacaaggaaaaatcctccttcaataagatcaaggaaaatcaattaaaatatcctctagaaagtgacatgcggataaacataggagctttaagaacacatgggaaacctaattcagctaaagccagggcagggccagaggagacttcccagaagatgcagagaaaaggaaaaataagagtttagagatggggagatgagattaggcactctaagcagatggaatggcatgttcagagaccagaatcaagagagagaaagattgtgattacttcaggatggcgtggatactgaaaataaagaaaggagaggggaaagacacagctgaagacatagagtgagatgtatcacaggatgctaagtgtaagcagataaaagattggacccaattttgtacagttttaaagctagaaaaaaaaaaatcttagaattggatgtaccatcttacagctcaagatactgagctccagagaggtcaagtgacttgcacagtgtcatacagcttgtgaaggggggagttgagtctagaacactcttcactctttccactccctctcactgactctcccaaaagggagatgactgatcgagcaccttgtcccatgcaccagaactactgagcctgtgctctagagctcgggagcagcaactactgggcccacgtgccccgactactgaagcccgagcaccctggagcccttgctcctcaacaagaaaagcaaccacaatgagaagccctcacactgaaattagagagtagccaccactcgccacaactagagaaaaccctgcacagcagcaaagacctagcacagccaaaaatacataaataaaaattttaaaaaaaagaataaaggtcaagctgttcatgtgggcagttataaggccacatttccaaaatcagtgcagtattttgagacagaaagaaatgggatttgagcaaagaataaaaggtgggttcagcaggacacgagtccaattcttacagtatcttctgctccagctttctgtccaaatgacctcaacccgtcccatgccccctgaccttcctacatgcctttgatttctcctcatctccttttt

SEQ ID NO: 45575 - DNA, 900 bp, Bovine  19866880446420
cttgacagaaggattgggaaccccccacccaagcaaagaggattatgctgcattggagctaaacctcagaagaaaatattgctgtgaggggcttcatattttgcctctaatatgggggatggaaagcagggaagataatgaccaccaacagcgtaaggaaaatgtaactaaatatggcagccccgagaagacagatgagttatggaatcccaaagcgcccagattcactttagagtttacaggtgatgattccctttgattcatggtcatggttcttaagggcaaaagaacttagttagctggagaaggggatgcaaacagaaagaaagccttctccagctgggaaaacaaaagatgtttgggatgatgtcgatgaaagcttttttaaagtgagaggtacagagagagtgtaagaggaaggcagctggagtgtttccagatccgctaatgatgcgtggtgctgctgacaaagcagttcaccaaccggtgcgagagacagctgcctgggggacctgccctttctcttagggctggatcctaagagtccaggtcgggggagccttcaccgcttgcttcagagagcttttttcttttgctctaatttaaatgcttaccactgggacatacttaaagcttagcttattttttccccccttttcagacttcatttcccttagcaagtatttggtttctaagatcagaaatcaacaggggagaggacattagcctgggttataaaatgaaatgaaacgccttcactttttcatccacttttaccaaaatgcttggttctttgctcacaagactgagaaaaacccaacctgggtttaaactactcacccgtttgggaatcaattgcccatcccagggacccagggacctgtgggtctggtaattatg

SEQ ID NO: 45576 - DNA, 1274 bp, Bovine  19866880580800
tctttttcaaattttctttcttctcataagacatctaggatgaaagagaactctaacgttgcttgcttccgaatccctctgatctttgaaactgtatacatttcatcggagcccagtcagcttgatccccattcaggatcccagtcaagcatctgaatgccagccatctgaataccgatctgaatgccgatctgaatgccagcctcatctgaccttggtgtacaagtcattgtgtcttgctctatctccaggtaactgaaagctttcttagaggtgacaggggagaggttgcctttcagagatcagagattgcctctcccagcaacatcagcctatcgcttcagaaactgaggctcagagatgggaagaaccttaaaatcacacatcccctttttttcagaagccaaaaattgctgagcccaccaagatgaccaagctgtgctccccctccctgtaccccttgagcataaagaacctcacgtttcctccaacttccccatcccacttgcctcttcaggggtctgaagcaatttgaatgagcctccccctgccctgtcacagactggagcacattaagggcaggaaattaggctggggcatgtttgtagatccggtgccgattactcttcccctccgattgtacatccaccaatacggaatggatttctctctaatttattaaaggtcggtcagcatggaatgataaaggaaagggccatgtctgataaattcacctaaattgaattcttgggccacattaccaaaacagcagacataatttatctggattgcaggaaagcatttagggctgtaccatataacagatgcatttactaaggcaaaccattgtgtgatggttaagtgtcaggtggcaattttgggaacaggtttaaaatggcccagaacccaatgctgggtgcactgccaggagacacttaagagtatagacagaggggtcagtctgggggtcattatttcaaagtccttgaccctaattataatttaatttccacaatggtcatatctcttgagagcagaattgggatgaagggggctgggggggggggggcggagacagttttgaaaggaacagactgaaaacaagttctgtgcttcttttttcaatcagagtggctcagtgagggatgaatgagttattcttccaccaaatgaacacaaataaacaggagaataaaggaagccaaagacttctgagcaacagagcactgcagcgacaaactcggaacaggacagggatgggaggcagtgggttt

SEQ ID NO: 45577 - DNA, 850 bp, Bovine  19866880600816
agagggagattgcagagagctaaatgtggcaggcctcaaagcattttggtcaaggattgtagaatactacccatggtagaacatataaagtaaatataaaatttcaagaaggatttagaaatatgcaagttttactatgtgagagtttaaaagagagcaattgaagtctcaatcaaagggggtgaagagttttgccaagtgaagtagaatatgattatgtagaggattggaagctacgattattattatttttttccagaaagaacactgcacttggcagcagccccagttccagtacacagaagttagtaaactaatgacgtagcgagggattcatctagagaggctgatttctttgtcaccttcggccaagaccatttggaaataagcccttctgtcctatttctgctgttgttggaaagagatggaggttgaccacgaaagactcaacaagtaacaggtgaatttaggcatttgggcatggtatgttttcactaaatatttgtagaatgaacacaaggaccctgagggatgggatggagagggaggtgggaggggggttcaggatgggggacacgcgtacacccatggctgattcatgtcaatgtacggcaaaaatcactgcaatactgtaaagcaattagactccaattaaaataaataaattaaaaaaaagagagtctagaagtttaggtcggaggacagttttctggactaggctatgggtatgctacatctcgcagtggcatgggtgcagatccttatacgtatggatatatgcatgtgtaattatctgacctattccacctgttgagccctaactgcatgcccataatgagttggagaagtt

SEQ ID NO: 45578 - DNA, 987 bp, Bovine  19866880641121
gcctgcaatgcaagagacctggtttcgatccctgggttgggaagataccctggagaagggaacagttgcccactccagtattctggccttgagaattccatggactattccatgggatcacaaagagtcggacatgactgtaatcttgctcattacattataagtaatattgacaactggtaaaatccaaagagcctcaaattgtttaacagcaagtccctatccctacttggctcccacagatgagatcctctagccaaacagccctcctcatcaaagggaccaggcactgttcctgcttatccctagaggtggattccagtttcccaaccagcccacagaatctttcaaacaagccaatcatatctttccatggaaagcagggatcactcccaccctcctttttttttttttaatttatttttaattggaagataattgctttacaatgtggtgttggtttctgccacacaacatcgtgaagcagctctaagtataccaatactgcctccctcttgagcttccctcacaaggccccccatcccccctgctacatcatcacagagcaccaggctgagctccttgcacccccaccctcttgatactaaaaacctgcctcccacagcccctggttgttcaccctgttccaagtgcaacgctcctgtgacttcacatgcatgagtgtcttctttccctgggctgtgagcgtttggagcgtaagtggctgaggacatgtgaatgcttatgaccagtcctggggcgtcctttgttcagccgttccctagccctagggcaggaatctctccctcaccagtgaggtgaatcacctcttggtgactcaaagaggatgcagcacagtgaaggtgaggccgagttcagttccacacatagagacagaaaatttcaaagctggataaacctgtcttactctccaaataaggaaacagatttagaggccagggttctcgactgtctgtgccttttcca

SEQ ID NO: 45579 - DNA, 1983 bp, Bovine  19866880665085
tgccttgggtcgggaagatccacttgtagaaggcatggcaacccactccagtattcttgcctagagaataccccatggacagaagagcctggcaggctacagtccatgggcttgcaagagtcgggcacaagttcgtgactaatccctccaccaccgttttgaacagctaatgagttttaccgttgtttttattaccttttaccttttggaatttctaatcatgtggcttactaccaaaaaaagttagattttctagctttgggtcgtaacatatgtagaaagtgaaacttgccttagaattccctcctccgaggccacttagtgctccttttgggtagggagtgagatccgtctgtttatctttagccttgctcttctggcaaactggctcacacactggcaatgtgatgtctgttactttgtatttcatggaggatttcccccagccccaggagttccatgacctttgcgactcagacatttatggtcaattctcttccatgctctctggatccaagatactgggtagtgacataaatgacgagtcattggctggttctgaaaagatttccaagaataactgccacaaaactttttaaggaaaacgatgacttttaaagatctagaaatgttgtctgtcaactgaggtctagaatggagactgctggtggccaaatcatctcacaggcatgttttgcttggccaggctagtgttggcctgcagagtgtttaagaaatatttaattagttcccaacatttgaaaaatcaggagatgtcatgtaaaaaaatccagatttctggcatcatctgatttggtagctcagagtctgcatacccacctggcaataattggctacccctctatagcagtcatcccagctggttgggccaagcgcactccactcatcagtccctaccactccacaccagacttcttcactcaactccatagcatgcctggctcagtaggcgatttgaggttgagatctttactttagaacttcactgtgcctagcatgctgctaagaactgtggaggaaacaggaaaaggattagcattgtaagctggttagagaaaacaagaatattaacaataaaaaaaaagttaatttatggatcaattaaggtctccatcgtaaggtatcaagcacagacgtgacccctgacctacacacaacacacacgtgtgtcctgtctgtagaagtgatgatgaaaaagagccagcactgcaggagaccagttgaagaactcgacagtttgtccagttaggtcatgaaggtgcctccactgtggacgtcagagactcattcatgtatttatctactgtttcatttgtcaacaaatatctgtaaactgatggggaggccccagaagcccaccactcagccctctctccagggaaccttcctggggaccttggtggacgacagtcacacatactgagcctttgcattcactgtggatccaacctcccagagaccactttctgccacaatctgagcttggtggggggttctggaccgaggccattcctgcccaatatgggatttccccagggagcaacctttgtgtgggccccaccttcagtctagccaaaacttgctgagaactgcaccgtggtctgaggctcttcttacccaatctcccttccttccctctctcctttcactagcctcctgtcagacctgtgtcacagtctaaaacctctcccagccttctctcagcttcctctatgttatcccttataggtgtttccactaataagctgcttgggtgtctaatccttggcctctgcttctcaaagaagcagatagaacttgcagttgtatgtcagacactgtgcaattaagtgagggtacatacaccataagcagtagaaataagttatttaaactagggaaaggcttgagaatgactttcagatttattggggtggtcaaggaaggtctttctaaggagataatgcttaagctgacatttaa

SEQ ID NO: 45580 - DNA, 1278 bp, Bovine  19866880816531
tggagtttgagtaaacatataaccctttgttatttatatacacggttcaaaaaataatatatgaggccaaagttggagaaagagcattggattaagaattggtagggctcaattctcggttcagccacttattctcagagtgacgttggaaaggttagctaatctttttgagtctcggtttcctgacttgtagttacctccaggcttatggtgagacttaagtgagctaatgcatgattcggggtcacagaaggaggtgcttaaagtagatggtcacatagggaggtacttataagtggatgctcaggagataactttacccttttaggtgccaaggaagaaacacattcaggtcaaaccactgttgggattacttttagttacaagtgacaggaagcttaaatcaaactgatttaaataatgtaagaaaagtgttcgctcatttagctgaaaattccagaggtgggacatcaggcgtggtttgatccagagattcagaacgttgtcagggttgcaggtctgtttttcagtggccctccttcatgttttggctttatccttctgttggcttctctcttgtcacatagctgcctgctgccccagggctatattttcttcattcacatccagggggaaagaagcttctcttgccccagacatcaaagagagctataaacttctctctggttgggccggtttaggtcatgggcccatcactgaatctgtctatcactgtgactaggcaaatatgactccttgattggtttaatcaaggctaacgtctggagttagaagatggagttacagcttctcagaccacaaaactgaggaattgctagtcttattaggaatgagggaaagaaatggatacaaaagagacgattctttggcaaatcccctccttgagttcttcctttctttccatacatatacctttgaaagtctgtgcctgcttgagccacacatatcttttcatcaaagggagacccctcaaggagcttccctggtggctcagtgataaagaatctgtctgccaatgtaggggacatgggttccatccctgatctgggaagatccctcatgccaccgagcagctaaggccgttcatctcgactattgagcctgtgttctagagcctgggaactgcaactcctgggtccatgtaccgcaatgactgaagtcctagagcctctgccccacaactgggggaagtcgctgcaataagaagcccacacacttcataatagagaaaacccacggatcaatgaaaacctagca

SEQ ID NO: 45581 - DNA, 1268 bp, Bovine  19866880845537
agcattctctgtcacagacggagatggagcagcgtgtctccccaagtaaaccacacgcaacttctgggtaaagactgccaaatccgtgatgacctccagtggctgagagaaccggaatcggccagagtggacacgcgatcacactcgcatgaccgcccgcctctcaccggcagctggcctgagatctcgggccctgtcatctcacagatctcactctctgctccaaagcactggccaactgaagcctggaaggtggggaagggaggaggtgccctgggcgctgagcaggtctctccacctggagggtgaggagggggagaggagcagaccaggacccctgctcctccaagtccagacctgccctgaagcagggctgcccccgggagatggaaggaggggagcttgaaactgggtgagaaacaggagtccaggaaacaaatgggtttgtgtcttaaaaactgcaccgagactcttctaataactgaaaatgatccgaaaattctggagtctgtccagatgttactaagggatgataaggtatatggtgctttgtggcacacctcacaggaaggactggggaaaaataaaaccgtttcaagttcgtgtttcgttgaatgcagaccatacaattacctggttatatgcaatagagtagaaaggatacagatattaaactcaggctgacttgggtttgagtccttgctcagccacttactttccacatgatttctggcaaattactttctgcacagtttccttaactgtgaaatgtggatgggttgtagcaaacacctcccagggatttgagggaagattaaattaaataagttctaggaagtgtctagtgtgatggctacagcatggatccttgaaaaggggagtgatcattactgtaacttgagacagaggtgataagtcaaggactaatggccagtgtagctgtcacctgtcatttaccgcagttagacgtgtcaaatctgctaagtatttgatgttttgtaaatcccaaactttctttttcaatgaaagcagtaacactttcaaagcatttttctgcttgatttgcaagtttaaacatctaactggaatctaattctatgaaaaccatgaaaaaagggtctcttgtcctgatcagaaacacgaggaagctccaaagaagagacccgaggcagggcttctgtcagcctccaaatgtgccacacacgtttcactgggaaaacgctctgaatgacatgctctcagaccttgggagcgcgttcctcagcaac

SEQ ID NO: 45582 - DNA, 1000 bp, Bovine  19866880944343
gcataccagggtcagctttccatcattaatggataaaatgcagcccatgaccacacacaagccaggaaatagaaatggtcctaataaatacagccttgcattagcaaggttctcagtttgtgacaagaccaaaaagcctcatatgatatcttgtaagacatgcatcccacaggccagctgttgacatgttcttggaacatgaaaaggatgagggtcttctctatacctcacctgcccttcctggggtctaggcatttacaggtcacagtgtctcatggggctttttaaaaagcgatgctttcgaattctaatttgccttccttttctttttgccacatctctttactaattgaaaactgacaagcaaaattgtcctcaaccacaaatatctagaagaacatggagacattcgaacaggctgaaatactttgacttttatgagttttaagaagattaatcaaggctctggaaagaattttgtttcatggtggactcaacaaaaaaacgagctgggccctcctgtgattggccagaggagaaggcctggagccggggccctgatcaaccgctggtcaagccgggtgaggccaggccgcaacttctttccgcggtgacgcaatcatggtggccattggacgctatctgttgcttggccttcagactgatgtcagtctccgctccctgggagtcctaaataagcctcctctgaagttctcacagctgagtttctccctcagggaatttgttttctgaggagtttttgtctcaagtggaggcatgtttccctacctcatttcttgacagcgacgttacgtaacccaggctggggtgtgcggtggttgggtgagaggcaacggggaaagattttacctcagggatagcaacagagaaagtggggttgacgaatgagaggcgcgcatccaggtattagtgctggtgtcggacagcctgcggagaggagtgaaattccctcttccctcacccatccttcgtctcctcc

SEQ ID NO: 45583 - DNA, 833 bp, Bovine  19866880995935
aaatggtagggaggctatgtagcatttgagaaacttgaggcattaagacttatcaactgaactttacagctggaaatatgatggtgtaggaaggttaagtggcttggtcattgtgccaaaggtaggaacatacattagggattattagtgatggctttgctatgaaattcatcaacaggcccccaagccaatattattcccttgttccaacacagaactcggagagaagggagaggcagcaagaggaagatgattaagcagtaaaactctttctagaggaaagtgaaaatgtgtccaaagtatatagacaaggagcaatattagagtcagccagaagagacccaaggagctacaactgtttaaataaaattgccattttatattcacaatgggccagcttttatcccggtatagctcctcaggaattctctggaaaggttcctaactctagaattacttggtgtgagtgaattggggccctatgaaaatgatactcagtgatgattttatgcaactactttttaaccacctaacagacagagaatcacttttctcccagtcccacgttggcacggtcctgggatgaaggttcagcaaatcccattatacatggatttgacttttctttcactttgatagctttggggaaagaaactccaatgagttgtgtatttgtccagctaactcagcataaatattcatttctacagaatatgtgcactatgcaaagttggctcagccatttaaacttataaaaagtccagcacatgctgtaagaatcacttaagtaacgaaaataaaaaccccagtgatgtctataccggagaatcata

SEQ ID NO: 45584 - DNA, 753 bp, Bovine  19866881025722
tgagggacagggaagcctgtaatgctgcagtccgtggggtcacaaagagtcggatacaacttggtgactgaacaacaaccaaccccaaatcttcagagtctagtacactatgcagacacatagtgagcatacataaataacttgctgaatgaatgaatggttagaatgttaggtgaaaagggcaggttataacagtattttcaaaactgttcatttttataaaattaagcaaaatggaaaacaaaagctactacacacacagagtcaatccttattacatggattcctcataggtaaattttcctactcactaaaattcatgtgtaacctcaaaatcaagaactgcaacattttcatggtcattcacggacatgtgaatgcacagatggtgaaaaatttgagttgcctgatgtgtacattaccaactgaggtccaaggctgggagatatgcagccttctggcttcagatttcaaactataaatgagtgtccttttagtggtttatttagtgcaatatttttcacatttttgtgcttttggtgggtgacttcactgtttaaaatgactcccaagtgtagtgcagaagtgctgtctagtagtttctaggtgcaagaaggctgtgatgtgccttctacagaatacatgtgttagataaggttaattcaggcataaattacagtgctgttcaccatgagttcaatgttaagaatcaataatatatattaaataacgtgtcttaacaaaaacacacat

SEQ ID NO: 45585 - DNA, 925 bp, Bovine  19866881025834
ctggggagtcccagattgaattacggaagtttttgaagtgggtcttacattacaccaatgggagcataacctgtgaagtctgaattatttttcaagtgaggttgtcagtatacgtataatcagtataacagactagtaagacccaaggaaactccagatatgagagtaagtggagtagaaggtgcagaaataaacataattccccatgggggttccatatgctccatacctcctttttccactcttattcaagatcagggacatagccaggccttggagaagaggttgtaggagattgactcattggtctccaactcttcaagcatctctatgttagaatcacacatccatgccatttgtcatatgaatttcctttctccctccagaggaagagtatattttcctgctcctggatcttggatttggctatatgatttgccttggcctgtgtggaatgaagtgatctgagcagaggcttgaaatgtgtacttactggccctcttgagcttcttccatttgccattaggacagaccttacatagctgctgtttccagtaagcaaaaggacatgggggtggctacctctgaatggaacccaatgatggagccaacccaacaagcttgcatcccaaaatacagctactgagtcattgaactcagatcaaattagccaaaatctagtccatgagaactgtactgtcaagccataaggtcagagatttttgagtttgtttgttattcagtataaactgactactacagatgcaaggtgtgtgaacaaattctgaaaatgtatgccaaagggcaaatcctggaggttacgactgtgcaggataaccaaatatgaccacccaaaatctttgaccacgtaattagcacaggctttgtgaggaagccaaagttggaaagaagcttaaatgaacca

SEQ ID NO: 45586 - DNA, 1236 bp, Bovine  19866881111338
ttctcttccatcagatgggttctaaagtgtttttagaaatacctctttgttggccagtgcagctcactaaccagaagggactccaagccctgtgtttcagtgactgcaagacaccgccttctgtaaaccagactttgtggctggcagttgcatttcaaggaggccccttcctacccttggggagatgatttttaccagtggtggccttgacgtgaccttgtgcatgaaccacaagttgagcccaatggagaatgctttcttttagtcagcagaaactttttcacagtatggataagggattaagtagcattagggatatgacagcagttaacactgaatgtggcacatggaaggtgagcattgcatgctagttctgtctgaagaatctgagaatcgtctcctgtgacctccgaggatgggagctactcatcccatgtggccctgctaaggggcgggcctgcatgtaagtactggggaactctgcttccctgccactgacccacactagacaatgagtctccatcagaggatcttatctggggctacagagatttctattgtccagtcactgggctgggtggaacatagagtaagccctaggtcagcccccttttccttgagcacagttcagttcagttcagtcactcagccgcgtcccactctttgcaaccctatgggctccagcactccaggcctccctgtccatcaccaactcctggagtttactcaaactcatgtccattgagtcagcgatgccatccaaccatcttatcctctgtcgtccccttctcctcttaccttcaatctttcccagcatcagggtcttttccaatgagtcagctcttcacagcaggtggccaaagtactggagcttcagcttcaacatcagtccttccaatgaatattcagaactgatttcctttaggatggactggttggatctccttgcagtccaagggactctcaagagtcttctctaacaccacagttcaaaagcatcagttcttctgcgctcagctttcttcatagttcaactctcacatccatacatgactactggaaaaaccatagccttgactagatggacctttgttggcaaaggtccttgtgcacagagaggaaggcaaatgaagcagagcaagtagagacaagaggctgctcctccttttccaaaccagtatctcatcctcccaagtggggggtcttttatagcaaacatctttattaagatatgat

SEQ ID NO: 45587 - DNA, 1446 bp, Bovine  19866881142341
cattttgtttagctccttattcttcagggtggcaatttaggtggcctgactgggctctttcccatgtcagtggtcagctgcaggttgagtttgctgatcttgctgggctctgtcatatctgtggggtagccgggcagacgtggctctggtcactgtgggctctcattctccagaagtccagccatttgtccacagagaggagacagagatcccaagatagcaagtaggagtgtgcaaaggctcttgaagccttcgaatgggcacaatttcactaccatgtttaataggtcaaagccagtcgtaggcccagcccagactctgcctcctagtgaagggagctgtagggttgtcacagtgcagaggaaaacactacaaggaagagaaaggatttgatcattttgcaatcaatttcccatacctgggacatatttcacctgtgccaggaggctcccaggaaactgagaaagaggaggagttagtgcatgtattaatgatcagatcaggaaggtgaggtcagcagcatgctaggcaagtcttatccaggatcttccttgatttgagtttcattttacattcaacatttggtaaaagtctgtgtagtcaaagctatggtttttccaatagtcatgtacagatgtgagacttggaccataaagaaggttgagtgtcaaagaactgctactttcaaaccatggtgctgaagactcttgggagtcccttgaatagcaaggagatcaaacaagtcaatcgtaaagaaaatcaaccctgaatttgatgctgaagctgaagccacctgatgtgaagagctgattcattggaaaagaccctgatgctggggaagattgagggcaggaggagaaggggatgacagaggatgagatggttgggtcagtccactggaccaactcaatggacatgagtttgagcaaactctgggagatagtgaaggacaggaaagcctggtgtgctgctgtgcatgggattgcaaagagtcagacatgagttagcaactgaacaaatgctgaatgtagatgtctcacaatcagatcagcgtgggcttcagaatacccagagcaaattaaaatcgtgtctttgggagagatctagctacataagaatgagtatcttaggttggaaaatggcgagtctgagaaagacaagaagggttgtggccgacctagttaacagtgagcttacaatgcagtgctcatgtaaaaatagccctagttattctggggagagtgatacatatcacacacgcaggatgagtgtgaaaagttgttctctgtagcccacaactctattaatactgttcactcatggcacctcttttttttgttaacacctcaaaagtgctttgtaactgtcttcttcaaaatgtctcaggaaatatacctctacatacattttggtcctcatttcacagaccttagaatctgagagttg

SEQ ID NO: 45588 - DNA, 1210 bp, Bovine  19866881151293
atgcggctcgcggtgggctgttgccccagtcccagcctcgcgggccctgctcctggcgggtgtggtgctggcctctccgtggccctgagagctcctggccatgatggtgcctctctcagtgtggccgggtctgtaattgtccaagggaccttgacgcatccctgggaggtgattttgcccaagcaccctaatacatccccaagaaagtcttaaatgagttgactgtcttgcagcttttccagtcaaggagcctcacggtgactttgggaaagcagatggctcgagctagcactggggccactggaactcagacagctttagtgggaagtgaggaaataagcccgtgataggtgcttctgaggcatcttctgaggatccactgggttaggtttccctcaggagcattgtctgcggtcagcccttgacgtcatgcgacttgtcagggtgtgctgaggaaaggtagggacaaaaatcggcttaaaggaacaggaaagagggataggtagtcactgaggtataagcctgaataaactcatttcctcatttctcaccatcctcgcctctctctgctttctcagcgggcagagctgacatctgataaagacatgtaccttgacaacagctccattgaagaagcttcaggagtgtatcctattgacgatgacgactacgcgtctgcatcaggctcgggtaaggctagctgcatccacactcatctctgttctctgtgtttgtgtatgcacgtgccacacacaccctgtcttacacacgcatacactcacactctattggaatgtgcttcagggaagcaagcaggaggcataactgttaagggcacgctctgtggagtcacagtgcctgggtgtgaattctagctctcagctacttgagctgtgagatcttgggaatatatttaatttggctgaacctcagtttcctcatttatagactggaagataataatcagccctcccacatagggttgtcatgcatcttaaggggttgatacatctgtaactcttagagcttgctgcttggcgtgtggtcagtgttctgtcaacattatcagagtgatgtcctgaaaaccaccctcaaatactagtttcataaaactgccagccctaccttaaagcttataaatgagaccaagaagagttatactttcttactgctagtgtatgcctcagaagtaggagggagaatgtagcag

SEQ ID NO: 45589 - DNA, 1327 bp, Bovine  19866881256679
cagttttgttcatgctgcctgcccagcacctagaatagtgcctggaatgtggtaagtgcttagtgtagatacatcaaataaacaaattaattaaaatgtacattacacatcccaatatctatgcaaacatatcttggagaggaagtgatggcaacgatagggctgggcacccagggcgctcactggaacttgggacatttggacatgggagtaaaatcagtccaaatccactctttctaggtgttttgccatcaggcgttgaatctccctcagcttgctcctgagtcttgcaaaatgggaataattatagccacttaaggagttacggagattacatgagaagaggatacaaatgtgctttgaaaaatctgctaaaacttacagaagcatcagatttccttatgtgttgtgtacacatgtctgttgatggagtgagtgattgggttacactaatccgttgcttaattcaaccactctgctgaagaggctactaatggatgctcagttgtcatggcaggtgcgtaaagggagatgcctttcccatgaaataccagggatcagaggccaatcagaactgcccaaggagctgtttaaaaattgtatattctgaggtgtggtaagctgtatgcttgtttgcatttatttgtctcccttgccactctcaggctgccatatataccatgttttcctggaggtgatgtttggttttcatcccccaaaatatgggcgtggccatagatttgcccttagtcgatgaattataagtgagcatgatgcatgccacaccaacatagaaacattagatgtgttggcatggtttggcttggcatcccctctagcttctgcactcagttaagagaatggcacaccctagttagaggatactccttcagcctagtttctggaatgaggatacacatgcttcttggtcaggcccaggcatgcccaacatagccacaccgactcacagcccttatgaaacgtgagcacaaatgtttgtgtgagccactgagatgctgaagtggtttgttaccttagtgaaagctgactggtaaaccaggatccacgccaaggcccccacagtccatccactgaggctcagagatctgtgtttttaaaaaccttgtaatcaatcagatttgggaacaattctcctagattatctacaccccatccttccttcctcccacctgcccataggaacagggtttgactaacgcgtctatcatccctataactcagctggtagcattcttggttgtcaggccagaaggaaaagaaaaggatgtctctctgtgtgggaattagatcgaatataagctgcaga

SEQ ID NO: 45590 - DNA, 915 bp, Bovine  19866881262510
ccccaaatgccttattgaccctttgaggtgttttcttaaagcagctgaggaggatgtcttacgttgcttgagtttagggcaagattccataaaatgagatccttccaaaactattttttacaaagaaatgcagcctaattagtaaaagagccttagggttgaccttcttttcttttcttttttttttgcctgttgctgggccctggttcagagtgctagactcagaggcaagaagggtctcaaaagagcatgcctaacctcaacaaatcatctcctggaaacatggccctctcatcttgtgttctgtgtggggaccaatatcaatatcaggatgataacctagccacccatcctggaggcagccacccaggaatgttcccataccagagggagcttgggcacgaccccaaagacaacatgtaactgatcatcagaagactgggaccaatggaatcttaacaggacagggctcgtttatacggcagttttacctatatcagtggttctcaactgggcggagattttccacccaaaggtatttggcaatatgtgctgacattttggggtgtcacaactgaagcagatggtgctattggcatctagtgggcagaaatcaagaattctggtaattatcctgcaaagtccttatgatacccttacaataaagacttatgcaggccccaaagcaatggtgctgatgttgagatactagtgccgtctggggattagactggtgtgcacacattggagtggggatgttgttttcacttttctgctctcccagcaaagccccagaaactcgtgtggccatacctgagagtcctcgaaggcactcaattaactctactctgccataggggcaaaagctacagactttgctggtaattgggtcgtcaccttaggagagaagacagg

SEQ ID NO: 45591 - DNA, 2559 bp, Bovine  19866881527224
aaaaatattttctgttatgttacatatgcttatcagctgtctttcacatgaaccaaataactacaatggttattgtaaaacatgcccaaataaaatctgtaatggttcatacttcattattttcccagaaatattgtgagtagaataactcaaaaccctttcacaatatttcttatcattctaaggaattagctgcagcctttgcttccaaagccataacactattaatggttttataacaccatagcattaggacaaattaaatgctcttaaacaatcaagaaataattaaaggctgagagagagtttaagtgtttaagttcatgaatttaccaaagtcaactctaatgcttgtatgtgaactgtgctttgaaattaaaattcccgatttctttaagagaaggcatctaagaaacccacaataaagtcaaccaatataataaacactataaccaggataactctcatgataaaacactagacatttcctttcaccgctttatgccacacctccacatcatccgatgacggcttcccacagccaaggtaaggcagctaatgcttctggcaccgagatgagggagaccaggcagtgggtaccatcaacagcaaaaggggtgctctctctttttctccgtcatgagatgctctcacttctctctgttctcaccaagtcttctcacaagactttcaggatcaagcgattcatgcccaggaaacaaaagcagaactgtcccaacgccccaacggattggatgaaaacgcgtaacaaaatcaggtacaactccaaaaggagacaccggagaagaaccgagctgggtctgtaaggtgtcgcacatctgagctggcacacatatagatgctgtatcaaggtcacccgcatcttaccatatcgctgtgaaaacatcactactgtctggacagccaaatgtgcgttactgggaaaatgatttgtctctttgtttcagtgtttctgtattagtgagctggcttggtgataaatacataagatcttttgtttgaaaaaaaagaaaagtgactctacagggaactcaaacccgggctctgtaacaacctcaaggggtgggatgggaagggaggttcaagcgggaggggacatatgtatacctatggctgattgatgctgatgtttggcagaaaccaacacaacactgtaaagcaattatctttcaattaaaattacataaattaaaaaaatttttaaaaagaggtccaatatcctactatatagcacagggaacttgctcaatcttatgtaacaatctaaatgggaaaagaatttgaaaaagaacagatgcatgtgtatatacaactgaaccactttgctgtccacctaaaactatcacaatattgttaatcaactataatataaaatataaatgtctttaaaaagtatataaaaaaatgtgagtctagaatcctactcaagatcacacagctaataagtgacgtaagaggcagaagagaaggcagactcaagcccagatctgcagagcatcatgcatatggcattcttcactcacagtacgagtcatccagggagtgacaactcaggtatttcaactggctgcagaacttcaactccacaacactctgggtcattgatcccccagtcttccacccctgggcccttcccttcccacccccaagggaaacaccatttcattccaaatgtcttcagtttcttcatgaccatttctatgaggcctttctgatcagacacacctagggcagggctggtggaagcaaaggtggcttttcccaatctatgtgggatgtgtgctgggggcacagtgggactcagggaaggctgagacacagccagaaggcgaccctctcaacactgcagtgacagcagtgctgctggtgctggcatcacagaccactgcctgccctgtccctgctgcaaccggcaagaccccgcaaggacagtgccagggctcctgtgtgctatgctctgtttatccaaaacgccattaaactaagactcaacctaaatttatttcttccacacagagaaacacagaagattcttttcagtatgacaaccccacaggaccctgagatatcatctgaataaaagataaaagtcagactcaggatggtttcagaaatcagtgtgatttatcagggcctcactacgtgtgtgtacgtgcatgctaagtcgtgtccaactctttgcaaccccatggactgcagccggccatgcctccctgtccatgggattctccaggcaagaatactagagtgggttgccaagccctcctccaggggaccttcccaacccagggatcgaacccacatctcctgcatcgtaggcaagattctttactgccaagccattggggaagcccaaagagattctatttcttatctaacaagaaacaaaggacctcactgtacttagctataaaataagagattgggcatctctaataaaactttcacctctagaaaaaaaaattctgagaatttttgaaaaattgaacttatagacagctaatgtatacacttaaccagactattattgaacagtaa

SEQ ID NO: 45592 - DNA, 1206 bp, Bovine  19866881567066
ttaaaatacttgatatgcattatgcctttattgtacatctttaatgcattacaattttcctaaaaactactttcctttcctcaacatgcaactttaaaaaataaataaatatacctcggcaaaaaaagatacctatcccattgcttgctaatttatcaaagtttgtgaagtaaagaatggacacagaatgactaaaatggaacagaaggcatgaagtcagttttctaaaggatcacaaagttcaactcccaaagcaatggacaaggaactttgcaaagcaccagcaaggtcaacctcatcacttaactacacagaaatgagaaaatttctaagacgaaccacaggaaaagatatctagaatcagaagacatttcctcagaatgttttgtttggggttagatattacaagtccagaggtaagtacatcttaggcacatttactcagcagcaagcactcttcagactttcccttcagaataccttacaaaagaagccccatgaaatgagaggtcctttacctccctgtgtgaggccaggccacaggctgcaagtttaaaggactgcaggctagacccagagaacgtcactgtaatgagaagacgagtgaaaagtcttcttttgggttctggttatcttccagacaccctcctcacactcatgtacccttggacttgcccttgcaaagagaaaagcacagaagtggctctaacaagctggaggccacaccaccttcctacctgttctttcctaccccctgctgatggtacaggcagcctacacatccatttttcaatgggacaaggatagatccccacatttaaaaataagactaaaacgtaaagccttctcatcaggacacatggggacacctgagtctttaaaagggtgtaattaccaagccaccaagctacaaggctgtacctaggcctgggaacagaaaacaaccgagatgctggcattactttcagtgtacagccctgtagtttggtaattggcagttgactggctgtagagcctgctggtctgtaatgacagagcaaggccatctgtggcccacgagtcaagatgacaagtatcctcatgtagcaagtagagaggaaacagaagtataacccttaattcaacagtgcttttacaggcaaagggcctgtcagctggcacagagtacgagcttaaattatacacatttttagttcaaaactccat

SEQ ID NO: 45593 - DNA, 1715 bp, Bovine  19866881623587
ttgcttttgcttttatttttctttttaactctaccagttatctagctttaaaagtagtgcaatcatcttttctccaaggaagtgacatttaaactgtgccctgaatgttggagaggagccaccaggggaagccccctggttctctgtgcaggagaccacctgggaagcttaaaaacaaataagcaacccaaaccgaaaccactttgttgcctgggtaccactcctgagaatctgaattgatcggtttgggatgtggcctggaatgcagatggttttactgtgtaactaagctgagagacataggtcaagtgcaaaacggtcctagctgagaaaacatcaagtgctaaggacctgtggcggcagggagtcagtaaggggactctgctggagcagcccatcacactgaattctggtggagaagggagaggaaaccccgaggtcagagaggcaggcacagcacccacattggctgttttatccctgggtgcgtgctaagtctcttcagtcatgtctgactctgtgcgaccccatggactgtcgccctccaggctcctctgtctgtgggattctccaggcaagaattctggaacagatcacatacccttctccaggagatctccctgacccaggcatcaaacctacatctcacgtctcctgcattgggaggcaggtttgttaccactagcgccttcccggggaagaagtttggattttacgtaaatacaactggaaggcccagagggttttgagcagagcagtgaactatgattttaaagcaggtactctgtgtataaaactacctcattctttttaaggaatgcatagccctccagattatggatgtcccgtaatttattcaaccactttccaggtgattgacatttgggttgcttccaagggaatgcaattacaaatagagctgcagcgaatatctgtgtgcactgtgcttttacatttttgtaggatagagtccaagggcttaaaaaatttagggaacacagtgggggtggggaggggagaaaatcctttaaaactccctgtcatgcgagggagagagctctcttaagcccaagtgtcttaaatgtgtgttccacaccagcctggataaagccaggtttagcagaccatcaagatcttgcgaacagccgctggagtgtcctgcaataatactgaagtgtgagaaacatggacacgcccggtgttcctgaaacggacatttcatttccccttaggttttaataatatcataaattgattacatttgctctgctttcagttctatccaagaaatttcgctaacatattgtatgtttagtatttcatgttcacttgaaaatcagctttttaaaactcttgtcataaatcagagcagaatttcactttgagataagtataccgtttttaaataatttccattgtctatagaaaaggagggcttcccaggtggcacagtgggaaagagtctgcctaccagtgcaggagacataagatacatgggttcgatccctgggtcgggaagatcctctggaggaggaaatgacaacctgctccagtattcctgcctgaagaatcccatggacagaggagcctgggaggctacagaccatgggatcacaaacagctggacacgaccgagcgcatacatatagaaaaggaacttaatataacatgtttctccatctattcaaataactttttttgttaacttctcaggg

SEQ ID NO: 45594 - DNA, 847 bp, Bovine  19866881885837
atgtaaaatctgatcaaaaggagccccagttttggaaggcaaagaacacgggactgtttagagtatccagtgtcattctacaaaaacctttttctttcctcatgagggcctttgatactctgccctggaaaaccaatacacagtattgtacaatttgataatgtgtgcacactgctctgtgagaagttggcaggaaaagtaaagggaagaaataatccttgtagttttaggggaaaataataaggtcactgcaagtagaatttttcccttcgtcaagtctcagtacccatcgtttttctgagattggatttcatgcgcatttccgcactggatgagaaaacttcatgttagtcctatcaactcacctgcctgtgacaatctcgagatcttaatagccagaccaccaaacaggaaatagtcgtgcagctcaagttttgaaagctatcagtccacaaccttgcttgccagaaatattttccagagcctatccaatatttaccattaaatatttgcaagtttaaaacacaaatattttatgttttttcatatagaacagaaataagagctattctaaggaaattaattcattcacatttatctactcatgtattcaactgtgtttgcttattcagttaatcgtcattcttttcctcaactaacacaagtcagaaagagggctgctgagtgatgaaaatacgaagatgaataagaccctgcattttccttcagggagctcttaggaaggtaggcgggcaaccacaatctaagatagattttgatttacaaagagatgcatccagttccaaacaggccagaagagttccacccaaggaaaaggagcatttag

SEQ ID NO: 45595 - DNA, 2498 bp, Bovine  19866880572046
agaaagaaatccactcccatggagtgtctaaatgtgtctggcatttagctgacttttggtcgggtggtctcggggtcacattgcaggcgtgcagctcctcccactgagcactctgggttcccaccattcctcctctgcccctctctcttttgcgcatcccctgagggcctctttctgttcttctcatctctcggtattactgctgttctgcaaaaacctttaggatgattcagaatcttgcatggtacaaggcaccccaagaagcttatccaagtacttcttcaaaccattgtagttgctcatcccaagaaaaattctggtctatacagttttataaatatgacattcgcactgccaactgcttcttggtgcatgaatggcctattggcttctctttgtaaacttcagaagggaggcatgcatcttacatatgtagatatccatgtgctgtagctccttgcctggtcctttcacagaatcaccacttaataaatattgaaaatggaagaatcacttttcttgtttttacatgaaagaaatgaaaattaacgtttccctaagcgtaacttcattagcaagctaaattgactgtagcaattacacacacacacagacacacacaggtggtgcagtggtaaagaatttcatgccaatgtaagagacacaagaaacgcaggtttgatctctgtgtcaggtagatgccctggaggaggaaatggcaccccactccagtgttcttgcctggagaatcccagggaccggggagcctggtgggctgccatctatggggtcgcacagagtcggacacgactgaagcgacttagcagcagcagcagcagcaggctgtaaacataacggatgtttcttttgacctgtctgtaatcaggtcagtttcatggacaattcatagacagaggagcctggagactatagtgacatggggttgcaaaaagctggacatgactgagcacacatgcatatgtatatatatagagagagacagagttaatcctctcatttaaactaacatctgtgataacggtggtggaagggagttggtggttggagaggaaagttggacaattttgtattttcacccactctttcttgtgtgtaacgtgggaatccaaagctgtgtctctggtgctgtgcttttgtacttaactgtgctgaaggtggttcctggggtcagctgcctttggggagcacctgcattgcagagttcccctgtgaggcctgggagctttctccgccagcagatgcccctggctccgtgatcactctgctacctcacttgaggggaccccacccccgaggggctgacaggctcttattaccaggaaggctgtttctaatgacctgtgatctccatgcccaacctgccttctggcttgtttttctttaattctcacattggctttttgttcttggagtggttagaatggattttcatttgggttttcttcatctctaataattctagaatgccatatactgtgaaatgctaagtagggatgaacggtaaagctgcttaaaatccccccggagcgctccagcccatcacttctaaatctgattagcactcagcacctgccaagcagtggggcgattacaggctcacagttgaatttcgttttgtgctggtgcttcccccacgttcctactgtgggaaatctgacgtacagcacggaggagttaagaagtcgcagccccacttgagttgtattagtattaattacctgtgcagatcttggataattgaagcaattactcttcatttcagctccagggcctggaatggatggtttctctgtataataacaatttgaacggaatcttagctgatgaaatggggctgggaaagaccatacagaccattgcactcatcacttatctgatggagcacaaacgactcaatggcccctatctcatcattgttcccctttcgtaagtaaagccatttattctgcagttatctttctttatgttagagcttgccctatttgtcatctgtcatttaaggcagagttgtagcctgtagtgggattatcaagagcatataatctggatttagatgtttcatttcccaccctgtctcccaccctggcctctttgattggctacataagcacaaaatgaagtgattttttcctagcccgtcgtgttgttgcagtctacacagcctgcacaccgcatagtgggtctcattctttatcacacctgaagtggctcatgaagctgaaagttttgatttttttaagatttcctatttttttcttatgtttctaaaaggctacatatattcaaaaaaatgtatattcttagatcttcctttactgtcccctttaaagcagagtctaaatcaaaatccagactctgaactttgtattgaactgccctcagtactgtggtttatctgcagtggtgatgccgctttgtcaggacaggtcttcactgttttccatcacatttccagtgaccttgtccactgcgggacc

SEQ ID NO: 45596 - DNA, 945 bp, Bovine  19866880580760
cggctccgccccgtgccccaccctcaccgcctccgcggggccggaagacgcgcccgcagttggtccagcgagccgctcctccccccgcccggcccggggcgcgggttggcgggaagcgcctgtcactcgccccgctcgggcgactcccggagctctgggagggaggagggggcggtgtgcaagaatgtggatcgagacagctctacagtatgcgtggatctgtgtgtgtctgcaaggcgccggctccctggccgtgtttgtgcctggagcagaaaaactgcgcaggacgctgaaagccccaagccctgatggagggagttgggcgcccgttatccttccccagcagtcttccggggcccctgccggcctcctcacgggaggctgggaagcggaggaggctaagtgaaagggagggcagccgtagtaatagcgcgtagtagtttaggggtatgggaagaaggtgctggaatttcactgtgcctctgcctgccagagcgagcctgcggaggtaaagggaggggacggggggaaggctccaagtggcacccaagctgtttgtagcacagtgttgaccatggaaaaaaaaaaaaaaaacaggcatcgacgtgctgcccgaaactttttctcccccaccccgccccccacccaaggctgtaattataaatctgtttcttttctcccccgtaaaaaggaaggagggcacaaagaacattcctgccaaatctgtctctcttctaaaggactgcaagcttccaaatgccaatgagggaaaaacagctgagaggctgaacgctttataaataaacaaacctgccctaacccctgtgttgactctgtggaccagacacagcactttaaccttccctcacctatcgtcttcccgtaagatatatacctaaaaaaaaaaagaaaacaacctcgtgggggcgggcgggagataggggg

SEQ ID NO: 45597 - DNA, 1314 bp, Bovine  19866881232015
agccttaagatgctccaattccaagctccgaggaaactgagaagccccagaagaaaggcgctttgcccgggaccctgagggttggtagtggccctgagattggcagacaggaacccaaagtctctggggtcccagtcagaagccagagagtcacagtcaagttgcgcagtagtccagatcccttagctgggcggcatgaggcacgttgctcattcgttagactatgctgttcctctgagctaacttcttgtgtgtgtgctcatctatgctatttcatggacacatgcattaagggcatgcttctaaagattctcgacttaagaaaaagtttcccatgcaacatgttaacattcctctatatgcccatactttcctacttcccgtctcctgtgttttcccctaagaagtttttggtagtttcctataacaaaaaatgaggagcgtttttatgggactgtataccattcattacaaccttctatgagattcccaggtgaaaatcattatatatgcataaaatcattagatattaaaatataaaacatgaaaaatggaactaccaggctgacagcatttgtatcttcattgttcaaacttgtggtatcttaccatcatagccactgaagccagtttcaaggtaaaccataacaggaagtaagcaatttccttttattcactaaaaaataaaggggtttattagtttgctgatatacatgaaagaacatttaaacttggagtacccctgaattgacgtcagcttcctaaatttaaaatgctgactgaacgtgtgtgtgtgtgtacgtgtgtgtgtgtatgtgagggggtggaatgccaaaaaaaaaaagttacttctgcctgctttgttaatcacaaagaaaaaataataacatttggctctctagtgaattcaaggctataattcaccatccaggcttccctgttgttttagaaaccacttgaactgggttctcttagtcccctcttgtatcaccaaaacagtttgagtgatcccttgctcgaaatcattccaaagcagcctttcatcgcttcctgttttagccctaattcatttatcagattggcccagatccttgcctccgctgttaagatttctttgtttgagcataccttgagcactgattgctctcctaattttttattttttaataattgactctattaatagtttgtccatgcaattttgtctacagttcattcagttttgttttttttactccacactggttgaatgtgctggggaaacaggagcaaggaagagcaagtccttgccctcatggccctcacattctagag

SEQ ID NO: 45598 - DNA, 958 bp, Bovine  19866881330059
gaattcaacgctatcctggctgtaaaccagctcctattcaccactcttggaaaatgttaccccctgccatagtaagaacattttggtatccccaatctctgaaatgctagggctgccatccaaatcatacagcaatttaggaagtatctctaaattcatattttcttccgttcatattttttgactagttttttaaagacatagtgtcactctaaaaatcaggcaaatattctgcatagttcacaaaatccagcaaacaatgaagccatgtcttttaaggtagcatgtatatacttctatttagaaaatgagagaagttttaatgatagatataatcttatgtggactattacactgttactgaagaagggaattataacttttatccctttaaaatatgccttcacattaaaacctaaaggtttatcaaaatattctatatggggggggggagtgcatagagaatagacaagcccaaaggcaagaagagttttttaattttagtttagtttaattgtggtacttataaatgattttaagtcacgtgcattggcttgaatgtaggaaaaacatctgctcaaagatttcagcttattttaggctggaggatataaaaactgctatctagagaacctggacctcactctgctaattcttcaaacaattttacccctgcttttgactgaggttggatctgagttgccagtatccctgtactctgaatagcatggctgtgaagcctaattccttacacactcaccatcaaggcgcaggtaaaggaagttccgaaaagcaaagtaatcctccatgatggtcatgagggacgtcatctggcagaaaagcagcacgcggtggttagtcgctctcaattttggcagaatacgatcaagtagctcaaactttcccgaggcccgatacagctcagccctaacccaaaaatgcaaaacaagaagacagt

SEQ ID NO: 45599 - DNA, 3359 bp, Bovine  19866880512002
aaaaagcaagagagttccagaaaaacatttatttctgctttattgattatgccaaagcctttgactgtgtggatcacaataaactgtggaaaactctgaaagagatgggattaccagaccacctgacctgcctcctgagaaatctgtatgcaggtcaggaagcaatagttagaactggacatggaacaacagactggttccaaattggggaaggaatacatcaaggctgtatattgtcaccctgcttatttaacttatatgcagagtacatcatgagaaatgctgggctgggtgaagcacaagctggaatcaagattgctgggagaaataccaataacttcagatatgcagatgacatcacccttatggcagaaagcaaagaagaaataaagaacctcttgatgaaagtgaaagaggagagtgaaaaaagttcgcttaaaactcaacattcagaaaagtaagatcatggcatccgatcccatcacttcatggcaaatagatagggaaacaatggaaacagtgacaaattttatcttgggaggctccataatcactgcagatggtgactgcagccatgaaattaaaagacacttactccttggaagaaaagttatgaccaatctagacagcctattagaaagcagagaccaacaaatgtccatctagtcaaggctatggtttttccagtagtcatgtatggatgtgagagttggactataaagaacatgagtgccaaagtattgatgcttttgaactgtggtgttggagaagactcttgagagtcctttggactgcaaggagatccaaccagtccatcctaaaggaaatcagtcctgaatattcattggaaggactgatgctgaagctgaaactccaatactttggccacctgatgtgaggaactaactcgttgaaaaagacccaataccaggaaagattgagagcaggaggagaaggggacgacagaggatgagatggttggatggtatcatggacacaatgggcatgagtttgagtaaactctgggagttggtgattgacagggaggcctagcatgctgcagtccatggggttgcaaagagttggacacgactaagtgactgaactgaaagagagcttgcctctacaccttgaacaaacttcttttttttttttttgattggtgttttgctctctggttgtcttatgctcctggtgatactcagcagcacagaatttgaaagagattaaggagcaaatgagttaacctttaacagcagtgggaagacgatatttgtagtctccctcaaagtccactgggttcataggaacagatgatataggaagaaattacatttaaagatttacaaacctttcagcagaacaaaaatctcccaacatgtagctataaaatatcattagagagcattaattaagtcacaagaaaaaatagagttgaccgttgaacaacagggaggtaggcgtgctgactctctacccaatcaaaaatccaagtataacctcacagttggtttttggtatccaagtttccttcataacctcagctctgcatccacagattcaatcagttgctaattgtgtggttctatgacattcatttcttgaaaaaaattttaaaaacatgtataaatggtctcatgcagtccaagcccatattgttcaagggtcaactgtttagcttgctggagaaaaatcataattcatttatggaaactcgtaccttcaattatctattaaaacaaattcctgagtcaaatttaaatatctctgagcagcaacaactcattttatgctggataagattttaaactggataaatctttaatattatacatttgaagtattgcggagggattaactgcaagaacaaaatattctgtctttgtttcttaacaaattcctttgaagcaccaatgcatgaacacaaataacttatccatataactctagctcattgactttgggattagaaggctgaaataatctcccagtaaaaaagatatgatagcttctttgaaattatgatgaataattactaaagggtgacatgcatgttaaattggaaatggtttaggggccatcggatgattttgctttacagacagaaaaccaagtgaatattgcaggagggtagctggggaacagacaggttgtgactctacttgctttattattttatccaatttgatgcctgcttctttccttctcacctggggccctccactgtgacgtgtgcaattttaaagaaaactgaagggtaaaatgaatcaaacgaggcttttgctcctaggaccctgatccactccaactgagaagtcacaaagggaatttagtcttattaaagggcagtgggtcagaccacagaatccacaaagctgctcttaaggctcagtgttcttgctgggtatcattaccatcaaaaccaaataactatgcagcatatctgttgccagaaaactgtagtaaattgggttgctgggatgtagaaaatttaaagcatccaaagagacagtgctgttgttcaaagcaggtctctttgcccttctctatcatcttcattttgtactttgtttaatcttttcctcccatgagttttgctaccccagactgagccatcatgtagatgtttaaaatttataccatttccttaaacccatgctcagtagtgacctcgttctaaagcatggtttctcagtgttggcagaactgacatttggggtagcatagttatttgttgtcagggtcattctgcacatgtagaatggttaatagcatctctgagctctatacggttgatgttggtagtatccctgagctctgataagcaaacacatctccagacatttccagatgtccccaggtagtggcaaaaccaccccaggtaaagactcactgctttggaagttgaaactgctggacccaacaactccctatgcaagacaagctgatgacagctcaggctagccactgctccaaagcttttcttcagcaacagaagaggaaacataaaataactcgcacagtatcccaggcttagagaaactccattaattaacgtggaggtttgacattgacatgatggatttatctgcttgggaagcatgtggtttagaagttggacctgctgtaccaaacgctcagtctgtagtatggttgtaggtatggtatatggttccttgattcattgggtgacttgacaatgcctcagtcttctctgtgtctgcaagatgcctaatgccacatagtgacacaaaacaatactcataaaagggaatcaggtgtcgtagatgcaaccatggctagccacctgcccaagcacttcaacctgttagcagtagagcaaaatgaattccaaggac

SEQ ID NO: 45600 - DNA, 1669 bp, Bovine  19866880576224
cccatttggatcactgatcccaaacttggcttcacattagaaccatcttgggagtgggctttggaaatatggatgactggtcttcactctcagaggtttcactggaaatgaagatgcagcctcatccccccaaagttctaaaatgaacgagtatattctaatatatggaaaagtttgagaatggctgctgtgaattaatttcattggaacctttttttcatacattaatcaaaagcaccatttcaaccaagatactgcataaatcaattatttttaaaaaatccatcactgagattttactagagatatttttgacataaaaaatgtaaacatgtatgtgtactaacaggaagacatatagatcaatttaaatctttttaacttgaaacttgttcttgcatgacaataacaaaacaaggttgaaaggctgtgaaagataccatggcaagacagagttaggatgtggattgagttgaaggattttggaagaaagcatcatagagcacttgaaacattagagaatctgggcgaggtatttctgccagcttttcacttgtcagtacatcagaattaaggttgagccgcataaattgttagcaatgtcaactttgattgttggagtatgttcctaatcatggctgccaagagtggatcttgctgacttttgcatcttccttcccaaatcttggaagaatgatagatggagactttctttccaatgtgtaattgatacatttgtttagaaacaagtgatacttctgtgggaggacttgtgtgaaaatattccacctaccgataagacctgtgaaaaatcttactgggagtttcatctttagaaaagattgtagtatctcatcaggctagatacattttcccaatttttttccaaaagtgatacattttaaataaatctattagatgcatcatgactctagacatttcagtgcttgacaaaactccagctatgcctctcatgttaagaaaaccttgaagttgaaaataagtccctaaattttgtttattcacattaactaatacatcagaagcaagaaagtgaaagtgttagtcactcagttgtgtttgactctttgtgaccccatgggctatagcctgctgtccatggaattcttcaggcaagaatactggagtaggttgccattcctttctccaaatataccagaagtcaactttgaatacatatagtatgttttcactctttaataacttaattgatgcttgctgctactgctgctgctaagtcgcatcagtcgtgtccgactctgtgtgaccccatagatggcagcccaccaggctccgccatccctgggattctccaggcaagaacactggagtgggttgccattttcttctccaatgcatgaaagtgaaaagtgaaagtgaagtcattcagttatgtccgactcttcgcaaccccatgaactgcagcctaccaggctcctccgtccatgggattttccaggcaagagtcctggagtgcggtgccattgccttctccgaattgatgcttacactacaggaaaaaaaaagcaaaataagttgtaaaaaatatttaatctttggggaaagcacactggagtgaggtttaagttgtaattggtaaagaagcagtgtcactcatacaaggctggggtagaggaggggtgtttgg

SEQ ID NO: 45601 - DNA, 3466 bp, Bovine  19866880581575
ctggggatcggggatgggggtgggaggggtcatcaaagaactgcctgtgccacagtttgtccccacgttgtccctaaaagagttgtttgaaggaacaggagactgtacacttctattttccacccatccatgccttgtgtttctaggattagtttgatctgtgtcactgtgtcactctttgggacacatgcagtaaaaggaagctctgttgaggttaactaatgggatcatctgaatcttctctcatctccttttccagctgaggaatcttgggtaagccacttaaattctcaggatctctatttatgcatttatttttttggatcatgtggtagctctgtttttaattttttgaggaacctccatacagttttccatagtgctggcaatttttttcccagcagcagtgcaataaaaatttcttgttctacatccttgccaacacttgttatttcttgtcttgttgaaaatagacattttaacacgtgtgaagtaatgtctcattgtgattttgctttgtgtttccttgatgattattgatgttgaacatctttttgtataccctttggctttctttatatatttatgcattttcagttttgggcaatacatgcttcatagatttcttcttagaattaaatgatgtaatgatgtaaagaaatgaggtgcctggaacattgtagctgataaacacgtgttggccattttctcacctccctcctcctttctccagtggagaacggcaggctccatggtgcatcatagaatgtcctccagggctgagtccagtgaacctgggtttaaatctgagagctgccacttattagctgtgatgacttagacaatccaccaacctagctcctctgagcctatagtccctggctagtgaaatgcagacaaaaattacaagttttgatcattggttgaatttcatgattaggtaccagctttatgctaggaagtggattcaccatagtggacaaagcaggcaaggccccctccctttaggaaacttacattctcgaggagaggcaggcattattcaaataaccacaccaattattatgtcttaaatagtatcccacacactagctatcagtacctgagcatcagtgatgctgtggttaccgtcttctttatgagggtcccatgtgattacagcctctttcctcacataatttcctgttgtctttccagacccatttatacacatgaacccatgtgtataaagcagagacccttttctctaactattcctttcagcccgggttaggtctggcacagccattaattagtaatggctttcccatgaagtggttgtctttgtaggctctgagcaagcatgtccatgctaccataatgtaccagaatgtgtgcccctaacagtcctgaggcaaagatcaggaaattctgtttttattctcttcagagctaagatacaattaaaaatgttaccacagtaattggcaacatccattaacttgatgagaattgccagaggcagcacatttttcccctcttctgcacattattagcctataaatatacctggttcctttctctttcttctctagaatttctacaaaatacccacccaagctgtctccttaatgccctttgccttttaaaattaactctctcagttcctccagtacttccagtccataccacacaatcttgcatctaattacatgtgctgatgtacggggaagcagctggggaaagcccacagcactgagagctctgggctcagagtcagcagagtctggtgggaaccccagctccacctggttatcttgagtgactttggcttggggtttgatcatctgcaaaatgggaacaatacctgctagaaataaaacagtgagattacaggaggatgatgggaaggtgctttgtaaactcttgcatgtggggccctccagatcattggtccccagcagtaactttgtcttcctgctccctccttggtcttttggtccccatagaggtgcagggcagatgggatttggtggcacaagactgttgagaaaagccctcttcagctgcagctgcaccctgccagtggctagcaacacctcagggacctttccagcaggaggttcctctcccttctgatgcactcacttgattagaaagatatcccacccctgcctcaaagaagtagggcagagcaggatggaacaggggcttaagaacagtcagtgcaaaggaagagctcatgtacctccatcctccacagccatagagcctctcaatgccagagagcagagggggaggggatcccggcatcacccaccccacacctgtgatttgcagagagaggaaccgtgcccagaggggtcaagtgacgtagccaaagccacagtgctagactgtgaccagaactaaggtctttgccccagcccagtgctctttcttctacactccaatgcaagttttccttagacacttttgaaaggttgttgttgaaccatgtaaagatgccgggattcttggcctccagaggagaagaattcaatctggggcgagagacgaggcttgatcgctcagagcttttgtgtaataaagttttattaaagtataaaggagatagagaaagcttctgacatagacatcagaagggggcagaaagagtacccccttgctagtgttagcaatggagttatatactctccaatgaatccaaagaatgtctggaggttgtaaagacctcaccagacctactcccataatttaaattttaagataacaggattagccagaaggtttaatccagagactatcttcaggcaggatacattattgttatacaatcctaaggaatgtcgaggaaagaaaagtttgtcctttcttcctctttgagaattccagacccctctctccttggggacccctagacttcttatcaacctgcctaggaaatgactttctcactttctacacaatcagtggtattcagatcagtgtatgtctgtgtgcacatctttgtgtgtgtctgaatgtaagatgccaggaaccattgggaatattctctaaatatgtgcacatgctatttcatgttcatcaagacaaaacaaggaagttttgactcttatggaaaattatagatttagagaggttaagtaacttgctcaaagtcacacagctaatagaaatagagccaggattagaacctagggctgatgattccaaagctcctaaccactggacatagaagagacaagttcttgtcctaaaaacagactatgggttgaaaataatacctagtgtgatcgggcaaccccaataaacactgactgtgtcatcccagactccagtttaggaaatgtggggcagtgagacttctttttttaataagataatgtgatttttctcattaaaaaaaattatttacttttaattgaaggataattcctttacaatattgtattggtttctgccttacatcatcatgtatcagcca

SEQ ID NO: 45602 - DNA, 1578 bp, Bovine  19866880638988
gaatagaaaaattcatttaaaatttcagcatcttaactcaacttttagtgtcttgttttatttgtcatgtgtacacatttttatttttatagaattgtagccaaggaaatgtaaagaactagatcagaatacagctctcattaagcatttttccatgttgtctcactgtgctaattatcatctttatggtagcataaacattatttacttaactttttaaaatatttaatattttcccatttatttgatattataagtaatgttatgagtgtttctttctccaaatggcttttcctatattttggattatttctttaggacaaacactccaagttacagtttctgaatgaagggtctgaatatgtttatgactttacagtaagccttttgaaaaataaattggcaacatgtatcaatttttagtgctgccagcaacagttgaggaaacctcttaattgaagctgcaccaatattagctattttaacttaataaaaaatcctgctttagtaagtgaaaacaagaactgctttgctctttttttaatttgcattttcccgtgtttgtttataacttcttattcttcatttgcagccagtctgttcatgttttagccagaagctttagtcttcttagtgtagaaaaaatggaaaatgtgggaggagcttttgccaatgttgccagcaaacaatactttgcagatcattcatagtagtatttcagtttcatgaaaggtgtatgtaagagcagaggaggtagagaaactaattctctgcttagcagttctagggaaagcaaaaggaaagcctgaatgtatattggaaactgtgccttaaatgctgtattaaatatgcatagtcaatatccgtgttattgacttggggaaggctggatcctccaggaccccactcttcagtcaaaatgtctttgcaggtaaccagtgtcccggaagaccagatcctcgttgccgtgttccctggcctccccacttctgcagagctgttcatccttccccccaagaacttgacagagaggaggaaaggcaatgaaggggacctggaacaagtaagtgaaagaaaccttggctaggacactcttctgcaccaccctctaagggaacacaaagcatttctagcccaaaaggtagactgaaccctttcctatttgtccatcaacctgtcactcattgtctggcaccagggctttggaagcaatcagctttacccagaataaacacaaatgcacaaacactggcacatttagccacacaagaaagaaaagcgctcctgaaatcattcattccaagagttgccattcttgcaacttgctcatgtctcccagctaatgagttgtcctggcaaaaagggatggagtggggggaggggagggttgtgggggatgaagagaaggatttgagtttccctgtctatttctcaaaaatgtgcttcctgtcttgaaagaggctggtcaacagaagttctgcttctaggaagaaaatgaactgcttttaaacgtgtgtctttggagagagatggattccctcatcttgctttgactaaggaagcagcattccccaaagg

SEQ ID NO: 45603 - DNA, 1030 bp, Bovine  19866880644405
aatatcctctattaggtggtaatgtatcctcaaacccaataagtgacaagcacattcagtttagaagttgagaaagaggggacaagggaaagagtcttagtgaagttcagccctagaggaaagaaaggatgattcagcttgtcatggatgagaagagggatgcagtatgccaagttaatgagtaacatgagccaaaaggcacaattagatacccacagctagactggaaagctcttgtgatgaaatagtcaacaatgagaaggaaatacgggtattagtcaccttggggctgattttcagcatcagaataagagaaattcaactgaaagtcagtgaaagtaatttgtggttgtggctaaggacttggccttcagtaccagctctccccagctcaccctcctcctcacgctttccgtccatttagacaaggctgatagacacagcctgaacttgcctttaggagaatgtcaaggcagctcatttactcttggcccttccaccaagcccaccagctttgcagcggccttacaccactgggggtgccctcagggcactgcctgcatcccagcgctgtcctgaatgcttccacttggcctcaaactcaccttcctaaggctcttgttggctaactggataaaattactgagcattaatggttagcaatgaattaaaaaatgagcactaaaccttccacacatttagacattagatgtcaggtttgattctggtcattggaagtagttcctttgcacaaatccaaagaggcgatcctaatagtgagaaatgccaggcagggcaggagaaataagagaatgtactgacttgtttacctgcaggtgatcacaactggcagtctgctcatgctgcccctcagctgggaaatctttctcatagcctcctgtgagaggcttgcctccctattaaaaacactactctctttccacagtcaactgaaatgtcaccaccccagaaatgccttccccaccaccccctttataattgcaatgcctaataataattgactgcttgt

SEQ ID NO: 45604 - DNA, 2201 bp, Bovine  19866880678563
agcaccaaagaatagatgcttttcaactatggtgttggagaagaattcttaagagtcccttggactgtaaggagatcaaacccagtcaatcctaaaggaattcagtcctgaatattcattggaaggactgatgctgaagctgaagctccaatattttagccacctgatgtgaagaattgactaattataaaagaccctgatgctgggaaagattgaaggtaggaagagaaggggacaacagaagatgagatggttggatggcatcactgacttgatggacatgagtttgagcaagcttcaggagttggtgatggacagggaggcctggcatgctgcagtcatggggttgcaaagagttggacatgacagcgactgaactgaactgaactgaagaactgtagccattctgataccaagaatatttagaagttcactttccaaagcaagaattgttgcaaaaaccatagtattaaacatccattgcatttcttctaactgccaggaacagcataaatgctatatgcaatccaagggaaataaaatactcaatgccttcaaggaccaaacggtcttacaaagtaattaacctgcttaaccagtgaagcaaagcagaatgggatgcatttgagaagaagaactaaccacatgccacaggaagatgagactataaataacatcaagctacactggataaataggcagccccaggagtgtgagtatggaggttccatcacacattctctttttcccactgagccatattgcccagataactctaacaggacaggcccatgatgttttaggataactcagactttctggatccctgagtttcgaattcacatcagaaccagtccccatacatgagctttttttttacagggaatgtagacactagtccaggcttccctctatacttatgcctctgatctatttccctcccttcttttttatttgattctcaaacagaaatataacactctggcctcaacaaaatattttcatcattggttgtattatggaaacaaggtgtgaaaaatataaatatctgttctgaccacagccaccaaaagactcccaattcaaaaagatcttcagttttcccagagttttagagaactctggatgatccatcagttatcaacagaagagttcatgtgttatgaataaagacagaaggcctaaggagacactctggagtctgtgcgtctgtggttgctccagcctcagaccctctcagaccagcatgggcacccccctcgaagtcctcctgcattacccaagcatagcagccagaattcagaggcttagccaccaacattcccatgctccaagttgaaagccaaaggagtagctttagaagtcagtccctgaggacctgagtttcttaatgaagcgccttcatcagaaagaatgttcatgaaatggtcactctgcacattgaggatcaccgctgggctcccatcaagccagcgatctcttctggagcgggtttagacccttaagcccctctgagcctcacttaagtcaccggaaaaatggagatatctttccttttctcctttgcctttcacttttcttttcacagctatttgtaaggcctcctcagacagccattttgcttttttgcatttctttctcttggggatggtcttgatccctgcctcctgtacaatgtcacaaaccctcccatccatagtttttcaggcactctatcagatctaatcccttgaatctatttctcacttccattgtataatcataaaggatcttatttaggtcacacctgaatggtatagtggcttttccctactttcttcaatttaaatctgaatttggcaaatgagttcatgatctgagccacagtcagctcctggtcttgtttttgctgactgtatagagcttctccatctttggctgcaaagaatataatcaatctgattttggtattgaccatctgatgatgtccatgtgtagggccatgaaattaaaagacacttgcccctttgaagaaaagttataaccaacctagacagcatatttaaaagcagagacaattactttgccaacaaaggtctatctagtcaaagctatggtttttccagtagtcatgtatagatgtgagaggtgggactataaagaaagctgagcaccaaagaattgatgctttgaactgcggtgtggagaagactcttagagtt

SEQ ID NO: 45605 - DNA, 768 bp, Bovine  19866880683199
gcatggcctttctctaacttccccgttgacacaaaagaattgttttaggtaaaatatctaagaagtcatctcttgacaattgggatattttagtgtcttaattattcaaattaatgattactgattattttctggagcaatggttgctgaaaaacgtggcaattcccagacagcctctctttttctcactattattaatatcttgtgttagtgtggtacattggttataattaactaaagctcattgtttttactctttgtgtacatcctatgagttttgacaaatgtagaaggaatgatatatatccactggtggcacacaatagtttcaactgcccttaaaaattctccacgctctactctttcatccttcctctctccctagtccttggaaaccactgattttttattgtctccatagctttgccttttccagaatttcatatatttggaattatacattatgatttgtagcttatacaaattggcttatacatattggaaaacataaatgtctcccaactttctcttaactgtaagctctgaaccagactggggacaccgtgaaaaactaatcaaacaaaagcctagtgcttcctaacattattaagggcaaattcacaaagatgcattttatattatccagtgtgtttatagatatgtcaagtgagtcaactgaaattatcccatctcagggaacattattacaattaccagttattagaattattcattattaaaatgagaatgtgtcagagttcaggtggg

SEQ ID NO: 45606 - DNA, 1147 bp, Bovine  19866880692411
ctttcactttcatgcactggagaaggaaatggcaactcactccagtgttcttgcctggagaatcccagggatgggggagcctggtgggctgccgtctatggggtcgcacagagtcggacacgactgaagcaacttagcagcagcagcagcatagtctcaaaagtcttacaggtagatgtgttaaaaaatgaagagcaatttgaaaaaaaaatttaaatgctgccaaattgtgacataaaattcattctcttccaaccatctattaaaaatattgaaaaaagtgtgttttcagagatgcaaataaggtgaacaatctttataagggcaagtatatccaaattcttacaggtatcaatcattaaaaaagcaggaagggggagacagtgatctctggctgaagctctgaagtacccagacttgtgtgatcaggagtggtttgactgccccagcacctaataaatattacagttgatcccaacattcatgagtaatatgtacttttatgattagaagaaatctaaatcattaggctgcctttctatttagataagaagaaagtaagggctagcatgaaattttaattactcacatttagagagcctgtggcctgctgcctcacacataatctattcatttaaggttcttgtaaattatattaagctagattagaccagtaggagtcaagggacacctcccttaatgtatggaaagcagccattaaaaacatgaaaattggatgtcaatggaaggtagaaactgtccgtgtttcaaacatgttttgagggctttccaaattagctacgggagacctcattaaatgcccacattctacctggttgtggggttgaagcagggaagggaatgtagatgcttaaaaatacagctggttggcactagggcagcagagtgattctgcttcacactttcacagaatgttctgtattgggatgggtgtcatatgtcttgagttttaataacatctatgccagtaattaacttcatgaaatgtctgaacttcagaccaatttccccaccatttaatgaggtaagacaggactcttctacctataaaattctaagatagaagtgtggtctttttgtttgagggcataataaatgaaaatagagcattagcttgaggtcatta

SEQ ID NO: 45607 - DNA, 1287 bp, Bovine  19866880707779
tctttcatttagcaaacagagaagaaagggtgtcaggaagcttagggcaatgtctaatcctgtccgactccaagccatcagcttggtcataaaatagagcaatagaattttaaagccaagaaatcaaattattgtttcagaggcccaggtgaaaattctgagctagaaagggatttcagttttgcagaagggacgctatactctgaatgctgcatctctgagcctctgcagcatccaggtgcacagatgtgctgtgtgaactctggctgatatccacattcttaaaaggcaagtctatgcatcctcacaactggtgacatcactgctctatcctattgtcatcctaacccacagagaggagatggggtctgctcatctgcacttgtgacatctattcatgagctgccttagaaaagccttaccttgcaaacaccagatagcttcagaggacgtgggcctcaagataaccactgaataatgacactttaatctcagaatctgcattctcttctctccaataaacccttgcttctactgagatcctaatttctaagggaaagcatgtgcttattatctttctctatctatcttttgcaagtcctatctgttatgatcaggggaagacagaaaaataaaaaaagattaaaaagtgagcacagatatgcatgtttctctgtttcccagcttatttaaattgttagaaatgccttgcaatgaaacacacagatcaataatacgactgtatatacaacttatatatggattctgctagatgtaagacaacatgccaaaggcaggtaggtgattcagaaagaaataaaatatggtcacttctctgagaaatcttgcagcccaatggaatacatgatgaaaatataagtcgcacaaaatattagaggaaaagagaaagtgatcagctattcccagagtcactaggaatagattataaaaggtgcttctactttgccccaggagaagtaacagaatgatggacaaaatccatggtgcccagtcttatcttcatctcttagaattagcattttacagtgtatttcaagtatattaatatgcttcctggatactagctatataatttagaaagctgtgcaatttttttcttccttcttcaagttaggatcccttggggatatgcaaatgctatgcagattggtgacagtctgagatttacaggaaaggagggaatctaatattcccataaaggactaagtaagtgtttcggcttctctcttttagcccctcatcacctggacagcagcatttccttca

SEQ ID NO: 45608 - DNA, 2249 bp, Bovine  19866880722814
gtgtctgacttttagcgaccccatggactgcagcctaccggctcctccatccatgggattttccaggcaagagtactggagtggggtgccattggggttgaccccactttaaatattaaaattcacacgttacaatgggtcctatccattcacaaaggattcaggatagacttgttaaaagcaggataaattctaaaagcctgtttttaggaagccacttaaatttaaaacaagaagagggggctataagacagagttccaccaaacagctgtgcagcaggtggatacaagtgtttcatcctcagggtcacctgccgttctttaaagacacttatctctacactcttaccatttccactcccttcaggagaaatttaaatagggttgaatctgagattaaagagaaagagaaggctattgataagtcctagttcacccctgtagccattacaagatcatttcccactgtgcagggcttttctctgctggagcatttcatgagtccctcctcccccaaccctgaggaagggaagtggcatctttctcctccccttaaaacacacatctgtacagtggcaaaaacggctcccaggaggcagatctaccgggaggtgaaagtgaaagtgttagtcgctcagttgtgtcctactttttgtgactccatggattgtagtccgccaggctcttctgcccatggaatcctctaggcaagaatcctggagtggatatctattcccttctccaggggatcctcctgacccagagattgaacccaggtctcctgcactataggtggattctttaccacctgagccacccagcaagccccaaccaggaggcagaccaagctaatcttcaggacctcttatcacctaataatcacccccattttcaagcacacaccttgtcaaacatttcacattcaccaaacccccacattggtgtgcaaaataaggattataattcagctaaataaaagagacaactaggtttcagaaaagaaactgcccaaagtcacagagctggtcagtgatggagctaagaatcaaggtgaggtccatctacctaagcatgactctgccacctaaaacaccccagcttctgtctccccgtaagtcatctaatttattcattccatcctactggaataaaaaagcccgagactgtactaagaacttaatgggaaacaagaacctcaaggtgccaaaaaagatcagtggattaggaatcagctagacagacattagtatgggttcctccactatcttggtgaatttaaacactctgcagtttctatttggagaaggaaatggcaacccactccagtgttcttgcctggagaatcccagggacgggggagcctggtgggctgccgtctatggggtcacacagagtcggacacgactgaagtaacttagcagcagcagtttctcttagccatatttttcatacctggaaaaggacatggttatatcattaagtgttctttctagctttaaaatatgacctctgaactatttatattcttagagaatcttggagaggaccatgtttaacccaaaggaatgactcgaattgtcaagtttctgcccccatcaaaaaaaaaatcattgagcacagaatcctttcttctgcctcccaaagtcacatcacaagtatgagcaactttttttatgatttggtagccacagaactctctcacacatgtctggaagtgtatagtttataatgccctttcaaacatatgatttcattttgatccctccaactattacacagatgagaaaatgagtctgatgttgactgatttggaccatttcataaagctggtagaagatgatatggagactggctttccagttccagtttagtcacaagcaaaagggatgctcctgagggtaccctgtacttggatccagagtcctcttgcagcctgagcctgttcacacaaccactaagctatgaccatcatcatccccattaatctcttttgaggccataatagacactaagtaatagttgttgaaataactaataaaggatgctagtaccacctaaaaatctgccaactccatctccaggtcagatcagctctgtttaaaggcatgtgcacattaacactcacatgtacacacgcatgacctccccacaattttctctccttacctctactcctgaaaaggcccactgagaagtattttatcccagacatgattctttcagtatccctcagtccaaactgtgaagag

SEQ ID NO: 45609 - DNA, 1988 bp, Bovine  19866880728281
ttaagttagcctttggatctttccttttcaggattttattattacatctggtttagacaagtgccatagtcttttaacaggtcatctcctgtgaaatcatcccctaccctattcatttcccacctctagagaccatcctctgtattaccacaagattgggtgtctgaaatataaagccactaatcccatcatgataaaacctgagactgtgagccaggtggcagagcagttctgagttcccttaccctactgctctccacccaggcaccacttcccaataaaatctcttgctttgttagcaaaataaataaagtatttttttaacctaaataataaagaaagaacacatttcacacttctcagaacctacaggaagtatgtcaaaaccccttttagctgctcagacctttcacaaagtgatcaatccatcccagcataacatcagtcacacctgcccttataacttatagattggctaaaataaactgtcatttatcaaatatgctgtacttaccatagaccatggctttgcacacgccttcattgtacctgagagacatcatcctgtctctgttaactaccgtttatcctttaaaacagagttcaagtattccctccaaagactattccattagttcacaagaatttactgaatcacaaatatgtgtcaagcctgaacttttctagatagaatgaattgcacttttctccatgctcctttgaaatgctggccatgcctctctcatagaactagttgcacattagacttaaatttgaattgaccgtgttttatccatcattatactctagtgcctaggtctgagcaaatggttaacaaaaccatttcaacttgctctaaggaaaatatgctgttgtcgttcagttgccaagtcatgtctgactctttgtgacaccacagactgcagaatgccaggcttggtgctatcaccctagagtctgctggcatgctctaattcctagcttgtcaccttctgactgcgacatatggtcaatggaaatcttgaagtctgattgtctggttaaaaacaacaacaaaagggaggggatatatgtatacctatggctgattcatattgaggtttgacagaaaacaacaaaggtctgtaaagcaattatccttcaattaaaaaacaaataaattttttaaaaagcagcaacaaaaacaacaaacaaacaaaagctctctaaactttggtgggccaaacgagtgagtgacattagtatatacttaagcagtggtccatcaatcattttattaaagggctcaatctcctgtcttagaaaaatgcaggagaaagatggtgccaatttcccatcctcaaacatggattaattgtctttatctctctcttctgaatctctccatctttcttttccatccttcattttctctacccttctctctctttttacagagcaataatctttatttaactgtagaatggtggtctgaatcatgaaaatgcctctgggaccacaccatctggttctttattcaagaagatttaagcaaagataaagtcaacttactttcaccagagcccgcttgatcacattggcaatatcttgcctccactctggaatgtcaggattgtggtaatccagattaggagagaaagataagagctgggactggaagtattctgcaaggagagagcatgtgtgagtgaggctgagagaggctgcgataaggtggggagactccaccatctttgtgctttaggaaaagggcttccatgtggcctcatctctaattctgtcttttcagcctgtctcttggcttctaaatgaagtgggatttggtgactggaagtcacctactggaagtaggtttgtgctcctaccactttttttttttttaatcttaagaatttcttcttgtaaataaacatccaaaatgcaagatgattgtgaaacttgaggaaaaggagacttttgctgctacaggtagtcatgcagaggcaaca

SEQ ID NO: 45610 - DNA, 1610 bp, Bovine  19866880731590
ctgccccttgtgtttgtttcgctcctcattagcacagctcttttgacctttatcatccagctcaacccaacttccttgagttcctaatgtttgttaagtgacttaatgagcaaatgagtttatttcctctcgtaattcgtcctgtcttgggctgtactgccactagctgttagggttacagctacacacagtatgtaccgtggggtccaaagtaccaagtaaagtcaaagaaacatttccttatgcttctaaaatgaaactcttgaagagtagagttttaaaattttaccaatagtatatatcagtattataaagtaagctttacacaaattcaatgcctttaactgctaagattcatagccattttccttttttgttcctatataacttccaagacaagcttactttctttttctcaaatacttgctttggcttcattgaaataagttattactagttatcagcaaatttttgagaaatagatgcagtacaggcagtctagtttcttttttctttttttaattcatgtgtgaataatctaggacgaaagcttttagattcgtagacagaatagctgtctcctcccttggcactgtgaagggtgaggactactggaaaaagcacccctgctgaccttgaaaaaacctcagaggatgcatccacgctccttgaagactgcgaggacaaatatactgggaaagaacgaggctttcctaactactctccctcacttctcaccaagtactgatgggctacataacaggcaatgaaatcatttctcccctggtgcagagaaattaaactgcttcttttatgcaggtataaagaagtttcatgcccatgattttaattagaagataagaccaacatcataaatgaactttattttatataccatgagttacaataagggttaccatcaaatatctagtgcaatgtactctcttcctctagccctgtttcttcctgtacacacactccatactttcatacacaaagcacattaatctgcacacaacacaaacattacatgtatgtgtacacacatatgcttacacgtacacctctgtggcacatttatgcatacacatgtacagaaaagcaattatatataaggtgcactgacattgtgagctggttttaggggaccctttttggcaagagtacatttttattgcaatctttctctgaaatccttttatatactttgatatcactggcagtgtctatattaaatctagtgtctgagaagaatggaaggagggatgtagaaacctatatgttttagatttctgacctacgctgggtactttgcaggatattttatcgaaacctcaaacaaattatgtgatgggtcattatttgtgttttacaggtaaggaaacaggctcagaggaggaaagtaacttgcctattaccctctctaacagactcaaatgtcaccaccttgagtcacatacgcacatactaatgctaatactttgctacacccggaaaagcactttgtcatctttaccaagggacaagggggaagtcagagaagcagctttttagtctttttttaagcatctttaagaaactggttcactggtaaagaatccgcctgcaat

SEQ ID NO: 45611 - DNA, 822 bp, Bovine  19866880745703
cccaggaacaaatcccattctaatcgtctcaagcctcctcttcctatttcttgaaaattaacattgccaccaggtttaattaacaagcagaggctccttcatgcctaaacaccatgcttgaatgctctctttttagaggatggtgtgcaggtgcttgctttatatagctttatgaagcatgtgttataaaaccacctcaaccatatggcttttctataccatggcagtccattcatttcaatcccataaaatcctagcaatatttaagtgttaaaggtgactttcactatgatatttattattggataatgaaaaatgggacagatagccttcaaacctccaggcaatggactgaaccacgtctcttctaagcttttaataacaggactactatatttcctggaaatgacacaaattcccagagtcccctttgagattctcttttggcagcatgaattttcttaacagttctttttatttttactttagtggagaccaaatctcgtatcagtcagaggaaaatcagttagttgaatatttgaatctgctttctccatcagactggacgtttttagcatagccctgcccttcgcatttggccaagaattccctatgactcgtgactccccttgctgtagatacccctatagaactcaacatagagaactgtcagaacacagcgggaattaacttatgtcgtggttcccacctctggaccctcttgaatcctatgtcctgttgctattatatgcgttagcttgcttatggtcatccattactctgtatgtttgtgtctttagcagactgcgacatctctgagaa

SEQ ID NO: 45612 - DNA, 879 bp, Bovine  19866880746937
cactccagtattctgtcctggagaattcaatggactgtatagtccatggggctgcaaagagtcacgactgagtgactctcaactcatctgtcagagatgcaatccccaaactgcccccccctcataactctatgtcttcccccactaaagagcctacattttcggctttctaaacatcaccccatttacagaactggaaagaaattagcatcaactgtggagcaataagctgctttctacatttagtttctggactagaaatgagcaggaattagccagcttctctcctcattaataggcaacagttgccatccctgctaatttacaacatgttaacacaacttgagctactccctggctgtcgtgactagcttaaggtgacatcaaagggaaacacataatatttggtgtcactgtgtgtattcatttaggctggagaggcaaggatgtggggatgcaaacttgaatttgatcagaatagagtaagcacagctctcaactcagttccaaggtggaaagcaagaggactttcagcctttgttcctgccccatggtttaatgcagaccctaaggatcctggacatctagactaggaagggccaatttaagtcaaaggggagaaaaagatatagttgagagcagtgaacttcaagcttgaatatgttcatggatcaccaaagattgtattaaaatacacattctggtccagtgggtgtagtgatgggtatgagattctgtacttctaacaagctcctaacttaagccaatgcatccaggtctaacagatcataccttgactaatatggacttagaggaagtaaggactctgagatacaactggtgtagtcttgtggtgcttaggcttcagtgtgcatcagt

SEQ ID NO: 45613 - DNA, 1423 bp, Bovine  19866880775552
cacattgaagatttttagagggtgatgctgttttgcacctggatatgcattctgtgatttggagataaagctcaatttaattggtctctagggatcattagactttaactttcttcactggagattctcatagaaactgagattgtgtaccatatggccagttaacaaagagactataatttttgtggactctagatgcccttgagtaatacagctggaaaaaaacagcatgcttttacattcaattgcatttaaattaacacacttttgtgaagtgtattttgtttgatgaggctggtgcataagaccatctactggaaagatgtaagtgactctaatagagttgtgatcatggtctaatttgtgttagaggtataattcctgtatgttatagaattactgtaagagtaaagctaattctaatttgatgaatctggggagtctggcagatgcgtaggtttaaatgatgaattattagagcatgggagtaaggcatgcctgagtcccagcatgagaagagaaccagagtctgatgagtagaggtccattttattagaatatgagatgaccttggaaaataatggggataaaaatttaaagatgctaggaaagagcttgactaaagagttggacatttattctccaggctactgtatctctgttttctctttacatctagcaaataaatatatgcacgatttagtccctgtgcgaagttaattcaaagatatacattctagtgtaacagggtatcacatctgtttttccttgtctaagatacgtatagttaacacagatgtgaagtggcctgagctgactgtggccacttgaagctactggtgtatcattctgtcttctacgtgaacctcttcttgacattggaaagggaacaaagaaagtaagaatttatttgagaaattaaccttctagtctttggcactaagagaccttggagatcaatggggatcaatctcacccaactccgtaaaatctaaagggaaatattgtttatttcctggtctgttggaacagtttactgctaaagagggactcttgtccactccctgcctcagagtgcagtattgttatggctgtaattatacaatcaggggagaaaatacttcttgaaggccaaataataatctcttctttaagataacagagcccattccatccaaggtcaatgttgacaatgaatgtagttcattaggtgtgctcaccattactcttacaacactcttttcatggagagttctgttgttgctttctcatatctctaaatataaactacatttcttcttagctgttctccactgataaatccggtaacaaatattatttccaacagtctcaattgtattatggaaacatgctttgagctgctgcattttcttcagtattttccaacttgtaaatctgtaca

SEQ ID NO: 45614 - DNA, 2476 bp, Bovine  19866880799095
taccttgcctgatatatcttgcttctatgtgaatgcaatgacactatgtagttttttcccctcaacaagaccaacttcagcaagataaaaaaaaaaaaaaaatcacatgtatcttggcacatttttcattttgattcatactccagagcagaatgtctcattgttctaaatgaccaaggaatttcaggaacattttttttttttaaggaaaaggaacagcacagtggcaaaatgcactccataccatatcagcagagtctgagaaacagggatttctcaactaaaggtcatctgcagcaacgtctacctctcttaatgggctctgaccacaggagcatgaataatcctcttacctctataggcttacttgtgcaaacaggaatggcctccatcctaggaacattcatcgaaaccttcccacagatgcgacttactgcacaataacaaagatatagttctgcctcctggtgtgatgagaggcatgaaaatgtaagcttctcaaagccatttacactctttagtcatctctactggtctttacaactttgggaagaaatctaggtcatttcccaagctggaatcttgttgctaagtgaattatttcagcaccagtctacttcctagaaaatcagggtatttcttccctgacattcctgtctctccttctttttatatacttccattcaccccatgcctttttgcaatcctccttctaccttgtaaaataattgggatcttatatatttccatcactgttagtaaatgagcaaccaacttagataccagagtaggggatactggaactttgacatgagaagctcagaagagaccactgtaaagcagaagtccatgtacccatctctctgttttgacagccactcccactgttcaaaggggaaaactcacatggaagtagcttctgcaagaggcaacggtgaatgaatgacctccaccagcacagtatttatgggtctgaccacaagttactggtaaatgtgggagataatgagacacacctactttgctaaaatcaatccatctagttgaagtagtcagtcaagtactttcactgagaaagatcacatacatgttactagagatatagacatacaatatatcattagggttactgaaacaattaggttgctttcttaatatagtctctaaatggggtcacttggtttcctagataaattattatttaactggtgtgtgtgtatatatgtatatctatagatagatagatagatagatataaactcaacgaaggttatcgtatttaaaaataagaaaatttcaatgttaagtcaaggctggttctttcccacacataggtgttggcatctggcggcattttagaggaaccttcactcttaccactgatatttgctttcttctcttataaagttgctcataaaacatgattttccaaataatttaaagcatatagacagtactaaaccctccacctagacttcatagaaagaagcacagatttgaaaagggtacttaagagatcacttgacgtcacgtaccttcacttctggcctgcaatcatgctatatttaagacatcgactcgagctaccatttgttgaaggcttattgagtcaactaccacacaaggtgctttacaaacattatccctctttctcacaataattttattagatagatgttttatccccattttacaggtgagggaattgaggcacagagaagttaagtcccctgccccaaatcacaactgctaagcgcacagctgatatctgaactcaggactttatgactccaatgcttgtgttcatattgttagaactcatgaaaaagagaggcagattcaagtgcaggataatgttggctacatacctcatacaattcaataatgatgtttcccatcagacctcggctgctcttgatgttctccatggccagggtgaagtagatcccacgtgtgtctgagatgtagaggttgtacgtgtcattctggttccattcctggacggctgcaaacacttggttctcattggtactaatgatgtgcatgtcctgtaagaagatggaaagcccataaggcagcagatctccgtatctccttgcccactgggacccagagtaattaccatgacttatgaaatggctgaggaaaagcttgagttataggcaatgttaaacaattctgtgttgggccaaggctataaattatgagcttcatgatttctgctccttgctaagtgacagtaagatgggtgtaaggggctttggtgggtatcattttccatggcttcaagggatttatccactttcattttttatttttataactgaaaattggtgttagcactaacagagacatacaaccttgcgtgaggaaacccacacatgaaaaaaagacagggcttctcccttcactcaatcttaatttatggtttcaacatttctaggatagtggttttcatgcctttcttgggaatctt

SEQ ID NO: 45615 - DNA, 1497 bp, Bovine  19866880852335
tgggcatatatcctgagaaacccataattgaaaaggacagatgtaccccggtgttcattgcagcagtatttataatagccaggacatggaagcaacctagatgtccatagacagatgactagataaagaagttgtggtacatatatacgatggaatattactcagccaccattagaagaacaaatgtgaatgagttgaactgaagtagatgaacctagagcttgttaaacagagtgaagtaactcaaaaggaggaaaaaaaaatctatattaacgcatatgtacataatctagtaaaatagtagtgatgaacctatttgaagggaagaatagagacacagacatagagaatggacttgtgaacacagcaggggacggagacggggggccaaattgaaagggtagcatgaaatatatgcattactatgtgtaaaatagatagctggtaggcagtggttatacaacacagggagctcagcctggtcctctgtgatgaccgagaggggtgggatggcaggatggtggtttgggagggaggctcaagagggtggtgatatgtgtgtacttatggctgcttcacatagctgtacggcagaaatcaacacaagactataagcaattatcctccaattaaaaataaaaattaaaaaaaaaatcaactgtacagctctacaacaaataaggtgatgataagcagcagcttgtttaggttatacggttctcttgtcccctccaatcagaattccattaacacaaccagaaagaactttcgaatatcacatgttttccccattccaatatcccttcagaggctctccatggcctgcagataatgcacaaattccttactgggatcctgcctctctgaacacctcaggcctcctcctccacatccactcattccactaaataggccctgaagattttgtcttcctctggattccgccgcctttggggtttgccccaggcttggtggctggaaggttagcctgtcattaggaattagaagagtgaacaaccttgaccctctgctagtacactggcctaaggaagcctactttggcagtgcagcttgatcaaggtggtcagccctctattatttttttttaaatcatggtaatatagaatataccttcaaaatatcatatatgcacaaatttgtagcaattgggggaaaattctcatatttgcttgacagacacacagcacctctcaggaaagaaaagcaaatgtgcaacaagctgtgaaatggaaggcaacactgcctcagaagagctcattttaagttggttttaaaagacgttttgtcatgcatctgaagaacttcagtgggtaccgggaatgggtttatccgtatggcttggaatgaatctccattgctcccctaaagataacccttctgagaattggaaagggcaaaagaaaaaattccctctttctctacaggaggttgtgcatgtaatcaggacttcaatgacatatctcctccaaaaattcc

SEQ ID NO: 45616 - DNA, 2924 bp, Bovine  19866880867369
tgtatggatgtgagagttggactataaagaaagctgagtgctgaagaattgatgcttttgaactgtagtattggagaagaccctttagagtcccttggacagcaaggagatccaaccagttcatcccaaaggaaatcagtcctgaatattcactggaagaactgatgttgaagctgaaactctggccacctgatgcgaagaactgactcatttgaaaagatcctgatgctgggaaagattgaaggcaggaggagaaggggacgagagaggatgagatggttggatggcatcaccaactcaatggacatgagtttgagtaaactccaggagttggtgatggacagggaggcctgacgtgctgcagtccatggggtcgcaaagagtttggacacgactgagcaactgaactgaactgaactgaatcactgacaactcccatattgatatttttagcctggactctctgccctgaactccagactcattaatccagctatttgactcatccacttgaattctcttaggcatctcaaacttaatgtccaaaactaaacatctcaacttaccttccaacctccttctgctgtagtcttcatctcataaaatggcacctctatgcttccagttacttagtcccaaatctgaaggtcattttggactcttctcttttattcacaccccacatccaaattttcaccaaatcttcctggctttaccttcaaagtgtgttcacaccatgtttcttttcctgtccatgcttgcttgggccattttcacctggatggttacaacacagtccaaattcgcattttcccccaccctgcctttcttaacaccacaaccggagccaccctgtgaacactgaagtcctctgacataatcctccagtagctcctcgtctcactcagtaagagccaggatcttcacagtccttcacaagtcccagcaagatctaagcctccccagatctcccggacttcatctccttctgctctcccttgtctctcagctccatcctcattggtcctcttgatgttgattgaatatgaaaggcctcagcatctttgcgtttgttgtctcttacatggcttcatccctcatctcattcaggattttgctcgagtgtcagtttttcatagttttcctgggctccttttattctgctgcagctgcatagccctgaactaccctgcatgttaggacttgctcttctccttttgtttatccgcctgcccctccccacccccaccccttaacactcaccatcatctgactactgtgttacttacctacctgtttgtttatcttccttgccagaatgtaagctctctgagggcagagaagctggtttgttttcctcactgctgaacccatagcccttggccagtgggaaacattccatgcatatttgcttagtgggtgaatgaaaaaattatgagaatcagaaattggatgattcagtggactatcatacatttcagaagattttgtgtttgtttgctgtatgtgggatgagggtgggatcaggggtcatgctgaggttctttttttttttttttttcattttttttctttcttttcttttttttttcatttttttcctttttaaaaaaattttttaactttacaatattgtattggttttgccatatatcaacatgaatccgccacaggtatacacgtgttccccatcctgaaccctcctccctcctccctccccgtaccatccatctgagtcatcccagtgcaccagccccaagcatccagtatcgtgcgtcaaacctgcactgttcaaacacatgtccgctgagtcaatgatgccatccaaccatctcatcctctgtcaccctctttgcctcctgccctcaatctttcccagcatcagctgtggactacaaatactcaatttctgttccctgcagggagtgccccatgaattgggatgaggactccaggatttagacactgctgaaactgaaaaatatactcttgtgtacagtccctgaggagtatgttttagcatccttactacattaccactgtcgatcactttcactaaaggtcatggtccctattttaattggctggaaacaaagaactatcaggtaggggcaggaatgtggtggtgagacataaggggaacttcagggggcatgtatagaacctgatggatttaaagacaccaaggtttcaggaaggtttaatgaactaaagtaattttccttcagagtaaaattttacaggtattaaaggtcctcacttcactgaatgtgctcacgggcgagagcgtcccagtgatttatgaatttgcagattatgcattatcctttcagaggacaggactcccccggggcttcctgccttccttctgaagctgaagctgaagctgagtagaggagcccagagaacacaccacgtctgatttgtagcctcctgtatcacaactggggtctagaatgtgtgggtatttttcagagggagcttagcaactctagtgtctgaatcctccttctcccccatcaaataaggataacttggaagcctcgcctcctgaagaataattatcatactaataactcatatttgcatagtacagcttctaaagcaggtcaactttccttatttgatttgattcaaaaaccctgtgaggttggcaggggaaggagaatcattatccccattttaggaaattggaacagattctgaaaacgtaaataagttgctcaggctcgcccagtagcatatggtgagacttgggtgttgagtgcagccctctagtttgtaagtgctctttccacgctgccaggagagccccatccaggaggcagacggctggacccagtgggtcctggcttcatgaaatatgtgatcttacgaaaggaagagccatttctcttctgatcactttatcaccaagaatctta

SEQ ID NO: 45617 - DNA, 1773 bp, Bovine  19866880896611
ctagagcctggaattcctgctcaccaggtgacacagtcccagtacaggtctaaactaagatgcactcacagcaaatctggctgcttctaatcctgaccatgccccagtgttttaagttgcccccccccccccagttcttttacattagtttagtctaaaataacttagctcattcatttttatgaccaaaacatctggggaaagccaagcatttctattgcatttttaacagggtaagtgaatttaatccgaatttcctgcagctgctatttcccctcctactgggttcctgggctttcattccacaccagcacaacatgacttcatcagatggtttttaagagtaagcctcatttccattttcaagcacctcagcaggaacctgcaattctacaaggtgtgtaaacacaaacgagcagagcaggtgaggtcttagtcaaggtgacctcggaagtccaaggctagaggctgagatttcacagaggatctccaataaaagagatccagaactccttttcttactttccccacctcccagctatccaaatcaaatgagttcgttctttttaaaatcggctcggaggagctctccatggttcgatattatagacatggctgctcctgtttttttgttgaaagcatttctgggaaaggttggtctaataaggtaaaggctagatccaccctacgtgttcacttactgtcacttcccttgcctgtgtccctgtcaccagtgctttctgcatcagtgacaaggatgcctctcttttgcttttccagcgtgctattactccttggcatatgcacttgtatactcatagttattcattttaaaaattactcttgtgttgtcaaatgtttatccaggtcaacatttccttctgacagtataagttatttaggtaatgacttgagtttgtgataatatgtgtacagttcctagccacatatgcaaactgggttttgaaaactattttgaattctgaactattagaaatgattttagaaatgacccagtcatttctaaattcaattagaattaggaattaggaatacaaatcaaaggggcttgagggaccaagaaggtaacgttaatatatatataggcagatgatcggagaaggcaatggcaccccactccagttctcttgcctggaaaatcccatggatggaggagcgtgggaggctgcagtccatggagttgcaaagagttaaacatgactgagcgacttcattttcacttttcactttcatgcattggagaaggaaatggcaacccactccagtgttcttgcctggagaatcccagggacgggggagcctggtgggccaccgtctatggggtcgcacagagttggacacagctggagtgacttagcagcagtagcagtagcaggcagatgataggaatctttgggtgtggaaggctaaggcttcaatgagtactgactccatctaaaatactacacttttaggtatatggtagaggctttggtcaaaccaagggcttccctggtgacagagaggtaaagaaatccacctgccaatgcagcagatgtgggttcaatccctgggtcagaaagatctcctggtgaaggaaatggcagcccactccatatgacagaggagcctggtgggcttcaatccatggagctgtgaaaaagtcatataagacttagtgactgaacaacaacaacaataataatcagaccaaacaattatgattcatattcatttcatgggtcattcatttgcaacttctggcttaacagt

SEQ ID NO: 45618 - DNA, 939 bp, Bovine  19866880899433
taaaagttttatttttatataaattttcaatgaataaatgtgtctctaattagatctgaaaagattgtgaatcaccatgtattatataacctatgctgctgctactgctgctgctaagtcgcttcagttgtgtctgactctgtgcaaccccatagatggcagcccaccaggctcctccgtccctgggattctccaggcaagaaaactggagtgggttgccatttccttctccagtgcatgaaagtggaaagtgaaaatgaagtctcccagtcatgttcgactcttcacaaccccagggactgtagcctaccaggctcctccatccatgggattttccaggcaagagtactggagtgggttgccacgtccttctccaatataacctatactttttgacaaaattaacctaagatggttaccttagcttaagaggttagctaataatgtttaccaaaagatggtgacacagatatctgattttaaactttggcctaacttggcatgtaagtgaaacatttgggagtaaatctgccaatgacatggtgatcatttactgagtttgcagggccatgatcataaaatgggagctctccataaaatgggagttctccatagaatgggagatccaccaatgcatggggagacagaatgctatgggagaggggctggtctggctctgctgccagcaagctgtaaaacctctctgctcctaggttcattatttatttactatttataccttgcctatttccaaaacagattagaggtggctttcaataaaaaccactaatgtatcagaattcttttatgaggttaataacctgagattaaaaaaaaaaaaaagttatagcagcaaatctaagctgagagaatatgttgtaatggagcaaaaatgctgctatgagttccatggctacagagcaaaacaggaaacaagtt

SEQ ID NO: 45619 - DNA, 1673 bp, Bovine  19866880907548
gtgacctgtggtagcaactgagttaaaagaacctatttggacaaaacagaatttcataaaaacactgagaaaaaaggaaggaattgtccagcaattcccttttgggaaaataaaattcctttaagttggtgtttttcaaacaagggcaattttatttcttaggaggcaatctggtactatctggagatgttttcagttgttaaattggggaggtcctattggcatttgatggattgaagtcagtaattttaataacgaagactatggctggcatcaagccagtgccttgagaagtacagagggaccatccaatattcagaaacttggttgcacactaaaaatgctctcaatagttttttttttttttttccatttgattgacattcacaaatactgcttgagatcaataaaactcagggcatcaggaaaggagtcaaaatgaagaaagagaatgggttataaccaggatcagaaaggtcaaaagaaataaagcaaagaacagaaggagatgaagtgaatcaaatgaaaacaaaagaagcagagtcaaatgccttgtttctaagaaagcagaagtatgttctgatatttacatgaggaagaacctctagacgcaagcaacactctttggcatctctttctttcctgggatttagaacaaattgctgcacacctgatgttaacttaacctagaatcttcagtttggaaatcagtagggaactcgattgaacattttaggataacttgtgtgcctacatcagactgatttaaatggaacagcatcataggaaaaattggccctttgccagctgtttcaaacgccaattccatctgaggcttcttctgtaagggaagaattaacattgctttctgacattttccctcatgactgacattcactaggaatttatccacaaccattggtttcattaacattattattgctttaggttggcactctgttctctgcctcatcctgtaaatatcagatggcattttgttccaaagataaaaaattttctttcttgtacacacatttaccacacaggaaccccacatgaggacgtgaacacaacctactgtagatcaagtagatgtcaagagactgtgttcttccaaacccaggcagagggagttagccatgtttgccatgacagtctatactgctcacaaatgttttagaacaggagagaaggaagaaatgccttcatctctgtacactaagtcttcctcaatctgaggacattaagagccctttcatgaatgtcacatctacctgtctctagtctaaattgaaaaacagcatcacacagttaactaaagatgtgtctagagaggctcactatagtgcaatgaaagaaaattagggtaatttcttacctggtatttcagcatatgtgcatatgtgtgcaactgcatgccagtctgaaagcagatacacataaaaaagaatgcatctcactctctttgctcttcacagcagatcctgatttttaggatttatgagctgtcagaatttcaataagtgaaaatgtcatcctacttctaatgatatatttgattaagccatgcagatatgtgatagagattcttcacgggtttattgagatcagtcagtacataaaatgccttctctactggtaaccgatatttattgaatgcctcctatgcatgt

SEQ ID NO: 45620 - DNA, 845 bp, Bovine  19866880916220
aaaagaggttaagtgttacaatcgtatgagactctaaaaagtgaaagtgaggggaacggttttacggtgctctctaaaagaaatctatgatgtctcaatgctgtaagcaagaagaaaagaggcctggggaaaagcatagcttcccaaccaccccagaaaagatgaccataaacctgcaactctttttttgtttttgtttttattaattaatttattttttaattgaaggattaatcgctttacagacttttgttgttttctgtcaaacctcaacatgaatcagcaataggtatacatatatcccctccccttttaaacctccctcccatctctctcaccattccacacctctaggctgatacatagcccctttttgagtttcctgagccatacagcaaattcccattggctatctattttacatatggtaatgtaagtttccatgttactctttccatacatcttgccctctcggcccctctccccatgtccataagtctattttctatgtctgtttttccattgctgtcctgtaaataaaatcttcagtaccatttttctagattctgtatatatgctttagaatatgatattatctttctctttctgacttacttcactctgtataatagattctaggttcatccacctctttagatctgactcaaatatgttcctttttatggctgagtaatattccattgtgtatatgtaccacaacttctttatctatttatctgttgatggacatctagattgcttccatgttctagttattggcaaatagtgctgcagtgaacaatgggatgcatgtgtctttttcaatttggcgtaaactcccaact

SEQ ID NO: 45621 - DNA, 1362 bp, Bovine  19866880989523
atctcatagtctctgtgggtcagtaatcaaggcacagcttctctggttctcctttttaggggctcacagagctcaaccaggctgtcagccagggctgcagcctcatctgagacttgactggggaagggtctgctttcaagctcacacagagtgttggcagaattcagttcagggctttagtttcttgctggctctcagccaaagaccttcaaccctaacacagctgcctgcttttccaaaacgcacaaggcaggaaagtctccagcaagatggttgctacatcctgtgtgaatgctaagtcgcttcagtcatgtccgactctgtgcaaccccatagacggcagcccaccaggctccgtcatccctgggattctccaggcaagaacactggagtgggttgccatttccttctccaatgcatgaaagtgaaaagtgaaagtgaagtcgctcagtcgtgtccgactcttagcgaccccatggactgcagcccaccaggctcctccatccttgggattttccaggcaagagtactggagtgggttgacattgccttctccacctggaaacactaagttaatcaaaatcaaactgcttcccttctccatcagattccccagaacctttatttggctcctctgctttgtgaacgtcacaagacccccttgagaacaaagggtctagtatgcagtatttcccagacttacttgctctctctacagaagtacatggcttcagacttctcaggtaaactcccaggtcccatcccaagcctgtcaaattaagagtttctggaagtagggtccaggaatcaattttttaataatcagatggttcttatgacattaccttggaatcaccagaaagaatcctttgactgctgcttgattacccctaaaaataagaagctcatcaccttataaggcagccagcttcactatggggcagctaatactcttgtaacaatccttaccccaattggtgatattaccagcattatcattatcccaaatggccccccaaagaaaagccatctgaccaaacggtacctcttaaaatctagaggactgagggctctccaagctcaatcccttcatctttcagataaggaactgagacggcagaagggcaatcctatcctaagtcacacacacagacagaatcagacttggaatcagtggttacttctcgcagccctgcctcagacccctgcagccaacacccctctggctctgaccagagaccccagccctgctggaggctggctccaattcctggtggacctccctcagttctggcaagttgtcttggaggaccacgccacccttccctctgcccccgctcccttaggcaccagaccggaacc

SEQ ID NO: 45622 - DNA, 2058 bp, Bovine  19866881009533
ttctatatggggaatctgggacgtgtcaggtactgtcccagtgctgaagatattgtgaaaaataggacagaccattgtgttgccctgaggcattttacagtctagtcaagtccctactctgggtctcttgggctgttagctacttccaatctggggactttcttatcccttgaaaatccccttggttcagcagctacaatggtttggctgaaagctctttcagttcctgagctctaagagggaatgatgccccttgacaggaatggtgggaggaaggggagtgtgcattcctgtaggcaggaaaagcagagacagactctgaaatggaaagtgacaagtgggtaggatcacacactaggcaaaatggacttgatgggcctgtgatcttcccattgctgaggctttcaatgcatgtccactcaaagtaagcaccagcacccagggagtgctccaggctttcatctctacatcagtgagaggcctggtgaaattgctctttattttctgagcttcaagttgtcatcactaaagaagtgacatgttccattttggggcatgccattttcctactcgggtgggcaaatgacctggtttgctcagagatgaacctaatgtgtactgaggcctgaccatgtgcctggaacataattctaatcctcacatcaatccagtgaagggaatgatactggcttcattgtccagataaggacactgagactccatggggcaagctacttgccttaggtcacacagagagtaaatggcagagcctgaactctacactaagactgtctgggtcagagcttttggtctattaccaaggtaacagattgcttatattttcctctgtattcacgccaatggctttggagccatggtttcatctttcgtctgtttacacctgttgctgcccttggcttcctcatgagagtggtgctggtggtggttggatggaaggagtgatggacatgtaggaaggtgtgagctcagagtcctagttaatggtacactttgagctaatgaactctagttctggtgatctctcatcatgaaatacggacattggcagagaattctggggtcattttgccccacccccttactgggctgcatgctacctaaatcatttctaagagatggctgtctccttccttttcagtgtctcttaggaaatgaaagtgaatggatttttaattcatttttaatggctcgttacacaaaaccaggacaacctcccactactcaacagccatttttcacaagctcctagtttcaacaatgctgcattctgcttccttgatctgccacttgccttgttcagctgccacatgctgcaaagtgctttcttaacaatggtcccattttaattagggatgactaatgctaagtctcgtcagtcgtgtccgactctgtgtgaccccatagacagcagctcaccaggctcccctgggattctccaagcaagaacactggagtgggttgccattgccttctccaatgcatgaaagtgaaaagtgaaagtgaagtcactcagtcgtgtccgactcttctcgaccccatggactgtaacctaccaggttcctctgtccatgggatttcccaggtgagagtactggagtggggtgccattgccttctcctaatgtctattaatttctctatcttgtatccctttcttggatcatataggaatagacaaacctgtgtttgggtgctgactcctacctctccccagcagcatggcctggacagtttcttcatctggactacgtggatggtgatatctgctcttcactgtggttatgctcattacctgtgtaatgcacacagaacacaagcacagcgcttggcattttgtaggtgctcaggatatactagcattgccactgctaccttttctgtgtttgttcttctcttgcctaaattactcagtcatgtttctggctgtagacatactgttttctttcatttacatccagtcaggtataggtatgtatctttgtcatctttagaaatccctagagagtaaaatcgcactaaaacttaatttagtcacagg

SEQ ID NO: 45623 - DNA, 1941 bp, Bovine  19866881028231
atttaaaaaaaaatgttcgttagaaagaaaggggaaaaaaaaaaaactagtctcaatgagaccaagtggcttgctctagttcacatgtctgctaagcagcatgggtatttgaaaccatgtctgcttgattttagaacacaagtcattcttctctgagccaaagagactggcagatgacttaaaaagaggccattgcaacccaatcctaaatcacctcctcaatggtgctaaggaacatatgtgtaaccagggagattttgccctctcttctccacctccatgaaaatgaatgagctgaactgagggtgagaagtcaggataggctgcaggtatctaaatctgtgtccccaaagcttagctggcaggcatgagtggggctactccactcaaaattcgatattcttctgtttttcaaccatttaaaaatgtgaaagctgtacttagcacacaggctacacataaaacaggagggaggcaggatttggttcatgggctacagtctgctgacctctgcctttggcccctgccttcttgccccctccccactattagctccctaacaccttgctgacctagaagcaccaacactcagcctacctcctagaccaaaatctgcacacatacttgaagccatgccttctccgagcgtgccttgcctgaaccaccccagtcccagggcaccatcctggacttcgtccatggtggctagaatgctcatctggttcgtgctagctttagtagtgggagagcaaagaaaaggactgctaaatgctgtgcttcttcatgccttcaaaagacctgcatgttaagagtggccaagctgcagcttacccagtggaccaacatgcaggctgcccaagctggagttcttcccaaagtgaatgggaagcatccaccacctccctttctttgccacaagcccagggatgaagcatgtgtcctgtgaagaggggaagtgacaacccctgcaggggaaaagatgcaccaaacccatctggtcagtgcaatctggccaggcccatgcggctaaactcatgttgcctaaagcaacagtttacctccaggttggaaaatggcagcaataaaaatataaatggaacccagccagagagatgattctcagtaaaaaagagactctgcataaggagaaatggggggaaaatatttatatccatagagagagagagacattatcttcttctccaacacatttttctgaagttacaaatcaatggtttctatttattcccactggagagaaaaacaaaaaccctgagatttatgagcagtgttgtttatttataatccaaaaactcttctcataccatatggttgggaaatttacagagagacaaagtgagaggaaattgcctgcttaattcaatggtcttggcaaagctagtaggcagagagtgcatcccaaactcttcctctgacacatgtgtaagcgtgtacaggcgaggaggcctgcatgcagagagcagagggagcccttccatcaccagaaaagccacaatgtagtgtagtgggaatgcaagcagctgatgagctcagctgagaaggacaggctcatttctctatcccagcacaggctagagaaagggatactgagaaacagaccagaaaggagggtgagggctaagcgatgtaggagcaaccagtcttctggacaagtaaagaggatgcacagcacatgagggttctcaggaaggcaaagtacacacagctctctactacacttctgttcaatcattttccttctccatgttagtgagaaataagcagaaatttctgattccatctctgctgctcagcatgctctacagaaaggcaatcactcaccgccttgaaggaaccaacacaagtttgcactggacgccttcacttcctccatgctcgacccttccctttcagaatgatgacaaacagaaaaaaggaaaa

SEQ ID NO: 45624 - DNA, 1425 bp, Bovine  19866881043806
ggggttccaaaatcactgtagatggtgactgcagtcatgaaataaaaagatgcttactccttggaagaaatgttatgaccaacttagacagcatattaaaaagcagagacattactttgtcaacaaaggtctgtctagtcaaggctatggtttttccagtggtcatatatggatgcgagagttggactgtgaagaaggctgagcgccaaagaattgatgcttttgaactgtggttttggagaaggctcttgcaagtcccttggactgcaaggagatccaaccagtccatcctaaaggagatcagtcctgggtgttggacagggaagcctggagtgctgcagtccatggggtcacaaagagtcagacacgactgagcgactgaactgaactgaagtcaatggaggcagacatggtgctgtcaccttgcgcttcacatgctgccttttggtgttgatactgacttcttcatcaacttcttgtgaaagggagaacccgctgtcacaagcagtctccaaaggacctggtctggaggaagctgcatgagcacaagaaaaagcagccacagaagatccgagtcgggtcaactcattgctctaaatggggtgtgagtgaagtagtttggtccaaagataaaactcatgggtctgctgttccctccggctcaattatcttccaacttcatccaggcttttctcagctgtcacctcccaagagacaccctctgaattaaatcctccaacattctgcatccattatcctgctttgcttttcttcatagaattttacatgacagttgctcattaatttctcgtctgcctcctccccaagggaaaggcagggatactcacctgttttgttctctgctgagcctagaacagtgcctgacacatacacaggaggtgctcaagaaatatttgctcagtgaatgaaagaaggagaggtcctctcctggcagacataaccaccagtattccaggcaggactgcagagttgacacccttctgccaaatgacttttctcaagcccagaaggatgggctgggctgggttgtagggcaaagggaacctgcaaacccaggtcccaactcagttctttcaggtggacaggaagactctgactgccttcatctggaaaacacacgccgtgaaattccatcattcacttagaaagttaaagagttgcaacaaaattaatttcttatccccagggaaattaaaatatctgcaaacaaattctacccctgcagcccagtttcaggtggttgatacatctgatgtgttggcagcagtgagaaccaagagggaagcattgggaaaactagtttctagctggaagggaagatttaggaaaggtaaaacccaaaaataaggaaaactaaaaatacaccaccaccaccaccaaaagcaacaacagcaaccactgcca

SEQ ID NO: 45625 - DNA, 780 bp, Bovine  19866881064212
tttttttgcgaaggagaaacataatatttctgggacttagaaatgtttctcacatatgtcctctttaagagggcactgagggttgtgaatttcactgttaatgatatggcttccctcctcatttggagttgcagcccctgagaacagagatcacgtcttatatattagatcctccatgtgcctatgtcaatatcccatacagctggaaccctgggaatgctgagagattaactcttgtccatgtggacataccagcctgcatttcttgggcttctaatgcagcttttacttaccttacccattttcaagcacttatcaaatggcatcatatcagtatcagctaataggtatttaccactcctgagctctgcctgggacccttgggcacaggctttctcctatgcatctttctcttactagaagttgtagcacatagtatattctcaagtaaaagcttgtggaatccaactgaactttccatccagacgatatggcagtctgagtccacagatcaatgccctaggagttgtaggaaatccctgcccagcaccaggcaccttcctaaggcctctctggtggaataaggcccctgatggagcatccccaggtaagtagtctgccctgtggtctcacatgagaccgggacactgaccagcaggcagtgtactgggtttcctctcaggtccatatctggagcttgcaggaggcgccaatccctgcctttgttgtaggtgatgtatgtcttcacctggtcatccaccttcttgtttgccaggaata

SEQ ID NO: 45626 - DNA, 793 bp, Bovine  19866881126295
tctgtgtgtgtccttgagcacatttaaaaaatatctctctgcctttcttcctttatctacaaaatacagaatataattaacaacaaaatagggaacatcttaagagcgcttgctatgttttaggcaccatggtaactgctttatttgattattacttaatcatgcaaccaccctaggatataaatgccatcactgccatttcatagatgtaaaagcagggacagaaagcagctctttaatagagctggatgtgaacccaggatatagaatctgtgctctcaatcttttaaattcctaacaagtgcatcagtctcatagtgatgttgggagattcaatcattttactccatggagatcttagcatctgactggcatagagggagagctgacagaatgttagttattattattctggccttcaaagaagttaggaaaactcgaatttgtattctctttaagaatttggtactgtgttctccttgtgagtggaaaatagaaaaaaataaagcaggaagaagacctagtggagactgggacccttagaccttgctcttcccactatggacatatcattcccctcctctgctttggtttcctcacctagaacatgtagggtttactagaatgtccctggactcttgtttctttttctaaattctccgattccttgataaatggggcctactttgcattgcacaattacaagtcatgtataaatattagcttatgcagctggttaatcacttaatgtcagataaacgtgcagagcaaggtcttaatatgtttacataaa

SEQ ID NO: 45627 - DNA, 753 bp, Bovine  19866881144601
agaagagacccagccccagagaaaagagtgaccacaatcactgcccatcccatctggctcccaagctcctgcctcctcttgatggaagcaggccagctggagtgaacagtgtggggctcggcgtgggtgagcgatgctagacagccaggtgacacatcccaaaaccaagtcaacaactccaggctcagtgtgtatcaggcagaaatatgacagcgactgtcaatcacaggaaatatcataaaagaggtttaaaataataaagctgcctcggaactgctaatacgaatgatccatgcacacgatggcagaccctgctccagattactgagtgtggaggcatccctgtgagtgtgtgtgtgtgagtccacaggcacaaacacacacctgcacctcacaatacacagagaaacaaagctggcactgtgtctgcaaaactcagtaactgtatccttattccaactcagttcttctacctgaaggagacaagtgatggcggagaagtgagatagacccagtggaccaggaaagaggcaggaagacccgccctgattgatgccaaagcatggcatagctatagatggccaacctgggcctgatgattagcaggaggaaacaggggcacccagtgaacctgtcagcattttctattgcttttctggaatctaggaaaggatatgttattgttgttcagttgctcaatcacgtctgactttttgtgaccctgtggattgcagcatgccaggcttccctatc

SEQ ID NO: 45628 - DNA, 1116 bp, Bovine  19866881183865
atttctggctttatttttagaagaacagattctcaaatttacaagtcatatgaattaaatgaatccaatgatctacatgtaattgaaagccatccttccagtgccagaggataattttaattgcaaatgttattaaactgtccttgtgaatttatttatgtgaacaaagtcccccataacagtgttagtatttggttgttttaatgtgtatcctacagtacttaaaggtctccagaagttaaaataattatctttctctttcatttatttcttaaaatattgatattcacttcaaatcatttccctgaaagcttacaatgtgggttggtgatgtttttgtcttaatgacaccaacatttatttttgtgagggtttaagttcttcagtaaatagtaatctgagattttaaagaaaaatggatcacccaagttcaacgtagtacctatgtataatagagagtagaggaactctggttttcagatccatatatgtccatcgacttcatttttgcttttggataaaatgcaaaatgataccctctttaacttgaataatgcaggtaacattttaggaggaaaagttggagaaaaatttgtagttagctctctttgaaatcatttgttcattttcagaaaggtcagagaagatgtgaacaaagattgtaatgctgagctgaagaaatcagccacttatttattttttcattcatgtcatatatacatattatgtgactgtataaatcttgtttttcattttctgtcttttatgatactttaacatcttaggaacttggctgactaggaaaagaggggctctgccatggctagctaattcctagagacagcaaattagtccctttcatgtgcaaaccaatgacccaaagttcatctctctcaatcaccttctttattgaatgtttacatgtgaagccgatattcctctgacctgacctgatcagcgcaggcctaggtagcggacaactcgagacagcccctactgaaattgcagcctgatggagttattcacactaaccaattctcatcctgtttaccttgctttacccattttcttgccttaaaaaccataatcattttcccccatacttttctcaaatcc

SEQ ID NO: 45629 - DNA, 1796 bp, Bovine  19866881228965
catctaccatttggctggcttccatccccactggtggtcaaatgtgaaccagtccttactgctgtgcctcataattcaaggcagaagtgcacacaagcactgccagaggacagcgaccaaacatgtgggcagcatcatttggaagtgcctggtggtgcggcaaggtacatgcagcagtggcatcccgccaccactttgctaagtgaccttcaataaccccctgagaggtgagaaagggtgcattcacccgttcttattaaagcaaccaggggcatctgcctggagcttagggaagggctgtccatccaaaacccatgcttgacttggctgcgatgaacaggaggaaaacatatcacaggcaccatccgtattcaggtattcaatgctgctttgcctcatggtaagtgaaggtgacatgagctattcagtcagagagaacttaaactgacttacaaaacacgtattcagttttagcaatcacacagaatggaacttgaattttatagtgaaagcttctaatggatttaatattcagcttcctgggattcaaattaatacctacttttttctacaacatgccttctaaagtgaaattcagctacaaccactaatccatttgacaaattctcactcatcttttaaaacttaagtcaaacatgaccctcggttccacgtcttctactaaccactctcagtagacttaatcacttcctcttttgttaccaaagcacttaatacacctctatcgtaatgtgtttccctggacaaagactaagtcttgttcatcttggtgattcctgtgcctggcactgtgctaaccacagagtaaatttttaataaatgtctgcttttttgatgccacactgggtttatttgctcttaatcctatgttcaacaacaagaactgcaaacaaactttattgttgaattcatctttgtttgccaagacctacgtgtgctcttaagtataagcctgtctcctaagatctagacccaactgcctaaaactttcatacctggatgttccatgaggtcaaactcaacatgccctaaccaaactgattatcttttgcccaaaacctgttctttttctgtagttcatccatgtctaagtaatatccccaatccccactcatttatctactcagctgaaatcctgagaaccaccctaaaatctttgtattgcaacatccaaataaactctaatttgagttgactccatgtctttagcccttctcaaagccaaccttcctcttcaaccttccaccactgcagaagtccaggccctcagcatcccttgcccagagcaccatgtcagtcactagcgtttcacttgctctatttcaaatacataggtctataacttctttttttctaatatataatgaagaagttttcatatcaacaaacctaatatttaattattacatgatattctaccacactaatgcattttaattgactaataaatctctcgtggttgggcattcagatgacttctaatcttttaaataattatttcaatagtagcaatcattctaataataatttttataaggcaatgtcatactggactctgatgtcactctcaccatccttcacccttacctcccggcgtgacctttctaagcaacagatctgatccaatgacaccctactctgtattctgttaagaacaaaacgttaacactccactacctagcccagaacaggagacccttcctctgcagcactttaccacctctttcctcttctgccacctcctcacatgggctttcagtctacccccgcaaaga

SEQ ID NO: 45630 - DNA, 736 bp, Bovine  19866881241583
gaggagatgactctgtacggggccctgaagatggttggaatccaagtaagtagagagagagcatgggaggaacttctaagaagacatagtgagcccaagcacaggacctgctggagaaacgaaagggaacgtggagcctttctgaattctatgagggtagaagagtgggcaggaggaaatatctggtgcaggtaagtgtgtttagtcacttagtcatgtccaattctttgtgacctcatggaccatagccctccaggcttctctgtccaaggaattctccaggcaagaatattggagtgggtagccattcccttctccagggaatcttcctgacccagggatttcacccaggtctcctgtgctgcaagtggagtctttaccatctgagtcaccaggtgagggaggagttttaatcccttgctatggacattagcctgaatcctgaagcaatgtgcagtggctagcagattttgagcagggtggggactacataaaagcaaattaacttacatcatatttttccctggaaaacagagctccctgcccaataaacgccatccgattgcaagatgtcaaagcacagcctagtctcagattataaatttacctgccaactactgagagtcatatcagcctgagaaggtttggtctctgcactgtatttatttcccagtcaaaaatgcaaggcactaatagcagtagagaaagaggcaagctgaggttgagtgggttcccg

SEQ ID NO: 45631 - DNA, 753 bp, Bovine  19866881268691
ccccagaatcagcaccataaagcgattctctgaggatcctcatgtgcactgaagttcgagaatcactggtctgtctaccactaaaatagcttagcgagagtaagagtcactggggtaaaagtcgcctcccctagcccctgttaccatggtacaaggcatcttggcctacagaagtgagaacagtttccaaattcgctcattttctcctgggcaacagctgcaactctgggcaagttcctggattgagttacctaaagcaaatcacaccgtgagtcagggtggtgatggattgtgccctgcaacaaatagtaagccaggaattagaagagttctgaccatcagcaagtcattctagaccacaatttctacatttgtaaaaggaaaacaccttatggtcttcctcattggctagttttgatttccacagatgtgaaaaacacactgccagttccacagttatcaagagaccggtgctcaggagtgcttaggtgaactctcttcttctgtagagggataaactgagactcagagaggaaagtgacttctctaaggctacactacagatgagtgcagagctgaagatagaatcgatatcctccttattgtagggcagtattatttctgtcacatacctcctcagcaaatgcagaactgatccaactgcccttgttgagagccagcagagagcctgattgggtatgcagtgtggcccccatattcataatgtacagaatgctttaaaatctgacttcc

SEQ ID NO: 45632 - DNA, 1959 bp, Bovine  19866881279499
aggaggagaaagggaaagacaagggcaaggcaaagagatttgaacacattggtttgaagtatcaggaaggagttttacaaaggaaagtgtaataaggcatttccagaaggaagagttttactttgctctgttattaaaattattgtttagtttagaaagtgtccaggtattttggtgcctgggatgactggacaaagcactttcaaagagtaatggggaacaaagttagatgcataaaagtcaaaagttgatggaggtggaagtacaaatagcaagggtaacaaaccagagagttcaagtctgatgagaagcccttcccttccggaaaggccagagctggatagtcttcttccaagataccgcttggaccctcgttcccttgtcttcatgcagaaactgccctctgtgagaacactccatctttacatggaggatgcagaaagcatcaactttagctctgctaagcaaccatactctcctgagatggatgaggcccaaataattgaacctggaagttcgaatgcttatcatttagggtaggtttttctacagatggctaatttcatttcctgcatgttgactttttcctagctcttggcttggaagggaagctaaatttcatgcttagggagtaccttgcccttacccatgaacatatgcttaaagacagaatattttctctgctcatttttaactcataaaagatgcagcaggcttggggcagagaggaagaagagtatgaaacttacatggtctgtctagcagtagccatcccaccaccttctcagaggaactgcctcatctctatgtacaccagaggaatggtcatctctgcatcacaatactccactagccaggtctcagctgacggggctagagttggataatcattcaaaatctgcacaaagacagtacctggctggttcaaaaaaacaaactgcaataacaagattccctctatctgaaacttccttctaagactcttagcttgcaggagctagaaactttcttctaggacccttacagttggagaagcatgcactggaaaagcaagtgaaaatagagagggctaagagcaggcagaggaaatcagagatgcaagatgatagagattaagaccctattttcatggtccccaaataattctcagagtgggaaaaagaagagagaaacttgtgttaagggttcattgcaaatgggagaaaacaattataaacagcagctaaagtcacagtttgggggtagagcatttctgccataatcgaagggcagcctgattttctgtcagcaaagcaagggcagcttggactcccatggatgaccactgggtgcttgcagcttacctctttctaatcattggttcatcactataggcggtgtacatattttagcctacttaaaaggctctttttttttttactttacaatattgtattggttttgccatacatcaacatgcatccgccacgggtgtacacgtgttccccatcctgaacccccctcccacctccctccccataccatccttctgggtcatcccagtgcaccagccccaagcttcctgtatcctgcatcgaacctggactggcgattcgtttcttatatgatattatacatgttttaatgaaactggagcctattatacagagtgaagtaaaccaggaaggctggtttctatctctgctacaaagccatagtctgtccactacctctgggttataactagagggatatactgatttggtctggataatttctataaaatgtaaatatattttttcttcattgagagttccaaaccaagtcacaagaataatgtacagatcagaggcactcagattagtatttgataagtgggagctaagtagggtacaagaattctctcatataatcctcaaatcgtaccatggaacacctactattattattatttacagtttgagctgaaaagaaatgaag

SEQ ID NO: 45633 - DNA, 973 bp, Bovine  19866881287864
ttacatctcttattgccctggcttctacctctaaatcttatactaatgtttactgtaactcacacctgtaacagacacctgtacaggtggtctcatgcagcttaaacaaaaactacacacaaactaaacttgtgtataaactgggagtttgggattgacacatagcactactatagataaaacagataaccaccaaggaccaactatatagcacagggaactctgcttaatattctgtaataacctaaatgggaaaagaatttgaaaagaatagtatgtgtatatccgaatcactttgctgtacacctgaaactaacacattacaaaccatagtccagtctaaaataaaaattataaaaaattaaatgcataagtcaaatcttattcctccactggcttaaagcttctttcaggttctctgccatgtagctaatgatctgtgaatcaatagtgaactataccaaggcattgaccagcaagttcactatttgctcctccactccaacctccacacacacacactcaaagcccacctattttaatattcaaaatatttatattgtgggttttcttaaagggaacatgaatttaagtatacatttggttctgctcaaaaagtcacaatgaacaaaggccccaaatctggaccatgccagatgactgctctaaggttctctttattacataagtatatggaataaaaatagaatgtatttatgaaaggctgaaagaagttccaagagatagcgtaaaattccctaagaagtagaaggtggaagtcatacttaacttattttcttaatatgctatactttgaaccccttagagaatgcctactctgttaaaatgtttcactgtcttactgggaaaaataaatcagttcatctatcattttcctgaactgccaattccaactaaaagcctgacttcccaggcttgaattactttccaaactatttcacttttcctacgg

SEQ ID NO: 45634 - DNA, 2874 bp, Bovine  19866881349204
atttatttttctaatactaaatgatattgcatcctaaaaataaattatattttagaataatacactttcttttgcatacgctgctagattcagtttgtcccactgaatcttcacattgtgaagtaggtgctttacagtctccttacagagtgtcctttagtagtaatatgatcaagggtaaaggtagaacttgccctcaaacctgtctggttgcaaactccaagattttaaccatctgccataactctttggatcctttgaagtttacaactcatgaacgtgcatcaacatacatttgcatagtgtccactagtctagttttttcctcttgagacagtaagatccaacaggctgattaaactgttgtttattaaacaggctgtaattaaactgatggaccttgaaaatcaaccttttagatgtctgagtgtaaaaagaggaaaaaatgattgaacttcaggcattaacatgctccaagaccagagggatagattataaatgcagactaaaatgtcttttaggtctattatagagaatgattctaagtttatcaagttaccatcttaataggaagggaaggacctcatctccttcccatttatgtattaatagatttatgtatctatcaagcctatttacacaagcccacctgcacttacacacttcctcatcagaacctttaccattgtcaatcgttcaatacaaaagacattcactgaaaatgaagcttttggcaagctttcaccaaaccattcaatgtccaaagattaattcagatctcctgttatgtttttctttcactttgaacatgtatgttttctcaacctactccagttactccacatccttttctaaattccatcactagagccaaacaccatagagaacccaaatgaactggaaagaacctaggtcaagggaggcaaatgctttggaaaattcaagaatgggtgtcaaggggttctgtcccttctgtgctgttaaaagcctgcccgtattcaagagatcatgttctaggcattaatggtatgctggagatccacagaaatgactggaatctctgctctggaactttgcttctctcacattgtcttgaggagccctctcttgaccaccctaatttgcagctctcccaccctgactctccctaatctttcttatgctattttccttatagcacttatgacaataattaacaacacatattattgttagatcaattccaacaacagttagccaactacagttgaccttgaacaatgcaggtttgaactgtccaggtgcacttacatgcagatatttttcaatagtaaatactatagggagggctacataatcagtggctggttgaattcatagataagaggaaccaaggatatagagggctgacaataaattatgcacggattgacccccaccttgttcaagggtcaactgtatatcaagagttggccaactatacaaaccaacaataacaataaatatagcactttatttttaatttgacacacatggaaagtttcatgatgggagaaattttttgtctgctttttgtttgttccttaatgtactcaggtacctagagcagtgcctgggacacagtcactgtgccatgaatactgatggaaagagaaaaggacactggaatgagggaggtaaggagaggaaagtgaaagggaagtcgctcagtcatgtctgaagttggccttcatttctcactgtgcaacctggattggaacatgctgaccaccactgttggtcactagagcagggtctatattcctaaaatgtggagacaaatgatctcagctcagatatgcataaagagtttcccaagtacacaaccagcaagaatagccatttaaaggtctaagaattgtgttaaccttaaaacaccaaaatcaatagacagcagcagaaaggaatggactacggatatgcacagtgacatgatggaatctgagaatccctgtgcttaatgaaaaaagccaggcacacaaaagaagtgggcattgtatgaccccatttgtgtaagatgcaaactaatctacagtgataaaaagcagaggagtgctggcctggggccataggtggagggaggaatggactgcacagaggcacgagacatctctggcagaggtgatggaaatgctctgcatcttggaagtggctttataggagcttatgactgtcaacccccattgaactgtgtactttaagtaaatgtggtttattagacagaaaatatttttcaataaagtcaataaggaaaagaataccataactagcacagggagaggcagatggctctttagcttggttttctatccaaagaacaacagccaccagacctctgtataatcatcagtccagatatctacaatatgcaatctcaattatttctctcacttgcccttcccccctttctagccatcactcctcctcctgatatgaagaaatcctgaaaaagtatatcagcatgcacagttccactccttccacctcagtacctgtgtggccaccctagatgttgtttgtaccgtttgtcaccatacgaggtttagccaacactccatttgaaccaaggcagccataatccccagcatctccctagagattcaccctgaccctagcctcaccttactgtcctcttagaagtgtttaaagatcaggaaagtaccccagaatgaaaaaaaaaaaaaaaaagaaagaaagaaagtgtacttccaatagaaagatttttcatttaaatgcactttattgtgtgatgtattcctttaattaaagtgtgtgtctgggtgcattggttgctattacagtgcaattcctcatgtttatgaacgcaagagagctagggcaatgcagggaaactca

SEQ ID NO: 45635 - DNA, 1319 bp, Bovine  19866881349857
tgctgcatttagagtttgtggcccaggtcttaggtataagaaagtaataattggtttccctttgtcttttcccatgagactcttgggaacctctcaggtaggaatgtttgagacaagagtggggcatttttgatacactgtcctattttacaccatcttatttctataaaatcctgccatggctccatagcatctgcatcttgacttaaaagagctttattcctctttatttggtggaggaaagcaatttcatgcaactctccaccaatgtgggaccaattattcaggagttaatgcaaccagaaactacagctgaatttagaagctagaaaagggcatgctgtgggtacctagataagtgagaggaaagacgagctacagcactcttcccaacacatacacacagctgaacaatgcttctgcaaatctagcccttctctagaatgatccacatgccatacctcggatgtacccaagattgttacagtctctggactacctgagtctgagaagctctcagactctatccatctaaatccagcccagttgtgactccctcatcaagccttcctagcaagtccagctcaattttcctccactctccccgtgtcccaagtgtttgctctacaacctggaactgtactaccaccactttactctccccgttcaccacgagaggggcaagagacagagagatgcagcagaaatggacaagggactgtcagatgtcctagattctagttccaagtcttctcaaactctttggttgtctttggctagttattccatctatctgggcatatttccttttctataaaaaaggattcagtttttgaagagaaatgatgtctgccctttctgtcttatcaggccattgtttgtaccaaatgagacaccccatcctgtaatgaatttaatatactagctgagagctgctatagcagtgagctgagtatgaaagcaatttcctggcttttccctgggcctgtttgcacttctttgaccacagcagtgcacccagcaccagcctctgtgagtgttggctgctaatgcctcactgttgctcgtgccccagaggggtcaccgtctctctctaacaccccagcctcctcctggatggggcacatctgtggtgtaatggcctatcacagcaacaaccctacctctgctaggagttttcttctgtggctgctaagccctcaatctcaagaatgattactgaccacacaagctgagctttcttgaaagtgattgtttactgggaacatctggtgtgtgaatggaacacttatattttttctcttccctccctccagtca

SEQ ID NO: 45636 - DNA, 1544 bp, Bovine  19866881384550
ctcaaagctcttgttactttgcaattaatttcacttcccatttgagcacaattaccctttatttttacaaatccatgcagtgaacagatacttgttgattctttccatatgcaagttaattaaaggcatcaaaagtcaaagaaagaactctggatttgaaaatcagaaatctgaagcctgaatctcagttctactagttcatgactggtgatgtcaaggtctgaaacctcactagaggaaagatggcttcttaggggaacccagaaaccacagcaagaaatggtcctctggcttgcacttgctggaaagcctgccaaattgcatagctctgcagatggctgctcttggtccaattaccctaactcaggggagattaatattcacaggagaagacaacgtagcctgttcagagaaaatagcagggaaacaatagcaaccgggcttctgtgctgaggaggcaattactgggggcacaggctctgtgctcactaagaccccagcacttgctggagacaggccagtcccccagatctggtccaaccctggtgcccatccatagcggctgctgagagtaggaggttgttacatttctagtgaaagccacccatcgctcctcactctgaggcatgacatctcctgtggctcctccttaacctctgcagattggaagcccacaaagcaggcaccacaagctgccagggagagcagatgttcgagtcagtgtgagggcagagctgtgaaaaaaacctggtgcaaagacttaggctggaaaccaacaggagagaccagctttctgcctgatggtcattgctatcctcacatctctattttctaactagaatcactcttgtcttgtattccaagacctttatttttttttttctggataagacatctgttctaaatctatgttgttctatgttggcttagaggtgggatgttgacagattaagatcaatgagttgcagagaattttttttaaaataaatctcaattgcatagaatctggttaaaatgtaacccttggttctaaacacagtcaccattaatcctggcaattatttgcttctttaatttgctatttatttgcttctttaatttggttttacttttaattgtaaaaccaacacatgcaaacatacctgcaaaactcaagaagcagatcagtagttttgaaatttcaggatgcaccagaatcacctggaaagcttgttaaaactcagactgctgggccccacccatggagactccgaatcaatcagtctgggtggggtccaagagttgctttttctaattaagtttccagatgatgttgatgctgctggtctggggaccacacttggagcagcacagaagcagaactttaatgccaactgacatacagctctgtgcctctctgctcctcacctatcttgaacccggcctccctctcagatgcagcttctttcctgaattttgtgtttagtgatgataatttttttttttttttaaccaaggtgaaattcatataagagaaaattcaccattttaaaggtacaattcag

SEQ ID NO: 45637 - DNA, 1474 bp, Bovine  19866881438899
ttcgtttgtttctctaattaagataccattttaattaatacagttactttaaagttcaggtatcatttgccagtttgccagggagtcaaaaccacatacaccaaaggactaataggatacacaggaatctcactgaacgtgaacaaagacttgctctaaaaccatacctacctatttaccttagatatgtgccactgcttatttggcaatgctacagaatggcaataaggacacctctttgtggtattaacccttttctccatcggaatcaagttctccactgtagatctctcttgttctgacagcaaattccaaccatactcattcagctgagaattttcaaaatttcacttttgttcattagtgtcaccccatgtgcattttttatcaaattctgaacctgtctgataggcatctggcatttcttgatccttcccatcttagctagtctaccgaaataggttgaccagctgtctgttgttttttttttttttttccttgattaacattcatctacataattgaattcaatacctctgatccttaataatagataaaatcctcccaccatactaggaccacctagtgctgtctttctctgttctattaaggcaggacatcttttctccttatatggtcttggctccaaacaatggacaaaagagatttgatgacctcctgacttggtgcagaaaaatcaacacagaagttctggattctgttatacataattgcttatgatcaaaatacagtgtatgtttttcgctttaaagaaggcagctaaactctaataagcatgattattaagtctgaatatgtgaagatgaagtcaataattgaaaattcctgtatgatggtatataaaatagatgaagcatcaaataaggtatgagatatagcaagtgtaatcaaatgtatttactgttgataattttaattaaggaagtcgttaatggagttgtgtatactcaggaaagatttcatgactttatttttagaagtacacattctcaaatttgcaagtcatatgaattaaatgaatccaatgatctacaggtaattgaaagctgcccttcctctttgcgaccccacggactatatagtccctggaattctccaggccagaatactggagtgggtagactttcttttctccaggggatctagccaacccagggattgatccgaggtctctcacttgcagtcagattctttaccagattctttaccacaaaggaagcccaataatactggagtgggtggcctatcctttctccagaagatcttcccaacccaggaatcgaacccatgtctcctgcattgcaggcagattctttaccaactgagctatcaggaaagccctaagattttatttggctgccctaggtcttagttgcagtacgtgggacctagttcccgatcagggatcaaaccccaggcctcctgcatgggagtgcagagtcttagccaggga

SEQ ID NO: 45638 - DNA, 1049 bp, Bovine  19866881476510
caagcctggggttaccttcatcacctgctcctcctaagatagcatctctgacgcattgttccctgcctcccactcttcccagctccctgaatttgctggaccaaagcagagacaaagatcgaaggtactttactagcagaaaactggccacccaagcctgtcgtcatttatggcactggctccggaaatgtctaattaattcatttatccaattagccccttgctctctgaaatgctttttcttggttgctgggcaactgggatagactttcaacacatgcatgctgctggtgaatgaaccatcagttttttccttcaccctggcacccccacttttctttctccttttatttgtctaatgcacagtaatgaagaacatctccaccaatctccagttttctcaccttccccaggcctctggatatacttgctgtctgccttaacacatttctgaaggtaatttttatgccagacatttgtcatggacgaggagagtgacagaacatataggtacacagagatgtgtttgcaaaataatggaattagccccgctcacgcaagacttgaggagagcttagctggtgcctgggacctggccaaggttatgctcagaagtgtttgggcagagtggggagactctcttctggtgatgtggcattaacaagggcagtggttccatttgtctttatggcctgcccttcctggggaattgtcatccgtctccagcctacagtgtattgtgagcactaactaggaggcaggactttaagagagactgaaagagacatcaggagggcagtacagtgccttgaggaatcatccttgaaacataacatgctctcgttgcaggatgtggaagtgccacatgctgcttcagggagttaaagtgttagaactggactttgagctgaggcttccacccttttctgtctttacagatgagaaattggaggataaaccttccggaggatataccatttgcttggtgtctcagaaccagagtttggggttccagagtcccagaccttctcatggactaccctgctcct

SEQ ID NO: 45639 - DNA, 1306 bp, Bovine  19866881558855
atccatcctcctgtgacatgcacatctcaccttcctgtgtcttctctcccctgcaggaggcattgccaccattgcaaacagcgaaagcacaaaggagatccccaactgcactagtgtttaacaccaacaagccgcgtgggcaatcgcctttctgactttttatttttgatgattcctattactcttattatggaaaaatgaaagtgtcttttttacctattgtttaccaagggccccatgaatagcaggcagatgcttagctttgggaggcaaagcatacttagctgattatgagccacgaagaataaatggctgtttttgtgctaagggcaaaggatgcgtcttcccatggctttcttacttcattctgccatttatagtgcaagaaatcctgtttcccctgtgatctgtctttttattttttaagttgggttggttttccactaacctcccatcctctccctgccctgtaccacaccaaaccaccagtacccagctcctccctcccagcacacccacctaaaacagaaaccatttcccagctagatctgcagaaggtaggttggtggggagtgagggtggctgtagaaagtacacacctgtcagaagagaccctgcctcatgcatgtccattgcgaggctgcagatggcttattgtatataattacaatgtaaatagctttttatttcctaagaaataatttaatgtttagtaaaaaagaaaactgaaaaaagaaagatgcgtctgttggcttatgcactcagctttggagctgaccaaccccaggcctgcttgatgtgttgggttctggatgctccccagttgtctgtcacacttaactcttgcatctctgtgtccctgccatcactggtttctatttatgtgtataaagtggggagggggagtacttctttgaaacaaacaactggtaaagggaggacaagagtgacatgatagaatgtgtgagtttttggtcccatccgtgatgtgggagaagttgcaagatgaagtccactagagacttcaaactgaaacccagatgggcaaacaaggcttcccctccagaagagtgaggttgaggatagttaacagtctgaggttttctctaaagaagccaggcaatggatcttaaaaaaaaaaaaaaatggcatcctgctttctggttggattccatggaattgtataatgcttacagggaattctctgaaaagacccttgggcactaggttaagtccagtgagggcctcagcctgggagaagttagaggtgggaagggagccggcacttgtggaatcatgtgaccgt

SEQ ID NO: 45640 - DNA, 1136 bp, Bovine  19866881757032
gatgcagtttggctcaggcccctgacctcttggggcccttggctgggggccctgggatccctgggtggagggcagacacatcatatcataatgaacgggttgtagtttgaatcatggtgctgtcggagtgctttccagggagacctggtgtcaggcaaggctttcttgaagaagcaatgtttagaatgagaattgaaggggctgcgggctaatcagtaaaacagcatagttgtgagcctggaggcttctggaaggaggtgaggctggagaggtggcaggggtcaagtcctgccagtccatggaggcatagcttttcgccccagcacacctctctcctgcacagcatcgtgtgtgttaatctgtccacatcctcctgatcgggccgtgggctccttgcaggcaggagctgcacccggacacctctgattcctcctcagcagcagtggtagctggtgccgagtggctttgggagctgaaagttacattttgggaaattttgtgagctggttaatgcacatggatggtttgaaattggccacgatgacaatatttacactatgaaaattggtgaatgctatataaatcagggttcttatttttcctctcagtgagcctgtgtttaaacatttcccagcacacccctgccagctgactcagggttgggcataggcatacagagcaggaggcagcagcgggggagaagctggaactcagaattgggagacggacaccagctgtgtgtcaccagtcaagtaacttagtctctctgagctcagtttccttattggtcagatggaaattctgagacagatttgagaggctggctaccagaaatgtgtcccacgaagcatccttggttcagggcagacaaaccaaaccaggctggtttctcctatctctcaacaactggaaatacctactctcttttccttttgcattgtttttgattgttctttaaactttttttttttttttactttgtaatatgatattctctgtggtggttaatttcacaagccatctcccaccctttcgaaagaaggtgggatgtataccttcctgtacagggtaaactccaggaataattgttctgttggcttatgtcatccctccccctccccacccggctctcagtg

SEQ ID NO: 45641 - DNA, 773 bp, Bovine  19866881769297
aacaaagcaagaagctggaccaagaagtatttgcttctgtaaaaaataagaagagaaaaataagtagcctaagtaagaagtctgtaaattgaaacctttagtgactaatgacaatgattgaggtaaatgttttctaactcagaatgaagctaaaagtgttttttccaccaaatatgtttttgtaaaacaacaaaatctcaatgtagatcagatgcccaccaaataaataaaatcaaaggagctgcatttgccattggtttgatggagccaagctgtttgctaagccaacctttgccaacttttcttttctgagaaagctctgaatcaaacctgatttaaaaaaatatatagagagaatctgaaaatgtgttggctgtaaacatttgactaatttctatgtgccatatgcatttatctcacctagtctaaataacaaactgtaacttcagagagcttaagcctctgagagtttaaggttaatggctcgaaatcacacagcaagcaaggtgagacaaggattggaatttcatatctccagctgttgtctctacatccaaagtcaatgcattttggacttagttgcctttttctagcctgtgtgtaaatatccccttctccctttaactgtaaaattctctcaaagacaagagaagattgtcacttgggagattgcaaaaaaaaatcatcttaggtattttttaaaaaaataagagaatgaacatacacaggtttctgagtcccaactcagatctactgaatcagcatttctaaag

SEQ ID NO: 45642 - DNA, 813 bp, Bovine  19866881867586
tcaagtacctaataagtaccccagtgagtttccctccttggtgaaatcttcctcatccttcaaagtccagctaactccctcccccaatattctgtagtctccacaatcccttccctgctggtggtctcagaaagtcattagtttcttagattcctatgtcaacatacgtgattaacagttcattactttttctctctcattagactgagctacttcagggaaggtctgagtctgattcatcattatatccacataagcactgtatacaattatttaaacctttcaagttctcagtgaagttttgtagaatggaaaagcaacctccggcataagaaaatgagggtcttgttacagagccaagctgtacacatgaaacagacattgaagaaaagatcgttacatgctacactctgtatcccagattttaattactgcagagataatccctaaggcacagtccccggaaaacaaaaagcacacatatacctctcccacctccagctccagatgtgctctctcctctcagagattggaagcatcaacaaagggttgttccctatgactataaagacaggtcactgtctgatcaagactggatttcttgatatgattattgatggaaagtccaagtctcacaccaagagagacagagttggacagaaaagtacacatactaaattctaaacaaaactgaaagtctacatgaagcttataaaaggcaaaactaaagattatctctgctgctgctaagttgcttcagtcacgtccgactctgtgcaaccccacagacggcagcccaccaggctcccccgt

SEQ ID NO: 45643 - DNA, 2450 bp, Bovine  19866880344183
ccctgggatttctttggaagggatgatgctaaagctgaaactccagtactttggccacctcatgcgaagagttgactccttggaaaagactctgatgctgggagcgactgggggcaggaggagaaggggacgacagaggatgagatggctggatggcatcactgactcgatggacgtgagtctcagtgaactccgggagttgtgatggacagggagacctggcgtgctgcaattcatggggtcgcaaagagtcggacacgactgagcgactgatctgatctgaaggtattatcaagcccatcaaattacacaattgatctggaacaacatgggtccacttacatatgagtatttttcagtagtaaatatacattgctacatgatctaaggttggttgaatctgggaaggtggaaccttcggtacagaggattcctggtatatacagtgccaactataaagtatacatggattttcgtgtttatagagggtcagtgactctaatgcttatattgttcaagggtcaactgtatttgctttatcaaagttaatcagaaattactcttaacatgcaattgaaatacaatatagtttataaagtcagttgctacaaataatcaaacaaatttgctttacactactgaaattacaaatcaaaacttacagtgataatatctgtgtgggctcatttcgttgttgtctaaaatcccatatttttaactgtccaattgaatttactgtaaggatctcaggagttcgaaggaaggttacagcatggagtgtactgctatctgcattgtctgtaaattaagaaaaccacagtgtatgttaacagggcaccacttttccatgaatatcttaaacagcgttccctctgttgactgaaaaattacaagtgaaattttaaataagtcacaattttatttttatggaaaaatataagaacatatgttaaaatggactctcctttgatagaaaaattatattactcacaggacatctgaactgttttccaaattgaggactaagttttcatatatttctctatttccacttaagagtactaccctccatgtctgagacagctgttcaagtttctttataatccaattttatctcccaccactgcttcaccctagacaacctagacatcatgttaaaaagcagagatattatttgccggcaaaggtccatctagtcaaagctacggtttttccactagtcatgtatggatgtgagagttggactataaagaaagctaagtgctgaagaattgatgcttttgaactgtgatgttggagaagactcttgagagtcccttggactgcaaggagatcaaaccagtccatcttaaagcagatcagtcctgaatattcattggaaggactgatgctcaagctgaagctccaatcctttggcaacctgatgtgaagaactgactcactggaaaagattctgatgctgggaaagattgaaggcaagagaaggggacgacagagaatgagatggttggatggcatcactgactcaatggatatgagcttgagcaagctccaggagttggtgatggacagggaagcctggcgggctgcagtccatggggtcgcaaagagcacctgaactcaactgctttacccagaacctccattctgttgggccaaacaccacagcttcctacagagctcattctgaccctgtattattctgctgactcatctcaaatcgattcatctttatccttatcagctctctcttctgccatgttcttcctgtttgccttaatgttccttctgttttttctagtgtgtctaagcttatacatctttatttagtatatacttaaagacttttgttttgtgaccctcctcccaactgtcaccaggccggcagtctttcaaagctaaacaaatggtattcctcagaactaaaataataataatacaaaaaactgattcatgggctcaatccatagaagttctaattcaagaggtctagggtgacgggctgttaaaaatctcctcaggcaagtctgtgcaaaatatggttgagaactactacactagtcagacatgatttagcaactaaaccactaccactgcactaaataatccttctaaaacatgatgtgggtacattacccctttgctcaaaaactttcaatggctccttagctgtctacctaataaagtgtattagattcttcacaacctgactgcaatctacctttcttgtttcatctctcaattctccaaatatctaaagtcaggtcaaactacactttctgtcattctctgaatggccttaccccgcctctatgctattccctttatctggtgtgccacttctcagtattatttatggtctagaatctagattaaatgaattgccctgcccctcaattctttatccgataattccttccaaccatcctccccataaatttctctttctt

SEQ ID NO: 45644 - DNA, 2839 bp, Bovine  19866880543345
atatgtatggttttgaagaattttttaaattattacattgttttgctgaactagtctttttattaaatctgtttttgagtcatattttctgcatgctgcaaaaactcatttttcttgaactgcaaactcacacatgtaaccagtttgctttgtaagtcttaaggaggcttgatgattacattgcttttaacgttgtgctaaatatttgaggatctttaagtatttgagctttgctttgctttgcttttttttttttttactatgttcttacccttcctcaaggtgttggaggtgcttctgaaaatgatgacccttccaaaatggttatggttctggcagctactaattttccctgggatattgatgaggctttaagacgacgtcttgagaaaagaatctatattccattaccatcaggtatcttcatttgagtcaggaagctcatgttaacttttatttttttaatatttttttattttatttatttactcagctgaaccaggtcttagttgcagcatgcgaactgttagttgcagtcatgtgggatctagtttcctgaccaggatttgaacccaggctgcttgaattgggagtgagagtcttagccactggaccaccaggaaagtccttcatgctgagtcttcagtagttttgctaaattttgaagtttggtattactttaaaagacaaaccagttcaattaaaaacataaaaactaaaaaaatttcaattaaaaaaagttttttcaattaaaaatttaaatttaaaaataaactaaattcagtgaggaatagctgttaaattttttaagcaaatgagctctaagaattgaaaaacaaaaagtagactggagaaaaatagaacattgtttatgttgatatttatgtttatattgatttatatttctgtatatgtttatatatttttatatattatgtttatatatattcatttatattttgtttttcccaatagcaaaaggcagggaggaactgttacgaataagtctccgtgagctggaattggctgatgacgttgaccttgcgagtatagcagaaaacatggagggttattcaggtgcggacattaccaacgtgtgcaggtatgaattattttcaaagtataggtttttgtttctggttctggttttgtttttaggaagcatagatttttgtcagtgtaaacttctgttatgaagttttaatgctaaatttagatgaataaagacccacattatataacctagtcagagacacacgttttggcattaagctagtgttagctggtgctagttatcttgtttggttatcttgtatgtcactgaagactgtggttcatttaaaagctacacgttcaagaaggtagtgttaaaacaactgatataaaatagataaccagtaattgtcttggattagaaaaaaaagttttaggttttaacactttttatttgcatactttaaaaagtgtacattctagtaattaaaatcatttgaacaaaagaaactgttatactggttacactgcattttaacagcccatgggacaccttggaccagttgctttttactctagatttcactgccacccctcccagcttcctccttcaccagcatgtaaactggttttcttccccactggccagacaggcagatgggagaggcaggaatggccttcagccctcctgtaagtagttctcctttctttgacatgaaagggcagcacagtcatttaaatttgatccacactctgcatcttacaaaattaaaacagctaaaagtaaaataagaaggcagagcttgtggaatgtatggtgcttattggcggcacacaccttattaaaacttgcctgcttacttctgttgtcatttcttttgaaagcagtggattttcctcttccatttatttttgtcttcaattttgacttaccaaattttataatctcagccatatcaggtatgtcagatatggtcgcagaggaagcagagcgaggcatgactgagcagagtccagtctgcacggtgactgctgcaagtgcctgggttagaaaaattaacattggtgcattcattcagtatattgttccataggagacgtagtccagtatagattgatttggcacatcagaggggagtacagtctcattttcagtgaagtgtcataaatgtgataggagtatcagtaacaggaaaagatggtctctacttcaaaacgttattgaagtagctttggacctaatcttagtattagcttggacattattaggaaggtacttgactgcactggtttactcacctccaaagtaaacattctatgcagggctgatgtgaggattagcaataatgtgtgtatgaaaccctttgtagctgtcgctttgcacacgtggtggctgctgttaaggatcaaactgggtgaaagcaaggaggtagttgaatctgaagtttctccttaaaaaaaaaatagcactaatacagaggaggggaaaggagagaccacttgactgtttagtttttcttacacatgcagtagaaaatatttaattttccagccaacaagttctctcctgtccctgtgatgcttattctttatggtacacctttaattaaattcagttgccctcatgttatatccttctactacttcttgggctttttgctcagatttaactgctaacaaaacagctcaaaaacaggcctaattgtccaatactagattctgtgcagtactattatgtatatataataattacagaataacacatgcactgaaaaaacatcttctgttcacagttttgtatttgcctagcacatcattttaggttttcgtctttttaatttaaaac

SEQ ID NO: 45645 - DNA, 2216 bp, Bovine  19866880719680
gccttatggactatagacctcaggcccctctgtcctgggattctccaggcaggactacaggagtgggttccatatgcttctccaggggatcttcccaacacaggggttgaacctgagtctcttaggtctcctgcattggcaggtgagctctttaccactagaaccacctgggaagccctagtgaggtcttaggggttcactgtataatatccatttatttttttttcccttctcccttcttcaactgaagaacaaaatgcaagaggtagacaaaggaggtcaaaatgtcagctatattgctgagaaagtcaattagagaacatggcgttagacctgtgatcaaaagagcatgtcacaagaaagagtaacttgacagtgaagaaacctgacagatgctgtctcagccaggtgatcaaggtcaacattgaccattgtaaaccatgtagatacaagtacacttgacatgtatggtatgatgagaataacactttacctccaaggtcttcctccccaaaacctaaccatcagaagaacttcagacaaattgcaaatgacgaattttctacaaaatacctgatcagtacaccatcaagctcctcaaaaacaagcaaaatctgaaaaactgacctaagccaaaaggagcgtaagcagatatgaccaaaaattgcaatgtggtaccctggatgggttgcaaaagagtcagatgtgactaagcgactgagcacgcatgagcacaaagtattaagaatggttttaaataaagccttaattctatcaagtcatcaacaaactacagacctaaagcttcttctctatattttctggggcaaatggtaacaacctctctgcagagagggttctccacatcagagaggcagttcaccttactctgttcatccatcttccttgtttgcagcatctcacccctcctttccataagcagttgctgtctcagatggcaggagaaggaaactcagagaaacgcttatcactctcaactgggtgattctgggctcctgccaccattaggaagaagcttcttttagcctcataactgttgccagaactgaatgagctcaattcagtcgctataactcacttctatggcacctcccagcaggcaaggtgttacactagacggaagctcttagctcccagcctcccaggaagggtaagcttagggtgtgcttgagaaaatgacatgtaaacaacaaggatatggttcaatatagttgtgatgcctccataattaaaatagtcttaggttttgtaatcaagtggcctgcatgctgaaacaggaaatttgaaatagtaacaataacggtaggtgctgacattcacaccttgatgcagagtggtgaacagatgctagatgaacaggagtaaacaaagaaaaagagaaaggaaactggagctccttaatcagtcttgagattgcacatctggaccatttttcagaggagacgaggccacagaggtcatggttcatccaagctcactggccatgtagcaggtacagtgatggctgggatgtacacgtcaggcatagacttcagctaacaaactggctgaaatcacaggatttatgtctgtttacactgacagtctcatgttcctcgacttaaggaagagggtattagggtgggtgtccaggacagtcttgtgtatatgtccatcctgtaaataacagtactcttttcactctcaacaatgtctggccgaacaataaatgacatgatcactctagtatttggccagacagacggccaatgtctgccagacttcagagactaatcagaggggaaatatttcctgattcagctttagggtggcaggctcccttgggacggccagaagcctgtgttcagagtgccctgattctcctcacccagttcttagccgacgcaacaagttcaaaagagtcttttgtcctgcgcactctgcaggcatcttcttcgtgctctggagcctgatcctttcaggagcaggagccactcagtgcagacgcggcctttcagtacatctgccccggcccctcccctctgaacagccctggcctgccgaccgtcgctggagagcagcctcagcaaactccagaaaaccctttcacctggaaggtatggcttccaagttggatggcctctgggaaacagaaagattagaaacgcttccttggagttgaaaaacaagtacctaaccatctgggagggctaggg

SEQ ID NO: 45646 - DNA, 1328 bp, Bovine  19866880826400
ggataaaatatgtattgccccatttttttcttttgaatggggaagtattgattggattatttttaatccagaggaaatacttaacttgcaaagatgtccttgattatcctataatggcttagcttgaggcagcagctcatatatattaaagagaccttctatggaagagaaagaggagaggcagagaaatccagggaatggggaggagagtgggggtggggagagagagaaagagaggacactgcaaggaatacaatccctctgagactcccaggacacacgggacagtgggcttcaggcttcataaagaatgtgcagtgtactcaagcttccttttttttctcctttttgattttaaaggaaagagtgacctcctaggagaaagacttgggaactgacatcccaagcagacacttggattgcatcacaagttttctatgaaatggaagggtttttatcatgccacacacattcctgccacaaagaaacctcaggtcctgatggacactctctgcagaggctgagactgccttctttcttatatatccagctgttctttagacactgtctttagtgctccccaaggaataagccacaagtactccatcataagaaagacaggtttacaatagctggggagaacagtttaatttagctccaaggaaagggccagagttgtcaaaggagaattgaggacaccccctgctcttcccagcctttatattctgtgattctgaggaagagaggggccaaaccccggttttgtgccttgatgaataaaatggcctggctgggtgtcagctggcctgccaaatctggcagctggcaaggaagaaacagagaacttccaaggaactagctccatttgcatgtataatgtgttcatatatgctgtgtgcatatagattgtataacatccatgacataaagaggaagatttgggattcttggggggaaaaagctcagaaacagacacaaatcaggatatagattctcacatgcagggtgacctcagccaccagaggacatttagaaagtaggaaggcacacatgaggacaaaggaagccattcccacagtcagggccctgacctaaagctcagggagctttagggcagttgcctggcaacaggagagacctagtagggatgctggggggatcatttctcatgggggagctgagccctaaggagctaaatcccatttcactgaagcatttggttgcacagaataggtttgccaacacttactggggcaaaatgtgatgacaaaagctcacagctaggagaagagaggtgacatggtcccaaatgcctgcagaaacagcaa

SEQ ID NO: 45647 - DNA, 2784 bp, Bovine  19866880886053
tactttgccacaaggtccatctagtcaagttatggtttttccgtagtcacgtatagatatgagagttggaccataaagaaagctgagcactgaagaattgatggttttgaactgtggtgttggaaaagactcttgaaggagatccaaccagtccatcctaaaggaaatcagtcatgaatattcattggaaggactgatgctgaagctgaagctccaatactttgaccacctgatgcaaagaactgactcattggaaaagaccctgatgctgggaaagactgaatgtgggaggagaaggggacaacaaggatgagatggttggatgacatcattgacttgatggatatgagtttgagcaagctccaggagttggtgatggacagagaagcctgacatgctgcagtccatggggtcacaaagggtcagacacgagtgagcaactgaactgaatctaattaatattagcacatatatagggctgccatctatggggtcacacagagttggacacgactgaagtgacttaccagcagcagcagcagcagttttaaaaagcctttgtagaaatttaatacatactattttttattttaaatgatctatgcatgtaagtcagattaaaaatatggttatgtagaattttaaatattaggaaaaattaagaaggttaatagattttgaagtcttaggatgtgacagggttatacatgccatggcagcaaatttttggttttccttaacaacttaaatgttataattcagatctgtaaacttaatttcttttcctttttttgtgtgtttgggtgggggcgggggggatactgttaatatccttgccttctatttgttttccacagtaatattcctatcaaagtaatgtacatgcatttaaaaataggaaaaaaacaaacagaaaagaataaaagtcatccataatcccagaatctagagataacctcttgttaacattttagattttttcttcttttctatatatccatagaagtatatacatttcttttgtattcctgagatcatagttttattttataatctctctttatttaataaaatatcatcaacattgtctttcatcattaaatattttttaatggtatgattttttttcaccagttttattgagatataattgacatatagcattgtagtagttttaggtgtacaacatagtgatttggtatgttgcaaaatgatcaccacaataagtttaggtcttacattcaagtctttaacccattttgatttggggggatgtggtggtaggatagaggtccagtttcattctgttttcatgtggctgtccagttttcccaacaccacttattgaagagactgttctttctacatcatatattcttggctcctaattaattgaccatatatgcatgagtttacttctgggctttttactctgttccattggtctctatgtctgtttttatgctgagtaccatactgttttgattactttggctttgtaatatagttggacatcaggaagtgtgatacctccagtcttattgttctttctaaagattgctttggctatttggagtctcttgtggccctgtacacattttaggattgttctatttatgtgaagaatgtcattgaaattttgatagggattttattgactcagtagattactttgggtagtatggatattttaactattaactcttccagttcatgggtatgaaatatatttacatttatttgtgtcatcttcagtatctttcattaacattctgtagttttcagtgtacaactctcacctctttggttaaatttacttccagatattttatcctttttgctataattgtaaatgagattgttttcttaatttttcttttgatagtttattattagtatatagaaacaactaattttagttatcatctgcaaaaagagacagttttacatctttctttccgattttgatgccttttatttctttttcttgcctaattgctctggctaggatttccagtactatgttgaataaaagtggcgagagtgggcatccttgtcttgttcctgattttagaggaaaagctttcagtttttcaccattgagaaatgatgttagctgtgagcttgtcatatgtggcctttattatgttgaggtacgttccctctatacccagtttgttgagagtttttaatccttttcccttttcaaaaaaatttttaaatggagaggatatttagaaatgtactatattgttgggcaataaagatatttattgacaaaatccttagtactttgcaactgtaaaatgtggtaaaatgatttaaaaaaatagtatctttaattcatatttttaaaagcacgagtaaatttatgaatagagcattttgcaagtaaactctttgaagattaagtattttaatgcttgcatgaatttcattaaaagctgtttcatgagaattatagtacttatattatttggaagaatatattaagaggagccagaactggtaacttatcatttgacagacaatccagtgttgtatgacaaagacaacttatgggagaagtcatttttaaaatattttcttgcacaatttataaaattcatattttatagaaaataccatattgtccaaaaatcccttaattcaccacatacctgggaaattttagctctttatttatctttccttcaaatttatttaacagctttttaaaaacttaaaaaaaaaatttattacagacaagttgcaagaattgtgcaaagagctcctgaatctctt

SEQ ID NO: 45648 - DNA, 1192 bp, Bovine  19866880996695
ctgcagggctcccatcagcacactccggtgtggtcatcacctgcccccagttcccctgctttcctgtctaagtcccacgaagcaataaacagtggaggcacctgccgcatagctgccgcttggcacagcctgcctgattctgagccagagtcagagagagcgagagtctgcccagccacctcctctgggcaggccacctgcctggccacccactccctttggcttagctgcacccctgtggccatagggaggggtcataatgacccttcccttgcaaccatgtgggtgggggtgggagggaagtttcccaaagaaagggggtgtcaggccccaaacccaccggaactcaagtctcctggccagcctgccaaaagtgtgtgtgatcagtattctgagacctaggaccaggagtggagaaggggatcataggactgctgcaaggatggcactgatttccagctcaggaagatgtcagattctgtgcttcgggctcttaactgtgatgcttcctgtttggtatcaggtgcctcagtccggaaccctgaagctgtcccacctgcgggaaggagcatacacctttcagttgactgtgatggacaccgccgggcagaggagctccgacaacgtctcagtgaccgtgcttcccgtggccttctccacagtaggtgagaagaaagcccttccctcgcattcacagtggccaacagaggccaggctgtggatggaagggtggtgttaaactggcattttaggggcttccctggcatccagtggttgaggcttcgtcttccagggcagggattgcaggttccatccctggccagggagctatgatgcccacatgccttgagggcaaaacaccaaaacacagaacagaagcaagggcttccctggtggctcagtggtaaagaacccatctgccaatgcaggggacacgggttctatccctggtccgggaagattcccacatgcggcggagcaactaaggtgtgcccaggagccacaactacccagcacacggcagcaactactgaagcctgcacgccccggagtccgtgctccgcaacaagagaggccactgcgatgaggagccctcataccacggctagagaaaaagcccgagcagcagtgaagacccggcccagtcaaaaataagtaaatagaattatttttaaaaaaccagaagcaatat

SEQ ID NO: 45649 - DNA, 758 bp, Bovine  19866881059414
aactgtatttacaacacaggaacgctagtgcagaaccatgggcaccaaacgaccccccacgtatgactttagatgtgacattgaccacaaaagggcatagatggatgcaaaaataaaataccaaccagtagcctgaattccttctcctagtgataaaactgcctgcactgagcttctaatagaaagagacgggtgaaagacgagtagaaattagctgccccacccccattcttgaggtgcaatctggcatttagctggaggcagctactgtaaaaagatttgtggcagtgactgtgaaagagaaatgaaacgtcagggtttcctccccggcggggccccagtgggtcagtgcagatggcaccccaccatgcagtgtgctgaaaatacgtattaaaggctgttttatggacttagcaaactatgctgcttgaacataatggaatacaagctagctaataagatgctgtgtgaaaatgttgattaatatggatacagcatttgaaataatgcaaattaaaaaaaaaacaaacccacccagaactcaaaatagcatgaacacactaatgatagctccataatacatggatccatttttaaatatttgaaagagtgtttggagtatagttaatagagtttacgagattggaaatcttagttcatggttaattttaaaggaattctggagaatggtcttctttgggcaaattggtgatacacgttccattaaattaattctgctggtcccaggccagctggat

SEQ ID NO: 45650 - DNA, 839 bp, Bovine  19866881330364
acttctgacaaaatgtggtcccctggaaaagggaatggcaaccatttcagtgttcttgcctcaagaaccccataagcagtatgaaaagacagtaaagaaatgtattgaaaacacgtattcaactgcaaacaggagacagttgttgccatcaaaggacttccaattatgtggatgcctccattctcctcctataatgcatagggttcctttaccttctctttctctcttacctaatttaaatggatgatggcgtcctattcctctttccccatctatgcaaatatttgttggaatgaatgaataaatgaatattcttgccctccacaagtctttccacagtttgccccaaggattctttcaaaaaggaaaaacccttctgtgatcattttttcctcaaccataaagtgatgctttagagaccaaatcacactctggtctccttttttctcagcttttacgcagtggaacagatttccaaaatgccagtgctgactaagaaaaacctggtgaaaatttattggcctgaacttttaagcagaggcaggaatcctggctttcattccttgttccatcaagacatgtgtgagcctgttgctctgaatgttatctgccgctggaaaagccctcacttcttcccagtacagcaagcatctccactcccaaagaagtgaacaattactgtgcaaacaaagtaatattattgtacataataaaaaattaaaattacagagaagaatggcagtaatgtgtgattactccctttgaagacttttatgacccgggcattaatgccttattccatcatgatactcttttaattcacagtttcaaaaaactgt

SEQ ID NO: 45651 - DNA, 947 bp, Bovine  19866880349804
ttatgaaccgctgcagaccagggaagagaggcagtcacagtttggatgatattctggtggacacgaaactgtacatattttcccttctttgttctaacttcccttttctatccatcctcggggcttcccgggtggctcagtggagacatgggttcgatccctgggtcgggaagatgccctggaggaggaaatggcaacccactccagtaatcttgcctgggaaatcccaggaacagaggagcctggcaggctatagtccatggggtcgcaaagagtgggacacaactttgcgactcaacaacaatgaaaatccatcctcaaattatctatgactaaaaaagcgacatggatccagatggatatatactggattctgaatatatactttcatctggggaagatatgagagaagagataatatgtctttgtggaggtcacattcagtggtgttttctactaataaacaggaaggggtgggattactgcattaatatactctcgtgtgatcactacatacataatttaaaaaagaaagatgggggacttccctgatggtccagcagttaagacttcgctttccaatgcagggtgtgcgggttccatccctggtcaggaagctaatatcccacatgccccatggtcaaaaaaaaaaaacaaccataaagtagaagcaatattgtaacaaattccataaagactttaaaatggtacacctcaaaaaaaaaaaaaaatcctaaatacataaaacgaaagctagactagctgtagttgccggcggggagacgcacctcagaggcaggagaacacagtagcgcacgatgacgcccagcacccacaccatggtgagccgcggactgacgtactggaaattcacattggtccttgtgaggaggttccatgacactagctcctctgaggagaacctctgggtcacttcgtcttccaca

SEQ ID NO: 45652 - DNA, 1099 bp, Bovine  19866880675520
agttttgtcctaactgcctcggtgggaccttgagaattgaactgtgctcgtatttcagaacatagtatgttgctgtggaaggaacaccctggagctttgtgttgtttcataggagagcccagagctgtttaataaaatgttttctgtctctttcagactcaaaaacttcctgagtgaagtggtccacctgacttgctgccgcatctgtgttcgcgccctctctggaaccattcactatcataacaggtgcgtgtgttccgctttcgtgcctgcttcctcaggtcagtctcgcatgtgattgtcaggagtgggtgggggaaaacaagggaaggaagagtacttccggagtgttcatctctaccgtgtagagcgtcacagacgtaacaatgcacctgaacacttttcgaaggcaatccagggacttccctggtggtccagtggttaagaatccaccttctaatgtatgggcgggccttcagtccctggtgaactaagatctcgcatcccgcagggcaactaagcccgcacaccacaactagagaagcccaagtgctgtaacaaacacccagcacagcgcctccccttcccctcaaaacagcaatccatttgcagaaagtgaaagtgaagtcactcagtccaactctttgcgaccccgtggactgtagcctaccaggctcctccctccatgggattctccaggcagtactggagtgggttgccatttccttctccaggggatcttctggacccagggatcgaacccgggtctcctgctttgcaggcagacgctttaacctctgagtctagggaagccccatggaacatgatgataaacatgtaatgacacctaataattgggcgtttgtggtgtgcaggcctggcctgtgattctttctcctaggtcatctctaagagaaggcgctattataccgttttacaggtgaagcagtggaagctccaggattggttgtctagggtcatatgcctaataaatgtcagttaggtttagaatgggggttaattaaaaattttttttttaatggtgaaggtgatagggctgtaaaaatgatggaaagaaggctagacatggaattctgag

SEQ ID NO: 45653 - DNA, 1174 bp, Bovine  19866880819944
ctgtcttctgtaagaggatctagcggggttgtatctcctctctaatagcatcattgtggcacttggtttaaaaagtgctatgagattactcctttatagcaatattatagtctagactctaaagagatgctatttttctttctaaaatgtgccatattttttcatataaaggagaaagcaactggtatcaaacagggaccaggcttgtaggttttctctgagatgcaaaggaatgcagatcgggtgtgaaacaatgttggaatgccaatcagtgggcatgtcttacagtcacattctactgccacctatttctatgaccttggccaagtcccttcacatctcacagcttgtctcctcacttttaaagcaagggatttgagcaaaatggctttgaggtttcttttgattttaactgttctttgacgctttgtcatctaaaccaaagcttgtgtaggctgggatggaggcttaatttatttcccctgcttaaatacgggaaatgatgtgcaatttcaacaatgtatggactgtcatctctcttttgagattctctgtggagttatactagaaagagagggtttgggaatttgcagcataatttgttatctacaaatttagtatccacaatttcttctttatatttcggcctggcctttgtagttagcatcctgatctgaattcatgttaataataatagtaatagtaataataatggaagaatcctttccatctctccttacttttttttccttcactctgcaattgttttttttaacttctatctcacctcataaaacaatgaacattttccaatttatcgaaacagttgctctgtagaagaccagcatgctccgatgactctcagtatcattatatcttcatcaaccccacagagaagagtgtgctggtgtgtgtttgtgtgtgtgagtgagcatccacgcagagttgagaagcatgaggtaggcagaggaatgattaggtggttgggcttcaaagagaacatttgtagattctatctggaacacattttattaaaattgcaacaaactttataaaatcagatgtatggttcattaagggaacattaccttacaattatgattaattagattaaacttatgaaagtgtgttatttgttcaaaccaaagggtgggggaagatgatggatgatgaa

SEQ ID NO: 45654 - DNA, 1073 bp, Bovine  19866880831775
tcactgtcagttacatggctagaaccaagatctagggctgtggttcttaacggggtggcggtggtggccagcttgcctgcaggggacgtttgggtaatgtctggaggcacttttggttgggaaagggtaccactagcgtctagtgagtaaaagaccagggatgccgctaaacaatcctaaaatgcacatcacagcccttcacagaattcaaagaagtctctgaattattaagttcaaaatgtcattagagatgaggttgaaaaactctggtctaggatgagttatgaatttaagaatggcaaatcagtgaacaagtgaagatgaaatttaaggtgaattacaaggctgacattataaaaatcagtctaaattatatttttaaagagacacaacaaacacgtctaccaatattatgccaaatgaaccctaaactcaacaacctgactattacactagcaactttaagtagaatatagtgtaaattgggttagtcttggatcccaaccaaagcaatgtaattctgaagtaccagaataattgtgctcagttaaaatcattttcataacatattccctcaggagttgattcattaaattacagtgaggtttttaggaggtgttatgatcactacttttccacagaggggaattggaagggtaggctttgatcttatggctgaattagaaacagaactggaaccataattcagcttctctgagtgtatggcttgattctcccagttaaaccagctctcttttccaggctgggaggccgtcccctctcctgtgaggagatagtctctattaatgcaaattgtctaggaaaagaatgtcttgaaggtgaaggaaggtggtagagccttgagtcatattaaactattcaaaagaggagtttagaggaagaaactgtcacacttgtctgagttctgacatgaaaatacatttcggggctaagacaattcatctgtcaggcttcctgttggaataatatttactcagctgtgagaagacagcttcagtgaacatccaagataatgaaagtttgataatactcattttctggaaataaccctg

SEQ ID NO: 45655 - DNA, 1487 bp, Bovine  19866880992570
aggcaggatactagtcttggtctcataactccctggcacaatatcaccatgctatgagtgtctgcagagaagagaaggggctaggggagcaaactgggtgtcttctttactttgagcaagggtgctggcacccagtcacttactgagtttcatggtaataatacaagctagagagtcagcattctgattcatcattccctgggcccatgcccattcaccttacatctgagtaataatgtctccctgtgagaccatgctgtcattctcctaggagtccttgaatactctctatggtcttgtgggaaatgaagggttaggagtcgcttttccatagaagatgcagagtggctaatttccttctttcctcccccacacacccatttcaaactcatccatcagatctcaggaaagtacaatacgtgaaacaacaagaataaaagcctttatattaaattccttgtgggtgagctttgcagataaagcagaacaatctgatcttagcaagttaaatggtttgcaaatcacaatgtgctgcacccttcagatgcatccttatgtaaaataaatcacctagtattatcataacagtattggggaaatttgcaagtccagtggaggaagagggtttgcttcagaaaacatgcatatatttataagtattttttatatatgaatttataccaggggtctcaagccatttggtaagagacaaataatgtttcatttacctaaactcataatagcttgataagaatatggagaccagggaaagggaaactagaatgtagaggaagggaagggaggaatagaggatgtcttcactgagttcttgagtttatagaatcagagacaaggacagaaaaagatggtttgtcactccctatggaaatcaagggaaagtaagcttcacagaaagatcataggacaggataaagctatacgatattttgttgatattgccctgttgattgcagacaaaatattttatgtgtatttatacttcttcttcttattattattattataattattccagtggtcatgtatggatgtgagagttggagtataaagaaagctgagcacagaagaatttgatgcttttgaactgtggtgttggagaagactcttgagagtcccttggactgcaaggagatccaaccagtccatcctaaaggagatcagtcctagatgttcattggaaggactgatgttgaagctgaaactccaatactttggccacctgatgagaagagctgactcactagaaaagcccctggtgctgggaaagattgagggcaggaggagaaggggacaacagaggatgagatggttggatgacatcactgacttgatggacgtggatttgggtggactccaggagttagtgatggacagggaggcctggcgtgctgtgattcatggggttgcagagtgggacatgactgagtgactgaactgaactgaatacacattatacaactgcaaaa

SEQ ID NO: 45656 - DNA, 1321 bp, Bovine  19866881124218
gcaagtctattttcctcctttggcaagcagacgaggaaggtgtggtggaagttatatattaagaaaaaagtaagtgcactgtagtgcatacttgaaagcctttctgtgataaaaggacggaacttagctcaggaaagtcacagtgtcaagcttaaatgctttctctactggtgtgcttcagcagggacaaaaagcacataacctgggaagctggtctggcaattatattactgacagagagttttatgagacaatatcagaggggaaatgcactgaggctgtgtcaaaccacaggctgcacaaaaagaaaaaaaaaaggggggggatcatagaaacaggggcaaataaagttggcaatgaagagggcattgatttaattgttcaacctttcctttcaactgcacagatacgtggagcaaaacgccccgtcctatctcccgaagtcacctgatgcttaacgagagaaccaggaccttgaagacgaggtcaggcagaagagggcaccagtctcccagggagaagccaggactcgtcagtaacgggtgagatatagtgtataacccctcaaatgatgtatttcagccttccactgagtctgaaatggcaggtggcaaagctttgaccccaaaagaaaacaatttgcactgttcgcgcctgtgggagaattcatggaagaatggttacttttgcttcaagctttgtaggcagcataaaagatcactgggaatagatgcatgggaagaggaaatctgtgtttggtgggcagctcagtgcacggagccttggggacctgaaggctgtgaattctaattctggctctgctgctaatttcccctgggacttgaaaggatgtacttcatatctgagagtgtcaatttctttcccagaagaggtgggcatgaaccttatccataaatgattatgaagcaagtgtttcatttaagtccccagagcagcctattccatggagttattctcaagagcagcaaattaaaataatcctaatacaatgaagctagaaaaaccaaaatattaatgtgatggaagatacacattttactcaagtctaatcttttgagtttccctggtggctcagatggtaaagaatctgacttcaatgcaagagacctgagtttgatacctgggttgggaagatcccctggaaaaagggcatggcaacccattcagtattcttgcctggaaaattccatggacagaggagtctgccaggctacagtccagagggttgcaaagagtaggacacaactgagcgactaacactttcactttcaatcttaaaagggcggcaatttccccccaa

SEQ ID NO: 45657 - DNA, 1134 bp, Bovine  19866881493234
ttataatgtgagctattgaaaaatacccaaatttgaaaaatccatttggcttagagaggataggaatgcggaggaggacaaaataggtgaaggagattaagagtaccaacttccagttacaaaacaagtaagccatgggatgtaatgtaccgcacagggaatatagtcaattaatgttgcattaactttgtatggtgagcagacaaatactaaatgtatagtggtaatcaattcataatgtatataagtgatgaatcatcatattgtacacctgaaactaacataacattgtattcaactataattaaaaaattaaaagtaaaaaataaatccaataggcttttggtttctatcattcaaaccattaaagtttgcagttctatttctaatacttggctaaaactgtaaattataccattatacattgaagttgtaatgataattacatattatcaagaagcacggaaaaatgctaagaaaattctgaggcctacagtcacaaatgagtcatactcaatctttgttgactaagacacagaatgagtactgtctcagaaacacaaaatcattattaggcaagttggttacgaaatttacaaagatagtactgtaggaaaacagctgctttctccgctaaacatctcagccctaacctctttggattacagggaggtcacaatggatgtgaaaggtcacaaaagattacaatggatatgacagtgcttgtccacttaaatgaaaagaattattatatacacccagagttggatggggtctatcaaggactgttagcatgagggtctctggatgggctttttggaatccataaacatcttggaactacataaaaatacttgttggtataaagcaaatgcatgctattgtttttctgaaaaaaaggatacataaatattaactgattgctaacctaataaatgtcaagaactaccaattcccataagtcttttcagagaggtggttaaagcttccttagattcaggaagagctccacaacttagagaaatgtataacttgttaaaaggtagttgtccaagagttatatatctgaccttatattttagacaatgtctgccaataaaaaaatagtttttacaaaggtcttcaaacccccgt

SEQ ID NO: 45658 - DNA, 1242 bp, Bovine  19866880462074
tggggatcaagcgtggaggttgaatgagtttgttccgtgtccccatcccagaggagctgagaaggcttatgtgacaggaataaggtttaagtagttttacttcttggtctgcaccatggaatgaccgcagtgacattctcccagggccatgtgaggaatgcaaagaggttggataagggaactacctgcagcagctctgggcagtgactgaccaatgaggtggttgtccgggaaattggttcccaatgtacccccatctactgccccttctgcaagtttcaggttggagcattaatggtaaccatccccaggcaagaaaagttctgctggacttagagggagcttgtacactgggaaagcctggtgctgggatgataacattagaagaaggggccacagagaagaggcagaaaagaataaagttccagcagacagtgttggcagctgccagcaaccctcaaaagggcccctcctcttggcacctgtgtccttactggccctgaaactcactaaaggtttgccctggggaattccctggtggtgcagtggttgggactccatgctctcactgccaaggtccaggttcaatccctggttagggaactaagagcccacaggctgtgctgtgcaaccaaaaaaaaaaaaaagacttatcctgggccagttggcagctacctactaaggactagccttgaatggagccaccttattgacaagcgtgggcagagcttgtggcctcaggccagtggggtcaagaggtcagacaggccatgcgaggcagcacgtagcgccccaccccctccacctctggcttcccggacctgccacctactgccaggatggggacagacccggggaagtacggggctcccaggaaaataggaaagaccaagagccaggttgtggtttcagttcttgccagtgaggttgaaaaatacacaagacttggacccagtgagaaccaggggccagcccccattccatcttcatggctcccaccaccctccttgtccagtggactctgctgtcatggagtccccatgagacccggagaattcatgtcttccccctaaattctccagtccatcctgtccctgtttggtacatgtaaaaggaggtatccatcctccagctggtcccggcactgcggctgggcagcatgccaagatgagtctcagtgtctctgcagcatggtgctgcccccaagtttaggttgaactctaattcctccagctttggggc

SEQ ID NO: 45659 - DNA, 2805 bp, Bovine  19866880550711
cctccctccccgtgtctgacagtcccccacctgtccctgctgtcccccaggcactgtgtgtctgacctgtgcggcacccgcgaccccaaggagcaggaggagctgcgttgccaggtcctcagcgggtacgccagcatctgccaggaggcgggcgccaccccggccagctggcgggaccacacccactgcggtgaggccctgacctgccccagcagctggcccctgaccccctcagctctttccactccctgttctgctctgagcccccacagctgcccccaccttggctttccctcttggttcccccagccctagactctcccccttgtcaatgtcctcctgaccaaaccccttccctgccctaacccccatcacccctgcccactcctttctgccaaggcccacctttgatcctcctcatgagttagtgccacagacaaaaagactcacgaagccggtcctccctgcctctagcaaactctgtgctctgttgggtgaccttcttctccatacctggaggggcctacccctgctcagccactttctgactatgactgtgtcctctcagccttgtcatgtccagccaatactgtctaccagagctgtatgacaccctgcccggcctcctgtgccacgctggcagccccccggggctgcaagggcccatgtgtggagggctgtgccagcctcccgggctatgtctacagcggagcccagagcctccccctggcccactgcggctgcaccgagaacggcatctactaccaggtcagggctagaagtgggagaccccaggggagcgcaggggtgaaaggacagcccaaccctggaggtcaagcaggtgcccctgcttcccgggccttttccctctccagcagggggacagctttgtgaatgacgactgctcccagcgctgcacctgcgcgcgcacggggttcctgctatgtgagcccctcggctgcagccctggggaggtctgcacgctggggaacctcactcgtggctgcttccgaggtgagccgggatgggccctcagcttccagctgccctcatcccctgtaggggcaggggaagggggaagtccctggacttggaacaaaccagccctttcagtcctgggaagagcccatctcatcaagatcaggacgctgctgccatttcatttctctctctctctctctctctcgggagggacaaggcagaggccctgtcttctgagcctctgctctctgctctgcattcgtgtctcaagatctcctttagtccttaatcagcacttggggtggtgagcatagcattcccacattatagggtaaagaaaatggagttcagaagagggtaagcagtttccccagatctcgggggtatagaaccaggactggaagcctggtcagcggaccccagcaaatgtctctgggagaaattcttccctggtgtcccagcccccaggcccctcttcctggctctgagtgtcctcccagaaccccctcccacttgcttccatccttgcagacagcccgtgcctacagaacccctgtcagaatgatgggcggtgctgggagcagggaacgcacttcacctgtgagtgtgaacctggttacgggggagaccgttgcatggagctgcaggatgtacctccccctgaaaagccaggcaagaacttcaccccagacctgtatcctcacaagctcctctcaccttccaccccaacaatggccacagaataagtccgtgtatataatattaacctgctgctgctgctgctaagtcacttcagtcgtgtccaactctgtgcgaccctgtagacagaagcccaccaggctccctggtccctgggattctccaggcaagaacactggagtgggttgccatttcctcctcaatgcatgaaagtgaaaagtgaaagtgaagtcgctcagtcgtgtccaactcctagcgaccccatggacttcagcctaccaggctcctccgtccatgggattttccaggcaaaagtactggagtggggtgccattgccttctccaatattaacctacagtatctattatagatgtatgcgtgtgtatgtgtgtcttagttgctcagttgtgtccaactctttgtgaccccatggattatagctcaccaggctcctctgtccatgggattcttcaggcaagaatactggggtgggttgccattcccttctccaggggatcttcccaactcagggatcgaacctgggtgtccctcattacaggcagattctttaccctctgagccaccaaggaagcccatagatgtatagtagatagtatattatcaatgtcttatattactatatgagatataataatataatatttggatatgatccctaaagattagcaagatcagtatcttcaaagaatctcagagtccctatgccctacccagcactctggaatcttctctctgaccctgagctccccacttctgtgatctgtatgcctcaccctgttgttgttcccctctcttgtgccctcttagcctccctggtactgtttattagttttctccatcccaaattataattcccatgtgcctctgcaccagcaattctccaactgtgattgtgcctaagatcagggtgggggaaggttgtctctgggactcagccccagagacatggatttggtaggtctccgtggggcctcaagatgcctgcatttcacaagctcccaggtgactgatggaagtgataccagggctactcttggagaagcactgacccagctgataccctggactctgggggaccagctgggtgaacatcctcctgaagg

SEQ ID NO: 45660 - DNA, 2740 bp, Bovine  19866880683039
gatcctaccatatagcacagggaactatattcaatatcttatgataaaccataatggaaaagaatacgaaaaagaatatatgtataactgaatcactttgctgtgcagctacaaagtattccttcatataaataatatttcttaatacaatccaaccatccatctggcaaacatttgcgtgcatactaagtcatttcattcacgtctgactttttgcaaccctgtggactgtagcccgccaggctcttctgtccatgggattctccaggcaagaatactggactgggttgccatgtcctcctctaggggatcttcctgatccagggattgaatccacatcgcttgcatctgttaggtctcctgtactggcaagcagattctttaccactagcaccacctgggaagcccagcaaacatttaggtaaccttgacttttccttcctattgtaaatgatgctgcaattgacatctttaaggcatgtacatctttgtgaaaatacacacatatttctgcaggtaaaatcctagaaagataaattggatccaagataaacacatttgaaagttgaatagtcattgtcaaattaccttctaagacgctttctcgaacatagtcatcaatgtatttcagtgtgtacagtacctgtaccgtgaccaacgctcaatgcttcaatcctttgaactgttgccaacatgaaaattgtagtcttgatcagcatttcccttatgacaacggaagcagaacctcttttccaatgtttcctggctccttgtaggtcttcctctgtgacttgtctttttcaattctttgcgaagaagcattttcagtcctcacttcactccatctttctgttgccttcgcccctgttgccagctgtgtagaactttaggtttgaaatggttggaattctgcagacagtgttccactggatctcagaatccatggttactattgaaaattctggtgccatgctgattcctgatctttagtacgtgacctgcttttttctgtctgaaagtgtttgggaatgttctcttcagccctgacagtctgagatttcatgacacacctttcatgggtctctttgcatttgtcggaatggaccccttttaatcaagagactcattagtcagttctggggaatcttcttctgtgttttttcttaagtaatttcttttcctttgttatttcttttctggactctcctggctgaatgtcagtcatcctggactgagtctctctctcgcttttctccctctctttctttccctctctcgttcttattttatttctcttgatttcaacatttaactcttctgtaagggtttaggcttcggttctcgtagttttcatttcccagagcattcttgtgttctctgtgcagttttcatggcttcctcagaaggacgccaagcgaggaggggcagggggggataaggtggcctgggctcctcactctggcttcctcctctccccgagagccgcctctgaggtcccgcatggctcctccagtctggactctggtgctgctcctgggggctgcctggggccaggaccacatgcctgccccaacccggtaagctgggctcagggggtatttgggggtgcctctgaggaagagaacgaggggcaaagctggaaaggacaagcgggctggtgatgaatggtgtggccccggggaggaaggagggaccccctgatggatgttaggaggctcggaacagaagcaggcggggccctgcagcctgctgagactggacctgggggtgtgagccgctgagcagaagcaggacagaggtgaagtgtgaggggacagggaggaggtgcagagctcgggagacgggtctgggggtggcaggggaggacagagagggtgggttctcaagaaaatggacaaaacccaaggcagagccagtggacagagacacagcaagtaggaagcagcaacaggtgatggatggcttggtgtcctggagcttgtttgagaggattttttttttttaacatttatccatttggctgtgttgggtcttagttgtggcactcgggattttcgttgcgtcatgtgggctcagtcactgtggcatgtggactcggtcgttgctgcacgcaggcatggttgccccacggcatgtgggatctatttccccaaccagggatcgaaccctagtcccctgcattgaaacgcagattcttagccactaaaccaccgggaagttccatgtttgaagggatgtgaacaagcaggacttgaactactaaaacaaacagctgttctacgtggcccacgccacctgggaaaggccactggcttctctgtggaatctgtaagggtcactggtctgtgtgttcagtcagggcaggaccgtccccgccacacatctggcaataccagacccatatggtccctactccttggagaaaacttgggcaacagcacaggaaaaccttgacctgaaagaaagagatgcctccgatgtaaactctcagatgtaaactctcaaactctcagaattcctgcacagagaaactggctcttctcatgttagagaaccacgcgtgacatccagggcacagggggtagagggagccagaggggacatgaggaacttggaggggagatgcttttcaggagacagatgacaaggtgagaaggctgtgagtgacctttttgaaaaccctcaagtaagtgtatgttccctgcatacacgttgatacaataggataaaaagaaaggac

SEQ ID NO: 45661 - DNA, 1119 bp, Bovine  19866880772552
attcttgtagcactgtgtcctaggggggtctgctctctggggcccctctactccctggagctctgacgaccacttgcctgtggcatttctgcgggtctgagaccagatgagtcttattttgcagggtagggggctgagggaggcggagccgctaatgctttgcttggggcttgcagataaaaggacagcttcccaggtcagccgcccccaggtctccttcccttcctcctccagctcccacccaggcaggggtggggccccagaggcgagatgacagagccaggcctagaggagccgtggtgttttatttttcgaattattaactacgatgacagtagtcctcctctcgtgcccttagcgctcccttcactctgaaccctgtcaggggaggaagccatgggcataggctgaccagtgctcccctgtgggaacaactccccagtgcccagctagctgatgctgttctcctcgtggtcggaagcactgtggggaaagcagggcaaaggtggggggtgaggcacagaatggtgatcagacaggccgaggaggccctgggggaccagcgtgccctggctcgggccagcacccctttctccatgttctcgcttccccagcttcctgccacgttctgggcacttaggatgaatcatttcacctatagacttacacacgcccaactgccgtcaagcactttagttagctgtggtgtcatgtttggataccagtgttttatatttatacatagagaattttctaatatagcctattatctatctatctatatatatgcacacacacatatccacacacagccattctcccctcccagacagctcttccacatgggaatgggatgaacccctatcggggccttgactgcagagccggagctccaggggctgggggagggagccacatgtcccgatcaccccagggcctgagctttttcaggaaaaggctttgtgcaattggttgggttggttttttcctttttttttccccatgtgcctcccctcctttccctgccccccaaatcgctgcaccaaagctgttgcgggcaatgttgggaaagaactgcatttaaaaaaaaaaaaatggctctcgtggtcttgctttggg

SEQ ID NO: 45662 - DNA, 709 bp, Bovine  19866880790056
tacctttttggcttctttctcagagtcttccttcttctcttctttgtccccatcaccttcagatttcttaattttgtcatcactggaactctcattttcagcctataggtagagacaaatcaccaggaacatcattctctccttcagcctttttcagagagccctgccaactctccagcagctcagtccacaagtttgcctctcgcccacccaatacccaacaccctaaagtggctccatttcccgccctccaggcctcacagacagcgccagaagccccagcactgagacctgtttgccatcttctttcttgtcatccttttcgttggccttgcgctctccatcacccaggcctggtccgacccggctttcctctttcttgttgggctccccaggctttcctgcctgctcctcctcctcctcctgctccaggatccgcagatcattctctgtacctccttccatcttaatcacagctatcaacacagggagcagaggtcacattccaagggtcctggccttctgcctctggctttctgtcaattttcatcttcagccaagaccctggtcaccagacaagtccacccctcccaatccacacacctgcatccagcatcttgacaatggcgtcagctttgtctatgtccagcagaagattatcaaaccagccactctccatgagggacaggaacacccttagtcggttttg

SEQ ID NO: 45663 - DNA, 1799 bp, Bovine  19866880837732
ccccttgaggccgaatggaggggcgcttcctcccccgccgctcccagggtccccctatgggggccccactccggcctcctatgctacggccagcacccccgccggccctgccttccctgtgcaagtcaaagtggcacaacccctgagaggctgcggccctcccaggcggggggcctctcaggcctccgggccctccccgggcccccattttcctctcccaggccgaggtgaagtctggggggctggctacaagagccaccgcgagccagggcggggggttaaggaggaggccccgggggtctccggccctgcaggcgaaagaggaggctggtatgggtcccaggtccctctgagccagcctcccgagaaggagcttgagaggctgaccaagaagctggtgcacgacatgaaccacccgcccagctgggagtacttcggccgctgtggtggctgcggagaagacgtggtcggggacggggtcggggccgtggccctggatcgcgtcttccacgtgggctgctttgtgtgttctgcgtgcggggcccagctccggggccagcatttctacgccgtggagaggagggcgtattgtgagagctgctatgtggccaccctggagaagtgctccacgtgctcccagcccatcctggaccagattctgcgggctatggggaaggcctaccacccgggctgcttcacctgtgtggtgtgacaccgcggcttggacggcattcctttcactgtggatgccacgagccagatccactgcatcgaggacttccacaggaagtttgccccaagatgctcagtatgtggtggggccatcatgcctgagccaggtcaggaggagaccctgcgaatcgtagctctggatctcagttttcacattggctgttacaagtgtgaggagggtgggctgctgctgtcctctgagggtgagtgtcagggctgctacccactggatgggcacatcttgtgcaagacctgcactgcctggcagatccaggagctctcggccaccgtcaccaccgactgctgagtctccccaggagcacctgctgtgccctcccttcccatccaccaccttccccaacaactacctttataactttgtcaccaaatgttgtctcctcgttctccagtcatgaaataacaaccctgccagagtttacaaaaaaaaagacaaattcaaggagagcttgccaattactacctagttttagctgctatcatataataatatgatgcttacaaaggagatagcatggaaatcctaaggatggaagagtggaaagtcagaattaagttgggccttatgatgttgttaggttatgactgtaaccaacccttgaacttttcaatatgtaagacaaatgaactccttttgttaagtcactttgggtcaggtaatctgttacttgtagcctaaagcatttttccttatgaaccaaccatttttcttctccactctccatcaaagcagtgagatcccagaatcattcatctaggagccattacaaatgtgtgctttctgggctaaacgagacctctcaggctacctggaactcactcttcctatccctcgtcaacttccccatgtgtggagttccagtttttcagttctttcttcaatctgcatcccctttctctatataaggttagagacctcatttcctacttctcagagaaaataaacaacagctgatggaaattccctcagccttctgacatctcttacagacatacctacatccatactcatctttgattccttcccccattgatgctcatcatctcct

SEQ ID NO: 45664 - DNA, 1388 bp, Bovine  19866880889197
acacacaccaggcctccctgcccatcaccagcttccgagatgatacgagatcgggcgccttcaggctgatacagccggaggcccatcaccagcttccggagtttactcaaactcatgtccattgagtcagtgataccatccaaccatctcatcctctgtcgtccccttctcctcctgccttcaatcttttccagcatcagggtcttttctaaggagtcagttcgcatcaggtggccaacgtattggagtttcagcttcacgcatcacgtccttccaatgaatattcaggactgatttcctttaggacagactggttggatctccttgcagtccaagggactcttgcaataactcacactccctaatgccgggtttttcccttgaggcgtgtctaccgttttaggcacaaagagttagagcctcttgctagtcttactcaggtgccccaatagatgcaccttcagaggggcagcccatccggagggtccagcttccattgctcctctgccatctctgaattgccctcaggatgaagtgaggagcctgttgcctggggactcatccaggccacccactggcctctgccaccattccagggcagtcttttgccaccaaaaatggctggcagccagaaatagcaggctggaggcaccagagatggtgtcaccaccatttcaaaaaatttccactgaccaagtggtgaccttatgctgattgtgtttgacattcctgccttaaagcccagggatgggtagaatggcaagatgtacacattccagagatttcagagtcatgagggagactttccgggaaaattagaaacagagggaaaattttaaatatacatatattatttatttcactgcccattcagatctgaaatcacttagctcatttaataaccaaaaaatgcatccttacatttgggtcataaaattgtcatggttggtcttcttagagataaggaaatctgaaaactggaggatgccgccctgctttattttgaggtggggtctgggtgagtggcaaggtctgtggggaaaagttctcctctccttcatttttcttctttttccacctagctcagttggtaaagaatccgcctgcgatgtggaagacttgggttcgatccctgggttggggaagatcccctggagaagggaaaggctactcactccagtattctggcctagagaattccatagactgtatagtccatggagttgcaaagagttggacatgactgagcaagtttcacttttcccacctagcaggtcccaagacaagagaaacaagacagctcctagtaggaattttgtaccgaggcaaagccatacacccggagtgggaaggagagtcaacttctagaattcccttctggggtcagg

SEQ ID NO: 45665 - DNA, 927 bp, Bovine  19866880913216
ccgtcattgttgaacgcccagattatccctctccggattccaggccccctcagccagagccatgggtgacagcgatgacgagtatgatcgaaggcgcagggacaagtttagacgagagcgcagcgactacgaccgttcccgggagagagatgaaagacgtcgaggggatgattggaatgaccggtaggacacaattttttcttaatttcggctccctgttttattgtcgggcattcaagtttcattgcagttttcttaaagctttatttattaggtcgagccatatgaaatcactcgtttttgactgtttcatgtggtttgacttcattgctctatggcttaatttttgaaatgttcagaagatcagagcaacagaggtaagagtttgagtaggaaaaagcagtgtttgtgtgtgcattctattgtttgtaaattatacccccagaaagttgactcagaaaaagtaataatacagaattggcttgattggagaggttatcagactagttctctatcaggatataattaaatttcttgtaatagtgtagcctagaatcagaaagagttctttgaacagtgatcagttcagttcagttgctcagtagggtcggacccattgtgaccccatggactgcagcataccaggcttccctgtccatcaccaactcctggagattgctaaaactcatgtccattgagttggtgatgccatcggtgatccatggatgggattacttgattaggtttgatgtagctagtgatttggagaaggcaatggcatcccactccagtactcttgcctggaaaatcccatggatggaggagcctggtaggctgcagtccacgaggtcgctaagagtcggacaggactgagcgacttcccttttccaacttttcactttcatgctttggagaaggaaatggcaa

SEQ ID NO: 45666 - DNA, 901 bp, Bovine  19866880997709
ttggtcttcctcccaccatttttaaaggagaaaggaattaactaatcctcagaaagtgctctgtctgacttgcccgctgtctccctaccgcttggggttcccggatccgagacgtgttaggacgtggttgcgggattcagtatctaggtttttctcccctcctgttggctcccgggtctacctgttaggacatctcggggtatctatccagcctccagttctagggatccccgaacacacacccggaccgcccctcggagacaggacgcccaatccccgcctccaggtgccccactccgagttcaggccctataaatgctacctcaccggagatccaccctccctactcccgcggagagctccgcaggattaagtcttgtgaatcccgacccccaaccctcccccaggccccaggggcagatgagcccttggccaccgcccctccaatttcctgcagacccggcaaacaaaaggctcgggaagagaggcgaggctgaacagggcgcccttcctgcaggaacagctgatggagcaaaatgacccaggagggagagcaggggagggatgaaattccagggttccaggaggaccgcagcaggaggccagactcttggatctcgaggaaggagggagggagtcccggaaagtggatatgcaaggcccaggcaggacactgcagtttgctgggctctctcagatcccagcagccctggtgggggtgatgtcagccgtagggaatggagagggtggggggaacactggatttcaggtgagctctgaggcccctaggctggagtggtgggggcttgggagaggcctgaagccctgcgtcatctcctttggggcccagcctaccgccccctggcccgacctgctaccctcggtgagggccccaccctgg

SEQ ID NO: 45667 - DNA, 673 bp, Bovine  19866881002126
cacccccacacacaccctggggttggctctgcatgcaggctcccctctcctctccccagccattctcacccagtgtgattttgaggatgactccagacccctctgtgattggagccaagcgactaaagacgatggagactggactcgagaaagcaggcccttcctcgccagcggcactgcccctcccggggggtaccccagtggaggtgaggaggctgaaggtttagggaggcagctggaaggtggacacgggcagatctgggtgcagggagctggccggaagtgggtgctagggctctgggaaggggctgggggcagcccttggtgggggtggggtgggagtgggcaaggcttcaccattcagggctctgcctcccccagagggctactacctgcacatggactccagcgccttccacccgggcggggtggcccgcctgcgaagcccccctatatgggaccagggccccctctgtgtgcgcttcgcctacttcatgtttgggctgtcgtggggtgcccaactcaagctgtggctggcctcaggcgccaagggcaagcaccccaacctgctgtggaaacacgtgaacacgcaaagcccctcctggatccccaccgctgtcacggtgcctctggggctcgtcctgcccagccgggtgaggctgcaggcagagta

SEQ ID NO: 45668 - DNA, 1195 bp, Bovine  19866881240264
cgacctggctggaccggacaaagaattgccccgttgcaggtcacagccgggaagggagggccccgacatcacactttacacacacacacacacaggagggatgccaaccctggcatcacccctgagctgagaattgtagatatttactgctgccaaacccttttccctgttcagaggggtctcccctaccccagctttaacttcagaacccctccagccccctacagggccagaatgatctctgaagtggagagcagtgggggctcttccctaggagaggggagaatcccaaattctgagctgggggaatgtcaaggggggccttgggggaagggctgcatgtgaactaagctcatctctgagtaggcctggcagagcattgcgttgccaggcaacggtaggggcctccctctcctctccctcttgtctggatgggttgccatggtaacagctgggaggcagctgtgtttagctcctcgtgtgcgcacactcacaaacacacacacccctgcagcccagtggagggaggggtggggagtagagcagagcaggacaggaccggaggaggagaccagatcctgccccctccctactccaggtcttcctgccctgtcagcgaacacacggggacctcaccccttcagtctgctgcatgtccccatccctctgatctcccagaaaagttcccagttcaggacaatgggctgtggcttccaagtaaccccttcaacacctccaccagatcatcacagacatcccccaggcctccccgttccccctcctcactcactgtccagctcttttgccttcctccctccatacaggaccttccgctgcagagcccagcctgccccaaacgtcgaggcgcccatctcttcttcctcctctggcgtccctgcgctggcgatgacgtgggcacaggagatgctggcgaaggcccccccgtctgtccccttgctcttgcagcttggatcttgaccatgggggacggagctcccatcccacagcccttattcagcacccccccagccttgaggctctcataggcagggggtctcttgagcccagctgctgcagctgggtaggtccagaggggggtcagggggcctgtggttggatccggaaggctgtgtggggaggccaggcaggcgcggtggtggagaaccccagctgctgcacccagagccccactgtg

SEQ ID NO: 45669 - DNA, 1153 bp, Bovine  19866881628095
ctgccaccccagacttctgaggggagcccaggagcagagagtgaggaggggaccacagccatccgaaaaaggagctacttcccagcctcgctgacagctagccgtggtcccattgctgcaccccaagtgccgttggatggagctgacacagcggtcttccccaacaacgttgtcttcgtcacggtaagagggtccccaggctcctgggataggggtcaggcatgaagatgagagagaatgagaacatggccaggagggttatgacccagagggttcctatgcatgcacccctccctggagaagccaggtcctcaagagagtggtctgaatctgccattgattccattttggttgtatctgcccttctataacctggaaaggcaggggctgtacctggagtccttgctcatgacaagccccaggatagaggcagcttccttttgctctgctcctggacagtattgtaatctagacccatccactttcctttggaggctgctgctcatactactgggggatgtggtccagatgaaaacttgtcttccaggcttctgtaggtgcctgaagggatgggtgtcagacattcaatgtcttgggatggggaggaggattaggctagtggctggctaattatgtcctgccctttgatagggacctcatttgcgttacacacacagttgattgtcagtggccaggaacccaagcgacttggtcttagaccaccaccacactgaccctagatggtgggatggggaactgtgcaggagagtaccaagtcttaagtatctgtgccctgactgcacatcagtccccaatacttcagttagtccacctacaggaatagttggcagtgtgttcagttacacccagaagaatggactttgcagaggggtggtagtgagctaatcatctaggtctcctgagagatggaggtcttcatttctctggaaaaaaggaataggcctgaaactttgatagtcccatctagggaaggaacccacaggtctccctttcaacatgagttgggcccctttgcagaacattgaatctctcaccttaaatgcctgtggggaataagtactggacaggatcctcggagaaccccagcattctttctctgcaatttgaacttagctttgattgccttggggat

SEQ ID NO: 45670 - DNA, 1634 bp, Bovine  19866880168527
aattgatgcttttgaagtgtggtgttggagaagactcttgagagtcccttggactgcaaggagatccaaccagtccatcctgaaggagatcagtcctgggtgttcattggaaggactgatgctgaagctgaaactccaatactttggccacctcatgtgaagagttgactcattggaaaagaccctgatgctgggagggattgggggcgggaggagaaggggacaatagaggatgagatggctggatggcatcaccgactcgatggacatgagtttgggtgaactccaggagttggtgatggacagcatggcctggcatgctgcagtccatggggtcgcaaagagtcagacacgactgagcaactgaactgaactgaagactattgaaaacagttttgttacagtaggaaaaaactggaaacagtcaaaacaatctaaatggaaacaacaataaggccatggctagacatcattttaggaaatatatagtcattacaaagcatgttttcaaatgacataataagtatagaaagaatactgaaaaatgcctatggaacattaacaaattagaatagcaaccagtttacaaacagcataatgccaaatttatttttaaaaattaaaaaaacgcttatttccgagcgatacgattgcacattgtttaaattcctcacactgcacatgcactacttttataaacagatactacgatgagcagaagagaggggcacccacatcacctcacgtcactctaagtgtgtctgtctggctcaaagtgcgccctcagacaggcacctgaggaactagaaaaaggtagctcacagctgggctgggcctgtctattctgaggtgatctgctgtgaattcccatcaggaatcactcccttggagcaatgcctttgaccttagccagtaggcaggaatggtttctcttgggtggtaccccctgggcaggggactgcaggagatgacatcactgccatgtgtgaagcaccccatgaaggtcctcccacagagaagccaggggaccctgagggacgtactcacttttcaccaggagcgtccagcgacaggacgcctggcctcggacattggtggctgtgcagctgtagctcccgctgtcccgggcccgggctctccacaggcagaggtaatgggtccccccagcttcgtaaacctcgatgctgccctcctgactcctcacggggacaccgtccaggaaccaggtcacttcaggttttgggatccctgaaactacatggccaggtgaaggacgtgaggcccccaagagtgcttgtggggtggagtgggtgatgaagggactgagcctgagggcgggctcagctggtatgccactgccctctggctggaacctactcgcttaccctccccctcctccccaagacagaggccggggcgctttgagaggagagtgccaagtgacacaccaggcctccagaccagccagagcctgcagaaggggaccctggggtttgttcctggtggccatggtggtgacaggtttcccatggtgggggctaaaaatcagggttcggggtcagtgctctcttcaaccatgaacaatgggccactgcagggagcatctcctgaggggagacccctatcaagtgctt

SEQ ID NO: 45671 - DNA, 1577 bp, Bovine  19866880420845
tttaaaaagaattagtttaaaaaaaaaaaaaaaaaaagatttccaaaaatattgtcagagttgaattttggtcaactctagatctgtggttaggaatctcatttctaaattttatttatattttctggtcttctttgattgatctggttggatttgctatttcctatttccaagactagcccttaaatatattcattaatataatttttctactttataatgaactcatttcttttatataaataaatcattttctttggtttgttctattattttattttgtgagttgaatgcttggttcattaatatttaatatttttgttcaataataaaaaattaaagacatgagtatatttctgatattggctttagctggttataaactactcaaaaagcaagattgttgtcatatttagtagctgttactagttagaaaacgttcacacactcacacttcatctaggaataaacttaagatgtgcaaactttcaaattttccaagcaacatatgacaactcttgaataaataaagaaaaatactttgtcattagattaaaaataatcagtggaattatattattaaatatggaatgttaaaacactgtcataattaaaaccattttggttctgatacaaaaatatacatattgattaataaaacagtccagaaaatccaaaagtaatctccatacatgtgacttcagtatatgataaaagtgccttaaaatgcatgataaaagaatgaattaagtaaatatgtataattttttaaaaatcacatttaaggtccctacttcatactacacagagaaacattcatttcaattaaaattttaaaggtaacaaaggccagaagacatgcatattataagcttagagatttcaagtatgataccaacagcagaaaccataaagacatttaggcacttatatttaaaatttttgtacaaaagtacaattatgaccaaaattaaaaggtaaacaaaaaatattagagttatatgtagaaaacaaaggtggaagctctttatatatatatatatatatatatataatttatattactaaataaaatgagtacataaagaaaaaagtaaagggtatgaagctcatgagacagccaaagctcatgagacagccaaacataaaaagaagtttaaaagtgatcaagcaaatatgaaatcaaatgtgatactattcattattaaagtttgctaattaaagtgataaccagtgcttatgagaggatagaaaaattaaaagttaaaaattaaattcctaaacattgctgatgtgagagtaacaatttgaacttcatttttcttacctattaagtttcatagtaatgatgatcttaacaatctggaaatagctatcaaagattttaaaagattcaataagtctaatatctgcctatggaattatcaaagatgtccatgaggatggatgtagtgtggtcgttcagtcgtgttcaactctttgcgaccccatggactgtagcccgccaggctcctctgtccatgggattctccaggcaagaatacaggagtgggtagccattcccttctccaggggat

SEQ ID NO: 45672 - DNA, 1132 bp, Bovine  19866880422558
tgtgctgccaggcttcgatccagcacagcgctgcagacttgatcagctgagtgatccctggtccttgcaggctgcctgggcaccaggcttcagatgcattctgggtagtatgaagtagctttctgcagtctgacagtgctgacccctcttacatttgtggtgatggaaaacccaagaatttgtgtccttccccatatttttgaacttttttttaaaagctaaaagcaagacttgactgtaaaatgaaagctgagtcacatagtttaacacaatacattctcaattttggatgttacaagtaaagtcaaaggccctttttacttcataccaacttaatttctccctggaggtagatcctggtagcagacatcagggactttccagacctttccatgtatttacatatatgtctgtctatctgtggaaatttgtaaatatctctctgtgtatatatggctgagggttaacatatagggcttttatatcattttgcaacttttttttttttttccatgcaatgacatgtcttgaaaatcttccagatagtatttctcatggtggatattccatagctgttttagcaattcttctattgtttcttttttaaattttttaccattataaacagtgctgcagtgaacattcatgaacaagcatgcacataggcaattatttctctagggtagatacaaaggattggaattgctaagctgagtaataggtacattttttaattttaaaatgtagatttcatgcataaagcttgcccttgttaattttggcctagtgttcaaatctactgagataaatttatttattgattttggtcatctcttacagtattaacctcactataccagttttgtgtcatctgtccataccatcaggcatatctttcatcttgtcatcttagaaactattttctttttaagtcaaaatgcagcagtcaagggaagagctttgtggctaccaccagagacctgtatcctacccaaagctcactgtattgtcctaataaacactcttagggttctgcaatttatctgcagtaatcccacccagctctactcttatcctgttcatttttcaccatcttatctgtaagactgctgtggaggacatttgccaaagg

SEQ ID NO: 45673 - DNA, 1430 bp, Bovine  19866880437838
cccacaggtactggaaggccattaaaaagaatgagtcaattagttgaagaatttggggaaagcatccaaactatgcatatcctgttctgtgaaacagcctgtctgtcctttcttgaggcaagcaaacaggaaaaacactggcctgggtacacctcaccccccttctgaaaccttctctggcacacagtgccccttgaaatcaaggttgggaggactgtttcctgagaaaggagaaaatgagtctgaccctctgggttataaccccttagaaagggtggagggacattttgttatacttctgagggtctgatgaatgcccatatcctttaagatgtcaggccattaagcaggagccagtggcctgaactggaaatgttctcactggtggagtgtctttagcatgtgggagatataccagccacaaaggaatagttttacttacagccaaatgttttcctggaacttttgaagttaataaaaattttttaagtacaaaggaaaaagaaaaacaacaaaataatcagtgttaacaagctggtatgtttatctcctatatatttttttgagttttacaaagctttttatgacgggcatgtattactttataatgatgataataaacattgttctttctctaaatagttcagtatcacatgccaggaagttttctagatgctggagatacagcagtaaacagataaaaatccctcttcctctagagcttccagttagggggtatttggatggaggaagtagtaaaataggagacagtgatagccctggaaggaaaagttgggatggagtgagaggatgggagagccctggggatgaaacatcagagacggttctccaaggaggggatgtctgagcagagatctgaagtaagtgaggggccgagtcaggggcagggctgcggaaagagcacttctttacacagggaacagcaggcgagggccctgaggttttgctcaaggagaagcagaaggccagtgtgaccacagtggagcaagcagtgagcacagtggaggagcggaaggaaatgggtctggagagccaggcaggagtgcactgggccttgtaaggccatgatgaggagtccatccagtctcagtctcagtgtgaggggaagcaaagggaaggctgaaactggggagtgaggtgatgtgtagttcgacattgtctcctggatgcctccgtgttccggggaccacatttcccccatcagacgacaaggtcctgagttcagggatatgcggatgttttctcttgtgggttcctctcccaagagagggctgaagcaggagctgcaggccacaggaaagtgacggcttatctctccccaggggtttcacctcctgggactcaccttctactgtcaactccactgtcacctggcgggcaccactaccgttagtggcttcacaggtata

SEQ ID NO: 45674 - DNA, 1580 bp, Bovine  19866880483344
cgtgtgggtttgaagttttgggtaggtgtttatttttgtttgtctctccaatggtttttgtttccttctttgggctagagaacaggaagctactgtgcccagggtggggcagcagaggctgtacatagcaaaggcccagggcaacgctggtaacttaagagtgtctgcagggctcagaggagtttatcagattaacccagaagttcaggaccaggggagctgaaaggagagggggcggagggccacagaggaaggtgagcgcttaggaagccaaactctgtcataagtgagagattcttgttttatcacttcctgctcctggtgtatacaacattccactaaccgtctttctaccttctctctttttccaggtttggacaattccaataggtatgtgtaggctttgtgactgtcatcggtccatctcgaaatgccctgttatagaaaagagggattgtaatcaagaaatgccctaaatttctgagtcatcatatagtggggagaaccgcctgtttgaggggcgttgttttatttggaatgtttcattttctattgtaatttgctgccgaggttctgggccaggcttgccatcagtattgagactcttgaaggccctgctcagtatctttactagttagccatcattaggaagggcactgctctgcaagcatgccctccatgttcaaggccagaatccacctgcttgttttctggctggaaactgagccaactgcagagaaagactttcgctcttcagttcaattcagctcagtcgctcagtcgtgtccgactctttgcgaccccatgaattgcagcaggccaggcctccctgtccatcaccaactcccggagttcactcaaactcatgtccatcgagtcggtgatgccatccagccatctcatcctctgtcgtctccttttcctttctctcttactctgtcctaattagtgggctttcataattcctggagcccgtgcttgtgatgagtaactagatgattgttctcttccttcttcttcttctgccccaccatccatccctcaccaccaaacaggtcactcgtgagaggaacaaaggtggccggtacggacatcaggaaggaagtgaccaatggagtcactcaggggtccaaaccggatggcctggatgctgctgccgagagtaagaaccgccccagcacccagcgaggcggctccccgacctgggccacagggagccagcctcaaccccccagggaatctgagctggaaccactggggaactcccccagaaagggccagagggcccccgtcctgcaaaagacctccagcaccatcaccctgcaggcagcaaaagtccagctggagcccagagcgccagtcccaggcacgccctgtccttccagagaagagatgggaggggccagctgcgtcccctccagacaccctctccaccaggcggtcaggcctgggaagccaggacaccatgggcaaggttgctaccaggaaggtccccatggagagccagagggacaccatgtttcccaaatttgagaacaagccccagagccaggaggtcagtgaagatgagccagtcgagt

SEQ ID NO: 45675 - DNA, 1559 bp, Bovine  19866880509143
tttcccaattagaagagaatcatctccccacccggctcttaaagaaaggagaaactttgttctccaacacagctgtcagcttgggtgttgcttaaaatttgaatacaatcaacaacccttgtcccagtccctagcaacctaaaatgataacattgccttggttacaaatcacttcagaaaacctggttctcaaaaagttatctctgtaagagcttgtgaatgaatgaaaacaaagcaaggttttcttaaaactgagacttagagccgctttatcacaataaaccatgtacctgagtcaaggtgtcagtcatccttctgcatctcaggtgaaacgcctcttcttccaggaagccctcaggagaccagggctgagttggctgccccatgctgggtgcaccagtagcatcctgtgcctgccttgtcacagccggccttaccctgtcactgtccttaccacactcacttcagtggcctctgcactggcccatttcctggttacactgcaggattcaggaagacccagactatatttgtttcttttacaactgaatcccctgaacactgctgctgctgctgctaagtcgcttcagtcatgtccgactctgtgcgaccccatagatggcctcctaccaggctcctctgtccctgggattctccaggcaagaacactggagtgggttgccatttccttctccaatgcatgaaagtgaaaagtgaaagcgaagtcgctcggtcgtgtccgactcttagcgacctcatggactgcagcctaccaggctcctccgtccatgggattttccaggcaagagtactggagtggggtgccattgccttctccgtccctgaacacagtaggactcaataaatattcatgaaactatcataaatacatacattatcaattaactaactgacgtggagcccaagtgtaggcagctgctccactgaggatattatttatccatttcacaaacatttcctgagcatctctcgtgccactgtggtacaggatgtgtcaaatgcaggctctgccctcaaagagcatgcagtgagggaaggaagtcaatgacacgaatacctatgctgtgaagtagacacacagtaaaaccaaaacaggatggatattagagaacgagaaaacaaccaaggcactggggtcaccgagcagttcagagcggctggagctgaggctgtgggacaggtaatactggaaccagagtctggaggcccttgaataaaaacttcaattaaatagtcaacatgtggcagggtaagagctttatatatatgatttcacttatttcttgaaacagttctatgtaaaaccatcctattacagagaaggaaaagtctcagaggagtcaagaaaactgcataagatgacacagccagtaaatgccagagctgggtccacacctaggccagactaatgacaacgacagggctgtagggctttggagactgagatgccaagttaaggggctgttactttatccagtgggatgcagggccactttgagtaggaaaatgccccaaagactgaagatttatcagacagt

SEQ ID NO: 45676 - DNA, 5286 bp, Bovine  19866880635284
tcagaagggcctgaggtataacctaaggctgccaagctgtaacctgtctcatgctctttgtggaaattacagtgtgttctctgtctggctggtgtgggggtgtgggggtgtctgtgtcctgggccaaaggaaaagaaaacttgccacaggaagtgagagcggctgatcacagagagagacttccggcatctttcctgaagacctgggtggccttctccaggccggtgtgaagagtgcttctctgcattttgcttttgtttttcatggaaatgcttcagttcctgctgtttcacaactttggacttaagggcagagagggtccagcaatttaagcctctcactaattgctgcttttagctggtatgatctcttcctgaagattctgtgggttcagtcaaggcttttgactgttggtaatgggattattcaaagccttaattaagttcctgcccatccaatgggccaggtgccgggtgctgacactgacccaggcccctaaactgtcatgtcataactatggttcacccttcactcttcactctcataatatatccatgatgtaagtttcataggcattttctgtggtctaatttgctgggaatgttaatatttaaattccttctgtgcatccgtgtccatttattatctggatgagcttatacttggagatgggacagaagattcgtcttcaatgaattcctcaggatcattggtgtctttgctattattttcagtttttaaatcaccagctctgtcctagtcatttatcctaggagaatttatttatgtaggagaagatgccttgaaatagggcaagaagttcagagtgatgggctataggcaggctggcaatcataggaagcatggagaaagtcgcgttgcagaatcagctttgtctgtcttgaggagggggacatctgtccagcaggtttccttaatttcccatccttcaggctcagcctttcccagcattgattttggttacccagtaggattcaaagaagtacttatggacaaccccttcatctattattcccagccccaaggatttctcagctcactgctcacatcttctttgtgtatctttccaactccccagtgtcccgctgagcagtcccttttcaccctggctttagtgtaaccctggtttctctctctctctctttttggtctccctccattctcatcatgagcagagcttcagtttcatgtcttgcccagctcggcactgcagctgtgtggcttggcagtgtgcacacagggacaggtccacccaggtacaaaagacatgcaggagatcatcaaaaacaggaacatcaccccctttctacctcttaccaagctgagaaggcagatgtgtagctctgagtcttgggggtatggcggtcagagaagctgactttgctctgggcttacaccctggtagcctgttccaggcaacctggaattgactgcaagcccttcacacacatcagaaaaaaatcaaaagataggttcgattcctgggtcagaaagatcccttggaggagggcatggcaacccactccagcattctttcctggataatcccatggacagaggagcctggcaggctatagtccatagggtcgcaaagagtcagacgcaactgaagtgactgagcacgcacacccttaagaatgtttcactttcagtcattaagtagatctctaaatagcaccagattctgaaaaacttcccagcatggcaggcagatgtgacacggcagcaagcagccgcccgcctgcagcccagctttctcctcaccagccaacacacgcagaacgagcccccactccttttaaaggtcttttgaggccataaaggctcttggggacattttatggaactgaagcacagttttactattttaaattattataggggttatggtgactctatctttatttttatgacaagttgtcagatatgcccttgatttatttgatcccaagcttttaagaatacaacctccaattaaatgtggttactgtggcaaaaaatatgattctccttagaatgaccctctttggggccatttccaaaaactcattatggtgagaagtcagggctgcctactcatattcacaggcatctctccttatggttgctcggttttcccttatggaggattagagagtattaaagctgtgggctgggcccaggggagactgaaaggggaagaaagaatcttcccccagaagctaagtgggtcattatttaattcagactacttcagggatagaaggacctgaggcatcaagaactgttttatcatcaatgaaaggaaggcattacaacctgaagaggtcaggaagccaagccagacctgggacacaggcctgggtcttatgtcatctgtcttctctgtcccacacggactctcctagggatgtcttgggcacatgcatggcacccatcctatctgtcctaggccgttgggttatttctgctataatggaaatacaatagatggggtggtttaaacaacagaaatttatttttcacagttttggagactggaaagtccaaaatcaaggccccagcagattcagtgtctggggagatccagctcctggtttgtagatggccagcttcttgctgtgtacccacatggtaaaaaggagtgagggagctccctggaatagcttttgtaagggcactaatcccattcatgagggtcccacccttctgacctcatcactccaaagggcccgcctcctaatataatcatattaagggttagtatttcaacatgaactttagagagacacatttagtctatggcactgtcctttgttgctccaaggaaacagccctagacttgcttttagcatggccatgaccattgacatttttcccaagtggggaacagatattgctttaacataggggaggtttaaggtctataagggatagacatttatcaatgctttgggttctatagtatttatctttccaaaaacataaatttacagtgaggcacagagagacagctactcaactgatagaccaaaattgtggtcccagatctgtcacttgatcttaaagatagcatatcgttcacttctccaggcctctttccttagctctcagggcttaataatatgattgtccttgcatgctgtcacagacactcttggtaccccacccaaatcaccttcaccaggctgctacacctgctcctagttgctctgagtgtcagttaagggcttggcttcctgaatccttatctcaggttctgcttctgcttcccaagacacctccattatagcactgcaagaatcaaataagattctctatgtggaagactctgaaaactgaagtatcactgggcttttattgcagttttgactgggctgtaaaagtcccagctgtggcttcttggcagaaggcccatgatgaaggcagataagacgtccagggaggggggggctgttgtcacacacccaagattgtgggtactgggtttctcttctttccccacctaggagcccaagatagtgggaagacaataaaaacgagtttacttgaagctgagtaatttttaggtaaggttaggtagtgactgaacaagtttttccatatcgggaggataagaattggagctgcggattattcagaccttggaacagaaaaaggtcatagaaattcctgcttttgcttcagatacaggctgtataaaagtccattgcaaactgcagttttctaagtggcactagtttcagcattaaaaaaaaaatccttggatacttactttaagggcactgcaaaggtggatttggtggtgtggggtggaggggaatgtctatgcatatagaaaatgagaggaaaatagaaagggaaatagggatctgtgtcctcaaaatctggagcacttgcaatgtccccagttaatcattgatgcctccagccctgatggccccagagctggcaccactgcagggggccagagtacttgctcatggaatgctaaggatgcatttggtgaagttaatgattcatcacctccccccagtcccagggccctacatccctttctctgacactgacagaagcttacctgatcattttctggaggtgaggctggccctgcctctcacaaattcactgtaagaccagattcccaaggggcttccttctgtaggaaagtttctttccttagctgtttcctgaagataagcttcaaagagaaaaagaatgtgttgctagagtgattgtctgatattccttggcatgaagttttgtgccaagagggtaccacaagatgatatgttttttatatggattatgcattataaacatgcataatgtttatttgtgtaccactgttaattccaattctagatttaggtaccttgaggggctccacaaattaataaatggttgtgctatacatttattatgtgcatgtgtgttaagtcacttctgttgtgtctgactctctgtgactccatgggcgatagcccactaggctcatctgtccacaggatttcccaggcaagaatactggagtgagtgccatgccctactccagggtatcttcctgagccaggaatcaaacctgcatcttctgtgactcctcagtgcaggcagcttccttaccactgagccactggggaggtcatatattcattatacagacacactaatatgaaaggaacacatattttcatttaaatttttttctgttttacaaagatcaagtgtgttatttgcaagaatatcagaaaatgatagttaagtaaaaggaaaaggagcaacccagaggtgatctctttttgtttcatatcacaatagacattataatatgcatgtggtccccttcaaacccatcaccctaagataggatatgtgtgcttggcaaggctgcaacggtccaggtgtgagtgcgcagccacctaccctccccttgctcccacgtgctgataaagcatcctctctgacctcgctgaggcatgtgatgagaattatagttgccagtcactgaaggctttctttgtaaatgcaatttggggttatccagtgaatttgggttttgctgcatctgtacccatgctctcttgtcttggaagtggatacatgtgtaaaagctaccgctgccacctatttgcaacaccaacagtttctttctcaggagggttctatgatgtcttctgtgcatttccaatgctaaaatcccccaattcagggccccagggtttgcactgatgggccagtctgagccctgcttctctgaagaggaatccattctgaagggctgattga

SEQ ID NO: 45677 - DNA, 1788 bp, Bovine  19866880641046
aaatttcaatggcttggactgggaagtctaaatctgctttaaatgtgtgtttcgaaataggactcaaacctctttggcattccctgcccccagcatgccaccaacagacacccagacaagcacggcacgcacaggcttgctcacaatgggaccttctaggagggtcctgggatttgcttctgctctctttcctgtgtcccctggggccctgccttagaattcctgaacaatatcttgtgcaagagcttccctgcatgcaactcatttggcaagagtcatgaatcaggcagaagtggccgaggagcatgccccgggtgacactagggtgtttgtggagggaagtgggtggagggtaaggagccccaaggctcctgccaggctgtcctcccactgccctggcctgccatccatctctgttcacccctccttgagcccatcccaggtggggaccctgagggactgccacgaagtcagcagagttaccaggaaccatctgctgtccagtcagacttgagtggctggttcttacacacccagctctatcaaccacccacccccgctccctgggggctgatgctgtactggaaggtggtccctggaatcctgctcaactcactgcagcagcaccatatggggctcccgacatcctccctgtactccttcaatcctcagtccacaccccttctgcagccctgactatgtgtgccctgtcatcttgcaggcagggagccactccaagacggagtgcctgttgtctccatctttttcctggcatggagaagaggcctgtgtggcaggggtacagtgagcaaggatggagcagagagaaagaggcaggggccaggccacccagggccttgggagccgtggtaattgggctttattcttagtgcaatgagaaattgttggaaatttttaaaatagaggagtgactttggtctgatttatgtgttttcaaacttttatttcttgttttaatacctaacatagagctattgtactaaaggcaatgtagtatttggcagagggataaacacacggctcatcgaaacaaaacagagttcaaaaatagatccacatatatttggctcattgatttttatttattgctgtaaaatatacatggcataaaattgactgttttatccatgtttaagtatacatacagttcagtggtattaagtatattcatattgttgtgtaattaaactccaccacccatttcccaaactttttccatcttataaaactgaaactttgtacccattaaacactaactccccatttccctccttctcccactgctggcaacaagcattccattttctgtttccatgaaattgattattctagatcttcatctatgtgagggttggaccatgaagaaggttgaacgccaaagaattgatgctttcgaattgtagtcctggagaagattcttgagagtttcttggagagcaaggagatcaaaccattcaatcctaaaggaaatcaactctgaatattcactggaaggactaatgctgaagctgaagctccaatatttgtccatctgatgcgattagccaacacattagaaaagaccctggtgctggaaaagattgagggcaggaggagaaggaggtgacaggatgagatggttggatggtatcactgactcaatggacatgagttggagcaaactctgggagatagtgagggacagagaagcctggcgtactacacagtccatggggtcacaaagagacatgactgagcaactgaacagcaacaggtccttatctaagt

SEQ ID NO: 45678 - DNA, 927 bp, Bovine  19866880785762
cctgggggaagcagccccgagtgcccctctcccagcccagggcccctcgtcagccaggagtgtcagctcacataccattcctgaaaagccaactccagagtctctggctggtctctgtctccttccagcaggtctgcccacaggccagtgtccctgctgggcaggggtttctgccctcttccactcacctgtttgttcagaacgtccttttccagaatgcattcccaaaatcatcacagtcagctggtggagcgtactcacctgcctctgtccctgccacagtctggggacctgaacttgtctctcttggtgatgtccagtgcgagggcctggtccatctgccccttgcattgtgctactgctctccaaggtcaggggctatttctccctcttcttcttaccttgctgttgtatatttctatgagagaactcactagaagcgggggttgggtgtatttagggatcagttattttggatctgggttatctgtgggctttgatgaggagagtgggttggttcccacaggacctctgacttctgggctcctgaggatgcctgtgtgaagcgcactcgctgtgatactcccagtgccaggcagatgttgggctcagacctggtccactcaatacatcttcctcctccccacaggctccttgtgctccgtctccatcgagaaggcactgcccgaggacagaggcttatacaagtgtgtagccaagaacagtgccggccaggctgagtcctcctgccaagtcaccgtggacggtaggtggtgtccacccaacacagccccacacagagtcccacttatcagcgcccaccgtccctgaacagatctgcccccaaagcggccatccccaccagaggcattctcatcgtggatgagaaaccatcttttgcaagacgaggcaggaagggaaacagca

SEQ ID NO: 45679 - DNA, 1556 bp, Bovine  19866880800690
aaaaaccctcttgtcgttgggaatatccggagcagaattggagcatcatgggtatatacagaaatatactactgaaaatttttcaaagtgactgcatccatcagcaaagagagttcctggagcgccacacttggtattattggtaaagacttctttttaccaagtaacccgggaaaggcacagcccatactttgcaagtatatcagacaaagcaaagcctttatcaaaggcctataataaatctttatttaacctttgtgatatcagctaatgagagaataatctgaaaagtttaacagatttaagatgttatcatctgagaccaggtcagacaaggatgcgatggataatgagaactttggaacctgggaggagaggactttgctcaagaccagagcacactgactaaactcatcattcgttctacagtgagaaggactagaaattgatttcagagcttcttttatatgcttaatgattcttggaataatttatttttcccattgctgtatattgttttctccttccattgtgtagattcaatcaataaatcctttttatcttagtcccccccccccaaaaaaaaagacttctttttaaagtatcactgtgaaacaaggtaccccagttaggtttttagataaccgattttaatctataagcaactttttaattctaatttttaattctaacaattctacttcttgaacagagttaaccacctaacccttgcagcccacacagaggtgggcagagagatgtctactcacatattcaatatctagcaatttcactgtctcttctttcatgggtagtcatcactaaagtgtcagaaggtcacacaccttctaatcactcttttaggaaatgttgaagatggccaaaacaagaacttaatttccacataatcgttaagcccataagttctagtctcattgtgcatggacatctttgctgctttaaggctatttctatgtccagaatactgaaggttgccctgtaagtgggcaagtgagttattactcatttcatttgttttcatgcggcttggcaaatgttactcagttatcaaataatcaacacatatttacaaagcacatattttatgttactgagctagacattctggaagccacaaagaaaatcaacatttctcttgaggaggcagggccctagggtaaatcatgtggaatgttgtcatctaccttcctcttctcattttaatacaaactctttcatagatgaaatggagttaaaacaaacatcagtgatggccttgaccttggagaggaaagaatgtcttaagagaatgaaaatggaagaggggagaacaagcctgcccatagggccatggtgatggggttagcaggcgtttggttctatccaaaatgtccataaggcacttggtcccataagacatctggtccatgtcgaaaggtccttgaaatttggtcctatctaaatcatccatgaatatattttgggtccatgccaaatggtcttggacaggaccaaatattaaggatcttttggcatggaccaaacaaactgcaata

SEQ ID NO: 45680 - DNA, 1806 bp, Bovine  19866880824813
actcccagtagagacagtggtttgagagtatccgtgtcggtgagtcagagcccactgttcaagggcaaggatggcagacttgcccgtctgcctgccacggctcttccagcctcatcttggcagcatcactaattggcagtgccgctctttccacatccatcctgtctgtggcctcagtggtgtttgttttttaactacatagtctcaaagatatgtattgatacaaggggaagatagtagctgtttaacacaagctctggacaattactgcctctgaccagagctggaacttgatatgaaacatagttgccatctctgaccaaagtcccacaaggtgtctaagtggctgatgactgagtgggctgagaagaggtgggttgtactgagtgctcgctgaggtcacaaagcacctagcccatccctgtggtgaacaaggagtggtgcgaagtgtgggatgaactgcctttgccagtcagggaatgggtgcatgagtccagggactcggttccgatggcctgtgggttctctgtggatcatctcacattcaggaccctgtgagtgagaagtgaaggaacttgctgtcctggccctgagggagctctcatttttcataaaaagcctgagctgctacttcagtcagcctaaatgctttcaaaattaccaaagtaatgaacgcttatggtaaaaagttataaggatataaaactgcgtaaaatataattctctaaccacttactcccatctcctagggataatcactgttagcagtttggtaaatgtcctaccggaactccttttctatgcacatactcatagtgtctatgtgtgtatttatattctatcttttctcacaaaaaaatggactagtacaaattatttcaaattatcttgcaaattttttctcccacacatacaatatatcatggacatccttaaattgtcactatatataaaactccttggagaaggcaatggcaccccactccagtactcttgcctggaaaatcccatggacagaggagcctggtaggctgcagttcatgaggtcgctaagagtcggacacgactgagcgacttcactttcacttttcactttcatgcattggagaaggaaatggcaacccactccagtgttcttgcctggagaatcccagggacgggggagcctggtggactgacatctatggggtcgcacagagtcggacatgactggagcgacttagcagcagcagcagcagcagcataaaactccttgtcctttatactggtttcaaagtgtaatgtagattgtatcaataattatatcagtttattttactaattccttattgttggatttctaggttatctccagttttttcttgctagtttttacagaatatactgaagcatttttgtaattgtgagagttttataagtagaattgctggaattgaaggttgtgcactttataaatgttgataggtactgccaaattaatttctaaaaccactgtatcaatatactcttctgccatgttatgtatatatattttccaatctgataggtgaaatatggcctgcttttatgcttttatttgcatttccctgatcattagtagtagaagttagcatctttttactttttatcgatcatttgtgtttcttcttttgtaaatttcctgttcatgttcttgactcatttttatagtaggtttacctttttctttctgtttttttgagagctctttgtaaatttgagatcttaatcttttatgtaatggttttgttgcaatgcagcatatatttgtctcctagattatctttt

SEQ ID NO: 45681 - DNA, 1802 bp, Bovine  19866880879909
tcccagcaatgaagaggcagggtgcgggcatccaacatcatgctgggccctaatctcgctcaatccctggtcctacaaggcagttctgattattctcctttcacaaatgaggacaccagggctcagaaagtcaactccaagtaatccaaggtcacagagctaagaagtggaaaccaaaactgaattctgatcgcagccataccctgtgggcttcctggaggaccccagactcagacgaggcatttcctgctttcctcagtaatgggagatgccataggcagaggcttggaactgcacaaaggaagggggagggggaggtgtaacactcccttctgctctcagttctggctttggaagacacaagactcttcctctctactttcaggggagctggaaactaagagtagtgacatcaggctcagaatcctctctattaatcctcttgattctgaccttctgaggtctcttgaaggtcttggatgctatcagccaaaggaatatgctcagcctcaaacacagaacacagaagtaagtcatctatccccggccaggtgggaaagtctggcttcaggttagaacaggcaagtcagtgcagcaagtgcattgtgaggagtgagggtgggtgagcaggctggttactaaccagagcccactcccaagctgggttaggtacaccaagcagctctgctcagcctatcgctccaccccctgccatcagccacataaacagatcctgtccacagtgccagtgaacgattactgacatatttggaatgctcgatcagaataataataatagtaacaataataatacaaaacacccttgttcccttctatccctcatccagcccagggaccacattccaatcaagagcaccagcggggctgggtggtttctgcagtaatttctctaccagcagcagcagtgctcagtgactagaattgaatacacctagctaggggggttccattcaacacgagttaaatgcagatcaaaggaatagaagaagagaaaaaaaaaaaagaagaggggatcagaagagcagtggtctgagagctggaagccacaccctgccacacacacgcaaggcatgggccaaagctcacctccaaatagggttttcataagtagcagagttttttcatcattcaaaacagcactacattaatttgactttattttgatcaaaagcacttcaaattctctcttgaacccagaaaggaaccctttcaactatggaacgacggccaaaagagagggcaaaaagactgaggcacaaagactcagacgttttaaatcaagaatcctgttatacagcagaagtttagagaaaccagctgccccctccccacccaaagtacacacatttcaaatgctcattgtccttaagctcctgatctggcagcaaggcatctggaaatacaataccttccccacagggaagggctcccagcaggctctgtactggaagccgggcagtcggctatgaacccacggagccacgggcacacagcagacacagcaaaccacccaggtgcaaatgcccccagcaatgacagctcgctctctccaccttaatcctctctcttcagagccctcaaatcccgacaaatgccctaatcgctcttaatcctggaacgagctgctcctcggctgtgggctgagcccgctgacttgccattacccacgggagcaggcagtgggacagggccacaagccagacaatggacgcgccttaccgtggcctctccctgggcagctctcccaggagtcgggatacgcgtgggcagccacttcacca

SEQ ID NO: 45682 - DNA, 1510 bp, Bovine  19866880953216
gtattttgaggttggtggcattatctctgcctcacagataaggaaacctgggttctaaaagaccaatgtcttcccagcatcacatgctctgtgaatcagggagctatggcttgaaatcagccccagacttcaaagtccactctcttgacatggtcaggtctgtcttgactcagaagttttatgctgttctgtgagccgtgtggattacaggacattgtgggctgagtgacagggagagtacgtgcacaggggcaagaagaggcatggctaccaaagccaggagaaactcgagggccgtctacagttgaagtggcagggactgattgggaagacagagtcccactagcccagggatctcacccagagtcagggcagacagaaccctaccttgagccaggtgacctgtggctggggccggccagtgatcttgcaggagaaccgccccatctgtccttctctgaccaccgctcggcccagcttggtagcaaattttggtggacattctccccagatgctaggacgggtctccatggcagggggtgcaaatctgtccctgggaaaagatcagcaggaaatccacagcaatgcagatccttttctgtctattcccacccaagtcacttaagatgggctcagaaaccagcaaagggaaaccttcccaattctgtgcctcaaatacattcctggaaaatatctgtggcaccaaaacctatttcctctacctcctgagcattcggctagtcttcatttactagccccttgaatttgtgctcctcctcccgctcagttactcagtcatgctcaactctttgtgaccccatagactgtagcctgccaggctcctctgtccatgggattttccaggcaagaatactggagtggtttgctatttcctactacagggaatcttcctgacccagggattgaacccatgtctcttgcaacttctgcattggcaggtggattctttaccactgagtcacctgggaagtccagtgaatttaggtacacctgaattctaccgaaccctggccaaagcctaggttttggccaacagactgtgaacagaaagcagaagcactatgtgctacttttaggctggactattcaaaacctcctatgtgattctcttctggctagatgcagagggttctgccgaagagatgatggagccacaaaatggaaggatcctgggtccctgaaatttggttggaaggttctccacttgtctgagaaaatatgaactgattttgcttgagtaagaaagaaactttgcttgtgttaagcctttgtgatttagaggcttgtttgttacagcagccatttttatttgcccttgccaatataggtttacttgccataagaaaagtcacatattgattgcctcttctaagtctgtttattttaggtcttctgactctggtcttggttattagagactcctgcagactatgtccatatagcccacttccatttagttggaccaaaggagcgatccacagaggccaca

SEQ ID NO: 45683 - DNA, 886 bp, Bovine  19866881181690
tggcctttccaggtagtgctagtggtaaagaacccaccttgccaatgcaggagacatgagacgtgggtttgatccctgggtcaggaagattcccctggaggagggcatagcaacccactcccatattcttgcctggagaatcccatggacagaggagcctggtaggctgcagtccatagggtcgcaacgagtcagacaccactgaagcgatttagcacacatgctggtctctgctttttctcatacaattcttctaatccatgagctatgttaagagacccaccaagggtcacagagtttgcagttggcacagctgggattcaaacctggtactttgtgacttcaaagctgacagagcatcatcttctcctgaatgcaagtaccatacttctgtcaccaaaaagaataatcttccctcagccctaacgcagcttctcaaggcaagaatcatgaagccccattagactggttcctcccactgggctctataaaccctgtgggctgactgaaccatccgcttccagaaaacacagagaggaaaacatatttgccatccacatgccagtgagaaacgaagagatatgtggcttctcttgttacatcagatttttaggaggctgaagaaagggaggagggaagcacccagccaacagagaggaatcattgaccaccccaggatccataataacatttctgagtcccagaaacctcataactgtagggattatgagaaagtgattcatttattcaccatccagtagatacttcctgagcacctactatgtgccaacattgtactaggtgctgggagaagaggtgaaaaagccatcagcctctgtcctcataaagctagcagctattggaggacatttgtggggtaaggcat

SEQ ID NO: 45684 - DNA, 2159 bp, Bovine  19866881206398
aagttgtgaaaagaagttccagcttggagaggtcagaataaggcaaggcggtattttcattgcttcccctgaaagctgtatccagcaacaaagacttgagccaggagaggaggcacgtagagctaaaatgcttaggaacttgagtgaaaattataggcgccaaggattacttttattaagggtcaaggaatcataggatgtaatgttagtaaaggaagtacaacttttgtggcagaatctctaccttgtccgtcctaaaatgctacctttacttctctttaacttatgctccataacctgacaaaatagaggttcaaaccatagatatagtcaggttttataatctggaatactgtgaagacaaagtaaccgagttctctttggtacaaattactgacattgctcccaatttagccacatatgtaaatgtttttaatagggatgaactcggggaaggaataaggtaggcaggtaagatttggggaaaagggaacagagggtaataatcccttgaaacagaacagggaacctctgactttcaacttaactggatgttgaatgatggtcttgagttgaaccatcataagctgagtcacagacaactttgcttgcaaattctcctaaactctggtctttcgcccacttcctgaaacactcaaacatccttggctcacagtgcaaacttctccctctgctgccgtactgaaacttctcttaaatgttagaaaaacatgaaggctttagctgaaatagttgctggtttcagaggtacattggctggcttcatcggatcaggcattagctcatcctatgttcctatcaccactatcacagagacctagcattgggtgtgagagtgaggcagttgtaaacaggtactttaatagactctgtccccctggattcctacacacaactctaggggaatgtggcttctccttaccttcagctgttgagaatcactgcttgtgatgagaactattactgatgtggagccagaaagaagtccaatagccactgtctcaggaagaagaggagagctggtcacctgcttctttgtctcagttatcttcttggcctctggctatacacttaaggtcatgttcagcccacctcgcacctcaaaaatacccaaaacagctgttcaggaagtaggggtacatttaactttcttccaacttgattttcccatctgaaaatacaaagcaagtatgagacacggtgaggcatacccatatctctcaggttttatcattttcagtgggctccacacatcttccaactgccattatctacaagctggtgcttgaagactttatctgaagctctggaagctcactaggtccaagataacatggcagctcagcagttctagaaatttaaccaccctgtcccacagccccgagcttccttcaaccaatgaatgatgggagattatgtgtaaatatcccagtaacctcatgccttgggtgggataattctgaagtgtgtgttttacactgtttccctgtaggcttaagctatagctgtccactgtgtagttggcttaataattcactttttattggctgtcttccccttcctgactcacttcctcactctcttgctggtatttccttggatcaattcccaaataaactacttgctctcaaatacttatttcaaggttgatttctgagggaccccaaacaaagaggattttctagtgtaagttagcatcattatacatacattactgaaaagccactaaatgagagagacaccccctcctcttattcctctgtttttatctgaggcattggggcttgaacccagagatttgtgaggtgtgctatatggagcctcccctatgagcagcctggtgttgtaacaacatgtttacagacattgggggtctcctaactgtgtgtgaatgtttgatgaaggaacatgggtcacagtggaaagagagtggtcagaagctgggctgatggtgagtgagagaagctatggttttcaagagtggtaccccctacactgtgttccctggtgttctgggagatgtttaataaatggaaaccccaaaataaagttcctttggtcaaatgctcggaaactgctggatcaagcagaggctgtgttatggtaagacttcttaggatctttaagacaaagtacat

SEQ ID NO: 45685 - DNA, 1980 bp, Bovine  19866881216336
caagaggttaagtaagggtagcttgtctgagctgctgtctgcagaccaaagggagtgaagcccctgaggtgctcaggctcacaaagggctgacaggatgtgtgtatcaggttataattggtacatccaggagtgatgttagaggtcttctaaccccagaaatgttaggatattccccccgggcccactgtcagcagatcctgcccctgaaattcagtggctcttgtcttaagttagatgcttctgtgtgagcctctggttttcttattgatagtctgagggtaagctaaggcccccttgtgttctgatgctgtgtgtaatctaggacaagacaccaccagcctggactctgacccactctcagctcctccccatggcgtcactaacagtgtgacattgtcacctggctctgaaccttggagtcagaggcctgggttcaaattcagctgataagaagtagctgtcattggtagctttgcgattttggatagattgctcaacttcggagtctccttttcatctttaaagtgataatcatacctcttacagagttgctttgaaaatgaaagttaacttaggcaaaactctcagtacagtgcctagctcctagtaggcattcagtaaatggattatttccattgtagacattatggtttgtcagcacttcatttggctgagtctgaggtttccttactgtgtgatactggggttgggtggaaccagtgcttctctgaccctcccgtcctcaagagaagtggaaaaataatagtattctaaaggtaggggctgggaatgtagcctgaagcagcttgcagaaagcaatcacatttctttgaagtcttaggatgacttgtaaaatcaacttataattgtcattcagtacaccaatgtgaatgcattggttctcacataaaaatgcttctgccaaatctttaagtataatttatgcacaagggataagttgctccactctgaggaagggggtgtgagagcaggatttttaagatcctttccagccctaacattctaggttcccagggtaagtgagtctcctccacaaaggacctgaaattggtatccaagaatcctgaagggaccttggggaggtaggctcccctgtgcccctgcccctcgtgagactgcacggtgccaggggggtgccactggtggaggagggaagatgacgcagcccctcagagtgaagactgaagaagcctgaaggaggagcagggctgtgtctgagcctgactttccgtccttgggctgatatgtggctgagttgggttggcagctctccaccaccccaggtaaacttcaggaaacaataaaccattgtttctcatccagagctgggggctgtcctggagacaggacctcctgtcacgggagggcaggtgagggcaaggggtgaactccatgtggaagcacagggcttgtcacactgccaaggtgtcctctgggcagttccgatgcaacagccaaggccaacgtctggggctgtgcctagccagtgggagaacagaggggagtctggagaagagctgcatgctctgggggagaacacagagatgtttggcctgtgaatgggaaaagagagcctctctgtgcatggggcgagctgtacctactgatggtggcttgggtcctgcataaactagctgaagattacccagtaagcatggtctttccctcaggcatgaggggttgaaaagaagccatccttttgtttgggacaaataataaggggctttccctaggtaggggcccgcccacattagtcaaatttgtacccatcagatatcattccaattaaatctaaaggaatatcaacacagtgctatactgaaaatttcctgttgggcatggtgtttattatgataagatcgaaaatatcttgctaaattctcccggaagatattattgaattgcagctaggatttggagtgagaaggactggactctagttctgccttattagtta

SEQ ID NO: 45686 - DNA, 1142 bp, Bovine  19866881340598
tcactcactagcaatggaaatgttctgattttctacagatctacaaaagttctgtggaggccagaaatggaatcatccagaattgcagtttccaaattattccttaggtaacccaggcccctcacagctatacctaatgtctgtctgatatcatacaaattactaactctgaaggaggaaacagacagaacaggctccatcttgaaagcaggactccatcttgggccagactatggactttgagctatatgcccagtatctatggaaatgacataccaaccggaaaaccagactcccggcaggaagagccccagggtgcataccgagactctccgttgcctaaaaggataccctaatcatctgtgtaactgaatagaatcacacattgtattatgcttattggcgtatgaccacaggcctattgataactgtccactcacgggttaactttgattctatctttcttttcctttgttcagactagtttcagggaatttggggtggtgggtttcgtacacttagggtatataaggttttcacaaaaactggtggggtccttggctaagaggagactctgccttgggcccgccggtgtaataaactgctctccactctctgcattgtccttctgagtgagtttgttgcctggaacgcgtggctacaacaactcaaaccactctcagttccaaagttacattgcactacatttctttctaagacatcctgtcttcgtgaagtgggattttcataaaacacaagtaccgtgcctaatgcaatacaggaaaggaaatgagagtgttggtgtacaatctgattcccagatctgagaaactgtgcagtgcccaatagacacacatatcccattaggaagtaattgtggttgtttaagaatgaaataaatgtcttccattcatatatcttactttttcaaacagctactaagttgttaggacataaatacgtttcagctgatttgacctaactgcctaataaacagaatggctggctatttctcctagcctagggatggtgtgagaaagtaactgagacactaacatcatcttaagccaagaactttgggaacttctgcttagaagttcagaatggctctaaatttcttagtaaatggcttcttcagattc

SEQ ID NO: 45687 - DNA, 1522 bp, Bovine  19866880107376
ccacaggaaaaaccatagccttgactagacggaccctgtgttggcaaagtaatgtctctgctttttaatatgctgtctaggttggtcataactttccttccaaggagtaagtgtcttttaatttcatggctgcagtcaccatctgtagtgattttggagcccagaaaaataaagtctgacactgtttgcactgtttccccatctatttcccatgaagtgatgggaccagatgccatgatcttcattttctgaatgttgagctttaagccaactttttcactctctgctttcaccttcatcaagagtctttttagttcctcttcactttctgccataagggtggtgtcatctgcatatctgagcttattgatatttctccaggcaatcttgattccagcttgtgcttcttccagcccagcatttctcatgatgtactctgcatagaagttaaataaacagggtgacaatatatagccttgatgtactccttttcctatttggaaccagtctgttcttccatgtccagttctaactgttgcttcctgacctgcatacaaatttctcaagaagcagatcaggtggtctggtattcccatctctttcagaattttccacataaatggtattcatgaatgcagtgaacatatactaaatggtacattatatactaatggccaccccccctcagaaaactgtaaaatcaaatgatggagggagagtcactgagttcaagagggtagagatgcaaaagaacgtgaggttggttaatctatacataacatttggtgccaggattttattattatcattttgaagctaccatttttgattgatgggaagatagtttcccttggcagggggcggagggtggggaatgtggctaacttctcctcattgagactggcagatgattaaaaaagtcttttggataaagcagacatgcattgcccttattagcagcatctgctggcttggaatagaagctttaaaccctaatttacggtgtgttacattctgcaagatcatgaaagactgaggttgaaaatatcttcatcacttagttgcaaaataacagtaaacattgcaagtttattgtttctagttaactttttcagtgtctttctaacttcgattagtaggggaaataactgcaagatgttttcccctcaggacttttatttttatatttgagcagcagcttattgtgaagctaatgcagttttaaagttagaattgcctttaaatcagttacggttccctttctgccatattgctgagaagacagctgctcttcatttgtaattgctcaagggcctctgatgagcttgcgcctatgggagaaatggtttgttgttctatttatttatttatttttagcaaaggtttttgaaagagccctgaacattgaagttcccaatccatgctcataatcagagcttaatgccaactggaacaatcccttggtttttctgagcttcagtttgcctgtgtgaatgctcggttgctcaggcactcagttgtg

SEQ ID NO: 45688 - DNA, 1537 bp, Bovine  19866880355246
ttggaggataattactttacaatattgtgatggtttctgccatacatctacatgaatcagccataggtatacatatgtcccttccctcttgaaccttcctcctacctccctccccatcccaccactctaggttgtcacagagaattggctttgggttccctgcatcatacaggaaattcctactcgctatctattttacatgtggtaacgtgtatatttcaatgctactctgtcaaatcatctcactctctccttcccctactgtgttccaaagtctgtcctttatgtctgtgtctcctttgctgacctgaaaatagggttatcagtaccatattttgagattctatataaatgaattaatatacagtgtttgtcgttctctttctgacttatcctctgtataataggctctaggttcatctgcctcgttagaactgactcagtgtgttcctttttatagctgagtgatagtccattgtgtgtatgtatcacaacttctttaccaattcatctgtcagtacatctaggttgcttccgtgtcctagctattatgaatagtgctgcaataaaccttggggtacatgtgtctttttcagttatggtttcctcagaatatatggtcagtagtgggattgctgggttgtttggtagtttaattcctggtttttaaaggaaattccatgctgttctccatagtgctgtatcaatttgcattcccactaacagtgcagtaacgttcccttttctcaacaccctctccaacatttactgtctgtagactttgttaatggccattctgacaggtgtgagatacctcattgtagttttgtaaatcagtgtttttcaaatttgagtggtgaacctgtttgaaatcaatttagatcagttaccatttctagaaaaaaacaatataagagtgcattgcaagtacaaagtctatatagaggatctgaatcctcagtacctaggaagaaattttcaaaagtctctgaattagaagatctctttaacttttacagttttattaattgttcatgagaagggcatgtagtgcgggaaaatgaggggtaggcaacttatttcaagcgtagtatctaaaatatatccacatattcttgccacaaaatgtcatggtcagtgatctttagaaagaaaagacttgttttgatacagtatttggtttactcacaacaggtagaaaaggtgaaaaaagtatataaaattacagcttatgaatgtggaaatatgtcttatctttgagaccagagaatgctcactgcgagaagtgaacagatgcattgtgaattacagctaccgatttaagaggtggtattattcagtctggccagaatgttctctcatcagtcaaatgacttccaagctaaaaagtgagaatgtgctctgctttttgattgcttcatttatatttcatccatgttattctacattttgtgcttactgttgggaaatgggttctttcagtggagagtaagggaagggacagcccagtaatttacaaaaaaacatgagtttcaag

SEQ ID NO: 45689 - DNA, 1161 bp, Bovine  19866880426717
actttggcccctcatgcgaagagttgactcttggaaaagacgctgatgctgggaggaactgggggcaggaggagatggggacgacagaggatgagatggctggatggcatcactgactcgatggacatgagtctgagtgaactccgggagttggtgatggacagggaggcctggcgtgctgtgattcatggggtcgcaaagagtcaaacatgactgagcgactgaactgaactgaactgaactgaattattaaatgatgtaatatgatttgaagtagagcttggctaaggtttacctgaatttattagcaccttttcacagtgtaggtgagttgttgaaataaaacttggggtcacaggaaagtaagacatttttaagtactactgcattagagaagtcgcgatttacaattaacatgctatttacaaagtttgccttatctagtcactaaaacaagtgccctgaggacctgattaggcatctatattattgaagtcaatggatgtttttgtgtagcacttcctgacgggctacagtccatggggttgcaaagagtcagacacagctgagtgactaacatttccacttttctgatttacaccatttttaagagtagcctatgtacccatttccttcactcaactcagttaataagattctattagttttattaacggagaaggcaatggcaagccactccagtattcttgccaggagaatcccatggatggaggagcctggtaggctgcagtccatggggtcgcgaagagtcagacacgactgagcgacttcactttcatgcactggagaaggaaatggcaacccactccagtgttcttgcctggagagtcccagggacgggggagcctggtgggctgctgtctatgaggtcacacagagtcggacatgactgaagcaacttagcagcagcagcagcagttttattaaattacttaccaactaagatcatttagtgaaacattaggtagaagcattttagagggagttttgctcaatttattccctcctacttgatctctgcaaggaggtcaaacaagtcaatcctaaaggaaatcaaccctgaatattcattggaaagactgatgctgaagctgaagctccaatactttggccacctgatgggaacagctgaactcattg

SEQ ID NO: 45690 - DNA, 1488 bp, Bovine  19866880462951
actagtacagacagatttcttctcttggaaatatgtgaaaccttttcttattctgtaggattttttttaatattcatattgtttatcctcaacttgaactttttgaaattagaaatgtttcattaattctttcaactttagatggacatgtctaatgttccagacattatactatctgctggccttcagagtaaaacctatccatgaagaattctctatccaataatttaaataagatatgaataaatatcaaaacatagagtattactgccatggtagaggaagcacaagatctgatagtggcttgcatgagagaacgattgattctggctgtgttctttagggtgcacagtgtaataccttatgcttattaggcttacagtaaacagttattggtaatgataatatggcataagtagaaattcacagaagagaggaggtggaaaatcatctttcttagaactgagatagatgccaagcattgtgatgataagaatgcttctcggtaatgggtggcttttattattaatactggcaatcacttattacagttataaattgctgccatttattgagtgcacattatatatcaggtaccatgctatattaatatatttttctcatggtacactatttaattataacacagtccctggtggttgggtatttttcctactttatggataagaaaacagaggctcagtgagacagtgaattcctgagccagaattataatactctctgtcttccacatttctccatttaaccactctatattattatcaatatgaagattggagccaaatatgtcgatatgtttccaaaacaactaattatttgaaacagttgtaccaatgccctaggattctttagacaattggaatagtcatgatgtgttattcagttattagcaaaattgaaatagaatctcttagagggaagagagagagagagagagagaaagagagatatagtttaaaatcatttcccggcaatgtggactattgaatacatgagtgaatttgcatccggtattcaaacttctcctggccttacaaattatataatagtaaagtgacaaactataaaaccagcatttaaatttaaaacagtactttagttcttcatgaagagtttataaagcatttcttggaagtattttcataggcatttcctcagtcaagatttacacttcattttaaataaagatttcttcctattgaatattatcctagtcatttacatttacgtttttttcatttattgcctttttgtaaatctgtgatcaaggctgttataataaaacttgtaactacttataagtattcactgggaacataatcttattctcaaaggattaggctataaacaaggattagtgtcactaaacacaatatgctagaattgagtgtttaaaatgagttacaaatgttttagagacttaaaataaagcgtttctttaataaagaattaagcaagtcttgtatc

SEQ ID NO: 45691 - DNA, 976 bp, Bovine  19866880511944
cactgaaaaatgagtatatttccttgtatttaaattatacctcattttttaagaggaaaaaatgtgttataaaaagaaagaaaaaaagaacttcaggctgcttcttaatcttacaaagcagagttagtatatgcatgttctgattttcctcttagggtcattgcttataaaaatgaagcagtcaacaagatcatacaacagagaacatcttgaaggatagtatagcacatatttacaaagagttcaacaccatggctagcaacagtggagatgaaaggtgttatcatatttagttctctcagctgcagttcttaagaattggaaacattctaatcagtttctactaattctggtatctctcccttactcttaaaccccaaggcttccctatgctgttagcagcttcactcttgacccctaactgcttgctaggtcaatctactaacacatcttgtctcttgtcatttctttcacagttacctgaatagatgctggctcaatatctcctgcctgtggacataaaaatgtcatgcagaatcacctccaagcgggtggagagttaaaaggacactacaaatgaaattaacaacagagaaaaatgccaatatatctgactacaggaaaatattaaagcccctatgcttttgaactgtggtgttggagaagactcttgagagtcccttggactgcaaggaaattcaaccactccatcctaaaggagatcagtcctaggtgttcattggaaggaatgatgctaaagctgaaactccaatactttggccacctcatgcgaagagctgactcattggaaaagaccctgatgctgggagggattgggggcaggaggagaaggggacgacagaggatgagatggctggatggcatcactgactcgatggacatgagtgaactccgggagttggtgatggaacagggaggcctggcatgctgggttcatggggtcgcaaagagtcag

SEQ ID NO: 45692 - DNA, 2240 bp, Bovine  19866880532530
attttccaggcaagagtactggagtggcttgccattgccttcttctctctattgctgcattgtaaataaattcttcagttccatttttctagattccgtatatatgcattagaatacgatgtttatctttctctttctgacttacttcactctgtataataggttctagattcatccccccccccacagaattgactcaaatatgttccttcttatggctgagtaatattccattgtgtatatgtaccactttcctttatccattcatctgtcgatggacatctaaggtggcttccacgtcctagctattgtaaatagtgctgcactgaacaatgggatacatgtgtctttttcaattttggtttcctcagggtgtatgcctgaagtaggattgtgggatcgtatggtggttttattcctagttttttaaggaatcaccatactgtcttccataatgtctgtaccattttacattcccaccaacagtgcaagagggttctcttttctccacaccctctccagcacttattgtttgtagcctttttgatgatggccattctgaccagtgtgaggtgatatctcattgtagttttgatttgcatttctttaataatgagcgatgttgagcatcttttcatatgtttgttagccatcggtatgtcttctttggagaaatgtctgtttaggtctttttcctaccttttgattgggttatttgttttctggtattgagttgaatgagctgctagtatattttggaaattagtcctttgtcagttgtttcatttactattattttttcccattttgagggttgtcttttcaccttgcttacagtttcctttgctgtgcaaaagcttttaagtttaatcaggtcccacttgtttacttttgtttttatttccgctgctccaggaggtgggtcatagaggatcttgctttgatttatgtcattgagtgttctgcctatgttttcctctaagagttttatagtttctggtcttacatttaggtctttaatccattttgagtttatctttgtgtttggtgttaagaagtgttctgatttcattcttttacatgtaactgtccagttttcctgtcccgttttcccagcaccatttattgaagaggttgtatttctagaatcttttataataccttcaaggtagaggtatagagtgttgattatcaagaaaagcttgttgaatcaatgattcaaggggtaagtgcttcagtgatgacatgggagtcgttttattatgaagcaattttatttttagtgttgtttgttattgcattttggctgtaggtactatttatgaacttgattgtttcaaggtttagtttgcaatctttagatggaggggagaaataacatgttcatcttgattttaaaagcgggtactgtgaagcaagtctgcagaaagctgttacttttttatgtgcataggtcctatgttaaaaagaacagaataatagtatttttattgggtgtaggacatttaaaaaaatgacattcatatccatcttcataatgctcacctttcccctcctctgactgactttaaaaattaatttgattatagaactgtcctatagggttaatcacaaatgattctgtctattaaaaatagccaagatataaataaatgaagttaaaatggctcctactcagaaattgtgcttacagatctgcaggatattgactcagtagtatactacctcactccgtgagtgcagtttcttagaataatgatgtggagtgtgtaccaagtgttctaattaaaacccatggtcattcatctatctaattgcaataatgccctccaggatacttccactccaaatgtaccattcttcttttgcctgagcaagtgactttaaaaccacctggctttgtgccaggacctgaagtgaaaaatttactgactgtgatatcacactagtaacagcattacagaatgaaaaattaaagaggacaggcaaagaagctagattttctatcaggtttctagaggtatagcttataaggtttcagtattagctgtcataatatctaattttctccacaaattaatagaagtcatctgttaataaaagactttctaaaatacactgtaacctctgagttcccaagctaaagaaaaaaaaaaaaatgaagctttaaggagacagacaccattattggctatgctttcttatagatttaacccagaaggctgggaaactgtattcag

SEQ ID NO: 45693 - DNA, 1611 bp, Bovine  19866880571539
tttgatgttcatagaataatccaactacttaataaagaaattataggtaaaccagagtgttgcaaggatcaaatatgcttaggcatttgataattaaactcttggatctgtccttcaaatagtgtaataattaggtttgaaatacatgctagacacatgggttttaggatgctactggaacaacagaaattctgatgaatggggttagacatagtactgtgtcaaaggcttgagttaactcaagtgattatgagattaactctcggaaatcatgcccttgacttctgcaatgcaattctaagaaagtcagttgttcaaaaaggtccaaaatgatcatcttggaaagtgcttaagaaatgggaagagtagagggaagagcctaagatttcaaattaagccacatatttaaaaaagaaatcataattttattgtgcattaacacctgtcttaagtagactttcataagtttatatagttttgacctggaggatttaaaaaccacttcaatttagttaaaagtctgccaggtctgccatgcacattatagattagagtgtatttaaataccatgaaaatgtactgttatgtaagaaaggcttagctccttctgtgctctgaggcaactctttctcattggttagtcagacacaaaccaggtgttatcaaacagaactatgacatctttgatatctgcaatgctcactggttccacaaagttagggaaggaatcaaaaataacatggaagcttgtggaaagagctataatgtgaaagagtctgggataagaatcataagacctatttctttactgagctctactaccaatggttaatagtgagggctaaaacatgcctcttatattttcccttcactgtgaataggaggctgtgctttgctgtgcttagttgctcagttgtgtccgactctttgtgacccccatggactgtagcccgccaggctcctttgcccatggggaatctccagctaagaatactggagtgggttgccatgcccccctccaggggatcttcccaacctggggactgaacccaggtctcctgcattgtaggcaaattccttactatatgagtcaccagggaagcccttgaataggataaaatgatacagtctttgctttttctttaaaactgtatagtcagatggaaaaggctgggaatctgaatggctgcagtttaatggattccaatgtatttcatacagatttgggaaatccatcaactaggtagcccagaaaatacagactaccacatatgcactacactggatatgggatctcaggatcaaaactaaaataataataacaaattccaggtttatttatgggagagtgggagtaaatatctccccccctacttctttctcagaccaggtttggcatcctggaacattccactgaaagatagataaaatcatgtctgataatttttttcccctttaagctcaatagatacacctatatttatattcttattatgtttttcttgaaacatcttgtcaccattcagaattttctcttttcaatcatcttttaccttcttctagtctctcttatttttgaattttgtatacattatttttcccactaagagg

SEQ ID NO: 45694 - DNA, 1720 bp, Bovine  19866880623568
ggctcctctgtcctgggatttcccggcatatctggaatggcttgccatttccttctgctttcctaggttagggagcttcctaacctagggatcaaacctgtatctcttgtactacaggcggattctttacccagtgagtcatcagggaagcctcaggacaatttgtgaagtacaaagtaaaaaaggtaagagcacatgaatgtgatagcctttctgaaatcctggggaagaaatagtagggtaatttttctcaactgcatgtcttgtttaactaggcacataaaagttgactggtcattaagtcacagatgaagcacaagggttacctctcctaataaactctttcctgaaggcaagaagataacgcctactgcttgagcaaatctagcaagagtagagttacataaaatgcaatataatactaagaaatattatatataggacactgcatcttcaatgaaagaataactgtcatcaaggattttatgaaaagtgattccactataaattcagtgagtaagtcacccaaagaattatatgtatagataatggcatcatattatcatataacaaacatgtcctgttgaaacttcctttatttgtgttgttacgtatgcaaaaactgcctctggtggtttctcctagtatgtgtccatagcactgggccttataaggccttaatatactgacagaagttttgtgtttaccttaaaaaaataatccactttttaatctcttctagtaggtcaataaataaacaccaaggaagagattagaaactctgtgcacacagaatgtcagtaaaaggaagcagtccaaaatgccatctaaccaatagcattaggataaactggtggatatcttatatgttcacttaatttagcaaatgattgtacgatgatgtctctcaaaactgcttgagatactggcttttgtcaagaaaaacaatctgaagttctggatatgcaccaaaagcttcagtctgtaaggacttttcaatctcctccagcttgcaagtttagaaactgaattgttcagcatatctctaataaaaaatcatttcccaaggctcattttctatgcaggcaaaatcaaattaactttaaacagaagaggttagatgcatacacaaaggaagtatcaaactgtaacatcatcttcctctagttctcgcaggtctcctagaatctacccaggagagaaacccaaatactaacttcaccttgagtgaaagaaagaaagtgaagtcactcagtcgtgtccgaccgactctttgcgaccccgtggactgtagcccaccaggctcctccatccatgggattctccaggcaagaatactggagtgggttgccatttccttctccaggggatcttcctgacccagggatcgaacccaggtctcccgtattacaggcagacgctttaacctctgagctgcaaaattaagcaagggtagtttccggatgggaatggcacaaagtgaattatcttactgtgctgttgaacacactgatgatgagactatagtcctctggacttttatttaccatttgctgacagccaacagcgatcctaggttcctttcagagcccacacgttgtgacgcatcctggccttgatcgctgggaagctgctacatcaggggatccccatgctttggcattagggctgaagtgatgctctgtaccctccgggccagactgctatgtgagcaccacaa

SEQ ID NO: 45695 - DNA, 739 bp, Bovine  19866880627252
cttatgaaggaaatttcctcaatttgctgaaggataaacttaagtaatgcctcaagaaagggggcccatggacccaaggaacattgggacttggggaggaggcaaagatgacccttctctccatctttgttcttgaactagattaacgaatgagcaagactgacctcaattcaaatccctgggtaataaattgcaaggagtaagtaaaataacctcatttaaatctattttttttaatgtaaaaattaactttgaataataagtagttccctaaacagtattttatagtgtcagagactgtgtaaaatagaaaaaaaaaacataaataataaaaaaatccatttagtgtttagtagggacttagcagcagcagcagcagggagtcaatatataggagctccttcccatgtacatacagatgcaagcaaacagatgtgtcaaattcaggaacaagggaagggacagcaggaggagttaagccaaccctttctctttctaaagggggcaggacccagaagttccacaatacaagtaggtacagctgtgttaggcaatcactgtgtagagcgagtttctgctgctctttccatagcaagagcttgtacataaaagccagagagaatgggacacaaacagctgggaaataaagatgaaagcaaaactgtgtcagcggggagagacatgcaaccccctgagaacgtggcagcgtcatgaaagacaatttaaacaaggtcacagg

SEQ ID NO: 45696 - DNA, 1329 bp, Bovine  19866880630130
ttttttcttcagaagcttgaaaccaagctattttggagacctatgatgtacagtataaggagagggaaaaaaagaagtgtgaaaacttgattcaacaggaaggcagtcaaggatgcactggttttagtctgaaatgcagatataaaaagtgctaccaagtgtttttgagtgtgtgtgtgtttgtttcagctttagatctcagaatatatgacactgtcaaaaagagataataaggtctctgagaaagaaatatattaagaactttgtcactagagtagctaaaacttacaatatacaaaatgtgattataaagtaagaaaactaattctcaattgagttcagttgctcagtcctgtctgactctttgcagctccatagactgcagcaaaccaggcttacctgtccatcaccaactcccagagcatgctcaaactcacgtccaccgagttggtgatgccatccaaccatctcatcctctgtctaaattaattctaaaatctatatataattttttttaatctatagtcaccttgacaacttaatctctatgcaggtggacatctctttagaaaatagttttctgaaaataacatatatgaaaaatgcactggtaaatcctattaataattgaactgttttctctctttcttttccttttgttctctccttttcttcctccctcccccaccccctccttttctattttctccttctctgttttttgcctattttatgacgattattttcctattttggtttttacagcaaaatctatagattagaaccgtttctttaaaaagaattgtcattattgaccatttttagatgcaatttaacttctggttgtgtgagagggtgattacatttggaggaagtaactctttgcttccaaagaaaagtttgctgatgaaataattctacaaagttaaaggaacacatgactactaaagcattgaataaacatttgttgaacattttttacagaacagccatgatgcacagggaaaatattgtaagcagaatagttgtctgccctcatgtaatgtgtctctagcaacatattctggataatccaaaaaaaatgatacagtctagtatctatttttagaatttgtaaattgctagttttctaaaaattatcccactctttcatcgaataaaattagacagtgaaaagagagatcagaattttctggttcacacaactagagccatacaaaacctatcattaaagagcatgcaggattagaactcaggattagaactctgtgtaggtgcccgcacagaactttttgcttactaggaagcatttctgccgactcccatgtt

SEQ ID NO: 45697 - DNA, 2840 bp, Bovine  19866880692403
cctccgtactcttgcctagaaaatccccacggatgggggagccgggtgggctgcagtccatggggtcgctacaagtcggacgcgactgagtaacttcactttcacttttcactttcatgcaatggagaaggaaatggcaacccactccagtgttcttggctggagaatcccagggacggcagagcctggtgggctgctgtctatggggtcgcacagagtcggacacgactgaagtgacttagcagcagcagcagccccagccataaggccccctcagaagctgtcccctccaaagctgccccttcctgagaccttacctgttactaggtcctgccctagattctgggttacatccctctccttctgacttctcttccctgtcttgtctccctgttcttatttcttaacatggatacttctcaaggttccattctctttctctctccatccttaccctctccaacaggcatgtatgttcccacatctacaatacccactctgcgtgagcggctcctgatctttctctttagtacccgccctgctttccacaacagtggaggaacctctctgcggatttttcaggaagaatatagcttttctcatttgctgcccagcagccagagcatacctggaacacagctcagtgttcagcacatgttttgtgagtaaaaaaatgaatgagtcgcctcctgtatcctctaattacctttcccaatgagcatatccatttccaaagtgtcaataccatctccatgtcaattggttgaacaaacaaatgaatgagtttaaaacaaaacttttttttccacctttatccaatactccccctgcttgctgtgcccttaaatgagttttagattcagagtgaatgagtttgaaactgtgatcaatatattaataagtgaagtctcaggcaaatcacttagctttcctgagccatctccttaggaaacaaacaaacaaacaaatatcacagagaataatgatcactctacttgtatattatgaaaattaaatagtacctgtaaaatatctcagtgccagccatattcatgcttatcagctttaatctcttaactttcccaaaagtacatgaagtatctcacttaaacctcacagatatcacatgagataaatacttttatctctattttatgaatgaggtgatgagaaaacagagggacagaatgtgacttacttgcacagtcagaccaaagccaagtccccaacgcccataaaataaccatcttactcttagattataagctaagaggcaggattcagaccttataaaaaatgataaatcaaatggctccaaataaaatgagcctttagaaagtgatcattaaatactgaagaaataaatatatttacttttggaaatctgacttctcagtttgatggtaagttatttcagggaaaagcttgtgaatgctcccacaatactaagtgaaatatacatacatacatatatatatatatatgcacccttgacttaaaaattatggtctaataaagaaaacatacttggtgatgcttttccaaaaaacatgagggagtggatgctgcacaaaataagaattttaagataagaagaaatgagaaagaaaagtgtttctgagcaaacatgctccagtgaaagttgtatgagtcaacatcctagaaaccaagttacaatttcttcatcagaagagggaatatatgattgagaaatctgttctgctaattggggttgaagcagttgcacttgatgaaaaggaaatcatcagaaacagtttgatgttttctataagaagctagaaagtgcattataattccagttgtggatagaaatttaatgcattttaaacagggtggaaagggtgaataattgttttgtcagttggtggagtagattttagtcatctcaataactataaacctaattgaaggggagcaggaaggcatatcagaaattggggaatgtaaaatcaaatggaggaaagcagattgactgcttacatgagaaattaatatggtaaattgcttagacagagtttttgattaaatgaggaacagaaataataattagaagagaggtacctgactcaaaaacaagaagaaagaactgctcaaatacagcaggttgttgaaaagcttaaaaaaaaaagatcctgaagcgaacaatttgttttatgaaaatgataagaacacacaaaatataattgcttaattagaattatattacttaattagagtcacatccttgcagtgatagatatggtataactgaaaagtgtggttatgattggagaccaaaaataagtggggaaataaaatttctaagtggaaatacaaagatttgctctctgtgacaagggatagtaataaaggtgaaagacatgttttatgggccctgcaaaagctcacaactctacttagaagtaaagtttctagaggaatagctgaactgtggcctttctccaacagctcttttttctactagatgatgagagactagaaactcaagattaatttgaaagacacttgtagaatcgtgtgatcattaaacttctggtaagaataagaacagaggaaaattacatgaaagactgtgacatttaaaaaactgacaatgggaaaatgccttttcagattctaagtttacctaaatgaaaattaggtgaaaaaaatattgagtgatgtggttgcttatatagacaaatggcaccccactccagtactcttgcctggaaaatcccatggacggaggagcctggtgggctactgtccatggggtcgcgaagagtcagacacgactgagtgacttcactttcccttttcactttcatgtattggaa

SEQ ID NO: 45698 - DNA, 901 bp, Bovine  19866880702211
tgctgctgctgctgctaagtcgcttcagtcgtgaccgactctgtgcgaccccatagacggcagcccaccaggctcacccgtccctgggattctccaggcaagaacactggagtgaattgccatttccttctccaatgcatgaatgtgagaagtgaaagtgaagtcactcagttgtgtccaactattagcaaccccaaggaccacagcctgccaggctcctccgtccatgggattttccaggcaggagtactcgagtggggtgccattgccttctctgtattcaatgctaagcatagttaaaatatagtttggatgcctctggctgcatctaggggcctgaggagcagggaggaaatgcagtgttggaggaaggaggtagtgtcttgctcctgttagtgctgggctatgctcatggattcccaggggtggcagagcctagtggactgccgactatgggatctcacagagtcggacacgactgaagtgacttagcagcagcatgctcatggattattttgaccaagattgtttattgtcccctgctttcagttcttgaataacctaactgcccacttggaacggtttgccttacaatggggagaatgaatttctaggtcctttaactcccaccacatattcagaaaaaaactaaaattgcaacactggaaagggagaaaaaattacccattgccactcaatatatttcactcagaaggaggctttgaaagaagcaatgatcctttgtgcccaaggctgctcaatttgagcactgcatcctgttactctctgaaatgatattttgtttctatttggattccaggccactaaaatagagtcctcctcaggcgaatgtacaagaatacagtgtattgtcctcaaataactctccttacagaatgat

SEQ ID NO: 45699 - DNA, 1703 bp, Bovine  19866880726904
aatttattgtctgctggcctggcccacagagaccaccatttccccagagtagctgggcctggtaaccaaaaaacactgtgtagcagaaccagatgcaaactggattttagaataccttatgccgtggtccactcctgtgtctcagtgtgtgtcctctggagacaagaaccaccccagatagtacctcttggagtttgacaatgtctgcagactggtcagaagaaggagctaggaggaagttctcacagacctagcctcctggcccatggctctataaggctggttacaaattggtgtttttaggtctgcctattgttttcatcagatctgagttggattttaaaaattagagataactgtaatatcaggtcccacagaaacctgttgaattcaggagtaaagagacacattcacaaggaatctttggtttatggtagccaatatttccaagatgggacagaatttagctcggccatcccagctaatctcagtaagtacagggcatctgattgtacagatgaatgtttattcatccgaatatcgtttggtgttcttttgtaaatgtaaatgattgtttttgcttatggttcattttcttttgttttttagacaaaatgggtttgggaaattaaagcctatttttaagatagaaataaacaaattgcacaaagtagttgtattgcctactatatctctagaatgactaatacatgtaaagaaggtacaaaatatatatttaatcccattacaaattagaataatgatccacaaacccagattatgcctcagagctcctgatgtcttagaaagaatagtgatttgaagaataaaaatttgagccgtaattctagattgattatagtagttatgcaaatgtaattataattttctgtgcagaaaaacatatttaaatagaaagcacagcaatgatttttttcagaagctattccagtgaatacttttactgtaaagaagaatttggtgtattttagtaattgtcagccaaccattatgattgtattactgtactgcgtaattttcttgaattggatatgtctttttgtatgattttaattaccaaaagtaatgacaaaccttagtaaatatgctaattgtacataatagcaattttctccatataggcataatattcttgaaagtgtttttgcatttctaaaggaagaatgtgcagggaactcagatgaaagccactgaagagagcttctctgagatccattaaaaggtgggatgtcctcctcacagcaaataaatttcaaacaagttgttatgcttcaaggctctagttaccttgggtctggctgtcctatgattttctgaatgatagttggagaatgtgaacttaatcctagtttaataatgaccaaatgaataatctaaagacatctccattatgtgagtacagtaagtcccctacacacaaatgagttctgttccaagagagtgtgcataagtccaatttgttcataaatccaatacaattagcctaggtgcccaactaacacaattaactatatagtactgtactgtaatagatttataatactttttccataaataatacatgaaagcaaataccaaaaataaagacaacatttttaatcttacagtacggtaccctggaaagtacaacagtgcagaacaatgactgccagggacaggtttgcatctttggaagcttgcac

SEQ ID NO: 45700 - DNA, 947 bp, Bovine  19866880737964
atctatttgcaagcaatactcaaggtcattttaaactatgtttttattagattaattttttgttcaaagtatcaaggctcctacatagttagagctatgaatacggaaccactattgtggcttgtgtttgttcctgaagctatcatgccttttttagaatagtttaataaaaagcaaatatttgagtatataatttttttcaaatgttatacacctcagcatgtcaagctttaaatgaaactgaaggacactcaaataaagtcacttttgtcaaagccttctcctatcataacatatttggatgatgcaagatgcattcccttatgatgtccaagtggttgataaaccgatttctgtggaatatgtaagaactattcagactttgtggtttccttaaatgagatgaataagaatttctcttttctgaataggacataaagtatgctaggcctattttagatgcttcagtgtgccaaagatggtattaagtttggtgttcataaattactaatctggaataagagattgaatgtattttgaaaacttaaacctgtttcacctgaacatgtttaactagttaataagaaacatcaaaaagacaaaaccctgagatcaacggtcatttttttgcaaagctattatatgctgtttaaattggttgttcgggtctgtctataacataagttttaataacctagctcaaatgcagatttctaattttcaattaacataggaataattttgtttgctaaaataaaataaatgaatgaatgacaagtctgaaacatgaaatgttctaggtagaactttttaaaattccaaatttcaaaaaatcatgtggcaactgtatagctcaagctttaagtattaacttttaacctttgaccttacagattttaaccaatgaaatgtctctttaaactttaaaggaaacaatataacgagcg

SEQ ID NO: 45701 - DNA, 1251 bp, Bovine  19866880774279
ggttagcctgtaaaatagcatttcgtttgagctgcattttactttttgagctcacctattagatttgtgggcataaacaggctctctttgtagttaacaagaggctgactctgagacaagggttacagccatcaccacatactttatgttagacaaataaagtaccgggattgtaaacatattctgcaattacagaaagtgaaatccttttcttctttcaccctgcttagaaagaatatttttttctctagaaagaaagattttctctttccagttcccaactccgctatgtacttgtctttcaaatcaaagggaaagatcttatcaatataaatgaacagctcttgccaggcaaacatgtgaccatgatgattcccacagggctttggaatatatcaggacagaacagaaggagccatggagggggcgtgtgtcagaactgaggttatgttttggtctgctgaagcagtcgttttaaccctatgcaagtcattcaaagctcaaatttcctgcaatcatattaaagtgctaataaccacttgttcagtgtttgctgtcatggtaaatgagacagaagctgtggatatgctctgagtgaatcacaaagtcccattcaaatagacacttctgttattttctcctattactgacaagtttttcaagcattttgtcttgctcatttgagtaatcaagtatcaataaggaaggaaaaaagtctgttcagactttcttagcagctggtgaaagaatatttgcattggtgtatatgggttgggcagattcatcatcagagactcagggtacaagccagcctcagacccctgctggtcaggggctccctatgtatctaggaaatctcaccaataaaagaaaactaaaaagctctagaagaaactcattaggtatctggttaacttgactccagattgattaaaagctgttgggactaaaaggtgttgcaaacacctacttttctttataaataacatgactaagaatacatttttctcactctttaaattttaatcatgcatgcattcttaggtgttgtattttttgagctgctattaaaaatacatatgtttctgccatataaaaggaggaacagacacttgtgtgctgtattattaacatcgtgctagagatgaaattctgggtcagtctttgcagaaggcacacacacacacacgccccataagccaaggacgtgccacatgtacacagccacgtgtgttcctgcctgctgctctg

SEQ ID NO: 45702 - DNA, 1713 bp, Bovine  19866880777881
acgggtgatgttcaatcttcattacacgtgggaagaaggttcagtgccttttctcaggtctgagactgggatcagttctaattcatattttcattaatatcagggatgatgggatagggtaagctcaatacattttccaattatgccaaattgaatagtgaagctaacacctggaagaacttgattgcaatttaaatgacatttttgagtttctaaagaactgaatgacagtttaattagacaagaacaagatgctggggacaaattactagtgatgataagaataattttgctgtgctttagaaaacaagttcacatctttgttaattttatttcaaccttgatggaaggtatagttatcactctggaggtaaagacaggactaggtaagcatttaatggggttggtacagaaagatggtgggatgaacagggatggagttgaattaaagagtgaatcactaaataacttggcaaccaagcttcacattatggtgtttaagattataccttggggtaatatggactaattttactggtattctaaaaactggacatgccttgaatcagtatgttgtactcaattttgatatccaaagtgcaagaaaaatagcagaggtccagaagagatcaacagaaattctgcttgactaggagactaggtctaggaaagactggaaattattcagcaccaaaaagagaaggtgcaaagtacgtatttaatttcaaacacattttcatggttcatattggaagaacagtcagcaggtcttcaatatttctgttgctgttggacaatatactcttgctttttttgtttgtttgtttttcttgaagtacattctcaataaagacaaacatcacatcaacgtggacctgggatgtatgattttctgtcgggatgatgcaggacaatcattgcccctagtccttctccttctctcttgccctcccaccctctccctcttccttccttccttttcctttttcttcttccttcctaccaatcctcctttcctttcttcacttctttcttctacctgtaaaaaattctacaactttagtgaatgtaaaatttggagcagagattaaaacttgagctaagaaagctttattaatattatctgattcagtctcaccctgtaaggtcatttctttgtttgttttttaaagttgaaagtgccctgtagatgcagaaaatagtaatagaccatcttcccttttaggtcaaatggcaggggatcatacaaggctggagttccacaatatagagaccgggatcatcacggaacgccggtatctgtcttctgttccctccaacttcattggacacctgcagagcctgacatttaatgggatggcatacattgacttgtgcaaaaatggtgacatagattattgtgagctcaatgccaggtttggcttcaggaacatcatagcagaccctgtcacctttaagaccaaatcaagctatgttgccttagctacattgcaagcctacacgtctatgcatctttttttccagttcaagacaacatccctagatggactaattctgtataacagtggggatggaaacgactttatcgtggttgagttagttaaagggtaagtgtaggtctgttcaatgacaaataattagagctttgggaaaatgaacctcattttccataactatatatttagcagaagagggaaggtggtttgcaaataa

SEQ ID NO: 45703 - DNA, 836 bp, Bovine  19866880782075
ttattttaagagaattcaggaattcattcaagttctcagagtggcccctggtttaaactgtagagaggcttatctggaaatcactaagaacttagtttctgttaaagtatatattttatatgaatgaaataggttattgataatgagatggaaactggatccacctttttcaaaaggtgaaaggactagtatacgcattgcaggcatagcattggcgttttcattggaatttgaaagagtagatttacttctgcatcaaacgagctggctaatagaaatgcttggttacactgtgtcagtaatcacaaatagaagaatagccagaaaggaatttggtagattattgctctcatagaaataatgtgtgaatgaccttgaacttcttttgttggaggtaatgttggtggaaggaagcctcttcccaatgaagaaaaacaaacaaacggctactacagttaaaaaatttaaaaaagctaccagctaaggagtaatgtcacttcctagagaaaaggcaagtgtaatttgctgttaatcaaaaagaagttacatataaaacatctattatttgtttttaaaactaagaaccctcttcttgtgagttctgacagtctttcataagcccctttaccttagccagaaagttactctcttatttgattatcacattatagggttctgcagagaggcataaaaagctaaaaggtgagcttgttaaccttgtaggtcagaatgaaaatatgttttaattcacagctacactagttagactcagtgccttgaagggaaagggagattgctttgacaggttcagaaatgttgcttcaactcagggagtt

SEQ ID NO: 45704 - DNA, 1361 bp, Bovine  19866880797946
tctttgcgaccccatggactacagcatgccaggcttccctgtccatcaccaactcccagagcttactcaaactcaaatccatcgagtcagtgatgccatccaaccatctcattgtctgtcatccccttctcctcctgccttcaatctttcccagcatcagggtcttttcaaatgagtcagttcttcacaccagttggccaaatatttgagtttcagcttcagcatcagtccttccaatgaatattcaggattgatttcctttaggatggactggttggatctccttgctgtccaagggactctcaagagtcttctccaataccacagctcaaaagcatcaattcttcagcactccgcttttcttcatagtccaacactcacctccatacatgaccactggaaaaaccatagctttgactagatgggcctttgttggcaaagtaatgtccctgctttttaatatgctgtctaggttggtcataacttttcttccaaggagcaaacatcttttaatttcatggctgcagttaccatctacagtgattttggagcccccaaaataaagtctctcactgtttccattgttcccccatttattcaccatgaagtgataggaccagatgccatgatcttagttttctgaatgttaggttttaagccaagtttttcactctcctctttcactttcatcaagaggctctttagttcttcttcgctttctgccataagggtggtgtcatctgtatatttgaggttattgatatttctcccggcaatcttgattccagcttgtgcttgataggagtaaagaaaggaatattcaaaactgaagcatgaagtaccaaaaatattgtatctgtatcttttccactcaaagttaactgttcttattctctgctccaggattatgatggtcatgaagaattatccttggttgggtaagttgttaacaagataatgattaattatttaaaatatttacatgaatgacatatgaaactaaccctgatgaagctttttaagtaaattaaactgaaaatgggttctgccattttattaaagactgccacaaagctctaaacagtacttgtttatgaactgctttgaaagataaaatatttgctctgtagtgatcattgttgacaaagtgccaagaatcattttcaaattagcaaagataatacaatattaagtgattcataagtcacaatataaaacagagaaaagttagagtgaacatattgaaaatattgtctcaaaagagattaattttaaagtaacttaaaatggcaataacattaagtcacttaattttaacttaaatgttaatttatcttaaaattttattcaggtttccttcc

SEQ ID NO: 45705 - DNA, 985 bp, Bovine  19866880827414
tttggtagtcatctgtactgttcaggaatagctttcagggagcatgtgaagttatggacacaaagaagccagtatgtatgccttcctattcctcatggttactttaagaccatttagatgaaaaagttttacactgaaaataatttctgtggttagcagaagggaggaataactaaagcctggactcctgatgatattattgaatttctcagctcgaagaactgtcctgtttgggctttattatttgggtcaattaattagattgctatttaagttagatctttctttcttgcagctaaaaatatacccaatgttattattttgtaatccagaaaatatgataaaatacatattgtgtttgtgtgtgtgtggttttttattttgaggtttcactttttgaagtggaaacacttaagcagcaatagaaattattgacataggaatatattttagagaaatatagaatattttttaaagagtggaaagaaactgtggtttgagtattatgtttagggaggaagccagactgaaaaagatcagggagaaagctatctcagaggaagtgggtagataatatcagattcattttaatatgaatattagtttcagattaattaccttaagtgcaaacttgataattgtgtttccatgatttataaaattttctatgtggccaaagctaaaagaaaaaaaaaattattaattactaaatggatgtggtagtatttcaatattgctatttaccttagtagaacatacatagtttagcagagtttaaatcatcaatgattgttatttggttcttacttttaccttaattttttctgtgagtgtcatgtggctctgaatgttgtataattttgaggagcacacacaccagctcttaacaagtttgacaacaaggaaagccttttcattaaccatcctgtaaaaagtatttgggaagtaaacccatatttatatatatacatatatatataattat

SEQ ID NO: 45706 - DNA, 1165 bp, Bovine  19866880858945
acaaagcctttcctttgttcaaatgcaaggatccagtaaaaagagctttgacatgttgtgccttttatgtgtgcatttttctggtttcactgatgtccggaattttgcaaactataacgtgtgccttcaagttctcctatataatgccatttgtacactgtatcaagaacagtttaggatagcattacattcacacgactctaacgtccaataaatacttgatggtttctcagaaaacccacagtggggtgaaacggacgcaaaacaatgctttgttttcgtttgtttttcataaaatcttcccccgatacacattcactggcttacctgcagggtagcgctcaatcaccggccagctgtccacctgcaacgtggcattgccaccacttctcgtgaagcggactacgtggtatttcccatcgttaatgattgcattggactcttcgatggcgatgtcatccgtcccaacattaaatttaactccaatttttccttgatgctggaagagagcagaggagtaaaaagagttgagtgaagttgtgctgattcatcagtatttagtaaggattacattcagggtattgctcaaaaatatggttcagaacaacagttgctctccttctattttatttcttaaaatttgtgctacattcttgacatctgggtaaatctgaagcatctctctcacggataattaatatttcaaaagacacgctttcaagagaattcagccgccttcttcccaggggttgccacagacaaggtgcacagctgcctgtgtgaaacgatatactttcatgttctttaacatagttcctttaatccatgccttccatttcacaagaaaaatgaggcttgaaattctcccttttaataactggtgaaatcagagcaataaagtctatttctgaatacaacgtggacaaaggctaacaatatagaaaatcattctctagagtatgaacacacaggcatttagtgagtgcaatcattattcacacacagaagatcctcctatgctaagactctgaaatttactcaaattattttacagatgatgaaatgatgacgcaggaaggtgcaatgacttgttcaaggtcgcataataaaaaggagggatgctagagttagaattcagttccctcgttcttagtgtatatctaag

SEQ ID NO: 45707 - DNA, 1530 bp, Bovine  19866880865094
tctctgttctcatgccactcatcgagtcatggatccatgtcactctttctagacatcccttatgtccccaaaagtcttactttccttttctagtttcaatagtcaaaccctttgtttctttagtatagcttaggtagacattaagaaagcaatctgattcaatgacgtcaacatacaagcgctgaccatgtactcaaagtactgtgtcaggcatacatgcttggactttggctggggagtcaagggccaaattaaaaaagttagatggaaattcaacataatacataacttggtatccatctacaataaaccaccgtttgaattgtagttgccacagaagttcacagaagaaaatggattagaacaaagaaggtgtgacagaacacacaggattttacctagattgcaaataatctaaatcttattgaaattacaaccagataaaaaatgtattgtaatgtggatagtaatcttcaaaaggttgataagtaattattctctgtaacttcataaaactctacactcctacatctattttataatcaatacattctctaacagaatatattttgactcaaaataattacagatatgaataaaagtggttaaaatacttctgtcatgcaaagtgaaatatgtaatacacataatgttaggactattaagtaaaacactatgtcagttggcaagaatttgagggtaataggcagaaatgaaaatattcgtgttagggtggagggatgatgagtgatcttttccaaaatttaattgaatattgttggtatatttataaacactgtaattttgcccctactatttctttaaaaagaagcattttctacaaattaaatgtagtatcttaacacaatgttatagcaagagagggtggcacactcaagtgccctgccaatcagcccacttgcacagctgaagaaagaacaggctgctcaaggagggaaatactctgttcataactaatgcttcacagggcaccccagttctttctgcagaacagcaggcctttgtatccagttaaataatatcttcatgtgagactgctgttatgctgaacatagaaaaccacaagctatctatgcaggctttaacagtgctttggggaagaaattagaagcttagcgtatttctaactggcttaagaaatttctcccttcatgtccctttgttatgtggaaatacattaagatatctagtgtgcctttatagaaagttttttatgagcatatgttcctactagctacttacattcaaaattttacttcggatattgttccatcaaaagaattagaaataaaggtaatcttgtgaactttgggtctcaactgcctatgtgtaatgaacagtgatttataggttcttccctaagccttctaggatgttggattcctaatacaaaaacaaaaacaaaaaaacaactggagtatcatatcaaaaaccagcagtggaaaaaaaaagaaatgaaagcatcagggagaagcagataagaaaatacagaacatactctgataaatt

SEQ ID NO: 45708 - DNA, 1859 bp, Bovine  19866880884123
agttcagagaacagatcccaactcctccaagttggagaagagcaagaggtttgggttaaaaccttggactgggaattaaggggaacactgttttatttaagtcgttcccaaactgtcctgcaaggaatgttgttagataatatgttttgtatgctgcctcaatgggggaaaaaaaaatatgccaaagcaaacaaaaataacagagtactttggagctgaacaagtttgggaagggctaggtagaatatatttcagctttctttattattttcatgattaaccatttatatgctaatcagcattatgaaccttaaaaaagtattaagtccactgaaaatctgctgaaatttgggatgtcctgctttatgtatcctccacatggtgactttaagggagcagctacagctgaaggcaatcagttgaaaattcaaggacttgggatcctggtcaattcttttccagatataatgactaacaaaatttaatactaaaatgatcagaaatatttctgcaaaaatatggcccaatttatttaacttaagtatgtctctaattgataacatattaagcaaaacttatttcttattggtatcatcttctgacatcagttgggcatctctgaaacccattttaattttgtagaattctcagactattttggaagcaaatgttcaatggagtagacttagataagattttcaaaaatgaatttctcagcttgggttgtaaaacttaaacatgttcactgttcatctgcaagagaatggtatttaggcagtcctttctcaactgaattaatcattaacacctttgtctggagcacctaatatttcaaggatttaaaggtgtccatttaaataccactgatggacaaactttatcatttgactttattatcatagatgatgagggttttctttgctaagtcttcaaaatacaaccaaactcagtcatgtaattgagaaacaaacccaacactgagctagtgacaacatcctgacttaggtcttggtgttagcaagatagctgatattccctttgaggacagggaccttgccttgtacatctccacagtgctttgcacagaactgacactgagctccataaatgtttcctcaatgaaggaagaaaggctgtgctgccacgtacagtgcaaagtagttttcatcttcaaagccctttattcacattaattcagctatttacattttgctgatgggtaaaggctggagaggctaaatgggctgttaaaggccaggaagagtaaagccctgcctgtcaggaagcagacatttgcacttactgatttccagtcacatgccccaggcttcatccaagggagaaaaaaacaaaaaaagacatttaaccaagggcaggtaggtactggttattctactctcgtgataagataatagctattaaagacacaaatccactagatggtccccacagttctactgaacaggtgtaaacaaaaagtgctctgtgttgtgtctttagacatgtgactcgtgtgtgtgtgtgtgtgtgtgtgtgtgtgtgtgtgtagaattctgatacacactgtgatgcagaggtaccatttcccatttgcaatacctaaatggcttccaggcgccatgtgcagtttacacagaaattgaaatgcatttgacctaacgcttattttgctctagcaaaagtgtgctaattgtacagacccaaaggtggcggtgtttgctgtttagtcactaagtgatgtccaactcttttgcgatgccatgaactgtagcccaccaggctcctctgtccatgggatttcacaggcaagaatactggaggggttgtcatttccttctccaggggatcttccatacccg

SEQ ID NO: 45709 - DNA, 1710 bp, Bovine  19866880991906
agacctgggttcaatccctaggttgggaagatcccctggaggatggaacagctacccactccagtattctggcctggagaattccatggacttcatagtccatgcagtcgcagggagtcggacatgacttaaaaaaactttaacttttttgtttaaaaagtttaaaaaaaccatcatttttttggttaatgtatctcatcaccttttttctcatgttttcttgagaaggcctggcaccctgacttaacttcacaaatagtcagacaaattttgctggtctgggtgatgatattattgcaaagaaaatagatatatgttcttacatgagagtggtctatggttttgcttccacttcttgtctccaaaagacaaaacaaaaccctaagaagatgctgctgctgctgctaagttgcttcagccgtgcccaactctgtgtgaccccatagacggcagcccatcagactcctctgtccctgggattctccaggcaggaatactggagtgggttgctatttccttttccaatgcatgcatgcatgctaagtcactttagccgtgtctgactctgtgtgaccctatggacagcggcccaccaggcttcgtctgtccacaggattctccaggcaagaatactggagcaggttgccatttccttctccccactaagaagataactgtgctgaaatgcatccataatgctagtccaattaggtgcacaaatcattcaaaatcggttaagaaaatggaaaaatatctattttaatattctgggtgagtttctccatttcactgtaccactcagggaaatcatcattttgctggagtacgtggcggtctccttatctcttggttacttcttactgttgatgggaatgcctgatatttcttattttcccacccatctgactgtaatttaccttttttcaaaatgattgccttgtcatttaccttttggggcgtctgctttgaaaatgctttgttttttaggaacgagtggatagtttccttggatatgaaatgttgatggctctcttgagacctagtgactgctgtaccatgttatctgtcctatttgtctgtgtgtatgtctgtgtgcattccattttttcttttcttttctttttattttttatcactagggatttttcatcccttttctttaaatacacacacacatgcaatataaacataaatcttgttgatgaacccctgctttaaatgtataacttactctgccatattgtccttatgtcataaatttgttagttgctacggttgtcccactacataatattgtagcacttattgcttatacaagccattttagtgcgttagaagaaatatagcagattgaaagcttcactcaatggactaggttcattaaatcttaaggactcataatattgaagttgagaaagatgaaagcagcaacagtccattgatttcacacgatgtcacttgctaaatggtcttcaaaccaagagagcaacctttataccaatccaggtttgcactggtcctgagccaaatatccaatcaatagagtgacgcaaagttaagttgatgtctgaggatgtagcccttatcctaaacaagctgtggtgttgaacttggtatgaagactggtgataggaacaacttggagaactctggaagaatatgtgctctaactttcttagttcagtggtactgctcttatttttctcattt

SEQ ID NO: 45710 - DNA, 1014 bp, Bovine  19866880999465
aatgacaaactttgctactgagaatcttcttaagctttgtgtctttctgtcctttgacagtgtgaacattagcatcacggacattttgtaattgtagtgccaaatcatgtggcagttaaagagaagagaggaacataccaataattcggaacctttccagaaagccgactagccctctggataagcagatgcatgcctaccactgcacatgtgtgcaggaaaagagaaatgactaaattcaaccaaatggtgatgagaaagatgagagcaatttatctgttgcagaagttggactttcccttcttgtccttcgtgtgtttgtataatagttctaatagctaacatttgttgggcaatgtagcaagggctctgcttgagtaaaaacttactctttaaatcaaatggatgaagtagacgccaatgttaaccttggcttttttaacaacgaaactgacacacattaggttgtgacttactaggtcacacagtcaataaatggtagcactgtctctgaggcacacatcattattatcctaatagtctctgtaagtgtctgggttccaaatgacttttacagcacagaacagtattcacaagtatcagattctcatccatattacttttgttctttaaacatgaagatatattagtaaaataaatgtgagaatggaggaatttgaaagtcagcaagctccattcttccaaatcctaacattggagaatctgtacaaagaacactgcagttggaaatagtcttaactttgagtgtcccacttcaacccagtattaatttatatccaaactcagtttgtaagcaaggatttattttctagaaggtgaacagcacatgtacatggacctaataataaagcctgaaatctttcagtgatttcaaagacaccatgagatttccaactaaaacttttatattggttttttctagaagaagaaatcctatgattaaagtttgcttcatgatagaagctcattgtaactgtgtaaaaggggttagaa

SEQ ID NO: 45711 - DNA, 2114 bp, Bovine  19866881020178
gaagatctcagcatcctgaagaactttatactgtcaaaagtttgcgaagattcactttctgggattatctttatagaaagtttctctcttgttaggatgagtgggtcttatggaaacatttagatactaaatatcataaacaaaataactttttgtgaattttatataatccatattaaaaagtactactaatattgttatagtcatattttttaaaattatttaatcagaagggttggtaaatggatccattacttcatgacatagatcatgtctttctaaagtaaatatcagtcttaaaattgatcactatcaagagaagaaaaacttttttttttctttttaaagcatattcacttttaaataagaatgtaaacagaatcttatgggatgacattttgtgaattctcttttatattctttgactctgtgaaaactgaaaaatacatttctccccactacttgccttgcagaatggctgaaaaaacctcatctcatctatctgaaatgaatccaatttaattctgcttgaccaaaaatctgtttctatagttctaaaacatgcaatcacccttcggtacataggcattgtaacttaagaggctctgtgttatcactgaggaaaatacacgttgattgagaaaacagtccagtatggcttttgaaaactaaatgaccctccctggcatacaactgagtaagacagttgataaaagcaggcagttatagccattatggaaggaagatgcctcatccaacctgcaaaaatgggtcaaaggttatagtcttagactgagcattacaaatcactttcctattgaaacttccaagactcataattctagcaaacacttaaattctgtatatatcaataatttctttgtagttggagggcagttaaaaatcaattgtgaagtaaaggaaattcacaataaattagcctgctattcaaaaataagcaatttgatttcttctccagtagtctctctttcatacattcacattttactacctgtaatcacaaacatatccttatgagagaattttaaaagctttcagtacaactttaaaacactgttgccacaattgaatatttgtagtatattattctaaattctttaattgctattattggtctgttgaaatctgaagatttaaaatatctattttttaatcaacctagtaatcttttatttaagtcaatacctcctcaaatgaaccaagtaatcactaattgattagatcatttacttccataaaccattgctatctttaaacatgttatagcttataaaaaaagagagtcttttcattggcaattaatgggcagttaactattttccttttacattacttaatattataaaatgcataaattttaatttcttcatttttaggtgtttaacttgtacatgaaatagctattttacacatattttcttaacaaacataatttcttactacatagcaagtactaataaataaagcatattaaaatgaggctgatacttccttattgggggatatatctggtttacctaagaacttaagcagctgcaatttcattaatgatgaagcaagacttctgaggaaaaaaaatctgcttaattaaaattttattcacaagaatatttccaattctaaatgtcctagaatatcctcttttgaattatttacttaaaggaaaaagtttatcattgttctgtgttttgctttcctatatcagatttgcttgaataacctgcttattgttaaataagccacacacaataaacacaacaacaaatcattaatgaagtaatatcttaattgaattgtatacttcttgtacattgtgacatttaaaatttttttcccctaaaaatttagacataagattgaaaaataagctcagtgaatattttgggtgagggcagttagccacataatgtacaaaatatgttggcccaagacagtttttaaataccatattttgggtctttgtactcagataaactaatagtgcattttttcctatcaacagtagaagagtagacttatcgttcatgacaagacccacgtgccttccaattcaaaattttcagacttcaaaatacaagtgctgtaggtaattt

SEQ ID NO: 45712 - DNA, 1470 bp, Bovine  19866881034580
ttaataaagaaatcctaaagtgtaatgtggtggtagacaccttgagctctagcccagtgtgagaggtccccacaattgtggcatggctctgcagctggggtcagggggctgcgtgcaaaccatgttgataacaagtctccagagtaacatcagcccccatttttcaaatcttcttaaacaaaacacagcttcctttgcttaacacgaaggctagcacaatctttgacacttgtcctagcagctccactacctccccaagtcccgcgtatgttgctgcctctggtcgcttgggttatgggtggccctgcccacgtaacgccaggctctgcatatgagaaagacttttctttgccaacacattcatggatacctatcagagctcaaaaatgcagattaccctgattacagagggaaactgtttctcatggggataaaaaggggtaaagggtaggaaaggaggactttgcctcccctgccacccaatttgtctttcctgaataaattctaacaggatgtttttatcctccctcccttggctagtaattttcacagagaaaatttgaatgtaagtttgtctaacttcaagctcatatttttacctgcacctacagttctccccagaaagggatagatcctgaaattcctcagatgcaaaattccccagagaagttggtaatgactgatattaacattgtaaatttttttttccaacctcatctgactcttgattcttacatataatgttaagcattgtgttgcatgaaacatgctcttctccttaacttctcacttctgcttccaaagacaagttaaaaattcatagctgtttaaagcctactgtcattaactttcagttctgttataaaaagatactgattatgaaatagagatggggaattttctggtgatgtttccgtgacagcctgggtttctcaaaaataataatttaatacttgataatgaagtcaggcaaaatacttcccaagcttattttctttgactcagagtcacaacgtatattatgggaaaggaggagcaaaaattcagaattgtgttgatcactgcataggtatcaagtgtttgatgatgatgattacatctcaggtttctctttatgtggtgttaaggtggaaaggaggaaaaaaaaatgaagtcagaggttagcggtgtagtcttttaaggtctttgaatgattcacaggtatgacatgagagaatgcatgaagcccaaaccatggacagtgcttacaggattagtagttaagatcaaagcctgcttgtatttgtaggaaagagaaagaaagattctgaggaagtgtgcaaagaaaggtcatgataaaaataatgttgtgcttgctttaacgaataattttagttgtagggaaaaaatattaccatgaagacaatacacctagtccagcaatcctttttccttcccaaaacaaagtattctgtttctttaatagattta

SEQ ID NO: 45713 - DNA, 1780 bp, Bovine  19866881067458
taaggggcattactgttttgtgagtttatgtatgtctttcagcttgagagttctttggacgctttctgggtttaagaatgtttcttgcaaaaaaaaaaaaaaaagaatgtttcttccattttcagctgcacttattgtgtgtcagtttcatattccattggctagaaagtaagcttgttgctttcaacagcattatagaggagattttatttttgccacctttcaatttaactccaggaaaaactaacctctttggttataccttggaggctttccttggtatataaagtcatttaagcaaaacctgggaaattctttaaatattttgagtttgtgcatatgacttaatttgcaggatcaaatttagtctagagtaacgtatatgtgtgtgtatatatatatgtaacttctctggatacctgtgtagagtctgagtccttcagggcctcagaaggggggtgagttctagaatataaatggttatagttttgtagattggagaaggaaatggcaacccactccagtgttcttgcctagagaatcccagggacgggggagcctggtgggctgcagtccatggggtcgctaggagtcggacacaactgagcgacttcactttgacttttcacttttatgcactggaaaaggaaatggcaacccactccagtgttcttgcctggagaatcacagggacgggggagcctggtgggctgccgtctatggggttacacagagttggacacgactgaagtgacttagcagcagcagcagcagttttgtagattagaagaaagagttaatattatagcttaattagatgtcagattttcttcatctttgtctctagcttgaaatcagtctggggggaggaaatcggcaaaactcagtaatcatcaaatcttttttaaggctttttctttctttttcttttttttttttttttaattgaaaagaaggaagattgtccaaaattcattaaccacatattcccacttggacccgcaatttaacctgcctcaatattgaatatgtaccttggagcagccatagaggaaaatgggaggagactggtctcctgaggatcctcagtgtctggtttttacgagtgacagttttgtctggctgaaatctgtgcttccaacataaggaattagctgctgtggtttagttctttgtatatgttggactaacactactctgatattgtctttcttttcaggaatttcaattccacaagttaggtctgtgactgatcttatttcagctgtgcaaaattgcttctttccaagaaaaagctgaacttcttttgctactggtgtttgctctgcgtgaaaaaaattagttaactgggacttatagttcttttctctgtctcttgcattcctctctcctaaggagcatggttgtactccactgaacaatagaatccaagatgagctgaatctccctcttgaaccaaacccggggatgctgtgtacacttgtttaagacgtagaaatgtggaggtgttctcatttatgttgttacctccacagagttgcatatttaatatgataattttctaggaaagagtaagcaaatggcttgttctgacaagatcagtatactgtaacagtttcccagcaattggaagtaaagggttttgaagaagatttgatttttttctgatttgcctaagggtatcctagggactggaagtaaccatgccctttatgttctaggagacagagggtctgtactagatcaaagttagggttacaatacagaatgtctaactaaa

SEQ ID NO: 45714 - DNA, 823 bp, Bovine  19866881078538
cctctttgctctccctatcaccacaatgcatcctgagctttgtggggtccaggtaatgctttacagttggaatgtttcaagctaactgtgttctggaagtcaaatctatcattatgagatttcattagaagctaagtctctcctacacataacaatttgtaccacaaaatgctggtttcccagagcatccgttaaatcctgtctgggtttaaatgctgataagaaatagaaaaaattaaaaatgaaatcattgtaacttccataaattaagtcttaatactgtgtcaaagttttaatatcatttcctatgtctaaaaatatttccctgctaaatatttccaactgctatagacattcacaaactatataagtttttatagctaaattatgaacacccataaaaattatttggcctacacatttaaccttttttctcaatacagacccactttctttaccacatttataggaaaatgcttacaaagtcttgttctctgaggatgtcattggtactgattaaatttatttttcataaatctttattggtgatgagaatttttgcagactgtgctgttgattgcttatgttacctctctctttaccactttcattagaagcctcattgtaccttgttctcttagagaagaatttaaaactgatttggggacgaaggaattttagtccagtgtatacagcactttatgaaacatttattgatataaagcctaaaaatacacatggtaggtacagcattcatgtgggtaattatttagcagattcagcccataattttataccacaggggttcttactaggaatacca

SEQ ID NO: 45715 - DNA, 1288 bp, Bovine  19866881091348
tggtttcttccatagagaactctgtttttggtgaactgttttgacataatggctaacaaaatatacacaaacgctagtgatcagcatgttgataaaaagcaaagaaagtgtccatggagttttaggggttcatccaacaatgtggtggggagttaaaatccagtcagcattttgaggtcagagactgaagttgttcaacattttatctccagtgctgttttatttcttgtctaaagtcaccatctcataaatgtttgatgaatgaataaagggaaaaaatagatatataaggtaggaagggctattcagtataaagaatctgaagccctctttttttagaaacaggatagtcaaggaaagttctaccatacatatatatatatatatatacatatgactcagatctttaaggagacagattacaatctgcagaaaggagaaagtaggacaagagatgacagatatataagaaatgaagggacggggaagttttgggttatctaattttaatcatcacgatgcctatgatttccttgcttcttgatgtttcactgaatctttttacagttccttcccttgctattatgattctttcctgcatccaggggctcttcccaagggggctgacatcagcgaggtctctgtgatgttctagggactagcgagtctactgggtaggagagagcacctttctctccttcagtagatggcccagagctgagcctgaacgcgtgcccccatttgcccactaaacacaagtcaagagtccctcagcaaagattcaggcttggctttgtccccttagctattaagctccattcccacagaattatgacatgtctgaggtttctaaaaccctttgtgtgcatctcacacagttattgtgctggatccaaatttcaaccttggttaaacaggcctcaaatcctttccaaccctgcccctggcagtgaaggctcaagagcacataataaaggaggggataagaataacatctatagcttagtgatcacttattatgggccaatcactgtgctaaactcagaatgcagcatctcctcaccaccagcctgcctgctagctacctacgatgactactcctatcacctctgctttatggatgaaataaagaaactcgtttaagttacataagcactaagaattaaagccagatttgagactccggcagtcaatttttgcagttttcaagggcaagggcccacaacactagaagtacataaacaggtttaataatgtgagagctgtcaagccagcacgtagataccta

SEQ ID NO: 45716 - DNA, 1577 bp, Bovine  19866881107048
tctttttctgtagaaatagttaaaaggaacatcctagtatagtgggtcaataaactcatttttgcaaaagaacttatttcttttgctccttttgagttcactctctacctcactcattgcccctagctcctcaaattataaacttcttccaagacttagcctatctgttctcagctatagtgaacctctgtatagtgcggtgtttgcagatttatagtctgagtgaatgttgttatgatgccatcttaaaactaatgtgattctgtcagcaagtctaatatcctcattttatagttgagtaacccaaggaatttaaaatcttaccatggtgacaaagctgactgtgtaaatgaggctagaactggttctatgcactcagtgtttaattctttagctagctctgtaattgatattttttaaaaagccctttcttccccactttaaaggaaactgttagtattatcctatacagtagtctatgtattgtaatttacttgtaaaagtaaggtgttaaatatattcagggaaagtagggcataagacagggcgattattatttctcttcagtttaaccttaggatatttctgaatgtaagatattttagcacaacacacaagacaaaactggtaccttgtgttcctaggtattatagcttagtactctaggcataaggtcttgattatacttaaattcagtttcagttccttatctgatctgctgtggtatataagggacattatttaaacccctctgacatgcatatgtacatatatcaagcaagcctaggcaccttctacaaatcactctcctcagtgtattctttattcttccctatcagtgaggaagggcggatacagtcccttgaaagacaacagaatgatgaattgctacctgatttcagcaagagctagcaatatatagaaagagacctagttccatctgtaaaacgataataagagcccctaattcctggagtgctatgaggattatatgaaataatctgtgtacagtgttttttgtaaatatcagatatgttaatatcatccttcatatttccagatgctatatataaactagttctgttatgttacaaaatgtgtatgagaggacaactttacttttctgaaaattacatataacactcactaaatattatagtatgcaatgtggccatctgtccatctacctcacagtgatttgttgcttgaatatttaaatttccttggataagctccaaaggagaccatctctttaaacaagtttggccctggagtgaatggcgctacagcaattatcccactgaactacttttaaaaagattactccattagctttgcctttgccccccgctccttttttaaaatgtgatactgaataaatatccatgaaacctacattaaccttttattcaaagtaagtaaaaaccagtcccagattttcattgcaaacctgtcatcggtcactaggatgaacacatttgcaggagaaaacataatgagttttcacagaaaaaaaaaaattgacactagcccctttaatgttcttgggttcatttttagttagatttaggccaagg

SEQ ID NO: 45717 - DNA, 1673 bp, Bovine  19866881111025
aaacacttaaagagcatcaactaagcaagaggaaatagcgcagtggttgaagccagctcagagccagtttgttccaaggggccctggctgccttgtggaggctgtgcaaccttgtgcaaacatttgcctcttcagctgcccttgcatcattggtaaaatgaagatggaagcagtgcctaaagttgtagtgaggactaaatgaaataatacattttgtacacatggtaaatgctccataaatattctttattactgtgattatgtgccaagcacaacctcaaccggattctcattactgcttggaaattcttgtgttcatctgttgtggactctaatttgtattccttacagtgggacttagaactgtttccccgtattctggccagactttctcactctagatagtgtgatcttggagggctgggattctaactaatttattcttctatttgccagatggacatatagatggtacacattgaaaacacctactgaatgaatacgtgaaggacagcaagtatttattgagtctactgtctttagttagcacataaactaattggatgggaaagacaagtataaaaagaatgagaagacaatgcaaataagaatacgatgaagcacgagccttgaacagactaaaggccacgatatttaagaggggaatgatagtgaggccgaacaaagtgagttgagacagaattttatttgcatcttaaagtctggatagtttacatatacagaagggataatggtatcatttcttgtgagaagtcgttatacatttctgagcaaaaaagtggaaggttgatgacagaaatgttaaagataccttgcagcaaagaaagaaaatgttacagatgtttttttaaagtaaatctttttatagagataaggaagagtatagaaccaatataggttttcccatcatttgtcaggttagaagaaagaccataggaatttcataattaaaattttcataattttaaaaaaatttagtaatttttaaaagaagtgtaaagaataacatccacaggcttatcctcgtgtctacgggaaatagcctccctttccattctctgtgacccagaggtgacggataaagctgtaaatactggagtcagtgttccaagttctcaagatcgtgagttgaggtcttcctacttcccagaatgatcaatcaatgcacaaactgaacttcataaattcattgtggaaaaggaatgctacgtaggttaaaattgcatttgaggattggatttataacctggtttgtagactgtctcccaaacagattattccttttagctaatggtttcagaggtacatggagcagaattagtcatcagagaaaaaccagagaaaaaatattgtgcactcactgtctctgtattaaatggaaatgctgaactcacagttattaattatgcacatggacatccctaatacctggtatgtcatgagtttataatgaatataattttcctttcctgccttttcactcagatcctactgacatctggctagacatggccatgaggggtcctcttgactgcagagtcaaacagtaaaatttatgctaagataagatttcttattgaaaagtggaggtcattaaagcaaagtagaatttgggtgctgtcaacaaaatactcaagagatgaggaaccaca

SEQ ID NO: 45718 - DNA, 896 bp, Bovine  19866881126671
ctcacactgtagacagacgctttactgtctgagccaccagggaagaaaacaagcctacgaaaccataatatgtatgtgtgctttagtgtgtgcatatgtacttgatgtgcatgcgtgtgtgtatgtgtgcatgcgcacacatatttgagtccttgaccattttccagagtgccttatgcatattttataaagatgtatatagaagtgaatattttttaaccttgagattttattgatattttcctctatctcatatatattttgtttgaaagcactctgcaaatcagaaagcactgagggttacatttacgtgagaaacagagaaagtgagaagtatttcaagtataatattaaattgtctttttgtatgttctttattattggcttcttgatcagcaatagagcaggattctattaacagttgcacggaggggaacgtatgatagggaacaaaagcactaattgtatgcacgtgttaaaagtagaacaggttccttctttcactgaacccaaaacatttttcttaaaaactcatgaaagtgtcttcttgtaatacttacacaaattttatatttttatcattcttgagtggtagtggaaacattaaaaagagcaaaataagtataaaaatgactcatgtaaatataggaagaggacactgaaacagattgttttggtggcagttgaaagaattgaaaagaaggctttctatgcagatctgtatattttagttccttttgccttattagctgaattaggatttggagacaaaaatctcttgagctaggatttcactcttttactctattttccactcaacctggaagagacacttgctccattttacattcaaatggtagagtttttttaaaaaataaactcccttttcagcgttt

SEQ ID NO: 45719 - DNA, 765 bp, Bovine  19866881126841
aatataaaatggggtcaaagctgacagctttaatatataacaaagcagagtttatgttttctgggtcaggaatacagagtgcagacagtcttcatctacaatttaaaaatacttcacagcaaatgtgccttcaaatatgggccagtttttgaatcatcagagttgttctgtagttattttcctaaaggaagggaaaagaaccagtttgttgaaaggagattcaattaattggggagatgtagagcatgtataaatggtgaaatcttacagcttgtgattaggatttttgtgtcatcattttgtacctctgtttatttcactgtttcaggctctgcagctgtgagacaaaatgcctcagagaggacctgggaaagattaatgaggggataggcactgggctgaaataaagttttgtggactcagtttcttctgctcccacactgttcttaacttccatgactcccaagtgcttagtgtccaataagatgaacaaccttgagatgcagaggaagtttatagaagttctttgagatctatgatagaagacatcaaaacaagtcaggattatagctctgatgtccagttggtaggatgttatgtaagtagaaagaagttatgagcctcgaagtaattcattatttactcaaagtttatgacataattgcaaaattattgctgctagagacccaggactactaggtagagattagcttcctcttttccacctggaatctgaaataaaggagacaagaaagatttcagtgc

SEQ ID NO: 45720 - DNA, 958 bp, Bovine  19866881188924
tgtgctatacatatcccttctgcttcccacccaccacacaccatacctaatcaaacacatatgcacacacccacaggcacaaatattaacatgtatcatcttcacattctttaacctccaaaccttctttgaagaaagagtctgagactaatttatactaaaatgtaaatgattgactatagcttaaagagctattccttacccccaccctaaggggagtttgaatttttaacagaaatcaagcactgtatgtaatggaatgaggccactaaagaagacatttggacttttaatgataaagcaaatgacagatttaagtagaggttctctgaatacctctgcatcatgttatgctagaaatgaacttctcctgagtaattgctaatagctttcctgtacatgggctataaggtttctccatagtgacaagctgcttctagcctgatatgaggagccaatgtgcacagaaaatcctcactaaaagtacaagctacagaaccagtcaagactaaagcagaacaaacacaaaaatcaatttggcagcttatttgaatctacactgtgcctctttccaagggcagacaggatttataatctagctcggaaaaaataaaatgaagtcccaatttccattaaacatctgtgtaatgaaaagaaatggaaattgtctaaccagagatgattcgaatatctaagtaacagtatcaatgaaagcagacatcatgcttgcttttgaggcaatatcattttactaatttaatctagcccaacaatctactacttattccacacctttaattaaaatcagtgtttacttccatgggattctagatggaaatcaatgacagatgctcaggagggaaacgtaaggcgtaaaataagacagtcaacataatgcagagaggtttatatgaagctgctctgtaccaacacattcctaaataacagaagaagacca

SEQ ID NO: 45721 - DNA, 1577 bp, Bovine  19866881190579
tgccgtatgttcatatgaaaagttatgttccccaggggctcagctggtaaagaactgccagtcaatgcaggagactcaggtttgaaccctgggtcaggaagacctcctggagaaagggaatggcaaccctcaccagtattcttgtctgaaaaattccatggacagaggagcctggcaggtacagtccgtggagttgcaaagggtcagacacaactacacatgcacacacacgtctaatgagtgggtttgagcatctatgtacttaagaactacactctgaatgctgctaagtcgcttcagtcgtgtccgactctgtgcaaccccatagacggcaggcctaccaggctcctctgtccctgggattctccaggcaagaacactggagtgggttgcccatttccttctccaatgcatgcatgcaggctaagtcgtttcagtcatgtccgattctgtgcatccccatagacagcaagcccactaggctcctttgtccatgggattctctaggcaagaatactggagtgggttgccatttccttctcctaagccaacttaaattcaacttgcacaagtttacataggttcgcttgcaattacttttccagttgcttacacttctgactctttttcctttggtccttagctggaaatcacttcccgataccactgcttaatcattttttcccctcccactcaacagttggccctttatggacagtgtttttcttgactttcttcacttcttaagagtcagtacttttacctatacccactctctgggccttcactagttctcagacacattccagaaatttaaaagcctggtgaatattgaaggtacatgataataagtgcaaagagcagtcatcacacaatctaatacccagagcaacctccttgccagggcctaatcaaccaggtgccattcattgaaaattgttagataatggcctagggtcagatctctccccaaggtcagaagatgtcttatgactgctatctacttcattagccaaaaaaaaaggaaaaaagagatagtgcaaaataagaaaatttctgagagagggaaaagtttgtgcaaatttgggagcattgctgtattgagtgtgcctatttatgacaacaggtgcatttgtttgtctttgattgatgcataatgttaacgattcttcttaaactgttacacctgaatatatattaactggtaattttccttgcttgctgtgactctaatgggcttgagaattgatccagccagtctctcctccctctgtctttttctctcctctttctttcattcctttctctctcctccctctcccttgcttcccccctttctttgtctctttctctcactctctgtgaggttcatttgctcgactgattctgagtgtccataatgactgtttggcatattctacaggcaaaggtcccgagaccctttttgctggctataacctcaatgataacgaatggcacacagtgcgtgtggttcgccgaggaaaaagtttaaagttaacggtggatgaccagcaggccatgacaggtaaagccctatcgtccttgcctttgctgaa

SEQ ID NO: 45722 - DNA, 705 bp, Bovine  19866881192049
attgatgctgggagaaaggttagaatcaatgagatatgttttgatatcctaaaaggaaaaagaaattttaaaaggaattcagatcactaatggtatgaatgactataattctgccgtagggacaaatgattctgaaattcaaaatttcaacagaggataaattatcctaggtcagacctaggagagaagacatctctatcacattttagctatgtgaccttgggctgagttgttttagctttctaggccttcggtttcacgccagcaaaatgataataaggtaaagatgaaataagttaataaagtgcctggtacataacaaacatttaccaggacccaacttccttctcagtagcaaataaggaccagcaaccgcaatccttaattccctgtccagttcactttccatgacacttcatgtcacataaataacattgttttaaactgagaatattaagtgcatttaaaaaaagcctcttccaaaatcaatttcttcacatttttaataatgcagggaaggagcttgaagttggtccacagagattttcatgaaccaaagggttatttttaattggattttgtgcctgttgttatggaaattattgtttcatggataaagctttatgatttcactgcaagatcaagcccagaatgggggtataatgatgatatcaccccctatgcttcttttttcttgacaaaaca

SEQ ID NO: 45723 - DNA, 1165 bp, Bovine  19866881274011
ctcataggaaatttaatcatttgcatatgttgacaaagtactctacattctctctcttgagactattagaatgaacttaaattgtgtcatctgggaaggtaaaatctggaaaaccaaataagctggagatagtggaggtgaaatcaaaaaggatgcttcttattccaagtctttaacacctgtgtaattgtctattatttagaaggtttaaactggtccagatgatgctgtcccaatgaaagaagagaatgcttaagtatatttctttagttttataattttgggaatggaaaacctagttatggacttccccggtggctcagcagtaaagaatcagcctgccaatgtaggagatgctgcaggagctatgggttcaatccctgggttgggaagatcccctggagaaggaaatggctacccactccagtattcttacggggagaatcccatggacagaggagcctggcgggctgcagtccatggggtcccaaatagttggacaggactgagcaactaaacagcagcagcaagcctagttataaccaagggatacaaatggccagtttctcttatacaaaaacactgcctgagagccctgctggataagcaggctttgtgtgcaggagaatcttaacccaagaccatcaggagccaaacagaagcaaaggggctttttttgttactactggcttaggaagtcacatgagtaaagaagggtgagcgggtttggtcagaacatctatgaggccttgaaacactaagactggtgagaatggtgtttggtgagttgcttttctcccaaggtggatgcgcttcataaactaataagtgttttccatctgtgagatcaaaagacagatttttacaacatttggcagggagggttaagcatttggagtccacatggagattatataggagaaaaatcagggaaaagctgcttttttggctttggtaggcaccagattcaagcagtccataaacaacaccctccaaaagataaaccagaatgccacttcaaaaaccccacttgtcaaaattgtcttttctcttctcaatttttgtattagcagtttctatttagtttcctcattccattcatattgttctgagaaggtacaatcagattaagaatatatacatatagagagaaatagaagtgggg

SEQ ID NO: 45724 - DNA, 803 bp, Bovine  19866881379950
aagatatataaataaatggaagaaactttgaaaactggcattttttcaattcaccaaggacttttaacttctctaagcatcagtcttcataggtagcatcacactattctagaaacataaggaaacttaaaacttgtaagggtcaagctccctcattttacaaatacataacttaaatccaagaaatactaatgatttatccaaggttaaaaataaaagaaataaatatttgagaaagaagtctagattagaatctgtgttttcctaactcttagttcattgttgttgcctacagaacaaactccactctgttaaatgtagaagtgtttaccagaatttactgatttaaaagtaattttacagtgatgtgaaattcttcagatctaagacatattttcaaaataaaatcttattttatatttattatatcctagttgggtttcaagacagataattgtttcatctgaaagtgaaaattttcagaacagagacggatagcagagacaacatggaatcaatgttttcaactaagcccagtattctttccatttttcagctatctccatcatatttttattacaagggattctgcttcttttaatagtgctgcatactatatatttttaaaagtaggacaaagtaaaattaatttttctgggggagtcttgtgatatcctttgtgatgtctggagacacccaagagtatctcaaaactaggatgaagaatatctacactagattattcaatctcccaaagtaatttgtctcttaataacaatcataattactttctacagtatcca

SEQ ID NO: 45725 - DNA, 1518 bp, Bovine  19866881383681
atgctgagtcttaagttgattgtagaatttgaaatagacattggtcaagccctgagatttcatgataaaatcaacaagtacttaaataaaacattcaaagttattctagaaatgaatgtgtatttatgagccagaagtaaaataacagattagtcagcatgagctccttatgttttcagaattgaaaacttacttagggaaaaagtcaataagccttattgatgattgaattgttacaatctgaaaataagtttagtagttactgccttatttatatttttaatactacaaactcatataacatgacaactaaatttaaatttttttcctacttctcctgaatatgacaaagaggaaaagattacaaacaacaacaaataacacaccatttataatctggcaaagtaccttctattcatggaacttctttcctaatctatgaaaaatagttgtcacaacagacatgactttctcataattaaaggaggatgcaatcagaagttactttggaaagggaggccaggcttccttcactattaaggccacttcctccccctccccctcctccctcccctttcctgagattcactcccttctgttctccatctgctccgcccccacctattgtctctactccctgccaagcatgccaatcccatctggtcctactcttgcttctgctggctctaattcccatgggcctaggaaacagttcaatgccaaggcttttctcctcttcaggagaataaggatagctaggagactatcaaacaattagccaaagaattcacacacatgaacaggcacataatgtctcaaatacacaattctctcctaggctaaaatttaaaaatgtttctaattctcttatctcagattcatttttaaaaattgaaatcgtcctatctctgaaataatcacaatttatatttcaaaaatacaaacattttcattaatcccagatatgcattttttcagtaagcagaaataattagtgtaaataaatgttactcaaatcttaccatcatgaaatatttccattaattaatcagatttaataatcactaatacattttctgctgcattaaacatacatttaattcacacattccaccttcatgacttctcaacgaaaatccactctgccgcaaaagcatgcatggtcagaatctaagcatatttaggcaaaattattatcaagtcattaacaataataaagcagtctggcgagtattgaaagcagcttttattcatgcttttactcgaaccaacttaatacatatatacatatatagaaacacacacacacacaattttcggttgtttctgccacaagcatgctcaaaaacctctgaagctcacagaaagcagcaaacaaaagtataagcaaccatgctcagggtttaaggacatttaaaaatttaaaacaacctttctacatttcctatagagcatgcataaatttgacatgcaattccaagaagaaacattttaaatataaatattaaaattagttta

SEQ ID NO: 45726 - DNA, 1396 bp, Bovine  19866881395742
acgcttactccttggaaggaaaattatgcccaaccctacatagcatattgaaaagcagagactactttgcctacaaagggtccgtctagtcaaggctatggtttttccagtggtcatgtatggatgtgagagttggattgtgaagaaagctgagtgctgaagaattgatgcttttgaactgtggtgttggagaagactcttcagagtcccttggactgcaaggagatccaaccagtccatcctaaaggagatcagccctgggatttctttggaaggaatgatgctaaagctgaaactccagtacttagccacctcatacgaagagttgactcattggaaaagactctgatgctgggagggattgagggcaggaggagaaggggatgacagaggatgagatggctggatggcatcactgacttgatggacgtgagtctgagtgaactctgggagttggtgatggacagggaggccgagtgtgctgcaaattcatggggtcgcaaagagtcggacacgactgagtgactgaactgaactgaaaatatggtatagatatggaagaattaaggagtacatgcagcaccctacacacatacacaaacacatacaccctcagagcaattatttttgtcaattgagtaggttatttgatggcaacattccagcaaagatagggcttcacaaacacttttctttaaaaatagcctttggcaccacttagcctaagtaccactttttttgaaagattcctttaacttcattaattagtatgatttatccaagattacacttacaagggaaaaaagtattcccatcatcccattgttaattatgtctccaggctaacataaataaatttttctagttactctaactctatgaaacttatcagagagatgacatttgtaaggtctatgggggattggagtaggggaatctcatttgcaatgtgctgtgttctttctctttccttaaaaaatagttttctttctattttccattctttttttaatttgtttgttttccacgcagttgacagctacagtcacagaaattaaggaaaaatatctaaactggagaagaaaatttcattaagaaacaaaatgtcatattttgctttatttaaaaattaaaagccatcctctataggaaaaggagcttgttaaaatggaatcacacttggcttatgtgtacaacttaaagaaaagcagtgagatgcagagataaggtttattttgatcagtttaaagagtgaagaaactgcgacataccacatttgttgcttgttaattgcatgtcttcaggataactgtcactattgtataatagtgacaacttctacaaatagatatgaaaataagatttgcttttaaatattgatctgtacccacataac

SEQ ID NO: 45727 - DNA, 775 bp, Bovine  19866881397445
atatgcccctgctcaagtatggcaggaagatttatctcagaagaagaaaaagctaatttgtaagcgactctgaggagccctatctcatgttgttagggttttcaagtaccacacaaacacagctgtagcgagaaacaaagccagatactctcttatccactgcgctgttacctgacgcagattcctggtgactttcacatcatgccaggcattatcattaaactttccattcacgggctccaccagtgcttcaaaggcccctgatcccaaattaatgaccagagagacagctccatttttcagggcgagattgacataatcggctgatttcccggtgtgaagcatcagtccgttcctctgaagggttttaaaggacagagttatttcatcgctgctgctttgaatggggttttgagacaagtcgtagcagaagtattccgatcccttgaaagtggcaatatattcttcttttcctggaggaaaacagatacacacatgcataagtaaagaaaatatactatgcaaattaccaaagcttaacagaaacgatcactaatcagcccccagattaactctttgtctagttaacattcatgacaagagccttgtcagagttaaacagcattgtgaaaaagtgaaagggttagtcactcagtcgtgctcgactctttgtgaacctgtgaactgtagcctgccaggctcctcagtccatggaattcaggcaagaattctggagtgggttgccattccttaacaatactgtaggtggcagcat

SEQ ID NO: 45728 - DNA, 1453 bp, Bovine  19866881504274
ggagctcaatcacatattgattttaaaagttgcattaaaaaatgatgctttttaaaaaaaaataaaaccacttataaggtcataatattgagtactgacagtggtataaataaaatttgaggtgtgaaggaagttttccattcattttctaaaatccgtattattcagcctcccaccttccatttggttctccatcaaacatcgcaaaggcctgtttgcctccttttattcagaaatatgtactgagtgcgtgataggggtcaagcacagtctctgttctttatggctctagtctcatagtggaggacagactttgaaacactataaaagttctcaaaatgtggtccccagatcagcagtaacagcatcacctggagacttgtttgatgcaaattcttatgtcctacccacacctaataaatcaggaactctagagttggggcccagcaaacctgtagtttaacaagcgctgcaggagattctgctgcatgataaagtttgtgacaatctatttcttgaggaataacagacattgggcaactgtagagggtacagtgaccctgccgggaattgttaactggggggaagaagacttctgatgaagttttatggaggataagacctatgagctggatcttgtaaaaatactgtctaatagttatttttatgcttgcattttagtaaattccaatatatcatataactaaattattttgacttttcaaaatcacagtttataatgaaaactaacactaaagttattttatagttggaagagaaatcattttagaatatgctttaaaatgttggtggactggttaatatagaatgacttacagataaaacactgataagaaggaatgcactatcctcagggctaataacatcctttaactccatgaggttagtttttaaattattgctttagaatttcatttttcaagaataggtttttgtttttttttttaatttggggtgaataacttgagatagaaatagcagtgagaaaaataaaatagtattggcttataagtaaatctttggcaaaggcaaggaatgaatttatatctaaattcatatcctgcctctactcaaccttattagttgtcagatctagtgatagattagagagctttgcatacttatagggtagcataattctaaaagaatcatcacgtgaaagattccttgtctaagaaatcactgttgtcaattccttattcaggatgtgtgtgcatactgaagagggtatctcttagtgatcaaatacattaaaatcacagaatcattcctgatggaccaagttattaaatccaactcccctgttcatactctgtcccagaataccaccaccaccaccacataaggtgtgtttggagtattttgtttgtttgtttattccttttaaatgattgttttgaggctcttctctgtcgagctgaggtgatgaagg

SEQ ID NO: 45729 - DNA, 1016 bp, Bovine  19866881506922
actttaaggataagctctttagtcctactggtcagaaaatcgatgctgaagtgattacctatttaggaatattttcttacagacagcattacagagaattacaacaagtcacagtaacaaaaagcatactcagctttcccaattccctaaccatggctccgagttcaccgttacaacagaatgaaatttgaagtgggggaaacacttcactcatgcaatgcaaagaaattaatactccagttgagtaagcctaaaggacttcactgaattcacaaatcagtgtggactgtggaggcaaagacagattgtgcataatagccatcaagccaagaaaaaacttactctgaatgctttaacaagccctagtcgacaatttcgcaaactctgttaaagaagatggtcagaaaagatgcagaacatctcaaactacaattactttgtcttgtccagataactgacaattgcattatgacattccatatgattagaaccaagctttttcacattttagattcctgctgctgctgctgctaagtcacttcagtcgtgtccgactctgtgcgaccccatagacggcagcccaccaggctcccccgtccctgggattctccaggcaagaacactggagtgggttgccatttccttctccaatgcatgaaagtgaatagtgaaagtcaaatcgctcagtcgtgtccgactcttctcgaccccatggactgcagcccaccaggctcctccgcccatgggattttccaggcaagagtactggagtggggtgccattgccttctctgttttagattccaggttagtataattcccttaccacacaaaacacaacagaagtccttttagttcaataagatgtatccaatttcaacaatttttcaattttcaatatagctagaccagaatctttggtaaaacccattttaaatggaccattatcaattccacatctttctatgaatatcagcatatattagctagacagtcatcttattttagctttagaat

SEQ ID NO: 45730 - DNA, 1266 bp, Bovine  19866881550118
aagaataagagatctaagttctccccttgtttccagtataattagagtggtaagatatcaacacacaagtcttattttccttgactttgtttagaggcatttgtgtacttgaagtgtgccttgcactatctaagaagcagcttgagaagattatttgatatactccatttgaatcccagcagcattaaacctggtaacataaacaggacagttgtttaatgcatatcttttaatttgacgtaaatagactgagacagaagaattatgtgaatacccagggccaggttgtaaggttcaggctaaatgtgcctgataaaatcagagaaatagaaggactttatggccactgattgtaagctggaatattatgaaagagtttagatcaaaagaaaatataggatgcattactttgggataatataaatgcacacaccaaacatgggggacagcacaaatataccaggaagacaaaattaaaacagcattcaagaaagaacacaaaaggccagaatagactagaaaagaagaattttcgaaaggaccatggtaaataatgttggatgagaaaagtcaaaggagagccttgagcaacatgatagaatttgtgactatttttttttccaaaggcaatgagaagtccaaaaatataagacatgcaggctaggagatgagagaatgtgaaatagcaataatctggagagaagagaagaaattgtatttaacattcaacatgtgtaatttgagtaggagtgtcctttaggaatcagatgatatgaactggggactcaggaatgctaggcctggaagacctggcttgggagccatcaaccagaagcagataaatgaagtggtgtaagaagttttctcttttcttaaaacagggagcataaggcagttagagcaaggacttggagtgcgtcttccaaaagcagaatgtaagcatcaaggtataattagttctttgactcagctttcctgtttattcatatgcattttttagtgcctcaaacatctcagtttcattttaattaaaaagaacatacataaaaaggacaactgctttatggatttgaatagctaaaactctagggaaacttaaggaggctcctgcaatctcttgtaagtggcatatggggggaaaaaaagtgaaacaatacacattgtcttactttccaactggccagactggagaagtttctagaggctttgctgagaggatttgaccttgtttagcaaagatggagactgctaactttcctctcaatt

SEQ ID NO: 45731 - DNA, 1012 bp, Bovine  19866881628229
gcaaaaccagaattgaattccagctctgctaggtgatgtgacttcttgatgtttcctcatccattaaatgggagtcatatttagtcatcttcttgagatgtttgaatgattctgtaaagttcttatcatgggaacataagcatattttacttccatttcccttaagagaggttaggcaaactgctgttctttatgcttccatgggacctagtgaaggacattgtaaacttcttccctatctagtcatatgcttctttccagtgatcaccagtacagaggccctgtcctccaaagttgctagctccatgttagcaccatcctttgtcttttcagcacagggtactgcctccattcttactttattatgattctttcttcccttgacatctgtttcatttaactgtactattttctttccattctgatagttccatcctctccttctctcccaatttcttcctttctctgccaccaaggtgcagaaattctattttaagtcctctcccctctgtctaccttctcttttttggtgatctcatcaagtattctcgtttatttccctcgacccaactgttctgttggatatttaaacccatgctggactttttccacctgaatttctgggcagcacatcaaagtccaagaataaaagtgaacataccttccccaccactagaaacttttcctgcagagtcagatggaggtttttcagggtctaaagctaataaaattcaaggagtgccagttaagaaaaagaataccaaatgttaaataaaaatgaccacagtcgctctgttgtcacctggtgtgagggggagtatggcgaaggaaaacctggagcagaaagatttagaagcttaacgatcaagatagaaatgacttttgcaagttttacaagaagatatgactatgtgaacacactgctggggttcccccactctgggttctgaaagaagtcctatagataggtgaccctgaagcttaagattcattagcttcatgtaaattaatt

SEQ ID NO: 45732 - DNA, 1114 bp, Bovine  19866881787383
cttttgtctagttatgataataaaacaagggcacagaaggtgtgtgtgggagttagacccgagtgaaagatgaggagtgtcttttgcaataaaagacaattggaaatcatgggtgactgggtgagtccatcttatagctcattaacactgcccgtaattggcacagatcattgctgagtttatccttatgaaataattatacatacatacatatgcaaacctttatgtacatatagaaatgaaagttatttccactaaatcaattttaggaggagaaatagagaccagcatttccttgctattacagtacaggtttgttctatgctagcccttcatagtacggtctatcttcaatccagaaaaagactgtctttttttttttttattgaagtatagttaaattacagtgttgtgttaattactgctttaaaagtgactcagttatacatgtatatacattatttttcatattatttccattatgttttatcacaggaggactgcctttagtaatctcaaaaaaaatcataggggataattctcagtgttagtaagtcaagtgttgaacacaggaattaattaggaaaaatgtaagtagaaaattcattcgcacttttgaattccagttcatccaagtaaaggagtttttggaataaccctccttctttccctcccaactctttttccatgttcctcttccttcactgttgtctttttccttcttatcataaacaattatttatggtgcactctaggaagtgcctagttttatagaaaaaaaaatttaaagaagatacaaaggaccatctgggcaagacatcaaccctcaaggcatttactatctggtggctgacagaagacacactgaggaaatcattgtttctttgtttctcaaaaacacatatggatggacatgccaagatgcaatatcttaacaggagtgccagacatttataagcacctgctgtatgcaaggctttaggctggcaaatatttgtgacactagtgtccagtcatctgttacgaatgcagactcctgagcaaaacctcagcaattcagtaagtccagggtggaagtacaactttaaatcatggtttcacaggaaaagttttt

SEQ ID NO: 45733 - DNA, 1044 bp, Bovine  19866881787440
ttgtagtaaagtaaaaataaccctgaataaacctggcctaaaaaaatgtgaaaagtgtacatggaaaattcagcataaaaatattaccatgcaaaaataataattaacccaagtagacctgcacatagtgattttcagcacttttggaaaggaacaaattttgctatgaaagcagtactcaaaatcaaataaaggttaggagacctagtttaaaattgttattaaaacacacaggtattttactttaatggtcatgggcgtagttccaactatttcagaagcaaaagcttattgcttggatagtaaatacaactgatcccaaggctatatttgccactaaatttagaatgttgggaggttagccctgaagggatcctggtggtttatctgcccttggtgtaatctgacacaaagatcctgatgtccatctcctgaaaaaggctgagcccaagcaggaagtataggagaagtgagcctaggagtgttttcctagggtcttgtcattctgagatgctgaggctctgggtgtaagcctcagggtcatttctaagctacttaattgtatactgttttatatttaatatgtttaaaatgcagatcatagttgcaattgaggttcattctagccatgtttaatgccaatcagagcataattgtgcatcatgcagtcaatgatgggagttcccagggggagctaatggtaaagaacctccctgccagacatggattcgatccctgggtcgggaagatcccctggcacggtaactcactctggtattcttgcctagagaatcccatggataaaggaacctggcaggctacagttcatgggattgcacagtcagatatgactgaagagacttagtgggtgcacacagtcaatgatgtcaataaaataaaggggctgaggtgctccagacgagtgattttcaaagtttaatttgcatatgaaatcacccgggtatcttactaaaatgtagattttgatttatagatctggggaggagcctgaggtttttcatctaacaagctcctaggtgatat

SEQ ID NO: 45734 - DNA, 1030 bp, Bovine  19866881798981
tcactcttacaaagtgtgtaatctatttgtcctgaattggatggtgattagattatagatcccagacaaacctatttagagattcagttcaaattgcatgattaaattatttttagtgaattcagatggcaacatatgctccagaacatatatccataaagatacatcagattggtttatgctccaagtactccagcgttcaggaaattaaactcatggcatgggtatgatgtctggttctagatttgaatatctctatttactaagaaatttgcaaattacatctcagtttttatatcaccctcacttgccttatagttgtccttcaactctagttccattctctataatgccgtgttgctttcttctgcagcgatgcatgtatgtgacagactgtgccaccgctgatgtaggtgacagctcccgggttgtcagtttttgtcattgatctctcccgtagttgatgctggtcagactgaaaacttgaaatgccaggacctgaaagggactacttttttttttttcttttttaaacggtacctgactgtttggatgactaggttttatatggaaacaagcattctcacctgcataagttagtaaagtcagattcagagtgtaatgtcatgcagtcagtgagctcaaattcaaaagatgagagagaaaagaaaatagttttttctaagtagaatgaaaggaatttatagttacatggtgtgaaatgagaacatctaggtttataaggtagacatcttgaagtctttaaagaatgctttaaagatctgggaacagcactgctgtctatgtttagagtacacagccagagaggcaaagttattggtaaggagcttaattagaaagccctcccggtgttggttaataaaacccatgttaaagactttgacattcagacagagcagtggttctgaaaatctaattcccctgggccagcagtatgagcattacctgggaacttgttaaaaatgcaaattatcaggccactgtacagatcaagggaatcaaaagcaaa

SEQ ID NO: 45735 - DNA, 925 bp, Bovine  19866881805281
atagcattgatatgtaatatgtgagtaactgatacactgattgattgaaactcatgatatcttattgttcctttaataccctttaaaatatttactacagaggcatgtgtacagttcatccaattttgaacccattatgtcaacattctccttaactagaaggagaagctaattgtatctgaatttattacatatgaaacaaagtatcctccctcccttaggaagcacctatgaattttagaagagagatatgagatgagaagctagaattctacaattctagggatgtcattataacatttttttcccataaaaattgtcctaatgcatcaaataggcactatttcaaggtctaatcaatttgtgtatttaattgtagtttcataattataaaacaattgaaagctaatgacatggaaggaaatggaattggaattcattaaaagctagagtttcatacctctgtgaatggaaaaaagcaacaaataccatttatttttatttgttctacttcaaaatcagatcctttgagagacacccacatagtaattcagaactgaaacatttatatgtttatctctgctgaatccttgcagagtgggatggttagcaaaatattaaagaatgaaacagtcctcctaaattaaaggctttattacataataaataatttctctgaatcttacaaaatgggttcttttatcttcatctgtggaaacccacggaaatagacaaagtggctgccatggtcttgataagcagaaaactgctttgactgttctgtcataatgacagaatatactagaaaaggctcttccttgctaaaatctaggtagatacacaacatagctgttagactggaaaatgaaaagaggggttactcattgctgttggcttttcctttgtcatgtacataggccagcag

SEQ ID NO: 45736 - DNA, 722 bp, Bovine  19866881893376
tccacagccttttggaacaattccacagcaaacagaaagtgtcagaatgttttcagtgttatctttcacaaatcacagtacctaaaataacaaaagatgtcatagaataaatagtacctcctatagctctttacagtagaaaaaaaaagtcactgtacaaatatgaccctattgtacaactatattttagtttttagtgtactttacctgatataaacaatacacttttttcatatttttctctcagaaattaaaatccagcaatagtcttgtgaataaaagatctcaaatcaatagatgccgtgatagaaatcatcactgtatgaaaaatcaggaagtggctcaagtgcagggaggaaaatcaaatttcattccaggggctgaattaactaaacacttttctagccaaagctgtgtaatttaaatttaattcactatgtttggaactatctccctatgacatgctgttgaagagaggtataagaaactcaaatatgtcacattaatcaattctattcttcaatatacttttccttgatgtttataacctttcccagaaaagagacgacctgctgaagaagacagaatactgatcaagcaaaggcactgtcttttcataaccagtacatttagagtaagtgtccctaactgtgtatttaaccactcataggtcaaagcgcatgctggtcttccttaattcagagtggtctgggatattttta

SEQ ID NO: 45737 - DNA, 1568 bp, Bovine  19866880415378
aatcaccctctgatgtagatactattgttattgtccccattttactgatggcaaactgagacacagagcaatctaataatttttccaggccacacagtgagtttagaggcctggccagaatttgaactaaggaattctggctccagaacttgcactcttaaattataattgcctctctagaattcctagacattctagaatacaccctttgcctcctgtatgatttcctcttctggcataaagtcttcaactgcagatctgcagatagcatccccagactacatctttttttaaaagcaatggtgtggggaccccagtctctggccgactcaggcagctggctgactttggcatacttgttgtagacaattgaagaagggtggtaagggatataaagcagcagcagtgaactggggcaagcctgcattcacacttctaccatatctgggtgatttgactagctattcaatccccctcaggctggcttccttcccttaaactctctgagcctcacagccttttttgtaaattaggagtaatattatctaccttcagagttattttgacaaattcaaaatatttatttaagagcccagcatgtaatgtacaattaatagatagtagttattgctattattaatggttgaacatcttgtgccagacactgtgctaaaccctgagaaatgaggatggggaacaaaggtgaatcagaggagacttcactagtgatgcacatcaataatggcacaaggcaggctgatgatgttggtaaatgagtttcttgtgcccttgagtctgggatgtttgctttaatcatagaattaattaggtgtgtcactcagctttgtcagaaacccaatgtgctagaaaattagccaaagtgcttgctctcttcagagagatctgaagaattccacttccaaaaagacacaataggcatacttctccatagtcttcccatgaagcacaactgaaaccccagacagtatgtgtaaagcaaacataagagactcagaaaggtggagagaagaaagcagactggctaaggacctcagggtcaaatggatgacagggcatcaagttctaggtttcctttttgtctatgtatccaaactggatactgggaatattggagaagctggcagccccaaaacatggacagatactcacaaaaacacctcaagaaaagacagaatacttggcaatgaaaacagtccttctccaaccaaacaccataaataaaaaacatctctagccccactcctggcagcaaaagtcaagtcaatgtttcctctgttgccaggatttaacatgatatcccaacacccttattaataaattatcagagaaagccaagtgaggagcagggacattcatacccactgtagtagcaagctctccctctccctgtggtgtcagtggagaccacacagggagcatgaactttcaccacaaccaggcagtaacaaattataccttcaagccaggatggtatgagtagaatgcttgtggaagcctgaactcccatcctgactcaccagtaacaaggagctccagcccagtcccag

SEQ ID NO: 45738 - DNA, 1301 bp, Bovine  19866880501316
acatagtaagtctacagaagtgtcagctatctttattatatgagatttcacatccatatgtcagagggctaccaatctctattgttatgtgaaattttctaatctgaagttggtaactgattaaaattttatttaagtagtcccagatccaaatacaatgctgaggtctgcatatggctcttgggctgccaatttgagacctccgacagccatggtaaattaaagtggggatggagtagtggttgtgcttagagaagagggaaatgaggagagctggccctgggagaggtggcagagaagacagtgcctgcctcatgatgtcccatgccctgcagggtcccggaaggagaggcaggtgtacagcaaggccgtgaagaagctgttcagtgtggaaacctctggaaggagggcccgggtccgcagagggggcggccgtggtctctggcgtgatgacctcctggagcctgccaccaagcccagcatcaccggcaagttcaaggtgctggagccaccggtgctgggtcacgacctgaagctggccctgtgcttgaccagcctcacctcccgggcccagcgggtccaagtcaacttgagcggtgccaccatcctttacacccgcaggccagtggcagagatcctgcacgaatcccacacagtgaagctagggccagaagaaggtaagaatgccccagctgggtgggacctggtcggcccagccccttttcccagaagagaaggggatatttctgagcatttgcagatgagaaaactgaggttcagagggactgaataataaggataataataaaagtgcacaatcatctcgtggcaaacatgtaatgctcaagtgttcccactcagtttgaatacttaccaatgaataaatacctgctgggagcatttcttaacatgtggaatatgtcttgtgttacctttttaaaatccaacaaattttggagctcatctggctctagtgtttctcaagagacaagtaaaaggtgtttattaagtgcctacctatgtgagaccctgtcctgagaattctgcaggcatcaggcacaacctacaaccaccctgaatcctctcccctctcctcttacaccatatattctctatctctccctctctctctcatacactttctgaaccctaaggattcaatcaaagacattgttctctgaaccacttttccagtaagtgaagcttgtgttttttgacaaggtgtgaaaatatgtgaaggaggtgtcccatattttttgcttttctctcacttatttttcacagaatctaaatcacaaaat

SEQ ID NO: 45739 - DNA, 1820 bp, Bovine  19866880637500
taatcttcctaggggctgtgagtttgagaggactttgcctggtaactgtagaccggggtctgtaaatatcactggggaagctctctctccagacccccacaatcaaacacatgaagttctgctgagatatctggatggttctgcctccaagctgtttttgcttagactgcactgcataaaacaagtgctctaaaacaggagtctccaacttcctggccaggtacctcctgtcagatcagaagcggcattagattagaagtaaagtgcacagtaaatgcaactcatttgagggacttccctggtggtccaatggttaaggatctgcctgccaatgcagggaacacaagtccaatccctggtccaggaagatcccacattctgcagagcaattaagcccgtgagccacaactactgaaacccttgctctacagcccatgctccacagagagaagccaccgcgatgagaagccaagtactgcgaggaagagtagcccccactcactgccaactagagaaagcccacgcacagcaataaagactcagtgaagccaaaaaataaatttaagaaaaggtaatatgcttgaatcatgaaaacatcccctcaccccaagtctgtagaaaaactgtcttccacaaaaccactccttggtatcaaaaaagttggggactgctgttacaaaatatttcaactttatttacaaccagaaccctggccccaaccccagcttttcgggctttgctctgtgggaagatctagatgagcagggacacttctgacaggtccagggctcaggaagatgagcaggtaggctcctcatttcttctgggcttgtgcccgggcccgttgaatcttgtcggctgtggccccatctgtggctccagtgcagtgggacaatacgaggctcatctccgcctcattccggtgttcaatagcaacgtccgcagcctgagccacatccctgcagtttgagtaggaggggagataagtattgagctgcccaagggcacaaattgtgcctctcatcagcccactggctctgccacccagcaccccagggctctcagcagacgcacccaacaagaagcaaggccttgaccttctgctcaggacccacacgggaagcatacttcttggcctcatatttattgtgttgcttcatgcagatctccacaaagggcttaggagaagagggtagaaagacatcaggcaaagccctcctgttctctcttatgagcaaagcctgtgtgtcaagtcacatcagttgtgtctgattctttgcgaccctatggaccatagctctcaaagctcctctgtccatgagtaaagccaagtggctacattatcccaatgtatcttatatacccttctgtctgtataatccccccaattcctatcccacacccatacaacagttgtgatctcaaaattctttgggtgaaaaccacctaccccaagctctattagagctttgagatcaattatttctatgcatccacgccatcatctaccgttacccctcacagcaggcatttcccgccttcccagggcctgagttttgggcagtttatagctgcccttatttgaccaacctaccacacctcttaactgcctgccacagaaaacaaacaactcaacatcctccactgctttgcaaatgtactctccccttcctccccaccaacaggactttccttcagacactggtgtcccctatggccctccttggggaaaagcagctcagtctcctttcctccagcatctgcaggcggacttgggcctgtcctcccctgtgccagactccgaaatgtgcccaccagtt

SEQ ID NO: 45740 - DNA, 2807 bp, Bovine  19866880768687
tgttttgtcccgagggctggagtgagtagcagctgctggagccgcttcctcccccaccctctcctgagctgaggaggctcaactttctaagtggcctaaacaccagctttcctagaccttggcctgggctttaatcccacccttctaggaccacttggttttcaaggttcagcccaggtccactccctctctggactcttcctgccaccctggttcccaccgtctcctcagtgcctccacactctctgggcctccccacacctgtcctgccaggttcaagttaagaagccctgtctgatgacccccaatatctaccatgtagtcaggaggtcgttcaattaaccatgtaactagctcattagcttggatattctccagctccaaaaagactggaaatgcctagtccattaatcacacacacacagaagttgacacttctgagtaattgtttagtttcagacggttaaagttcaaaactctctgacttttagctttctaacttttgagcaggttatcccttgtttggacatttttctgatggggatgttttctacccactgagtagagagcattcctccagcattcagcttgtgtatgtgtccagctaatgtgtgtgtttggataggtggggtaggtttctcacgtggagggagtgggtgagtgaaggtggctccaggcgggcagttggaggccttattctggctggactcactcgaaagctaagttgtgagtgatttccttcagccccctggcatcaggttccccatccagaagacgaccatgtcaacctctgtcctccctgctggcactcaagccctctgtgctgaggaggggatgagtcagaacaaaggagcatagccccttccccaggagccccagggatggagtaatgtctcaggtttgtgtcctcccagccctggtggacccccacagatcaagtccttgtcatctgaggaaggcctcacaaaacagtgggaagggcttgggagccggcagcctgggtctggttctgcctctgccactcgctcctgtgtgtctcaggcaagtcctttaatttacaggtgtgtcatactctgtgtgtacaaaacggggatataataaccaccaactttattttgtgagacatcaaccaacaagatgagtggttgtgcctaacccatagctgagtttgatataggggaacaactagttattatggttttctcatcactcaccattgcactgagaacccggccaacatatttgggatcgtttctgtgggccacatccgtagcagggtcacggcgaaaattcagactgttatccaggactgagaggcaaatgttcaggatgccttcttcaaactgttcaaaatggggccatatgttactataaaagaaattgcaagtagtatcggctaattgagggcatggaggctatgctggtaagagccacgggcactgcccatatctcagcccccgctccatggcccccagaactgagaggctgaggaacaaccacccacctggcctttaaccctgagaactcatccagacctcttgctgtacacaaggccctgtactgaggcccctcaagtttaatgagactgcctcactgttacgaactcgagagcagtcacttgacctgtctgggccttaatttcaccagctgtataacaagagatcaggctgagcacatctcaaagtttccatctagttctgacattgatctctagcatatcacttagactttggggaactgattataaagtgtctcactaaaattggaatttgaagccattttcacaaaatggagaaggccaagctctttcttgccttagagtcttcatatatgctgttctttcttcctccaatgcctttccccaagatatctatccagctcccttgtctccattaagtttcttatcctaagttcctttctaagcaaggttctcccagatcaccccatcaaaaatatcctcccttccacccctcagtgcacccaccccacccctttttcttttctatgaaatttaacacagaacacaacatttaaaactcaaccatataaaatatatggcattatactgaagatagaatacatggcagatgtgccctggttgactccagaaagggatctggacatggcagaatgtgcacctgtccaccctctgctggacatccatggcactccatccaaggtgcttcattgaaatacttcatttgtctgccggaaagaagaaaatatggagggaatccctggatgtggctagctgagcaaactcgggaattctgtggattcagatgtcatagtaccataggacccttggaaggtcgaatgctcacaccaaggaaatttcatcacattatgatgcggaatgaataacagaaactatactgttgtgcaagtctctactgggccttatcttcattcatgcatcatggtaccaataacacgttgttgcatcaatttagttatgtgtctgttttgcccatgaaagtgtgacctcttcaaagacatgaaataagtcgtatccatctcctgtatccataggtgtaccttggcccctggcacatagtaggtcatcaatgaatggatgaacaaataagaagcaggcaaatggacagatttgggaactgccacctatctgtggggtctgctgtggagcttctttgggtagaatagggacattactgccagcctctatgacccttttacctgtccgtagttccagccaatcatgctaattcgatttgtgcttcccacaaagatgatgccagcatcttcctgaacatattcctctctctcagcaggtactcataaagaca

SEQ ID NO: 45741 - DNA, 1108 bp, Bovine  19866880792232
tacaaatgtacatctccctttgacccagaaattctgcttctagtaatatccttcatataaatgcacacacatgctaagtgacacatggacaaagtaattcactacagcatattttatccctgaagaagaatgaaaacagccaaaatgtccagcaatagacactaaagaaattacggtccatccatacaatggaatattttgcagtagcaaaaaaaagaatgaggagactgtctgtgtctgcattttcttgcacaggctagctcaggaaggatactcatgaaactggggacaatgcttgcttatttggagggcaatggatgagtcagaagcagaggtggaagactttgctgtcaacccttttaaatttgaattttagtacactgtgaatgatttatctatttaaaggagaagaaggcagggtttagttccaatatggaatgcgttctaagatattaataaaaaaggtaagtattaaatacaaaagattgtgtacaatatgctatacataggtgtagggcagacttatttttccttaattactcttctgtgttatcttttgaattttgtaccttatatatatacatatttcctattcagaaagaaaaatgcattttcatatgcatcacctctacaatcctatgactgaaactcaccaagtatttccctatttttctaacaaaggaaatgaacagagaagttagaggaggcaccaggaccagagcccactttccctgccactccctgttagctcctccagccgtggcatcctctaccacctcccatccctgtcttctctggcttcttccctcaggaagcacaactcttaagtccagcctcagagagtctgccaccaggggcttcactcaggggacccgtttctcttgctcagagccaccaaagggtggtgggagccactgtgctctgtggctggttccagcctgccctgaccttgcaagctgccaggccctcctcccctggcctgtacctgtcaatgatgacggggtctgagggcgtctcattccggttgccacagctcttccggtcacagcatcggctgaaggaaaggtgaggagggagggaaggaagaaagaaggagagggagattaca

SEQ ID NO: 45742 - DNA, 1260 bp, Bovine  19866880803323
atccacagcccacaatgcctttccacccacagggagccagaggaagagagctgtgggcctctcatgggagaaaatcttccccattccctcctataccacagtcatcctggtcaattaggtaattatttagttttagagctgtggcatccaattaggtagccatacgtggttatttaagtttgaactaattaaaattaaataaaatttaaaactcagttcctctggtgggctgccatctctggagttgcacagagtcagacacaactgaagcaacttagcagcagcagcagcagcagccacagtagaccaaatgcccagtaagtacatgtggctagtgagtaccatattggtcaatgcagaacatttccatcattacaggaaattcttttgcagagtgtgtcttaaagtcttatattgttctctagttcctcttatcattatgtaaaggctcatgtaattacattttgtgtcctcaacagctctgtaagctttcagaaggcaggaatcattgtttgaacctctctatcttttcctaagcctctatcatagtgcctaccccacagcaggtgctcacggattcataattactatgacaggatgaatgctgtatcaagcccccaaatagaactctgagaattgaagagcaaggatctttgaaaatctgttcctccacaaaacaacaggaacataggcaaaaactgtcaaaatcaactttttcagaattctgaaaattaacaaaaggtttgcaacagtccagggggtatttatttaagaaaaatggctgaatcttagtaagaacgaagaactttgcagttgttgttgtttttggccatgctgcacagcttatgggatcttagttccctaaccagggattgaaccaagggcctcagcagtgacagcacagagtcctaaccactggactgccagggaattccctgcagtgttttaatttgccctattcccagatctgtagtagtctcgcaaccatagtagttgtaaaaactagcagcctagtagccactaaaagggacagattgggtttggatcttctcaacaagttgtattttcatacaactgtcacaatttgatctgcctggcagttccctgacagccctattttcaggacttgttatctggcctgactcagaacttgcttagtgggaaaaaccctattcttagggtatttgttgaaaacaaccagtagcaactattgaacactgctgttgcttgagacagtgatagtggttgaggcaagacaat

SEQ ID NO: 45743 - DNA, 4030 bp, Bovine  19866880824242
aagatatttgtttacatggtgaagggaagaaggctttctccttgctcctgccaaaatcctgctcctcagtgtgcctggtttgggccaaaacctcctctctcaattagaatggttccaaggctccagagtgatatccctggccaacaatgcacagccaagttagcgaggggcccaagattggcatccaggcttcatctctgacaggagcttaaacaatgggcactgagaagccctggggtctttagtgaggttgtatttcctccattggtttctctttagtagcctatcaggctggactaggactcaaacaacctgaccttaccataggcaagtagctatcctgtgcctgacttctcatctctaaaatggaatagtaataatagcatagctacagtttgtggtgtgaggagtcagtccaggaattttgcccacataccagatgccccatgggtgccccaggacaggtatgcttgcctttattttaaccaacagaaaaattaagttcaagaagggttagcaatttttgccaaagctgtgggactggaaagtgcagtgctgggattcgagcccagcttgagctaatacaccagagcccatgctagctatgacgctttgccacttccatggcctgccttgcccttgctaccaggccatatttcagggagaacaggaaggaaaaaggaaggaaggactgtgtcttgggtttcaggagctgatgctgaaggcatctgatcagtggcacacagggttatgaaactccacagcgaatgggttttagcaaaaatgaacatgggttctaggggctggttcacagggcttgagtatttaggtggccagagaggaggcttttagttgagggatacaggagtgagggttttagggtgatgtatgtagtgggatcaagtctggctaggaattggagagggtcagggactaagtggaggcctggagtggggtgagggtcaggtgggtgggtcttaccctatcatgtgtcttacttgtagtgactaatcactcactgttttgtctggagggttagctgagatgtgaaaagccagcatcctgggcatcgagggatgccaccttccaaggctctcctggtgtaaacagcttgttgggttggttttagaaacccctgggctatgttttccgcactcacatggctgtgcaagccgtctcccggcaccaagccccaccgagcatttcacagtcagaagagttcaacacctgcatattttgagatttcatggcatacgaccttttacctcttgttcacactcatccatcctccgtttaccattgtagggtccaaactgtatccaggacagaacatttctctgaaggcctagagaagctttctgctctttagagttccatacaatagcttacaattttctggtctttacaaagtacttcacacacagatattattgcctttgactcacagcaactccatgacaggacccacttcataccaaggctcaaaagaattaattggccaaggtcacacactgcataggtgggtgaaatgggatttcttgtttgtttttccatagcaaacctcaggagtcttaaagagtaagctctccctgggaaactcactgtgttggttggctcatttcccagacttggggatgtggacgaggcaggaggtaggaagtctagggagcggggaatgcttgggcagaaacatctggaaggtgaaagctgaggtctcatgaggattctggctagccctctctcagctacatttctgtcattgagccctttctagagcctgggcaagtgaaaagaggcggttggtgggggaaatggtaaatacaggtagaagttgctatgagtctaatgctgagacagttgagcagctgcaagaaaaagatactgccagctgctaaaggggccccagtagcatcagcacatgcacgtggaaactcttgatggcttggccacgctctgctcctggttgagccttctgccctaacatctcttcccaaaatttctggccttccacaccaagtacctgcagcatcagcttgagggaggtgcccagaggtcaggccagtctatatcctgccagttccagcaatatcacccatgtcccgcccagtcccagctagagactgtaggttgggggcctgctgacacagaaaggccctggtcccactgccctccctttcccctgggcctcaggccctaggccagggctcaacagacacaagcagcgggatggggttgcccttctattggtctaagtcctgagcgttgcctgggtgagacatggaggtgaggaggcccacgaggctcagtagtgtggaaaacagcagcaggaaggaggcggtgaagagcagcgcagggagggcactgagcagcagcagcaggacagccggcagcagatggcgccacaccgcagccgccacgggccacagggagctcaggaggtgggagccggtggtgaagagcgcgtgacacagcatcagggccagcagcaggtagaggaccccctccagaccccacagcacacgctgcagtggctgccgccagccagatgtagtccaccactgggtccagctcgggggcacgtgacacatgcaccagcgcacccagccctcccgagagacccaggctgaccagggcaccgcacgctgcggcccctcaccggccccgatggcatctgtctccattcgtagctgctgcatcgtggttggtgcacctagggagagggccaggccagctgcaggagcagccctggagatgcctgggacctcagggcaggtgtgggtgcagagggatcaggagggaccagcatgggtgtggtggggctttgaactgggtcctgggtcttacctctgggcagagccacctaagtcatgttgcttcctgccgcacccaggacagcctggcagccagagttgagcccccactctcagtgcccccaccctccccagaggagccctattatgacctggatcagggtgggggccagccaagatagggaccattgctgggtgtgaggtttacctgagcctctctcgtggacccttcaggctttaggggagcctggtgagcccacagatgtagtctgtcacgttttcttgtggaaagccctctttggagccctcccttccctgctggcctgtatccagccctgcttcactcttttaattctttcaagagaagttctctagaatcacagaggaggccagaatagcctccccccaacctacaggttctgagatggctccataccctgcactgggctccctgtcccttatctcacattttactgatgccctcagactcagacttaggtatccactgtccacattgtgaggccagaggtcccccaagatgcaggctgggggataaaggagtatcctcccaccttcccaacctagggtggaggaaaggaagcctgaggaaacagcatggccagtgtatttccggaggacactcaagtccaaggatgaaggcaaaaagcaagggcaagcagggtcaagggcacaccgcgggctcccaggagcaaccccgcgcccaggcacagcagcaacagagcctcctggaggctgagtcgtcctgcgactgccactgcgggtggagcctcctgctgttccggaccctcgccggccccctgactctggcctcttgtgagatgtgtgtgctgtgaccaggtgggacctgcaggcctgtggagagaaagggcggcagctgggtttggggaggctgatggtttgctcacctgcccaacctgtaggctgcagtccacttaccggtggagcatgtcgaaggccaggaagctgaccagtagcagcagcagcagcaaggctgggccagttgtggaaaagatggcccaaattgtcagccccagtgcccccagtccgaggacactatccaggacctgggcccagctagggccccagggggacacacacggacccactggactagctgatccctcccctgcacccatgcccctgggagggcctggggtaggagaaacagcagcttcgggcctgggtaagcagaggtgggt

SEQ ID NO: 45744 - DNA, 793 bp, Bovine  19866880873760
cctggcaggctctctgcggcgggatgtggttgaagggaacttctacagtgctactctggctggggaccactgctttgatgtcttagacctccactttcactttcggcatgcagtacggcaccgtcaccgggatggtgtccattgggaccagcatgctcaccgccacctctcacatttgcttctgacccatgtggccgatgcctggggtgtggagctgcccaagcgtgactatccccatggtgagccctatcacaggtggggagggtagtgatgcaaagagggccctcagagcataggtctcataaacagcaggacagagatcctcaaggggagcagagccccctgaaggaccattgtgaatcctgagtgtgccttccttcccctagccctgtagtcacctttgtgtacacgaattgagtattgagtacataaggcaatatgtcaaaagatccatatgctacagataaacaggaaaagaatgggagtacttttaggtaggagtggatgtagggcgtggaaaagcagaatcagaggaaaggtaattcaggcagagtggtagaagcaacaaagccccttggcagggactgttaaaccctcagttcccgcctgccctcagttcccgcctggttttaaaggggacgtcatggtttattgttccatgtctgcttctgccctggatcatgtcctgcaagggtaaagtacctgcctcacttgttaataactcatccctttcagccccagtatctagcacaattgctgtgtatatagtacctgcaggatggtgtttattgaa

SEQ ID NO: 45745 - DNA, 910 bp, Bovine  19866880955299
tttcactctcattgtctcatgagtgtacagtgttttccagaggctacatgatattgcaaaaaattgaatgcaaaagcagatatgagaatagagccttctatttaaagagatttgcaaaaagagtaaagcaatgctattcttattattttttgtttttgaaaaagaattatttttcataaatgcatgttatttgtcttaagatgcaatgagcttattagtttttaaatgagttaatgaataacattttataagtttctcagtgttaatttccaacttggtaactattcagaaatataacccacataaacaagtgttctttggaattctcaataatttttaaggatataaagaggtcctgagaccaaaatgttggagaactgctggactagaatatggttcccctctaggatttcagttctgtccctcaagagaaaagccataaactgacaaatcagagaggaggggcctgaggccatgccctcaagtccagatgagaccataggacagacaagtccaggggcagctgtgctgtgcttggggcagcccacagagtgccctggtgctgggaatcttcatttccagagccttgtggctccagcaaatatggacaggtgctgcttatgggtgaatccaaaggtctgagcagttggctggaaatatgagtccctgtgtgcttaggatagaagttacctccactgtcttgagaactcatcctcataggatcgtggtgggtcagagggacccaccaaggactagacctggactggtctggtggtaagccatcccttcccctctctgggcctctgacaacccagcctgtaaaatggaagatgattcttttcccctcccaccactgggtgaactcactggacaactaagactgtgaagctctaactcattgctgcatcac

SEQ ID NO: 45746 - DNA, 1157 bp, Bovine  19866880957593
tttcagcattccttttacagagccagaaactgaggcttggagagattgtgattcacttaaaagattaagtgtcatagctactaggtggcaatgccagatcctggtcctggaattcctgatgtgaaatccagtgccaccacccattttctcggttttactgctgtgaccccttcccctttccagctcccaccctaccttacccccatcccacaatgaatcactttcccggtttgaccctagaggggttgcaatataccacgagggcttgaattcccaccagtgttcccccacagctgccagtgggtgggtgaagttccttgatttccagtgacagtgatgggttttcttggaggcctgagcttccgggaggaagagtgagttggttctcctgggtagcacagatgggaggggaacaaggtggagcagagagaggctggggctgtggaaggactagcaggcaggtgtgcccaagatggcaaaatccttcaagctgttatggaaagtctagacgtacaaagcagattaataagggtggggtggctatttgcttcacataaggaactaataaaaactgattacttatacagcccatcttgaaaaaattttgtctgcagaaaaactgaaagctatcacacctgtcagaggcagcatcccctagcaacctgtcttctggcagaactgagcagaaatcttccctataacaaaagcacccggctggctgttatttaccttcaaagctcaagggaagagctatttttgtaggacaaaaataatttatgtgagggaaatgcttttaaaaaaaactgtacttctgcaagaagcaacagagttaaatgggaaggcaggaggaaacaggcaaaatggtcttggagtcctgacgtcatcacctactctctggatgactctgttaagtctccctcctttcctgagcctcagggttcactgttcaagggagctggaccagctgatgccagggcctgtcatctccatatttggggcaggctgggtaaatccctccagtgctaaaaacagagacagctccctccttacagcctcacctcaaggcgtgtgtgacctgtaggtgccgggcaccccccagccacctagcatgactgcatgagggagggggagaccacccagaggcaggcgagcccccc

SEQ ID NO: 45747 - DNA, 1250 bp, Bovine  19866880999945
tgcctttaattactgacatctggtatctggctccttctctcatgcctgcagcctgctgccctgggctctgggcagacctgggccctccgaagctgttcttctgcctatatagggtcagactcctccctgctaatgatagtctcactcagggcccttttatctttcatcttgggtttgcttgcctggactggggcttccagaagaggccagggcattccaaaatcgccccttcaacaaacccaaacaattcattgtcagatttaggggaaagcagcctggcagtagagccctgggatgaaagccaggagattgggcttggtatctctgggccaaactggctgtgtggcccacaagaagtcacttaccatctctgagactctgtgtcctcatctatgaaataagggtgtgagctggatcttatcggttctaacattctctgattctaaatgatcagactagagatggcagacaggagccaaagactgggaaaactcaggatactccagtgtccagcatatagtgggtgtttcacaagttaaaatctgtgctatgaaataaaaatgctttaaaataatttaattatttttcttgctgtaaagaaaactatacttgtagaaaatccaagcaacacagaggaagaagaaagcatacatgcatattgcctcaaacatatgtaaaataaatttccataaatcccattgtccagagaagctcgtttgttgcctgcgctttatgcttaactgtataaatgctcattcgatgctttcttttccaatcacggactgcacacgcattgtcgtcagcagtggggtctcttgcatgagcttacagaatttagttagccttccccaaatcgatagggatttactttgtgtccagtatttttgtccttataaagaaacagaatactatttttcctggtatttgtgagtgcttcctggtttcagtctccttgactgaagagcatcttgagggcttttggagttccctgtcctctcacctgctcccagcaccaagccctagatctggtggagaaggaggtcctgttaagtagccctgtccttttggtggtggtagtacagaaaaacagaggcctctaggtgggccttggagaatgggggaagaactttctccaggaagcgaagcagctagaggactaggcagggctcctgccctttagcaataatggattatccacatgcttgagaccagcaaaatgtgagcaccaaaagcagtttaaaaaataatta

SEQ ID NO: 45748 - DNA, 1424 bp, Bovine  19866881085178
ttacaataaatcagtcacctttaggtttacagatgatagctgtagggagtaggtcagcctatgtgtactttttagaattacctcattatctaaatttaagccagaagccctgaataatcacacttgttatcattcttgctacacacacacaaatatacccccacacacccttgccccttacccatgtacaagtatggataataaaaacacctttataactcttcaggtaatgggttctaatatagaatgtaaaatgaaatcattttgaaaagtactgttggccatctttttgaaaatacttatttggctgtgttgggtcttccctggggcgtgtggggtctccatggcgtcatgtgggatctttccctgaggtgcagctgtctagttgtagtgtgtgggcttaattgctccaacggatgggatcttaacttcccaaaccaggtattgaacctgtgtccgtggcattacaaggcaaattcttcaccagtggaccacgagggaagccacagttttggtaatcttttcatttgtaagattaatataaagggttaaaaattctatattagcggggaggattctgggaagctggcagagtagcaggcactgtgtagtcatcttcccacctagacagtaactgcagtggcagaatctgtctgatatattcggaatgctagaatctgttgaatgcttacaacttccaggggaagatggtgaattgtggttaacttcagtagatttcagctcttagtgagtggcagccattcattcccctgtccccgtccatgtgacagtcagctgtgtgccgttcctgaagcagcttgcacacagctggcggggccaagacagacaaaatgacctggccctccagatcttggggctctgtgttctggtcactgcttctgatatcagaagtgcagacagaggtagacggctgttgctgagctgttgtcagcttccccctcccccctccatatctccagggaatatgcgagaattggaaagtgaccatgaatgcccagggaatggctcatcaaggacctgaggagatgttaagtttacatcaggctgatcttcaaagatcagccttcaacaataagagaaacagtgactagggacagtaacaaaactccgcaaactctggggaagggtagaatctaatttccagagttatcacattgataaattcaaatgtccagtgttcaacaaaaaatcacaaggcacataaaaaaacaggaaagtatggctcattcagaagaaaaaataagtcaacagaaactgtcccagagcaaaagggaggtttatttctataagcatttatgttaaaaacaagacttgtgttgaaaaacagtatttcaacaggtagttgcacagtaaatgttctgcttttaaaaacaagaatgatgtcaaatcaaatatatatatat

SEQ ID NO: 45749 - DNA, 1374 bp, Bovine  19866881104833
gaacagttttgtacgtttcctgctatcttttgtacttttcctgctatgatggacacttgggctgtattcttgggatttttctcttgcaggcatgatgggcccacctcctggtatgaggcctcccatgggtcccccaatggggatcccacctggacgaggaactcctatgggcatgccgccaccggggatgcggcctcctcccccagggatgcgaggtaagtgcctgtagcagtggccttgattccctagggctaggttgggttaggaattggagagaaggttggattttgatcataccttcttggcttttatgccttaagtttagggaagtgaacacttagaggacagctttgttcagaaaggaaagagggagcaagcatttcttaaatggaccttacctccctcttagaatagtgagaacctccctgtacacagtacttccagtatctaaggcagtattctctggtcactgtaaaatagtgcattttgttgcatgaccaagaaaggtcttaggccctttggtttgggagtggctattaattaaggagggactctgggctttgctgtactatttattatggattatctgtttaactccagtttgagaaatgctgatgcagatcagttcttttgttttgtaggcgagaaacaggcccatagagagctcattgtccaggccagtgttcttttcatgaagccatagtggcctataagttaacccgtggccaaactggctgatcactgtatttatagttttccattactgagctttgtaagcttaggagcccatggccccagagaagtacccctctgagcatttggtaactgccgggtgtgggaggctggggtagggtggggatttgagttgcagatcaggcactgactaaacttcttactcttacttcaggccttctttgaccttggccacagagttatggaagtagctccacagaggcttgggcccgattctccagggccacgttaccacacctgtttgtttgttaagccgttgttcgcggagtctcaccggattgtctggtttcccttacaggggccccctcccccgggaatgcgcccaccaaggccctaggctcatcttggccctcctcagctccctgcctgtttcccgtaaggctgtacatagtccttttacttccttgtggcctgtgacactagtttataataaactctttaagagaatattacaaatgcacctagtatgtttgtttattttcagaaaaactgttgatgtattgggtgcttgataagaatcaagaagggttgccttggaaaaactagccctaatcctgtttccttagccctaatccttagctgtttcccttgtaaaatactgtatttatttgcagggatgca

SEQ ID NO: 45750 - DNA, 1477 bp, Bovine  19866881116395
taaaatctatcttcctaacaagaggctttctttcacttttgtatgttcccatccactgtctacagcaaagaaaaccaagctcatttcaagcactctcagtaagtctcagtagccctgatgacattattctctaaaggattttattaacttatgttgtctgtaccagtttccccagcaccagtgtgtgtttatttagcagattcctttcatttgcacttaatagttatccaccaaggatcaacacttctttggtctgctatttccatttctgtaagatgttacgttctttgacaaagtaaaatgtcaataaaaagtaaggaaagataatgcagtaattctgcatcctcttctccagcctattctacttaaggtttagtggggtctgtttccttattttcctgcttcacatcgcttatcagtgtacttactgccttgtttcagcccccacctcatactacacccaacccagggtcaagatcatttatcaaagctgagatgctatacttttaaaaagttaattaatttggctgtgccaggtctgagttgcatgtgggatataggatctttatttgcagcatgaagtatctagttccccgaccacaaactgaacctgggcctctgcatgcgttcggagcatggagtcttagtcactaccatcagggaagtccctgaattcttttaactttcttattaagtttggcacagctccccactccctactcccaaccttggaattctctctctgctcctcttctcctgcccacccaccaaataggtttgcgttcactttactactactgcatattgtatctattaagtaatggttttctaatcagtctcccacttgggcctgggagcttcttgcttagttccaaccacttctgagtgtctaccatgagccaagaaattatacaaggcaaggttggtatatctcccggagtaggtgaacgttgaacatacatatgaatgggtgagactagtacaggtgagaactagccagattccaaactccatacaaaatattaagtttcaattacagctcagcctgtgacatttcccaatcccaaagagctgctgacaataggtaacccctccagggtctttgttaagtacacgtgtgttctggtaggagtataattgagcgtgtgagacagtatgaaagatgcagtcaatgatttctaaacagtgtggattgcaaggtccgactggagagaacccagaggtagcctcctcaactcttaagatcacagttcagagactcactccctttcacaaaaagatgtcactctgtttttccatgcctttattggtgacagcaatgtacaacaacgtcaggcatagcaggtgccacgccaacacctggtgtagcaaacaggcactgcagggccactggcacacacagcccaagcgcaagaaccagtctaccccggccatgtacccgaatgggcatgaggtcgtctatccagtttgtatgtgt

SEQ ID NO: 45751 - DNA, 1672 bp, Bovine  19866881206383
caggtttgattacatttcctgttcgtgtgtgctcagtcatgtctgactctgggcaacctcacagactgtagtccaccaggctcctctgtccatggaattttccaagcaacaacactggagcaagttgccatttcctcctccaggggatcttcccaacccagggattgaatctgcgtctcttgtgtctcctgcattggcaggcgggttctttatcactgtgccacctgggaagtccatgtttcctgtttagtgtctcacaaatcccaagtcaaggaagatgttgactgagttgggctcttatctagaggttgtaggaagaatccacttcccaggcttatttaggctgttggcagaattcagttccttgcagttgttggactgaggtctcattttcttgctggctgttggttaaggggtcaatttcagatataagaagccacttacatatggtgccctccaacttcaaaatccaataataacagtgtatcgaatcctttcttcaaatctgatttctctttctgccactagtctgagaaagctcattgtttttaagggccacttgattagttcaggcccacgcagggtaacctcccctatctgagtcagctgtgccatatataacattacaatagctttccttttacctctgtggccgcagccatgagtatgctcaggcttcagaagaggcttgcctccagtgtcttctgctgtggcagaaagaaggtctgtttggaccccaatgagactaacaaaatcgccaatgccaactcccgccagcagatccagaagctgatcaaagatgggctgatcatccggaagcctgtgactatccattcacgggcttgatgctggaaaaacaccttggcttgccggaaaggcaggcatatgggcataggtaagcgaaagggtactgccaacacttgaatgcccgagaaggtaacctgtatgaagaggatgagaattctgcaccggctgctcagacaataccgtgaatctaagaagattgactaccacatgtatcacagcctgtacctgaaggtgaagggtaacgtgttcaaaaacaaacggaatctcatggaacatatccacaagctgaaggcgacaaggctcgcaagaagtctctggtggaacaggctgaggcctgcaggtctaagaccaaggaaacccgcaagcgtggtgaagagcggcttcaggccaaggaggaggaaatcattaagactctgtccaaggaggaagagaccaagaaataaaattccccgcctcttctctgtacatagtggctttggcaactgcatagatcactcattcaataaaaaacaagcctacctctctgcttccaaagtctctggctgcctgctgggtcttcactgtgtactggaccagaactgaggatggggatacaggcccttctctgggttcctgctttgttgcttccttggctcttagcctctggtcaggttcatgccccctccatccatggagtgtggggcctactttgaagggaggagaggaatgacttctatccaactttcagatactgtgcttcaaaactgccctttacagcagagtatgagtgggatctcagacgcggcctcagatgttggttattattcaattgggagttgtcacattatttaaaaacaacagaaaataatatgcttgcactcctcaa

SEQ ID NO: 45752 - DNA, 1045 bp, Bovine  19866881317436
ctcttagcgaccccatggactgcagcctaccaggctcctccgtccatgggattttccaggcaagagttctggagtggggtaccattgccttctccaaatctactaagttgtaaataattttcttcaaaattttgtgggcattgctttattatttggggctgactcagaaaaacgcaaccaatgaaaggtcccaggggtggtggcattggctgtatcattgttgagcccaccatcaccaaatatgtcaaggtcactaggcttgaatctttgaacagagtcccctggagacagatatgcagcgagacgcttgctttgtctcctctcctaggggctgtatggccactgtccctctacccctaactccatcagtttaccttcaaaatatgatatgagaataaggattaagttctcttgattatgacccattttcactcttgcctctcaagtcaataaactgaaatgtgttggaacctctgtaaccatttacagattaccagttagagacaggtttcttttccagatcagtccctttatacatgttcattcttcttaatttcattcttggagggtaaccttaacctcccattttggggttactatgttgtagccctctcacagtcacattctctgtgccatttctggaatgccagtatccagaacacctcccacaaaccacattgcttctaacacctaaacagccctcctgccccacccccatttagcaggtcatgtggttaccccattccagaaagcctcaggttgcttcctggcagagtctatctgtgcattccaggattgaaattctgaataatcccccacatgaatgcccacaggcatcaccttgctctcaagggaaagaactggggacagacaggttgagcgacttgcccctggacacctagtcctgggaacctgtgagataaagtggctcttcctttcttggtcagctgcccaggtggtgatggggttacaatgcctcctggcaactcagatccccacagaccccttgggtggagaattagcaaagataagaggatgagtctta

SEQ ID NO: 45753 - DNA, 1559 bp, Bovine  19866881348857
aactcccaagaaaaaagcaaagagtctgagaagataaaattcctcactgactactgcagaaaacttttacttcctaggttatggaaaggagaagtgaaacttaacttctgacaatattttccacttgaagagacccagatttgtttcaagaacatctgcatacatttaccagaaggttaaaatccttttctttgtatgcgagagtgacaatggcttaaggctataggacaaagtggattgactcataatccttgattttcaggtgtgcactctttaggtaatgtagaaaagaatccaatgattttgtaagtaatataacactcctttgctaccaagtattaatactattataatagatcctcatccttttctaactaatttaattcacattctgtggaagtcttttaatttcatgaaaaatagatatttaggaacgtttcccaaggatgtgactacagatagaattgactctaatattctcatggaattatttgtaataaagtaggaatcagtaatctatcatagagccgattaataaatctggaagaaaaaactactaaattcataaatatcattaccctctaagctgtagaggtaaatccgccgctgtgcccagcactagtgccaggaggttcagacaggactatagcaattactgtgctgagtgctagtgggccacagtcacccctggaaagggacccaggacagcactctggaaacctggcatttcattcaccacaagtttatcatgtagatttgcacaggtcatttgttcgttttttgtctctctattactgatttataggtaaggatctatctacatccataataagattgtatatgggagaatagtgaggagcgctattcaaatgcagggtttctttggggtaataaattataatgtaatgcgaactctatctctcttttttttcagggtaaaagaaaacacctcactgaagtattaattcttgactaatctcaaagtaaaataaaaggtagaaaaatgtagggtccacatattcattcagacatgcaaacattctggttccattcttcatactgggttctctgggcaattgatgtgagcatcgaattaaaaacaaatgatggattctttgtaaaacagagtatttgtttcatataaatgaagatggtagtcatgataagcctcataacactatccaaagttataggcagttcttttcttacctctgggattatgactagaccaaatattaagccaaagaggacaaggttaactccatacatccatcggaggaagatgaaatatgatgccactgaagaaccaaagtgacctgaagagaagacgatggtgggtgtaagtgttacagaaggagaatggtaacgttgccaagcactgtatgtgtgtgatgggtacaatttgcatgtcagtctgtgtaacacatatctcttctttttttcccaaataaaaagggcttaacctatctgcctaagttcctacaatcagaaagtgaagaagcacaatttaaattctggtctaactagtccaaagcccattcctttttctaatacaacag

SEQ ID NO: 45754 - DNA, 868 bp, Bovine  19866881349041
tgtgatttgtgcaaaggatggattccccaaaatctaggggcccagaggcagcctttgagtgggagtggggtgggaccaggggaaagccccagcagaactgatatttaaactggactttaaatgatgacttggggagcttttcaggtatcaagaagggtggagagcttcccagtcaaaggtctctatggctggtattgtcaaggaaagtctcctggaagaagaaaaagttaatctgggccttggatgtaattggaatgggaagggcaccctaggtaggaggaacaatccatccaaaagcctagaggagggtaagtataaggtatgttcagggcatggggaggagactagcctgactggttgaaataagtgagaagtaatggaagggaccactaagctgaaagcacattgaaaggcttgaatgtcaagccacaaagtatgacctgatcctgagggctctggagtgccatggactggcagaccaggctcaggaaggagacgtgactgatggtctgtctttcttccatcttctttccccagtgtgcccagcctggatccccaagagaaggcctcggtccaattcaagatcacccccttcaagagcggcccacggcagctgcagggtagacttcgtcagcccccacttcccggacatcaagggctttgtgatcatccacgtggccacagctaaataacaggcatgaagggctgagaagggaggagaaggtccctattcctctcctgtccacttctctgctcttcccatatgggagtcaggaggcctggattccagtcccacttcagcttttgccatactctgtgaacttggggcaagtccctcctttcccgagtctcagtttcctcatctgta

SEQ ID NO: 45755 - DNA, 3006 bp, Bovine  19866881413911
aaaagcaaagcagctagaggttcagagataattgaaatgacaccaaaataatagaaagcagacagagaaaatacacccactgtagcgtatgacacttacaatttcaacccatgaacattcaaaattatcagcgtatactattgttactgtgaggctattggttgcttttgtgaaacgtctggagtaaaaaagttaggttggtgatggtgtatgtttgtactccatttatttcagtactgatttgctttcaaagaggacactttttttttttggataagatagagtatgagtaaaaacacaacaaaatataatctcattttcattgcaaaatcttttttctcttagtccgctctggctgctataacaaaaagatcatagactgggtaagttgtaaacagcagaaattcatttctcgcagttctgaaggctacaagctcaagatcaaggagctgcagattctgtgtctggagagggcctgcctcctggttcagagatgcccatcttctcgttactgtcctcacatggcagaagggacaggggagctctcagggtctcttttataaggacacggtccattcatgagaagtcaagactcattgacctatcacctcccaagggtcctgtctctaaatgctgtcatactgaggattcgatttcaacatacaattttggcgggggggcacaaacatgtaacgcatagtcttcctcaaatgtattcaagagcttggaaaagaccctgatgttgggaaggattgagggcacgaggagaagggggcgacagaggatgggatggttggatggcatccctgactcagtggacatgagtttgagcaaactcagggagatggtcaaggacagggaggcctggtgtgctgcagtccatgaggccgcaaagagctggacatgacttaacggctgaataacaaattcaagtgctgggcaagaaaagcaaccccacatattaaaataacttattcactataaatgttatatatttattaaagagcacgtggaaaatcccacatgctgtggagcatctaagcctacgtgctgcatctacggagcctggggccacaactagagaagcctgtgcactgcgacgaagacccagcatagccaaagaaatacatgtttttttaaatgaaaaaaattaaattctttcctgatgatttactagtgagcttccccacaatgtcaggttagccaggagtcttgcctgtggggtcatccgtatttttgtgctctccttaaacagatctgtgtcacttagcacagaatacattcagctcctgggcataatagcttcttcagcagactttgtggtttcttcttaaagactcctttgttaggattaatttggccatcctgtttctcctactaaaactttattttggcttgggtttttagagacaaaggatttccgcttttgaaggtgagacaacagagagagaaagggagaccagggtgaaagcttggcgactgaaatagaaccgaggggtctgagggtgaccccgtggggaccgaaccagtcaaaccttcatgcaagtcagagcatgactcgaaaggtgtctgcaccagccctgcctctacattctaatcatgatttgtttcctcaagaagagagaatgcgtttcaggcagttctgctgacacagttgccaccatttgccagtgaggctgggtgttgtttatttatgtgactgccgtgagagcgggcgtggagtgatctgaagaaaacctgcacagctccctgacataatagaagagccccaacgtgtcctgggtatgcgtgtggaaaaaccctcagagagaaggcacgtatggtgccgaataaaggaaggactgtttgagtgtcctaagttcagagatgaagcacagctgagtgagtggatttgcatatctttttttttaaagtctaaaaattcactctgtcctgtttccagagaccagttaatgtatttaatatttaagatgtaaaggttacatttagatggctgaaatcatggcataaataaaggttatagctcttcctttctcaacttgtggcagaataactagaggcaaaactttcaaaggaatccaggctgagtgagagagtttttgtgctaacacacaagggacaaagttcctccggttgaatagtccctgtgagatgagtgctatggaaatatgaagaggctcaaaccatattttcctcccgggctatagaatttggcaggtgtttttgtctatgatttttttctcttccaattatatgctctgtatagatctttattctttttaaacaaaagtcatgtttgtggctaactggcattatgcataatagaggtcagaaggtgaccatatgcaagttatttcttctccacccttgtgtctctgctacaggcagggactgggtaacaggtccagagagtgcattcatatagacaatatgcattcgcttgtcctatagagcatgaggctgaacagtatttctaaaggtggtcaacacagaagcaataccagggttttttaaacaactctcctccttcctagaagtccaggcttcaagcatttttctcttgtgaccttgagaggttcacctggtcgtgcattctgcttctaggatgtggcttcaagctttcatcatgaaacacttctctgcagccttgcctatctggtaattcctgggtttgatctcactctgggaaggaggaagaatattgaaagggtccggttggagcaaagcctcttcctcttttctaattgcttcagatattattttgccaccatatcaagtacatgtttagtgtgttacttgtcctgaaaacggaatccctctagttggaaaaatactacctagaaaagcagtttgcccgtggtggtgttggcttatgatgcagccctgatgacgccacacgtgtgggttttcatgaagaagaggcgggggcttcagtgcacgtgtgcacatcttggcctcggaaaatcaccagggctctggggaaaaaggcaaagtttctggggctca

SEQ ID NO: 45756 - DNA, 883 bp, Bovine  19866880752578
agtgtttgtcttcttaggatagatacaagaaggaaatcaatggtttgattcctctgagcatcctgcctgagaaacaatgacttcagaagcagactatataccattactgtcatcactgtaacctagtctataaatatcaatgctgcatccatatcacagactgttaagagaatatttcagagtatattattctgttagttgagtgatctaattcttccaagtacaattccacttcggggttatagtgttggtaacgtgcattccagaagcataactgataaaactgttgctatagccacagcaaaggaattaaaagtcataaaatgatgatgaaacgtattttaaaagaaatgcagatgtgacgttttcagcttacagaattaagatttctaagttcacacaattcagcttaaaactaaatctgtcaacgatgctgatggtactaaggcacaaggccttgttacttatattcattgctaagttcaaggccaagagcttcatgtagtttctccacagtctatagtaggttgcattaatatttgaaaattcaaattcttcacctaagcctgagcacatgcaaatacatacacgaagactgtcttgcagaagaataatgttgacatatcactcacctcaagaataatcttatacatcaaaactacgatttataatacttttttaatatatacatctgcttccatgcagggaagattaaaaaaaaaaacacaaaaaggttggggggtgagggtttgtgtattttcacccttcattttatatatcattattacttttactgagaaggcatcacagatgcatcttaaatcagaagagttgttgaaaaccactctctacaaacctctaaattagcattcatatcacctag

SEQ ID NO: 45757 - DNA, 3109 bp, Bovine  19866880872580
ttacatatgtgaataatcgcaaagcagcaaacaactggagacagcacggtgcgccagcaatcattgcgggtgggtaagctgacaacatgtaaccacatattaagacaaatgtagaatttagacaaagtattccatctcttttcagatgtatacttttaaacctcaggaactgttttcagtagatgtcatgccttttaacttgaaaaaagataagcgcaaataagctcccaattgtctccccaatatgtaaaccacatctcgggctgctgtctctgctactcctttgaagtttccctgaaatgtcatgtgttgtgaagactgctgtgcataagcaagacaatttgctcactctcagaattcttaccggtttccactgctatttggtatccagcctctagtctccgagatgacctttccagcctctctgtgttatccagcagatgtgccctctgaaaaagaaaaagggaaaaaaaatcagacgaccgtttacaatgttcttttttttgccttaaaaaaaataatgctgttgtatgccctaacatttcggggggagggtggatcacaatccattatagataatttttagccaatcttcctttatacaaaccactacaatgaaccgatgttcaatcaatcgtgtatggaccatccagtttttgttgttttgttttagaaggcagactcacattgtacatggccacagtgaatcttactccaaaacactaagaaatgtacgaagaccagaaccaactggatctttcctgttgcagcagaagtagctttatgagttatttgcatggattgatgatccctattttgtatttattttttataaaatgcaatcatgaaaaaaaaaaaaactcactagttcctttggttcctaaagaattaaaaaatttttaatattcttaaagaatgccccctaattttcgatgtgcagcaagatgccatatagaacaacatatgctactaaaacagaatactaaacagcaattctagttctaagaccactcaggacaaccactaagaaacaagagacacatgttcctccatgcacacagatgtacaaaattgtggatttattcccaaatatccccagatatatggcactatactgaaagtgaatttccgacacagtgttttagactaagaactaaaatgataataataatatacattattttatattatgtctgatgggggaaattagaagattttccccaaatcctcagcttctgaactttcttttctacattgaggctgatctttttaaaagcataacaatcatacacttgatcatattcagactgacaaatacatttataagctaatcatggctgtgaatggatagcaatatgtgcatgcccttgggagtgtgtgtgtgtgtgtgtgtgtgtccatatgtgtgtactgatgcatgtatgtctggatacttaaaaataccaaaatatgtgtaactatatatttgggtatatgtacgtgcatgcatgtatttgtatgaattagtactttaccccttcaaatcagttttggtatctggtcaaaaagaaagaaaaaaatgcaaccataactccaagtttgtgttgttgacagatgtcatttaaaatcgaagaaatgctttctaataataaaaaaaaaggaggtgccacacatattatctgagtggctgtcgagcgaaacgatccaccttgctctaatgagcccccatggatcttggagatgcaagctgtattgacatgcacacttaagctaatacacctagaccagtgcctccaagctctagcagccagggatgctgacagaatatctcgcttccatcttcaaagaaaggaagtgattagtatgttatcattaccattcaaaacgtgatttccttattccctcccggcataggtgacacatctgagatgcggccagacgttggaggcagctaaagccacatcaaagctttccttgaaaaaaattttttgggggggagtgctggggggagtggggggaagaatcattaaaacaatgcatttagaacagagagataggacctgatgtgaaggtcaggaaagctgcaacaacagtctatagtaattaatagagtcgtctactacacagtggagaaattaagagaaaaactgcccctccctctgcaaaaaaaaaaaaaaaaagcactaaataaataaaagggaggaaggaaagcatatatcataaaaatgtaaaatcagtagtctgtaattgagaaaaggaaaagcaaggggagctttatgtgtttggcactaatgactatttttaaataaatttaacactttactcagcttgtcaaaaattaggaataagaaaagctttcttattcctaattctcactacatgaaggttttgggagggggaattgctcttcccttctttgaatattgttttctaacttaacaaaggacttgatttttcaaataggtgattctctaaaaagatatcagcattgtggcatcaagaataaatgtgaattttattcaagaattcagatcaaagattttggttcattttcatattgggtgaaatccctaaactaaaagaaaatatttagctactgcagatttagagaaatcaaagttcaatactgaaaatggagagtttaattatacaataataaaaatgtaggaaacaaagtatttaaacatagaatgatttctgagattccatgaatgggagccaaattagcttatcgagtatatggctttgtaatggaaagcaaactgctaaaacaactttttcattaaaaaaaaaaaaaaaagggtctattcctaaataatgtcagtaactcttctgcaggacagttcaattttatcagagcaaatctgcacacaagaggactatcagtttaccagcagctttccagcaggacctcactttgtattttggaacctcttcacttaagtcaagctaaaatcaagttcttgtaacagctgtgctatttacattgttcccttagttgtacattgccctggtctctgaaaatgaaaggaaatacagtacagtagcagctgatgctttcaacttgcccccacactccatcccaaactcattctctcaccctcttctcagcccttttcaaagcaggtaa

SEQ ID NO: 45758 - DNA, 1951 bp, Bovine  19866880936865
tgttcttgcctggagatcctagggactggggagcctggtgggctgccatctatggggtcgcacagagtcagacacgactgaagtgacttagcagcagcagcagcaacagttagtgatattgagcatcttttcatgtaccttttggtcatttgtatgtcttctttggagaaatttctatttagatcttgtgcccaattttcaattggattttgtattgcagtatagtcaattaacaatattgtgatagtttcagttgaacagcaaagggactcaaccatacatatacatgtagggtttttttcttttttaattctgagctatatgagctatttgtatattttagagattaatcccttgttggtagcattgtttgcaaatatttcctcccattttgtaggttgtacttattttgtttatggctttctttgctgtacaaaagcttttgagtttaattaggtccaatttgtttatttttgtttctacctccattactcccccactccagtactcttgcctggaaaatcccatggatggaggagcctggtgggctgcagtccaaggggtcgctaagagtcggacacgactgagcgacttcactttcacttttcacttgcatgcgttggagaaggaaatggcaacccactccagtgttctcacctggagaatcccagggacgggggagcctggtgggctgccgtctctggggtcgtgcagagtcggacacgactgaagcgacttagcagtaccctaggtgtacctgagtgtttaggatggaaagtcttatgagcttccatgtgtatttgcagggctccatcaagagctcagtgcaaaggtttatctacaaagcttgcaacccgtgttgtctaaaatggataacgatcttatccttcagatggaaaagagtagacaaaatgcaaatggtcttctaaaaatactctctggttaaagataggggaccagagggacagcaagcttgtgtttgcgaagtgctgtaaacaatacccacgcaaactgctgctttgtattctgggtgccacgttcgtggtgtctccaaacaggcagtatctgggcatggtgattcccaccaggccagccaccacgggacctgcaaagccaaggacagaggggcacggccagtccgcaatctccccagtgtcaactccacaatgcacatccagtcaacaaatgtttgtcaagtactctcttggagcaaagtttggcaacagatttcaaggattacaatgaggcaaactatggaattcacagactctgagtggaaagcaacataatcaattgttgtgggttgaatgtctgtgtgcctcccctcacattcacatgttgaatctctaaactcaatacaatggtattaggaagtggggcctttaggtggtaattagaggaggtcgtgagtgtagggctcttttgatgggattagtgcccttgtaagaagaggaattgggcttcccaggtggcactagcagtgaagaacccgcctgccaatggaggagacatgagacataggttcgatccttgggtctggaagatcctttggaggagggcatggcaacctactccagtattcttgcttggagaatcccagggacagaggagcctggtgggctatagtctatggggtcgcaaagagtcagacatgactgaaatgacttagccctgaaatgaacaggaagagacaccagagttctctttttctacatgaggacacagccagaaggcactctacaagcttgaacaggtagaacccactgtggtagaatccttgagcttagactttccagcccccagaactgccagaaaagtgtgtggtttaagccacccggtctatgtatggcattttaacaaccaggctgactaagacataaatcaatgatgatgttattcatgcccttgggatgtacacaaggcatcagcagcacaaacatcggagggttaa

SEQ ID NO: 45759 - DNA, 1766 bp, Bovine  19866880955759
atttatatatatataaaataatataacatgtaaatgtctacttttataaaagtttatagttaacttgggacttccctggtggctcagacaataaggaatctgcctgtaatgcaggggaccctcagacaacaaagaatctgactcaggcagtcctggagaagggaattggctacccactccagtattcttgcctggagaattccatggacagaggagcctggtgggctacagtccgtgggagtcatagagtcagatacaactaagcaacttttacacacacacacacacacacaccaacagttaatttaccactgtattctactaaaaaatccaagggcactgaggttggtttgcaggacaaccttaaagtgacatcttccatgctggctatattgatagtttaatgttagagcactcaccaaaaggagttaactatcaaatctcaatcttataaccttgatcaatgcattgaccctccagtatctatgaccttctttgattatattcttcagctttgggagggagctacatgaaaggtgttgtgagagagaaaaggcagtccaattagccaaatcaagccctgtgatcagtgtcatagcaagaacatccccaacccaacccagtcctgtctggaaagaggctcaccaataggatgctttgacaaagaaggtcctttaatgttcaacaggtatagtgatacattctcctttttagaaactcctttaatacaaattttgatcaaataacttttttctatgaaaggtaaatgcctatgtatcatcaactgaccacacgttactaataatagttatatttaaatagtgttttatggtgtataacacattttaacttatgccatcatttcttaggaatattctgagacaggcaatataatttcccttttattgaagaagaaacagactcagaggttatgtgatttgcttgtgcttagttgctcagtcgagtatgaccctttgcaaccccacagactgtagtgcgctaggctcctctgtccatgggatttttcaagcaagaacactggttggggttgccatttcctcctctaggagatcttcccaacccaagaactgtaatcacatctcctggctctcctgcattggcaggcagattctctgccactgagccacctgggaagcccatgacttgcttaaggtcacacaaacaagagcttgaacccaaggctggtcctttgaccgcatgttcagggcacttctcattattagcaatctttgcaaagacagtcgagtcacttcttaaggtaagctcaaggactaaaagaagaaacgaaaactggcttttattccaatcaggacagacagccaatctatcagcaacctcagaaagaagggctgcccacactattaaaaaatctgggagggttgatggttttcttcagttttctcaccattactataatgccaatgtcatttgtgttcattctatctgatttcttagaattcatcatgtaagtaagccaatataacatagccatgaattaggggcaagggagaacactggccattcataaaagaaaccacttggaatcattttcactatatttgctcttacaaaatgaatatttttttggtaacattaaactttaaaaaaattaatggaaatgttgtcaaccacctatttttgttgttcatacactgggcaagagctacccaaaaatacataaaataggtcctatataatctatactttgcaaaatagctgaataataagagactgctaagtataaa

SEQ ID NO: 45760 - DNA, 1563 bp, Bovine  19866881023886
actgatggtgaatgatgcatttacccaatcatggtgcctctccatttccacctgtcgtaaaatcttcatggggtcatatctacagttttatctggttaaagcaacaatcctatactttcggacagggactcagtagttaagataacccatcatcaacatgtcccctgggtctgttgtcatgtgtaaagcttattttccttcctagagaaccctcctcagttacttcagtggttttgccattctttcatcaccctggtgatccacattgcatcaagcccctgccagtataggtcaagggttgtatgggattccttttctcaggacttaatcactagtggtgtgtagcctggggcagatctaggttttgtgggaccttgaagcttatttagagagccctcttgaaagaaaagaattaaaactttgaatacaaaattagacacagggccttgaaaagggcctgtgcatgtcagattggaggagaaggggatgacagagcatgagatggttggatggcatcaccaactcaatggacatgagtttgagcaaactcctggcaatggtgaaggacagggaaacctggcgtgttgcggtccatggggtcacaaagaatcagacatgactgtgcaactgaataacaacaaagaatgttgggggtcatgacacttacgcttcattccccgcataggaagtttgccctggagaccagtgttagaagaccttattcgagactgggaactgctctagaccacaagtggggtcttgagcagatcattttctcattgggttttagatccttttctgtaaagtaaactaggttattctaggatcccttctacgtctcaccttctaagttcagcagattaatagcttccagagaactggcaactgggctccccttgtggctcagttggtaaagaatcctcctgcaatgcaggagacctgggttcaatccctgggttgggaagatcccctggagaagagaaaggctacccactccagtactctggtctgaagaattccatgaaccacagtccatggggttgcaaagagtcggacatgactgagtgactttcagtttcagggaactggtaaagtgagttccaagagttcagtcagtggagctccaggtaagataattgtttcctttatgaaatgaataggttgcacttgatggcctttaaggctatcttccagttctaatcttttacgtaaagatttctatttctgatttctgcctgtggtttcctttagccagctgggctattgcctcctcactggaagctgcggatctaaaagacaaagcacctctgtaaaaggagggcagctgggctaatggccattgcataggtggtttctctggagtgctttattctgagtgcctttagcttcagtgtcaacacaggcagtatgctgaaattagacaaagaggagacccacaaagcaaagggctttggagaccaaagacccagggagcagcagccaccctaacctttccccttagcgctgtccaggtaggaagctcactacgctgtgcccgaggttttaacaagagttggatgctga

SEQ ID NO: 45761 - DNA, 1158 bp, Bovine  19866880491755
tgccccaaattattttggaatgttcctccccatggttaagacctagggagagattgagccatcaggtcattacaggctttctaatctgtacacaccacactccgttgtgtaacatttgctgttatagaaatgtgaactacctttgcataatttagcatggctgtattcatttcttttggaaagctttaattcccattttgttcctacagataagaaacaagacggagctattgagaatcgcaacaaagggtaaattcaggaggttaaaagtacacttagcttattcttattatagccaaaactatttctcttgtgtactgtattcatccaaaagtaggatacttgtagcagagaaaattaacaacctgtattacttgggtgtatgtctctctggtcagtgcctgactcatgctgccttaatgttttgataagattttaattatggcatgtggtagtaaacttagaaagctccagatgtaggtaactttaaacttaaacatttcaggcattttatcattggttactatgtgattgctggcagaaatgcttaagtaacaaaatatataatgtaaattttttggcatctatttaagagtctgtaagcatatgtacatttctcgtttgtgtggtctcacatgatgttctacattatggttataacttattgggaggaatttatggtgtttggaatgacaacacacaggaggagagatgattgggtatttcgctctttcgggactgtatttcttcatcgcctcatctctatttcctagcacagcattctcaaatctggtacagtttcaaaatgtagcgtcactattgtcttattttctctgggtgggcacagacatacacaccaaggtgaatgtttagatctttatgtttctgtaagaaattggattcccgcccccccgcccccacacacaccaaattgctttagaatgttaacagttatgtgtgcacttcaacatagcaaaagcccaggatggtgcagccatggaaatgcagcctctgaagagtgaagaaggtggagatggtgatgagaaagacaaaaagaaagcaaatttgccaaaaaaggaaaaatctgttttacagggggaaactgacgaaactagctgttcagattggcaaagcaggtatgatatatataagcaaata

SEQ ID NO: 45762 - DNA, 1010 bp, Bovine  19866880546478
ttccaagcggggttgacttagagaaacctcgggaaaagcggtccgtcgagcgacgccactgaaggcacaggcatgttcggcctctttcaggtcaccagcgcagacacgcctcggccgcagcgcctcccgcctccgggcggttcccccgcaccccggtaccgccgcagcctcccgcactgcacgccgggaacggcctacctccacttctcagagacttcatcgtcctaaaagtcccggcctccaagcagaactgcattttgggatttggagtcctcacctcacgccttcacttcgtccataacacacagtgcagggaactcgcgggggaatctgaacgtaaagcatcacccacggtcgtgaaatgtaggcatcgctagcatccgggctcttgttgcggcctcggcggggtggggaatggtgtcgcctagcagccgccgtcgctattactcgctccggaccagttggctggatccagtgtccgataggaacggcgctggagagcggtcaggtttggcagctgggccgggccgagtgggtatggtagctgaacggccgccgctggttgccaggtttggtgtaggtaggtgggtcctggtgagcgcaaaccgatagtctcttcccacgcaggttctttaaccttcggggcccagatagacaacagcttagtttccccattccttagccgcctgtccgcaatcggtttgctttcctttttctgcagccctgatttcccaggcccaactgcactcgtttcaatcgtaaatttcctcactttttaaaaaaattctagctcttgtttctcagaatcagggctcaatttcagcctttcaagcacccccgcgcttggcaccattaggtgttcgaggtggtaagggggcgtggaggagcgggactcagaatcttagttctgacttagattaagcgtggaagtttaagcgtggaagccttcgtaagttatttgaccgataaaatatctgatattttttgcaactgttgtacttttcatacag

SEQ ID NO: 45763 - DNA, 1357 bp, Bovine  19866880652573
aatgatcatttgaaactttagtctcaataatgttctttgtagcatctgtgtctgaatgaaagtctcttatgtgttagactgcaaaataaaattgtataaatatgaggaaaaacatagataaggtaggagttaaggagctaaggagactatcaatgtgaaaaacaaaaaggttaaaaagatgacataaaaataggataaacattttaaacacttaaatgcatcatactaaattctacagttagtaagcattaaatgcactaacattttaattcaccttttgtttgatattttctgccatccatgggctaccaaaatacagaaccccatgctaggaacatataatactcgctcagcaacaacaaatccaactgggaaaaaaagatttgatgcaggaataaatggtaatgccattaaacaaagcgcctacaaagagaaaaaagataatttattaaattaaaaaatatacacacatcaacagtcaaatccaaatattttatcatttaatctggataatgtactggtggatcaattttaataacactataaagaatactgatttaaacataaagaaggaaacttaaggatggtaacaataaacatgaggatgtatgtcagcaaggtgagatgaagtcttcctaaatagtattagaccttacacctcagcctcatcagataaaaaaaagtttttgaaaatatatctaaaaaaaattagtaatttttatatatctaactaatgtgcacaaagaatcagacacgactgagcgattaacgatttacataacttatgtgcacgtggtaaaaacaaactgacaggaaaagatattagtactactactatgtgtaaggaacactggaaattgataagctacatctcaaacaagacagcagcctacttctacatgttacttcagggctgctctgcatagcattctgatgggtcacatacatttaaacgacttaaaaataaaactggcccttttaaatcaacagtcatttattccataagaatttctaaatttccaacactgtgcactgtgttagaaataaacatcacaaaatgcgtagacgtttttgccattttgagaatgggatggcatatggtttccagattatagtcattacaaaagataagacaaaataactagcacacaaataacttatggaaagaaataggctggttgtcagtaggatatctgtttccatggacatctgcttccatattctgttactctgatttgttttatagtaccttgtggaataaacatgttgttttttcaatttcagaagtctgagagtcttctaatagtttgaggaagcaatgttttttattatacattactactaaaatcgatgtaga

SEQ ID NO: 45764 - DNA, 1121 bp, Bovine  19866880674760
ctacttcactggttgttgttgattagttgctaagttgtgtcccattctttgtgaccctatggactgtagcccactaggctcctctgtccctgggattcttcaggcaaaaatactggagtgcattgccatgattcactccaagggatcttcccaacccaaggactgaacctgcatctcctgtggctcctgcattgccggcggattctttacagctgagccaccagaggatcctagggcaaaaaaaaaaaaaaaaaaaaatggcctggattcaacaaaccacacagaatgggagtaaaagaaaagataattcattagcaaggtgtgagatgaattagaagggccatcaaaataatggaggcatggtgaagccagaaagaaaccaaatactattttgtggaaccaatatgatttaaatgcaaagagcaaaggacagaggcaatcccaagaattagaattacctgtatgattatggcctgtgtgtgtgtgcatgtgtagaaatggagcctcaaaaaggctgagaaaggtcacagtgttatggcagaatgtgggttcaaagctaagtcttcggctttgaatttggtgtacagcaaaagggcatggttcttctctaaatacaccatgagcaaaggaacaggatctgctagagagtgtcctgataaaagagaaaagatacaagatacaatagaagaagacaccactatctttgaagaggaaaaacacaataggaaataagaatactgttaagacaaataataagatataagctggataaatatatgctaaaaaggtatataggaaagatgcactcagagtgcgtagcgttgtttttaatatatcatttgttaacacagagtccaaaaattatctcatattctgtgataatattaggagtacgccctgaagtcaaaaaaagattaagtgataagatattttaaatctgaaatgttaatattttccatattatttagaaattggatgtgatgtttttccatccaagagtgtcaaatgctgtctacctctgtagacaagttgttcttgaacatttatctcagaacagagccatcatcaactcacagcttagtcagaagttcaagaacgaaacccagagactgtccatataa

SEQ ID NO: 45765 - DNA, 1588 bp, Bovine  19866880681258
tgtatttgtctgttatttcacttagtataatatcctttaggtttatacatgttgtcacaattgacaggatttcattctttttttatgcctaatgttccattttctatatgtgtaccctatatctttatccattcatggggaggtaattagtttaattataacaggtaagagtaaaataaataaaagaattagcaatgaatatcgtaagaagcatcagaatatataccatgatgatttgagtacaagtcctgagtgcactatggagtattgttgacaggcaaatgaagacagacccaaggtcattaaagctataataacaaaatccaatatagcgatcagaagcagattgattagcaggtgaaaagaagctaagacagtaactgtgcaagttaccagatacagcgtggccatttgacaaacactgaatgattgtggccactggtgtacagcagtggttggtggacttttctctaaaaggctacatagtaaatatttagttttgggggggcatatctctcaaagaccgtagatagtgcttaaatgaatgggttggctgtgttccattgaaacagtttacaaaaataggcatttggctggatttggtctgaaggttaaagtttgccaactcctggtatagagcacttgaagtagaatttagacttagtgggataaagtgccaactggtgagtgaaggcagttgtaatatatttctcttcaaggaattagactttttggtaaatttatcccctcagtgttttaagaggctttttttttacttggagagagaaattttctaattctttttgaaacttctgaatggctaatggcaaatttttatgattttagggttaggaagcaaaaagcatccattacatcttcttataccacatggagcgtttcaaataagaaatctacctaccttgaagcacagtgatctgttgtcctggtttgatggttgcagagagggtaaaattgaaggaatagtatggcattgcaatgatggttgtttaatcaaggtaatggcagaaaataatttgtaaggttatgtcactttatgttcctgaaacaaagtagaagtggcactgcagtactctacaaattgcagcagttctgatatgcaataatgtcttcatcaaattgcagtaattctgatactcagtaatgtcttcatctcacgtgccaccatctttatacaataacattgtttcccaatatgcgttctgtggggctttggttctttcagatgtgcttcagaattagtgatgaaaacatctggaagaccctacatactacatattccttcttggaaattcatgttgaacatatgtgttctctgaatcatctgtactataatgacttcacgtgaaagcatttctcaaacttgcttgattatagaatttgttaagagagtgccaaggtgacagttaatatgtacagaataaattattttacactttttgccctttctgtgtcctggacttgtctatttaatttcacataggttcacactgtaatgttcaaaactggaactaatccagtttggaccaacccagactccaaacaattaactaagccaaaaacttagaaa

SEQ ID NO: 45766 - DNA, 918 bp, Bovine  19866880691217
tacctaagaactcgaagctcccgttgaaggccttgctctgtctcatcaccttcaggaacatgtttgagaatctcaatctttgtgcacaatgaaaagttagaagacaaagtttgacatggaaatatggggttttataaagatccatactttcaataaagcataaatttataatctgagctttcaaaagtacatatgattacacatctatggtgactctatccactattaattcaacaattatttactgacgaactattgcatgccaggcactgtcctaggcacactggatacagcagtggaaaaaccaggcaaaatcccttcctgcatgttcctgtggttctctcagtgtcagtgggggaagacagtgagcatgtgatgtgatgtgattggtttacatttcaagatggaggagcctcttaagaaaaataacagagtagcaggacagagagtgactggaacactgtgtggggattgggagggtctgaggagcctgcgtttaaggagagatgccagtggggagtgaggtatgggaatatttgggcaaacagtattctaaacaagggaaacaaaagcagagccctgaataaaccaaatgagtttggtctgttccaaggactgaaaggagttactgtggctagaacactaagtgccagagaaagtaaagacgaggccagagaggagaccagatgtcagaccatgtaggtccctgccggctacgagagaacttcaggatgttatgctagggtatggggaccactggaagattctaagggtggactgctatgatgtgctttatactttaaaaggactacttggtaaatacgtggaaaatatgtcaggggtagggcttcccagggcttccctgatatctcatttggtaaagaatccgcctacaatgcaggaaaccctggttcgatt

SEQ ID NO: 45767 - DNA, 3071 bp, Bovine  19866880720800
actgtatcttagttttgcacattgagttttaaaccagctttttcactctcctctttcaccttcatcaagaggttctttagtccctcttcactttctgccattacagtgctatcatctgcatatttgaggctgttaatagttctcccagaaatcttgattccggcttgtgactcatgcagcctgacacatataggacttaataaattttaattcccttccttttctcttgttttcataaaagtttatattaaatagttcaaaattaaatctactttaccatttattatggcttaaaataaaagtacagtcattaaaatatagttgccttaaatacatataaaacctttatttccttcagagtgtctccgcaaatacctccttctgtaatcatcacaaccgtatgaagggcagataaaaccatcttcacttaacaactgaagaaagtaaagcttaggctttcagctagtaaaagacagagctagatgtaaaaccaagatcttgtcactttccagtccaataatccaattcaagcaatattaatttacagtcttcatcccataagtcactagaacacataacaatctcattctttatgttataaataaaactttttaaatgtgcaaagttaaaaatattttattctaaggtaccacaagtctagagttactttattcagttagtgccaaaggtttaagaatcaccttataggtacgatctactgagaaaccaaaaagagcctatagcaagcatgtttgacacatagtaagttaaaatctggtttcaaaatttgctccaggaaattgaaagttgactttctacagtaagatagcctagtctttcacaaaatgaatgaagtagaaattttaaattgaggacttattctggttatgtggctcaaaagtttctaaacacagaaaattcaaaatatagaagaaaaatacaagtaaacataatatataccgttgatcaacagatcttatttaaaaacttaacacaactcatttcttcaaattatgaataatagtgatagggcttaagaactacatatagtcaaatcatcacaaatcgaaaaactagttttcatacataaatcattaaagaaacccttaccaatatttttgatgtataagcacaattcacagaaattcctgttacaagataggacaaaaatatttggtggaatagcttctgggtcaggaatctttttataatgtttttcatttatgtaagcttgaacaactgtcattcgtgttcattgtcaatgttcctgtcttatctgaacaaatagctgtagcatttcccatggtttcacaagcatccagatgccttactaaattattatctttcatcattttctacagtgacaaaaaaaagaggtagttaagctacacataaaaccaataacctcattatatcaaaatgattgtaaactgctttaaaatcagaactataactcccaactttacttggatacatagtataaagcaccgatttaatactggaagaatttaatataaatggcctattcaaataagctaaacaaagtactagctttctgtggcttcagtaagtttcccactacataacataatctagtaaatgaaagcaaatcatgctgacatgcctccaacagcttctaggaagcatcctcaaattctaagagcaatgacaatttgtactcacagccatgtaactgtatttacatgtaaggtttaagtctccttgttaagtggaaaacaaaagattcttgaatcagtcaataagaaaaaagtagcttttatcagttaaaatatagattttgtgggtatgtagttgcctgaattttttttttctctttttgactctgacagattgaggtaacatatcaaaaccagcaagggtcacttttatcttctccaaatggtggtacattggcattctcatcctggaggatcatctcttcctcttacttataagaaaaagatagtttctaaagaaaataagagttttacctatagttccaaaaggcatttaggctaaaatgcttaataactgattcctgaaacattaactggaatgggttaaaaactgcaaagagttattttacaaagtatgttctgtgtctactaatgtgcaagatattgcaagaaactcgttccttgaagtttggggaaggaagattactgtgatctgtgttaatactaatgattaaaacaaagttctgcagtaaaaaaaaaaaaggtgttcagttttgcaaaacactaacagaggagccataaggacgacacctcagtgaagagaaaagtggtaacgttcgggctaaatgaacatttaatgaaagcttaaagaacaatagtcaaaatgctcctactcattttctgtcaaaggaatgcaaatcaattctgcctatatctttttgatcaactgaaaaatcagtatcactaatgagtactcaaaatgaactaatttcagtactgataaaatgattttacccatgtgtctaaaacttacatttaccctcaattgttttctaattattttaagacatcaagtagatgaacagatagtatctcactattactttgatacattcaccacttcatttttgaaacaaaagatgtgaaatgcctgaatataaacttaaacaggaagccaaaaaatattcttatcaagacaagtctgctaaaaattcttgggaacactgaagatgagagtgcaagagcagaaactatgattaattactttgtattgctttctgtctttaatactacttaggaagaaatactaattaacattagaaaactgacaaaagcagcattctttcattaggtataattttatatgtgaagccattttgaaagaaagatcaaaactgtccaggctgaagctgtaagcaaactagatgtccatcaacagatgaatggataaagatgtggtacatacatacaatggaatattactcagccattaaaaagaacgaatttgagttagttccagtgaagtggatgagcccagagcctgttatacaggataagtaagtcagaaagagaaaaacaaatatagtatattaatgcatatataggaatatatat

SEQ ID NO: 45768 - DNA, 1081 bp, Bovine  19866880731330
ttaatatactacctcaaacttaattgtgtaacattccctttattaagcttctagattctaggtcagaaatatgggtaggagactttgtagtggctcatctctgctccacagtgtctggagcttccaccaggagtctcagatggcgggaagggactagaactgttcgggaccatacttctttacccatatctggtgcctggactgaaactgggttcagttcagatggtcaaccagaatatgtacccatgatctcaaagtgaccctgggcttcttcacagagttggcagcctggattctgagaagggatacacatgaggagactgggcattccaagacaaccaggcagaaacaacacggcggccgcttgtggccaagcctcatgtctcctatgctgctgctccggtactctgttgagtgggctgtccagattcaagggtagggactcgaacttcatctctccatgggagtggtgtccaaaaatttgcaactgttttacagctgctgcctgatgccttgcgtacattgctggatcatagttttgtttcctcaaagccttactaaacaatacagcttccagcttttgaagttttattagcacacatggtgagagatggtgtttcactgtagatttaatttacatttctcttatgaatgacattgagcatctttccctgtttttaaggtctgtttttatattttagtgtatttctgacttttttataggatatttggttttttccccatcaacctaaaaaataccttcagtgtttaaggaaaattagcattggtactctggcctccaaagtgttggtagaattactcggaaacctttgaacctggtgctcttctgtagaggtttttctttggaggtttttcttttgataagctgtattttcttaagaaattacccatttcatctaggttttaagatttatttttatagaggcctgtaatctattttttgaagtttcctatgcatagttttttcctgttgtcgctttattttagtatatttgcgcattctttctactttgacagcctgtataacgtgttcattctcttcttttaaccacgttctcat

SEQ ID NO: 45769 - DNA, 1438 bp, Bovine  19866880809256
tatgtcttctctgttttgttctattttatttctcaaagtttggtcatgagccactgaattgattttagactcacaaatagactacagcccaagatccaaaaagagcactgtccttgttctttcttcaccattactgaccctgcagttttgagctttcttttttccctcctcttgtcttcttctaaactctttcatgctgactttaatctctccctgcagttctcatcccttaaatctacacagctagctcccttgtatcattcggctcctggatcaaatctcatggacacttcaaaagggcctctgttcgcttaaccacgattagccttcttttttatttgatagcacatcatcatattttattttcctcatggcatttgatatctgaaattaactatttgtgttttattaactgaattcttcatatactgtccacacctgccagtctgaatataggttctctaaggagagagaccttatatgtcttattcatcatcacatccttagcttcgaaaacagggtaggtgcttaaatagttgaattaatgagcagcacttggcttaaaattttatcttatgaaagttaagcttttatcatacttcagcggtgttgatatgtcaaataggcatgattcatgggtaacacataatacttaagtttctatatgtggcttgcctactgtatgttataattaatagcagtaaccattggttgaggatgaacaagttttagctactgctcaaccttctttataaatgtcttctcatgtaatccttgcaacaactctgcagtaagtggtggtctcctaatttgacagatgaagaaactgagtctcaaacataagtaacttgccttaggtcgagatttaatctttccagtttcctccctcttaactagcaccttgggctgcctccctatcctgaagatgagaatctttggaggcagagaacttgaaattaacagagttagcatcgtccccactgtggaatgctttgagtcaataaggtgttcagagctctacataaaattaacggaacatataagcatcataattacatgtctgttgccatcaattcagaatcttttttgataagcattttctttctttccaaacagtttgtggagacgtttctgttggagaggaagaaggtgaaggtgaaactggttggattgaaggagcggcaatcctcttgtcagtggtgtgtgtggtgttagtaacagcatttaatgactggagtaaggaaaagcagttcagaggtctgcagagtcgaattgaacaagaacagaagttcacagtcatcaggggcggtcaggtcattcagatacccgtagctgacattactgttggagatattgctcaagtgaaatatggtaagtaaaacagggcagtccatgtgacgcatgatgtgattttattggaatcttgttcacagcttag

SEQ ID NO: 45770 - DNA, 2915 bp, Bovine  19866880829732
gagatcttccctacccaaagatcgaacctggttctccttcactgcaggcagattgcttacagactgagccaccagggaagcctaagaatactggagagggtagcctatcccttctccaggggattttcccaacccaggaatcgaaccagggtctcctacactgcaggtggattctttaccagggaagaccccagtgctccatggattccctcaaatatgtcttccacttcaaacttctgatttcttattgtctatacccaaaagtttccccaaaccccaaaattctgtttatcctaagcttagctaactttcttggctttccaaacatgtacttctcttttaatccatacttaataaatggtgttattaccactgtaggtgcctcaggtaaaaatgcagaagtcattttgaacacttgtttcctcaatattctcgaccaatctctcaacacaccatattgattctactttcaaaatatatctgaatttccagtcaccccctcccactacaattaccttgattcaggattttagtagtcttttgtaactattatctcttctgcatgaaacgctctacctggtcaacacatttttcaaaacatgagttaaactcatttgttccgtatactgtagcatcttgttcatgactcggtagtagccttagccactttgcagtattaatcattcatgttaggtctgtgcttagttttctttttttcacagtttatatgacatctcattaatttctttagtcaacaagtatatatgcaactgatgtacaaagcagacattatcttagaactcgtggagcatataagtgacgaagatggataataaagaaaataattatagatagaacaatgagcacaatgataggtggatgacaggcagccatgaaaatacataatgtaatcaaatgaggttagaaaaaggttttcctgaggaaataacgtttatctgagacctgaaagttgagttagagtcagcgagattgagaaatgggaaggtagggttataagggagaatgttccatttagaggaaatagcatatggaaacactcggaggccacaaagaaagggaaagggttgaaataaaactataaagttatcagtaaacatctactgagtgaatataaggggacatgagtccatttatgctgagcattctgaagaacataaaactctttttggtttaattacacaaaaaacttttacaatagtttgtggacttctctgaattcttaaatagaaaccacataatttcacttctatttgacaattcaaaattatcaataataatttcagtaattgtattgatgtggcagtcattattagctgcctttattcatatccccaaactctcttctcctttgttaataaaacctgatctaaaatgattttatatgtaaaaataacctcttttatagtcatggtgactcctccatggatagcactggtgtagtctccacaccctcgccagtggcaactctgtacttttttgggtagtccttattttcattttgtatgagctcatgctccaatgctaaggcagaaaatatcccaaatattcagaagaatttaaaggtactattaaaacttattccatttacattttgagcttctgtgaatatatcaattaagaatgctttcaggtacaagtaacagaaaactagaaccacaatgacttaatctcaggatactgttttcccaacaagaaatccggagataaatggcagttcagtgatttcacaagaatcttagctctttccttcctgccattccaccactctcggctgttggcttttattttccaacttagcacctcatgaggacaagatggctgccaccacttcaagcaccatggcctcaaacaagtgttcaaaggaaaacaaggagggaaggactcaaaacacttttttcttacaccctctctcttttattatgaaagaaatgttttttcagaaacctctttaactcacttcctcatatttcatactcagcaaaagtaggtcacttacatatgacaagatcaatcactggcataaaggactggagttgctttgttgccttagataagggcttgacaaactatggtcctggaccaaacccagactgatgcctgtttttgtgaataaagttttattggaacacagccattcacaacccattcacatacatactgactacggttgttttgtactacagtggcaaaactggtgggtggtgagagatcatatgaactgcaaaagccccaaaatatttattacctggctttttattttaaaaaaaattgtcttcctctagtgtagactatgattaattccctaaagctggccataaagccaggattctttaaacaaaaagaagaaagaatggctcttggaaaggcaattaatatggactagtccctccctcactgcctcaccatctttcctaacatcatttatctggtaataatgcaaatttcaacaaatggccaagaagataccctttttgaaaacttttttttttcccccaaattgtcagtgtggaatctttaccttgagtttccattgccattccatccaatctttaattacatccctaatctctaatctcttctttcaagactttctttcaacctttagaaattaagacaaattcttcagaatcacaggccctggagggagtgtggcatagaattcaattactgaataaaattgaatttcaatttttcccccatcattacagacacattactctagtgtctgatttcctatttccttccctggaaggacactgtgggcctggttggtgttttcccccccaagtgtaggccactctcctcggacctaagggagaaaagctaaaaaaaaatttcttagaaatattagtaacaattgaagatgcaccatcagagctaaataagaagagggg

SEQ ID NO: 45771 - DNA, 1049 bp, Bovine  19866880846831
ttcagtgtgacaagtgctacataataattatctccattctttagattaggaaatggaggcttggagaaattcagtagcttgtctgctatcacagggttaggggcagtgccagcattgaacatgcaggtctgtctgacatctaaagaccacaaccccaaccccttcatcctctaacttacccatgtccaactagaaaataggtgcttagttattttcaaccatcctacatgtataaaacacatgtgaaagtcaagtgatactaaccttatttggtaaaataaacaacatgatttatagactttgtccaatagaaagctttctttacttattatttatacctcattttgtcatagagataaaactaagatttaataccaaaaaatacgtcttcataaaaatcagctggtcagaaaccaaaatggcttaagcagaagatgtttgaagcagagttacactgactgtcatgacttgtgtcattagaaaccttctttcttcccagcgcctaatgggaaagcattaagttgacctcagctccaagttccccggggtttggcaagccatctcttcctaagggctggtatgaccacacaagcagttccaacagctgccctgggactaggccacttcgggtgtggccgttgagaccagcgtgggtggttgcagttagcagaccacagggccaggttcctgcaatggtcctctcagaacccagatggccaagagggctctcttccactcctttcacacaccctacttcatccagaaaagttggttggagagagggagacctccattccagctagaagaacaagttgaggagaaaattccacccagtgtgggggcgtgccagccttccaagcaacctgcctgctgattcccaggagcgtctgtcaatatccatgtcagcttcctcccacagtggtgactcagccaggacttgctctgctgtggtggtgggcctgtccttttcattcctccatgggtttcctaggagtcgaaggagtgtatgcagttggcagggaaggtttcacagtcagcaaagaacagag

SEQ ID NO: 45772 - DNA, 1081 bp, Bovine  19866880892576
gttgtttttgtttttccgatgttcttaattgattgcctgcattgacaattagatttcactaaaaacattcacattattagtatctagcaaaactagaccctgattcccatatggtaacactatcttgatgctttacctgccctcactggtttgccacagtctctatcactccctatagggccacaccactgtcatttatccgcattggtggccctttattcctgtttctttcagagtaaaactaagagcaaagtgaaacatgtttattgctatcaagtgtggaataaagtaaaattgataaggattcactctcaagaagaattcttctcactcaggtctttttcactcaatatgtgttacctacctgaccccgtaggtgtttgtatggaacctgtagcctctcctaaaattctagagctgtaacaaaccagcactttcgaccaggtaatcatcttttcctcattgtatgtgtgagttaagacccctcagagacagtgacatgcccaagattttagttagaaacaaatttgaggctgaatcacatgtagagttttatttctttatttttcagacttctaaacattttatcatttttgtcttaatttttaaatgatagaaattagtgtcaattctcttcagagtaaacaaactctctgatacctcttccctctacaaaatacatatgtaattcatggctttttaaatgcatattgttagcatttttccaataatgtcaagaagctttttagttcaagaagctttagttttgttgcaatgctcatagtgaattttaaaagaccatttgaaaagtactttgcattgatggttttcctttttgtcaagaatggagaacctggacagaatttgttcctgaaggccatgcaacctcgaaacctgcatgtggaggtggttttgctgttgtcagttgcagatatggtttagcgtatcaggaaaagactgcactggctcttgactacctgtgaaaccagaagccctgtgaataatagattcatgtaatgtgtctgtaattacttctggctattcatttcaagcttctccacaacattacagaatacaaaca

SEQ ID NO: 45773 - DNA, 1301 bp, Bovine  19866880893929
cccaggtgttgccgacgctgctggttgcgcccatgcacagtctgaggagcaagttcttagatactgcggtagctgaggttaatatgtgtgctgtgggagattggatggaaaaagtggattttaagaagcttcactgtgatttatgaccagaattcttctttggcaactcatcaggaaaatttgctagagatttcaaattacttttcaatgttttcgtgggtgggactctcatttggactggccaagaagcagcttggctctatgcaatttcagttgtaaaattctggacgcaagaccaagggactccatgtatttctgatggaggctcctgccctacctttcctagcttcaaatagttggggaaaaaaatgtaaatggattctttgtgtggtgtgtcactcaggctagtttcttattactcatctgtttcattcctgccaattaagagcaacagctgtcttgcagagatggtggtcgttaggaagtgacacagctgtggggtttagatgagataacagttgtacagccaagacaaggcatctttggaatgcaaaatgccgtaagcctgatttatagcgtatatccaagggggaaaaacttaaaccaaatcaactaaaataacaactcacccaacagggaaaacaaagcaaaatatcaactcagagatgtttagccccaaagtcaagttttctcagacttttttaaaaaccagattcggactaaaaattgacctagagagattccaattacctcagttgtctacagtgcccagagttatgaatttttgtttgagatttaaatatttatgcaaaatccatcctcttgttgctcaacacaatttgacatttccacatccctaggccttagtgtgcaacaaggagggtagacttgctgaacacaaaacagtgatcggtgactaacatttacaaagtggtgttatcgaagtaaaaatatgagttcaccaatgtagtaagtcagcaaatcaatggactctacataaagaattattttcttccttttaaaagtgagactagaaccatcattatagttgaatatttcaaaataaatgtaacatgaataatataattatgattaaattctgctacctaatattatatatcccagattttatataatatataatcttacttattatatatcttttatatgatatataatcttatatatcccagatttttcagactttcacatctttgctaatctcttcctcttgtaatatattctttttctcatccctgagcagctaaatcctactcatctttcagaaactgaatcatata

SEQ ID NO: 45774 - DNA, 1455 bp, Bovine  19866881002060
taagggaaggaaaaaaaaaaaaacaggatgagatgataaatgcatgtttcatctgtaaatagattgtcagaatccagatctgagtatagaataagctggtatctgaaagactgttttcaactaaatggagtctaccctgctcaaattgggacttgaaagtgggactttctcatctgagtggctggtgtgtgctgttgttgtccagctgtttccagatgcttccacccagtaggagcgtcaccctgagttattaagttaatggcttgggtggcacgttatgatttatcagtgaaattactcctctgagggcagagcctataaaaggatggtcagcttataagtcatgctgttgcagagcagcaataattatgggtaagaaggaccctttagaaagcaagcttgttagtaaaataacaatgctctttcctctgtacatgtcatgatgcagtctcatggacagtgccacatcaactatttaaatgcaatgtagtctttgtaaacagcaaatgtgttagtggagatcctgagagattatctgggatgttggattttgctttatggcctctcacggtccttatgctctgcctgaattattaggttggggttttagtttggggcttaaaaagatcaggtcttttctctttgcagtgacatttgattacaggctgacctctgaatgtgcctgaataaaagcaactccaaatttgggaggatgattggattatgataaagctttcaggataactccaagcacctctacagcagccaaaggattttcagagccacagggacacacagtaactggctctgattcttttctctctggcttaaagcctctgaagaagcttaataattaaagaggtatgccatcacagagtttttaaggacttgcacgtgactgcttgttttggcctcatctgaatacctgacaggttccagagagaatgaaaggacaaatgatctaaacagattgtaaggctagggtgtatatattatcctggttgcctgtttagagtgcagggctatggatggctccattggcatgtacttgctggtcaagacggtggcacacccatcccttcgtggaaagagactcacccattttaagccacccacaaatagtttccttggcttattcaggacttctgcctacatttacatgttttcctcttgcagaccacacagcatgtcctgtggatcaggagaaatatggagaatgtaagaaacacacttgcttcctactggaatgtgtgtcttctgtccagatttccttcagttaccagagtctgaccaattctattgaacaggagatttttaaaaaaatttttggtcaactcctcttacttagattccctgcttgtgctaagtgtgctaagtagccttctaagatggtcctcagtttttcccaagtcctggtatgcatgcccttgcgtaaccccctgttcttcaatgttg

SEQ ID NO: 45775 - DNA, 940 bp, Bovine  19866881005828
ttccatccatgtaggtgcatgggcaaaaaagaatctaggtatcgtgctttagcctttttttttcccccctttcatcctcatccagtccttcagcaagttctatctgatttccttacaagatacctggaagactcaggggctctgcctccgtttttgaaacccagagccaaccaccaccacctcattttgtactgtagagaccagtggtctcccagctggtcttttcctccactcgcatgcatgctcttcagtttgtccttcagtcaagtttaaatgagattggttatcactaccctcctataaagccttctagtggttcccattgcacttagaataaatgccagtcctctctctgtattgttttaactctctctctttccctccagtacaatataaccttgctgaatgtaagacctttttgttcaccctgacttctcagcaaagtacaacagtacctgggcatagtagatattcagtaaatatcagagaaggggtcagactggtgttgcagaacttttaactaggttccataggtttgttattttaaattaatagaaatcacttgtccccaaaatagagttaaaacctatattgttcagtttgtaacttgtcttcctccttacttaattaactattgccctgtagtttatgatttatatacttggtacgttctttggtcctcccaaacaatctaggttttaccaataaatattaattctgcccatcccccatgcccagccccaaaaggagtaagtgacttgcacaagatttcagtaggttaactgggacctaggtgttctaattcctaaaccagatacctttggcggtgcagtgttctaggtatgtgcttgtatgtgtggtgggagcatagaagaattatgctaatctttgggtcagttgcttttttacttcctgtattccctccaagataacattctaa

SEQ ID NO: 45776 - DNA, 1221 bp, Bovine  19866881073683
aataatgccaaattatggaataatgtgggtcatgctctggaaaatgaaaaaaactttgagagagctttgaaatacttcttacaggctacgcatgttcagccaggtaagcattattgattaataaagctattgttaatagtttgttttctttttgaaaatttgattatatttgtagaaagtaggtggagtttattttcaagctttattccagctgacttgaatactataatgtttggtgctggcttattttttgaattgggttatatgttagagctgtttatatcagacatttagggatgtttttaaatacagatttgttggatggcagtgatgagcaattttggtggaatgatagatacaaaggcctattagagtagaagaagaactggagacagttgatattaaaaactggtaagaaatgttggtgttgagtgtggggtcaagagagggtagtaggatgctggggtttttgggtttttttttttttaaaggtgaaagaaacaaggcatgtatgtgactagtgcattgaagttgggcaaagtagtaattcagggttggggaacggagtaaaggatcagtgttcttgaatagatgagaatagataattaagatctgatactcaggatgaggatttcagtcagctgaaccggtagttaccatatagtaacagggaaagcagagtgtagaaacatggatatagataggcaggtgaataatagacaaataacttctgaaagttactgtttgcttgttttctcagtgacataaaaagcagaatcaacagtagattgtggggaagggaaaggacgttctggagatctaagaccaggagagagtctgaagtactacatctaggacatggcttcagaaactttaatgtgtgtgtgagtcacctggagatctaatggtgcatgttctggtgtatagcgatttagagtagggccctgaagttctgcatttctgataagttcctaagtgatacttagcccatgaatcacgtgttgagaaacgaagatctaggaaaatgtatagactaggaaaatgcagtgtgattgccaagcagctgtaacacccttcttgaggttgctatgctaagtcacttcagtcgtgtccgactctgtgcgaccccatagacggcagcccaccaggctccccagtccctgggattctccaggcaagaacactggagtgggttaccatttcctcctccaatgcatgaaa

SEQ ID NO: 45777 - DNA, 653 bp, Bovine  19866881091797
ggtgagaaggaaggttaggatgcagaaggtcctatcaggcacagagatgaaaagcactggctttgcattcagaaatgaatttaacttctggcttcaacacgtaacagcaatttgacttcgggcaattaacttcccaaacctcggcagctcacctataaaacagaaataatgttcatacctacatcacagagttaatatgagaactgaaagggatagcatatgccaagagttggccatggtgtaattggtgtacgtgctgcagttcatggggtcacaaagagtcggacgcgactgagcgaccgaactgaactgaactgaactgattgttattattaccattcactgcaggattttagggcttgggaagagggaagataagatcagtggtagacttgaaggaaactggagaattcaaagagaagaagaaaactgtcttgctggctaggaattcagtgttgggcttttctgtcataatctggtatttttccgggaagactagttaccaaggccagaggggtagttccccagtggaactttttctctctttttgacatgaaagcattgtttacctcccaagaggcagagtgtaggactgtagctgaagtttgatcttaaaagttgaagaattcagaaccctgagagagagaaggaat

SEQ ID NO: 45778 - DNA, 1366 bp, Bovine  19866881133643
gagtgactgaactgaactgaactgaactgaaaaacaacaagctatcaagacacaaaaatgtggaagaaccttaaaagcatattgctacggttaattcatgttgatgtatgacagaaatcaaacaaatattgcaaaacaatcatcagtctatttaaaaaaaaaaactatggagtgatgtcaactaatttgtccttccaaatgctaagcatacagtaatgagtgggagctgggaaatcactgagacaccaaagagaaatcacagtagctgagaagatgagacattgagggaaatcctgatgacagggaggtgagttcttggtcagggccttacaaatctgccttacaaattgtacactcttaacttgaatactaaacataaaaggaaaaccaactgctatatttttttccaaagagaagttttgaaattatgcaaagatcaaaactgaaatttgggaaaagtgaatttctgatcatttcacaaagtggaaacaattgccatgatgcataatatgagacctccatgcagaaataacggactttaacaacatatgaaagtaacgtttcaacttctatcttgaaatttctgggcagaagtgagaataccctcaacataataaattatgtaaggaaattaaaaagggcaaaactgttttctgcatagctaacgaattcctataataaacagataactccgtaatgtgctttagctttctttcattattttggattcacagatccttgtgatacacaaacagataccattctctttagttgaaaccaaatattggtctgctattagattcaagctttctcagatggcatagaagaattaaaagtgacatggtacaccatactatctaattaatattttctttcttaagttcagagggacttttatagaaccgtatctttggaaacatctattgctgtgatgaaaggctgtcaccatgggatttccatcattcagggaaactgtgcacacagtagcctgaggtagaggcccattattttcttttctgctttttgatccatgccagaaatttcttgagggaggttgaaataatattcaaattcattttgttggcaaagacaagatgtaatgattgatacagaaacgtagtgtataatttctaaaatttttttccatatcatctccttgagttgtttttgacaaaggaaaattaatacaaaattttattttcttattattttataaagaggtgactcctaaaacattacatatttttggtgcaaaaaagcacatgtgaatttgctctgagtaggtgttggagaagactcttgagagtcccttggactgcaaggagatccaaccagtccattctgaaggagatcagccctgggattt

SEQ ID NO: 45779 - DNA, 1415 bp, Bovine  19866881165050
atcattggaaaatgaatggtgtggatatagaattttctgtaagttggaaatattattgctatattcctgtggttttactacaagtttaataaatgaaaataatggcctgatgaaagtgtacgagtgtcattgagttcagtcctaaatctgaaacagttaaaaagaataataagtgaacaaaaaacaaacttcagaatcatggactttagaaaactttatagtataatcttactaatttctagtcaatcacagtatgttgtgattagtaatgataaaacttagtaatttgttaatatattattatgttaatattttctctttccttaaaagctatgcactgaaagctttctttgtacattattctttgctaagtgaaagtaatattttattgaataaaaattaacatatttttttgttttgatttatcttacataatataaagagaacagttggattagttctttaatagctattgcttttttgtaaggagaccatagagacagaattttttttctaacttggccccagctcacaagtatctgtgaataataaagattttttttttttagctttatgctctctatagtatatcaaacatttctcgaagggcaaaactttgtaatttattcatatattaagcaatttagtaatcattcatgattctttatgggtatatctgttaactatattggcacttactaatatgtgaaaaagaaggatagagaagatagaattcgtattgtttctcattaatatcttattaaaagtagcctaaagtaggcagttgtagaggaggctacatgtggatccaggatcttagaaataattattttaccttttgtttgatttaaaacttgatttagtttttaagaattaaagttttgggggcttaccagtgggtaagagtccgtgcttccactgcaagcggtgcaggtttgatcactggtctggaaactaagatcccatgtactgtgaggcatagccaaaaaaaaaccaagaacattaaaatattggaataataagagttatttttatgtttctcatttgttaattcttttatttgtaggattaattgctgaggacctgaacctaactgaacacttttctcaagagaatagaatgggagaaagaaaatctgatttcatgagcctcaaaaatatgagtgaagaacagtcaaaggtagatagtaaagtattactatggcaaagttaaagaatattattatcaggctttcatttcttcccctattatctcattttggacattgcttctttttatacttgttaaaaagtctcagatagatcccaagattaatgaaacgttgtttactctgaatacagattaggagttcagataaagtagagctgctgcataggagaccatcattcaatattccacagtcatgtcagaatgag

SEQ ID NO: 45780 - DNA, 2461 bp, Bovine  19866881167102
aacagtgtattctcttagaattaaaatatatgtaggaggaagtactatacaccaggtatatgcttgtatccatttgtaatcatgtgttagctgctttagagtagtatgaggatccttgagttgattcatcaagctcaaataattagtaaacagggttatggctaacccatgaaagtatagccattgttttggaaccttgttttggtaatatcactaatttccagccctttcactatgaaggactcctttattcttcttatgtcatggacctcaccttttttagtaaactaagttataattaatcattttgtcatattttaattgattaagactcatataactggcaatgagaatttctaatcaacatgaggaaaccagacttatcagttacactgaactaaaattattccagtccaaagtaaaatgcattttagtttacctatttaatcttatcacaatggtcatataggacatttaataattatcatcaagctcccctccttttttggtaatagtaataaatgtataatctttttcacatttctgctaccttataaattaaaataaagccaatcaaagcatcattgattgaccttgaaaatttaaatttctataatcttaactgtacaatttgtcaagtaagcctacctaataccttattccagctataccaaaccacggtaacaagtgtctcatgaaaaaatttgtgagaggagtttgttggccatttatgtttgggaaatgtgcatgtacagattgagatcattttttactttagaacttctcagagcatttgatatgatactgtgtatatgaattttcaagggagagcaatgttgggaatggagcggttaaaacctgttaacctctcatggaattatgttccatgaaatacttcaggaaactttagtatttcgtaaaaagaagagatgctgcaagctaacagcttttccacaagggtctagaaattggaaaatctagtatttatttacttagagtatgtacctaatcatatctgaagtatcttattacttcctagactaaaagagatttctgatattgccaaaaggcaagttgaaattttgaatgcacaacaacagtccagggagaaggaagtagagtccctcagaacacagctgttagactatcaggtatgtgcatgtgttaactcttctacatagaggcttttcttttccaaaatttatgttagatattgggatcattttgtagttttaatcaggataaatcaaatagaggctcctgttttcgttaattgtaacttgattagaaaaattttaatttgaaatgccattggtaacacaggaaaacatttaaatgcttacagatgcattgtagcaactgctgatcacagttcagacaatggggagaaacatgtctttcataacagcattgttccttgtatttatgtataggtttccacatattctcacattatagtttttttaggattaaaaaactacccgttgtctacattagtagtattatcagtattgttatttacatatggacgtttaaagtaaacttagtaatattccaactggtatgtagttaggtgccagatttagattttaaataagtttcattctagttctttttattctgcagtcttttgcaatttatgttaaagcaaggttagatttttgtaattgttttaaattagtaaattctgatttttaagtccacgataagtttcactgggaaaacttgaaacttactacaaatatttatttttcatgtcaggcacagtctgatgaaaaggcactgattgccaagctgcaccaacacgtagtctcccttcaggctagtgaggctgctgctcttggcaaggtggagtcagttgcatctaaactgcagaaggtggaggcccatactctgcgcttagagcagaaactcgatgaaaaagaacaagctctcttttatgcccgtttggagggtagaaacagagcaaaacatctgcgccaaacaattcagtctctacgacgacagtttagtggagctttacctttggcacaacaggaaaagttctctaaaacaatgattcagttacaaaatgacaaacttaagataatggaagaaatgaaaaattctcaacaagaacatagaagtctgaagaacaaaacactggagatggaattaaagttaaagggactggaagatttaataagcactttaaaggatgccaggggagcccaaaaggtaaaacaccgattttaagttcagtatgttcaaaagaggtacataatcattttgagttaatatgtgcctatgtggaaaatgcttaatatatgagcaaaattccagatataatttattaatttagattatataaattaggagtttgggctattagaatatctgtttataaataaaatgagactcctctaagccatagtttcagtagaaatgcttagagtgtaatatcaaagaattttaaacactc

SEQ ID NO: 45781 - DNA, 905 bp, Bovine  19866881186917
aggagcctggtaggctacagtccatggggtggcaaagaatcagacacgactgagctacttcactttctttctttacagattaagaaataataagaatgaaaatagattagatattttattcaaaggcactcaaccagaaaatggccaagtgggaatctgaatccaggactaacttgtaagctcaggttttcgtcaatataagatatttgaataaaaaattcaaaacatagatgttactctatatgctcagcttccccagtggctctaaagcgataaagaatctgcccgcaatgtggaatatacaggttcgatccctgggtcaggaagatcccctggaaaaggaaatggcaatccactccaggattcttgcctgggaaattccacgggcagaggatcctggcaggctatagtctatggggttgcaaaagagtcagacatgactgagcaactaaaccacagctttctacatgctaaatttttgtctgtaccttattaataactgtacttcttgattcgctatgttcttgctctggagaagtaaaaaatatattctgcatcagatttttttgagttattatataatttatggagagacattgcaaatctaaaatcccctccttggtattttagtccttgaatgacaatctaaattgggcacttgttctttttaaatagccactgattacaggattgaaaaggctttgttatatcagagtggtctaattttttgaaattttcctgtgggtcactgtattctcacatatggtaaaacctttctgagaggattgtgctgaaatcacaacggaagttgcaacaggagtcttatcagttgctggtttctttttggatccaagagctacctgggaaatatctctcttaaaatcagtcagattggaacaagaaga

SEQ ID NO: 45782 - DNA, 870 bp, Bovine  19866881259195
gaaacccaggttcgattcctgcattgggaagatcccctggagaaggagatggcaacccactccagtattcttgctcggagaatctcatggacagaggagcccagcaggctacagtccatggggtagtacgaattggactcgacttagtgactaaaccaccaccattagtctgactaaaattcagatgaagcatttaaaagaaaaaaaagtatttttttttttttaatgatttatcattacagaaactaagagaaaaagaatctgctttacggttagcagaggagaatattctgtcaagagacaaagtaatcaatgaactgaggcttcgattgcctgccactgcagaacaagaaaagcttctagctgagttcagcagaaaagaggtggaaccaaaatctcatcacacgttgaaacttgctcatcagaccattgcaaatatgcaagcaaggttaaatcaaaaggaagaagtgttgaagaagtatcaacatctgctagaaaaagccagagaggtatttgattatgttatgctatcttatttattatggtgtttttagacaaatgccaaatactattctgcccttaaatggtgtttcattttttgttttcaaatgattctattcaggtattgttactttcacgtgattggattacagatctgtcagtaaaactggcagtttgtgttattgactgagtaaaccagtaatggtgttcatggtgaaactgtgatttcgagttaataggtgaagattgaggcagtaagttagaatgaaatccatcacactggtatcagtgaaaatcaaatttgctagaattttaaggggtaaaaaaacatctaaaatttaaaaattgctagaaacaagttaaaagata

SEQ ID NO: 45783 - DNA, 1271 bp, Bovine  19866881276791
tactattattattaccccatctgccagatgaggtctttgagagcgtaatagaagcctgactccattacacattccaaagattgtaccacttgctctgcctacatactcactaagcaaccttctaattataatgtggattcccatgtggcatcatctatgggaaagagaatgtgctagccagaactcgagaatctgtttcccaaggcagttatttttttttccccactgtaaattaataaactgacattttaatattttatatgaatctgatgaggctttgataacatgagcctgatccccaaaactagattattaagagtacagatcaactgggtttcagaacctgcaagtttcagcctctttatcatggtaaacctactaagggatataataaatcctatcccgtgagggccccaggggggacagccagtcctcattctcccaaaagacgagatacatcaacatcatcattagcatttccttcccttttgacatctctaggggacaaagaggtaacagaagcgaccggattctaatcctgactgtgctgtgctaacataaccggagccaatcactctccttcctcattcccagttcttcatggataaaacggaggagctgggctcaatgatctgataaccccttcttatctacaccactggctgtctatcctgttcaacacacctccctcaccctccacaagcactttccagttttacatttcttgctcttagcattgcttctgtttctctgactggctcccccatccactttctgtctctccacccatcccaggaaagtctggggtcctctactccgacctcagcaacactcagttatgactctagatctgttctcgtataaacactactatgctccccattatactgagcctagcatggtatctgtatatacttgtggtattgaaaagctgtgcctttatctgaaagacccacatgcaattcaatagtcttaggttcaggatttcaactggatattagtatttccttttccaagttttgtctcttgctttcacttcatttatctacaagactctatttcagacatcgtttctcactcatctccaaaatccttacagtaatttaaggtttagtcctaacctcaagctcaaacctcacaatccattcctattaccaatccccaaattcctctagaccagacttccgaactggtgtcccagagaaggctaattcacaatatgttaatagctatgatgtgaaaaggtcagcagagcaaacaggcttctttag

SEQ ID NO: 45784 - DNA, 816 bp, Bovine  19866881320986
gaaatgctgctgctaagttgcttcagttgtgtccgactctgtgcgaccccatagacggcagctcaccaggcttccccatccctgggattctccaggtaagaacactggagtgggttgccatttccttctccaatgcatgaaagtgaaaagtgaaagtgaaatcgctcagttgtgcctgaccctcagcgaccccatggactgcagccttccaggctcctccatccatgggattttccaggcaagagtactggagtgggttgccactgccttctccaaagattggaaatatttgataagaaatttgcctctccccatgttcgggttggtgaaattttattgaaactttgaagttcttactaatagtggccagcggttcctgttactgtgttaaaaatctagctcattatttctcttctgaacttttataaagttttaactaaagaatcagtagccattgttggaaaagacacatactccttgcaaagaagtgctttgatcgacaataatgtcaatgaggatattagtcttccctttctaaattcagtactattacagtcccctaaaagtaacaaaaataaaatacaatgcttgggtttgtacaatgaagctgttatgtttgaattctgagagtgaccagagtgctattgaatgaaaacttaacctaatgaatcagtggcctctatcccaagtgtaaaatcttccctgacttaaaaaaagaaatgtagtcccattcttttttaaaaactaatctttcctgcatcagctttgactttaaggcatcaataaattttaggccagccatctgtagttctcaat

SEQ ID NO: 45785 - DNA, 731 bp, Bovine  19866881363943
aacccctagtggcagagaagaataaactacgtacctgtacattttggtgcagatttagatattagtcttaagtaacacaaaactgccaaatatgtccttcttttaaagtaaaaagccacgttcaatcaaccccttacctgagatgttgtcttatcacctacattgttttaaccataaaagagaaaagtaacttactgttaaaataagccttctattagaatgaaagataatgccgaaatagttttagtttcagtgaaatgaactacaaccttttaacaatgtagtaaataaaagttacccggtatatacttccctacatcaagtttttcacattgcctctcctgttcttcctgcttggagatgccactgcttcctgcttctaggaaagtgattcccaaatccccatcttctgttctgactggttttccatcctaagagtccactcagatgttgtaccagtactttaaactgactgcaggcgagactacaggccgtctcctcactgaccattgaatttatatcaacattactaccaataatttcaatgtgaagtctaaactcacttgaatacttcctttccccttgtcatctatatagtattagctcctaagtcctatgtacttgccctctgaatatttcctctccttcctattgcccctgcttcttcttgctcttacttggagctaaagctactgtaatagcctttgaattgatatcagtctccagcccat

SEQ ID NO: 45786 - DNA, 1494 bp, Bovine  19866881391706
agtcttgatttaaatttatatctgactatctctcatgtccatggtccttctgatccatgcaccttatcctggttaagtggatctatcaaaagaaagaaacagaactctgtaactgaggcaaaaagcaaaagctcaaagaacattaatactactaataccaaataagatcatagtgattatcgaagtataacaatcattttgtaagtgacaaattgtgtcccaagtgattaacctaaagctatgtaatttgcatctattttataaagggttaattttactatgacttttaatgaataattctagctttttaaaatgtaaaattctgggacttccctggtggtctactggttaagaatccctcagccaatgcaggggacacgttcaatccctggttcaggaactaagatcccacatgcatagggcagctaagccatgcaccgcaacttttgagcccatgtgccctagagtccatgttctgcagcaagaatagccaccacattgagaagcctgcacaccacaactaaagaaagctgtgcgcagcaacgaagacccagcacagccacacacacaaaaaagtaagattctttggagaatatcatgataacctgtggtgtgtattgtaagtggtaatgtttttaaatatagccagggatgagattgaccctttataaacaccactaagaatattcaggttataggtaatgatacaaaagaactctaagaagtcacaattaaaaatttggtttatcagtttttttgtcattgaactttatacagtagtgtttatagtaaataattttttttggtgttattctctctcaagctggatgattattagagcagtccctagtctttagaattcaaacacaacatttagagatatttaacatatttcttacctctttttggtgatgaagacaatgtttttttgttctgctttttcttccttaaacagtgtatttaaaaagttatcctgggtttgtctatctttggtgatattcactcatgccttaaaaacactccacaggaattgggattgggagtctgaatatacgctgtttatgtcagccttgaaggtaaaatgttattcaaaatatatcaccaattatttcttattgccatttctgctacggtgttctaactttacttttaacttgacaattaattctcaatgttaaatacttcaccaaaaaattaataaaaacaatttgttctttgtataatctacaccataaccagtgctctgaatagtcttagttgtatgtctggagcatatatgaataattccccaaatgctatacaattgttagatgcttaaatgataaaatgtttaaatgtgaatactttgtttcatttgttcttaaggtgtactttttttttttttaaccttttaacatgtctgaaatcagaataaatcttacagtgaaaggcatcttacaattaatgaccttttttgtttcttaatgatatataagataaccatgagccttataa

SEQ ID NO: 45787 - DNA, 1624 bp, Bovine  19866881401729
ttgctatttcctgttgtatagggttcccacttatcctgtgtgttgtcttataagttttatattccttctggaaagaaggtataaataaaataaatacacaaatacttaataatgttaagtgcctcttctagaatgaatgccccagataggaattttcttggtctttgcctagtcctgagcttcattgagagggttagatgtctacagccctgtctgtgcttcacactgatgggttctgataaatagacctgtaagcagaaccccccccccccccgttgaacccccttttccctttgttgtccattttaaataagaacccggctccagcacagtttcaaggtggagtggcccactttgacctgggccacaagtgtgggtccactacgactgtgaggacaaagtattggtgtcttctgagatgcgactcagcaggggctgtgagcaggcccacttcagttcgtaggagtaatcacctggaggcttaaaagagaaatgttttgttcactaaattgctagagtgagatctgtacatttctgtaactcttgagacttatggtctctcctaagacaaatatatcatcagctttaccaatcccataaggtaaaaactctacctagtggaaaattcttgtaattgtgtcaagtctctttatgagaaaaagaagaaatcttgcttgggctgtcagaataatgtaagacagcttgtggtttttttgcctcgagtttgcgtgggcaggaaatttattctttgctcggtacatctttgagctgcacgcagctgtgtgagatcccagctctttacaaattgctaataaagaagataatgccaacatttgcactccactcagaagtcaaccactgaagatttaaatctagatttctggatagaaaatcttaatctttcgagtcatgtcactatgcttttaaattcatttctgaacactgcagtgaactaaaattagaatttggaataagctagaagcaatgaaacaatttcctcattcatctaacatgtacttattgaatatctaatctatgtgtgtgcatttagaaatttttaaaaagtgacgacatgggtttgttctccaagtacaaggattctattaagttttggccaaagaagaagaagctaattaatatttgttgagcctttactatgtgccagggacttggcctgggcttgtataactcttatgacataaatattatggatcccattttacatgtgaggatactgaagctatataaccagtaagtcacaaagtgggatttttaacctcagcataatggattccacagcctgctatatcccactgcctcctacagtataaattttcatcttgactagaaaattttcttttcttttactttttaaaaatgttctcatatatttaaattcatttaaagtagatttaaggccttccctggtggtctgccttccaatgcaagggacacggtttccatccctggtccaggaagattgcacatgccctcggtgcaactaggcctgtgtgctaccactactcagccttcatgccccaactatggaaacccacattctctagagccccgtgttctgcacaaggagaagtcactgccaggagaagcccacgcaccacagcta

SEQ ID NO: 45788 - DNA, 2012 bp, Bovine  19866881485054
tatggtttttcctgtggtcctgtatggatttgagagttggactatgaagaaggctgagcactgaacaattgatgcttttgaactgtggtgttggagaaaactcttgagagtcccttgaactgcaaggagatccaaccagcgcattctgaaggagatcagccctggggtttctttggaaggaatcatgctaaacctgaaactccagtcctttggccacctcatgtgaagagtttactcattggaaaagactctgatgctgggagggattgagggcaagaggagaatgggatgatagaggatgagatggctggatggcatcactgacttgatagacgtgagtctgagtgagctccgggagttggtgatggacagggaggcctggcgtgctgtgattcatggggtcgcaaagagtcggacacgactgagcgactgatctgatctgatctgatacactcaataaatattacttatattatatttggattccctggtggctcagacagtaaagcatctgcctgcaatgcgggagacctgggttctatccctagtaggatagaagggaaggtcccctggaggagggcatggcaaaccactcccagtattcttgcctgaagaatccccatggacagaggagcctggctggctacagtccatggggttgcaaagagttgggcatgactgagcgactaagcacatattacagtcagttctttaagctctaagaccatgtgtgtaaatatggtttggaaagatcataaaattaggtagaaatgtaaatcagtattagtattactaaaacaaataagagcaacgtgagggtttctaaaacataattatgctacatataattccagagaataaaattatttgaaattatatacaataaaacaatactaaaaattaagttgaagtccttcgaggacagggttgtaccccattccacagtaaagatccagagtttggagaacagagatggacacaatggaaaataaagcaaaatgttttcttgattttctatgattaagtactgttctcagtaaattcttgctgaactacacagaatcaagattctaatttgttatctcatatctcactactacaaaaagggtgtctctaaaattacttatgaaaacacttttaaaaatatcactggagtagtataagtcaagattcattatccacaagctaacacacacacatacacacacagagtaataaatcaaaaaccatgcaacctgacacattttgaaagacatttaaagctctgcctccatttcctaatataaagaagaggcttatttttttaatattagaatgtctccatttccttggcattttgaatccctatgagtcaataacttttgcagcattatgcaaagtggtctaaaaagagatttgaaaagtgggggcagtggtttttcatctcctgccttgtatgaatttaactcaagcttcagattcctggcacacacttaaaaactttttcaaaccaacatataaggagtacagtccaacacagtgcaaattgagtacctgagcactgaggggaagaaaattgaagcagctattaacatgagagaaaactcaccactgatcttctgagctcccccaacaccagtaggtttaagactctggaatgcttacaaatcaccagcagaacttgttaaaatgcagatttcaagctccagctcccgagattctgattcaataggattgtgatgggagccaagaattagaagttttattagattcataatcagaggaaggaaataatgtctctatttttctttctctggaacatgaaacacaaaataatgtgtaacatgtaaagacagagcattgccttactttacctcaccaaatggggaggaggagatgagacagttcatgaagactcttctagctctgtgatgcatatgtttataaaaatccaggccatgtgcattacacagacacttcttaaatgtagcaaagatccatactgtctagattttccacttagatattttcca

SEQ ID NO: 45789 - DNA, 1406 bp, Bovine  19866881698914
cgacttccctggtggctcgaagtaaagcgtctgcctacaatgtgggagacccgagttcaatccctgggtagcgaagatcctttggagaaggcaatggcaccagtattcttgtctggaaaatcccactgtcagaggagcctgggaggctacagtccaccgggtcacaaagagttggacacgactgagcgacttcactttagtgcatgagcagtgttagaaccactacagaatccttgctagttagtgacactttgcaaaataatacatggaatccaactttttaaatattctactgtctgcatttgtcaaataagtaaaatgataacaagtttaccttactcctattaccagccgtaaatgtgtacgtagaaagagtgaccccagagactaaaaccatcagaatccatttgcaaaaataattaggcatatgttttattttacatgtcttaatcaatattgcaaatatcattaacaaaaggaaaaaagggtagaaatcgctcatcatacaccaaaaaattcattgttcaaaagagattaatctgaatctcaacattctttgtgctcatttaataatattattaaaacatcaattcaaaaggacaaataagtcaaaactaagtattttattaactaaaattgagaccctaaatcaactacacaactgaaaaataacctaccatcaacctagaaaagttttatttgctgacatataatgaatactcaagagcctactacagggtgcatagacaaattttcttttacaaacaagttattttgagttatagagactctgtagatgactagatcattgtttttaaatggctgctaaaaatgactatttagagtcaacctattcacagaattgaacactaaataacattagtttagttcagttcagtcgccagtgatcatttaaagttgaaattcttgtctaccaaattttcataacactttttaagcacgtaaattaacttaaaagatctgttaattatatacagcaaaagagctttggtaccaataaattaggagtaggaaataaaaaataccttgtagttttacagtgtgttttagaaattaaattggaaatggctacatatgaaaatgtagaagtctttttctattaactacattattgtgaagaatgaaccactcgcttattctgaattactgatataaataaaacacgagcctaaaatttcttccaaaaagatgaatgggtcacaccctgcaatttaggcaaaaggtaaataaagaattcagtgctttacttttcaatgctccctttttcttttgatgagagcagaaagattctaggataaaaataattccaataaatacatctagaatatatcaatcttagcactcccatctgataaggggctaagaagaacaaccacctgccaatg

SEQ ID NO: 45790 - DNA, 1048 bp, Bovine  19866881859256
gcattatcattaagagtgaaatttgagagacactatctttaggtgcctgctataaaagactattacagaaacaaggaacataaaaactgaccttttagattcaattacatattggacattattgtatatatcctagaaattataaataaaaaaagtaagaatttaattcagtcatctgtcttatgtccccacttataatagatctatttcttgtttaaaaatagaaatgaaattagatgtgccatgaattgataactgtcaaaactggacagtaagtatattattctactttcacattctggacaatttccataataaaaaatttaacaatacaactgtgtatgtgtgtgtataaaatatttataaaagctaaaaaatctttaagtttttctttgaaaattattcccgtatgtattgtatcattttcctttcatgttacctcagattctatatattccaaaataagctactctcacagtacccttctacatatcatgacacctattaaaaaatattccccacaatggggcaagtaaatactcttacccaagctgcaaaaacttaattcttaagtttctgcatcctgatcttactcctttaattttttgctcattcattacaaaatttcataattaaaaagtgaaaacgaccagtttcaactgcatatatgtgtaaaaacataaagaaaaagaggagtctcacatacttttgggttagtattgcaaaagaccaccaataagttgtaactggccatttctcttaaaacctgtcaaccaatacaattcagctcacacggtaagagaacgctgcacccaaaatgaagttaacatatctgtcagacaaaagaaatcggtatatttaacccccaaatcaggattctatcaagatatgagtaacactgtataattactctacatacatcaacctaattgctcaaatgatgtcctttaacctggggccatattccacagacttacaagcataaactacttttcacctcaagcagatttttttacctttaataaaactacctggggctcaatagcat

SEQ ID NO: 45791 - DNA, 829 bp, Bovine  19866881913248
attgtctaatctgatgtcatctgtgtaaaaatctcagttcatggaaagacagcaagaacagtcataaaatatcattttctctggatcattcctttccactcaataaggccccctcatttgaagggccccttgccctcttgcctgatggctagtgtttcccaaatctggaaactctcactagaacactagtacttgtgggcagactgagccagaagaatcacaaccttctcaacaacaccttgacaagccttaatttgggggaggagatagagctccgggtatcattgacaaagataaagtactagctctgcagggggcagagtttgtgggttggtagttcccgtctatgagtagtcatttcagtgaaaagatagttttgatttattagaaagaaaagtgactggcaaagtttaccaataatgtattagcataaaataacaatcctcaatttgtaagtgatgtatctggaaagtgacagatgattaatcctgacttggtcagcaatacttgagtaatcaaaagttgggagatattctgaaatacccactcatggatggtaggcaatttaaacatctttcaatgttcttggagtatgttcactcagacttgtgcatctgtcaaactggttggcaacacgccaaagtcagaatggaatgataccaataaagcactgggaactaagatggtttggttttggtttttttatagtgcatagataccaatttggtattgtgcaaccagtaagagatgaaagaaaagagaattttatcagccaaaggaaagagaatttcatcagctcttgcaaattgtggtaccaagaatgatgctg

SEQ ID NO: 45792 - DNA, 772 bp, Bovine  19866881914920
aatgagggatgatttatgttgatgggtaagttcactgcacatctcattaaaaagaaaaaacaaaaaactcagaaatgtgcagttcaagctgttgctatttttgttgtacatagaatttgaattttctttagtccccaaatgaaattttaggttttacttagtttttttattctaattttctgttactcaaatagaaatcaaggaaggttactcttcaggaaaaaggcctggtttagttatattgtcactggatgtgaattggagttgagtttagagttcttcctaacatacagacatctcagaaaaatatacccacatctgaatgaaatgggaaccatttacattccacactttgtggaattgaggggattgagctattagacttaactgctctatgttgatacctcagattgctctggttttgtaagctgtcctctctgtgaacttgtttgtgtgtatgggatattttctgattgcacttccttaaactttgaatgtatcagagagggactcattcagaatactgtgcttctctttgttaatgcttaatcacttaaagtaaacgcttaataatcgcttaaaataaacacagtagaggccaactgtgtttactgaaacgtgtgaaactgaaagtgagccctgttggacaaagtcagtgaaactctcctacagagttcttgctgatgaggacttttaagggttgatcttaagattttccaagtggaaggatagcctctgcaatggtagatggggccttccagcttcttttctg

SEQ ID NO: 45793 - DNA, 1831 bp, Bovine  19866880487801
ttcagggaaatttcaagatccttttgctattccttgagttaccctagtccccctccctgtcagacacctttcccccggccttctctaggcaggagtaatgaggaaagagaagccaagggcttattccttccttctccaaattcttcactgctgatgttgcccattacttgaggaaggagggaagtgagcagaaccaggtcctccaaaaggtctctgggccttttaacccagtcaaccaatttgacatagtgagagactctcatggtttcctactggaagctgggtcaggatacctagaactgacctgggggcttggcttcactgggaatggagcatcttgggagcagctctgcctgagaggggagaacggaggggaaagagagggccaaggaaggttctgtcccaagagcttttggggcagcctggaatgtagatgtgtcctggtgctgcaggcccacgctctagaaggaaacctggagttggaactggtgcggacggcatgcatgtgcaagggggtgatctgctgccggatgacacccctccagaaagcccaggtggtagaactggtgaagaagtacaagaaggcggtgacactggccatcggggacggggccaatgacgtcagcatgatcaaaggcatgtgaggggtcgggggcagtagtgcctagccgtgggctcgccctttccttcttccatgggcaaaactgatgtgtgtggctctgtgctgctggttcattctcctgcatatgtcctgtatgtattgtgcatttatactgttgcaacttcatccatgttcctcggcacctgagtacccacttatttatacatcattacatacagtcatgcacacacattcagattcatgcatgtaacactcatgtactcagatacccatggctccaacaagaacacaagcacatgctcagagaacaagctgtgcaaccacaacacccatcttgttgagatggcatcaaagcccacagaaaggaccctggggccggagtcatggttggttcctttcttgaaggctgtagagttgaacaatgttaggcagacaacagggctgcccaaccagggaattagctatgcagcctgatgcagggatcttttcctctctgaggcgttattcccaagagctttccctgactcccctggctggagaagaatagcaaacttactgatgcttcagagtaatagaagcaaatggctgaaactggtgttaatttcagctgaacgctgttagcctccagcagcttatagttctgtgagctatgatcacatctaggggtcctctagcccaacctctctcccatactgaagacactagcatatatgccagcctcagtttcaacactaggaagcgttcttgctctctttctccagtttctggaacttatttgacttttagggcctcagaggttttagttattctgttaagcagtgtaatcggtatgtaccagaagatcaaagaatttaatctatactaccacaggccaattaaaacttttagaaatttaagtcttatcttccatcaagcataaaagtgaaagtgttagttgctcgacatgtctgactctatgcgaccccatgacctgtagtccgctaggctcctctgtccatggaattctccaagcaagactactggagtgcatagccattcccttctccagggaatcttcctgacccagggattgaacccgaggtctcccttgctttatccagaaaaagacaccttaagcttcctgaagaactcatttcttactaacaaagtatgtacatcactgttctcccaacagttggagttagctccttagataaacttagataaata

SEQ ID NO: 45794 - DNA, 1471 bp, Bovine  19866880541307
ggggaaactgaggtatgggactgtgtgaatagctcattactctttcacatgaggcgcccacaaaactagggagctgggctcctttaagcaaagtagatgccagccgccccctccaggaaggaatggatgaagcgaaaggggttcaagaagagatgtcacggatagcttcgtggaccacctgaacagggcgagttgggctgctttcccgctcccatttccccagcgccatctctctgaaagcagagagcgactgttgcaagccacgggctgggatgtcgggacagaagaccaaagaggggccctaggagccccgggtcccggaacgggctgacccaacaactgagggcggtgtctggaagtccgggctctgggaggcggggtctgaggccaccacagtgccgggaagctgaagaagaatgcgagagctgggactccggctcgtaggctcggggaggtctgagtggccgaccccgatcccgctttctaggagtcagcactcacctctggagggtctcactacaaggcatccgctcggttccggcctcgagtcgggaattcccgccccctccccttcgtttccccctcccctcgcgtccaccgcgtaccgggcccccagtgaccaatgacagcgcctagagggcgggaccagactgggagtgacgtgagctaggagcaatcagaggtcggcagccggagtccggcggaggcgtggacgatctgggggagtgcggagctgcgggtggggggccgagcaagggaaaggaattctcagagcatctagatttgagagcctgggtctctgtgatggtcagacccgcggacctgactggtgtacaaaggcttcgatcctttgaagattctaaaagagaaagctagatgcttctccgatgctccatagcccacccccgcgatctcaagtcttccacctcccacatctctaggatatctgcctggtcttgggccaaagtcttcttatctctatcagaagattccaagatccccttctgggcaccagggcgccaaagggaaagcgttccattcctaagactgacttccttggttgatttcacttgctagcacccacaaggaagaagaaaagacaagaattgaaagggggggctagcaaagtgagagtatttattttatttatttatttttttcctgcaaaactttattttatttcttttttctaattttattttatttttaaactttacataattgtgagtatttcttttatcactggtgggagctgacttgtgtgcagccttctgcctgttcaggtgggtaaagtggtgggacccctctcaggggttgctgaaaccccacttggtgaggagcttctctccgcacaccccagcttatcctcaccatgcctcaggacagctggccaggattctctccaatcttacttggatgtctctatcttctctccctccagctgcatcagcctcttttctgttttctgttc

SEQ ID NO: 45795 - DNA, 748 bp, Bovine  19866880543754
ttggggcacagcagtgggttttgtggttaacctttctttggactccagctgtaagaaacattgatgccatgttcaaatatttcagaagacccaggaaataagaaatttgacctacttttctaaatgaaatcccagattgagcaaagagctgaaccaatttgaaagcttgaacaaaagcggactaagctaagtccaggggcctagaacaaatgctttttggttctctgcataacaaggagatatgcctttcatctcaggcggcagacaaacagagctgtaggatgattcaaaagaaaccatgagagtggtatatctctgagggtaggttggggacaaaaacaggttccccagagaggcagacatctgatcccgtacgtgtctggagagtgtgagactgcgctgtgagcagccttggctttctttcggaacacccttgaggtggccgagtctaccaccattgctttagggtaaaggctctttggttgctaacaagactataatggtgattttagctcatcattttttgtacagatttgatcttaattcattgctaaaggatagtgggcttcccttgagctagtttcttatcacctgtggctacgtttgctctaatgagcttggagagagagagtcactggctgctttgtttccaaaaagttaggaataggctatacctgcaaagggacaggagtcccttggtctgccctccatctccttcacaagtcaacaaaccccttagcgtagcagg

SEQ ID NO: 45796 - DNA, 1114 bp, Bovine  19866880613955
tgctcttctgggcctggtgaggggataagggtacaaaggtgagtcagctgtggcactggcctctgggaagcccagggcttggtggggacacgatgacacctgtggtgagccagcccaagggcaaaactctcctcttggtgactccccagtctgaggccctcaatgcccacagataaaagggaaggatgccatgggaccgtggtgctagggcagctgagctggtcagcttggcgggtagggccagaggggccagagaggatggcttttatggccttggatgccaagatggcagggagccaagaaaagggttcagaagcgggtggctgtggtagagcccccagtgaccaccctcttggcccccttctcacccatcaggcttcctcaagtcccgagaacgttccagccacaagctgtactcccagctgctacacacacagatgttctcccagttcatcgaggaatgctcctttggctctgctcggcatgctgcccttgaattctttgactcttgtgtcgacaaggtattgggatcatcccttctttttgtgccctctgctctactctgagctctgtcaccccagatgtaaacactgtctcacacatggtgaggctggcgcccctgtgcagcgcatgtgactggcctcatagacacagtcttcctgcccctctgccccttcctcgtcccctggctgtgtctccggggccctgacagagtctgggcccatcacctccttccctgtggctgtgctttcccggaagatgttatcttctggatccctggctctgctctgtgcccactgtctggatgtcccctttcttaccatcctgcttcaggtccacccagagcaggagaaacctgagcccgtgcccctggtggagctggaggagctgtcaggcagtgagctcaccgtgtttatcatgcctcccgaggagccgccagcgccagagggcagtgaatccactccccagtactggtgagcgcctcccgccccctctcttgctctgaggccggatcagctgacttagtaccaactgcactccatatggcctctctccgcccctccagttacgatgggttccccgagctacgggctgagctgttcgaggctcctca

SEQ ID NO: 45797 - DNA, 1191 bp, Bovine  19866880669150
cagcaagggcgagggcactcctcatacttactgccgaattgccccgcaacctcaaccccggcatggtgagtggggccctgggccaggagccgagattcatgccatctccctgtaagaggtggacactgggcacacagggcatcctaggaccaaggcctctagtggtgggggtgggcccagaggtgtgacactggtcttgggggactgggattaataggagttctaaagacaaagaccacttaggggtggtggagaaaataaccccccagaaacctttgtcagctgtgtgtctgcttgtctcttgccgttttggggcagtggggcccagcagtgtacctgtgctacaaggtgggcctggccaaggccaacacactggtgtatgaggcaggtgagtagcccctctgtctctggcccctcgacactctgtgtccctctgccctggtgcctctcggcgggtaccttcagtgtccacagaactcacctcccctttgccacatggcccttctctgggatcccctggttctttcccccggagtctgatggaccctactccttttggggaccccccccctctgtcgggggtgcagagctgctgggccgctacccagaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgggtgtgtggagtgtggtcaggggtctgggctctgcggagcccgcctgactgcccctctgcccctgccaggtgtacggtgctgccctgcagttctacgaggcgttcccgagggccaggctgtcggagcggcaggctcgggccctgggcctgctgagtgctgtggagcggggccgggcactggggggccgggctgtgcgcagccgccgcgccatcgctgtgctgtcccgctggcctgccttcccggccttccgcgccttcctcaccttcctctaccgctactccgtctccggcccccaccgtctgcccctggaagcgtgagcatggggcttccctgatgctgggaagggttacgaggccaggaggaatggaggagaagacgatggagctgggggggtggggggcgcagaggagtcagggacggggctgtagtg

SEQ ID NO: 45798 - DNA, 1325 bp, Bovine  19866880689507
cgatggacgtgagtctgggtgaactccgggagttggtgatggacagggaggcctggcctgctgcgattcatggggtcacaaagagtcggacacgactgagtcgactgaactgaactgaatgacttatttggggtttccccagtggctcaatggtaaagagtctgcctgccaagcaggagatgtgagtttgatccctgtgtcaggaagatcccctggaggaagaaatgacaacccactcccattttcttgcctgggaaatcccatggacagaggagcctggcgagctacagtccacagggttgcaaagagtcagaacacaactgagcaactaaaccaccaccacaatcacttacgtagttcacagtatttccctgggaaacactaatctttcccttgtacccaattggatagtctgagacatttagcactgaaaatcaagtaatcatatttgaggaaactgtttcatcgcattctcctggcattatgtagtactattctgctctcatcgtattagaagaaacagaaagggcaaaatcagataatctgagtgctcttcatctcttcttccttttaaaaagtgttttaagctatatatattgttttagttttcaaagtcatagctacggtattttttaattaactggaaatatttggttaatgaatttttcttttctaagaaacccttcaagcagggatcttaatacagttgtcttggattatgaaaagcaatgaagcattaaatatctagtctgatgacatttttttctcaaatttatggatgtacaaatagaatatagaaagatcttttaaactgtagttaatattttagtcagtactaggaattgctttcttgatctgaaaattttctcatccactctcaggcttagaagctgtttagtttttatgatcccacctactttcctttttgtttcagattatcccctttatttgccctacttgttggagtagagaatccagttcttgtttgagtggggtttttgcttggggataggcaattgtcttgctattaggagccattctgtttcatacctaatctcatgcagatgtctttagtgctacgtagagatttttcttgttagaggagtttttgaagagccattcttaactgtgtcaaaggtatgaaagtctcagtgaaagatatatatgaccctaatgccagatgtgattatcaatcttagaaagctttataggtttaaaaaaaaaaaaagaatgagtaattggagctgtgtggccaaaggaaggatttgaatactgtgttcttgcctggagagtcccagggacgggggagcctggtgggctgctgt

SEQ ID NO: 45799 - DNA, 2652 bp, Bovine  19866880718531
tttccagccaaaagccagaatgactcttaaaacacaaatttaagctcttcttggctcaacaccatcttgtctcccagagtaaaagctgaagacctaacaaagaccctagtctccacgaagtcaggccctgatcttgaggtatcacctcctcctctctcttgctcatctgctctgccttcctcacttccacacgtgttcaccgcatggcctttgcacctactgcttgctctgcctggatgctcttcccctgacctcccccttggacagccctttcatatatccaggcctctgctcaaatgtccccccctcacccccctgcccagggaggcctttcccaatcactcaatttgacagaaccctctactgtcacactcccctttctatgctttgttttccatcattgcctttgtcagtgctgacatcttattagatatgtatttgtttgtctgtctcccttgattggactgtaagatccaggaagccaggagtctttctgtcatccaattatctgtatccctgaggcttagaacaaagcctggcatgtgacagacactcagtaaatatttgttgaatgaaggaaggaacaaatacaaaagatgatgaagtattagtgaaagagtaagccaagcgtacacgaaatgcctgtctctgccaagagacgtgggacatgctgggagacaccggcccttgtggtcagtgctaaggcaaagcctgcatctactagacacttggagtgatgactggcatcccatctttatcagcagtgggtaccatttagggtggaagagcctgaatccaaagtccatgagactgtaagtgtctgcattttcagcagaagggaatggtgatttggcttagactactctctgtctagcccagggtctgtctctggcagccaggggaaggagctttctctggaaggagatggttgtttgtgaagctagtttgttttcacattcattcaatgaaatatttagatgggcctgctttgtgcaaggcaccacatgaggagttggaatgttaaaagtgaaaaagacacacatggtccctgctttcagggagtttaggctggaggtggagctgggggagtaagcaaggcgggccagcgtggagcaggatcacttctcaaagggagtgcttctcatctcatgtgagattcaaaggccaagcagggggactggccagccaaggggaaagggtgcagcaagggtggatgagcattctgggggcgaagagaacgcgggtacaggagagggaatatgcgtgagaaagatggactgaaattcagatggctggggcttgcgtaccaactggggagacaggtgagaagtgatgatccggtggggacagctgcacccagacacttgatttaaagcatccgcgcctccaggagctgctgtcaaggaggtcccctgaggctctgcttcttgcactcccccgtgcctcgtggggccggctgagtgccactagaaaagctgctctgaaagtgagtgggagtctgtggctggccgcaggcactcagaagctctgagctggaggtgtatctcttgccaagtggtggcatcctggggtctgtcagactgtgctgggggagaccttctagagttggctttggccagaacactgacaagtttgccaggcagagctgtttcctcctccaggggtgaggttcttttgaggttttggcagcacctgctgagtggtttatttttttttttcccccttctttcctctgctcctcttcctcctcttcttcctctcccttttactttttttttttttctagtgcaagattctacttcggtaccactgcccgcattcctggtggctggaggaagcctggcctttgggaccctcctctgcatcggcatcatcctgaggtgagaagggccccggggtggccccgcggcattctcaggcttcacatctagctttgccagtgctaggatggtggccatgggttggagagccagatatatttgagaggtagaatggaaagatctgatgacagcttagatgggaaggatgaaggagaggaaggaatcaagtctgacccttaagtttctggcttaagcagaacaaccaagtagaaaaacaatgcttacatcttggtaccactggggaaaccccaagtgggcaagtttgggaggccattcagatcattgccaccaggcagatggtagttggggccatgggagaagatggggccaaaaatgtcatctgtggagtacaactgtaatattgtgaagaggaggagcagagaaagggactgaaaaggagcagcctgagagggagcagaagaagcaggaaagcctggttgtgaaagtgtgtgttagacactgaagaaacaccttatgctctgagattgcaacatgaaacatacccttcctctcctaagagccacagactaaaatgagtaaagtaccacttgaggagcactgcagcagaagtgcacgggtaactctgaagtgcctggctagactacctccttggggatattctgtgttttaaaataagcagacgtagtgggtcatttttaaatgtcctatcctggtgcccccctccagtcttggtgaggggcttggttggcactctggtcactgccgtgccatgcctaatcatcccagtctgtctccacttaatcactggtgt

SEQ ID NO: 45800 - DNA, 1255 bp, Bovine  19866880752934
ttccttcttctaacctcttcactagggagctccttctcattctttttaaaatataacttaaaaaaatatttatttggctgcaccgggtcttagttgccacacgtgggatctccaatcttcactgtgacccgtgcaggagctttttttttttttagttgcagcatgtggagtcttcagtcgtggaatgcgaactgttagttacagcatgtgggatctagttccctgaccagggatagaacccaggcccctggtattgggagcacagagtcttcactggatcgccaaagaactccttctttctcattctcgaaagcccagatcaagcatctctcttttccacacatcttagctggcctcttcccaaccccaggcagcgttaggtgcatcccttgggaatctcccagtccatgtgccctatgccatcacagaaccagttctcaaatagcatctgggaaggatggtcagaaggtctggcatgctagccccaatttcaggggaggtggagagaggcagggtggccatctccgtcgacaaccataataccagacatcagatcttgcagcctcattgtgtaccaggccctatgctgtatgttttacaggcacgatctcactcagatcatgcctgagtctttgttagggctctgggataggtattactattccgattacacagaaagggaaattgaggctaaaagagattaactaatttgttgaaggccaaacagttaataggggcttcctgggtgattcagtgggtaaagaatctgcctgcaatgtaggagacacaggagatgtgggttcactctctgggtggggaagatcccctggaggagagcatggcaacccactcagtattcttgcctggaaatcccccggcaagaggaccgaggagcccagcaggctacagtccatagggtctgcaaagagttggatacaacctaagcaactgagcatgcacgcatacagttaataaagagcatgcatacataggctctagagccaggaagacaggttccaaaggctgtaatcttaaccactatatcctggttctgggctatgtgaggggggccagccccaggtacttgcccactcagaccaggctggagggtatttctgggtctctacctgccttagcagattggggagttagaaggtttctgaatatctgctaagtctggggtaagaagaatcgttttctcaacaggaagtttctgataagtttccatttcgttttgacacatgaatcgatcctg

SEQ ID NO: 45801 - DNA, 1549 bp, Bovine  19866880892771
gcagcagagagccggcagtacttccagcacggtgttgtagccccatgcatcctgagagacgcctgccactccagaaacagtccctgtgctccagaatcataaaatgcctggtgtctacaaagcaacttactgtttacaaggtggtttcataccttgttctcaaccattctcaagacagccccaggcctttcacccaactttatagataccacaggtgaaggctcagaggggtgagtggctcgggccaggatccaaagccaaggcctctgactcactgcccacaagtcctcagcccgctcttcggtgggaaacagagtaaaaatgtgagaagtgcccatttacacagacccaaatgccaagataataatgcaaggtgtctcaaaggtgcgtgagtgcatgctaagtcacttcagtcatgtccgattctttgcaactctatggactatatagcccaccaggctcctcagtccatgggattctccaggcaagaatactggagtgagtccccatttcctcctccaggtcccaaaggtgggatataattaatcaccacgtgcaacctccagtagagaggggggagacatcactgtccaagaaagcaagctttcggagacagagggaggggtacctgagatctccagcattagagggcaagggatccaatatggggcagccacggaatcagtggagggcttggatttgagcccagcgttcccagatgcccaagtttgtgttctcaatcccctttgcaggctgagatggaaagagagcagctctccctggtgtctgccaatctacccttcatctatgtgatacagttagtccccacttagtgctgggaacccaagggagaacccatgcaggagctcattctttctttctttcatgacgatttcaacctcttctcatttcttgagcatctcctaggtgtccaacagtgtggtagacactacaggatatttacagagatcctctgcctaccagaagcttccaaactggcttatatacagaacccaactttctatactatgtaggaccatccagctgcagggaaagatgtccattttgctcttcctagacgatggtctaattataagccatgtttcatttagcctcttgtatgttctacacttaatgaagagcagcctggaatcatttactcggcacacacgcacagaaatgtctcgaggagtactatgctgctccaattaagggcccaggacaaaacagaacacggtttcagcccttgggaaggttccgatctttgaaagcactattgggtgcctgaaacaccatccgaaccacaagacctagcggggctgaagagcaggtggtgaattcagggacactcagactttgaggataaggccacttccccttcagaaatcaactgggaacagatcataatgctttcgagccagaaatgaccatcactttcttctcaaaggggtctgaagacatctggggagcatcacgcctccccagggaaaggatttgggaccagcctgcgtatttcaaactctaattaatttcttttggcagaaatgaa

SEQ ID NO: 45802 - DNA, 3450 bp, Bovine  19866880895067
tttactgaggcttgctcctcagattttggtgtccacagagtttactggaaccaatccccctgtggatatcaagggatacctgtactctcaaaatgtgagggattattaatccttgtgaggcactgagagacagtatgtatgggggcccatggggatatagtccaggctgaagaccaagagcctctgctagacagggctccagtgcaggggtctgtcagtcagcagggtgggcagtacagcccagaagattcctttgctgtcccataggaggacacccttgttcctgctcccatctgacccctggaaccacagctctgtaagtgtagcctccctcctttcagactcaagcagataacagtaccctatcctgccacatcctcactcagcatcctgttcattccttacaagtcacaagtctcagttacgtattcatctttacttggaaccctgaatattcattggaaggactgaagctgaagctccaatacttgggccacctgatgccaagagccaactcattagaaaagacccttatgctgggaaagattgagggcaaaaggagaagggggcggcagaggataagatggttagatagcatcaccaacttaatggacaggaatctgagcaaactccaagagacagtgaaggacaggggagcctagaatgctgtagtgcacggggtcgcaaaaagttggatgcaacttagctattgaacaacagcttggtttttatctatctctttcccacctctccacccaccgcccagagcagtgtttcttgatctgtctgcaagaatcacttggaaagcttatttaaaagacccacattctggcccaccctagaccaagtaaatctgaaactctaggcatgaggctctggcattgggaattttcttaagtttccttgggtgatcccaaaatgtaacccgaattgtgacccaaaaagggatgggggggtcatagctgccttgtttgctgtggaatctctggtgccagcccagctcttagcactataggtgttgggtaaattcttgtgtagtgaatgaataattcctgttggctgtgtgaccctggatgattagactcctccatcttgggtttgatttcctcctctgaggaataggtgaataggttggatgagccctgaagtgccttccactctgaagatcccttattctgtgccctgtttttttaaaatttattatttattcttggctgtgctgggtcgtcacacaggcttttccctagttgcagcacgtgagggctactctcattgtggcgggcaggcttattgtggtggcttctcttgtttcagggcacaggctctgggcacactggctgcagttagttgtggcacgtgggttttgtggctctgcagcgtgtggaaatcttcccaggcgagggatcgaacccgtgtcccctgcattggcaggcagactcttcaccactggaccaccagggaagtccttctgtgctctattcagagcccttgttctatgcagacctcgtgtgtggtctcgaggcatgtgagctccctggggacaggactcatgcctggctcatctcaactttctccaagggccaggatggtcctggtacagtcaatagaattttactgaataaagaggtgtgtgagtgaatgactatgtcacgtgaagaaaaggacaggtggacagtggcccttgttaaccacccagaaaggaaactcatgtaggaaactcattgctaagcctgtgactaatggagtacctgacgagttatcctatgccatgagaaggacacccttcctattcccagggggtggtccaatctggaataaagggtcccaggtgatctccaagccttagaaagtactggagcagtgctggcccagagaggggaaggtgactctggcacaggactgtcctcccctctcgttaggtctcagtcacccagatctagttctaaagtagtctgatggtcgccctgataagttctggaagagttctgatgtgacatggacaggatctggcatggggtgccacggggccctgtggggagtgggggaaagtctgctctgagctgtcacagagcagaagactcagctctgtgacaaacactcttccttcctgaccttgcccaggtttctcctgagtggggaaggaatgccacgttctccaaactgctgagtcttactgcctccttagcctccgacagtgattccactcctttggggtttggccagcctgaaaacggaatgctttggtgccaggacctggggtcatctgcaagtgctgctcttacaccagatactatcctgaacaaagctggctccagacttgatcctctgccacttaactggttctaagagcctgtgggatttttcagccagttggtgtaattccaagagctatgggagggagattttatgtgacagagcaattccaaacttgccttcaaggagcttgtaattagaaaggagaaccaattcaattcaactcacctcaatccaataaaataattaggaagaaccaactagtacttgaaatttgctaagagaacaggtcttaagtgttctttaaaaaaaaaaaaaaaaggtaacaatgtgaggtagtagatgttaattaacttgactgtggtaatcatttcacaatgtatacctatatcaaatcatctcattgtacactttaaatatatacaattttatttgtcagttatacctcaatccttttaagattctttttagaatcaactaggtgagaaaactgtggtgatataaatatgaatcagacatattcccatgaatcagctcatgatctcagttaactccagcatacaagagacacgataagggactgtcatggaaagcttcttgggcaagacagggatttagtagtgcttcgaaggcctgtatcagacaaacctggtgttgtgctaacacaataccactgattcctcccattcctttcatctgcttcttcgtgtgtgactttgctttgctttccagcaagaagtacagtccgtttctcaagcccttgaatctgaagctggccatttgccttcctttggccagcggggtcttagagaatacgacacagaatgtgacctttgaaggaggtcagtgcagcagggcttgctgtaatactgggccccacatttcctgtcactccaacctatgccaacacagctgccagacgtaagagtgaggctttcctcgacaagctgcatgacagaagctcaccccaggtgagaccagcagaagaactaccatgctgagccctgccccgactgctgacccacaccaaagtgaactacatgattattaagtcattaatatggggtgtgctttgtcatgcaacaaaaccaatacataaacaaatctaactcacgccttcacttaacacacatgttacacgttggggtgatgtgcctgccatgtctaacatttccctttcagcttctcaggccacag

SEQ ID NO: 45803 - DNA, 855 bp, Bovine  19866880906026
ccgcagggctgtgctcccacttgagatccacggcggccaggggcgcggcggtgtcggagcagacgcccagcgcgctctcactgctgcccagcaccgtgcggactgtccaacccggcagcaggtccggcctcgccttcacccgggccagggccagctccaccgccggtcccacgcgcgcccaagaccacgggtacgaggtgttggtcagaggcagcaccacggccaccgtcaggttaccagcgtagctgcccgggagcagtagcaacggcggcaggagcagaagcaggcgcaggcgggcgccggaggggcgcccggggcgcggcatggcctcagcgggcaccatggtgggcgagcgctcccaccatggcctcaagcgtccactccggctgagcggccggtacgggcaccgggagcgcccctgtgggagggaggaggggcggagcgggggcgctcaccccggagcacgctccccctctagctgcgacagtccgcgcctggagcgccaggggcgcgcgacctaggggtgtgcccagggctctgcggagcaggtgggtgcgaggagagcgcgggggccgagaggacccgagtgtgaaccacagggtgtctgtgtgtatgttaggagagagaaaaagagagcgcgagcgagcgctcggtggagaaggatgggagagagggctccagggaggataaggggagtgtgtttgtgtgtgtgcgtgagcgcttggctcagggagtgtgccagaaggggcgtccggccggcccaagtctccgacagtccgaggggaactggggaggacccaagccaagctccgaaccctccctcccggccgcttcccctcccagactccgagaccg

SEQ ID NO: 45804 - DNA, 1634 bp, Bovine  19866880914835
tggagttccccatgcaagggggcctcatgtccttcccctccgtggccccagtgtccgctgcaaaatgagaggctctgagatccaatttggacattcgaaggtcctgattcttagagggtgaggcctgagaccaggggcctgtgttggacacgggggcctcctggacaggcatgtacctcagttctgagaagtgatggaagtgtttatgccatgccatgccctctctgtgctgggcccttgcctctccagcttgctctgtcctggtttgcccatcacacagccccacacattgccggctccagggccgcgcagagcaattcttcgcatggctgcttgggctggcccataaggtagggggcaggggcagggtcccccagcttagcacgagcccagctccacatgcactggtatagcctggccagaggagcagccctcgtgggaaagattcgtggccagaaagaaattcagctgccttagaaagaaatgaatgttggggccagggttgggaggcagaagtttgatttaacctggaaaagtttgatttaaccttcagcatgacgggagtaacagagaggttgggtgagcgtgctggtcaaaggctgagctgagacttcctcaccaacccccatctctttgctccacttcacaggttgtttagggatgtagaggccctttcctctgtctgtcctgctgtttcctctacagctggggccaaaggagccttctgctgtcttttgttggtggtggtgggtgattttgttaaaaactgctgtattttgaagttagtcaccacgtacttttctcttcttccttcactgccaccctgacaggccatcctaacaaccgaggatgcaggaaagaaaaccgtgacacccatgcctgggacctctgagggtaaaaagggcccatcaagggatctgtgacacaaattcaaggtgaatcagtgtagtcatatgacttgggtaaggggtctcctggctgccctgcatttaggttctgcctgtgccatcttccctgccacaaggagcaagcactgggctactcagccggctgtgaagaggcaggtgcagctgcaggagagctcacggaggggaggcagcctgtgcaagatgcgctctcaccttgctggaccataatttaccctgcctcctgccctgggatctcatacaactatgatgtggaatagaggagataatgggtataaaagggcttcataaactacaaaaggtcattcattcatgcattcaacaaacacacgctggaggccctctatctgctgggggctgggcattcaagatgcagtgaaacagctctgagcatggctcctgagatgaggccatggaggggaactattaacagaaggtactatggaagcaaggggctgaggggccaacctcagcccaggcagctgtaattggaaaggcatgatctctaaacgggagagaggaccagcccagcaccagctgagactccccctccttccccagggcagctgagctggggtttttccagacacaggtttccaccatcagttagggggacctagaggctgctcaaagggttccctctgctcctaactgccaccgacaggctgagctatggcaacgtgactgcctggccaaactcttcaaata

SEQ ID NO: 45805 - DNA, 1269 bp, Bovine  19866880948705
acggaggacacattagggacttgttctatttagaagtgctgctgcttttcctcctacctattttctaatatatttttaaaggtaatatgcattctttttgtaataaaacaataacaacataaaaatcactgtgccaggagcctccatgtctttaagaaagtaaacggcttctccatccttggccagagcagacacagccgatgtggaagctggtccctggagagtggtctttccattgtcatctggcagagcatctcatttttctcatcacagattccctgtgatgacctgttgtcttcccacctctcacctctccatctccccaaacagatgcagaatgtcatgtatgacttgatcacagaactcaatgatcggagcgaagacctggagaaacagatcggcagcctggagtctaagctggagcacctcaccgccagcttcaattccctgcccctgctcatcgccgacactttgcgccagcagcagcagcagctcctgtctgccctcatggaggcccggggcgtcagcgtggcagtgggcaccacccacaccccactctccgacagcccgatcggggtcagctccacctccttcccgaccccatacacaagttcaagcagttgctaaataaaactccccactccagaagcattacccataggtcttaagatgcaaatcaactctctcctggtcactttgccatcaaggaacatttcagaccagggatcgtaaagaagagacaccgagctaattaactaactcatgttcattcagcgtgcttggtttgatatgccttgaaaccagaaatctaatctctgtttaggtgcctctacttgggagcaggaagaggagatgacaggaagcgacgcctctggcagggcccttgctgcagagttggtggagaacagaaatccacgttcaatctcaggtcttcacgtggggaggggtggggggtcagatgcactgaagtagccaacagtgaagccagcctggaggtgggtcccgctgtggggagggtgtggtatcaggcttgggagatgggttcctcacccctggggtcctccagcccactgctttcctttccttttgtctaaggaagtccccagaggacaaaagtaagagagagctgtccacagcttgccaaaatagatgttctttcctcccatcccttacacagtcataaaatttagactgaaagaaaatttgatgaataaaaagccagactctccattcaatattaatactcatataaacccatgtatttgcaag

SEQ ID NO: 45806 - DNA, 1504 bp, Bovine  19866880950414
ggtttgaatggccttcactggggatcgtggatgggccagtggccaaggtcctcctttagagctgaacagatagattggggacccctgagatcctgaagcccctggatagcccctcagcctgcttggtccgaggacatgagctccttcagaaccttaggacttgactggaatgttctggatagtggcctcctctgccgagctcatgtccatttcttgccctgtgccaacaaccactcccctgacagatggctgcacacgagggagactggaaacggggaatgtgtccagaggacggtgccgggcctcccaacgacctgcctgcacctggatggctgaaagggaaggaggaaagaggggccagtgctgctcagttcgaataccacgagtccttgtcagactacccttcaaagacagaaagctgagaggatgacgcatcggcagccccctcggtgacgacggtgtcacctctcatcttatctagtgctgtgtattttttggagcgttgtcgggtatattgtcagacctcttgcctgcctgactttaccccttagacttttaggtttttacctcctccaggaagctttctggccgcccccactccctgggcaaggtgccccttctagaagttggctgtgttctgacctggacactgtttctcaccctgtgtctgctctggccacaggtccgtggtgggtggggactgactcggactctctgctctgtgccacagccaagagcagccagcacacggcagggattcgataactggaaccaaatgaatgaacaacgagcccaggggtcagacgggtagattgattctttcctcggtccatagaagaccaaacggagtctctttaagactgacagactggcctgaagccctggcttgtgcatcataaggggtccaggggtcttggcaggctgccctctgtgagctgggctggccaggcccactgtgaccctctgcatcgccctcttgtcccttcttgtcccctctcatcacaggccttggtcccagagcctcttcacactcagatctgcagctggccatggattgccatggttaccactccagccttggcagtctctgtgtgacattttggttttatttgctaaatatttgaacacttggctttaaccctttctgtcccagagagggctttcctgccatgttgcccttccttaggggtgggtggtctcctgctgccatctcggggccccccagagcccaagggcggcatgcctagggagcagcaaggctgtttctcagctgcctgtgttgactttctgttttggcagttggaaatgtcatcctgtgtcatgcttcttgacagggcgtctgttaacaggtgtgaaaaccattgccctgggcatgttcagacttgccccagcctcgagggccagtcccagacttccggagtcagctgcctgcagctccattgacttccaggcagtcacctcttgccaagtcctccagaagcttcctcagctccaggactccagg

SEQ ID NO: 45807 - DNA, 954 bp, Bovine  19866880963345
ccttttaaaagaaactgaaattccttctatctcctttcccggtctagccaataaagaagaagtgcaactttgtgtggcattgcctgataggctggatcttcctgagcaagaggtggacagctttatgccaggactagatttacagtcaatctgactgactgggttttctttttcttcttcttcccctctaaactgtatcagagaatgcctggctattgtgccttaatatataatggtgcagggctttaagtactgcaaagggtccagaagagaaagtccttgagttccagttatggctcaaatcatgatctctctagcaatcgttttacctgaccaaagctggtttgacttttctcagagaactaaagcattctgactgagttcagggactgcttgtcagttagagggttctaaggggttgcttgtcccaatgaggtggctaacaaagaatatgctccagtaaagaaaccaggacgccacagctgctattcccctaaatatgcacctccagcttgatgggtggaggaggtaaggaaggaacaatcagtaaaattgaaacaagaggcctgggttacataaaacatgtaaaataatgcttaaaacaagaatgaatccccccctcctaaaaaaaagatacaaaaagatttaaaaaaaaaaaaaaaaagggaacaatcccagcagttaggatactattattgacacattgactcttttttttcccacactgtggttctctaacaaaacccaacctggaggtctggccagtcccagccagaaaaagaaaaaagttgagtacagtttgggtgggggtggtgggggggcaataaggagagacatttatccaaatatggggagggggacagcacacaggctttgaatgtactttaagactgtgagattaacaacaaaattctcgcatttccctcccccaccaccctgtggtgttatgcttaa

SEQ ID NO: 45808 - DNA, 1291 bp, Bovine  19866880969072
tgaaaacaggagcaccattcttgggacataaaaaaggatacggatcttttagataatcgataggtaaaaataacaagtaaaaagaaaagccagcagtaagtgtggcatctatggtatacagaaccaccaaggaaaatgctcaaaggagttattgagataaaagtgaggccatcgagggaagagcaatagcaatacaaaaagataaaagaagaaatttaacaagagaccaggtcttcttgaaagagtggccttcctaggttgtctaccttttgctgtctgattattctcttgtccttagaagaccaggcccagagctgtacacagctagactctgctctcagaaaggtgatgctgtcctgggataccccacaggaccatcatccacaccacagatgacatccttcattttaccctaaacagatgaaatgttccctacagtatcatttaagtccccacaagcagaagtcagagaccttggaatgagaaatgtgatgactagttggatggttttcacatcacaagcattatgtatagttacatgatggtatgagaaaaatatcttgcatccggatgccctgtcctcacaatgcctgtcatacactggatctggatgtttctggagcctcttgaagttggagaagtattacaataatttttgcaccgagataaacgtggcacaataggaataggctactgacaaatctatgtcaccttatcttacccacagtgttccctaagggctccctttatcttcagaaccttccactttggtgtggttttaggtcacatagaagggaccacctgggtcactcatcctcacttctcctcccagctctcatgtgaggcccttgacacctttgtgctcttaacatcgggggctggaaaactgttactggataaacatcactgaacaaacccccagacaatacttctattcatgaaggtgtcctggagttgcacctattcacacatgtgtgtgcatgtgtgcacagatcctcttcccctgccctcatatccacacacctgatcatgcactcccgtggaacacagcttgtttggatacgagataaaaactctgcagaagctgttatttttagaaggctgcttatctctccagaatgccaattttggcttgtcattcgtctcaaagcaagcatggtgtgccctgttttgtatttgaagggacctgcgtcttcagtgaggctcagaatgtggcaacactggcaaacccactgaactgacagcacccacatccagattcagaccaactcaacgtgcatttagagagtgc

SEQ ID NO: 45809 - DNA, 2877 bp, Bovine  19866880971004
taatatcaactgcatttccaaccaatcaatctggtgccaagctcagggtttagcacaaatcactctggaaagcaggaatgattcattcccattatgcagctggggaaactgactcaaaatcttgaaaatcacacaaatggcccaaatttggactctgccttcaacaccttgagaacttcaagggcaggaaacataggctgggaggtacagaggtcctacatcagagcactggctcagaagagtgggagtaaggcccaccctggccagggccttgtgccttttgttccacagaggtcgatttagcctgtcatttttaaaaactggtttaattcactgcaagtatttttcaatatcaggacatttcacccccttcactgaacactggtaccttggcctggcctttgagtgtccacagctagccgcaatagttcctctattggggcctgtccctccccgaggccacagcgccactgggccctgcagtgggcatctgtgttggagactctgagcaatggccactggaaagaggctgatccagggttatctcagacttcctcgtgccctcaaacttccaagttcttcagagataagaacttatgtccctaccagtccacttggggcgacaagggcctaaaagaaaatgtcaatccatctttattgggggtggggggaactctgcactgcaactgccttaaataatgcaagccctgccccaccccagtgcctggtgagctcagacgatcatctccagctgccgggcatactcgatgacctgtttggccagctccgtggaagggatggtggtatcttccggcttctgctgctggctggcaaagctgtagtagttgttgaggcccaggacccaccctcgctgcaagaaaggagagatgggagatgggtggggtgatcacacacaccctccccagccccccgagccagcacttaacccatgtaggccctggctcactttcctcaccaaccctgggcaagtaatttcacttttctgtgcccccgtttctccatgtttgagatgggaccctaatcacacacctctctgggtctgttgtggggaatcatatgaatcaaatagtactgagaacaatggcccagagtaaacgatcattagatatcagctgtccccatcacccgagttgagcttcacctattccagtctgaccgtgaccctcgtcagtcaccagggctactccaccacaagcatcagcacctccagggaccctgatcccacacaaacaccccagagccaatgaaccaaagtcttgtggggaaaagctgcactctccaaggaattctgaggacagacaccatcaagcgctaagcctcccgctctggctggtgccaggtgctgggctcagcttatcccacacatgaaaccctagcccctttctacagatagggaaactgaagttcagagcagtttggccacttgcctgaggtcacacaactggagtcttgctccagtgtccctccagaccatccctccctgctgttagtgagtgcacctatggtcccttgacctccaccccagccaccttcttggcgtagtctgtcatctttttgggtgtgttgaagaagaggatccgggtggcctctgtgaagaggattttctcataggccttctcgatacaaccagcaatttcatccctgggggaagatgagtctcattattgtgcacagacaaggcctggtccttcaattcagcacttacaactgaagtatgttacctgccccatttatcccatcgaggctcaggggagagtagcttgactagagctgcaaagctagggccacagcagggcacacactcaggtctctgggactcctgggcccaggctcagattctcactcctagccacttcaggacttcaggcttggctgaaactgagcctcagattcacataaggcgatctcttcacctaacaccctccccacaggatccaatcccaagggggatctttgtacccactttaagaggtcaacactgaagttaaaaaacagcaagacatcaaggcactgaaatgggacaagggagtagctctgggcaaaaactagtgaaaaggaggagcttgcctgtttgggaggtattttattaatatctcttaggctaggtggtagggtatgtgggcactcattatattattccctgtgcattgcagagagtagaaatatttcagagttaaaaataacctaaacctactcaactgcccctcctcactccccgcacctctctgggcccagctttgtcactggaggaatgaaaacgccactcagtctggcgctttgcccgggtgaaccaactctgatactacctgaacacatggacttgtacacgtcacgcccatccacccatgcagtgccacctgtgtacacagcaacccccaaggagctagcgggatttggtggcccgcttctaaagaacggaaaactgaggttccacagtttaggtgacctgaggtgaagccagatgactcaaggagtacttccatgagaaaggcagccaggtctctgtctgagcactgagctgagcagtttgggcaccaagcccatgctcagggtcgaattccatgggcccatacacacacacggcccagagtgagaagagggctcttaccaccatctcatgaccagttccagttcacagaaaaggaaactcatgtgcccagcctccccagatcacaagtggcccgaatgggattcaaacacagagctatctgactctggagtccaagctctttctacactccgcagggccctggcccccacacacctgatagtgtcaagcaggatgtcgatgaagaaagtgtagctctcggcgggaatgttgcctttggccaggaataccttattgtagctgccctc

SEQ ID NO: 45810 - DNA, 1693 bp, Bovine  19866881002243
ggagaatttgagccgtggtgattttgcctccattctcttaaaaacaaagatgtcattttaccaggttcctgctgaacagagagactagaattatcagcattttcttggtcgtataatgcaatgaagtctccaaacagtaaaaattctaccatgccttccaatttcccaaaccctcagagagtctattatctttagctcagatttagaatcactgcagtcctactacatacagccccccttacaagcacagcagggacagccactgagacggttacgaggaagcatggccctcgtggagctcataacggagcaagacgtgtcctaatcgggaggaagccctgggaccctgtggtgctttccaaacacacatccccaggcagtggggttccctagcctgcagggtccagaacgtggcacaggggatctgacgcccatccctaatgtagagcagggatgaagagatcatcatctgaaaactaccgaccacagtacaaaagcagcatggtccagcggctaagactccacgctcccagtacagtgggcccagggttctgtccctggtgagggaactggatcccatgtgccacaactaaaggatcctgcatgctgcaactaagacccagcacagtcaaatacatacaaaaatattttgaaaagaacaatacaaaacggaatgaattaactgaaaaagtcatggacagtgcacatctgcactcacagggaaacagaatattctattaagttgaacatgtgctccccagtgactttgaagaagtgggagtttgtattcatggaaaggaggttggaactgagtgctgaggaagggaatttggtcactgactttaattatcctaaaagctttaagatgtctgaccagattatatttgtaagagacttaagaggagtcacctttaaacttaagtatgttggagccaaggaactgtccttttgattgtttgctatttcaagttcaaggctatactaaggggatagccagctccctttgcggacagaaaagggaggcagttaggagaagggacaggttgcttggacagtccccacacaagggcctcctgaatgcaaacttcatccgttcttgctatcaaaaatcattcagggacttccctggtggtccagtggctaagactctgggctcccaatgcaggggacccagactcaatccctagcaggggaaactagattctgcacaccacaattaagagcttgcgtgtggcagtgaagaccgaagacctcccattccacagctaagacctggtgcagccaaataaataaataaagataaacatttttttaaaaaacattcatacccactctgtctacatttttctctccttatcatgagcatccttccaacatggaatactggatacaatcagaggccccagagatcgtctgatctaatctgcctactttacaggtgacaaaactcaggtagagagagaagtggcctacccaagctcacactgtgatcagtaccccagacagaccaggcccctcgcaccgtgcaaagagggcagaggcttgttgggaggaagtgccttggatggggcaggcacttgggctacttttcccactccggtcactcattagctgtctgtgttgggacaatgatctcttgtatccctaattatagcagaagcttcttgagaagtatgcctggccctcctcgttt

SEQ ID NO: 45811 - DNA, 1276 bp, Bovine  19866881008692
ggcgggcacagacagagcctcggctccctagtcagggatcaccagttaagcacaatacgtaaggttccaggtaaggccaagcgctgagacggcaaggacactaagacgctgcagttttaagctgctgtgtttctctaactcaccttgaaagacttggctggcatgttgttactgagacgctgcctaaaccaattttcccatcacagcagacgggaccctcagaatcaattactaaaccaccgaaccgagcacactttgaaaaggggagacatcatgttaacacctggcaatgaagtgtgcggtttgctgggatctgggaaccaggatgacagtccggttccagctcccaagacaggtccttacccagagtgacggatttgagatacacaggctgcaggaagtgggtcaacagtgccccctgcaggcccagcacgttccagcgcaggatcttgtcgctgcaggacatggtgcggagtctctcccccagccgaatgccgtcccatgtgggcacaatgtcactggactccactgggatcgtgccttcccctggatgggagacttggattagacctgcaagggccgctgggccagggccctccctggcgtggcattttctgctccttagacttgggccagaggcttctcactcatctgttctttgaatatttcacagcagctactttgtgctgggcactaggcttggtgctgggaagcaacagtgggcaaaaccaaatcagatccttgcgttcctagcgggtttatgggagtgagggggcagaaagggaacagacactagacaagtaagccaatacacacgtaacgactgtagatggtttgagggagctataatggacaggtcagggcatctcctgggacaggattgtcagggggctgagacacgaaggaagagaagaaacagttgagagtgtttcagacacagagttcagcaaaagcaaaggctctgaggcagcagagggtttagctgttgaaggacctgacgaagaaccaggatggctgaagtggcagggcttggttttgtgtcgtgggaagccacgacaggctggtgggcttttcgttcttcgtgaactttaatgagatacaatccacccatttagagtatataataatttttagtgtattcacagacttgtgcagccatcaccacaatcaatgtgagaacatttcatcaccctccaaggaagcctcctatccattagcagtcacaccccatttccctccagccccttccaccgctggcccagccagcccctaattt

SEQ ID NO: 45812 - DNA, 2088 bp, Bovine  19866881054141
tattgaatctttctgaatcttagctgcctcctctgtcaatcagacacttctaacgcccaccacacaggatggtaggattcagtaaggtaacttggcaacttggcaactaggagacactcgacttgtgtgacaatcagctgcagaaggaactcacatgctgaacgatggctcattttaggaaacttcgaaaaactctcccaatgctaatgttttcatttggtggaaaaaactcatcatgctaaattaagtggaacgtttctgctaattatttagctaaaatgttcctgcaaatttagcagaagaacaataggtttaaactaatattgcctcatattcattgtcctatctttttcataaaacaatccttcggataaatctaagtgagaatttactcagaaatttacaaatctttagcttttaaaagttaaaagcaaagttttgggcaaagggaaatctggggagtctgggtcccacagttacttggccataggaaagtaataaatgcctcttaatttctatcccttcctctgtttcctgaggcagatcatgattttcattctttcttcacggcatctagcacatttctcaatgatgtcttttctgctgttaggtctgtttgccccttgggttgtaaggttcataaggacctgggacctgtgcatcttcatccttgggtgcctggagcccagcgtagggcctgggacatggcaaagaaatgcctgggaaatttttgttggctgttacaaaataccatcatgaacactgtgctatacatccaagacattgttgaaatcaggcatgttactcctgcttcacaggtattaaaaaggcagtatagaaattgggagctccacaattaaattatatttatcaagaaccctctctgtcttctgcagaaattctgaaataaacaattttgtttattcccctaagatttctcaagaaatatgagacatttctgaacttggactttgacaagccttacagggagcaaactgaataaaaaaggtaaaaggaaaaaaaaaagaaagaaaacccacccagtagcaaatcttttatttccagcttccggtaaactcacttcctgttattctgtccagctgtgtaacctatgtgtagaataagaggtatatcctctacattaattgagtaggtgttttgtgatattttaaatatcttttaaaattcaccaatataaaattttttaaaagagcaaagagaaaaaaattataattcttaagttagtaattaaattttttaataaatttgaatttattctctaattgaatgttttactgttgcattcctaaatacatttattcctgtaaactgtttaaagcaaagcctgggacttaatatgtgctccaatattaaatgctagctactactattattacatttatttcatattggacactgacttttatttttttaattttaaaattttattcattttttttctagaaaagcaacaagttactatacaaacttttgacttctaaatacaactttgtgagtctgagtggaaagaatgccttgttgctgttcttgctgtttagctgctaagtcgtggggactctttgtgaccccatggactgtagcctaccaggctcctctgtccatggatttcccaggcaagaatactggagtgggttgctatttatgtgtaaagtttaaagtgcttttgcatataccatttcgaatgtgtcctgaggtaccttggtgtagaaaccataccattcagtctggagtgggaagatctgggttctaatttatgttctgtctcttaaagagccttacgaacatcttatgagcttcagaaactctttgatcttattttctaccctgtaacaaggggtagtattagcgtcccctagttttcaggattttgtgaggattatatggggggaaattattcatttttaaaaagcaaagtagtttccctactatcagtgtggatccataagaaaacgaaacaaatccacccccccaaaatctcagataatataaacaacttatcccaattaaagagaaagagaggaataaaaaccaaaggacaaagaaaagtgaattaaagcaaaacattat

SEQ ID NO: 45813 - DNA, 3099 bp, Bovine  19866881171763
agttgtattttattcggtggacattctcaggacttcaaagacagcatctcacataaatctgagagattgctccaaagaagcaagaggaaaagcaggatatacaggcgtttttgtaacaaaagactgcgtcgtcagaacatcaaaagattactgttaaaagaaactagatacctcaagttaagggacgacgtaagagcctggcctcactgcaatcattgctttgctatatgcctcagctacctggggccagtatcctgtgctttctcatcctgagtctcctccgggagtaccagttgtggggtggctgcatctagctgactgttgtatggacttggcagtgggcaacccatttgtctccaacctgagttcccttagcgttcatcattcggttggcagggtgattcttgatggctgtaacatcctttgtttactgatatggcaggcgatatttcagttctccaggggaatttctggcagaaagtatagcttgaacaaaggtgtggaggtgagaaagcatacataacactgtagagacagaactatattcaagcttggagatgcagaaaatgaggctgagaagataaagataggcccgatctttattttattgttgctctcatcatacaaatcaggaaacagaggctctgagaggttaagtagcctgcccttagtcacacagtgagcaaatggcagaactgagatggggacttgatctgactccagaacacaggctccagctggtgaattagacagggcggcccactttgatgcagaatctaggtggggtctgacacacccattcttgggctttaacacagagggctttctgaaaccttctggtttcagtcccctttgattttttttcgggtctgccacaaagaggagggaagggggcaaccatagtgggaactgctccttgcaaccttattttaaatatcaggagagggacttccctggtggtccagtggctaagactctgcattctcaatgcagggggcctgggttcatccctggtcagggaactggatccccatgctgcaaccaagacttgacacaatcaaataaattttaaaagagaagtatttttttttttttttaataagtaaatatcaggagagagagcttgtggtaaaaaaatttagctttcaacatgcctttttcccttctgtgggtgtggccaaagcaagtcctcccaactagcttctatcaggtcagcgctgggtcagggcaagcctctggtccttccaggcacagctgatgggcagttcccaaagagaaacacagaggcccctgggtctgagggctgcatttcagaagctgtgtttcttcagtcccatccgtgggggcttccatcaggctgcacccattaccttatcccaggaacctggatcctggttcggatctgcctaaaggcctaatggaaaagcacattctaattagcagttgcccagccagagactcttcagcctagaccttatttcagcacttttcattccctccaaactcggctgtgaggccaccctgtcagcttcaggctccttggggaaacttggtgggctctttcaagaggtgtttgtggttgcttctgaaaagccgagtaccagtttctgtctgtcaaactgggagggcggacacgcacgttttgacacctctggcctggaccctgtgtcaggtgtatagatcttcacagccacagtgtcttcataactataccaacaattagttatataccgacaatacagacccttatatctgacagatgaggaaacagaaactcaagggaattgtagtcacagacacagtaggtggaggtctggacgggaacccaggtctcaatccccttccaaagcccaaaccttttccttgccggtactgcgggggacagacaggcacggggaaagaatgtacctttactgcagtgagtctcctgatgcctcagcccagatctattaaatcagaatctctgggtgtgggaatcagacacggatggttttaagggctcccaggtggttcagagggacagaaagggctgccaagcactgctttactgtaactgtaagaggcacatcgcctcctccagggctctccaggtgctcctttcacagagtaatcctggtccgaaaccaaaaatcaaaaccgagccagtggtgtctaattcccctgctctgatcaacagaagtagggggggagggtccccggccgagctcgcccccgcggggttcggagctcctgccctggaggttcaggtgcggcgctgcggcaggaagccaccccctccgctcggccggtgcgcggggctgttgcgccatcctcctcgactttcgtaacagcaccctgggacagccgagagacagctccagggcgagttcctcaaatgttttcctgccttgccgggaccgtccgcggttctgagtcatgtgcaagtgggaagtcgcactgacactgagcacggccagagggacccgagccgagagcggcgcagggctcggggactcgccgtgcgtgcggagcgcgggccccccggggatgggggctgccctccgggcgtgagcccgcccgccgccccgccccagccgtcggctcccggcccgcccgcccgcccgccctcctgtctctctgggaacatggggcattaggcgaggaggaagcatgctggccgtccgctgcgcgctgctgaccgccctcctcgccgcgtccgggacggcgctggtcttgaagggctgccccgcgctgggtaagggcttcgggcgcttccggagggctggggcagctggcgggtggaggaaccgaggttgctgcggtagacgctgggcggcggagggaggcagggggcagtgatggctccccatgtccggggctagctggcgtccccgcggcacaaggtgcggccccgggctccccaagctgtccccccgcgggcgctagctcgcgcgcccccttgctgcgtcctgccgcttcggcccggcgcgctctccccgtgacttctctgcctccggtaagctctctgcgatccgcgtacaggacgtggtgtattctcagaaacccgatcctcgggtctccttgccgtgccccccaagagtccttacacaactgcgtcct

SEQ ID NO: 45814 - DNA, 4675 bp, Bovine  19866881210890
ttattattgaggagggagagcctgagcgcagtgtccatagcaaccctcccgttttcacctttaccgggagaggaggaaggcaagggaaggcagggaggcagcgagatgcctgcccttttgcattattcatatcaaagtgctgggtgcagaggccttggctgttgactttgccctgcacaggtggtgtggggagaggggacttttccccatctagtcacagcgacttggagtggagcttgggtatggggtggagtcagtaagaaagccggcttcccaggtggcgctagtggtaaggaacctgctttaacaacgcaaaagacgcaggttcgagctctgtggttccttccagccctctcagtcagcgattttatgctggcttccttaggaagataatagtggtaatatattcttttccgatgatgaaacagctcgaggaacctgccaaataggagctacttcttcaaaacgttcacagaggtgaatcctggcactgaatgtagttcctgggtctccaaggaaggaggcagaaggttaagggcgtggttctgtttggggatctccctccaggcttcccaaggggcctggagtgcagtgctatgtgtacatgccaccagcagaggtctccacactcctcacaaacccgccactggtttccgtgccccaggtgggtgacgggtgagcataggctgtggcctcaatctcaaagccagagctgggctgggagccaccacgaccttcctgcttgagccaccactggtcaactggagtctggggaagggctgatgtcatcggttggctcaaaagcctggggcccaagtcactagccagcctctggggacctgttctccactctcgacccgaactataggagggccattcatccaaggctacagagtgcctggggccctgggctgccctggttcttggccttctctttggcagctcaggtgccagttctgggtttgggaaactgttagaggtaattttttttctcctctgaccttttgggactgagaccaggaaatggacttaatcagtaaatcttaattgagagcatgcactgtgctaggtacgggggattcagcagtggataaaatagacagaaattccacccgcaggaagctgaatgtctagtcggggacagcggggaggatgccatcacctacactgcagtgtggggctgggagtggacacatctacccctccactgacttagccctcagtagactggcctttggacctgccctgactctagggatgaggctcagatgctgaaccctggccaaatgggtctccatgggctccaccccagccaccaaagtcaaccaaggcccttgcactttcccagtcgacctatgtatcactttacagtttgcaaagtgtgtgcccttatcctagctccctgtgagcctggccaggcagcatggtgatgagatgctggtgccctgtacccttatctcatgcattctttccagagatcatatcagcaccttttgtttgacctctgtgcatgccaagttgcttcagttgtgtctgactctttgactgtagcccgccaggttcctctgtccatgggattctccaggcaagaagactggagggggttgccatgccctcctccagggaatcttcccgacccagggatcaacccgtgtctcttatgtctcctgcattggcagacgggtccttcaccactagcacctcctgggaagccccagagacctttaactcctctaaaaaacagacccatccagactgactcatctggccagaacagcgagttctcacaccaaagccatggagaaagggtcaggagaagcatttaaaaatgtgtctcgattttcacaagacgactgtggagggaggcatgactgggtccagctttatgggctcagagtggtgccgtgtggtcactggcaggaagacggtggctctaaagcagacagattggagtcccagcctgaggctcctctggctccgccacctgcctgctcactctgtcttctcttcgcatccagaaccagccccgccggccacacggtttttggagcagaatcgtcacccttccttcacccttctctgtgaagctgcttttatgaaacttccccaggtccttttggcagagggggtttcacggagaacctggttagaagtggagggcgggaggaattgtcttctggaaggggacgaagcccggtggcggtgactgagtggagaggtgacttgcaagtggatggtccagtttggctcaaggcatgacctcttgccttctttgacaacaagcgcaagccagttgacttccctggaacttaactcagtttccccatctgtagaacggggctactaattgaaccccactgacttatggggaccacacaagcacagagcaggctttcagtgaacgcaccagggcatgagatgttaagccgtacatctcttttgtagtgagatccatgcaaagcacagaagtttcaatttttcttcagcaaagcaggatcctggaggagatggtatatgctgccgtagatggctaagagtggctggtgggtgccctggaagcaggtagggtgtgctgtggtcttgcctcactctttctgccatggcttgggggaggctgagcaggcttgagttaggagagcccttgtcctgggtctggatgttcagggactcagagaaaagcacggatgagggatctacacctacagatgggacctcacagtggccaggggtgcaggtaagaggtaagcactgtttccagggtcacagtgccctggactctcactcaggcatcagttcactcactcacctcccagttcaacacacagtctgggtgcgaggtgcggtgcggtgtggtgttgtgtgtgtgttttacaattcacactacaggctcctgtcaccgagctgcttgtgggtgtaaattaaaaacaggggaggaaagacatgcatacagaggactccaatacaaggcaaggggtgaaaaatatccccagagagatacaaataaagtgctaagggaattcaggagagggagatggtgtcaaactcggggggagaagctgaggagggggtgtctgggaaggctttgggtggaggcagcactgtgctttccttaaattccagtgggattggacactgagtgggctggagcggccttccaggaagcacgaatggggagcgtgaaagagcatgagtctggggtcagaaggatccaggttcaaatccatgactaacttacgaacttgagcgagtcacttcagcctttctgcattttagtttatgggggtgagagtgtaaaggctggagcgataaacccttcctggcttactttccagggctgccaggaagtgcaaatggagtactttatgtgaaagcagttggaaaactataaagtgctatgaaaacgcaggggctgtttttatttttaaagcattaattgattcagcaacaaaactcctaggtaagaacacagtaatgactgaacctggatgggctagacagcagttcagctcaaagctgtctctaacccaatcatccagggtctgaggaagtgtggttgatctttgtactttcatccctggaaggttacggttagcccttaaccaccacaaactttctcaaaaatcccaccattgtctgttgttgtagatcatctgaactccatccatccacctatttgtctgttcagccagccagccaatttaccaatctatccattcacccattcacctatccatccatccatccatacaacaaacctataatgaggacatccatggccagataccctgctcagtgttggggatacagaaaaaaattagaccccttctctgggctcaagaactctacagcttagtgggaaagacagccatataaatcatatatcattactctttctaaacccattttcagtcagttctacatttttgggggtaacaaattccagagaccacagattataggattttaaggctgagtgatctttgaactcttttttatcacactcattttactgatggggaaattgtgattattgtttgttgtagaaagcaatatgacttcctcttatttgcctccaaatgacctctccaagctttcaagttcagttcagttcagtgaacctttattaaacatctattgtgtgccaggctctgggcaagagctgcaggtgttggcagtgaagaagatgctgttcctgccctcagggatgcacagtctagggacaaagggacatgcagagagataatagctctagggcttgacaaagacagggatagaggtgggcacaggcactgaacacacaggagaagggtccctgctctgaatacgaggagcttgggagaggcttctcagaaagatgtcctgtgagccatgtcttgaagggcaaaaagcaatgtgttagatgaaagatgtcctggaaaggcatgctgggcagaaggcacagcgtgggcaaaggcatggaggcttattggaggagctcccctggagtaggaaatggcattccacttccgattttcttgcctacaaaatcccgtggacagaggagcctagcagactagagtgcattaggggtgcagagagttgtacacgactgagtgactgactatagactggaggaaccatatatgggtgttgggacttaaggggggaaagtggtgcaagatgaatgtggagagga

SEQ ID NO: 45815 - DNA, 1153 bp, Bovine  19866881235903
tggaaaacctgcaggtaatccttgttctgccagtttaggagtaagtgcttaattatccataagatgggaaaagtaaatccttaccttaagggttgttttgaggcccctaggaggcaattaccatggtgctgatggtgctaagagtgaacatttactgggcacttatgtgcaaatgcatttaatctcacaacaaccctctcaggcaggtactcatattatccccattttacagatgaagacacggaggcacagacgaagaccataaagttataaatggcaaactgagtcaatgcgaatttaagtgttatagaaactgtaaagtaccggaaagatgttagttatcatcatctggcccaaattcccactgagaatatgaggaaatggcagttccagagatagataggatgtgaggatcagaatcccacagctagctaatggcagagtcaaaacaagagccaggtccaaaaagaacataaggttttcacgtggtctgaagaaagacctgacgagatgtcatctctacgcaaacaaaattatttcctgttttccaggatcaaggaactggaaaggacattagatttgtttttaatcatcccggccctcacttagcatatgacagcacagggagtctaggtcctgcacttaacttcagcccaaatataaggtactaaacccacagcacagcctgggtagctgagcgaagcagtcacagcgtctttatgggtttgaacaggaggcccccgcgtattcgggaaggcgatgttaaatgcgagccttggtgctgactctgaattaattgtcagcaaacagcctggcacaaagctaagtagatcaatatctgcaagagaaaaagaaataggcttttaactgcactgtgctttcccgagtcgacagtaaatgctattgtgaccaggttctccctccaattcccctggctgattgctttgggcatcactagaggtgggaagcggccagaggtcgtgtgcacctcctgggattccctgagcttcccagggttcccaagcactgtttcatgatgggggggttttgggtacctactgagcgctcctgatgggcaggggcatcagggcccaaagatactctggggggtgagactggggtgggtcagggaactggggaaggtctgggtaag

SEQ ID NO: 45816 - DNA, 564 bp, Bovine  19866881366577
ggacttgggctaaattgcagtcggcagacttgatttgtagtttgtcctttgtgagtaaaggtcatcatttgtcttttccagaaatgaggaaagcatcattttctcattccaggtgtttgaaaaacttcaacttttctatccagagtgccagcctgaacaaattctgatgtccatgaattctcagctcaaactccataccaacaggtaaggagaatagagaagaagataggctaggatctaactttaccctcagtgaaacactgcacataaaagaactattgccttctaggtgatttttctaactcacaaataaattttttagttgaagtgaaattcacataacataaaattaaattgtctgattcagtggtgtttagtacatacacagtattgtgtaaccattacctctagtttcaaaacattttcatttatcaccagagacccatacccattaaacactcactcaccattctcctctcctctcagtccctagcaatcactaatcagctgtctctgtggatttaaatattggatgtttcatgtaaatgaaaccataccatgtga

SEQ ID NO: 45817 - DNA, 1192 bp, Bovine  19866881623038
acaggaactcttatcacttaggcagttgttagcaagtacccttaggtagtatgttcacaggaagtcctgcattgggggctactgccaggcagcagatagtcgcaagctcctggggaggtaagtagcgcctgtgttaggagagctgcatatatgtgtccttggagcctggatacacaggggagacagcaaggtcaagcactggtgaattagcagtggaggtttaggggggctttgaccatgtgtgggcttcaccggtggctcagatggtaaagaatctgcctgcaatgcaggggagctggatttgatccctgggtcaggaagatcccctggagaagggaatgtcaacccactctagcattcttgcctggagaattccatggacaggagcctggcgggctacaaagagtcagacacgactgagcgactaacactttcacacttgaccgtgtttgctcatctctgattttcttgcaatcaacaagaaaattaactgcaactaaagtgttattaattaatactttagattacttttaaaagaacttcatccaactcgccaggcccctacaatagaacagcacaaagactgctgtcaccacctcacgaccctgtgggagctgaaacaatcactgagggcaaggagatgaaacatttatgaataagactatttgcagttaccgagctgctgagattaagtgaccagagcagttgttcttttaaggcatacaccgactctgtttaggaaaccgatttcgccttcctgcttcccccgtgcgtcctgggttcgttcaattcaaagccgcggaggcaacagcgatgcagcttccctgcacggtagctgtgatgggtgcttttctggatcattcttgtggaagggtgagaggccttgggattgcttagcttgaaggcaagaaagcagagatgagacataactcattttacttaaatgaaaaagagaagacactggaattgctacaggaagagtttactgttgtttttaaccttttaaacttgtaaagtacagcacatacatacagaaaggtgcacaaagcatcagcgtgtgccttcatgaattattggaaagccacgtatgcagccaccacccaagtcaagaactagaatatcagcggcactgagaacattcctttccagtcaaaacctctccttcctaccctagagataaccagcatcctgt

SEQ ID NO: 45818 - DNA, 1226 bp, Bovine  19866881775396
ctgttccccttcccaaagctctatccagcttcttaccctcacagtctttgacttcagaattcaaaaatacagttgctgctgtttagtccctaagtcatgtctaactctttgtgacccccatggaccatagcccaccaggcttctctgtccatggcatttcccaagcaagaatactggagtggattaccatttccttctccaggcagtcttcgtgacccaggggttgaacccacatctcctgcattggcaggtggccaggaagcattggcaggtggactctttaccactgagccaccaggaaagctatcagtaaacaccatatgtggggtcaaatgttggcctcacttctgtgggattccctcttctccagtctcttcactcttaaatcctttgctatctcaatggatatgctttcgaatagatatttttaaaaaatattttatccagctcttctaactattcttcacgggaggtttggtctgatacaatttgttttgaaatgtccttggatgattttaatttattctacctagctcagagaatttttaaagggaagtccttaataacacccagaggatttctcaaatgtaaagttctgccaacaaaaactttgagaacccaccagaacattaacagaacacactgatctggctcttgagaagtcctgacatattcagtaccattcctggcagggatactgagatggaccattccaaaggcttttctttgcctttgctttttatctctaccaaactatcacggcaaaaacatttatgcccacaaacatcattttcttcttcccagtaacctgtaccctctatctgtaattactctcaatgttagaaattcaaattcatgtatatacaacctgaactttgagcttacagaaaaggctcacagaagtaaaaatacatctttaagaggtcacagaaaggaaattcttcagtttgaaagaaactgtttttcagctagcttagtcccctgtccagggattaaatgtgggcccctggcagtgggagctcggagtcctaaccactggactgccagggaattctcagaaattgctattcttgcatttccctaaaggaagagagctttcttccatccctgtgcctctaaaatgctattccttcttttgagaaccttctccctcttcatttttcattatatgctccacttggagatttccttggcctcacttttaatctgggccagctctgcataga

SEQ ID NO: 45819 - DNA, 847 bp, Bovine  19866881821860
gtctcctgcagaagagctgctatgaaaataaatgcggtaacctatgtgaggtcacctcccacaccacacagggctagcccagtctcctgctgcttgtgtggagtcgctgattttcaagcttgatgttttacccagagggagctgacttacacacccattgcttctatccatctaacgatggtgctttctatcctcccccatgcctagatccaaccgactctatcagcataaaataaagagggctggaaatcccgacagagtgtcccaggggcggcaaatcaaggatgcagctcacacgactcttattacacccgggagtctaaagcacattatgcgctgtgattaaaaagaggcttgactgcctccgccgcgcaatcttgtcaatcctcccaatcatcaagaaatcgtaaggactgacaaatatctcctcccaatctcatttcacagaggtctgtaattcttaagggcatgcagagggaggcatggatcattcgggaaacccaggggccatgggaggcagcatcttcgagttcctgcggaggaggatgcccccggaacctcttcctgctgcatctcattcccccttgtccccacgcccgttcctgccccgactcccctgccccgttcccgccgcagctgagtgcccttctgcctcccttttgccaccttccacttggtaaggcgcagcgatcgattcaaacccttatccagcctccatgtcctctgctgtgaaaatactctctcttcctccttttacttccaaatgaggtaagtcagtgaaataatagccacttcacagtgcattcaattttcaacaatctactctcttgtctcaccaaaagcgcta

SEQ ID NO: 45820 - DNA, 726 bp, Bovine  19866881824871
atgatgacagttacaaggcagagagaaagctgacaatatttagtacccagaatgggcctcggaaggctttctggttctgcaggcatctgaaagacttttgggaccccaagactgattagtaggaatcccatttcaatatacaatttctaaagctggactcattaggaaagaccctgatgcagggaaagattgaaggcaagaggagaaggggacaacagaggatgaggtgtttagatggcatcactgactcaatggatgtgagtttgagcaatctctgagtgatggtgcaggacccagaaacctggcatgctgcagttcatggggctgcaaagcattggacacaactgagcgactgaaccacagcagagctggacccactctgtggacccttcaggagttagggacaaatggacaaaagattccaggatatgtgctgggctgagcttttcccctaagatttcatgcaagaggcttctttgaactgcaaaaggaaagggatgatgaagtaaaaggtggcacaaattgagtcatttggggaggaggtaaagaagagggctcagcaagacatctgcttaatgtcagttttagaagatgagcttctccctgaaacaccttggtttcaaaccaattgatgttattttagttgttacatggaatctgttgcagaaacagaatccaactgtaaatcctccaggcttccctcctccatttgtcactttcatttat

SEQ ID NO: 45821 - DNA, 1786 bp, Bovine  19866880453161
cctgacctctccgtgcttcccatctcagctgtgtgatcttagccagttgcctgacctctctgtgcctccacttctgagctgtttgatcttaggcaagtttgggacctctctgtgcttccatccctgcacgtgtaaatgggcttacaacaagacctagcttagagggttcttatgaggatttcagtcaattgtgagttttcaggatagcacctggcacatagtcagtgctcgagccttttagtcctgtttctcaatctagcccgcttcctcttcccctctaatttcctagtaattaccctctgggtaacgtggaaggtgaatggctgctgagtcttaacctgacactgtttccacgtgtgtagaaaagaaggttcccagcagcctagggaagactgcctttcttcaaacactatgcatgcttgagtgtggccgaagccagagcagggttagtgtgcatgagtgctgctctgcttcacaagatcccagatgactcacatttcctaatggaaatgtactcatggcccttagtgcttgtgtttgtgctgttgtaactcttgcctgctctgtattcatctcttcaaagtgttaataagttatacatgtggctgatgctgtcttttttccttctccatgatgtagtttccacttggtggttctgaggtttcctggatcatgagctgggggtttctttgaggaaggagcagcactggaggctcagtaaggagagactgtggcctatgagctagttggaggggcaggagaaagcattctgctctagtctgacttttctccccaagctcccttccaactgcagtggcctgctaactcttcagtgagatgatggttaacagaatggttaacagatggttaacatttgtagcccaacatcctacaagggagaagaacaaacaagagtgagctctgcctcacttccaaaacccacagttaacctgtaaggaagatccagccacacttgatggtgccctggttgtctgttgcgatggtgctgccctctgctgtcacctcagggtagaggagccatttaaaacacagccggttagtgagtgaatttagaatttacttctctgaaagattttggacagctgggcagaagtaagactttctatctacaagctgctgcccagggcctgtcctcagtccctccctagcttcttatgctgttccagtgctacctaaagcagagacttgcttgaggaaaggtgtctggaaatgtcccaggatcagggaacctcaacccaccttagagtcctttcctcagagctgtgggaaagcattttcttctttgattaggccccagttttggctgaccagggaaccttttcccttgacctcaaccatgctccgactcaagttcagtcacatatgtctctttgttcccggcgttggatcagctcctcattgctcagtagatagtcatcaatgaacgtgaagatttcctcgggggtgacaggttccatgtagcgttcccggtcaattccctgcttgtcaatcaacaccatgttgaagtaggagcgagtgaggtgctgaaattgcctagagagatgagcccagggatgtgtgagaccttgtctggacatcattccgccagactctagtcctctctgatctttcacagctccactgatggactaattctttcttcaccgaatcccttgccccatcccctccagtaactatctcaagcccctttacttttctctgcttacaccttagtcttgctgccccaacatctctagctgtgttaagctgtcccttcctcacccca

SEQ ID NO: 45822 - DNA, 2546 bp, Bovine  19866880528333
tgctctgctatgtaggctctttgctttgctggccttctgaccttttacagctctaagcacatgctattgtctgagtagactcagaagctctagcaagttctcaaagggcaaatattattattcctgttggaagcaaactaagcaaaaactaagttccagaaaaccctgtttctgagaaattctcaaatatcattaagaagaataaatggttaacttaaaaggaaaaacaactatgcaacattaaagtacaatattgcaataagggtagaaaacatgtgtgaggtttcacccttggagttcagccttttaaaagcaaaaaggttatgcatatcaatttgcagtatactaaaattgtgttcaaagtttatttcaagtcacagaaaatatacaaactaagacaacagaatgatctgattttgttctgagagaaggtgataggagtcctccacctggcaccaatttgagtcattcaagggttaggatgcagaagtcatctttttgcaacatttcaacaaagttataggattaatttccatatctgttgccaggtatttttgaaaacctgtaaggaaaagttgggagaaagccattacaagtggagacaaagttctcttccccaaacatcaggaagaaaagaatttaaaggtaggggaaggaggctatgcataagaacaaatcaccaggaacagattcctaaggtgtctgcctcctgcttccccaaaataatcatctcttacagtggagtttctcaacctcagcactactgacatctggggccagataactctttgttatcaggtggtgtcctgagcattacaggaggtttagcagtatctctggtccctacccactgaaagccagtagcataccatacccgctaaagctgtgataaccaaaaatgtctccagacatttcccagtatcatgtagggggcaaaaccacctctggctgagaaccactgacctaatggtaatggtacataagcctgtcagtgatagcagagctggatcacaaccagtaaggtagaggatggagggagagccaatctcttggctacagtatgcaccaataccagcaaatacacattaaaaccttcccagtggaaaattgcaaagaactacatgcaccacatgtacatattagtggaggtttaaaagagataaaaggtgaataaggtctgtagtctagttaagagtaatgtaccaatgtacatttcttccttttgcactataaaccaaaaaggtattgtgtacaatagattcccaaaattttatcattgtgggaagctaaaggaaaggtgcatgaggctctctgtactattttcccaacttcctgtgaatttctaattatttcaaaataaaagataaaacaaacaaaaaaccctgctctgtggtatatgtgcaaggctttgaaatgaggtaccttataagcaagaatacacaagcagagaaatttcagaaacgttttttacctctactatcccaaaacataattttctcacattctaggggatacgtttttttaaaaaaatagctttttaaaaatctattcctctaactataataggcagtctacactttcactaaagaaaatagaatgacttgggtatctggactaaaagttctagttgcactgttaagtctggtgccatccatctatgacagcttcccattaaagttcagtcaatttaatgtctagatacagatataatgcatatttacagtttaaaagttttaacaatattacaaatatggattaaaatacaatatatttagtaaagactgctagttagtataaatgagaccactgttaaataatatatggacagaaattattacaaagagggaataaaaagcagaaattcaaaatgtgaatttccaattgatattgggacaatgcaaaaaagtaattagcctctaattaaaataaataaattttttatgtttatgaaatacaagatgttggggaaaaacttttttaaaaaccctatacatgtaatcagggttaggtcacatgattatgttcctttctagctgactgaagagcaagaaaactaagggcagtagtgtacagcaacctctaaaatgtacagggcctgatggagatggtggacattcactaccttaaattatgtgctgtaacagtttaatctcaaaatattctatgtaaaataaatacttgaaactaaaatgtttgcatattttattgaaatggtttgtgttttcattttgatgggatagttgggaataaaataataactgattctggaagaatacataccaaactatatttagcagttatgtctttggaatgagactgagaaaccagagcttttaccctgaactttctacatttctgtatttgattaatttggttaaactgatcatatgtcactgttgcccattttagggaaaaaaggttaaatgagattacaatcaattcaacaactgaacaaatgcctatcaccttcccctaccatgacagggactgagttactgaagagtgaagggtctagtcaagaggggtacaggcctcgggtagtcttg

SEQ ID NO: 45823 - DNA, 793 bp, Bovine  19866880547589
ctcaggcacagtaagtctgctcacctttaaggagctccagtagatttctgtatttgttcttttaagatcaggatactctgcctctgctcaggaggcagcatggcgatctggtctgcagttagttgaagtacctgcataatcaaagcagcctgtgcagaggaaaaaaaaaacataatgagttctaacgatggtggctaaaaaactaccaccagcttctgtccaaggcagaaggataattcacatacattaaaccaaaaaaatttttaaaaatgaaaccaaaccaaagaaaaaaccaaaaccagctggtgagaagaggcaaaataaaaagcacaggtacaatggctaagattagaagattcaaagcagacaccttcatgaaccccaaattcttacagatgaagatggtattggtaacccctgggaaatctacagtttttaatcctttgaaagaattaaatcctttgaaaggagctttgaaagttgctccttttcacaagttttgagctccctacaatggtcaaatatagaaacagaaagatatgcttgtggggaatctgctatcatctttagggataaggtataaaagggaggaacaaagggatttggatttccaggtcaatcaggcctgcacagaaaatatctattggcagatgagtctgaaaagtaagacaagctaccactgacatatagccatttaagaattttaggatctggcccacagattttcgggtaacaagatcataaagaattctgagtataagcatcatttccaaagggactctaagacccggga

SEQ ID NO: 45824 - DNA, 1659 bp, Bovine  19866880637925
agatatactgtactgggcctgagagggtatatttgtcattatctcatttcaattatcaatcatacttattacccactggctggctctttcagacttgccctcattattttcagtcttacatcaatttgtaggactgcactgaagaatgcttgtaaagtgctttgtaattctaaagtgtgttattaatgataatctcccattgcaaccttctcagcaacaacaaacaaatcctattccagcagttcattgccctctccccaatctaccattttacctgaattgttcccattatacctctttgcatcagtacaccctaacttctggagataatgcttgcaatcaactaagccttcagagagccttgcagtcttagaagcactttgattctgaattttgctttggaaatagaaagcaagcccaagagactgctcccatttcatcagggagaggctgaggcatatgaagattgtgacccaataatttaaaagagatcatgttatcagactgatgttctgtgtgtccttcctgttttacgcccacctctagccatgagaaaactgcagctattgaggttgtgggtttgggatacctattccccaggtctcaagactttctcctgagagtagttaagagtaagctggctgcctgagcacagctaattcatattcacagaccagagaacacaatttcacttttgaactgctctttacttttctgaagtgggactcaattgtgctcaaaaaagtcaagcacaacctaatcaccctcaaccatctgtctaaaccctgctcagagcaatgggtcagggtgttgtaaaaacatgtgattctgcctgagggaggccttggaggaagccctttggaaaataaagacctctcatcatagctttattcaaatatttattgagtacttactgatttgaatacttcagagtggtaatagcataggggtcatcagcacaggttctgaaggtcaactgcctgtgctcaaatcctgactctaatgcctgcttagtgactttagtttctctcttggtaaaatgaaaataataaaattactcatgccataagtgtagacatgaggacatatccatatgagatccctatctgaagtggctagtacattacctggtctgtaagaaattttcaataaatactatctaatattgttattcacacagaatcagagcaaacctgtcagggagccatgggtgggagtaaaatttgacagaccttaagccagtttcacgggcccattgctggaactgctctggggaagagtcaatgtgctgagaagagtggtaggaaaaatgccatgattggaggaagtaaagtagaaaccatacttgggtgccagggagccacttgcactacagaagtttcagaagaagatcagcaccaaagaggaaattattgcacatcaatacattctgttctagggtaaatgattcctgctaacacagctgagcccctcccactctcattttccatcacatgacagaggacaatgaaaatttagggaagtgattgttaggtgcaaagtctggaacctaatattattttaacttcctcccagcagcacttttcctggaattagtcctgtgagttggggtaccccaatgaccccaagaaaagacaaatatgcagaagagaagatcca

SEQ ID NO: 45825 - DNA, 3336 bp, Bovine  19866880944006
caaaatactctcaagacatggacctatatttccaaagagaagcaaaagcagttctcagagcgatccatccagtcacatgtttttagacaaaaacctaaaggaaaagtgcaatttacgtgagtggtggaattaggatgatttttcttttttttgtctcttgtgttttttcgatttttgaacactgttttaggaggtggggaaggggcacaagaataataaataaccacttattgaaagaattccaaaggtagataggaaagtaatgaattttagaatttctctacaagaatttgccaaaaattcttgcctttatccctctccctccttatcatctaaattactggagattaaggaaaagtgctttaaagtaattactcctgaaatgtaagttcagctattagctacaaactttcaaaagggaaggcgctacagagaatacccggtaaatgtgactctcttttaaatgttaagactgaaaggcactgtatattccagccctctgtattttcagatcaagaacagctgatcataaagaggctgaaatcttgggtcacacaactaacagcaaaggcaaaactagagataactgtgctttttcaatcctctcctctattatataagctgtatatggtatttggtgcctactcatcccaaagaaattctaccagttgcttagatcttcctagaacttgagactatgtgttcctaaggacttaaactgcttccaggatgggaatgaatcaccagaaagtttcctgtcccttatgtccacaggcagacctgagtcaaactctagggtaaagtggaattttaaaacacacacacacacacacacacatgcacaacagccctcttcacaatctcctaaatactagagacctcaggatagatagggatttttttttttcatctgttaaggtccggtttaacaaaagtataagctctttaagggaagaaactgtcaaatgtgtgtgtcagggggaggtgtttctagggggatgggattaaaagacagtattccgtttcctaaccaaccaattacatcatcagtgacacaagcttaacatcacaaatgggtattcattgtattgccacggcaataagccctgcattggtgaagaagaggtgactgcctaaacttttgtgctctaaatcttgctttaaacacataccacagaaccagaaaacaggaaagttccattaacttggtcacacagagcttccttgtgcttcaaatattgacctaggaccagctcctatagcatcatgccagatgtctgaggtccaagagagcaactgctggagaattattgcactgccatgccttatactaaagcatgaaaagcctagcacatacatacatggagagaacaggtaaatgatacatgtatacacttcgtaaacactaaggtcatcaggaaataaggcagacatcaaattttaaaacaccatatatgccacagccacaggaaatgaagttgagggggctctcagtatacccaaagtggtctccctaaactaaagagcacacatctggaggggttctcatattaaaacaaaaaagtatcaagggaaatcttgctaaattcttgtcatcttaaatgaagtttcctctaaagcttaggtttgtaccatgtcctgaaagggattttcattgtaagcctgagagcaaataaatatttctgtggctgaagaaaaaacaaaatagccaagcaaaagctgcatcttatttccaagaatgtgttgattttcctcccctcccttcctctgctactcacaacactgctttgtttgaataacagtcagtgccaaattaaaccaaaacctgacatggaatttaatattcctatggccacaacaccttgaacagtgcctcccaccctgctaaccccactcccaccattgccatgccaccaagcctagaagttcagtttagttcaaatttaggtctgggtctgggtcgaaacccagacaaagaggcatctaatcccatctaggcaatgtaagaagtaagtctctaggctataaaataaatttattccttaaattattaataaatgctgtactgagcattgactatgtaccaaccaccattgctaagcaaccaacaagtgttacctcatccttacatcacaaaagtccttattgtgaggccgcgactaccattgctcatgttttacagatgaggagacaggttcaaagaagctaagtaacttgcctaggactaaaccctggcaacttccatttctctcatcagaaacagagcccactctgtgatgagatatggctgcaattgtacatttaaccataaacaagggctctttggaacccctgaagcacaagaacctcaatggtttccccaattctgccttgtacttgtgggttttgttgaattttacttttgccttcactcaattagcccaaccacctaggaggtaaccctgcccatcccagagtggtaaagggagttcaatagcttttttggttcaacctcttaatttctccctcttttctgatcacaaaaaaacatttgatgttgaaaatgtagggggaaaaaggaagatactttccttaaatattgttactgcttgttttacagtcaacatttagtgtagatttggtcccttctctattaacttcctgtaacctttaagattaaagtgtttttctttgacatttaaatgatgcctcttccagcacatcagcttatttcctatagcttttccaaagtgaatttcctgttccataataagccagtacgattatctccccaataaataagatctgttccctacttcccaatctctaaactcaaaatacctgccccacaacttaaggttcagctcaaacccaacccaatgagaacaaccttccccccaactctccagcctggccaacacatatacttctttctttaacatcagtccttatactctgatcattcacattaactcatacccttaatcaattactatagtacctgctttcagtatctgcttcttctctacttacctgtcttacgtctggttgtctacatgttcagaaactacttgaagagccagtttggctgggctcctgcacccgcttttatactctccaggaccctaggacacaatgctcaattgatgaggtcatttggtgcttggccaatccctgttcagctcattggtcatagctggcctctgaggctaaccacttagtagtcactcaaggcttgattaattaaatgaaattaaaaactaaatgtctaagccatcccagtatcacactgacataaaacggaaaaattaagttgagctgttagataacgtcttgggacattacttcgctcagtca

SEQ ID NO: 45826 - DNA, 1315 bp, Bovine  19866881003164
tctgactctttatgaccccatggactgtagcccgccggctcctctgtctatggtattctccaggcaggaatactggagtgagttgctatttcttccgctaggaaatcttcctgacccagggatcaaacccgagtctcttctgtcttctgcattggcaggtgtgttctttactactagtgccacctggccaatgcgagggccacggattcaatccctggttggggaactaagaccccatggtggtgcagccaagaacatagtaattaattaaaaaagaaaatatgttgacaacaatttaaaaaaagatggaggaaggggctacaaactgagaaatgaagctctaggatgaaaacaaggaaatagattgtcccataaggcctccagaaggagccaggccctgctgacactttgattttggcccatgaagctggttttggatttctgactgtcataactgtcggaaaatattttttaaaaaaaaactagtttatggtaatttattaaagcagcataggaaattaatacaaagggaagagatgattacttgatcctttaatgtcacattgaaagcattttccaacacacctatttaggtgtcatctgactctttaggtctagagaagtataatttagcacaactaatgaggatttagtcattttacaattctgtaaaactgatgcaatgatattttctgtccacctaaagaagacatcacgattttggttcttattgccctcttgggcattaatcaactttgattctaacttagcaatgttattttagcaatcctttgtttttttaactgactgtatataaataccagttctcacatcctcttttgagttaactttaccatcctgctggtttcctccttcatgagttaaaattaaactttgcacatgctcacactctttgtataaaacttttcctgaacactttgagactcatacttcaacaatgatcccattttttgtaaaaaaacaaaaacaaaaaacaaacaaacaaaaaaactaaaacaacaatatggtggtgggaggagctggaggaaaatgttccacactctttacggcagttctctggatggggaagcggggaagatgattggggatttcttttgtgttgtttgcaatatttgacttttgtataattttatgtggtgtttgtagtctgaaaaatatattactttaaaaagtaaatatatgctaaaaatgattcacgcagtgtctgtccccaacaagtttagtatctggttggagagggagagatgtaatgcatacaactcactagaaatataaggccaagtatgatagatgc

SEQ ID NO: 45827 - DNA, 766 bp, Bovine  19866881005098
tctatccttaggcttgctttgtgaaccattctttttgtacgctgtgcacatttgtttctggaacacttacgaacactccctctccccctacctgcgggaaggttttcttcctaaagcgggagtaaatgggttaaggaagttttgaaccctagggtaaaaaaaaaacaaaacatcaagtttaagaattttgtcaagaagcctagctgccccctggttttgtcctggctacagctgtccagcgtgtgggtttatcaagacctgttcttgtgtgcagctccccttcctaaccctctgtacagtccccccttgtctgccatatcccagccacagttctgtggccacagagtgctacgtcaattctcacacctattgtttcttaaacatctagtggtgtgtggtttgaagatgttactgtatacagtgtataactctctattctctgatttcccacatagatcactggtgttatccttcttgccgttggcatttggggcaaggtgagcctagagaattatttttcccttttaaatgagaaggccaccaatgtcccctttgtgctcattggcactggcactgtcattattcttttgggcacctttggctgttttgctacctgccgagcttctgcatggatgctgaaactggtgagtccttgttttcttaaaattggttgttggtttttgaaaaggctaatatgttgtaggctttgtttctggaactaggcatggcccctttcgatttttcctcttccttataaaactagcaa

SEQ ID NO: 45828 - DNA, 1559 bp, Bovine  19866881455343
ttgctcagtctgtctgactgtttgtgaccccatggactgcagcacgccaggcttcactgtccatcaccatctcccagagcttgctcagactcatgtccattgagtcagtgatgccatccaaccatctcatcctctgccatccccttcccctcctgccttcaatctttcctagcatcagggtcttttccaatgagtaggctctttgcatcaggtggccaaagtattggagtttcagcttcagcatcagtccttccaataaatattcaggattgatttcctttaggattgactggtttgatctcctcgcagtccaagggactctcaagagtcttctccaacaccacagttcaaaagcatcaattcttcagcgctcagccttctttatagtccaactctcacatgcatacatgactactggaaaatgttaaataaaaaaggcaatgcagtgtgtatggtctgctaccacttgtacctaatgaaatactttcacttaaatatatattctccaaaaggattcacaaaataataatattgattttcttgaggagctgaggacagggctggaagggagatttactttttattgtatactcttttgtaattttgagttgtatgacatgtccgtatattacctactttaaaaataattttaaaaggacatacctcgcatatcttaatagcacatttcatttctaaagtcagtggaacttgtaggctatgaccagacacctttcatattatttgaccagtagacaagaggtccttaatgacagaaagctataaggcttgactagtcccttactagctaaggtagttagttacctgtcttatcttgagcatcagcttctatccttttcccattacctgagataaaggtatatttggcctatttggttgtatacttagaacttgggagttgctttgattaggcatgtaacactgcaagggagagaatatcagttttaccatctgtttgaatgtattggtttgtttctttcatgaacgcacacaaaaatactctctcatagtctccccatttaaaaattataacaataatattaacacatgcttattgtagaaaatttggaaaatacagaaaaatatttagaagaaaataaaaatttctttaccacctagaagtaataattttttttctttaatctatatcatggatgctttcctaactgtcaaatagtcttctgaaacttttttgttgttgcactgcactgcatgcagaatcttagttctccaaccaggggttgaacctatgccggctgcagcggaagcgtggagtccttaccacaggaccaacagggaattccccacagcatttgtttttattttttatttaatttatttattttattttattttatttttaattttattttatttttaaactttacataattgtattagttttgccaaatatcaaaatgaatccgccacaggtatacatatgttccccatcatgaaccctcctccctcctccctccccataccatcctctgggtcgtcccagtgcactagccccaagcattccagtatcgtgcatcgaa

SEQ ID NO: 45829 - DNA, 1217 bp, Bovine  19866881470501
tgcagtgatgcctgttttctttctcttttagcagacttttaacagagagctaaagagaaaaatgaaggaacgtccaaagaaatatctcatatccctcctttggtaaatgggttcatctacagaaccattagaatttttcagttttcaaatttctgtctgttaatacctccacagtccccctataattccacctactctaacattatatcccttagaactcctgttgtgcccatacatcaatcttcgagccatcaaataaatcttatccccaccaaggggctcaaaaatagttagggggaatgaatagtttgaaatagtttaagaatgaagatgaccctggcaaagaagatcagaagatctttgtaccctaatgctcctgatgaagtctgtgagcaacatatcaagggtaaccaactgcaattgagtcttagaagtatagggtcagtttagaactacattttctccccttgtgttcttgggtggaaggggactggcataagtaaagtattctgctgagaattatgctctacggaatcatttttagtcacgcctccgaaaacaactcggttttaaattcccagccattgtctgtgaagcctggcaacaattcttctgctgtcccttcaggaatagcaactgatgtctctcctaacatttaggttaggcgtgcaaaaactgtacgagcttaaaaacattcaactgtccattccagagagggcagtgttagtggtgggaatcatcattcactatgactacagctgctactttcaccatcagtaccacagcccccatttcctgagtgccttctggttgtcagacatagcactaagctcttcacgttcattattttattcacaacaacccatgggtgtaggcagcgtatttgtttttgttttacagatgaagaaattaaggggcagagaaaaataacttacctaaggtcccagaggctgtaagatgcagaacaaggaaccaaacccagatctgactctgaagctactttaggccagaaagatcttcttaagcttttctcaaactttacccagaagagaaagctatatccagggaaaatgttgaagcttcatcatgcccatgttagaagaattaggttgactgcagtaagcacactgatggtagtggcagacccaggtgagctatgacttccattctgccagacactaggctaagggtttacgtacattactgcctttcatctt

SEQ ID NO: 45830 - DNA, 1483 bp, Bovine  19866880388439
cgactaaccaccagcaaagagagttaggacaaaatcttaactagagacaggaagaggaaagggcggggggtggaaaagagaaaggacagaaaagaagaaacatgagtaaagaaagaaggtggctttttgaggggagtacagtttagctacaaatctgtagatcatcgaattgtgaagtatttaaattttctgggaaacagaaaccagcatgatgtttcaaaaaactaaatacaagatgaatgaagagagcctgtgaattgtatagtcttatttttctttgactcctcaaatattgttgtttggttcttagttgttttgaaaggaatctctttcttgacctaaattctttaaacaagtgtgtttgtttagtgacttaacatacagaaatattgtccttcaggctaggccacccagtgtagaaagccaagggcatcagtgcattatgttaaggactcaaaagagtgttggtacacaagagaaggagatgtacactttgttaatttcctctgtttcccagagaaagaccattaaactgtgtttgcaaaggacatggtaaaaaagaagttttgagtgattaaccaagtagctttgtagctgcggtcatctctgctgcctcttagaaccagcatataaatatagagaagtagggagaaaatatctgagttaacagggtgtgggtaatgatttaccctgggaaagttaattattatgatttagtagttttctaccattatagcactgacagacagcaaatatacattccagtgcctaatgaaactgtaaagaggctgaggtctgtgtacggtggcgggtagagctagatggcagggggaaccaaatcagccagggacacacagagccatttcaaaaatttaaaatgtgagtcaaaacactatataaaatattaataatatctaaatgttaaacatacataatcattctagcctgagataaattaaaaataatgaaactgatactataacaaatgaatgaaatttagttaatcatgaaaattgaaataattttattggatcttttaaaaaatagtgtgattttaaagagcaaagttcactgatggtgtcatcattgccatacaagtgtagttttggggttgaaatttccatcaggtttaaaaactcagactctatactagttgcagaatggtgaacagagttttgctctaattgctgttagcattttcttcttagctgttattttaaaataatttctcttgtttatttttttcttaaggaacagcgatgtttttatgctttagcatgttatatcctcactgcatcctatgaactagatactattattagcctcattttacagataggcaaactgaggcacagaaataacaagtaattcgctcacagacacattgttgttgttgttcagtcactcagttgtgtccagctctttgcgaccccatggactgcagcacaccaggattccctatccttcactatctccacaggtt

SEQ ID NO: 45831 - DNA, 1771 bp, Bovine  19866880391766
tcagggagttaactttcaaactgagctttatttccaaagagaccctgtatgtataaaaaggtgcacagtagcagattcaaagaaaacatactctaatggagtcgtcttgtcaggagattgtcaagaagcttagatagcagaaagttacgaaagtaccaaaggaaggaaaagtagggtattctggggaaggaaatctgttatagcaagaaatcacggaaaggcttagaatttggagtagtgtaccttgcttagagctgaagtcagagctattcaatccaaggttcttccttaagagaagttatcttcaaactgaaaagacgggatggggacttccctggtggtccaggggttaaaatttcacactgccaatgtagggggcaagggtttgctccctggttggggagctaagatcctgcatgctgttcggcatggcccaaagattcaattatttgtttatttttgactgtgctgggtcttcattgctgcgctggcttttccttagtttcagcaagcaggggctcctctccagtctcagtgcactggcttctcattgcggtggcttctcttgttgtggagcacgggctctggagagggccctctgctcacggggttcagtagtcgcagaacatgggttcagtagttgcagttcctgggctctagagcacaggctcagtagttgtggtccacgggctttgttgctcagtggcatatgggatctttccagatcaaggactgaacctgtgtctcctgcattggctggcagattctttaccactgagccaccagggaagcccccaaatgattaaaaacaaaaaaaacaggataggatggacatggaccaaagaccatgtgcatgaactaagccctgcacagttgaaaagagttagacctccctttgcaactggtaatgagggccagtaacaacctgtaaccagaggtaaaaatgaatacgtttgcacaaatcaaagaattttggaaagtaggaaaaaccggttaatgcctcatttttcagaatgaacttaaaggtaaattgcaaaaaagactaccttgatgtggatcctaggaattctagaacagatcactacacagatggcatcttctaactccctggctcaaaatagtttcgtcttactgttgtcagagtgcctgcttcttgctcttctctactctgtgattactgtggtgcttatgtcccagggtctaggccttctctccctgattctcaacacaaggtgctgaggtgtgtaccagttctaccaggtgtgtacacacactgtacagatgagaaactggtggcagatgaagtaacttctccaaggtgtatctccaccaggtagcagagctgcacccggttctgcccccatctattggtgtgagcctctcatttctgtgctgcactgctatcgcaagtctgctgtggaaggcaaagccagacaaacaccaagttatttaaattatctcaaaaataaaaagaggctctaagtaaatatcttgagaaagatcttctatgataaggtttttttaaagattattattattttatttatttttttggctgtgctgattgatgcttcatcgctatgctggttcttcattgctgtgtttaggctttctctagttgtgaacgagttgagagctactctctagtttcagtaggtggtggtggcttctcttgtggcacccaggcttagttgctccacggtatgtgggatcttcccagctgctgctgctgctgctaagttgcttcattcgtgtccgactctgtgcgacc

SEQ ID NO: 45832 - DNA, 1426 bp, Bovine  19866880392635
agtccattagtgagttataaatccatgtgaactgcaaccagctttatgaaatgaaaataaaaaagtaatataatagaaaaatagccaagtgcactgcatgtcataaaagtaagtattgttttgtgaaacctagttttatgtgaacgtatgcagtgggtactcttgcatgacataaaatgtattctgtggtaggggtcatggactaaaaactttaaaaaaccattatcttagatgataatacattatttgtatggctgaaaggaaaagaacagaatgtaaattttaggttaaatcatgtttactatgttaatacataggcatacatgtgtacatatatatataacaatagtacaaaacatagaaacataactattctgttgatttttaccactccatctgtggatataaggtagtttaagaacttagctgctgtattttagctaacagtatgtgataatgcatttttagatgccttttaagaaatatagcctttgtgaaaatactcaatatatttattcctagatttcagaactgtattttaggactagaaaaatccagtaacttgttgaatcaaattactaaacattcacagacatcaaacagcacatgaaaatatcttataatatccaatgttatgtttccattttccttcccatgaagggtgactggtggccacatggtaaagggctggaaaatcccttccaaccaccttatgacactaagagcacccagaggagtgactttaagaagccaacatgcccattggtttctccagtcaaacacagcaagttgcaaaagccttcttacggaataggtaaggttagcacgtctccattgtcttaagttactgctatcaaattaagatgtattagatgtgcttttacctcctggggaaaaacagtcctctacaggagttgaaaatatacatgcagcaagtgcagcccttgacaagtttgtttctcatcccttcctggtggacgatttagctctaaacatgtttaatataacataatgaaaattgtaatgatcattgataacactagtctccaagtcagaaatttagtggcattctgcacattattgccagcaaacttttaaaactgtaactgttaaaataggaggcaactctaacaagcagtatttctcaaagtgcacactgagggacactagtttttctgatgtttatagatactgctcaaaacaaaaaaaaaacagggaaaaactgaatttagaaagttaaacagtttttgtcttactacagaactcttaaaacccttattctaagcataagcataataaatttccaagaagaggaatgaagtatgctacgtttgaatgtaaaagacaacttcatccttttcagaagatcatctacatgactggtatctcacaaaacataatttaggaaatactgttctatacacta

SEQ ID NO: 45833 - DNA, 1125 bp, Bovine  19866880466524
ttttgttgtggtgtagttaaagtaattcaaaatcagaatgtttctgtgttttcatgtgccagtagcataactaaatttggaattggggaaaagaactttaaaaaagaatgattggagaaataaatttactcagacaattataatatttctggcaagtacagagtcaagagaaaacgtcggaatcttctctttcagtactttgtattgattgtaactagatatttttcctcagtgattgagtatcttggagtgatcatcatttggaacccagattgacagagtagcttagcattaggagattgtgagagcaatgcaactgagttttatggattccaaaagaatcatggatattgttttctgaaataattcccaccatcagtttattttctcacaacatgcttgtctttactgaatgtggaatttagcaaaacaagacaaaaaccatttaaatgaaggttcttgtaaatgtaggtattaccagaggttagctacataatttttggcatagactatattttagaaaaaaaataatcagcttttttgtgaccatacttttttgaaagttaggatcaagtgtgacgctgaactttgtctctcttgttttctcctgaaaccagtacactgaagatgaggctaggaaaattggagtggttggctgggtgaagaataccagcaaaggcactgtgacaggccaagtgcaaggccctgaagagaaagtcaattccatgtaagtaataagactagtaacacactcgtgtgatttatgaacttacttcagtgtttggttggacaataagaatagaattaatggaccaattttcgtttgtagaacgaaactaactaaactaacatgttttgacgcagaccagcaaagaaattcttagagttgagagtggaatttctactttcaggaatggatttcccacttgggcagaccctcagaaaagactgtagcatcattctccaatctgtatgaactgtgttctgtcagtctcctatcatccaagggagacatccagggtcaagtatttctcatcttaagtggttgtgacaggagcaggagcatagtgcttctgaagattctgaagttcttaaagaacctgcaaggcaaaaaggtgccatttc

SEQ ID NO: 45834 - DNA, 1423 bp, Bovine  19866880495480
actggacttggggctgatggatatggagatgaaagaagagggagtaacaggcactcctgcctggagaactattattgctgtgacctgttaacactgccatttacacaggcagcgctgaacacaggcttatttcactgaacaccttcccacttatctcctataatttatataaaaatccaagtgacattctgggaagaaaataattatgaaacattatagaatttatatctcttccattatattttatcatatggacttaaacttgagtactatccaaggcaagaaggatgacatgaattcactgtcagcaggccaggttcccacatagataaacatggcctggccaaagtgagtgcactcatatctactatgcaaaataatagacctggaaaggctttccaccaagaagcaatgtctataatgatatctctcgttgttttgttttgttttttttttaaaaagaactagagtttgttagaggtaagtcattaagccgaaatgactgcttacttactaccagtgcagcataaaagtcactggagtatgagtgaaacgtataaaagagatgcaaggagaaaagtaaagctaaaaggaaatggcccttggaattctaactgctataacagaatgtttaaaacccagatgaaagtacaacccagaggaaaataatcattcccagtgtttctgtagtaaaagtaactcatcaactatcttctcattgctgaatccacagggccctttcctagacttaccgtgttgtactccagtcatactattgagggtctccttgacaccgtctctgctcttggcctccaggcactccgctctcctcctgtccctgtgactattcgcatcattcacatgcatctttatttactggtcacctgaaagctgaccttcccccaaatcctaagcctggcctcttcttcctccacatgctctctgggttatcaaatccactcccacatgctccctgaaactcatgaggctctctgctgagcaggaaagtggaagtgtcaccctgagtcgtgtctgactccttgcaatcccacggactgtagcctgtcctgagcgagagacccacataaatgtaaaatcacctcttggatgttccacaaacacttcaatctatatgtgttcaaagctgaattcatcatttcctggccctgaacgctcctcattctgcttcagtgaatgataaccaccacccaaccagttgattgttaaccttacaccttccttctcctctatcacctatatccaatcagtcagcaggaatccagagtctccagaacatactcattgctttccttgcatactatcataatgacctcatatctggattactttaagtgcctccagactttctctccaacaatctatcattcacaccgtagccagagaatcaaaacagagcctaaat

SEQ ID NO: 45835 - DNA, 1849 bp, Bovine  19866880634989
aatgtgtgctgcagtagatgattagcatattttggaatgtgtgatagaaaaatatttgcattgtaaagcaagactggactaaagagcttcggttcatttccagacctgccgtctattcttgtaatatgacagtatctgtttccaaatgtggaactcagggaaatggaacaaatgaaggaaaggaaaatgtgtgtgtttttattctcagggtgtcagttggagaattcacacatcctttatttaaagtactcactggcctttgaagtgaccctgcacccacacccctcccagagagactgtggccgtgatggggaagctggtgattttctgctttctggacctgaataccttagctctgctgtcatcgagaggctgatgtgaaggtttgtgactctaggaggcggtcacaaggacctgagaattgtaggctgcactgggcagcgtgcgctgagctcctgtgggatggtcaggccgccagagtggtctgatttccctgcctcccacctgctgctctgtgaggagctggtttacatcagagaggctgctcctgacctcactgtctatttctggcaagagaggcacagcagagatggaagagacctcctgccattcagaggaagtcagataaatactcacttcagagagtgtgtcttgagccaaaatgcatatgagtaggtgacagctcccagcctacattgcctgcacagtcctggatgtaaagattaacggatttctattggagaaggaaatggcaactcactccagtgttcttgcctggagaatcccagggacgggggagcctggtgggctgccgtctatggggtcgcacagagttggacacgactgaagcgacttagcagcagcagcagcagcagctctgagtcagagacgtgttaatgaaaactctccatcagtgcaaaaccaagggcaagtgctggccttgctgattttgttttcttcttcttctttttgaaatgtacgctgagagcaagggggaggggactcctcatccttcacctggaaagcctgtcgagctggttagcaggaactttctggaactttagagagagttcctggagtgtgtgtgagtggtgagcagtcaggttgaagagagcgcgtgtttgttggctgtgcctcccttcagtcaagagggagctctgcacagagtccagggctgacacagtagccagcttgcctctgaggagagagcacttgtcagcactgcatggtccctctggggggtgaccctcccctgcctgcgaagctggcactggattttccactaagaagggtttcagcaactgagtacattcttagtcttctggtagtgatcccgaagtttaaaacaaattttgttcccttgtagagcttattctactgagcttattggtttaagagaagagacatttttggaccctggtcatccaatctccacctgcccgcagaggctggagtctccattctgatgtatttcactctgtttctttccatctggagacaggagaatgatctcgcgggaacttggccagtctttcaacactctgtgtacacgggaagactaggcgtcatgtgaggggtctgtttgctcatttgcttagtgcctttgcagtcagagcatacaaagaagaccagcacacttcctgtcatccttctacagatcagtgtggggcaacatgcattttagagaaatctcttcgacagcggctccctagtccctcagagaatctgaggaatttcaaagtatccaaggtgaaaatgcaaaaagtctccataagcttgagaatgatcatcattgtaggtcaccgtgttgatccatactctcatccctggtcttacaaacaggccttct

SEQ ID NO: 45836 - DNA, 853 bp, Bovine  19866880702776
ctttgttcatagtgatgcttcctaaggcccacctgacttcatgctccaggatgtctggctctaggtgagtgatcacaccatcgtgatcatctgggtcatgaagatcttttttgtacagttcttctgtgtattcttgccgcctcttcttaatatcttctgcttctgttaggtgcatacaatttctgtcctttatcgagcccatctttgcatgaaatatttccttggtatctctaattttcttgaagagatctctagtctttcccattctattgttttcctctatttctttacactgatcactgaggaaggttttcttatctctccttgctattctttggaactctgcattcaaatgggtatatctttccttttctcctttgcttttcacttctcgtcttttcataggtatttgtaaggcctcctcagacagccattttgcctttttgcatttctttttcttggggatggtcttgatccctgtctcctgtacaaggtcatgaacctctgtccatagttcatcaggcattctatcagatctagtcccttaaatctatttctcacttccactgtatcatcataagggatttgatttagacccatttaaactcagaacacatataggcatatggtttatagcatataaaagtaataaggagcctagagaaaattacaagaaaactgctctttggccctatctaaacttcaaaggattgggttttctggtaaatattgtattaaatattctgaagatgcattaaactgagtaataattttctaaacatagttttaaaagactctgtgtataaaagcataatagagataaacagagtctgacagcttttattatttctat

SEQ ID NO: 45837 - DNA, 1490 bp, Bovine  19866880747730
tttttttaagaaaaatgaccttgccagtctgagataaacaggacatgctagcaggaagcccaaggcctttctgatagaagaaaaaatatgctttagtatggtattttgatttgtaatttgtgactataagttatacagcttctgaggtgaggaaacaagactggagggtttgagtctctccttcttttagtaaaaggtggaaaatgctataataggcaagatgatgctataaagatggtgcagaaacagaaagggttaagtcccacattctttcattcgtccctggacagagccccagaagctgcaagcctcagtgctcgttaataaaggaccctgaaaaaatacagactgctgattcaggtgcattgagaaaacaatccctaagctaactattacatccacttagaaaaataaaagttagtaaatactttaatgccaacttccataaaaataattcaatttgtatttattttttctttcatcataaatttggggttttgtgtgaatgcaggttccaactgaatatattaaataagaacctccattattactattccccatgcagatggttaatttaagcagtgaagtgaggaaaaggtggggacatggccccactgagtaccactgggaagactaatgtgtggtcggcatatttggattttaataaaagacggtaccccacacatctggagatactgttagagcctatctagaaagtaacaaaatgccttttgtgattcacctctgtggtgatcacccagttaccatgggatgcaaaacaggttgcatgataattttgatctgtactaaagactggatatagataccaaacaattctatagttttaagtttctaatttcttgattttgtcttaatgtgaaaataaaaatctctggagatgggccaacgatgttgaaatgttattgattttaaaaagctgtaattctcatctctaatgagtcgattcttgtggtacccctagacagtgatgtaaaaactatggctcatcaaaactgttccacttaaattaggtaaagttttaagtgtctctaataattcttgatattgatttggatgtatttattgtatttactgacttctttgttataatattaggtaataaatacctgtacatatccagaagcatttataaagggcagtaattgctgttcaatattaaagtggccagaatttctctttagtgataatgatactagtttccataagaaaaatattcaagaagaatgggcgggtattttccgtgcgtccttccgtatctcccatctacccttctgttttgctctctgccctccatggctgcctgccatagattgcatcaaggcacggccttgcccttcaggcacagactgcattcagctaaagagaggcagcaggaggccagcaggcgaggagagaacgcagctgagacatccattccctcaacacctgctttctgggactcagattaattaccttcaaccctcccctca

SEQ ID NO: 45838 - DNA, 815 bp, Bovine  19866880875649
taatcagggtgaaacagcatggctttttgttccactggttggaaaaatttaaacagtttgacaccctgaagtcatcaactggatggaaaggcatggaagtctggctgggcaggcttcccaaagatgccgagaagtgctgcctcacccgccaggatccacgccccagcagcactgatggtgacccagatggaggtggaggcacctgactcctgaggccagctgtgttaactgctgtaagcgagcctaccactctcagctcgggacttggcagaaaaaaatagaggaactggttcgtaaaaaggtaataaatgacctgagggtctcaaaaccgttcagattctgcacctaaagcagcttcaactcttttctactgtttctcaataaatgactgcatccttcatggaatgttacacagctgaccttaggtttaatcctagtaccggaggtctccctcctcatccaccagtcttcctagttcctggtgaactgccgcaggttaataacatctgtgatgggagctacgtatggtgcaggactgcaccctgttagtacaactggatgtgccatacctgtcgattctagttttcttcttcattttgctgtaatctcatttaatttcaattactcacgtaaggcttttgctgcaacatcttaataaagtaaaaagctcacgataaataaacaaaaattatgtaggttgctttcaggcaatggagcatccatcatgttaaaagactcaaataaacatgaattaaatgcaaacaaatatgaaaccaaggaagactacgaattcggtaaaattttaacactgtggg

SEQ ID NO: 45839 - DNA, 1064 bp, Bovine  19866880878817
caagatgaagtacagttgaggagggcctcgcagacaaagacatgagaagagctggaaacgaccaactcagagtgcacatggtccatcccctctcattggataccacacacctgcaccttattgtccagcaggttagcacttaattggcttaaattatccttaatggacatacacagcattagccatggtcagttatagcaaacactgtgcctaattaatacatactgttccctaaaagagaaggaagcatctgggagatgcaggaggggaccggctatttggtggtaaacagcaagtagtccagaagctaccatctcatttagctaattacaaatctgtttctggtgggtggggggggatccgggctgcggggcagaagaaacctgaggcagttcacctcccttctcactgaggaatgaggcagctccagtgggaaaacagagggggtttctacttgggggaaagggacagggagctcaaggccctgtcctctgcactgggtcctgttttctgaagcctcctcgcctgactctgcacagggcagtccaagggcctttggggaaagatcaccagggatctgcaatcagagactctgctgtcccttccagaaaccaattaccccacattcaggtcagaaccaggggaggcttgggacaggtaacccagaggctctgggcctcggctgccttgtctatagagaggactgggccagaacagcagttcccaaccctgtgcacacattacaatcacttttggtgattctgtgattaaattagactcaggcagcaggatctgtaaaactaaagtgaaaggcgctcagtcatgtccgactctttgcaacaccatggactatacagtccatagaattctccaggccagaagactggagtgagtagcctttccctcctccagggactcttcccaacgcaggaatcaaacccaggtcccctgaactacaggcggattctttaccagctaagccacaagggaagcccaagaatattgcagtgggtagactctcccttctccagtggatcttcccgacccaggaatcgaaccagggt

SEQ ID NO: 45840 - DNA, 1028 bp, Bovine  19866880922630
acacttttccattttacattacagctgctgctgttttcatccttcggtcagcgttcaggaagacttgcctggcttcctggggcacttagtcactcctccctctggctggcacagacctgcgctgagccttgcttagaggattatgtcacattctctccccagccagaccttgagttccttgaaggcagaaactgtttcttttcacctttataacccaatgtcgaccactatgcctgccacaaagtagggattcaataaacactgaattaatgcgagaaggagaaaacctttgataatgtttttgttctgatgtttcctgccatttttatacacctttatgtagacacatgggacttcccagtggtaaagaatccacctgggatgcaggagacacaggtttgatccctgagtcaggatgataccctggagaaggaaatgacaacccctgccagtgttcttgcctgagaaatcccatggacagtggagcctgatgggctatagtccatggggtcacaaaaaagtcagacatgacttagcgactaaacaaagcaatgtagacacagtggatttttcactgaagatagtcattctaaatgctcatagaaggtgtaagtttttcaaaaagtattaagtactcttggtccactccaggtgggggcttcacctctaagagaggaatttttggaagtgttggaaaattggaaacaatgatgtgtgtttcttatgggcgaatggaagatctggtgttctcaggagcagctactggagatatttttatttggaaagatattctcctactgaagacagtgaaagctcatgacgggcctgtgtttgctatgtatgcattggataaggtatggtctattttcctcactagctttctagaactttaaattaggcttagcacggtccacaccaagaggatgcctgtgtgtaaaaacagtgctctctgaattgggatggtagttgtcacggatggaggcgaagcacaagtgttatttaaatttctctttcgtttataattattt

SEQ ID NO: 45841 - DNA, 1281 bp, Bovine  19866881003533
aacagaatgctctctgtataggtaattaaatttctagggaacggttttatttcctcaggtagattataatctcaatgccaagaatgtttaatttcccgacatgcctagcacaatgcttcgcacgggaggggtgctaaataaatatgaagcactcagtgaatgattccaaacatttgtgaaccacttctttttgtctgaaactttgtctaaaacaaacttctagtctttctggcttcatcatgccatgaataaatttctcagctaaaaaaataactcaatcctcaagtgttcctgctgctgctataatagagggtctcggagacagaacctggcaaacaataccctcttgtcgcatttaataagggtgagtcactttaaactagacaagcgagcactgtattccagaaattgtctcttcccactgtgactgaaaatattcattgattttagatatattaaactaaaaacacactcagaaataataagtaactttcatatgtgtgtatgagtatggttgataccctccatactcaaaatgtgctccatggataaacagaatccatctcacttgggagcgtggattagaaatgcagagtatcaggctctatctcaaacttactgaatgagaattcctgttttttaacagaaaccctaggtgattttaaaagccttgaacaagccccaaatgggcagagctggttgcactggagttttttatgtaggctcccgagaatataggctttctgtcctttcgaaatagtctatacccatggttcagcacttgccggaccccactgccagggtttctcatttagtaggtctgggatgggaccccagaatctccatttctaaccagcttccaggtgatgcctgtggtgatgctgctggtccaggaatcacaaccactgactcacatcacctaaaaatcacatgttgcatattcaggggattctgcttcaactgcactcccaggagaagggggaatattaagatagcagagagaaaagagcaaaagaagtggcagcaaaacgtttcatttgtgttacaggaagatagcagttaaacgttcctttgtacacagtggggtaaaaatagttgaagaaattactatagcaacagctgtgttatcctctaggtttttctctactgacaattcagaaaaggaagcctgtcttcccatcttacagaaattgtttaaacactgagccttatcaaaaacaaaagccacaggaaacagatcccattcgttaagggactatgaggtaacaatacagatttaag

SEQ ID NO: 45842 - DNA, 1612 bp, Bovine  19866881004017
tgtctcttggctgagctgttaaagctcttgagtgtgtgctgatgttccctatccttcccaaagcaagtgcattctcacagagtttttctaaagagaacaccttggcttgactcacggatccccaaccagttagttggaaaactcagtgaggctgatcacggggcaatccttctggctgcattccccatttcctgctgtcccagcagattccaataggaatgcctgcaggatcaaaattctggaattctttttgagacaaatttcttgtcaacactaacatacaatcttccccataagcaaacatgtcctttctccttcacactctcagttaattgccaggaaacagaggaaacaaatattctggtagaacttttgatggcataagacgcatcacatttagagcagtagggacagaatggagagtggccgtaccatccaccctttgattctggcatcactctaacccatcccaccccagcgccatgtggacatctccaatactgacaaccttggctgcttcccattggggctttctgcttccattcctactcctcctttgatttgattattggagcagcaatgggtttatccttgagtttacatcatgctgatccccttttctgtggggatccagtttttgttccagaccctaatgcaggccctggtgcttttaactattgttcactgaccagtgattcttccaagtccacctgatcctgtttcaagacaccaggtcctgacagtcacagctggtgagccatgtatgccagatcaaacctgggactgttttccaaaaaaccttgcctggctctgaactgtctgtcccacaagcccacttccattcagttccaaacccttgaggcagcaaacccaagctcagttgactcctgacttgactttgtatatgttcttccagttatttgacttggacttccctctacaattgttagcttggtccacctgtgtgctctctgtgtcatctagagacttttgcctgactcaccccagtacctgcccccctacaagaagtcacagttccaccaccaccattgtgggactcctggagaggataagccagttagggaaataattttacggagaggagctttttgattttctttaattcaccatgtaggtcaggagattatttctcagaaggaaatataaaataggggatgtaaacctggagtcttggtctagtcaagaaggaggtacaaacattttaaagagaaaaagtgatttaatctctctcctatcattccgccagatggaatgaagtcctctgggaatgtcgtgagggaaacatttatcaggaggatagtaaaggacttaggattattttgttatccaccttctgtaagcaagcacttctttttgcttttgtattttttttttttttatggagaaaaaaaagtgttgggtggaactccacgtgctttcttatgtaataaaaaagtcaagcaaagggcatgccttggttcgtcttggactcggcagtctgccgacattatcacaagtgctgggaggtggaggctctatgcgctttggggattatcacgcagtttctttctaagtgttaagcctctttctatgcagaaagggcccatcacag

SEQ ID NO: 45843 - DNA, 614 bp, Bovine  19866881024822
ttatggtaacttgttaaggcagcaaagggaaattctatagccactcagtcttttaactccattcctgtgttgttggaatccacaccctcttgaagcagaagccccctgtaaaaaattaggatacctcttcctggcttctcttgccgtgaaagagggcaagggaccctggatcctgtgtctaccaattatatgcacctgctgtaaaaaaaaccatgagccttgagccctggccctcctggagatgctgggagcttaataagttccttttctgctaaattagccagagttggtttttgtgaattgtaactcagaagcctcagtaaaccaggtatgaacagataatttattcaaaaggagaaagaaactctcaagctcaggagaggaagtttaccttagctggtagtaaaagaaactcaaagcagggttgagatgctatattataattactaaaattaaaagcaattgtttttgtggcaagacggttacttttgtttatagctagtaactatgtggatgcactgtatggaaagtggtaataggaaaatgaaaaaaaaaatctgtaaacatgttcttagctcttgacctaccaattcccggaaaacatggtaagtgtg

SEQ ID NO: 45844 - DNA, 1204 bp, Bovine  19866881070729
ttgtcatgattttctttctttcttttgtttttactcctttttcttatgggatgttcagatatatacaggacaatgaaccaaccccgtgtgtctgttaccgagtttcaataacaatatctgacattcttattttacatattcctccaacttttcttttgttattgttagagtttttgatgcagatttcctgcatcatgttacttacttgtaagttacattgaaccatataaaatagccaatgttggacaaaatttggaactacaaaacttaaatttcatgttgttcaatctaacactttactgtttttctctaaaagaaactccatatacctatcaaactatttttctaacccccagagaagatctacctccaaatgtccaagtgcatcttataacctatcagttatacttttccgcagaagcttgtcttcctctcttcctaaacagcagtcattctggtgtttagtgccttgcccatttcatagagtgggtttctcttttcctcagtcatgtgttttcattcctttagtcccttattttagtgatttagtcccttattttgttgaaacctaattctcctatgcttccccccaaaaggttcctgagagacaaaaagtttttgtccttgcctgccttcatctgccctcatactcggttgttggagttataaaatcttatgccccaaatcatcttccattcagaactatgaaggcatagttccgtgacttcttgtgttgagagatttgatgtcattttcatacaaaggtttgggagccatacctgtttgttcctatcagaaaactttttagatgttcaatttcttcctctttttctgcattttcacagtcatctaccttcatgaatgttttaattccactttagatgttggactcttagagaagaattgtcttcctttgacaatttctttctccctcactgtttaaaattttcttttttttggcttcactgagtcttcattgtggcatgcaggctttctttagttgtggacttcatttgttgcagtatgcaggcttaactgccccacagcatgtgggatcttagttccctgaccagggattgaacccaagtcccctgcattagaaggcgtatttttaaccacttgacctccagggaagttcctctctctcacttcatggttctcgtcttttgagatttctacgtggccctaatcctctaatttttga

SEQ ID NO: 45845 - DNA, 3286 bp, Bovine  19866881109904
atctccttgcagtccagggattctaagagtcctctccacaccacacttcaaagcatcaattctttggtgctcagccttcttcacggtccaactctcacatccatacatgaccactggaaaaaccatagccttgactagacagacctttgttggtaaagtaatgtctctgcttttcaatatgctatctaggtttactatgtcatttaatattaggcatcagttttctaacatgtaaatgagatggttagataaagtcatgttagttctctcacatcacgttgtatgaatttctaggagaagctaaaagcttatagtttatgatgacatacaatagaaataaatttgttcattcagggacttccctggtggtccactggctaagactctgtactcccaatgcaggcggcctgggttcaatccctggttaggaaactagatcccacatgctgcatctaagacctggcacagccaaataagtaaataaacattaaaaaaaatttttgttcattcagaagcctgagggaggtgttcatccagctccaatgaaattctaaaattacaaagtttaaatattagaaagaaggaagaacccaccctttgttgggcatctatcatctcattcagtcttctcaacaatctgtagagtatcttccccctttaatgtctgggggaacggagtctcagatgttaagtgctgcggccaaggtcacacacatgttatgaggcattgctgaccttacacaccagctcttatggactcccaagacctactcttggcacgtaggacctgtgttaccttctgctcacctttgctcagtagatttgtagggaccaacggcttagacatctgactagggttttccttttctttctcagagacctgtaagaaggcgctgatgtggaggagcagctgagacggtccaagatgacgaccacagtagccacagactacgacaacattgagatccagcagcagtacagcgatgtcaacaaccgctgggacgtggacgactgggacaatgagaacagctccgcacggctctttgagcggtcgcgcatcaaggctctggcaggtaggtctccctcccgccccaccgtcgaggcctgggatgccttacagatccctttgaaatcaggcactctgttgcccttgcacgatagactcatatctacttgaccatgtcctccaagagcaagctgaccattttagaagatggccagtcccctatttggagaatggtcagtctcaaggccagaatgattcagagcacagggtgtttgtatagccattcagaaagagttgccctgtgtttgtcagactgttttatttttagcacatcttacgtttcagaatattgaagtgtactgtaccttagacataaaaatacagttgaccgtggaacgacatgggagttagggacactgacctgctgcacattcgaaaatccacatttaacttttgactcccccagaacttaacttctaatagctcactgtcagaacttaatactaacatcccactgttgacctgaaaccttatcgataatataaacagttgatgaatacatattttgtaagttaaatgtattatatactatattcttgccataaagtaagttggagaaaagaagaaaacgttaataagaaaatcataaggaaacacatttactgtgtatctgtatatttattgaaaaaaattgtgtaagtgtacctgcacaattcaaactcatgttgtgtgaggcgggggtccccagcctctgggccatggactggtacttcctgtcagatcagcagcagctctagattagaaataaagtgcacaacaaatgtactgcactcgaatcatcccaaaaccatccccctactcctggtccatggaaaaatagtcttccacgaaagtggtccctggtgccagcaaggctggggactgctggtgtaagggtcaacagaatacaaataaacacgtttacttacggagtgtgctacatgaattaaccagatgtgttacagtactcactttgagtggctaaggttagtttgtatcacatggcagaagtttttgatctgaagagcagtagcttaatctggtgagggcacatttaatacaggtaagtctgccattgatcaagttaacaggcacgtgtcccctacgttgtgatttctcacccccttgttgctgttcagttcttaaagcacacttttaccagggccctaggtgagcagggagtgttctgtcctgagatggccctgaagatcaggaaggggctcagtcacagtgaaaagtcagcagtactgaatacatgtaaaccatgtggagtttattcagaatcttgcctctgtactttgagatttcaaataaaatgatttctgagtgagaaaatcaggtttatgtgttttttcctgatatctttaattatgacctataaattgaagtcacagcttaaaaaggtaagtttactgttaattgtgaagatagctcacttttttgttacctttacagcataatgtgattaagaggcatgtactgcttagaggaggaacttaatcctgaatggtttagatgacaaagagaagtgacagagcagtagataaattcacctttaagctagacttgctcctgaccttaaatggtgtgaccaggatccattttctgtctctctgcattttggctttgcttgctggtgtagacgccattatcaggtaggcttttgggtcctggagtcccaggatggctgccccaggttccggatctgtctgaaaggacatccagcagagaagcacacctctgattgcccagtcttgtgcttctccgaggccctgggatcgcctcaccagcttgactgattatgctcatttcacatgcctctctcagaacctttctccactggagtcacaagaggttatgctggttgacatcagctaatcagggtgcatcttggagtgcagggaatggggagtggtggggttgatgaggggtcagtcccacccagacagctaggctaaaaagtgtggaatataatgggaaaagaggaagagggaaatggatgttggggatgaagccaactgaatgctgtgggaaaattttcagttgcccttaggagagtttgtttcttgagtggtggtgacttaaagatctttcttgaacttacctgacttgaggtaagttgactcaagtaagtgactaaccagatagtcactctagaattggagtgttgttttctagcttattcactaacatggaacctcatggaaaccatgatcctgtcctgtgctagtggattgattt

SEQ ID NO: 45846 - DNA, 1329 bp, Bovine  19866881149015
tggcaaacacttgctcggcgtggaagacctgttacagaagcatgccctggttgaagcagacattggcatccaggcagagcgggtgagaggtgtcaacgcttctgcccagaagtttgcaaccgacggggaaggtaaggatggaccgacccccacagtacctcctcatcaccagaggcccatctctagagacttggatgagctgtgtggtagtgcagccttgaaaggtaccagccacttgtgggttcccagtgggccgtgttggggatataacatgatgctgtagggtggccttctgaacacttttaactccttcttacatttttgaaatggacctatctttcccttcagtacccaagtgctacttgcttatgttgggcagtgaactttgccagaccacactctgcacacccactgcctggcatggctctcttggctttcacacctggtcgtgcagatatttgttctaagtttgtttggaaaggattggttttgtgcatgttcagaaacatttaaatgcagctgccttcttgcttatagtttgcctcgttttttggttcctgagtgacccaaaagaaaataatacttcaggggaaaaaaataacattgttcctccctcctctaccaatcaagattcaagaaggtggccctgcactttgtatgaatgggggacctaggaacgagaacaggggtgtagccgactgcctattgtgcacgggagcccatgctactgctgtcacacccatgtgcccgccttgatgttacacaggttacaagccctgcgacccccaggtaatccgagacagggtggcccacatggagttctgttaccaagagctttgccagctggcggccgagcgccgggcccgcctggaagagtcccgtcgcctctggaagttcttctgggagatggcagaggaggagggctggatccgggagaaggagaagatcctgtcctccgatgactacggcaaggacctcacaagcgtcatgcgcctgctcagcaagcaccgggcattcgaggatgagatgagcggccgcagtggccacttcgagcaagccatcaaggagggcgaagacatgatcgccgaggagcacttcgggtcagagaagatccgggagcggattgcctacatccgcgagcagtgggcccacctggagcagctctcggccatccgcaagaagcgcctggaggaggcctcgctgctgcaccagttccaggcggatgccgacgacatcgatgcctggatgctggacatcctcaagatcgtctccagcaacgacgtgggccacgatgagtactccacccagtcccggtcaagaagcacaagg

SEQ ID NO: 45847 - DNA, 1132 bp, Bovine  19866881215701
cttttgactatgagacacctggggcgtgtttctatgaaaatatcttattcaggccatcattccatatttactgcaagggtacaattattctactggaaaattgtgtagttcatttgaggtatttccctaaagagttgtaattattatacctcatcttagaaaatgacataatcactgtttgttttttaaactcgaattctcctccaggtctcgaatatgatagtttccttaattgctggggaaaatagagaatataggaagaaagaagagcttttttaaaccattgacagcccagggcatccctctttggagagcaagcatatgtaaagacaatctgtctcctgaaagtcagtcattttcctagacagtcaatcatctatatgtgcaagtctagagctataaacatcatttttgccaatgcattctcaatgccaagggatcgtaaatttctctgggttttgagctttttaaatcactctagcttttgaattaccactttcaacaatacagtctagtaaattatttatatttatgtaaaagtacagactggaatcatttttatcatatctaattattcatttccaattacatttcaacagatattacagtaattgggttaaaaggcactttgttgtgtactatttgtaatagtgaaaaactgtaagcaactaaatgtgtctcagttgattaaatgcatatatgctggcatctacctagataaatgcctataaacacccaactgtaaatagtagtgattcttgtaaagcaggatatgtttgggaggtacaggggggagtctcattccacattacatttctgcattatttgatagttttacaaccatcttgtttcactttttcaacttttgcaaagacttaaaaaaaaaaaattctaaaagaacaagtaagtaccatatcagacagaaaaacatgtcagttgagaaaaacatgtcaaaactccttccattctcttccgcaattctacaactgacaagttcatgagactgtggccaaaatggctttcccctcctgttgactctgtcatttgaaatatctactcaaattttactaacaccatcttaagtaaaattctgaaggtctgtcatttctcaggtgagagaatcaagtattaa

SEQ ID NO: 45848 - DNA, 936 bp, Bovine  19866881278143
gacctggccatttcgtaaaggaacaaccccataatcactgtctataggtctgtcagttttctcaaagaggaatcctcccaagctctgcctggagtaggggagggtgcagcttcaacttgcaccactttgcacgctcctggcctcagaagcatctgatgccaaacactggggcaggaactagattaattttcaccccacctcctcctccacaagcacttagcttccagttttctgggatctactcaagtcaactgccacttatccatctgctttccaacctccaaatttgttagtatctttgctcatatttagttctcttttttttccttaaggctttaagacattttaatttctttactatcactgtactatctttttcctctttctgtctcttcctctctctcttgttcttttattggtatttctcattgccaagatcattactatattccaggtcctaccactatgcccagactcaacaattatttattaagttaaatgataattcatattattcagtagattatttattttaaagtcataatataacttaaactaataacataatataaacctgcaatttattcatagtttagatggtgtttggatactagatgagaatgattttagtttatgtaacattttacaatgtgtatataaaccagtctgtatgtcagatttttaacatatatatacatgtgtacatgtttatatatattcatacagacagaaaatgtgtatatcaacatgctttactaacaaaagtcatctcatagttattcttttccatcagcccacttaattacgcatggcttttggcattttagtaatgtcatcttgtgctgataatgaaagtgccctttatgtcttgtaccaccacacaatttccggctgccacccaggtcagttcaacaaaggctatactccatcatatcc

SEQ ID NO: 45849 - DNA, 1227 bp, Bovine  19866881281641
actgagccaaaaggcaagagtgagtagtgctagaaataatttaagtaaaatagaaatcagtttaggaaatattttgatattctaggtattcatgcctttgaattaagtgggtatgtttgtgtatcttttactgggaggaatgtttgtagttttcacactgttaactgtgcataaaagggttcaaaattttagaataaggaggaaaattcaagcatatgggagaatgttatccttaaatttaaattttatttatagtaatagtgatgatgtggttacattgatcactgatcagtgtgcatgatctcatgcttaatatccttatgaagttgctattatcctaattttatagatgaggaaactgacttctagagaggttaagtaatttatccaaggtcacatcgcttatatgtgctggagccaaaatttcaaccccagtttgattctaaagccatgattaacgactatctaacaaagcctctcatatttgttaattacatccattgttgtacaaaacaaagttgttatatttataaatatgacatagaaatatgtctcatgtctatcactcattgaagaccacacttgaatttttggtgtagtttattatccctttttcattttcccaaattgtaatttttgaggttattgatcaaagaaaaaacaaatgtgagggcctgtatgacgattctgaaatttctgtacattcaaaggtttatttttttttctgaagaaggtaatttatcctgatttgtcttgactttttattggtggacttaaaggatcatgcctggtgagaagagcatttactacagctatttgaaagacttttgcagtcttctcccttttctcaggccttctgagggaggcattggctgccactctgatgtctgtttctgataagtgagttttagtctctaacaactcctgggaattttgtcggcagagaccgggtgagatcattttgctttccgctgagtttcctttctctgtttttttggactgttctgatgagcatgaccctgaagcattcagtaatacctctgttctctcaggaactgttggcctactccctggttttatctctgtctgcacaaaaactccatgtctctggaaaggaaaacaaagttgatgttaaccagggcacacaagttgctggaagacgcagctgtgaccctgagttcatgtattagctcaagtcctggttgaaacaggctcttacttctctgc

SEQ ID NO: 45850 - DNA, 2243 bp, Bovine  19866881340449
tatatagaaatagataacgcagcgtttgcctgatctttggagagaacgcctccctttaatttggcgtcctaagcgtccctgctgcctcagcctggcccagctctgatgtgaactgtggtttagaatatgtgcaaacgcagtacctgaacaagcagtgtcaccgggccgctcttatccatttccaggatctctcccattttttgttcccaccaggatatgtccatgtcccagagtgatggcacgaattgaaggattatcttccaaaagcaagcctgaggaggggaaatactgcatttaatattgtaaatgctgtatttaatataacaaaaataaaatgattatagtgattctataaattctggttttatagttccaaagtactaagtacaaggcaatcctctgtggtatttctaccaacggccacaagctctgaatgtggaagaaaaagggagagttgattcggtcatggttttctaagaactttattcctatcttttgcatttctacgaacagaaggacttccatcgcatactcgggagtggcaccttttgagctagttgacaaggctgctcttttaatggcgtaagtcttcaagcatctttcaaacatatcatcccagagctccacaattccatcctttccacctgttacaaaaccctgtgaaggcacacatcagaaggattatatacacatcaaagtgacaaggacccacccagtctcaaaaggatccctccttgggtaaagaagcttagtctgtcttttcttcctaagtatggagactgaaaaacctgatgataacatcatattttctggacacacctctcatttctctagcgctattaaacactttctcactgggtgtccatttcactttcttcagaccactgattcgagtttagcaccctggatttcggatggctgtttccgtgtccagttccctgactgggatgtggactgctagagaacaggaccagcctcaaagtttgcagagtttctgatatctcatgctcctgctgaataaactggaattaatgtcacaatcaaaaatgattgctaactatttttaaatatttacttccaggaaaaacatcattatttctctattaagaataacaagtatttcatgtaacaagaatatcttgctctttctgttcatgagatatcaatttctaccataattaagatccagattaatttttataaaacctggaaagtataaagcctatactttattggatatttatttatgtatattatatatttatttatgtaatatccaatatacatattggatatttttttgctagacaatgatctttattcttattctaattttatgatttcttggccttattagttttcctttctggcaactaccaactgttcttagaaattttttaaaaagaaaattactgagtaattcattctgttttttcaaaaacttttaatttacttcatttcaatgatgttgaaaaggaaataatattttgaagttattacattaaatatcttaaatatccttatttatccttattatagattgtgaacctatagacatttactcccaaaattaaatcctgccttttcccatgatctttaagcttaagttactaagcaataaaagagtttaaacatgctatatcacaccaacttccaggcctgcaaaaattttctttctgctttaatcttttctaaaatttgcagtttaaacaaaacaaatttgctagtgaaaaacagctttaccactaaaacaatcattgtaattacacatctaacaagaacctactactatagcagaatcagcatatttacctgggaataagcaaacgcaaaatgaatcttctcttaatatgctgtattgggtggcttaggctgtttggaggtcagataacatacataaactggaaccatcagcaaactagcagtgaataaaacacttctattttctggcaaattgattgaaggaagtgttttaagagcgctgaaggtaagtatgatctttttaaattaagcagaatttttttttggccatacgttgaacataagggatcttagtgccttgactagagatggtacccatgccctctgcagtggaaccatggtgtcctaaacactgtattgccagggaagtccccagtgtgatctttatttagaaagaacaagaacaacaacaccgcaaggcaggaggttagcgggacagatcaggacaaagacgagcctgagtagaaatacagctggtgtga

SEQ ID NO: 45851 - DNA, 1761 bp, Bovine  19866881381948
caccgtgctcatcacactcatcaagtctctgtacctcacaagtatcagtcattaaccacataaatctgcaagagacaagcccagacttgatttttcaaaaacatttccccacctatggtacaagacacttcacagccgccacccaccaccccccttaccagtctctctccagagaggacctccagtagcttgatgagcatccgtccatcccgaaggtcagtgtacagatctgtgatccggcaggacacccgggcaaggtgggagttgacccacttggtgaaggtcttcttttgcacagcttcacgttcatctgtaagcagaggagaacttgctttaccaccaatcacagccttgggggtggtgggtgaggggcatgagatgccagccaaaggaagaagagcaaagctcaactgtaatgaacctcaaagtcaacaactcgggaacagaagaactggacaacccttgactgtctgagcccctaagcataaccaccggcagagcatcctttgcttgcactcacttcattttctccacctctgctgaggaggcagcaggatatggaaggccacagtgggcagtcccgcctgatagtatatacttggctggcgaagtttctaatgtgtgcgtcacagcaatcactcctctaaggcaagtgcaggagaagcactctgtgcagaaggacatggggcaggaaaactcagcagacggccagcaactgcttcttcatgtacaaagggtcaggcatcacctgacaggacaaactcacctgtgaccttgatctactatgacccttttgcctgcttagctggatgttcagtgaacaacagagaagatggtgggcagtgtggcagagtacaaggagcgctggccaagccctgggagagcagggcatgggcctgaggagacttggtcaaatacgttctgagaccctgggctcagtgtccccttccatagagtggacgaccatcatttccaagctttcgtggaagcttgtgcgttcgtggaaaacaccactgctggtttacagtctaaagtggggtggctgtacatctaaatcatcaaggaaacaggattaagctttccaagcctcagtgatcagtctgtccaagccaaagccagaaactctagacccaactgcctagaacaggcccttcgcaccccatacaaacaggcttcccatctccttgctctgcagagtgttttaaacgcaggccattgcagatcttcaatggagagccatggagtgtgcccaggccactgattcaaactccttgactgttctctaccaagctcagcagagagccacagagtgtgcccgggcccactaactcaaacgccaactgtcctctaccaagctatcctttaatcacatactcaccccaccgccaacagcatgaatttgtcctgaaaggacccaagacttcctctttcctgtgtgaggcccaagcccaccaagaagaaactacaagaaagggaggagactccaacaacgttttatgtatttctgcaccaccaagtggcaagtaaaaagcagccttgctgatggggcgtgtacttggtggccttggatgttctgggttcctaggatggtcagggggccctgggaatatctgcctggaaggttctgctaaggcctccacccaccacagggaggaagctagacagagacaagcctgtgtgaatcactcaagtcgtgtccgactctttgcaaccccatggactgtagcccaccaggctcctctgtccacgggattctccaag

SEQ ID NO: 45852 - DNA, 2183 bp, Bovine  19866881404681
aaccaggtccactgatttgcgatcatgcttatatctcaaatcagtggacctggtagatttactatatttttgtatgtagttttaatgaatatttaaaaataaaactaaacaaaatcatctcagcaaagtgaagatgatccttcctttcaggccttcaccatatgtttgaatgtttgaccaaagtttatatttgaactgtatgaaaaaaattgaggaaggcaaataatttaacatttttctcacaaggctgatcaccacagccaggtgaactctcaaagggcaggtttctttgtccattgtttatacatagtaggcatttaaaaggtactcaaaaaatacttgttgaattggacagaatcaacatgtctgtggctgcccttattaggtaaggtgaaatccgactagaaataaaagttgtttccctttcacttattttgtgccagagcccctagcccctccccccccccaatgttaatgaaataccaaagaaaacaatggcagtactgagaaatgcctgtttaaattctttcagtgttattctgaaattgtgactcttaactgtttcctttatcacagataacagtatttgaataaatcttcatttgatggatgagtcacctgccgtaccccagtctactcccccttactttaaaaatttttccttcagaaagggaagccagacatatctttagcaaggtactccagtaaagtggcagcaagtattcaaaaaatgtgaaagacaaggattcagagtttcactgtaaatacctgatagcaacctttggtgggaaaaaaacatcacccaggagagcccagggtatcactgaccaggaaaaattaacatgtcccccatccccaaaaaagtcaatctggagagatcactgaagaaggcacatatctctgtagaaggacagaaccgagaaaaagaaaaaacatttaggcaataataaaggtaactcaaaaggattattcttaagtatctcagatgcagctttgaagtctttcctcatattagacttaaggttgatttaaaggaacctaaaactcatcagtgtcctctctgtaacttcgtactctccattttcaaaaccttgtgagtatatatggctttgtcgccaggcattatttgtctccaataaagtggatatagcactttatttcaaattttttttacagatatatatagttactttaactttccattagaaatgtagggggaaatcttgtcaacctacttattagtcagtatagactaggttatgatgctgtaacacccaggtccccaaatctcagtataatatgctagttacgaatcagcaaaaacgttgttgcttatacacagtcaactgtggttccaagaaactctctgaggaagctgtcttccaaatgtcagctcagcattctggaatacttagatgctatggtaccttcatatcagaaatacttctgcccagaaatggcacaaagttttctccacttgcattttacatgacttgctttgtcaggtgactacaactaaaatcaaagattgatgaacaatagtgatgtctgccaccacttgttttatttagaaaagaggaaatggtactttatttacttgattatattagcccaactaatacctgtatacctacaaactattatgtataaaataagctacaacgacatattgtacaacacagaggatacagacaatattttaaaataacaaaaaaattattaagattataaactttaagttgtatatattttaccacaataaaaatttagaaaaaggaagcccatcttttattgtactaattaacatgctaaaattttaaaaggacacattttgaaaacttgaataaatttttttcatttctaatattcttaaacttgacttccttttcacactgaactagtctgagaagtctcctcatattagaaatgttccatctggtgatttacacatatttattttgcactggggaaacctccagacttacatgtttcaagtatcattaccattaatgaatagtttctgagcaccaatagcacatttattgctcagtaaaataattcattctttcaattattcaagaaatatgtatgccttaatctgttctgggctgtgaaataaagcagtgggcaaaacagtaaaaaaaaaatcactgccttcagggagcttccattgtagaagaggg

SEQ ID NO: 45853 - DNA, 1747 bp, Bovine  19866881464916
ttgcctgagctctgtatccattaaaacatgcatatttggcctatcatttaactatagatacctttcttggttttttacttttcatttttgatctgtaaacatttcatggagccacatacattgacatttctttctgatattttaaactctttataagattgcagataccactgccatccatatttcattaatgtccatgtttcttttagtttacctattaatttgtctttgataattaaattaatgtttcacttatttctggaaaaataagaaaaatctgaattagtttagtaacagataaatagcttaaacattattagtaaacaatcaatagatttctacatatttcatcatacttatgtggtagattaactggatactaagtagaattgaaccatctttgtatttcctcttttagatgcattaataaaattttagtatttctttccccactccagtactcttgcctggaaaattctatggacggaggagcctggaaggctgcagtccatggggttgcgaagagtcagacatgactaagcgacttcactttcacttttcactttcacgcattggagaagaaaatggcaacccactccagtgttcttgcctggagaatcccagggacgggggaacctggtgggctgccgtctacggggtcgcacagagtcggacacgactgaagcgacttagccgcagcagcattagtatttctttattgcctttcaccagactataaacttcataaagccagggactgtgtatttactattttgtgatctcacatatatttgaatcagaatggtactcaagatgagtacgtttaaaatatgtgtatatatctgtgtgtgcataaaaacttaaatgtagatacatctacatgtaggcactgataaacagtattaatatctacatgtatgtatacacacacactcatactccttgtttagactggctgataaaaggaaataacattgtaaaaaatgcatgaagtatttttaaaggatctctatgcaatgacattctgagactggcagttcaggtccctaatgaaagatggagagtgaatgaagcacattctgccacctctcctctccctccatcccctggaaatgagagtctgttcccttttcctccctgtctccctgtcttgcacactcccacttcctcttttaagcgcatcaatatagttcagaaactgaagatgtcaacctaaaaaccagcacttgtttcccatgcatcagagacagatgaggacattctcactatatggaacctgcaagcatcgttatctcctatgcttttacttttagttctttgagggctcttttttatttatttttaaaggataaaattgtccattgatttttggctagccaccaaaaagaaatcacagctagttgacaagaaactcaggagaaataaacagtaagggaacataagaaatgaacaaaactatgattccatggtgtcagagacaggctccatgaagatattttagcatttcaaacaaaattttgtcccattgcttccagtgggcataattgtttaataatctttagttgaaattatgaactaaaaatcataggtgttattaaaaacagtcttataagaacctccttgaattagaagaatatggaatctggttttggactttcttctggatcaaggaccagagtttgttttggtcactattgttctcacataaaataaaatttagaaggatataatgtacatcacaggaaat

SEQ ID NO: 45854 - DNA, 1522 bp, Bovine  19866881627677
ttattttctgtttcccaattgtaaaggattgcctgttgtatctcatacttaagtaagaatgtgtaagaaatttattctttagcttttatttgcagaatcagtgaagcagtaggtgttatttggaacaggttcagatgtgtctttagaaacagagctcagattttaagacctagttttagcttaatccatgctagaatgattgacatatcttttgaaacattcacttatgtattatatataagactgaagattatattttctagtgtatttaaataggaatgtaattctttaaccaacaagttcttttttttcccataactaatcttcttaataatgtctttcaggagccaaatttagaaagtatgtgggccattctgcacatgttacaaatgtccgctggtctcatgactttcagtgggtattaagcacaggaggggctgaccactcagttttccagtggagatttattccagaaggtgtcagcaatggcctgctggaaaccgcaccccagggtaaaaccagtaataatgtttcaacatctgttttttttttcaataaaaatttcatgtaatggcctgacatctcttctgaagataaagagttaaaccattttaaaaaattcattcctaccataaatttaaaaattaaaaaaaaaaaaacacagaaaaacgttttgagatatgggtcaatcgaatatgggtcaattggataatttccttcaaagaattttgcttatactaaatgaaagctgaaggtctaaagtttacatgaagaattaacttttgaaaataatactacacatacatttcagtctccttaggacaattctgatggatggtggggctgctgggtcaggtgacaaagtaacatttgaaataggagtcgccttcctaatagggatcaaagaatgatccacagtcaggatcagctgtgttccaggtcaatggatatgttggtcctttaatttattgtactttcagtagtaatgaccatgtactatgtgagggaatggtttttattgggagggattctgcagcagttttgaccatgacacttaccagcacctggtggtcatgttaacaggctaaagaggatttttactgaataagtggttgaatttccttctgacccagcttcctccgtggtaaaaccttcccgtctcccctctccccttttctctctttcaaagcaagatttaaaacccaaagatccattatccaatacaagtgtggaaatggtggggggagttacactagtctgttaatactcctaaaaagagggtgagaggtatgccaaacgtaaccaaaaatgaaagaaaaaagatgttttaagaatctacagcaaatgaaaattatggtgtatggtgtatttttattgaactcagtaggatagaagaaagaaaatatttttaaactttttagccattaagagtctcagaatttctgcttgtttcttgtgggggtatttctgcagacggtggtactgattcctacagtgaagaatctgattcggatttatctga

SEQ ID NO: 45855 - DNA, 632 bp, Bovine  19866881651577
cttagagagaattcgctggcagttggaggctgtggttggcatttctcatgcagaattgtggtgtggtgggggaaggcactttatgttaggactttgggggaaagatactggtgtattttgtgtgaccaagggaagagccaaacagccgatcagaagagaaggcaaggtgcagacaggccccagaacaacagaaagtaagggtttctattcctcagtctgttgattttagcttctatttctgctcctgcaggtagtcttccaggtagcagggaatgtagctgccatgtgcccctgagctttgctatccacctcttgcctcatttttctagtttcagttggcaacattggtggctgtttgataaggaggctgtaatttactagactttggtcaaggggtaacttgacctgaacgggtgaactgtgatgtgggggtgcagagggatggaagaacatggtagctctccctggaaccacatggagctcttcctacaaaagggggtggatgctgggcagatggcagtgcataacagtagatgctcatggcctgttttcggatagattgatgttcttgattcagagataaaactattttataaaatggcacggtgactttcaccattgactaactgctt

SEQ ID NO: 45856 - DNA, 726 bp, Bovine  19866881912629
gcaactgcatagcctgtgtgcaagacagtgtgagcagcagagacagtgaggagggaaggggcgtctcggatcctcgagatttcaggctccttctctcgcaatagcctgtgtgcaagacagtgtgagcagcagagacagtgaggagggaaggggcgtctcggatcctcgagatttcaggctccttctctcgcaatagcctgtgtgcaagacagtgtgagcagcagagacagtgaggagggaaggggcgtctcggatcctcgagatttcaggctccttctctcgcaatagcctgtgtgcaagacagtgtgagcagcagagacaatgaggagggaaggggcgtctcggatcctcgagatttcaggctccttctctcgctcaaggctgagggaatgctgcttgacctaacgcgagacatcgccagactcggagttcattagacacagcaacaattcaattaatatgtgttgagagttaaaataaacacaccaaaaactccaacaaaatgcccgaggcagactttttagaaaagcctaaccagttctaggcatgtatctgacacttagtagatgtctaataaatgcttaatgagtggataaatgaatgatgcatcttatactgtgtgaataattactgtactcctttagacatactcatttataaccattaactccaagtattttattaccatatatgtaattcattttgattgccatgtgttaacactta

SEQ ID NO: 45857 - DNA, 3338 bp, Bovine  19866880144045
actgatcttctttagaatggactggttggatctccttgcagtccaagggactctcaagagtcttctccaacaccacagttcaaaagcatcaattcttcagcactcagctttcttcacagtccaactctcacatccatacatgactactggaaaaaccatagccttgactaaacaggcctttgttggcaaagtaatgtctctgcttttgaatatgctatctaggctggttgtaactttgcttccaaggagtaagcatcttttaatttcatggctgcaatcaccatctgcagtgattttggagcccaaaaaaataaagtctgacactgtttccactgtttccccattcttttgtacatattaataccatttttcaggttcaatgagttcccttattttcctagtttagtaagaatttttatcctgaatagatactgaattttgtcaaatgctttcccacctttattgagaaatcatctggtttttcttccttagtctgttaatttgatagattatgtcaactaatttttttctttttggctctgtcacgtggcttgcaagatcttagttccctgactagggcttaaacccggccatggcaaagaaaaggtcaagttctaaccactggaccaccaggaccaccaactgatttttaaatgttgaaccagacccttcatttccaggataaaccccactaggttgaagtgtgttattatttttttttacatgttgcattccatttgctaatattttgtggtgtgtttttgcatgtatgtttataggagatactgcttttctaatgtctttatctggctttggtaatgaggtcatgctgtttgatttggagatgtctcctgttctattctcagaaaagattgtatggaattagtattatttctttgtcaatgatttggtagaatttgccagtgaagtcagctagcctaaaattttctttatggaatgatttttaaactacaaatttaatttctttaatagatataggattgttcatgttatatatttctttttgagtgagctttgctagtttgtacctatgaatgaactggtgtaaaattgtttgtaatattcccttattatcttttaaatatttgtagtgtctgtaattatattagcttgcattcctgagtttggtaatgtgtctgctttgtttttttttgggggggagcagtataggtagaagtttatagattttattgataaattaaacaaatttattttggttttatttacttttctctgttgttttcctgttttaatgttattgatttctgctctttattattttctttcttctgtttggttcagatttaatttgctctcttttatctggattataaaggcgaaagtttagatcattcgagatctttatttttttccaatttaagcatatgattttatacatttccttctaagcactagtttggctgaattgcatgaattttgatttgttttatttttattttaactcagttcaaaatattctaatttcccttatgactttttgatccctatggtttctttaaaagtgtgttgtttaatttccaaatatttgtgacttttccagatatctattattggtctctaatttaattctgctgtagtcagagagcatgcccttcatgatttcaattctttgaaatttgtattatgacctagcatatcatatgtctcgatgaatactccaggtgcacttgaaaagaattagtattttgctgttcttgggtagactgttctgtaaataccttattacatcaaagttggttgatagtgttgtttaggtcttctcaatttttggtgattttctattctaaccattgctaagagaaatattgaagtctccaagaataattaggaatttataatagctgtgtgaataagaaatatatttggtctctgcccccgctttctaacacaaagcttctaaaacccttgtaatttcctaagcagtggaggtgataggagcatcttacatagaggtcctaaaccccctgaaatgttctgagtgacaggagctgcttttgttctaaggagttgaccttggtgggcttctggagagcttcaggatgggagctggtcaccagaaataccaagccgtgacataaagcttggaattttcaagcctgccctccatcttcaggagaagggagagggaatggagactgaggtaatgattgatcctacctatataatgaagcttcaataaaaatccctaaactatggggtttacagagcttctaactggtaacacttgcacgccagggcataggtatattccagctttatgggggcagatgcttctacacatggaaccctggtagactttacactgtgtaactgttgatctatatcctttacaataccttttataaaaaaccagtcaccataagtaaatattttcatgagttttatgagccattctacaaattattaagcctgagggaatggttatggaaagccccgactttgtagccaaggtataaaaatgtggataccctagggacccattacttgtgagtgccatctaaattaaggacagttttgtgggacggagcccttaagtctgtggagtctgaccctacccagagtagaactgaattaaagtatagggcatccacttgctatccagagagttgaaaaattagttgatttggtgaaagaaaaaaaaaaaaaaaacccacatgctttgtttcagaactattctgtgggtagaggaatagttttcctttagttggtatcaaagaaatgggatttgcaagaatggctcctgtctcaaggaaacataggaaacatgtagtttgtgggaaaaaggggtgaaaggatgaggatggggaacttttgacccctgaatggctacctagccacccatggtatgaaacttcagctgcactgcagtaagttactaaaggtaaaaattaccaatggaatttagcagtggtggtagattccaactcctgaaaagttggcttattggatctgtaaggaaatgaaaaataataagaagcatgccaactatataatcccttggttattggtatctgtaatagccaaaatggaatgaagttctgggtcaggccttgttgctggacctaactctgattttggatggtctgaactttagtcactagtcttaaagcttccctcaaagagaaaaattatgctagagcaacagaaattagctgtaatatctctcgttgccaagaaagtagtcaacacaggggtttcagaaactcctgaaaccaagaggtttaatgtgaaggagctgtctcattttgtagatcagtatcatcagccttctgaaaaacctttactaaaatggatag

SEQ ID NO: 45858 - DNA, 933 bp, Bovine  19866880422030
ctgagagaggaggattcaactgaagagtgaatacatgagaaagaagggctctagagatctcaggctagagaggctgggatgagcacaagaccaggaattatctggaagatgaaaggtgtgactctagggaaagggaaacagcagaaggtttatgtttggtgtggtgaactgcacttctttttttatactagttagacacaagggtattgggttgagagtgaaagagagaatgggtgtcgggggaagctgaggtctgagctgagatttgacatccttgtgaggggtgtgaaagaatgagctgaccagagattgttttaggatggtctagcagagggagccaagtatgaagcaaaggccggaaattagccacttggctcctttggggaattgcaaaaatagtaggggagtgccacctactatttttgctaggtggcactagtgataaactcacctgccagtgcaggagatgtaagagacacgggttccatctcttgagtggggaagatcccctggaggagggcatggcaacccactccagtattcttgcctggaaaatcccatggacagaggagcctggcgggctacagtccatagggtcacaaagagtcaatacgactaaagtaacttagcacgcacgcacaaggatgcaggctagctagaaacagaagctacatttaatatgacataacgaaggaaacatcacaaatcatggggaaggaaaggattgtttaaaaatggtgcttagatatagctaaactattgataaagtctatttacatcctcagctcacaaccagaaatttcaaatgaattaaaggagctggcttttaagattcaaacagtaatatagaaggaaataggaatgaatttttatcttctcatctgatgcataaaagcagtaggaatcctaaaggaaagggatacttccctgact

SEQ ID NO: 45859 - DNA, 2221 bp, Bovine  19866880516454
cagcaggaccttatgaaaagaccccatttccccatttacatttgagaggctccttgtccaagcagagggcttttttttttttttcctggtgacactgaggagagacaacccagaaaccctttttatgcacagttgtaaattaatggtcctgtttcgagtaacacattgagtgggaactgcaagttcacagtttagtgtaaaaagaaaatagaaagaggcatttttcaatgaagccctcattttttttccctttaaataacagaaagcaattactctacttaatggctgtccaatgcaggttaattgggagcttgggggcaaggcaaggaacattgggcagaagagctgcaacaaggtctcagaggacacaaatatgggatggatgggaccaaacgaagagtcgagttgattcaaaaatgagcacagccagggcctctgctttccctggagatggggtggactcgcttccggcagacctactcctgacccagatcaggtaaggaggcctgcctggtctgctcactggactctaagtactgtcttgctaatttcctggggctcacggttaagaatcaccagcctgtgtcagtttggggacctttgtgagttagcttctcactcaaataacgtgagtggctcagttcagctagtaaagaatctgcctgtaatgtgggagacctgggttcgatccctcggttaggaagatcccctggagaagggaaaggctacccactccagtattgtggcctggagaattccaaggactacagtccatggggtcgcaaagactgagcgactttcactttcactttcaaataatttgacatacagagattccagttctagccctctgagttcaaaattcagttcaatagaacactaaatatttgacaagaatttcattgagttcccctcccctgtagcattttcttcagcttttgtttcacagactagttcactatgggtcattcgtgtattcattggacattcaacaggtatttcccaagctaagggcaatgtgttaggtgcttagaatgcagaactcaactggacacagcacagttaagcagaaaaagaaaagatgatttgaaatgggactctgccacttaggagttgtgtggctttcggtaaaacatttatccttttaagtcttagttttcttatctataaaatgagaataataatacctttcatgtgcttaaagcatttggcacacagcaggtggtctggaaatagtggatgtatttttgccccaagccataacatcaccactatacatcaccactgaaggcagtttggggttttaatatgatgccctgaggatagaagcagggtgtatacagaagtttcagtgggcaggggcagggtgaggcgggtgggagagtgggggtgggtcctgtccatctcctgctggtgaaatactcggtaacctttctgaattctcacatctccaatttagttttgaggacagcattcacaatacctggtacagagcaaactgtagatcctcagacctggaaggaacaaaggtctgactaacgttctgatattatagaggcagatacagtccacccatatcatctagaaatacccaggcttcccccagagacagggagtcatgtctagtgatgaaagctctgcctggagaactggattcaatttcaactcatcaactcacaggtgtggttgatcttagacaagttatttatcccttcttaccttcattcccacatctatgtggatacattggaagtagctcatgtagatttttcatagttccctagattaacatctattattgttggctattaagaaggctatagtcaggggctctgccctcaaccccgagcagcctagttcaagaagaacagggacagctgggaacaaactctctccatcccgccgttgctggaacaacagtggtttctggaatccgcacgggcagagtaacctttgaatatgaagaacagttctctatgtacacagacagggcaaggctgtattgattcagaccatagagcaagtcagtctaaattacagtcagatcagaaaagaaggcaattttattactttccatcgccgacgtggcttatcaacatgcctctgcacacacattctacggggctgacttaatgaatggagggaacctattcataattagcagcacctatttgtgtgccaacaattcatatgcgaaagtcaaattcaacagcaacgacag

SEQ ID NO: 45860 - DNA, 995 bp, Bovine  19866880588385
taagggagagggactggattccaacacttaattgccttaccccttctaaatggaatgggtcagagcccctttcagagtggatgggagtagcccagcaggtcaatggcagtttcacctgtggtagccatttttgtagagtactgaagttctagtgggtaggataggggtagcaggttttcctggttgtactcttcttgagttagtgcctttttgtctagagctgtagttgacttggcgttttatctaagattacccattcatctatccttgcccttgacattctgtccctgggttattaggagagaattactgtactaactcttcctagaacacatgagaaattcagctttgttctctatcatacctgaaactggcaccagccacaaatgcgccagacctagaattatggtcaaagaagaggtctcagagagggagctcctacatgaactccccctgagcctcagtactcggacagaataacagtgtatggaaagctcattttcccccagcactgtacatttaaaacctttttatctgcccagttgaattttttctttctattgaaatagaaaagaagcaagctcttgagtcttatagcagtaagctagtgattcttgtgggtctctgacattgtaatgtattggactctgtttatcaaaataagagttaatgctaaagagtattttaaatctgcaagtttaaatagttctctctagagaattacctgcttaattactaaaatgtagaatcccaggaatgggggagcctggtgggctgccgtctatggggtcgcacagagtcggacacgactgaagcgacttagcagcagcagcagttaaataagattcatctaaattagggtctcttcacattccttttagtgtccacaaaagaaatttttaaaaaatgtattagttcttaactcatttgtttatttcttaggcattccgtttagtagacactcttattaaggaggaaaaacctggttaaaaata

SEQ ID NO: 45861 - DNA, 2556 bp, Bovine  19866880595398
tggatgtgagagttggactataaagaagatgagcaccaaagaattgatgcttttgaactgtggtgttggagaagactcttgacagtcccttggactgcaaggcgatccaaccagtccatcctaaagaaaattagtcctgaatattcattgaaaggactgatgctgaagttgaaactccaaaactttggccaactgatgtgaaaaactgactccttggaaaagaccttgatgctgggaaagattgaaggcgggaggagaaggggatgacagaggatgaggtggttgggtggcatcaccgactcgatggacatgagtttgagcaaacactgggagttagtgatggacagggaggcctggcatgctgcagttcatggcgtctcaaagagtcggacaagactgagtgactgaactgaactaaactgaaacagtgagagaagcttgggctattcaaggcagtaggaaaaatctgcgaaagccaaaaggagtgaaagatactggtgtgttccaaatcctgtatgacgtgctcctcaggtgggaatggaagtgtatgaagagctgttggtctggggaggtactatgggaccaggacctttgcatccgtgaagatgactcttttgcagtgctcacatgtatgtacgggaggctgtgcagtgtgcagggctgagaacccggttccagagtcggttttcctgggtgtgaagcttgtgaagcttgcctctgcactcatcagcttcactcctcacgtttcaccctgctctgcaaacaaggcttcatactccgttatctgtaattgcaaaagccccagaggtctggaaaccagaggattttttttttttttcatgaacctggcacaaagtcatctggcagctgaacctggcccatcgggcgggaggctgtctgcagccttcttattccaagtggggacagtcctaggagtgtctgcaggagcattaaggtgatggatcctttgagtgttagtaatctacccgcaatatcatctttctaaaatttaaaaattcgttaattctcaaacacatctgggccccaggactgtggaaaacggattgtgtatctgtggcatctatctcatgggattgccaagagggataaaaatcagtttattcaagtggagcgctaagaacagtgccagacagcacgtgggtgacaatagacgggagctccctgtgtcattagttggatgaactatcaaactctaacatcccctgtctgcagagttggggtgcagtgagcaaccaggagggaagagagccaactgcgcagacattggcctgagcttctcgggggccacatgaaagcaggcctttgtgtgtgctgtttcagagaccagcaggcttgcccactctggccagtgctcccagtgggcaccctgtggctgcagcaagctcggcctggcctggcatgtggcagacagcctgcaagctcctggcagcccgaggctgtcttgtcattctcttgtcctcagcaccagctgggacattcgataattgttcactgaattgaatccatctattgactctagaagcagctaagtcaagtcttgcttgggaagctacgttattctccagcccaagagacacgcacacaggcatacacacatgcacacacccccccacacacacacatcaagacccaacctatattttgacccactcagggctccagagaaaccagtttcttgaagcaatgctctttttcctcctgcttttctttattggagactttggagaaaggaccaggagaacaggctttgttttacgtcaaaggtcattccctgctttggtttatgatttctggagccgccttgctgcctgctgcccaccagtacaaagagcagaggcatggctggctgcaggggctccaggtgtggtcaccaaccttccctccagatgggatccgcccgaccaggccgaaagtgcctgccctcaccacttgccaaagcaaaaggaggcgcctgcagagacccttaacccccttgtctttgccttgacttgagagattcttgagctctgctaaaacctgtccaggctttttacaactgggacatgccaaatctgtcctctgcccctgcatttttacataggatcccttctcgcaggagctgaggtcatctgaattgaaaacaaaaccgcgcccctcagaaaagctgagcattggggaattaaccttgcattaatcaagcaaaaaaggggaaaatctgaagagcaagtcctccctggcagccgtgaaggtggagctggagccagccagcgtgggctatttattcttcacttctgtgggcctggcaggggaaaggcgctcccaacccgactcactgggagagagggaagctggccagacagtgacctcgtgagtgggccgagtttaaggggcctctggcttgtggcaggcccctgcccagggccataggaattacagatggtaaggaaatctcatgtgagcaacatactgtgagggcctgcagggatgggcaggggtccttgaagggtgaccttaaaataaacagcgcctcttcaaagacacactgggatggggccg

SEQ ID NO: 45862 - DNA, 2072 bp, Bovine  19866880641430
tccgaccagtgatcaaacccaggtgccctgcattgggagcaggaccaccagggaagtcctggttcaagagatattgaggagccttgggttccagtcaccccccgagtctcagtttctgcctctgaaaagtggggagattatgtctgctatgtctattgcagggggacagggtgattatcagatccaagaggaaaagtccaggagctcaatggctggggtcaatgttgcaattggacagaaagctctaaggcaagggaaccaactcttgacaactcaaggtactaggatgaattagtgccactgtgtcattgaacctcagtctttgagagagaggcattcttgggtccacttcagagatgaagatactgaggcacagagaactcacccactgtggcgtcaggacagatgagcccagggagccccagtggtctgtcttatagcctgacccactggactgaagaagaaggagctgctgctcctttccagggtctccagggccatctgccatgcatcctatttgtaaaagctacaccacacactggggacagaactcacaccaactcaaagtattgctgctctaaggattaaataaggtgaaccagctcaagggcttggtatagaactcaggacacagaaagggctcaatatctcccaggcacttttgaaaataaaaatacaactacttcctctcctctattctttttttttgtcttctctctttaaattgcactgggagcctctatttctattaccaaccctaagattctaggtaaatgaagaacagattctggaagaagattaagttaactcagagaatccctacagatctccaaattttgtgatctgtctcttatccctaatacttcttagttgtatattacgatggttactgaacttctctctgtgctttagtttcctcatctataaaatggggtaataataacttccatagagttctcatgagaatacagagtaggtaaataagtatgtaggtaagtaaacaaataaatacatgcttagattaacacttgattgaaagcactacataagtttgcttttataatttacgctgaaaacacttacagagaacggctgtgtacttatagcccctccatccacacatcaagccattcaacgacttattatttattaaacgcctcctcgatggctggcacattcggtacttcacatctgttctctctgacagcaacaattcccaacaactgttctaaggtgctggagatccgaatgggaataagatgcccacatgccagcctcccacccctgtcactcccggtttagactaagatctcatttcacccaggtggccagtgaggcatcaggcaggccacagctttccagatggcttggtgcttcctcccccgagtctccattctcggtgggtttccttctctctggccaccatcccaagtagcacaagcagcccctcccagctggggcccagccagccagagccaggcactgggagaggtgccacaagaccagggttggttaatcttgcctttaattagcagacatgctaagtgatgaggcccaggggtgaccccacagatggctgcccactcagctttgagtgataaattggaagcatccaggtctgcaaaggtccatgttcacactggttcctgtgactgcgcttctcatacctgctgttcagtgggtgaggtgggggggaatggtggggccatccttggggccaaggtcccaaaggtgacacagaacaacaacactcagatcacacagtgactgtgagagttagatgttatatatcataatttcaagattccttgaaaactttgatgcaatgtgtgcgtgtgtgctaattcccttaatttgtgtccaattctttgagatccaatgtactgtagcctgccaggctcctctgtccatgggattctccaggccagaatactgaagtgggttgccacgccctcctctaggggatcttctcccagagattgagcttgcagcttctgcattgcaggtggattctttaccactgaaccactggagaagccctgtttgatgcaatagttaatgctaaatgtcag

SEQ ID NO: 45863 - DNA, 782 bp, Bovine  19866880654689
ttgttgctagtgacaatttgccagcctcccctcattccctagttttattgtggtggtaaatcagatacagggaacatctcaacacaagagaaatgtggccccaaagcctgcccaccatttatgtttcatgtctgactttcccagagtctaaagtctttgagggtcactgggatttatttgggacacttggccaagttcctgaacataactttttatagagtttttacccaagcctggttctcattgaattttaattatgtgcattcctactcttaacacaactgaaaataaacaacatgtgactatctttatcattttacctagtccttataaaaaccactccagtgacccatcacccacggtaaggtgagaaagccaccagaattaagctaagcaaattcacaggatttaatcacacattcagtgattcatttaacacacatttattgattcattcaacagtcattctttcattcactcaaagaatgttggttgaggacctacgaagttccaggcaccacagaagtgtttgggataaagcagagcacaggataaatccctgctctcatgaagctgacagtctagtggaggagacagaataaatcaggacactaatatcaaatgtcatcctgagtggcaagcactatgatgttcaagtttgggggatacaaagctgaatagttcatgcccctacagttagctgggatagtagtaaagacataaattgcaataataatatgatacatatgggattatggaattacatacacaatgcttatcaa

SEQ ID NO: 45864 - DNA, 1506 bp, Bovine  19866880740705
ctcacattgtggttgttgtttagtcgctaattctaatctgactctttgagaccccatgaatggtagcccaccaggctcctctgtccatgtgcttccccaggcaagaatactggagtgggttgccatgtccttctccagggcatctttcccactcaggaatcaaaactgtgtatcctgcttggcaggtggattctttaccactgagccatcaggcaagcctcacctcataccatacacaaagacaaattccagccagattaaaggctaaaatgtagaaagtaaaatgataaaactttgataaaacaaacaggagaatatgtttatgaccttggaagagaaaaggatttctgaatgagacatcacgagtcaaaagagacttatgagtgaatttcagctacgttgtgggttaaggacttcaagggtagagaaactaatcaccatgtttgacatggtttacacaggaaaatacttttcatattctaagagtataggactaatttataaatcctctatgcactcatttaaaatgtttaatataattttggttgtactttctaaaaatatctgcagctgttaatcaaagccaggtaaagcatattcacttaaagcagccagagggacttctctggtgatccagtggctaagactcccagctcccaatgccaggtgtcccggttcaatcccagggcagggaactaaatcccacatgcccacaacgaaagaattcgtacactacaactaaatatccttcatgctgcaacttaagagcaactaaggatcccacgtgctaaaactaaggactcagggcagacaaataaacaaatattttaaaaatttgttttgattgcagatgaggaacaagggatactcgtgtgctcttctaatggaagtagaagtagataccaccagcacctaacctatagtccagcaattctacttccaagtgtatttgctgaagaacttttgaaaataaatatcagaaggcaaagtatttatagcagcaatgtttgcaataatttaaaaaaaatgaaatttacccaaattggttgataagagaatgacttgttctttaaatggaatattaggtatgaagttggctgcctttcaaggtgagcaaaaaagcacatggtaagcaaaagtcacagaagactagactcagtataattctacttacataaagttcaaaaatacagaaaaccaaacaacatattggttggagactgttatgtgataagatcataaagaaaaataagggaataataaatataaaattcaggattgtggttacctctaggaagagagaggaatgagagcaaggagacacagagtgggcttggctacaaaggtattgtaattgtccatttttaaaccagctactgaattcattgggtgttcatggtattggtattctttaagccttccacatgtgttataattattactttacatatattcagtatccaataaaactgataagaaaattcaggtctttacaaatgcatggaa

SEQ ID NO: 45865 - DNA, 1460 bp, Bovine  19866880785591
cttacactgtttctaagactgattacttatagcagtatgttaagctccaaatgattcagaactaggagtctgcctagcaacttcaaagatgaacgtctgaagacagcagagacaaatcaacttgcaaagtccttcatcttacacctcatctgccttacagtagctatgtgatttaggacgagtcccataaatgcaactagcctcagtgttcctatctgtaaaatgggacaataaagtctgccttgcggaatttgtttgggatggcacactgtgaagacttagtgcaaggcaggtgtccagtacctattgttggctctctaaatgaacaacacttctttgatcccatcccttgaaaactggagacaataattcctacttcacatcacactaaatgtgattgtaaaatatatgtatagatgtatctatatattgcccaggctgaaaaatagatactcaaaaaacaaacaaacaaacaaacaaacaactggctgatcatatcatggactgaatttagcctagttgatggaacttatcttacatttattacttaggaaaatttttaactaaatattttagttctttttgaaaatgatttccaaatgtgaggaaaatttagctggaacaaccaattagcatatttcctagacacaaatcatcttgtgcacaaatgagtcaagaactgagagaaaaatgcctaaaaatagcttagagacgcaggtgaactggcttcctttgcttccctgctcactgtgtgcgtcgtggcctggcaggtgatcacactcacatcccgaatggcaaggctgattcgtcaaactggacaaacccctgaaactgaaatccttggtgcaactgtcagagcagcacaccccctggtcactagaccctgcagtgaaagctctgtgctgggggaggggcctacagatgacagtggtccttggagttcatgttcagtctatggatttaggaaaggaaaagaagcatctggaaggtgatcagcatcctccaagggggctgactccagatccagggcaggggccagaaaagttggttatctctctgggcatctgggtttgatgttcgacttctaactctcacttaacatctgtgtgatgttagaagagttacctaatcttgttgggccttgatatctttctttgtaaaatagggaagcactattttcccagttaacaagagtgtttgttttgaggttcaaatgagagccttaagataaagcaatacctagatatgaacctccattattactacagcgatagtagagatttacactgctgctgctactgctgctaagtcacttcagtcgtgtccgactctgtgcgaccccatagacggcagctcaccaggctcccccatccctgggattctccaggcaagaatgctggagtgggttgccatttctttctccaatgcagaaagtgaaaaggaaagggaagtcgttcagt

SEQ ID NO: 45866 - DNA, 722 bp, Bovine  19866880839750
tcttgtatcagtcaggttatgctagataatgcttcagtaacaaacaattcccaaatttcaacagcctaaaacagcaatgctttctttcttgtttaggtccaatgtgcaacatgggttgataggttaactacactacttgtagtgttcacttaggggcccaggctcttggaagcaccatcactgcacatgctttcaaaatttatgaggcaggaaaagcagtgagaacaaaagaacaacactctgacttttaaagttttcacctggaagttatacactcatatttcactggctaatgccattcatacaactgtatctaacttaaaagaacttcaaagcataatctcacatgtactcagaaagggaactggaatatttgtaaacaatcataagggctaccatgaatgtagcttctgctcctctgggagtgttattccataggaggacaatttatttgattgatagactctggaggagctgttctctccaagttcattatttgcaagcagtctggtcagttaaaagctgaggatgttggtgacaagcactgagagagcagcagagaacagaaaacagttgcttgagtttctggaccctctgatgtgtggcttaaatgagatacagatgaaaacttctccagaacactttctaccacccaaccccctggactttcaaggcttagccaaaactgacttcctggagaagacttaggggaccaccagacc

SEQ ID NO: 45867 - DNA, 1333 bp, Bovine  19866880862461
ccagtcccctcctgggactcatcttttccttcccctcctctgctttcctcactccttgggtgcggcgattctcctgcgttcggaggtgtcggttatgagctggaccctcctaccctgaatttctcggcggaggagctcggcggcgccgcaccgcgctccccttcctcgcccccgggatgggggtgaacgccgtgcactggttccgaaaggggctcaggcttcacgacaaccccgccctgaaggagtgcatccagggcgccgacaccatccgctgcgtctacatcctcgacccctggttcgccggctcctccaacgtggggatcaacaggtggcggtgagtcaaaatcctgtgggaaattgatttcgctgttttaatgaatcaagactttacatgccatcagccagacctgagaattgaactcttgcaccgccttgcccgtactgttttaattattgcaggtgctctaagcattaaatagaacggacttaatactgaggcgagagagttccggcagccagaaacaccttggccttcaggtgtgagttacgtgtctctgcgctcgtaggaattctttccctggatttatggagaattcttagtggtggagttaaagaaacacccttccagttctcagtggcccgtgtgttgatttccttggcctctgtggcatttgggattgcggtctttactgtttacgtttgtgtgttaactcatagtatggagaaaatcattcattcagtagagtcccctccaaatctagttttcttccaccttgaggttgccagagaaaaagcaagggaaacatttctttgctcagctcttcctctcaactcctccttgtggttggctagacaaagcacagtttttctttctaggcaaagtataatccttccaggatttagagcgcaggaagaaatcttagagaagctttatgatcttttcctgaaatgccaggccagatgattattaggccccgtggtggaaatgaaagcattgtttcaacagagtattgatcacctactgtatagcagggcttcccttgtggctcatctggtacaaaatccccctgcaaagcgggagacctgggttctatccctgggttgagaagataccctggcaaggggaaaggctacccactccagtataatggcctggagaaatccatggactgtatagtttttggggtcgcgaagagcctgacacgactgagcgatttcactcattatcactcacagccacagctttaaactgtataccagccacagctttaaacaccagggatacagtaatgaatgaaacaaatagaaattcttgtccttttctagcacatgt

SEQ ID NO: 45868 - DNA, 1924 bp, Bovine  19866880897784
tatgctccatcaagaggtggtcccttaaaagatgggaggcccagttatcagttgaaagaggggagctgtggagacctccaaacacttgttagaggccaactacagaatccagtctccagtgtctgagtgtttctcctcttaggcatcccttccaattctgagagctccttcctgtcacagaggtaatggttcagaaaagaaaaagccactgggaggctagttctttgtaggaggagaacttgacataaagcatactaatagggactcagagaatatgtgttggggcctgactcaaggatctaaagctgggtggagaattctgaaggaaagcaatagctgactcagccttgaccaaaaaaacacaaggaaaatgccagaaagggagagaatgagcctgtttagtaaaaagatgggaagacctggcagatatgattttggttttattcacagaacttatcaagttccagtaaataaataatcaacttgtgagcaggttaaaagggcagtaaaggtggcctctggatttgtacctgtgcaggttttcaaagtatgcagttgttttctttaactgccttcacctctgtccaaataaaaatgaaagtcccctttcaattcccttttgtggtgaaggtacagttcctttctctatcctttgcttttccttcatagtgctcagaccagttaggatgcttcaccaggatattcttagaacagttaggttgcagtaaacagaacacctgactaagagtgacttaaataatagcagttacgagtcttaggaaataagagatttccgagcagtactggtgcagtggctcaacgatgtggtcaaatgagggaggcgtgccttgtgccccttcctgaaatttccttccatgtgaatgacactcagtcactgtaagtcctgttctctttcttcccttttaccttctctgtccttagtggggaggagtggctaaaatcaagctccccttggtctctcctgctctgggtgtgatctctaactagtgctaagtctgcctaacttgggggagtcaggcccagtgattcttccatgaagttacatccacatatttagcatttatcagcaaccaaggtaatactgttctccttcatctctgcctccattacccaaattctcaattggttcatggctcagaattggaaaaagggagttattcattgggctgctttagactccagcagatgacatcaacagcccaggtgtgttcactctgcctactctgctatcatccgtctatcaacaatgtgtccccttagtgtcacaacacggctgccacagctgccaatatcacatcacatgaatgcatcccgagcaggaaggatggggaaaggggcaaaagggattttcccttgagaatatttcctagacgcccccaggtgactctcccttacagcctattcaccagaactgagtcacatgtccactccagaccagtgactggcagagagaaatggaagcatcatgacagtttagtccaattcaactaagttatgttgagtcactcagaactgggcatatagcctcccaaacaaagcagacttctgttagtaaaagacagaaggaacagctcaataggcagctactagtgtttgttgcattgctgttcacaatttgtggctgagtatttattggtatggtgattctttaatgatctgactattctttctagcttaagtcccaggaggcaggatgggtggctgtgttgttagtgctgtgccctcagaacctactgtagaacattcctcaaagttggggctcaataaatattcatgggaatatgtgaataattacatgctcagaattgctgggcactgtagtgaataccaagagaaatgtcagacacattccttgtttttaaagactttatggtgcaaatgaggcaagattaacatttaaatt

SEQ ID NO: 45869 - DNA, 1337 bp, Bovine  19866880912980
cctgacacacggtactcacggatactcacagacttagggacagagactgcctaatatcaagaggggtgggagagccctgtctgcgggagcaattttgcaaggatgtgaggtttaatgtgggtttggaatgtagctgcctgtcttattcacgccatacacacacgtgtgcacacacacactttccatttccttctacttctcccccccggaaggtccaggccactgtgacacaccaaggatatcactgtgacatgacacaattagaaagctgtgtgtggcagctgcagtcaaaggatggagcagggcgaggctgagcaagccgatctgccaggaccccaggaactcctccccttgcctggtctgcaacaaaggccaagggatgatgggtcagtattgtcagctcactgggcacaggctgacacaggacagacttggacaagtgtcctttgagattctagaagaattatccaaattcctgaagatactgagatgcttcttccaggtcgatgttacaatcctgttgataataacacatttcccttttgcttagtgtttttcactgacaaagtcgtcacttacataatcttatcagaataggtgctcagcaacagacacttattgggcatctaccatctactgtatgccaagcattctgctatatgctaaaggtatagccatggataagacagcaaggtgcctgccttcactgggatcaataaagatgtcactggcccaagaatcctacaaacaaatgccagctgacaacactgaccaagggaaagaaggcagctctgtgcaggcccatgagagggataatggggagctgacctggttaggtaggtgtgatgattgactgagacctgatggaggaatgggcttcattagataaaagggaaagagataaggaagagcattctagcagagggaagagcctgtgcaaaggtcctgacgcagaagagaataaccttgagaggctggcaaggctctattcaccttatccccatttcacagatgagggattaaaacccaaagaaccacacagcagaatcaggatcagaactcagacttctgactcaaaacctggttttgtgaaactccatggatcttcaaagcctccagcttgccttttctggggccttccatggtcctggctcaggctgggttgggtgagctggtggggatgggaggaaggtgggggcaggactgttctcacaaggcatttccgttccagatcagccagaagcaggaaatggcagagaacgctcattctcacaagactgcccaacttgtgtctaggccttggaggaggggtggggggagtagggagggtttgtgca

SEQ ID NO: 45870 - DNA, 2246 bp, Bovine  19866880935196
ttgtttgacagggaagaaagctgatgggatctgcccaaggtcaggcagcagaagtaagtggtagaacttacacctccaactactttatcttttatgattccggaactccagaaaaaagaaataatttggatgttttctaacagaaaaaaagctaatcaaatatttcctataaagatggtcaaacaggaaaatcttcgtgaggcagcaagtagaccaattttcgactccagtctttttttctagctattataatttgaagccacgcttggggaatttgacagtgggattacaggaggtcattacagagtaaaatgccttactttagtcaggacaggccagctgctataataaagaatcagtcactcttaccaaaataaaagtttacttgtcactttctaactgtggctattcctggtcacatggcagaatgcttttaggtaagtagtgacttaggtatttgcgtctattctatgtgacatctcagtttttgcatctgatctccgttgtcactgtgagcatgaggtcacactgcatgctctgcagacacacaccacctctcatttcattggccagaactagaacgtgagtctgggtgatgtagttcctggctgggtggctgcttcccagtaccaaggctacataatggaagggaaacatgatcctccgtgtcagctgtctcagctgtaggctgcatagtaatcaggcatgtggttcctctcagcctgctaaaacctagagaggcctagaaacattgttgcattgctgcaatctagaaagaaggcattctgtaccagaaatatttgcagaattggaggcttgtggcaccatccgcattggctcagataaaatggctaagcgaagcaaaagtagctggagccaaagaaatgctgtgaagagtctgtgcttcaaagatgcgctggtggttaatatttggtattcacttcatatgggtggttttagaagcactgtgtcatggaggcatcatgccagccatcttctggggaaacagtgcctcccctagtttaatgctcacccttttcagctttgcccactgccctctaccctaggaacttccctgtatgttctacattaaaaggttccattgacctctggattctagatggatttggctaaggggactccacacaagagactggagggaagggcagggacttaggcaacctcacctctcccccattcctgcaaagtccctctcttggaagttactgctctctctctataggcttcttggtctatacgattctcttttctcccagattctggcaatctctcctcatgtccctttgatcctaggggtagtaacaacccctttgttgctggcctaggatttctgcactgtctttgtggtctgcctacatcctaatcacgttttcattcctagttcctttgtagacatattattctaattttattttaccatttgttatttcttttttcttatctgttaacattgtggttccagccctgagcagaaggcctattctctgtgtaaactacaagaatcctttttcattgttcttagcatttttaaataagccttagagattcaaggctttagcttcccagatatagctcttactgggctttgctaagtctttgtactttcagtttgattctgtgtccctcatctctcttcttgcacatgccctttgaaaatctgagctcatcagcacactctccacccggtcacatgtccctcatcattgctccctgaatcttctaaaagaagaaattgctaacaaggcaagtggaacattcatcaagtattttcctttttgcagaatgaaagttccatcagatatcaaaaaagccgaattaggacaaacccagtacaggaggtaaaaacttgttttgaaatgtactgttaccagagaaatccagatacaccggataccagaattcagctgttttttgttcaattctttttcttcctgattattttagaagtctgcatttgatttttcagttttacctgtgtctatcccagttccaagctgagtcatctcccctcccccaactctctcaaatctccaaggaagattttgttcgatttccagttcctgctcctagcctacacttctttgatcctgcctagctaagaagcatcttcttctagccttgactgtactgaacccactcttccttttaatattcctcttctttttattttcctgagtgccagtgtagaataatggtaaacaaaaggatttttcagtcagatagat

SEQ ID NO: 45871 - DNA, 869 bp, Bovine  19866881004515
tgccatctgtggggtcgcacagagttgggacacgactgaagtgacatagcagcagcagtgttgggtaaagcagggttgggggccactagaaccaagacaggaggagccaactagggatcaatccctacacaattgttacttattgtgtaaaaagcagagatcaaggctaaaaatactatgcacttaaaaaaaagagagaggttgcttttctactttattgttttgccttgttttctatgctattcctttatatgtaaagcagtgagtctcagaattaaggatttcatagatctagaatttctctctgagtggaccaactttgtgtcctatcaaaataacagaggcaaccattaattattaccagcgtcatttttgatttcttaaaagacattttgacatcagctcaagatcaagcatcagccttcaaactgtacatactttgaagttttttggggaaaacctgctactctgcccttatttccgtgtcattctgccacagacggtggagactgtcccctactcaaggataggggaccagagacagaacagtgatcagctgttcctggtattcaatctcccctatcccgccacttgggaatgctggtgactggagaggtgtctatttcctataattactgagtcttaatgtaatcaccgaagcagagagccagctggaaaggatggagtctgacatcccgcaaagagagacagctaaataagtcatacggcttgcagacagcctggctgctggcttatgtaatcacctccgcttggctccctttccgttggtccgtttctccgtttggccttttcgtgcttttgctttctgaggctgagcctctacaataggcagggaaaatattggacat

SEQ ID NO: 45872 - DNA, 1392 bp, Bovine  19866881006949
tgggagcaataatgcagtacattacaaggctgtgcctgcagcagacagcacactgcactgcccatgagacgctaaataaatattgcttgaataaatgtatagggtattctctgtaaattaatctctctaggttgaaaaaaacccactggttggtaaggattacctaacatggcaggctaatgtattaagagattaatttgtgtttgttcttcctaaatctttccctccctgcggttacatcagggagccaggtagacttgtatgcctgcttacagggtagaagagctgaagcaatctggagctgagagcttctcccatcttttgttgaagcctcagccatttgaagaggaaatgccagtctcccctaaagagaagggagggcagaaagactctggagagagaatgacctgcccagccagggaggggagcactgatgtgaattcttcatacacagagtcccacacttggctctgtggcctagtttagaagaaggaagagcttcagggaggctggttgcttggtgtgcctgaggtaccatgggcccctcagtaaagagccccaaaccctatgactgacccagaagcagggacttctggacatcaagagttccccctgagcttggacagtaaggacgcatgaccacttctgcctcccaggttctattaactccttgaaacatgaaggcattcctgtaaggtctgaaattaaattttccacatccaagagaataaggatctagtgtcagaattaaggtgatttaaaggagataaagaaaatgctattttctgtacacccgagttagagaacagttattcatacctattaaagtatgaaaattgtagctgggaattggcaaattaaggctctttgaaagattaatgtaataatagtatttaaatatttcgattgtaagtattttcacgtgaaaccttataaatccatacaaaggcctgcacacagcactaagagaaagatgctaataaaaaaataaagccctttcctccccaccttccagggctggaggtatcttttgtaaagcccacacaatcctagattgtgaagttaaatgagcaatcatggctaaattatgcaggctcccagctgtgctgtgatgtttgcacactttctaggaagtgactaattataattagtgcttaaatacaaaagacataccgtcattacaagaaaagcagaaaaataaatcttacatgtgtagacccttggtctcccagcactggctgcttgcattcacttgtgctgggctgctagctgagtgacaggagggaaatgaatgttggttttcacacttcatgtgagaagatggatctagatgttcataggtcaaatgaggacaccagacacagaacaattcccgagactaagaatgtgatg

SEQ ID NO: 45873 - DNA, 771 bp, Bovine  19866881137579
tgtaggttacttaaagcctctcgcagattatttttatgctgcatctagtacagaggctggtgcctgctagcactcagcatgtttactgcgtgaatgaagcggtagtgacaccaacaactagactttttatattgcttttgttactgttgccccataaaaagaacttttacctgccaaactatggtaatttatatgcattctgagcaaaaaaaaaccccaaaaattttacttgtatccacttacatttttccacagggatgaaaaattacacatgatctaataaattcgtcttatgtagaaaaagagcatggcaggtcacacagaataccttactgaaatttacttatataattaactctgtgaaaccttgggaaataagtatttctaggctaagcttatctgtaaaatacagaaatgactgttttcttacttcaggaagattttttaagaaccaacagaatgtctatatatcacttggcttatgtgagaaaaaggcaccacattaacacaaaggacaatacacaggcaaacagaagtttcaaagtctagttactttctacactcccgtaattaacacctgactttgcgactaaacctgttaaggatgatgaccctttctatcaatatctccaaaagaaaaaggctaagcacactcacaaattgtaaacaaggttgccatattttccttgtttgaattggagtcttccatttgcagtgaaggcggtacaaaagaaagactgtctgaagaaacatctacatgacctgtcccca

SEQ ID NO: 45874 - DNA, 1021 bp, Bovine  19866881389625
gggtgccgatctcttttttccatgaagtaaagttttaagatctagagtgaaccgagtttaagatctagaatatactggatggctgtccattgaataccaactctacaacaaccggaaatggtgagggcaaaacaacttatgtgcccaaaggatcttggatgaggacatctctccatatttgggtatctgtttcagaagacacacaagaaaaccctaccctagacctcttatgtgggattctccataagtgggatccaagcaagtgtcatttggaaccacttccttggtggctcggctgcttctttccactggttggaaacccctagactctatgcaagcactggggtcacacctaagggaagtttctaaggtctcacaccagccacgtcttaggttcacgttatgacaagtataaatgaaaaaatccacaaaatcatagctcaggccccacctttgagccattgggaacaacttggtaggtttgccactctgtgtgtaaggctgcatgtaggtatgtgataagttcatattggttaaagccaggccatatagatcattccatatagtattttcattcatatgatatgaatgtgctgcatttcattgcaattaaccaatatgaatctctgggggaataggcatgccgggagaggtacagatttgcgtaatgaaagaggtacaattaaatgtcagatgtggatagggaaatacgttaatacctgaactacaggaatatgtccatgcaacacagcaaaagtcagagccgtccaatggcgggtctcagggtggacggatggatatttatgaggagtactgacaacctataaacaaattgaaattattttcaaaatgtaaccttcacaatacttagactagcaaatctgacctatctgtggctgggcacgcgggctagagatgtacagaggatgtcctggaaggcgccttgggcaatgctggagacatacagggtagtgactttatatcctctgtgcacaacaaaaactccttttgctgctcatta

SEQ ID NO: 45875 - DNA, 695 bp, Bovine  19866881393141
attcgttgtctcctctgtgattgactacagcaggtgtatctgttagtctcaccataatgatactgagtaacaaacaaccctgggtatctcaatggcatattaaattaacacttgcttttgtggggcagctccaagctacagattatactggatcggctctgtgggtctctcaccttccttacaccagcaggctaagcagggtgtgtttttctcatgacaatgcaaaagcgcaaaagagcaagttcaactgcacaggtgcttttcagacgtttggttccatcatatctcttaacatacctttagccaaagtttgtgaaaccaaaagtcaaggagcaagaaagcacactctgcctatggaggctgtggtgatgacaggaacagtgaatatttctgagtagttaatcgaagtaagttctcaggttctcactaaatgatcatggaatggaaaggacgggataaaaataattggactccagggatctcccatgggtattcaccatacaagctacaaaagcccgtggggactttttagctcctgaaatacagctctatggagaaagtcagagctttgtctgacagataacagcccaaccacccagagtggaatttgctgggggaagtaaagcgagccctcagaggactgccaggaaaagatgtcttccagggcgcttggggtggcagctgcctcgggaagg

SEQ ID NO: 45876 - DNA, 1680 bp, Bovine  19866881422873
ggtttcaggtgacgctgcttattttcatcaagctgaagagggccatgttacctgccatctgcccaaaaggactctggttatgggttgggagctgggatggctctgtggttgcagaattctttctgctctaacaagattgaatgctgggaatctgtacctggagaccctgtccattagttgattaaaagccatagatcagcatgcctgggacctgccagtgccattatgaataagaagtgtcaggaaatctttcggcataaccaatgtctttgaaatcgccatggtgacagttaataaaacttccgagtctatctttggacaagccggctctgctgccaggcagtaaaatttgggacagcttttgaagcagtttgtatttagatgagccgtgagtgccatatctcaaagtcccacaccctcagattaaaaggcaccatagccatcaacaacgaccttgtcaaacagctattccaggctaatagaaggggttgtgaacaatattaaggtcttcccaggattatggagagagagaggcgataagactacctttctggctatttacatgctctctgcagccaaatgactgtccatgttcaaatccaggttctatcacctcctggctgtgtgatattgggctacttacacaaactctatgtttctgttcttcatctctaaaggggataaaacttagtaactacttcaggatgttgttgtcaggatcagatgtgttaatatggatgtcttaacccatttggggtgctaagacaaaataccatagactaggtggcatataaacagaaaattaaatctcacaattctggaggctgttagctcgaggtaccggcagagtcagtgtctggcagggactggtctcctgcttcataaatggccatctttctgccataacctcacatggcagaaggtgcaggggagctttcctgggtctctttagaaaagtggaagttttactcatgtctgactctttgcgaccctgtggactgcagcccgccaggctcctctgtccatggtattctccaggcaagaatactggagtgggtagccattcccttcttcagggaaccttccctacccagggtttgaacctaggactcctgcattgcaggtagattcattaccaactgaaccaccagggaagccttttataagagcactgctgctgctgctgctgctaaagtcgtttcagtcgtgtctgactctgtgtgaccccatagacgacagcccaccaggctcccctgtccctgggattctccaggcaagaacactggagtgggttgccatttccttctccaatgcatgaaagtgaaaagtgaaagcgaagctgctcagctgtgtccgactcctagcgaccctcatggactgcagcctaccaggctcctccgtccatgggattttccaggcaagagtactggagtgggttgccattgccttctcgagtcataggagctaagacagggagaaaagagaaaaagaagaccccagagctactttgaactccacgtggacagaaatctcccatcggtactcatgattttgatgcctcttcctaaaataagtaggttctagagtcatcatcaggatgttagtgagtattctcccccttgtctggagagcaggaaggaggtggtggtgtaagtgtgccgagggcaatgcccacatttg

SEQ ID NO: 45877 - DNA, 1655 bp, Bovine  19866881463103
caacttttttaagctattataaaagaggagtgaggtctccgagcccctttcctgggagaaggccactgaagggttattgcctgaagttcactctgagattttttttttttcatgtgcatctcttaatgtgctgagtctgtggaggagaatgttgcctccgagagaaggtgcaagaataggcaagaagcacagtcctactgagaggctttttaattagcctcatccacagatcgatttgcctttcctatttaaacctaacatctctgtagttttagagaagtttgccaatttctctaaattgcatgcggtaaaagaaaaaggagagatttgtccccaagtgagggaagggatttcccttaaacacctgaagcacgaggacttctctactgggaccttccatagcagaaggggttggttggcaagtagccatcagataatatatcggcacctgaagccagtaacccctctgtgcttctttaataaagagaatctgcttaaactttctcagaatttaaggcaaagagaaaaagcctgcaaagctctactgctcagagaaaatgtaaaaagtgctgaaatgacttagagaaatgggaaccgtgggcttgcaggcctagcactgaaatcatctgaaagaccatcccagcccccttgtaacagcggcacactttcatttcttccgcggaacaatatatgtaaaaataaaaattgagctgctccatcaaagccggaagtggcctgagagtgccccccaccctcctgagtctaaaagtgaactatactttgaaagctgtagatctcatctgatctcttccttcacatacggaaaattgatggaccagagaggctgttaatcacccaaggttattcggcacacgtttagcacttactcaggctcctgacaaagatttattgagtgcttacaatgtgccaggcattgttctgggccccaggctacagcggtgcataggacagactaagtccctgcctaaatggtacctccattccagtggagaagacaagcagtatacaagtggaaaaacatgacattgggtagtagaaagtgctacagaataaagtcaggcaagggaataagagtaagcagggcttattggtttcaataaaattgacagttcactcaccataagtcatctgtgcatcactctgtccaaggaaatgaaatatatcgattggtgccctgtgtcatgttctcaacctagaatcaggggtggtggcagaaagactacttccccttccccccagaaaataattgtgcatcaatagaagaaggaaaaatggatgccgtgtaggcaaaaataaccgatttacactacccgggcataataagattttttttttaaataaatgagaattctgccctctcgtttttcttgtgtcacacaatatgctttcctggagacacaaaaaagtaattgtagcaatgagaactacaatatgctggataccagttttcaaagagcttccccatacatgatccagctgcagagcaggttagctccatgccaagaaaaggagcttgagcctgaaaagctgacagtcacatgttctctagccacctgatgagcccagtgagaacagaaagaagcccagtatttcgtgcattcagaagggatagagccctgtattgtgtaggcaga

SEQ ID NO: 45878 - DNA, 1128 bp, Bovine  19866881496815
ttataaaggccaaatcaataatagtgatggtaagagccataataataactgtccttgaaaacagggtctctccagttacaaagcacttctgccagcatgctatctcatttcctcaaggttgcgttgttgactggaaatgttgctttcaggagcaggcatggagccccattaaccatggggctaatggaattaaattgggctgtgctgtggcaccttcagactcagccagcacgagccttttatgcaagggagtgaaacggaccctgattaggccaaagggtctgtttatggagttgtttttcttggcagctgccaacctgcatgaagcaggatgtaaatcgcgtccacagcctggtggaagccctgctcccgggtgcagcctcagttgcaaggggctcttgcccgcgtgtgatgttaaacagtcttgcagggaggaaactcaaagccatctcatttactaaaattcttctgttcagcatggaagggaagtgagctggcccctgggagcctccttctgggtcagattcagcctgacttggcctattttgagccacgaatgaggcttttcttcttttatggggaaggggcaggcacgtggagaattccccagggtctgctcaatcttctctgccaattacagtaactcaaggctaacgtggctgggaagctttccctagccaaaagtaaatacaggcgttcgattcctctggggctgtgccttcctgtgtaggtctctcattcaactagcccccacagcaaacatttattgagtgcctaccacaagtcaggttctgatgacaagaacccctccaattagtcctaggcttgatggcataagtgcccttccatgagcacttggaaagctggggaggggggtgcacggttttcagcattgggctcatgctccaaacactaatgggcctttccttggggctgggtgatttttagggaggacccaaggccccatagcagggagacagttaagagatcaggtctggaagtcagccaggcctgggtctgaagttcagcttggccacttcctctacctgtttgtccagggggagaagagccacctggagagggagctgggaggcctgaactgaattagatgacatggggcatggttct

SEQ ID NO: 45879 - DNA, 1221 bp, Bovine  19866881498016
aaacaaacttaattcatcaataaaggtagcattcaagatactgaggctggctatgtaagatgtttttgtacagctaggcctcctgacattcatctcacagatttttttttaaatttagcaaatattggcattgacccattatgcactaagcactgttcaaagccctttacaaatgttaaccaattcagtcctcataataacaacttttatatctacatgcctattactatccccactatgcagatgagaaggtaagagacttgcctaagatttcacagctgagaggaactgagcttcaaacccgtcggcaatccagcttcagaacctgtgctcttcaccatatgtgtggctcacagaatcaggcacagtgctagaggatggaggctcagtgaaaagtaaaagccccgacattcttggggcttatattccactgcagggagatagcaatcaacatgcaaatcagtaagtatagaataccatgggattataagtgctaggaagagaaataaagcaggataagggtgctaaagagagatggactggtgagcttttttcagaagactggttggaaaatctctctgaagagctgagacctaaatgaggtcaagaagaaagatacaaaaagtgaaacccagcaaagcgggtaggaagtagaaaggctctgagttcagctgcatgcttggcaggttcagagaagagcagtgcggttagagtagacataagtggatgcgtggtcagaagacactgaagagactgccaatggttatcatatgtagaaagagttgggcttttgttttaagtgtgataggaagccatttacagatttttaggaaggaagtgatatgatgtgatatccagacatgttgttgagtggagaataaacattggggaaccaggaatggacacagggcagccagttagggtgctggttcagtaaccaaggccagaaatgatggtggtttgtacagtggtatcagcaaaggcagtatgcacggtcagatttgagatatatcttgaagatacagtttgcaggacttgatgccatcttattcatttatttgttcatttattatccatctctggtggtaggaaatgacctccaaacaggcaagaactttgagtttttgttctgtctgacttttcatcactttatctccggttcctaaaatagtgcctgccatacaattggcactcaatatatatttgttatgtatttgttta

SEQ ID NO: 45880 - DNA, 1008 bp, Bovine  19866881727402
tttcttgggtccaggcaagtctgcgtgaacagactctagcaatgagccgagatggctccagaccctaccaccaggttcggccacctcagctatgttaccacagggcctcgtgggagggcaaagccccctcatttacattgtagtctccaaggggatttctgaggtttagcttcttccaatcctggtatcttggcatagatggaggcctctgggaggtcaagagaaatccaggtcatatccattttggaagctccaagtataaaaataaagaaaggcagaaacaagattacaaaaataccaattaattttaaatacttgcatataaggaattaatatttctacccctgaataatagaatgcaatatacttgtgctcttcgcaatataactacaatgtttataaaattcaaatgttatttcagagtgccctgcaaacaaggttgtcccataataggacacaaccttataggtggacagtgaaagtcttttcttcagtcttgttggtctgtagctctaaatatactttacttggaaaaatattaaagatctaaatgtacagctctttgaggctatgtcattagcagtgaaagttcaaagacagaaagtaatagttaaaacatataaaagcttacctatgtatgtatgtatctgtgtaactatatatttatggtcaatgcatataagtactggatggcctaggtaatattctgagttaaatcaataataaatgaatatcctatgttgttttcaattccattttacagaagggaaaactgaaatggagtgaaatcaagtgatttgccaaaggtcacatactttagaactttaggtatgttcgtagaatcaggtatataagtaaacccaggattcaggctgagggaggtggactctggaggccacacccttaagtcttgtgatacatagcctctcaaaaggaaagacaggggctcaagaagatgtgcagaagcactgaatggctttagaaattctagcatcagtgtgactggat

SEQ ID NO: 45881 - DNA, 1057 bp, Bovine  19866881850509
atggtattgacgtataataatacatgagtacacgttaattatttggctcaaatacactatgggaataattttcatttttaaatacttaacttttctgcttccagtgtaaaggatttagcagttcctaatttttttccccaaaggcatattttcagggttttgttggggccagaaaccattgttcttccccttcacaccacatgccacaacagggaatatggatcagtcttgactgattcgtgggaaatgaagtagagaaggacttttgggaagaagggaggtcatataaagagaaatccagggcataagaaatcaccaagatggttaagaattaagtacacctactagtacagaaggtgcctgagcatcatttggcaaaagcaagaattctggaaccagactgctgatttcaaatcaccacataacagctgcatgaccttagccagtgttattcaacctttatgtgctttccttctcatctacagattagaggtcatactggtgattgcttcagaggcattgtgtacatcacatgaattaagatatgtgaagtgcttagggctgtgcctggctcatgacaagtctcaataaaggttctctatacagtgtgtatataccatgtatttataacacatatttgaattctaatgagactttcatgcccattaggagggctattatataagtcagggttctccaaagaaatagaaccaatacaatttttataatatagaaccaatacaatattatatatatatatatatatatatatatatacacacacaggtatacatatatatacatacacacacgtatatatatatatatatatatatatatatatattcccaaacatatatatatataagtttgggaactgagtcatgtgattataaaggctgacaagtccaaaatctttagggtgggccaacaggctggaacaccaggagagctgatgccacctttccagttcaaaacctgtcaggttggagaaccaggaagagccagtattccagttctagtccaaaaaactgactgctggaaaattcccactggt

SEQ ID NO: 45882 - DNA, 1339 bp, Bovine  19866880442123
ctcacacacacacacacttcacacgcacatacataactaatcactttgctgtatacctgaaactacactccaatataagataaaaagttctttctttactcccagaaatgaaagctttgatggtgagcccagcctagaccaacatgctcacaagtctgatgtcacttttaagcacaaactgaacaaactattaaacttcagatttcaactttaagacattcaaaaaatagttaagggaatctcatttgcatggcttgaaaataaattgagaagagggtaaattaagagacagaatgacttcccagaaatgtacccagaggtgaaggggctgaggcttcttcttacagtcatcaaactgggtaccacaagaagcttaagagtttctacagtggagagactgttaggaaggaaactgacaaagtcttaatagctaactatgggctctctcagggagtaccagagaagagagagggatatggcagaactctgtaaatttccccccgaatctattgccatgttaaagcagcataaaaccagcgaaaaaaggaggctcggaaaatgaacaaagtttatttacaaccacctagccttgtctctgctttagaagctgagatgtatgaaagaacaaaggtccttgcattcccacctaccaaatagcaggtcaatgatctttctggttctttgcttaagaggttgtttacttttaccctaattgtgtcccctagattattagttatttgcccctcccagattcatgcaatcattcatgcatttgttcagacatgcattcttatatttcatcactcagcaaatacttatatctatcatgtaccagacactgtatatacgttttcacaaaaggtagtgcatataaacgtaaaataaggcaagatttagggtagagcttctcctatttgcagctgagattaatttgtttatagcatactttgactactgttagctaaaagtcccagcttcaatgccatccataacatatccctccatcttgtccacaagtgtatcaaaattttatacactttttaaagaaaattgttttggtatatgatcaaatgtccaagtccctagaactcaattggcataagtgtaaaataaatagtacatctctccatctctcctatgctgtggatctcactccacagaaacaaccaccattaatattttctagggaggagttcttaaatgagcatttttgtagtatcatttttaaggattaaacaataaataattgcataatactgtgataaacaataagagggaaaaaaatgttgggaatctccaacatatcgaacagggaatttcacatttcaaatcccctatt

SEQ ID NO: 45883 - DNA, 2317 bp, Bovine  19866880666628
tctatatttctgtttttgtaccagatcttttagtcctggaaaatgaccagcttctcagtttaatttttttaatataaatttatttattttaattggaggttaattactttacaatattgtattggttttgccatacacctgcatgaatccaaaatttaaaaaaaaagtcacacaaaaaatcaccttgggttctattggtcataatgtgattatatgttcatctctgaatgaatttcagtgataacagagaaaaagaagtaatatgattaatttaagccagtctggacccacatctacaattgaggatggggtccatccttatctaattataaaggtgaaaatggaaaagaggttaatttctcaaagtagaatcaagacattatgaatagttggagagaaagaatagtttacaatgaagcatgatgctaataaaactactcagatttgcatacccctaggagtatctgattttgttagcatttgaaacctgcatgccccaaactgctataatctgatgtccaaattctcatgctttgtaaaacttagttttatgtaagtacgtattccccacaaattatagttcctgagccagtttcacattagttataatttgcaagaaggcatgattacctaccttgtctctggtctgcctttggcctggtattcaacatctgactgcagctctttgctggttaatatgcatccctgttctgcctgatgggaggcttatttgtggctctgttccactggatcaatccttgtccttgcctgctagttgaccatccttaagaaccaatgatctacttttaaggagccatctagaccatgggatgtcatcccaaatcaatctctgtgactcgttacttcatttattagttaaatgttagtcactcagttgtgtctgacactttgcgaccccatggactataacctaccaggaattcttcaggcaagaatactggagtgggtagccattcccttctccaggggatcttccagacccaggcattgaactcgggtctcctgcatttcaggtgggttctttactgtctgagccaccagggaagatctacttcatttataatgggaaataataacattttgtctacctatatatttaagatgacatcagatatagaaatggtatttaataatctttctagttaatttatagtatcaagttaaaatgatccatgtgaaatttaaatattaaaggttcattagatgcaaatactgatgtttgtaatataataatatgaccctggagtctgtggtatgttttaaaacaaaagattattgaaaatagaagtgttattattagcaatagtgcaataggaaagtggtacaagaaatgaagaacttagagtggtgggaaatttccttggaaaaagaaaaagggggagatttaaaaatgcagtctctcagctcatgatgatggatgaatcttttgaagctgtattacaagcacaaggtggcaatggcatggggtgagcctgcgaatgagactagagattttgttggtgaggattcccaacacactttggaaaagggtgtgtggatgccatgctttcaatctttggatttgattctttgggcaggaagccttagtaaacatacatttcatgggaacctaggaggatcatttgccctttggaatgaagttttgatggacaaaactttgtttctcagggtaagatgtggtttaaaacatcctggaaaaatacacctacacctgattcattggggcagctctggccaggatacagtttcagcttggcttgagctggcagtccagatgttccctgagaacacagcatatccccctggctctagaggaatcactcactatgcttaacaatccaaacaaaaccttctttgtgaaaggggaagggagagtcaagttgcgatcccagcccagctgccagtccctcccagtttgggaccctttcttgctctccccagagctccatcaaaagttgagcagaaacatttgcctcccagcactgactgtgtcagaagtctgacagcttgtttttatatatattttgttacatttaagtatgggtactgttttaggggagaaataaagaaataagatgaaaagtccatttgttggctttgctttgtaattctttctgtagtcttttttttttccagtcctagccaaggcacaaccatcagatgactttattccaaagaaaggcttatttgaggagtgatccatagaaaggattagaaagtaggagatatgatgagcgagtttggtatctagaaaaaagaagttcttcctccaagtaaggcttttccttagacccag

SEQ ID NO: 45884 - DNA, 1594 bp, Bovine  19866880702039
ctggagtgggtagcctttcccctctccaggggctctttccacccaggatcgaacccaggtctcccgcattgcacgcagattcatcaccagctgagccacaaggaaagcccaggcatactggagtgggtagcctaccccttctccaggggatcttccctacccaggaatcgaaccagggtctcctgcattgtaggtggattctttaccaactgagctatcagggaagcccttagatatctaggcactaagtattcaaaagagaatgaatcaggcatgaatttttatttaagagaaagagaagtaattgtcttccaggcttacaggaagcttagtgaaaatttacctggggattgaaaattatatggggtttacctgtgcaatagcgcaccctcccaacacaaccatcctttaaaatatatatatatatttttaatttatatatatatatatatatatatatatatatatataaaacctaggccctggtagtgaaagcactgagtcttaaccgttggactgccagggaattccccaaacatcatttgcttaatattgtaaacatttattttttttgtcagtgcctaaaatggccaccatcagagaaggcaatggcacccgactccagtacttttgcctgtaatatcccatcgatggaggagcctggtgggctgcagtccatggggtcgctaagagtcggacatgactgagcgacttcactttcacttttcactttcatgcattggagaaggaaatggcaacccactccagtgttcttgcctggagaatcccagggacaggggagcctagtgggctgccgactatggggttgcacagagtcaggcacgactgaagcgacttagcagcagcagcagcagcaaaatggccaccatggttagttaacttaccccactgggctgcctggtctccccaacctccactccctacatagggtctcaagcccagcacatctactactaaagtggggcaaaatgaatttttagcagttcgggccatcaattcctttaaacctgatttgcagtggttgccaatctttctattactgtaattgctggctaaatgaactataattgtattaagaagtaactctgaaatatgtatgcgctctctgctaattctcagaatatgcagggagaaaggaattgattcactgtgcttggaagaaccattcagaaatgctccctctgggatctgttagttggaggcctcttttgcatcctggggaaagtcaaggccagatgcccgagaatctaggagatggaacaggaatttcagggggttcctcacagcatttcaggttggtggcagaaatttctcacaactgtcaaaagagctaaagatcaagtcggaattctctgtggtcttggacacaactaattctgattaaagctcatattctgattgtttataatgctaagagctatgcaggagcttttcaaatattcctttccttcaaataacctctgcagtatgatacagcactaaagcttggggatggtaaatggcttgtcagtgtccgcttgttggtaatcaagaaaatggactctcaaaccccagtccactgagcccaggtcca

SEQ ID NO: 45885 - DNA, 910 bp, Bovine  19866880737974
tgctgcccaaagactcctgggaaacaatgacactgacatcccatctggcgttattactttttaaacacactgtgagctttttatgggatgagcgcattgagtctatggcccatgccggaggcctgtgtcttcctggtagagagtagtttctcagggctacccagatgagggtaaggatgcctttgaaaatgctttctgtttaatgaagtcccaagaaggggcctggctgcctctgtcttccttcaactgctgcttgaggctgtgtccgatcccagaataagcatccccatctgtgttattctgttaactgaaaaggaaggaattagcacatggacttgtcacatcttatgacctgttgcacactgagatgcgaggtggcggcagaacaaatggcattctttctctctgcacctttcagactcactgaggagacccagaagagcaactctgactacatgaaacacaccaacgccatccctaaaaatcagatggggcctctccaagctgcaccttatgcagaactgatggggaaggggtggcagggcctcaaaggaaacttcccctctctgccaagctccagatggaggaccttcccacggaaatgcttgctggaggcgctttgctgacacagagtgctgccagggaaaagggcctctggtggggctactcttgccctttctcacgggagaaaaccagaacactctgaaggtgggaaaggccctcaaaggccaggtcttgacagaggggccggatgggaggtccctcatgaagcgtctcagggaagttctgatcctggactggtggcttgccactgactcctggcacaaagattttcaatgcaacacgacaacacactgaaggtgtgtttgatctgtgtttctgttttccaaggctttcacaggaatccaca

SEQ ID NO: 45886 - DNA, 5065 bp, Bovine  19866880744579
tacgacgctcactcacagaggatttatgagaaatgaaatggaaactctttcagattttattaagagatatagtcttcctgcataacttctttccctcctggacatttatgaatgtttggctggaagggtggtctgggagcttggttttgatatatgtggttcctacaagaaggtgccaagggagacatttttccatcaaaagccatatgcatgaggatcctggaaagtcttccagcaacagtggacactggcaataaaaatgatctaggaagaaaacacgccggcagtgccagtcactgcagatgctgaaggaccaggggccaaatacgtaaataccttcagaactttgtgtggaaaacaaagcgggtttaaatcatctttctcccagattcagagtttttcaggacacagtcacagctagagaacggccagcacagtgatttggtaatacaacctccaagtgtactgttgaaacccacaagagacaggaaatgagaaaggtgtgtgaccttgcagtcatggactccaccacactgggcccacgccattgctcaacaaatagactgagggacttccctggtggtccagtggttaaaactctgcacttctactgcagagggtgcaggttcaacccctgctttgggaactaagatactgcagggccaaaaaaatccccaaatagactgagcttcccacaatgccatgggcaggatgacctgagtgtaaccaaggtagcctcatgtctctcagcattctttatggtgtatgtggtttgacactaatcttaacaaaactcctcaaagcaggaagaaaaaaattgtaatggagtataccaagcaagcaagcaaacacagaatacacacacaccactaccatcatcatcaacaacaacagagtgtaacttttgtatttctcttttatctttctttccaaattaatcttgaactatactctccttccccttctgaacatagcacccactgataatttttggttccttgacattcctatttgccacaggaatttttgcacaagatgtttggaaaatttttgatttgttttcttgatgcccattcaacttctattcatcctttagacatcagttctgacagcagcttcttaggaaatctgtgatacccgactcatacctcctacattaggttacattccttgtcatccataggcacagttttgtattcctgacacctataggacttattataaacatactgtgtatgtatgtgtgtgatgattatttgattaatatttgttttccctacaggctgaacactttccaaggaaaacaactatgcctgttttcctttaccattttatttttagagctttttctggaattgggccagaggagcacccaataattatttgtcaactaagtggctaaatgtgatgttgtgatgtataataagaaatatatatatttcatattcatccccatttctggagcagagctaacccccttggaatttcctaagtgatgaaagtgataacaatgtctagttatgtgaatgaggggacttttggaaagtccctgaagatgggagctggttcccaaggaaaccaacctgtggttagagggttggaaccttcagtaccactccctcaacctccagggagtaaagagtgcctggaaattgagatcagtcaccaatggtcaatgatctactcaatcttgcctatgtaattaagccttcagaaaaacccaaagggagaaggtccagagaacttcctggttggttactattgaggactggggagaatggcccatctgaagagggcgtggaagctccaccctccttccccatgcattgtcctatggatctccaaccctgagttacatccttttctgatgaactggtgacctagtaaataaaatgtttctctgagttctacgtgctgctccactacttggttgaacctaagaaagtggccactggaacctgcaacttgtagccagagggtcagatgcacagaagataaactgggcttgtggctggtatctgaagtctatgcgtggaagtgagagcctggtgtcaaaatattatttgctgagcacgttgccacttcctggcaagtgatgcaggtgctgcttatctggaaaccagattttcagaaccagtgaaccaatggtgttccattttagctgtacattatagaatcacttggaaggctttaaaaaaaattcagttgcccatggggcttccctgatgactcatggttaagaatctgcctgccagtgcagaagacacaggtttgatccctggcctgggagtcacatgccatggagctattaagcctgtgtgccacaactattgagcctgtgctctagcacccgggagctgcaacttttgaccccatgcactgccactgctgaactatatgttctagaactcgtgctgcacaacaagagaacccacggcagtgagaagcctgcttgctgcaattagagagtagcttgctgcaactagagaaaagcccatgcagcgatgaagtctcagaaataaataaataaatgaaatcctgatgttcacaccataccccacacaaatgaaatcctaatcaatggggggtaggtctgagacatgagtatttgcaaagtttcctaggtgatttctggaccataaagacagctgagtgctgaagaactgatacttttgaaatgtggtgttggagaagactcttgagactcccttggactgcaaggagatcaatccagtcagtcataaagaaaatcagtcttgaatattcattagtaggactaatgctgaaactgaaactccagtgctttggccacctgatgcaaagaactgactcgttgggaaacaccctgatgctgggaaagaatgaaggcaggaggagaaggggacaacagaggatgagatggttggatggcatccctgactcattggacaggaatttgagcaagctctgggagttggtgaaggacagggaagcccagtgtgctgcggtccatggggtcacaaagagtcagacacactgagcgactgaactgaactgaactaggtgatttcagggagcagttaaggctaaaaccatttgtgcttgctggagttcattttctctcctccttctagaataagtgaggagagataggccagacaaagacttctgaaaatatgactgctcagaagacatcataaagaatctgccttttcccatctctctttttaaaagtaatagatatataagatgtgtaacacaatacacaccacacacacacacacacacacacaccacatttccaggctatactttgtgatgaggctgctcagacagattgttcatcaaaatcgcaccagagggcttttgaaatacagattgatagactgcgcctccagagtttctgatccggtaagtctagggtggcatctgagaatctgtgcttttgccaagttctcaagtgaggctgatgccacttgttcaaggaccacatttggcacaccactctgcctgaggaaaataataagaatgggaggaatacttccagcttctctctttcctattcattcctttgctgccagtgactttgtgtggaatgatgcagaaagaaggaactcataaatacctgtgactcagccctttgtgagatttctctttcaacttggccctcactgaatgttggcattctggacccagaggctctccagggtcagggaccaagcctggctttgaacatatacctaaggctctgattctaataagattgtctgctccccaaacccctcaggtgactgatcctgaacactagattttagatccatctagagtttattaagggacccagctgactatacatagatctagttcagtgttatcagcagtttttcgacatatcattcagtttctcatgtctgttccttaattggttactaacttggggagaggtgaaaggtgtaattaattttcactactcaaatcccatcagcaacttgaaattaacttaaaactttgagtcttgtcacatctaaaaatctcttcattaatccctgcatgtgattgatagtttgactggagacacaaatctatgagaaggagacacttcccttataatcattgagttattaggcctagagttagagaatttgcaagactttcagcatctttgtagatcctaagtactcttagggttggaagccccgcccctcagcatatgaaacataatacaatcgtcacataataatattacatttcacattcatttacttaatgatctctcattttttatttttatgtttttgattccatctctatgtatacacacacataaacactacatatggatataatatttctatgttatatgacatatatcctgcattatttataatatcacatattatataatacattatatgctatatgcagatatagatataatatatatctttataagaaagttcctttctagaaaacattttcatagaacttaagaaactcacgagaccctagactctctgtcttattgtctaaaggataaaataaccttaagatacaatattggtgaggaaaagcttgaggttagtttaatttttacttctttataggcaactattctacatcttgggaactttttagatctgctctttattcttaatgcttgaagtgttacagcaatgtatctaggtttggacgttcctattgcactggactcttaatctatcccttcaatatgaatggtgtgacctttatttctctgggaaattctcatatattaaaactttgatatttttactcttagcattattttttccctggatctttattaatggggaagaatcctattaacacaacatttcattaaatagataggcattggccctaatgttataaacttcagttcagtcactcggttgtgtccaactctttgcgaccccatggactgcagcatgccagacctccctgtccatcaccaactcctggagtttacccaaattcatgtctattgagtcactaatgccatccaaccaactcatcctctgtcagccccttcctcctttcgccttcaatctttctcagcattagggtc

SEQ ID NO: 45887 - DNA, 2212 bp, Bovine  19866880787572
tgggataacttgcatggtgtggcaggagatgctagtggtcaagagagcagggactgcagcccaggtggttgggctctcggatccacaggtaagttgactgacctggaagaaaatgaagatcagtgaaggtcacctatccctgaatgatccaggtaaagaatagttacaggcccaggtatttgccatctggactgtgtacagagtagattcctttggtaggaaaaaaaaaagtcatgataatgcttctgccccacagcccagggatggcaggggctgcagaaattgctccagaagaagagagactgcaggttcgcagtatgtcctcagccctgcatccccgactcaccctgtgagctcagcctcaaagccaagaccaacacaaagcaaaagtcacttcccgacttggcggtgggcactgggtctgcattgtgctgatgctgcttcaaccttgtggccatccctggcgttcccatggggagacccttactttgtgcttgtgcttagaatacgcagtcttctagagcaagtccagtctaaccctattgcaacatcgccaagacattttttttttaatatgacccggcaccttctacctcttccagatttctcagtcccacctgctgcctgcctttttctctttgctccctgtttctaccttccatgataccctcttgtcccacctttatctcatcccctgtgactcccttcttcaggtctttctcatttctatctctggattccaatcagcacacagaccctgatgccattccaggacctctcggggtcttaatagaaattcaaattccattgtttaagatcctagaatttggtgccattaaccaaaatagcagagcccaggcaagggggggaggggtcctaaggcagagctgatttaaaatttaaattatttgcacactttgagccagcacatatatcttggtattgatcgaagctctttggaagctatttacgttttcagcacacctataagactgagatttatactgcatttggtgtttaactagcctcttaatgcatcttgttgagccatagtattggtgggcatattgtaaattttagtgttggtgctgaattgatttgcttagtggagttgaatttaggctattaaaataaataaataaaacaaataagaaggacctccagtacctcatatcatattaaaatcaatcaaaggcatagagccaccacctccagagtcaggattcagtatgttttgtggaaccgacttagagtgcgaaggatttctctcagggtggcctctcgtagtaaacacaaacagtgtggaattaagggtgagaccacagtgtggcctgtctacatgatgatttgaaattgagaaaacttgaactcacaccctgactttatccagacacccatagctggatcttcctgttcttggtttccaaaggagtggcccagccagtttcttagagttctagcttccttctaggcatctagacaattgcagctggattctgagatgtgtccagcccttgaggtggaacaagatgggagcagctctcagcatccagggctggtcttggtggcatctctttatcttgcaacccctcagaatcatgggtgggtctcagttattttcatattctagtgactctaatgaaccttagtgcatctcagaaacccgaggatccaagctgatgtcaacacagggcaaatactttccaaaagattcactccagataagaggtttattttgtcttctagagctcgggcagggtgggggtggagggttctttttttgtttggttctttgaagctcattccatcagactgtttcattattagtattgttttttatttttaaaaaatttagcagggaaagttctgaaatcaacagacaatttacaattgttgtcctggttctctgaaaaggtagtttcgttttcaattcagtgcaagggtgctggttaattgggctggatttttactgagactcgacacatactggggaccaggcatgatcaagagtaggttgccatcaaaagtcttctctggaggaggagcaggttcctagaggctggctgtgactccaggagcagctctgtgggggtgagaacaccagaaaccctccctgtctcctgagctgggacaggctaggtctttctcactcacagtcagcctgggtactcttgattagccctttcagatttcccacagatggggcaatctt

SEQ ID NO: 45888 - DNA, 2061 bp, Bovine  19866880856865
catggaccttttcgatgtagcgcttgggctcaacaattgcagcgtgagggtttagttgctctgcagaatgtgagattccagctccccaaccagggactgaacccgtgttccctgcattacaaggtggattctttatcactaagccaccagggaagtcagaagaatttctaattatgatgctacttcccagtctatattatctttgtgatttttttttatgctttcatttttcaaaagttaaaatatcactagcctttctaatagaatccactgttgtgaaatgactccctattaactcattttgctttttggtcattttcactacttgtatccaccatgaactgatgcatgaataatttttctagttattaaatcaggttttctcacaacattcaataactgcagctaaacaataatttctggctcaatattcatctacaaatctgagtgttttccctatgtccctaaacgtctgtatggtattttggaagtgactagatccatgctgtcaaatatggtggccacatgtagctactgagcacttgaaatgcgcccagtccaaactcagacatgctgtaccagatttaaaaaacttaatataaaataaaatgcaaaatattgcattcatatatttatattgattacatgttggagtgacaatattggttggcaatactttgtctctgacacacttcaaattgctgcagaattacaccattcaggtcacagccccttctgtatccaatcacaacagaattgtggagtggaacacaaaattaggaccccatatagatacccactgccctttccctaaagacttatcttctttactggaaactcacctcccaccctggaacctgatcccctgctccagaaatccatctgcatctctgtctctgtctctgtctctctcaccctattacaggctcccaccccaatcttttccctcacatgcgtcatgttcaatcttgaagaaataaaaagttggatgtataaacacacattcacgcaagcaacaggaatgcattttggacccatttttcctctctcacatcctgaatcctcagtctttctgtagcacatctgatatgtgccactttatatgaatctgaattttctctctacctttttcttgagccagttatcgcctagcttcacagtctctccacccactctgtccaggtggcacttgtggaaagcccatattttctcttctcttaccccattctctctgttagtaggaagacagaaaactagagatggttccattggctgtagaccaccccgcccaatccatcctactcaagtgtcttttttaaaattctctataccagagtcattcataacaggcaggaaggggaaaaaaaaaactttatatgtttttcattaacatatactgttaactacgccagtaaattatggataatttaatttagacttaatggcaacatttttcctcactaatgaaatggttatttgttattaggaaaatatttattgaagtggaattgtgtgatctctcacatcactattaaaccttgttaaacctttttttaaatttcaatttggatttaattaagattcattaagcattttattaaatctaaattaaattctaatggaaacaaggtttgcccaggaaagacagttgtgccatccttccctctcagttcttttaaagtgacacgggaagacttagaatcaagccagctccatcattattgcagaacagaaagaatgaaggaatgcaggttagtcccagattgatcattgttcaaattgcagaactgctgctgactcaccatgagaccttggataagtcatcttatttctgtgatgctcagattatcctgtataagatgaggatggtaacagtggagtggtttcagagatggaagggcaagggttaaatagcaacaaatatttatatctccttttcctgtttcagctatctataactccttagaaagtggaattaaataaatacgttctttgaataagaaagataagttactatccccaggacaccgccccaccctttgtggtatgcccacagcctgc

SEQ ID NO: 45889 - DNA, 2370 bp, Bovine  19866880870502
ctcagtcacgtctaactctttgctatcccacggactgtagccttcccggctcctctgtccatggaattctccaggcatgatactggagttggttgccatttccttctctgggggaatcttccctacccaggccttgaacctaggtctcctgaattgcaggcagattctttaccaacagagccactggggaagcccaacttagggtcaaacccaggattttcaacttatggtactgagaaatggagtatttcctgctatatcagtaggcaagaatgtcacagtcatcagggattccggccctccaaatgtgaatttctgaacccccaagggtacccaggaagagcaatgcctactacttcttccactccgtaaggtgagcactgaggaactgggggtggggggtggggtaaaaaaatgtgaaaagactgcagtatactggcccctgatagctgagatatacatgcaaggaatgatgtcagtgagcccagactcttgcatctttccatacatagaaaagggctaaattctttaacttgagatatacgatttgccttaatcaacggtaatcttttgatattcagactacctgcctcttgctgcaaacttctatatgacctgattcctccctcccgtttccaacccgcctgcctccttggagcggttatctcagggttacttgagatgctgtctcccaagcctgaaatttctaaaaattcccaccaaagaaaacataactctcaccttccagtttgtgactatttttttttggtggacaatacccattcctctcctaaggggagcacctctaatttcatttctctctgggtcctgacaggtccacagagtctttgaagagcagcggggcagaggaataggaaagtctcaaaccccaggatgagcttctttggttttttggataagagactctgctgggctgtcccccttctcatcccttctgagactcgggcagtaactaactcactgatcatttctgctttttcatcttaggtaggcaaaaagccatttaaaaaaaaaaagggggggggagagaaaaatgaaagagaaaacacacacatgcatccctcatgagcattaaaaaatagtatttcagggaacaaagaaaatgcttgatcccacaggcagccctgcttgaaagacatcttgttaagctagagcttgtgcaaaagagaaagactgcagttttcctgggtttgatgtttatctccagccgagcaccgccattcaaaccaatcaaagtttgactgggttcagaaatgccacagcagcacattctgagttcctagtccccccgaaacactgcaagtgaaaacatctgcatctaaaacaaggcagttaaggagacaggcacacatgctaacgctgggcgtctatttttggtcaccagcttactgaagagcagaagcagggaagagcatgtgcgttccttttattttccatttattgttattttttcaaccttggcaaaatatacacaacgtaaaattgaccgttttaaccactttctaagtgcactgtgtaatgacattacatacattcatgatgttgtgcaagcatcagaaacatccatcttcagaactttttcaggttttcaaacagaaactccatacccaggacttccctggtagtctagtggttaaaaatccatctgcaggggacatgggttcgatccctggtccaggaggaccccacatgcctcgggacagctaagcctgtgctcaagaagccaccactgcaatgagaagactgtacaccccaaccagagagtaggccctgctctccgcaactagagaaaggccgtgcacatcaaacgaagacccagcaacaacccctaaataaataaataaaatttaaaaagaaaaagaaactctatatccattaaactggggtttcccaggtgactcagtggtaaagaatcctcctacaaatgcaagagatgcaggttcaatccctgggtgggaaacatcccctggagaaggaaacgacaaacccactccagcattccttttttttttaaaggtctatttatttatctggccacggtaggtcttcattgctgtaggcaagttttctctgctgtagttgcagtgattgaaggttactctcgagttgtggtgtgcgagcttctcattgcggcggcttctgttgtgtagcatgggctctaggtacacaggcttcagtagctgctgttcttgggctagagcgctggcttagtcgttgtgatgcactggtttggttgctcctaggtatgagagatcttcccggaccagggattgaactggagtcccttgcattgcaaggtggatttttaaccactggaccactagagaagcacccctcccccaccccact

SEQ ID NO: 45890 - DNA, 2097 bp, Bovine  19866880962536
aaaaattaaagtgtataatttcccatgagtctgaagaacggttgcattttatcagccactgcatagaatactttctccatgagaatttagagtccagagtgtccaacagagcttttcatagaatcaacactgatccctccaccctcttttcaagtgtagctttgtctccagtgggaccttgagctcttcatgctggtgaaaccgagagaagctctgagtgccctgtgactcattctccaaggctgagggctttatcggactccattcagtaggtttttttttgataacaggggtttgaaatatccttgtgacaggaaattctcactgttatatttgtgctttcctgttggacccagtagattttgttttcatttattatttaatttacagacaggaaaatcatttgggtctggagacctcttgataacacagttaatgcaattgccaggacatccccggtgtgcgctaagccctcggactctgaatggctgtcctttcagagttccaggtgttggtttcaagggtgaccatgtgacatcccataatcacacttatgaaagggctaattaaaaatacagatgtcttcaactcacaatagccagacagctgaaatacttattagtattttttttaatgttaaatctctatatactcacttctttccaacagaaaaactaataatagataacaaagcccagacagaagggccctgaatccttttcctcccaataaatgacatggggttttgtttttttaaatagagaaatcacctagtacttctacaaattgatcttttacaaacatgcctttttagattactctgttttcccttttaggaaggctcagacacacagtattgtttatctagggcaagaagattttaaaggtctgcagcctgactcctccaacacagagctgatggccatacaaaacagcatctgagtctgagaacagagaaccattaaggacccttgagccttaagaggcggatctcttgtactgtaaacatcaagtagtctctaacttctgggaggcagaataaacagaaacattatcatgttaaaaaatgtcttagtgatgtgttgtgtggacttaagaactgggtcctgatgaaggaaaaatcctttacagaaatgttgggtttgcatatgtgaaccaacgcaaatgtattccccctgctctggcgggtaaatactttggacctgaatgtatagttaaaataaccatcaagaataccaaatttatgttctgccaaaataatgacccattaaattaaaaagatgtcttaaaaatgctgatgtgaccttttgttaactttctttcttcctcccttcattttttttatcttctttttttttctttctttctctttctttctttcttgtatgtcttcctatataaaaaactgctattctgaagggcttgctaggttaaaggcactgtgctagacacttagttgggtgcatggagatgaacaaaacttgccctggaggaagtcataggctatcaagaattatattccacaggcagtttggagaataggttggggagagtaaaactatagaaatcaaaaggttggagaaataacacagattgttgtataatctttttgtgcagctccagggaagttggtgacacatatcagggcagggaagttgtacatgttttaatcatctcacctccttgggatgagagtgaagatgaggtacagctggagaaaggtggcattaacccctctcctcatgtaggattcccctttctggctttgcatctctgtattcagctctcaggaaattttcatgtgcttttgctgtctactttcctctctttcatttaatgcacttcagaaacttttttatttttattttttttttttgagcatccactaaggtactctaatgggtaagacagatttgacactcgccctcatactgcttataaatcctaagacatcaaggagtcctgctctagagttctaatgccaacagcaactcttgggattgggataagtaagataattttcttaaaaaaattatttatttatttgggtgtgttgggtctttgttgaagcacatggaaatctccgttgtgtcatat

SEQ ID NO: 45891 - DNA, 1778 bp, Bovine  19866881005907
gattctcaaggcaagaacactggagtgggttgctgtgtcctcttccagagggtctttccaacccagggattgaacccgcgtctgtctcctccattgacaggtgggttctttcccactcataccacctgacaagccctctcggatcttacctaacccattttagaaacaagatcccagaaaattaaactgcttccaaataacttcactatatccaggaacaatctaatatttttaggaatataaaaatctccagtggtaacaaagtaaaatggacaatgtcttgtatccaattagagattactgggcatgcaacgaagtaacaaattatgacccatgatgaggaaaaagagaaattgaaacccagccagaactcacacagatgttaaaaggagcaaacacatttaaaaaagttgtgataagtgtatgccaattgtgcctcagtaagtctttttttttttttttttagaagagggattcagcaagtggtcaaaaatgtttgtctagtactaaactctcttctcaataaaatcagaagtagagaaaaagagatgaaaagagaattactttctatgtgagtcagtgttgctcaaagatgtggccgagtgccatgtaaatccatcacccagagtgacatacaagagcaccccaagcctgggaaagctcttggtcagcctgtgcctaggactggaggaagaggatgctgggagtctttcagaaactgcaaaatgccacctagctggaacatatagtgcaaaagaaagaccagggaggggtttccctggtggtccggtggttaagaatccatcttgcaatgcagaggacaccagtccgatccctggtcggggaagattccacatgcctcagggaaactaagcctgtacagcacaaccactgaagcccgtgggccctagaacccatgctccacagcaaggagaagtcactgcagtgagaagcccgcacaccgcaactagaaagtagccctcgctcactgcaaccagagaaagcccacacacagcaacaaagacccagtgcagctaaaaataaacactttaaaaaaagaaagaccagggagaggggactgttgctgtaattgaaagctgacctgagattttaaactcttctggcccaagtgagtttggtatattagctcaaatattggtcagatccccattcctgtctgttctttggaacttctgtaggctaaataaaccctctgaacatcctttccctcagagataacgtgggaatattagcccctgtctaccatgatggtttgaggagattaaattttataacgtagggctctcacttacgtcatagaggtgagcgccatctgaaattatgatattttgatattgctgatattctgtactccttatttcgccatcacccaaggagggatcttgtctgttctgttcaaggttgtatatctcacacttcgtatgcatagggctggaccactagcaaccctcagtagatatttgttgagtgaatgaatgaactcagggagtgtaacactacatctggaacatgataaatgaacacttaaaaaaatgtttatttaggttcttaggacaaggcgatggaatcaaagttatgaatttctcccaccgagatctttctgatatgtcaaatgacaggtgaagcagggtagctggtagtctaactctgagttctcccagagctcactgtttcatccaaggtcaagaaaactttttctgccttgggccaggttgagtcatcccagatttaaggagcgaagcaagtaaataaaatgt

SEQ ID NO: 45892 - DNA, 2394 bp, Bovine  19866881256657
attcatccactcacttttcctgctctttctgttttttttttctttattttaaatttccaactctccttactccccgctgccaccaagacacttagcacctgcatccccactctgtgctgagtctcaacagctattgtcaagaggacgaaggaagtacggaaaactgggagtttaccaacgcattcctaatacaattcataggctgtcagcagttgtttatgccttcatattaatccgggatttatatttattttattcggatgatatcatatgatgcctaattgctttggagagtttagaattgcttttgtagaactatggggcttgagtcatgaatcctaatgccttgctgctaacaggcttttgtcaggcttttgtcatgctccagaggatgtttcctgtctcttctcattcagaagagagtgctcacaccctagtgagttaataaaagtggagagagagtgtgatcttgatcttgcagcaggctttcgcagaagctcttagttggggctgcatatgccagacacatttgaagcacttgccagatccctagcccttagcttggaaatgtttctcccagcccatcttttaagagagaccattttaaagaaagaccaagatagtgtcacctacaaattggcacttgccatctacctctacaaggatggaggagcctggtgggctacagtccttagggtcacaaaaagttgagcatgactgagcagctgagtatgtcgcccatatatgcacactggtctatctgccaggcacaccttgtctccatacgtgtgttcacatcgttcctccagtgttaatgcccctccttccctctcttccttaaactccctgctcatactcaccctccaaagtcctatatgcatgtcgcctcttttctgtttaacttctcctaatatgctggtggggcttcccaggtagcactagaggtaaagaaccctcttgccaatgcaggacactgtaagagacctgggttcagttcctgagtaggggaagatcttctggaggagggcatggcaacccactccagtagtcttgcctggagaatcccatggacagaggagcctgggggaatacagtccatggggttgcacagagttggacacgactgaagcgacttagcatgcactcactgctgatactgggaaagcatcttgtacccctcccaatgtttcatgtatctcctgcctagctctcttgtcacatttatcccattctgtggttggaccaagaaacaaaaaccatgctaaggtgtaaagacagaaaataaaaaccgaagctatgccaagtattgaagacaggaaactatgccaagtattgaagacagggaaaggttgtataggtgctgaaaaagctcagaagccaaggaacatgatctgaaccctggctaaggtgtgaatccctgaatttcagtctcagcctctgggttaatcttaggacttccctagaatcaccaaccccagctcagaacagcacaatccgctgaatgctgaaatgagcagtgctcagtaattccaaacaagtgatgggaacatcttagactatgtgttctttccctagcccttcaaattactaagttcttctcatctgtcacttggtggtgagtaattccgagtggttccctggaaagactgaattgcagcttgtgtgctgttgggccaatgaccatggattttcccttgccttctccactcagcctccaaggagggaatgtggatcaggacattctcttctgggaaacagagaaagaaatgctctggggagtggtgtgtgtgtcccttgtaaagagagtatcaaccaggccctggggattggtgacgtggttctgttgaaggtgtgtttaacaaagtcttgatgcaacttcccattggtctctcttcatccttgagaattaatcctataaactaacatctattgctacttattatttaccagggcttccctggtggctaagcagtaaagaatttgcctgccgtgcaagagacacaggtttgattcctgcatcaggaagatcactggagaaggaaatggaaacccactccagtattcttaactgggaaatcccatggacagaggagcctggtgggctacagttcatgggtcacagaagagtcggacacgactaagcaactaaacaacaattatgtaccaggcaccatgctaactcatttgtacatgttatttcatttcaaactcataatgcttggcagagcaggtatcatcatcaatatcccattttacacatgggcaaactgaggctcagagagggaaaacaactcagagcaaacagtggtggcggaatttgaatcaaggagtatctaaatctaggcccccggggttattcttgactctccagttccgacatttgctcacatctta

SEQ ID NO: 45893 - DNA, 1134 bp, Bovine  19866881304350
gtactcttgcctggaaaattccagagacagaggagcctggcgggctacagtccatggggtctcaaacagtcagacaatgaccaggcacagtacagtacatagtgacagtccagcttagaggtctgaaaccctggacgctagctttcttatcttggcctcccagctctttctctatgacctgggttctccccaggcccccaagctccgtgtgaataggaaatttgcccagatatcaacatctgtgtctggttgacttagagtttttctgacacaggggcattcctggacacagttcgcagcacccggagtccttgctttcagaaccttctcctggtgttggaacttgtacaggccagcccctcgctctctattttgtgtctgggactggccaactgcccatgttgcagtaatctctgcaaacctgtggcccaaaatgctcagctgctcattttcaggttttagtatatctgatgctgcagcccaacttgtttatggcagagctccctgtgatggggagaggagtcattcgatgtgtccaggcaaagggtggccaacacccagcacttgtgacactgcttgtttccaagcagggatctaagcagacttttctaattaaccaattagcgtgcactttcacatctaggccagacatagccacagggattttcttactttattattttatacagctagtgccaatagatcacagttaaatgaaacccacattctatctctggtgaaaggcttgctgctaaggcaggcacgtagaaaagaaggcaccctgagttgactcagagaataagtgcatggggcaggacaaggtccctggggacagaacagagggagaaaaagttactgaattccactgagggctcattacgaagggaatctttattgtgatggcccaatgaaactcacaatcttggctttggctacattcaattctttagcgatcttggctcagcagaccagggtcagagaaagcagctggatgccttgatccaaatctggcaagtctcaggataaccacactggcagcggtgtttctccattactgttgtgatggcaagtcgagcatattataagcacgattcttttcagagaagcccttccaccaagcttcagaagggctct

SEQ ID NO: 45894 - DNA, 906 bp, Bovine  19866881404738
gccatatgataatcagatgacaaaaggttcatacaccaggagtatgaagaaaacccacatgtagttaagtcccctgtaaataatgcagagcatcaggcttgcctctaaccagctgggatggcatgacatacagacttctttctagtctatgattcttcactcagtatttattctgtaatcatctcacagtactgagaatttggcattttaattttatctctcaggggaatacgtggatacaggcaccatgacaagtataacagtataacagaaggacagttaccttaggcttatactccatccttattttttttttcagatttccaagaaagaaagatattttcaaggttcatagcaaaaaattttactgtgacttcatatgcatcatctttcactacatgaaatctaaaaaaaaactgtatgttccaaactctatttcttatctggatagtctaaccataagtcattcatttttaaccattccacaaatgtatgttctgcattcattgaatcccagacaccgcggtggccattaggaagcagtatagtatagtggtgaagaatgggagctttgaacacagatagggcttgaatcctagttgtcatttactgtcttgtatgccttgtatgtgttctttaacttctctgagtcttattttctcattatgagaagagtaaaatattcaagccaatttatcagatagtcgtgagggttaggaattccctgatggtacagtagttaagtttctgtgtttccaatgtaagggctacagaattgatccctggttggagaactaagattccacatgccatgtgcgcaaccaaaaaaaaaagattattgtgaggattataggagcataaacacaaaatatgctcagataatgatggtgatgatgaagatgattt

SEQ ID NO: 45895 - DNA, 1455 bp, Bovine  19866881451166
actagtggtgggaatttgaaggcaaaggagtctcccttccctccttcaaaacatatggcataggccatcccccattctgtttttgcaatgcatggtcttcctccaccccactggagatcagccgagaacagaaaaacagagggtcgaaattctagaaggtacataaaggtaaggtactgtgtccggggcaatttaattgagaatagttcaacaacacggatctcattcggaacaactcaggctcccactactaagacctcaggtcaacaaggtgatatctctgcaagggcacctagaggttttgggtgagcccttctgccactggcttggaagccaataaatgggtttatctgagccctttttctgcaatactccatctcccccaccgcctacaaccctgccactggatttctgaatgtactccctggtaagcattctatttccctcctgaatttcttgaggcaatcctcccctgacctctctatctggttctttataacctccttcctagacaatcttcacaggtttgtttttacctgaggccacagaatgacatcctgatgccatggatctatctctgagctggttcccagctaatttcagttatgagcatttacctagattcttgttgtgtttactgttccacagatttgaccttctctcttggttcataccagtctaaaccaagcctaagtctgataaactctttttagttgatacacagtaaactattagttacatcaggtacaaaagaaagtttttcaatgtctcggaagagctttctgttgtgatggagaaggcatggactcggaagtctaggtttcaatcctaacactggtatatataaagaatatgattggtattctttcacttagacaggtgcatgtaagcttcaccatttccttatctgtactgtgtattttacttttgttagtttaatgtttcctcactgaaggctattaaggctgagtatttttaatatttattcctaagtaccatcatctatcgagtgataatctttgttcaaacttctcttgcctatagtgtctcaaactgtgagatcagcttctcataaggcggtaattgtacctggtgcttaaaatgtgagtcattctatacaaagcccatttcaagttcagaaactttaggatcggaatgctttctcattgaagttaaatgaacactatggaagtatttctctccctgtgaatcttgagcttatgttggagggggaagtacaacatatatggagaaagtgtttctttctcttaaatagaaaaatttgtcagcaacctgaaaagcatgacctcccacccctcactcacacaggttaaacaatttcaggactttccataacaagtttggctcatgtatcgcacaatgtcaagatccccgaggtccactgatcactttcttttacatcatcatcaatcattttatgttttaatgcattct

SEQ ID NO: 45896 - DNA, 1075 bp, Bovine  19866881526664
atgcgtgtgagaaagattttccatgacagtttactaaggtcctgtggtctgtttctagatgactggaatgatgaagggaaaaggtcatattgattgaaaagatgctatttgtctgttgctaaatttctttttgctccctctatcccaatgcatctggatggcatcatcgactcaatggatatacatctgagcaaactctgggagttagtgaaagacagggaagcctggtgtgctgcaggccatgggatcacagtgtcagacacagctcaacaacaacaatcccaatgcatctagctcttttggctgaaatagtcttcctaaaactgaggtcattgaattacttctttaacaaacagttactaggattccttattgcctttgattcaagcttgaattcttcattccaacattcacaaacttacacagatggctcctggcttaccctctgagtcttacacatatttcttcctcggagtagcacactcagccccaccacttactgcttataaaagcccaagagctatcaggcatttatcccaactacaaagatgactttaactttagcgaatgctcctcttccattgtacaaccactagcaggactcagttacagtatgccaattggatctcggttcttatgtgcaccttctggtcatttagtgatggcatgtacttacacataacacaaacagggcaaaccccaagtgattaacatcattatcagctgccttgttcaaccaggacatcacaacgtctgtgtgggaaattctagttagtaacattttcagtcctttggctaattgtgaaactctctagttcacagtaaattgaacctcaatcccatggtatgtttttgacttaacactgagccccaaaatccccaggtcttaaccatacctctacttctacaaacagttgcacacctgtgattcggatggaagcacctgagaactgaagacagagagatgatgaaaacagaggaaatgatggcaaggttaacacgtgagtgaactacagcttgctcactctgtaagacctatttccaaagcctgggcacttattttagaaactgtgaa

SEQ ID NO: 45897 - DNA, 997 bp, Bovine  19866882085091
ataagacctactttaatagttactattttttctccctgacactctggttcatcatcaccacacgtataggagatgacctatacatctgggaaagagctccagctccaagattcttcacccactgtgctggcagcattccacaagctcgtcttgggaaaccataattgattactctggagggaaaactccaactcaacaccagctggcagccagaccctgccctatagcccttgaattagtctccagcaacatcctcggcagggatagtataagagtgaatggggttgacattatcttaacatctaaaatgccactatgagcctgttctttcttaaatacaatcaagactgtgttaataaagtcccagagtggtgaattttccactggctacctttgagcctccctagtggctcagcagtaaagaatctacctgccagtgtagcagatgcagcttgttacatggactgggaagatcccctggagaaggagatggcaacccactccagtatttgcctgaaaaatcccatgggcagaggaacctggtgggctacagtccaagggggtcacaaaagagttcgacatgacttagtgactaaacaacaacccttgggaatcccagccatactttttttttttttttgtatatttgaacaggcagtgtattttttcatccatcagctcttgaacaaataagccaggtaataaagaaacaatccagggatgcagcagcattgggctagtagcagaaaggaaagcggagaccagctttgagagatggtgaagtggaggtgaacatcggtatcctgggatatatggatgctctaattgtgagagctgagttgactgttagctgttgggtccattaaggctgccattctaactttcaggaattgaaaaggaaaacaaaaatgttgattatctttccaaactcttcaaatgaaaatgagtaagaatttaaaaacatgaatgtgatttccattccaagaagtgcttcccg

SEQ ID NO: 45898 - DNA, 2787 bp, Bovine  19866880360004
actggaaggcagccttagaagctgagaagcccaaggcctgaaatcaaggtgagttaccatgatccttgaaaaacgaaattagcctgggattagagaggacactaggcctgtctaggagttctgttctgttctctccacagaactccttccctaccctctcctccctgggactggttctttcatagctccactcccaccagcatacccccagggacctccttggccagcccacacccagctctggatctgacagcatttctgaggacatccactacccttccggttttagccacaggagggcttccagttctcttgacctgagagctgagtcagacacagcagggcaaagcaggagccgagctccgaatgtcggggagcccattacctgcccccatgatggaacagtccggtagtaccacattcctcaacctccatatccaccagaagagagaggcaaaccaaacagtttgtgcatctatttattttggagaaacagctggggacctggggcgagaggactgtcggaaaagaaatgaagcagggcaaaggggtatccttgaggtgggagcagacaggaggaacaatgtcagactgaggacttgaaggaaaactgcagagaattctgcagagggagagtgggaaaggacagagtggaaattgaggggtgttgaggggcatcaatcaagaggcagatagggctggggtctagtaactgttgctgaggctggcagggagggctgctctggagaggccggacagtgtcccaactgtccccaggtggaaatcaggagggcggctggaaattggcaggattgtactcctgaggtctctacagaagttctaaggaacatataagcttctcttctgagggttattgcagaaattctggaagcagcatcgagagaatatccagaagccaaacactggagaggcgcgggtgtatgagcagtcactcatctgttccttgctgcggcagtcactcaccatggtctcaaaaccactgtctggggacggacagcaacaatcagtgacattggaggtccgaggcaaagccccgagccctcccatcccctcatgccacagagactgaccatcactgaccccctaccccttcctagaccccagaaaggcagatccctgaaactggacagggtcagggaatgccagggagtcaccagccatgaactctgtggaagtttcccatggaaggttggtgggaaagagccattcaaaacacagtgacagggacttccctggtggtccagtggccaagactctgagatcctaatgcaggggccccaggtttgatccctggtcagggaactagatcccgcatgctgcaaccgaaagatcccactaagcaactaagatcccatgaagcaactaagacctggtgcaccttaaataaataaatgttttttaaaaagttcctctgggagagtaaagaggaagacagcaaaagaccaaactctggtgaacacgaactgttaaggctcccgaagaaaaaggcaagactcagtgaaagaggctgagaagaagcagtggaagaggtagcagaagaatggtgctggcaggaactactgctgacagacggggagaaggcagcccgaggaaaggccagcggatctgggaactccaggcctgcgaggctgggtgttataaggagggtgagccaagaaggcaagaggaatggaagtagggatgtggagtagctctaaaggaaaggagagagggagtgatagaacagtatcttagagttgtgggaaccagttggggtgccgcttagaaggctggtagagactcagttcgggaatggactggacccaagatgaaaggaagaggcagcttactgttctttatgagcagagtcatgcagctgctgccctttgggacaaggcaggtgtcacatcccagaaggcatcccaactccttggtctcaaagaggcatcgatagcagcttaggtattcgttgaaatatttctgtctaatgggttcttgatcatatatctcagactgacctggaacacagagaagcactgaccccaaacccacttaattcccagactgatcaaccccactgttccctcctacctccctactcagaaaaccataaaatcaccaattcctgaaaaatatcaggcttaatctaacatcagaagctttagttctcataaaaaatctccactctctactctcatacctcttgaaatgaggaactcattcattcaacatgcatttgaggggctaacatgcttagcactctacaagcctctaaattaaaggttaggccaaggcagttcattccaacttttagcagccctgttaagacagtgcttcctctgtgacttggtttcactgtccctcacccaacccccagattctcttttgaatatgctttcttaatctgtaatgttcagagtgtgaaaacctcagagcgtatcatcacaggacaggaagaatctctcctttctgtagccaggagacttcaaacagcccagggccacattctttgtttggttgtcctttaactgaacagactcatgaaacgttgtccaccaaagccctccccaactacaccatattcatctccctcctcctctggtcccgggcccagatcacatgttactgagcccccaaaacccactttcagacccagcagagcacttgtatgaagcagatgctgagcaaacactttggatctggtttctgtgtagacggtgctttgcacccaagtggagttatcaggctgaacttagccttgttctacgctgtgtatcctgaggctgt

SEQ ID NO: 45899 - DNA, 757 bp, Bovine  19866880370292
tggcagcaccccccatcaccaacccctgcactccccccacggcagccccgcccgcgtccctcccaccagagcctgaggcctctttcctgggccccagccccacctgcaaagagaaccgagagaagttagtgccccaggacgccctcccgcttcgccctccaagcccgccaccgttggtgccctagaaagaagaaatgagcgggtggggcactgcgtctgaaggagagaaaggggcgtgggaggagagaacgcgagcgacagcgaggtgggcgtccctctgtcacaggaaagggaaagaaagatccaggcatctgttaagagacttggagggttagtggaaaattactgctgagacctaactcccccaaaccccaattctaaagtcaacaggcgccttgatctctaatctcccccagctccagtcccaggagacctgaccactgagatggagcacagggcagtccctgtgcccaaggtcagatcagaaccacccctatctggttgggccggatagcatcttttatttactgcatctctccatgaggctgctcttcccaaactccaacccaccgcctgcctacaggactccaggcacctgagaactccgtctcctcagagcccctggtacagaggaaggcccccagaaggtactttgggactgccacacaccctgtgcagtgcattcagaggagcctgtgtgcacggcttcccaaggaagtggctcctaggctcagaaacttccccagcccttggccag

SEQ ID NO: 45900 - DNA, 1589 bp, Bovine  19866880434422
taggaggaagtccagcgggtgggggacagagggccaaggtccttgctttgaggcaacactggatggagaagattcttgcccccaaaatgggacagttggcagggagacccgattcggctcctgcagctacacagaccaaggctgtgggcctcatgccaggggtggtgaccgcagggggatgggtgagagggtgcccacccccgggcagaaccaagtaggccctggaactaggggacagcatgttcttgcaatcatgtttagaaataagagaggaaacagagtgaccacctgctgggggaagagatgagagggaacaggagatggagacatgggaaagtcaagtccctttcccggtccagctgtccccacccctggtggctcaatgctgggcccttccgggaggaaatccctttagtgtttcagccattcacctcccaggagtcccctcagcccccctcctgatccctgttgtcttgcttccgagggatggggcctgaagctggacttgggaggccagagaataaacaggaaaggaagggtggggattagtaactgagagacctgggatctagggggctggggtgtgagtgccacgtggggactagaacaggggcgtaaaggcgatggtggtgtggagcaccttcttgggctgctgcaggcaggtccctcccaagcatccaaaggagggcaaatggagccccttgctccctgctcccatctcaccctcatctccatccctagggctgcagtgcgggagtttcccagaaccctgtgccaacggaggcacctgcctgagcctatcccaggggcaagggacctgccagtgagtgcacctcatgggagtgggagacggggaaggggaacaagggaggggatgcggagaatgggaagaaaggagaaaggaaggaggcgaagaagatgaagagaaacaaatgaggcaaaggagggaggcaggtgggagcagagggtcaggatgtgaactttcctctctccacccctcccaggtgtgcccctggcttcctgggtgagacatgccagtttcctgacccctgccaggatgcccagccctgccagaacggaggcagctgccacgcctttcttcccacccttcccggctcccctagcaccccctctcccatggcccccagcttcttctgcacctgcccctctggcttcactggcgataggtgccaggcccagatcagggacccctgttcctccttctgttccaaaatgggtcgctgccacctccaggactcgggccgcccacgatgctcctgcatgccaggatggacgggtgagcgctgatgggagagggaggaagggacaggagggggccgtggctgggctgtggggtaggagagatggaactggagcccaagagactgtgagcctttggaggacggaggcctcgagaatcaaccagccaattctaggtgatccgtttacccgaaactgacattcaccagcagaattgtaatgactgctaaaacattgagctatttccaagccagctggtaaagaactactgccatagcccccttagcacagcccctgaccactttccccgccccctcaatctcccctga

SEQ ID NO: 45901 - DNA, 1732 bp, Bovine  19866880447294
atggggaacaaatgtatacctgtgcggattcatttcgatatttggcaaaactaatacaatattgtaaagtttaaaaataaaatttaaaaaaaaataggaagaactaatctgtagttgtagaggtcaaaaagttggttggttatctttgggaggtttgaactgagagagggcatgagagaaccttctggggaaggttctaaaaatatgttgaactggatggtggctgcatggctctaaacagatgaaaaatttcatcaagctgtctacttaggagaagtgcacctcactgtacctgagttccagatcgacagaaatgggaaatccttaatgattttacaacagtgtactagggcttccctggtggctcagtgacagagaatccacctgacaacacaggagacacaggtttgattcctggtccaggagaatcccacatgccatggagcaactaagcccatgcactacaactactgagcctgtgctctagagcctgggagctacaactactgaagcccatgcaccctatagccggtgctttgcaacagagaagccactgcagtgagaagcccgcaccctgcaactagagaatagctcccgttcaccgcaaccagagaaaagtccatacagcaacaaagactcagtgcagccataatgaaaggaaggaaggaaggaagaaaattataaaaacaaaacaatgtattggctttacaaacgcagcttcaagacaggtcattttgctatctccaccccattccagaacaccacccttgagctccacctgtgtggaattctgaagcctgcagtgtagagaacttaggcagttaccacattccttgatgctggaatgtgtttgtttggggttatataaatctgatcttccgagtccacctaaggttgggatgaggtggagggagtccttcagtaagatgagacctcatcatacgtgagttcagagcctcatccctgagtgggattttccaaaccaagacacttctaagagcagaacggagctccatgaatgtttccaccaggacaacaggcataaaccaggatgtcccaggcaggagggtgtataatgcaacttcttgatatgaaacccaccagatgacctggaaaatacacagactgggacaagttgacaagtgttttgggacaaagacatggggtatgagaggaggaaacatgcacacagagaaggctgtaatcagtcaagggtgcagaggtgttacacaaaatcactcttcagggaaccgggcctccagcccacgccctagcagctccccttctcctcctctgaatttactgtcccttctctagaactcctaagcctgaccccgctccctggccctcccagcccacggttcccctgaccccactccctttcccagaactcagtcgtctgagcccccagcctgcggttctgtcctaggcctcagcctttcctgccttcgactgaaacagcagcatcttctaagccctgggggcttccccaggccccagccccggcctagaacccgcccgccgtctgccacgctgccactgccgcttcctctataaagggacccaggcgtccgggccaaggggcccccgcacagcaggtgagactctcccagcccatctcctcgggctgccggggcggtggactccttccccgggggcgttcagtccctcctctcacaccccagcccctcctgcaccttcagccagggccagggccttggtggggctgatt

SEQ ID NO: 45902 - DNA, 1503 bp, Bovine  19866880447877
cggcaaagaatctgtgtgcaatgcaggcgccacaagagacacatgtttcatccctgggttgggaagataccttggaggagggcatggcaacccactccagtattcttacccggagaatcccatggactgaggagcctggcaggctatagtcagacatgactgaagtgacttaacacacatgcacacaaggtgtgaacaggcagtattcagaagagaaaactaaaaagccaataaacttatggaggtcattagtcatcagaaaaatgcaaactgaaatacaagataggactttacagtaattaaaactggtaaaatttaggaaagtaggcaatgccacgtgttgcctgagatgtaggagatgaaaggattacaggaacccttgtacaggtgtggccagtctgaagtgtacctggtgctcttgaggcaaagacaagtctgtgcctactctttgtccctaaattccgctcctgagtgcaaatcacaatgaagttctcaccctggtcggtgagggaacacgtctgctcttcctctgtgggctcttgtctggtggcagggcgttggtggcaccaggggccctttccctgggagagcaggtaggcagctatatgccacgcactccacaaggtgttctgtggcaggttggaggcaacggattagatataatcacaggaacacggatggatgttgaaaatactacatgggaagagaagaaaacagaaggagatacgtgtcgcctttacttcaaactgtattacacactcaaaaaacattttataaaacacattcacatgaaaagatacagattaaagatagaggggagacaggagtgggctgtgggggtgaaaggaaagaaataggtagctaaataaaacaatagtacctactctgtagatttgccttgagagtcacctgaggtctcgtgagttaaccgtctgggactatgtatagtggtcttagccttggctacaaagtgaggtgggctcggccagggctgggccacagctgtgtttagccccttagctgatcctctcttcccctccccatctcaggtcttgtttgccacggagaccttcgccatgggtgtaaatatgccagcccggacagtggtatttgactccatgcgcaagcacgatggctccaccttccgggacctactccctggggagtatgtgcagatggcgggccgggcgggccggaggggcctggaccccacaggcacggtcatcctgctctgcaagggcccgcgtgcccgagatggcagacctgcaccgcatgatgatggtgagccggggcacctcgaggccagctctgggcacctgctgcatcctctgtgcccaccctcctcccctctcctctctctctgctttcctttggtctgggagaagccaggggaggagcgagccaatctgaggatgaggctggatcttgtcttctctagtcttttcactgtgaatatggagctaggtgggaccttggagaagtctgtttatttagtctcgctcc

SEQ ID NO: 45903 - DNA, 1049 bp, Bovine  19866880449253
cgtgctgcagtccatggggtagcaaaaagttggacagactgagcgactgaactgaacagatgcctgaatcactttgatatacacatgaaactgatacaacattgtaaatcaactatatttaataaaaagaaaaagaaactgtatccttttatcctattaaaataaaggagaccaaaaagacatgacaaataaatgcagtgcatgatcttagattagatcctggactaagaaaaaataaactttataaaggacattatggagcagttggcaaattttggacatggactatagattagataatagtagtatatcaatttaagtttcctgcttttgatagctgtaccatggttttgcaaaagaaggttcttgctcttaagaaattcacaccaatgtgtttattaggaaaaggatatattactcatagtgaaagtgttagttgctcagtcgtatctgactctgtgaccccatggactctagcccatcaggctcctctgtccatagaattctccaggcaagaatactggagtgggttgtcattcccttctccagggaaccttcccaagacagggatcaaattcaggtcacctgcattgcaggactctttatctatcatctgatcctccaggaaagcctatcttatgtgtgacttactctcaaaggcttcagaaaaaaaacactaacatgtaattagagaaataacaataaatgtggtcaaattatatcaattggtgaatctgagtgaagaatatcttgggataatctgtggtgtttttgcctctcttctgtgagttttaaattacttcaaaataaagagtttaaaaaaatagaaaattaaaaaaaaaaaaagaatgatgctggcaaagtatactcattggcaaggaaaggtattcagagtgcaccagtctgggccgtggggccttaacactggagctgtgctacggatgacacctccagccagcctggactctcagttccctgagctactagaggaactgggtgtgtggctgaacccaaagccatcctgggttgactcaagaaggctggttgag

SEQ ID NO: 45904 - DNA, 576 bp, Bovine  19866880458605
aaggcagtgaagttcccagggccgtatggaacaccggacctgctgaacctaccccacaggagaggactgccaagacctggggaccctgtccccttacctcagcatcattgatatagtgaacctcatcaaagataacccactccaggtcccggatgacgtccgagccactgtacagcatggagctggaggagaaaggccccaggctgactcctcagcagctcctatctccaccctcacctcagccagagtgctctccaaagcagcctcaccttcctgaccaaaaacccgccccatgctgaatgcccgcctctcaccgaaggatctccgttgtcataatgaggcacgaggcttctgggtgcagctgcacatccccggtgagcagccccacgtccccaaacgtgtttcggaagtcccggaacttctggttgctcagagccttgatgggcgaagtatagatggtgctgggaggagggcacgaagtcagccaggccctccacacaggctccttgtcagcacctcctctcccaccctgacccttgccagcggcacgccgcagagctgaggcgcccccccaaa

SEQ ID NO: 45905 - DNA, 1136 bp, Bovine  19866880497388
tttgaattctctgacttttttgcggtcaccctgctgatgcttagttgcttcagtcatgtctgactctgtgcgacccttatggactgctgcctgccggtctcctctgtccatgggattccctaggcaaaaatactggagtgggttgccatattctcttccaggggatcttccccacccagggatggaacccaggtctcctgcatttcaggcagagtctttacccctgagccgccttcagccagttctctctattctaaaatgccctttttgtagaagtatgtgttgttaggccacatggattctgttggcatttgtgtcagattttcagacacacctaggctcagagccatatcccactacttatgaaaagagggcctttgggcaagttccttctctgaatcacagtatttttatctttaaattggaggccctgattcctcacagggctaatgtgacgttcaagtgagcttgacacagtacgtgctgaatcaatgagacctcccttctcctttgcctaattggaggacagactgaaattttcgaaaggactttaaaaattctgtttccctgtcttatctcttttcctcattaccaaatttcccaagagttgtttacaggcttctggtggctcagtggtaaagaatttgcctgccaatgcaggcgacaggggtttgttccctggtctgggaagatcacacgtgccatggagcaactaagcctgtgtgccacaactattgagcctgtgctctggagctggggggccacaactactgaaccccgagtgccctagaacccgtgctccgcaacaagagaaaccaccacaatgagaagcctgctcatcacgactagagagtagccccctgctccctgcaactagaggaaagaccacgcagcaacaaagacacagcagagtcaaaaattttttaaataaataaatatgagttgtttacactccagtgagagcagaaatttaaaaagttgtcaaggtgagaatttaagtttgtaaaattctgtaccttgtccccttcttgctacttctccttcctgggagtatgaatgggacagagggcctaatctcagtttggagtttaatacagatagtcctaggtagcaggtagagttaagagctgcggaat

SEQ ID NO: 45906 - DNA, 2001 bp, Bovine  19866880521420
catatattatgctaatcaggaaaaatgtaaccagaagccttttaatatagtttaaaatatttaggttttcatgatccttacgtcatttttctatagctctctgggttcaactggtagttttgttgttgttcagttgctcagtcatgtccagctctgcaactgtactgactgcagcatgccaggcttctctgtcctttacagtttcccggagcttgctcaaactcatgtccattgagctggtgatgacatccaatcatctcatcctcagtcaaccccttctcctcctgccttcaatctttcccagcatcagggtcttttcaaatgagtcagctcttcacatcaggtggccaaagtactggagtttcagcttcagcatcagttcttccaatgaatactcagggttgatttcctttaggattgactggtttgatctccctgcagtccaacagactctcaagagtcttctccaacaccacagttcaaaagcttcaatttttcagtgctcagctttctttatagtccaagtcatacatgactactggaaaaaaacatagccttaagtatacagacctttgttggtagttagctagaggatttcggagaaggcaatggcaccccactccagtactcttgcctggaaaatcccatggacggaggagcctggtaggctgcagtccatggggtcgttaagagtcagacacgactgagcgacttcactttcacttttcactttcatgcattggagaaggaaatggcaacccactccagtgttcttgcctggagaatcccaagggacgggggagcctggtgggctgccatctatggggtcgcacagagtcagacatgactgaagtgacttagcatagcatagctagaggatttagaaggctctgacaagtgcagtttctctaggatttcggctaagaagcagggaccctgccaaggcaactactaaaaaaaaaaccagacagactttagcaatcagctcagctgactccatactgaagagtatatccctctgaaccaaggattcagaagagatgaattcatagaaacctccctgtatcttctccaaaatttctagcttgcagtcaaacatttttatccccaggagaggtttctttgaaagcaagtaagtcatacaataggaaactccaactatgaaaatggaacattctctaaagaccaccaaaaaacagactagttaaaaacaattgttaattctccctttaagatacagatatgaaaatcttccctggtggctcagatggtaacgagtctgcctgctatgtgggagacccaggttcaattcctgggttggggaagatcctctggagaaggaaatgacaacctactccagtattcttgcctggaaatcccatggacagaggaggtcataagattcggacacaacttagtgactaaaccgccaccagtccattcatctaccaatgaatcgcctactgtatgagttctgtattggggagtttattggccctgaggggtcttttgtatctgaggacattcttagactctcctggtgctctaaaactcaactcctagaatcccaacagacacctaactaggagtaggaaaagatactccttctaactgagcacctttgtagaatttttcccccttacaatgaaatacattcaagaatgacgagatgtcactagactcctgttttccaacatctctccgaaaatccaaaccctggtccacatctctgtgtctatctaaacaggtaattatactttgggtattaaagtcttctatctctgacctacccagtgcacaaaaaacagtttaacctttaaaccaagtcatgtacaccattttactcctcgaaagatgaatttatgttattccgtcaaatcagtatcaacctgacctttaaacacatcagtgtttcttggaaaaatattatggctgggatgccgaccaaggtaaacaatattagctgctcctacccagcaccgagccatgctgcgcagaggc

SEQ ID NO: 45907 - DNA, 1198 bp, Bovine  19866880543334
taggaaactgttgatatggcagggaagtactcagttaggaacaggggttagtgcagagtcctaggggtgcaagctcgggggagggggaggcccctcaggtgccacctgaaggagtttgagctcctatagggagcgacagggaacacaaagggccgtgatatggggcagaaagtggcatttgcagctgagccctagtggtttcctacgagtggaccacctgctgggggagggccccccacgtgtgcgctcttctgtggggagcttccccctcccaccccagccccgagacccctcctactcctacttacaggatccatggtgaaacaggctcgattccagtccaaggagctgccaagcttcttcagctggtggtaaatccggtcacctttcctgggagtggacagacagaccagggtcagcaatggggtctgggctggcgggtgacatcaggtagctaaaggggcagaaggtgggggtcactcattgctctgagatggacctgggccctgggcccccatgaccctcagcctctgtgggcgggtctgaccctgcagccagggtcgtggggctgcgatgccagcagggacttggcactcactcctccttccacttccagacctcctgcaggaaagcctctcgccccagctggtgccgactcagcccctgctcgcgccagagtttcttctccaccaccacctgggtggcaatgcccgcgtggtcacagccagggttccacagggtggtctctccgcgcatgcggtgcctgcagggagcatcgagaagcagaggtgagcgagtggtggagctgccctgagggaagcagggactccagacaggaggtcgatggactcaggaaaggaaggggtggtggattagaactctctccttgctaaaatcgtcagggagagatgcgtgaggacagcccaggcaatttggcaaaagcaactaagaggaggctcctgcccaactagatagcaaaacatatcagagagctatgatcattaaaacaagcttccacaggaaccaggaacaaagttaccgattaaggaaacaaaacagtgactggaaacagatctaagcatatttagtatttgttaagggtggcatttcatgtcagtggagaaaggacaaactgttcaataaatttgttggagactgtagctaattgcatggaaaattgccctacttccccaagtca

SEQ ID NO: 45908 - DNA, 1130 bp, Bovine  19866880553409
tgactcccctccctgttctacttaattaaacccaggagaggggggctgggggggataattagggaggtctccagccgctgcttaatgagccagtaattaaccagccagggaggggagctggcctctggccagactcgggagagcgggcagcctccggcctcaccttcctaccctccacccggccaccccagacaccagtcttgagtccagagggggatcacatttattcatataaccaaacatcagacagttcagaacagcagtggggagggagggtgggcagggctaaatgtcctttcacagcctgtaggcccctcagtcctggggctagggggtgcgggtgatggagatgtgagaatggtctttatgtctttgccgggccctctcttcctttcttcttattgggaaggagggtggaattcccaggtcaaaaccttgggagatttgctgttctttgggagatggaggacagagccctgagatcccacctggtagcttgactactggggttgtccccacagctcaagacggagactctcaggcactccctgagatcagaagagagggtgaggtgtcccactgaggctgggatcctctcatagcctcataacacacttggttatggcgggagttattatccatcctaccttggctattcctaggctttgagactttcacctgctccacttcccaggaaaggtggatgagggtgatgaatattgagatttatgctgggtcttccagtctctggtgctcctccctggcaggggtgagggcatgcagtggggctgcccagcttttgagccccaggaatgcagaggggctggtggggggctcaagtctcagcaggtgtgtgtggggggccgggacctttgctcctccattcgacccccaccctgaactctcagcagcaactccaggagctcctgcccccctgggggtaggggaggctctgaccgctgggcttccatccgctggcactggaggagtggaggagggggaggttgatggtgaggttttaaaaagagcagaccttgaaaggagccagggctggtgtgaggggcatagaggacaccagtgatgtggggatagggagagtaggacctggcgagggggaagatgcctgggga

SEQ ID NO: 45909 - DNA, 967 bp, Bovine  19866880616843
tgaaacaaactagataaaagtataagattatcatatagtccagttgtttttaaacatggctgctcattagaaacacatctggagttttggagaagaatagcaataatttgggcatttacatttttcaaaagattccaagataattctgttatgcatctggatttttaaaagtgattacaagtttttctatgaaatcatagttttagtgatatagaattatattattttctgttgactgatcatgatacaaagatattaagtgtataatagttatataatcaaaatagtaaaaagtgttttagaggaggaaatggcaatccactccagaattcttgcctggaagtttccacgggcagaggaacctggctggctacagtctattgtggtcgaaaagagttggacacaactgagcaactgaacctacatgaccctcctacaaaggtgtgtctgtggtttcctgtctttggacacgtaagacttggaggcaaagaaatgtggatttggaggagtctgtggccagcttcctccctgcaggcccaagatcaaccatccaacatagaaaagcctttgatttctccatcaagtctgaatgagagtcttgctgtgtagagtattcttggttgtacattcttccctttcattactttagacatatcgtgccatttgcttctggcttgcagaatttcttttgtgaaatcagctgataacctgatgggagtccccttgtatgttatatgccattttccccttattgcttttagtattttattaatatctttgtctttaattttcacagttttgattactatgtgtctcagtgtctcctccttgggtttatcctgtctgggactgtctgcacttcctaggcttggttgactatttccttttccatgttggggaactttttagctattatttcttcaaacattttcttgggtcctttctctgtcccttctccttctgttgt

SEQ ID NO: 45910 - DNA, 2592 bp, Bovine  19866880686101
gaagtgatgagactgtggcgctcaccgccttcgtggtcatcgcccttcaccacgggctggcggtcttcccagagaaaaattctgagcagttgaggagagtggtaaggcagctatgtgtctgctctttgctgatgccctttcccgtcaggagcccagtccacagacctctcccccacacacactttcttccaggaaaattccatctcaagagcaaacaccttcttgggggcgaaagcaacctctgggctcctgggtgcccacgcctccgccatcacggcctatgccctgtcgctgaccgaggcccctgaggacctgcggagagctgcccacaacaacctgatggccatggccaaggacatcggtggtgagggggtcctggcagtggtcctgaggcttgggagagcttgagatccctgagcatgtccaaagggagaaacagaatgaatggaggccctcggagggaatcagagcataagcgggggtgattgggaaatcaggagagactaaaggggggggcgtcaaagggccagacatctaagatcctcccctgttcacctgtgggtctcctttcactccagataagctgtactggggctcagtcaccacttctccaagcaacgtcctgtcacccactctggctccacacagcccagcagaccccattccccaggctccggccctctggattgaaaccacggcctatggcctgctacacctgctgctatgggagggcaaggctgagttggccgaccaggctgcatcctggctgacccgccagggcagcttccaagggggattccgcagcacccaggtaggggctgtcccgggattctagggtggctggtcctgagcccgagtacctgagtcccggcccatttgccccaggacactgttgtggctctggacgccctgtctgcgtactggattgcgtcccacaccaccgaggagaaggggctcaacgtgaccctgagctccttgggccgcagtgggctcaagtcccacgtgttgcagctgaccaaccaccaagtccacaggctggaggaggagctgcaggtgaaccgtgccctcacctgggtgaccgggacacctgggcctccttcggccaggccagaagccatccccttttcctcacccctgctgaatccctatggcccctctttctgataactgtgggaagacttactggctctgtgagctgtagcaagtcacccaacctctgagattcattgatctgatgtaaaaatgatccatgcagaatctacagagggtttaggagatggtggagagagaatgcaggtgaaggtagaaagtgttgaaaagagaggtggggagaggaggtggagttattttggtggaggaggtaagttgaagcaacagtgtgcccttctgacatctctttcccttttgtgcttgtgaaagttttccctgggaagcaagattaacgtggaggtgagaggaaacagcaaaggaaccttgaaggtgagagctggtggcactgggcaggcaggcccatcagggtgaagctggggtgttgagtgggagacctgcgggcagagctcatggtctgggaaggaggaagaggcccctgggttgcggttgcctgtgctctgtcctgggcaggtgcccctcactctgctctgccctctttctgggcacctgtggtccccttcagccctcagtgctgatgctcaaacacttggcccctcaagccaagtgtctcccctgagctctgagcccctgtgtcccacagcaccttagacgtggttgagccccaaaccccttcctcctcctgtgtctccttgtctgactgacagtgtcccttccatacaggagcccagctgccactgcagaggccatcttagtgccccctgctccatcctaagcctgtcctcatgaccccagtacctcctcgtctgctttcaccccagccatgcccacctccccagcaggacaggtccttgcatctatacacatctcctggccctgaatgtccttcaggtgcttcttgtcccccatgacacactcattctcctcctccaagcttctcctggcagccattcctgaacttttctctgtagcttcttcagtgcatgtgtacagtgcctgcccccatgccaggaccctgctccgctctctttctcacccaacacctcggctcctttgtatttttggactggtctgggaggtggatgggaatgggcagagggcctcgaagctcttagcccaggagctaaggggtccagagccttccatgtggctctggagagaggtctgtggccccaaaggtcccatgtccccttcccaccccttgttgagccaggtcctttgcaactacaatgtcatggacatgacgaacacgacccgccagggtcttcagattgaagtgacggtcatgggccacgtcgagtacacgagtgagtgttggggtcacaggctgtgggtctctgaggggggtggtgccagggctgagccacagtgctgtcccctcgcagtagaggcggaggaggactacgaggactaaagtaggaggactctccagccggggatgaccccgaggcccactcccggcccgtgacacctctaaatctgttt

SEQ ID NO: 45911 - DNA, 4461 bp, Bovine  19866880710146
agaacctggagcggtggtagggacgttggtctcagtcctggagatacacacagacactttgttgccaaaggcttttattgagtccctggttttgcctagggctctgttcagggtacccggcacagcaggaatccaggcaccatctttcgcagctctggctcgtcctggggaagctgggagagcaccctcacacctggcagccctgtgtgccatactcctggaggaagctgttgagctgggcacagggtgtccgatggcgggtgctctggcacatgcgctcagagggcatctcctcaatccagctgttcgagtccagcaagtactgggggctgcaggcaaaggggcagtgagcaggggtcagcggagggtcagaggcagaccttgaggcacctggcttctgagggcacaggggaccgtttcccttgagaggcgtgggcagagaagaagactgaggggtcccgagaactcactctcccttgaggtcgtaagtggccccatccagacccatgatcagatattctttcccaggttccaactgaaggcggcaagaggctcggaccaggaagtttctggtctgatcagcggtggccctggcatccttggctgaggggtgaaggtccacagagtcattcgaggggaagaggaggggtgggacagcagggggccggggggctttgcgctgagcctccatttgaccctcaccactcccagcgggcaggtgggactgcattcctgtctgtggacaagcccagggcttctaagaggctgaggggctttgagctcggactggctgcagtttcactcctccaggcaccaaggccccaaagccagacctcagctccccagtatgccccccggccctgcccacttatcgtccccctcttactgaaatgcaggacttgggtgatacgggtctcaaagaggcggaaagcagccctgctgtcttctcggagaaccttaacctggaagcctgtggggggtttaggagaagggagggaaggttagttatcccgaggctaagaggatgggaggtcagtgcagagtgacaaggctgcccatgggcctgagaggagcaggccaaatctaagagaccttgagggggggtcagggccagggccagggccagggccagggcccgggcgggaagactgaccgtagtccactcggggagagtagcaggcgaatttcatccggtaaccctccaagtcctgctgcccacgctccagggcccggcgctgtcgagggcacttccctgaagtcaggggcccaggtgagaccgtgtaggccccagccacgccgccttcccacccctgatccccggcccagtgtctcaccctcagcacactggcagacatccgcagagcacaacgtggacaagagtttgctcttacgtggtgccccataaaacacagaacacttgtgctctagagaaaagcagagaggggcgttcattagggcactcgcctctccttgcctccccagtcccatggacccacaggactcccttaccaccctcactgccacctatccccaccctcccgagagtccccgacgtctcaccagggttgtagtagtcatacaggatggcactggccggctgtaccagccccacgggcacctcctgcacagctccaaagcccacacactcccgggaggtggggacctgccatggggggcgatgggtggaggggaagtcagggacccacctctgggccctgcagaccgctatgatggatttccttgcctgtttggttccggtcgatcttatcttcagtgtccttcaccatttgttaccttccagcctcgggatttctaaaaactgctccccaaggtctctgctgacttcactgctcacatggtgacctcaccccagtctcttgtcctggcaccttcacagaggctcacttcatggacacattcttcacgaagctctccctaccctcagggctagcttccagaccaccccgattctgacctgctcatttcttaccttcctgcttcgtccctcccagagacacaggccccagcgtaggcccttccccttctctgtgctctcctggggcagtctcaccgctccccaaactgcaggcgcgtggctcctgaaccaaatgttcagcctgattcttgtattgggatttttacaagatgtattaaactctcccaattcccactgcctgccctccaaacccactcaccccctccatagcttcactgatacaactaaggcctcacttgtctcctaggtaccaccaagtgctagccctctgccgtcctctctgacccgccactcgtgtaggccctgatccctctcctcatggccacgctgctccagtccagcctggtatcgcacacgagtttccttcctaagctgcacggtgagctccctgacttgacatcttcctcattttcttcaaccagactcctctgcctggcttctctagccaacagggtccgtcccctctgcacacagtgggcagggagggcctccccgacccacagacacatggcgaatggtatcacagtattaacacgcctttttcacatttctctccaaaggttacaataaatattcaaaaaaattttggagggccatcagagagttgataactgtgtgttagtcaaatttggccatgggaaagaaaaacaacaactcttctgggtccaccatcattataaaaacaaaaacaaaacacacttgaatatcaaaacgggaagttcaacaacaaaaaagccgtccctcacgacgaataaattcaaatttaagaaaggcgctctctcaagccctccccggctgactggcactgggcccaaagccaccgaaggggctcagccccgcctccctgcaggcagcggggaacctccctggccaaggctctgaccccctcctgtcctgccttcctgctcactccacaaggtctctcccagagcagtagctgctgatacacctgcctcctggaaatcctcctaacacgagctcaggaaacccagtgccagctgtgcgcccctctgtcaccctccttgctcaccgagtcgaagtacagcaggacgtggggaccctcggtctcaaagtggctcacgtaacggtcggagagggaggtcagctgtggggaacgggagccgggagtcacaaggagaaagcccccggccgcctgcacgtgacagggctcagcagctggggctgctgcggggatggggcagggctcctggggcacaggcggcccctctgggtggctggtcacaccttctccaggtcagcccgcagggcgtggaatccactcaggagggtgatgtccgcaatggccatgcctgacagccccaccttgccagtccgcctgtggagacatgtgcctgttgtctgggtcgccccccacctggtgccaggctgcagacacccagccccaacctcggctctgcctccctctcccagcccggcagcacccacacgcccagggccaccccagggctcaccagatgcacacagtgtactgcaccctggattcccgctcctcagctgccttgggggcctccctcctccggcggttcctccgaccgtcaaatagctgcaggggtgtcacgggccgggagtgggcctcggggtcatccccggctagcaagtcctcatactcgtagtcctggtagtcctcctccgcctccactgcgaggggacagcactgtggctcagccctggcaccacccctcagagacccacagcctgtgaccccaacactcactcgtgtactcgacgtggcccatgaccgtcacttcaatctgaagatcctggcaggtcgtgttcgtcatgtccatgacgttgtagctgcgaaggacctggttcatcagggggtgggaagaggacatgcggacacttagggccacagacctctctgcagagccacatggaagggctctggatcccttagctcctgggctaagagctttgaggccttctgccctttcccatcctgcccctggacctgtccagaaatacaaatggactcaggtgttgggtgagtagggggtgcagggtcctggcacgggggcaagcattgtacagaagcaccggagaggctttaatggaaagttcaggaaatgcgcctggcctaggcttgaaagaggaaaatgagtttgtcatgtgggacaagaagatcctggaggtcattcaaagctaagatatgtgtgtacatgggaggatctgtcccactagggaggtgggcggggctgaggcgaaaacagaggcggaggtactggggaggtgggcggggctggggagtaagcacacgcggagttactggggaggcgggtgcgactggagagaaagcagaggaggagttacactggatttgggcgcggctggagagaaagcagagaaggagttactggggaggtcagtggcagtcgggggaaagaacatgaggagttactggggaggtgggctgggctgaagagaacgcagaggaggagtta

SEQ ID NO: 45912 - DNA, 2094 bp, Bovine  19866880713797
ggactgtcatccccctgggtcccactgcataggaactggtctgtcaccacctctctgacatctgtcaggttggggaacgtggttttgtctttgaggacgaccttgacacagtttgtccactgcaggaggggcagaagaggacacaaggatggagtgagcgagcccagggcagggcttgctaggcccaggaggagggatgacttggggtcagaggtagaaagcagccagagctaggggatacagagagaaatcccatccccaccctcaacagcatccagaacctgagaccctcacctctgaccctgtcttgagattaatattcagcttatccccgttcaaagccacaaaatgagcgggaatgctcacttggttcagaagctccttctctgcagtcaaggacaaggatgtcagtgctggtccctttacccagcatcctgacctggggactgcagcacagcccacgatatcaccccccaagccttggtgccagtccctccagcaccgagtccagcgctcaccatgatctcggcaggtactgcctgggagtttccgcagagccaggttggcccccaccgtgcaggggaggcagatgggcctgaggagaagggccagggtcacagaggcccatccttggtgccccctcctccagggctccccaggacaccctcccctatagagggtgccctcccatcccagacccctgcacctagcatgggtggacatcttcactttctgggtcagctttagcaaagcaatgtcatcgccatagaactctgggattccctgactcttcttggaaaagacattgaagcctggggagatcactgcctcctcaatttggaattctttgctcccctgaaagttgggatcccctggaaacaaagtagcagattaggctggaccagggctcctgaaggggccagaggctgggaacaaggggtgggagctctgcccaggagatcgggaatctggttcgggcccttccttacccacactgaccctccacagcgtgcggtcctcggcattgcggaagcagtgagcggctgtcaggacccactggtcggagatcagggccccccggcaggtctcctggctcttgggctgcagggggacaggtaatctcagggactgctatgtctctggctcacggccgcacctctgggatccaagccccatccctctttctgtgtaccttaatagtgacgtgccagggtgtcctctcctgggcagaggcattggcagacatgttccctaccccacagatggggtctgtgagctgggagacatctgtgggtgtgaggagcagatggtgaaggaggccagtgaggggcaatgtgagcaggtgccatccagggaccctcagccggctccacactggccacccccctccagagagggggaagtgcactcacccagcatgtgctcgaagacctggctcagcgcctgtacatccttcagaatgaaggcgtgcctctcgccgtccttcttggaccccaggttattcagttctttccagtccacgtgtaggctgcccacaccgatggcatagatgtctgagggggagggaattagcagaatctcacagtgagtggctatcccgcagcacaggaagctgtagctgggaactcgctgtgtcccacgaagccctacgtgagcgggatgccctcccccttcctccactacctatctgacctcatttcctaccactcctccccttcagtctcttccagtcacacaacctcttgaagttcctgaaatacactcccacctcagggcctttgcacgagctttgtccctgcctggttcattcctaccccaggcttcccacatgcctcactctcttacatttctaagctttgattcaaatgtcaccatcgcaggaggcctgctgtggcctccttgtgtaaaactgcaatgacgcagacatctcgatttcttttctgcttaactttatacctcagtgcatgtcaccctctactgtgccatatggcttccttatttattttctgtaatgcctggagtgggtagaattatgtcttctcgaaaggtatgttcaggtcctaacctccaggacctgtgaatatgctcatatat

SEQ ID NO: 45913 - DNA, 1219 bp, Bovine  19866880782743
gttctgagtgcagcgactagcaggactgggggccaggggagggcaattaatggaagctgggcagcccgggtggtcagagcagggaagagagattcggtccccagtggaaatgttgagcgtagcctggccacagcagtagggaagtgggtgtgatctcaagctgcctctcccctccaaggctacacgtggatccaggagtttcgaaaaagagatggttcctacggggcttggttacatcgggacagtagcacctggtgagtttgggggagtgtcctgggtgtatggaaggggccagggctggtgggggcagagccagctactatgggagggtaaataggccaggagccaccaggagtggggcctcccctttaccgggaccagtggctatccctagcaatgccttcgtctcctctaggctcacggcctttgtgctgaagatactgagtttggcccaggatcaggtgggcggctctgctgaaaagctgcaggagacagccacgtggctgctgtcgcagcaacgggatgatggctcattccacgacccctgtcctgttatccacagggaaatgcaggtatggggctgggaggctgggccaagggcataggagggaagagtagccctgcccctccccactcgtggttggtgcctccttttctgcccacttcaaccagggaggcttagtgggaagcgatgagactgtggcgctcacggcccttgtggtcatcgcccttcaccacaggctggcggtcctcccagacaagcattctgagcacttgagtagagtggtaaggcagctatgtgtctgcccttcgctgatccctttcctctcagaagcccagtccacagatcctcccccaactttcttccaggaaaattccttctcaagagtaaacaccttcttgggtgcgaaagcaacctctgggctcctgggctcccacgcctccgccatcacggcctatgccctgtcgctgaccgaggcccccgaggacctgcggagagttgcccacaacaacctcatggccatggccaaggacatcggtggtgagggggtcctggcagtgaacctgaggcttgggagagcaagacccctgagcatgtccaaagggagaaacggaatgaatggaggccctcggggggaatcagagcataagcgggggttactgggaaattaggagagataaagggggggcgtcaaagggtcagatactaagatcctcc

SEQ ID NO: 45914 - DNA, 2232 bp, Bovine  19866880796303
cccaactagctcctctgttccacccttcttcagacgatcgattccgtatttgcccagccttcctctttgagcctccgcttcttcctacgtgcctcaggggcacagcaggccacagccctatcccttccccgaggcgcctcactctgcgcaccccagtcctccgggctcagcaagttgtcggtgaaaaagcgtgtcgggtccgcaatctcgctgagaagcatcagctccgccatcttttcccccccaccccccaaccattagacggtcccccaaggcccgcctcttccgcatcatcaacgaatcaatcgactcctaaaaagggaggggggcgtcccggaagtccttccgaccagtaagaggcctgggtactgagcacatgcgtcaatagaagagccggtcgtacaggctgggccaatgggagcgcggcaggacgctaacacttcaacagtactggacagtgaggtttgcgcatgcgccaaacagatctccgcctgaaagcgcctaggaagtgtggccttcggtctttggagttacgccctctgccccagagtgtcctaaatttagaagtttagctcatcgattcatcttcggagatggacaagcccccccaaaacatagcacacgtgactatatagctttttaatggtaaaaagggatgctgagaccacagctacctcccttaggaaggcagaagcttggagtgggatatggtgcaactctcccttggtccccaccaaatctcacagcatagaccacacttcacaggttcctgtctcttttaaggtttaacttttaatcagccaaacatcttgcgcagtccttgagccagccctgcatcctgtttcttcccctgaatgatcacctttcccagctcctcctgggctgcccggtttttggggtctacggccaacaccttcttaaggtcagtcattgctttttctaggtttccaagagcagcctgggcaacaccccttcggtacaatgcttttatatggccaggctcccgctccagcacccggtcacaactttgggccgccaaatggggctgccctagcagcaactgacaggcagccaggttggcgtgaagtacagttcgttccggagggccaggtgggggtaaggtcagcagcagccgaagagcccgtgcatagcatcgggcagctccttccggattccccgctcgaaataattctgtgccccttgcacgttcttctctggccaaggcctccttctcggtgtcctccagctcccaagagtctcgaccctgagtgaaggaggccagtgtgagcctgacaggaagtccagagcgcccagggagctgaagctctgcctcctcgccttgacacatggactccaagcatttctctatgagctccccccaagtttcctccctccatgggcctaaccccacagttagttctgtccagccctctggcagccctgaccccaaaggaaatccagaagcctgtaccgtgcagcgggagcccagcttgggtttgtccaagccgtgaccacggactacaatcttcttgacaaagctgccatcaggacagtaccagagatcagaagcttgaaggggctctgacatcgcactggctgatccatgagacttagcagagtctctttcaagttcagcaggcagtttttcaatttcctgaggattctctagaatttggctagctggatctgggctcactttcagctcaaggatttccgtaggagattctccccgatgctgcctaatctgagtaggtaattcaaggttcttttccccttgttgttgcggttgacagctgtccttctctcccattgaattgattggtgatgtatccatttgggtgcctggccccttccaccgtgggtaaacagttttggatagaaagggatggaccgagtccaggtcagcacctgatttgaaaaaaaaaaaaatcaaagcaatgctattggcagaaattttatttagactcctttttccgtccttttgggactccggaccgtggtcctcaaagtcctctttttttttttttttttctttcccgaatctctgtcgggtccagtctcccctccaaccccgaactacaagttccacaattccctgcggcttgggtagccattcccaactacggacacccgatcgagtcaaaaaatacctggggggggccgaagcgcctcgcctgatggcaatagccagaccattcaaatcacctcttcttccgaagccaagtgctactg

SEQ ID NO: 45915 - DNA, 1287 bp, Bovine  19866880846067
gaaaatatcaggttaatccaagttgcaggacattctttaaaataacgcatcagtaccaaatatcagagatcaagtaaaagtatcaagatcaagaaatacaaagaaaaggaaaaaagtgtcaatatcatagaatcaaaggaagactcagcactgcccacagagaggtgagaactaagataggagagcaaaaaccagtggatcctggatcagaaaaaggacatgaaagggacaacaggctacatcgagtaaggtctgtagattagtcttactgaccagtgttatattctgattttgctaattgtactgtggttatatgggcttcccaattggctcagtggtagagaatctgtctgccaatgcaggagatgcagaagacgaagatttgatccttgggttgggaagatctcctagagatggaaatggcaacccactccagtattctggcctggaaaatcccatggacagaggagcctggtgggctgcagtccatagggtcacagagagtcagacacaactgagcgactaagatactgactacacacacacctatggtaatataagacattaacattacaggaagttgggtaaggatacagtgctaacctgtactatttttgaataaaattaacttttctgtcaatctaaaattattttgaaatttaaaaaatttgactatacatacacacatacctccctggaccttagttgatgcctcagagtagaagtttggttgaatatttcggtccctaccctcaaggtagagagctttttcaaccatttgtgagtacatgggcctatgagtctctttctggagggtaaagaggagggaggtgaggccacgcagacagcaggcttccgggggctcagtgccaggagccagaaggggctccaggccgcttcattctgacagcggcaccatctgcccagagctcgactgagcctggaaggttctggaagccagaaggactgaagtagtaggggctggaggcagggaggggctgggaggaagagggacacactgaggactcacggtttccaggcagtttggtctgtgccaggtctggttggggtttgcgctccaggaagccgcagcgctcgtcctctccgcaagtggtcaccgtctctttgcagaggccgctggggcctccaccgcagtcatagcatcgcatgcggtttcctggggggagagaaagacgtgctggatcaggcgctcgggggtggctggcacagggcgacgggcctctgtgacaggcgccccgggtgcctccttacccaaggcagccccca

SEQ ID NO: 45916 - DNA, 1634 bp, Bovine  19866880903066
aaatgcagcagagaaggaaggcacggattagaaaaggaaagcagaaggggctgtccatttcacacgtggaaactcagtctggtggcaccagcccagccccacaggaccccagcatctcctctcctctgctcctacctgggtacaggggcagcaggcaaagtacggccatcagtgggtccatggtgtctacctcaggggcagggacaggcagagaaccaggagagggaaaaggtcatctgacttcccgaaaaccagagctggctcagcagctgcttcatctgctgccagagaaagaaaactagggagtggcaagggggaatgttcccttgttgggggtggggaagaggggaacataatcagggattgggggctgagctgagggggtgaaaggttggccctgtctccctagtctccacacatccctagagtcagtcgatctgcaccacaggcgatgcccactgctcccccacctccgctgcctctcagacacacgtgcccacacactcctacatgaatagtcaaagcacacaaaccaactgagattgcaaaacattttatttaagtaaagtttcggttttcttttgggttttcccaagtggatgttacgaatacttcctcagagcctaggttaatattgtcttcttcaacataagcccccaagggattacactaattgtcttaaaaattcttgatacctaggaggattcaccatctttttcttcccttagggataaaaatgaaatcaacacttagagacaagaaaaaggttgagaacagttttaaggaaagtccagtagataaaaattccctaacttataaaaaataattctgggttgattattcaaagaagtgaaaatatttttagatttggaatgtgcctttaaattgcaatgtgcatgggacttccctggtagtccagtggttgaaaatctgccttccagtgcgggagacttgggttcgatcccttgtggaggaactaagatcacacatgccacagggcaactaagcttgccaccacaactactgagcccacatgcctcagtggagacttgatgcagccaaaaaataaataaaattaaaagcaaaagaaaaagattaaattaccagccattaagaaaaataaaatttttaattacaatgtgcattttgtaactctgagctactgcgttagcctccccatcccacagaagtctttaatattcatcaaacaatgggtacgtgctaagtagcttcagtcgtgtgcgactctttggaaccccagggatcaaactcgcatctcttaagtctcctgcattggcaggcaggttctttaccactggcaccacctgtttaataacataatgaatgtcttcagaactgagaacactacatttaatatcacttggcttacaaggagtaattcccttatagacaagaggtgtgtatcattgcaaatttcaagtcactgatatgcctcctttcctctgaaacatcttcaaactcatcccactttttgagctcctttgagtagaggagcacaacagcgtcggaactggtggagctgacagagaaacaatagttgaatgaactggaagaatgtgggggggtagtataataataagattagtcaaagatgaagatgaaacatctctgaa

SEQ ID NO: 45917 - DNA, 1855 bp, Bovine  19866880952206
aggaacctgggggtgactacctcagagacgtccttgactttttcataacctggggcgcgtagagcatctctctcacagctggctttctgtaggtgagatagggaagtgtggagagaggtgtgaggaacaaagcttgcttaggaaggactggggcctaaaggacctcaggatcccacattcctcaccttgtccccattcttgatgtagactgccttccgagtcagggtcttcttagactcagacacaaacagagcttcaatgtcctttgcagggagtagctcttgcactttacagatggatagactgggtcattgcagcactctccctcccctccccgcctcgtgcttgtcatcgagtggccctccactccttcccgtgagctggcggctgggcagggcatgacctgctctccctccccctcatcccttccttgtctcagaacttcacccttaacaagctgctctccctgaatgtctcttactctgttgctggcatgtggttgaccttggaagcctcaaggcttgaatcgatccctcagtgcaggggagacaaatgggcctgttgaggagagatggggaaattcaaggatcgtgaaccctgggcctactactgtctcagttctgcctctcccagccttttctctcagaatccagatggctcacctgatggtggtctcatacttgagcttttccttgagcctgacgagggccacgtcatagtcataaaactcaggaatgccttttgctttttttgcattgaggtcgtacttcggatgaaataggatttcttttacctcccactccttcctctgtcctcctgaagtacaagaaggggttcctctagaccactgaaatctgtgtaggcagcctcctgcctgcatgtcatccctaacccaaatcttccccatccctaacttgtccagcatgcaagggaagggctgcgatgaggacaggtggaaagtgggccctggaggcagtgtggcccagagggcaccgcagaagctcagaattgatgggttgcatccttacccaggctgaccttgattgagtgtttctcatcatccacagtgaaacagtgtgcagccgtcagcacaaagtactcagacacaatagcacccatacagctctcatgcccctttgaagggcgctggggacagcagcagagggaaagctcagctttcacaaatctcacaatctgatcaagagtgccttgcccttcctccgaccttcatttcaccctgacctcccttcctctaagttcccaccaccaggacactgcacttacagtgaccgagatcttggcctgccacggttgcttgtggtaggcagtaccatccttgtgctcccaaaccatgccacagagacccagtgtccggctttcatctgacaagaaaggagattgtgctaaaagctgggacagttcatttccaaatggcagctgtcttgcggagggaggccagtgtgtctgtggggagcagatgcccaaaagagggaagggaaggcaaggaaccactggaatcatgggactaagctcagagacctgggcattttcaggcccaactcctgctaacttgccatttcttgacctcttttggccccagcttccatatctgtaaaaggagggacttgagaaaggtctcggcatcattgcagaactcgtgattctgagatcagggagtggaaagtaccaggaagcaagaatagtgacctggaggtagaggaggaaagaaagggcttccagactttccagggctttaggaggagtggaagaatgagtgaccttgaggggtctggggagagctgagtttcctgaccatctccttatagccttccatagcttcctaccaagcatttgg

SEQ ID NO: 45918 - DNA, 1612 bp, Bovine  19866880957633
aaggagtttttttccctaatctgcatggggttttctaatttttttctaatctgtacatggattcagttcagttgtttagtcatgtccgactctctgtgagtctgtggactgcagcatgccagggttcatggattgttacatggtttggggcagccctgtggacaacccccagatggaatgccactggcaaaattccaccttccctgggtagaatgttcttcccaggatgtccctttcttccacggaatcccatctaagacagaaaaatctgacttcacaggatcttgtctttgcaaaggagtccgttatggggcagactctctacaaggcagctccttccacccatctcaggacagagacctgaatgccagagcccggtcctggggcaaacatctcggtgcctatatccagggagaggttccgcggcgagctccaggaaacaccatcatccttactccacaccagcatggtagaggccacctggcagccagccttatgagcacagagggagtagaaaaggaagaccacgcctgtcgtcgtgtcgctcaccactgcccccaagttcagcccatctggggtctccccatcatccacaatgaaagctgtcggagaccatgtgctgcctaaagaaaaaaaggaagagacccagggtaagcactttgaaggtgctctttccaccactccctgccattttcacctcctggctaggggacccaaggctttacgatggccccgaggcctacaagacctgcccttccttacctctcatgacctacctttgttcactccatccagccacacaaactcctcattcattgaatatttccctccctccttggggcatctaagctgttacactgcttagcatgctctttctcaaggctcactcacctcctctgagtctgctaaaagatcatgtacttaacattgcagtcagactctagcactctccttatctcttgccctattttggtttttttccactgtatttattacctcttaacacaaaaaatacatttagttatttattatgtatattgtctgtctccccattccctaccccatgaaggcaaggatttttgctctgttttgttcataactgtattcacagaacctagaacaatgccaagtatatagtaagtgttcaataaatgtttgaatgtatgctcaactccttggtgatactagtttccagatcactgccctgacaccttccctcctttaggttctctctacttctcagggatccagcagccctaggcccctaaaggcaggtcaagctccccacccatccaacctctcgtgacccagtcatctttataccctggtccatagacctccgcagagctatgaatttagctcctttatccgatgtcgacatttttctggcctcagcaaaggcaaggagagtgccccgaggagtggtggtgatgagcgggattcggaaagtgtccacggagccgatttgcttcccactcacccacagaagttgttccatggtcacaagtggatgaacctaggaagaggaagggtcacagaacaaaggtgactttgggttttagagtgaatgaagagaggcttggagtcagatttctctgggagaggctgagtg

SEQ ID NO: 45919 - DNA, 713 bp, Bovine  19866880967981
gccgaatctgggcaaggagacagagacagtggctctgagacaggcagggccaaggtctaactggatcctcccgagatcagcatgcttcaggcctccactctcccgaccagaaaaatggcctttcactccatccagatagggaggacacgttcccttcaccacgcacacaactctctggaggacaggccgttcttcctgcccctccccacacacgccaacttaaagagactgtgctctgtgccctcagccaccaccaccagccctagcctctcctttcccaccctggcacccctacatctcagcaccaaccccagacccctccttgcgctgctctgctctgccagcggctgttcccagctcaccttggatgttcatgtgcatcatgaccacgggttccacgctctggtgggaaatccggatgaccctcgggtggctggtggtcggtgggggagctggccctggcggggaagccccctcattcgaagactcaacggcggtagaagagggggccacggacgaggcctgcccagcaccagcgggaggtgcctccgcacttggagtcgggggggggccgtgtcccattccccgtcatggtcacagtggtccccacattgatctagacgacagagatgacagggcaaacgtgagaaaaatacaagagcctaacccagagcaccccatgatacacttctaaagtctcctccatcctgggt

SEQ ID NO: 45920 - DNA, 825 bp, Bovine  19866880975054
ggccaggccgtgcgcacctgcgggggacagggagggaaagaagatcagagagccgctacctcggccgcacgcctcagcctccctctaagatgctccctcaaacgtccagcactccctgggaataagaacctcttgagtcctcctctccatactccgcctccgtcccctcccctcccctcaccccccacacacctgcactgccttgaagatggcaatgatgcctgtaggccagaagcagcagatggtggtcagcaccgcgatgggcatgtagtcgtggggcgggcgccttggctccagcagggccagccctgggccctggggtggcggggggagcgtggaggttactcctgttccccccggggtcgcgcctgcatagggctgtgaaaggaaagaaggttgtagggaggggacgtctatcattcttaaaccctctttgagcccaccagctttccacgtctagcagagaaagaaggttgctttcctcttttaaacctcctctggacttcaaggctgtttcccctgccagatcttgatctttgactccaacagaccacccaccccattcccagatctttctctagtctctcctctcccttggccccagatcgcctcctggtcccctggttctgttcctctttcccaccagtccccactgtgcctccaattccatgtcctgttccatccttctcccagccccctccttccagtcccctgtccgccctgtactcaccgtgcccaccgggtagaccggcacgtaggcagtgcaaggctgcagctgtaaagggtaacccggggctacgtagccacccagcggcagcgtgccta

SEQ ID NO: 45921 - DNA, 1370 bp, Bovine  19866880975512
agagaaggctctttggttgtgatgtgagttctgaggcctaagtcttttcctacagcatctccttccctgcaggtgattctggtggccccctgattattcacaagaggagtcgcttcattcaagtgagtcttctctttcctttctctggagagatgctgagtggtcagcgtgggccccaaaacaggaaagctcactgcatgtggctgaaaagaggtggggggtggggcagagcctgcctcaccttcagactcttccttgaactggccaattcagggccatgggtctggtctgtgtgccaggggacagaactgaactgggtccctagtcctcccaggtcaggtcacttcagatgcaactggcagtagctgtgcttcctgggattaaggagttctactaaatgattcttggcaacccctcgctctctccaggttggcgtgatcagctggggcgtcgtggatgtttgcaagcggccacagcaagtacctggttatgctcgagactttcacatcaacctctaccaggtgctgccctggctcaaggaaaaactccaaaatgaggatctgggttttctataaggggtttcctgctggaaaggggcatgagaccaaattaaaacagctgcgacaacacctgtgttcaagatccttttggggtaaaggagtggggagcgtgcactagccatgtggttacaactgagatcacatctaacagccgtttttaaaggctcaaccccaatcccaagtgctgaaaaaccagaggctgagggagatgggtgagcttccacctcagtgttttactgagaccagcgttggggcagacgaggcacacggaatccagctccattccctagaagccgtccacaaggttttccttgtagacatcgtcgctgtagacaatctgagtcctcttgtcccggtggcagcccttagggctattctggacagctgtggagggaggagaagttccgttaaagtctgagggagagcaccgaccagacctgaggcccagagtttggccacctcaactctagcctctggcctttggatgcccagtttccatgctgccctctggtggccaggatggcttctctacctttagcccccttaggcctctggctaccaatccatggccccagtaaagagtgggcagttatcatggcacacgcaaacactgtaatgagtgttttgtcctcagaaataacccaaatgttattcttgacacatgtgaataatgttaaccgcctacttccagtcagtacaccaaaaattagaaaatctctatagacctttgctaacatgctggtccttcctggttccttctttagtataacgggttactctggctccgaactccctgtgcctactgcttta

SEQ ID NO: 45922 - DNA, 1394 bp, Bovine  19866881006052
tggccatctttgaagccccggggcgcgtgaccccgggcggaaaccgtattggatggggtgaagaagggggctggcattactcagcagaaaccttttgattggtcaagggatctaggttacgtcatgggggcgggacctactttaaagagccggcgaggttaaaaaggctgcatgtaatcatggatgaaataaaagtccgagaatttttgagaaaacaaaatagcaattttttaataaaatctttttactacaaaagcgtgatctggaaggcggggaggctgtacaggcgggagacagtccaggatcagggctgcatctttcacttcttcctcttcttgtctcccggggtccccttgttcttcttgccaagaatcttcagaaggctcttggacatgtagtagggccggtctgctgagccatcattccgctccaagtcttccactaaggcgcgacagagaccgtaagagcgaacctttgggaaccaaccccactacccgggaaaatgagggactaagagacagctgcctggtttccagactgcaccaccaccggctggtttggggcgcagtttttgtaacctatgtaatcgtgtcctcatctgcaaagtagggtgaacgatactatatttcatagcgtgataagggttaacggaaaaaatatatgtcagttgcttgacagagagcctgctacacaggaaactctgaataaacgcctacagtatggtaaggaactccccactcactacagccacctgctgggaagtctcctggggctaatttcttccctagtttttctcgggaagataccagaggcctctgccctaaaatgccccttcttgggagagcccaggaacctgggagcgaatcagaggcctctgccctagaaggccccttcttgagagagcccaggaacctgggagctcattccctccattcttcccaaacacctgccctgaggatgttagaagaggctctggctcctataactcacaaagtcgctgtttctagaagcaccacatctcctaaagagcctgaacgatcttttaagctgaggagaggaggtggaggggctgtcttgtcactcacagaaacagaggaagagagtgtccacacacattccaaaaacactgaagaagccactggcgatgaggtaggcccctaggatggagacctggaagacacaaggctcccgatagtgttcctttggagagttggagaatgaagtggcctcggggtggaggggtgggaggatgagaaggtatggagtgggggtgggggtgggaacgtgtcactcaccatgatgggcagccagtaatagttgagttgaggattctcaaaggttttacccagactagggattcgacccgtaagaaaaagaaggacaggacccctagg

SEQ ID NO: 45923 - DNA, 1879 bp, Bovine  19866881027662
cctagcagtcatacccaactcctcaactggagcaggttatctgttaatacctctgccaaaaaaatcactgaacacttgtgctgtgagctgatagatgttgaggatgcagaactgggagggtctctggctagaggagcccacctgtcacatttcccttcccctgtcaaggctcctttaggcatgagacctgcatgagttgtgacctctgagtacttagcaaatgacatcagagggtgagatggtctaaggtcggatagtcttttagacacagttgccagacagagtataaagaaaaaaaagtttttttttttattttgtggaaaacaaaagccgaaaaactaaaaccccaaactccagaaaaaatcctaaaaaatacgttttttttcttaaaaaatactgtataagtctctactactctccctccccgcaacagcctttcttgtgtactctcatctaagtgccctacccccccgcccccaccactatttgtagttcttgccgttgtaccccacttcccagtatctacccaggctgctcacccccatattctcttacctgccatcttattttgttctccctagaattttggtgagctttgtacccatcccatttccccagcatgcaagaactgtctccccttcccttctccagaattcagtcatcctttccccctaccactccctctcccaaggatctattccaagcaggagcaggtaagctgcctcctgccagattccctcccacttcccaccccccgtcccccatcaagaaatgtcagaacctcttcctgggcagccttagctaggaataaaacattttccagtctttttccccccgcctcattctataagcccttttccctccctccacatatccatgcacctctaagagaagaaactttatctgggaccccctattcccttggccttctctaagaactctccctctctccatcctttccttctgaagaggcagggtcttctctccaaggaatcttcggccccttgctgtgtgtctgttcaggctcccaccgtacctgcctgcccccgaccccccacccccctattctcctggaccagggagaccctccccacttcgcccagggccccggcgcccgcctcgctagcggatgaggacattgatctcagccacactggcctccagcacgttctcggctgtggtcttgccgtgctgctccttgaggtgccgcctaatggccggcttgtgagcgaagcgcacgtcgcagtaggagcagcgatagggcctcgctcccgagtggaggttgaggtgatcgtgcagcgtggacttctgcgtgaagcacttgccgcagatgccacacgagtgcgacttgacgccgcggtgcacgttcatgtggcggttgaggttgctgctgtggttgaactgcttgccgcagcgcgggcacatgaagatgaagtgctgcgcccgcatgtggaagaccagcttctccacgccctggaacacttccgggcacttggtgcacttgatgttctttaggggatttccgctggaaaagcctccgggcaggggtccccggccgccccctgcccccaggctgccccccgccccccgggcagccatggccaccgctgctgcctccacgaggcctgaggtggcccccacactggcccggcctccagggatcaagagcaggccctccccttccgcgtcctcagacaggctgtagcaggctttaaccacgccctgcggtggggccacagtgctgggaggcacgctgctctgggccagctccccaaggtggctgcccacagagcctccaatgcccagacctcctcccaggcccccgggaggtttgagccggtgtgccacctccagggctgattccaccttgacgatgcag

SEQ ID NO: 45924 - DNA, 922 bp, Bovine  19866881141829
tcggatgagaaaataggaattaacattgaccaaggtgcccagcaaagaagcaagaggtgaggtaagggtcaggggagacagaggcttgtcaaagatgccacaaggaagagacagttattctcaaatgcctttgaaaggaaatctttcttattccacctcatcaggctggcccgagaccattcccagtagctcttctttccaaacccactacagctctctcctcggcataggtcagcaccctctccctcaaccccctacccctagctctcaggctccttcacaaactcctgccaccaccaccgccctaccctgctccctgtcccccaggactctccagctcacacttacccagtggcccaccaaggaacaggatgcagaggaagatgctggaggtacccatgtctggacctggcggggctcaggagtctgggagaatgtgatctgcacgctgagatcctagagctggagcacctgagtgagacagggagggaccagtaaacaaacacacctagggagtgaatctgagggtgaggcggaacagggaccagactcaacagcctgaaacagcggagttcctggccccgaagctctcacaccctccctgcctcctaccggagccttgtgcccttgggggtcttctctattcttgcagctttctctttgcttgtctgtcgcttttgaatggtgtctgtcagcgtctgtcactttccctcctcctcctctccctccctctccttgtctcaagctgctctttgctctttcatctccttgtttttgtttgtctgtcttccccttctgtgcatttaagtctctcaaagttactctcctaaacagccctggcccagatctgtttttcgagtggtgtttgagtgtggactcagcaagcccccacccacccaccaacccacaaacgcagctacag

SEQ ID NO: 45925 - DNA, 591 bp, Bovine  19866881169495
acattcactgcttattccctgagaaagagggagtctacaactttctgctctgggtcacatctccctcccccaaaacaccgccttcacttcaaccctcaatcaggtcttaacccctaggcccagattctgatgttctttcccctcttctcagctacattctgtgacaaggctgaaacaagtgacttcttgctgaaggaaactctgcttccctgttgcctctgaaggaaccgagtgggaggagagaggcctcaccatctgggcaatgccacggttggtgaggatatagcgggcgtggatcaatccatagagcatttcagctgcttgctcaatcaggtcactctggttggggttgtcctccagctcctcatctgaaacatggcaccagccaaatgcaaccacttgtcttacagctttttaaggtgccctgcccactcccgggggctgctggctcttcagcccagcacccaacttggagcctcaccccagccacagcctgggcatctgacccagaaacatgggcctctgacccttccaccaacccaaggcagctctgccttccttccatccctcttagccttgcttctttctctt

SEQ ID NO: 45926 - DNA, 1205 bp, Bovine  19866881170999
tgtgaaagcagccatataccatatgtaaatgaatgtgtctgtgttgcaataaaattttatttacagaacagtgaactggatttgactaatgaatcatagtttgcaaatgcctggttatagtttttaagatcatggatgctggatccagactacttgggtttgaagcctagttctgctgcatgactttgggcaagttgctcaacctttctgtgactcagttttcctcatctgtaaagtatagtatgtaccttttattgtgtttatgaggattaaataatgaatgtcatgtgctttgaacagtatctggctcacagcaggtgctggaaaaaggtgtttgttatcatgtttgcagttattactgctactatcatattactgtgcgccttgtctgttactgtagccttctgattggtcttccagcatctggtcttgcctcttctccctgcttctctgacgatctaactgctgtttgtacccagaccctcaccatgatgacttgtacctcaatgccagcagcttcctggccctgatcaatggggaaagagaccatcccaatgccactggtaatgaccccaggctcctaccttggtcccattttctgcttctctgaccttgtatattcccctttccaacctagcctgacccctgtgactaactcaggctctcttattcccaccctgtagcttggcggaagaactttctgcgtttgggccgcctggtgctgattgggggccctgatgatggtgtcattactccctggcagtccaggtaataagggactgtgtggcctgaaggttggctaaggacaccccaatcccagccaatctttatctcatttctaaaactggcctgcttcttccactgttcagttaatcccccccaccctccattcatcgtcacccaagacgaaaacctgggagtcatgtcccaacctcttatatctagccagtcactaagccttgctcactctgcttcctttccatccctaccagccccgctttgtgaaaactttgaactctgaactatttacagattcttagcatgttgcaaagatagtttagagaagtcctgtgtatcttttgcccagtttcccccaatgcctacatcctatgtaatgacagcacaatagtgaaaccaggaaattgacaaatcgctacaacgcatgtctatagttccatgccatgtaatcacatttcctaccagct

SEQ ID NO: 45927 - DNA, 1140 bp, Bovine  19866881174831
tacaagatgaacctgtacggcttccacgaccgccaacgcgtgggccccgtctccactgtcggtttaactggtgagtgtgcagtaggacactggctccgagctgggctcagttcccctttaattgccagtactcgtgtttttctcccactgttcttgagcttgagcctcccaagcgcctgggagtggttctgtgcctgtcttcactccaagccttactgtcactttagctgtctcaccctttacactttttgagtccttgaagagggaagatgccaaggaaataataactcaggcagacctggggctggccctattctcagccccttagagctgtgtgacctcgagagagtcactcagcctctctgtgcctccctttcggcatccttgcagaaaggataccctacctgtctggcaggatgggtatggcttgcctcacccacagtgtttggtaactacggctcctcctttagaagaagaaaattagttactaaaaacccttgggtgaattctcataattattattgatttcactgggtaaaattgtatttgataccaatacccatggactgtatgtcaacacggaaccctgctatcatggatactgttacttcagtagttaacattagtcatggtggcttagtcgatcaattgtgtccgactcttgggatcccatggactggagcccatcaggctcctctgtccgtgggattctccaggtgagaatactggagtgggttgccatttccttctccagaggaagattcctgatctaggaatcgaacccagttctcctgcattgcaggcagattctttactgactgaactatgagggaagccctaatattagtcatatgtgcagctaaacaagatattttctcttcattaattaccccttatcttgtctgttggttgcttgtgttaagttcctttatagctattacctgcaacatgcttaaaacttggttcccaaacacaatggagatctgaaacacgatgattttataattcagctattaagccggaataaaactctatgcagaacaggaaagacaaaagaaatctgtgggtatgatgtgtcgtccctgccataaactggcaagagaattaatacgaggtccccaagcaacccaactgcaaaga

SEQ ID NO: 45928 - DNA, 1542 bp, Bovine  19866881210645
tgttatggcaggtggtgcccttggggcagggtcccgggtccaggtaacactcgttgacgtcgtgttcgcaggcgtggccctcaaagccgggtgggcagcggcactggatctgggggtaggtggccagacacactcctccattgacgcaggggttggctgagcagaagtctcgaagctggcagtgctcacctgaggtagaggacggacggtgagggggctgtttccaacaatgcacacgttccagctcctccagagtgacccgctctcactctgggttatctctgtgtctgatttccgtacttccttcccttcttcccatcctctccctgtcctggtccatcatcctcagttttatcattttttgggtagggttctctctggagtgaccacattttcttccagccgaaaactgaacatgtggctattggtgggagtattgtgaatcaaccctgcttgggaaaatctgggacttggtgtctgtccctttagtggtgacctgggtggagaagatcccccggagtaggaaatggcaactcgctccagtattcttgcctgggaaatcccatggacagaggagcctggtgggctacagtccatgggatcacaaagagttggacatgaatgagagtcggacatgaatgagcatgtggtggggaagtagaaagcatggatcctctgaaggcaggtgacatagcccctggctttgcccctgccagctgtgtgcccttgggcagtcatctcgcctctctcatcctgattccctgatctttgggtggttgtaatgtatcgcggtaaagagattccacagccgtgcgcactagtgggaatggtggcagtggctgctggtactgaactaaataagcactttctgagcatcgccccctttcctatccacatcagccttatgaagtgtggacactggctgacaactgaggatccagacagcttaaatatcatatgcaaggtcatgtctagtcagtggcggaactggctatgggcccaaggagggggctgcccagagcccctcctctgaagcacaaggcctggcaagttgccactgcccatccttcttcttgtcatatatgctggtctctcacacccagttgcaggcccagtttcctcagaatctcctggttagtttaagaatctccattccctgggtctgctccagacccactagagcaggctttctgggatgggggcactagtatttttaaggccttccagggttgcaaagttggacatgattgagcacacacaatacatccatccgtccatccaccaatcaaaggtgactgctgtgcctgctcaagtctgagaagcctggcctctagtccacccctcctggaggcacccacatccaagtacttcctggtcacgtgagctttgcttcctggtccagtcctctccatcctgcttaggtgccatggagcctttctctccaggtcctcgcagctctgtcctggcacccctgacagggtagcacacctgcccagcatatgtcctgctcttgtaccccaggactgcacccctcctcctggg

SEQ ID NO: 45929 - DNA, 1323 bp, Bovine  19866881215425
tgtcgatttcacatttactgaatgggggtgatgatacctatctctgagagtcgataaaataattaaaattaaataagacatggcccaaccctgtacttatcagtggttcaactattagtttcctttcctccttgcccgacagattcatctatgtgtcctgtggaattcaggatacctgggcattgcctactatgatactagtgactccaccatccactttatgccagatgccccagaccacgagagcctcaagctgctccaaagaggtaaggacagatctatgaattcccctgtgctggcactggaagtgtattgcattcacatggccttacctgactcaatctattttattagttgactcctagagactccctttattgttttcaggaattcatctcattattcacaaatatatcaggtgctggagatatagtcctgagcaaatcagtcatgtctctcctttaggggtttatgatccagtgataatctcatgggcacccctcttccctcctattaccccatcagtcttactgctttctttttctaatttcatatgtgactcctacttctcccagtgtgggggggccttccctgctcttggaggaaataagtttttgaggggtgaagggaggtaacaaagggagggttaacaggttcccttttagtcacgagagaaagatcctcgaactcatttgctctccattctccttccaagttctggatgaaatcgatccccggtctgttgttacaagtgccaaacaggatgagaatatgactcggtttctggggaagcttggtaaggactgaaaaagggaaagaggaaaaatggggaaggacaaaattacggaatgttccagagattaaagggtcttgtgcggagctacagccaggagatcagaattgggtgagagggaagatgggaaagaggcaaaacgactatgatgtacagactgatggccctttctttgtttcctttatagcctcccaagagcacagggagcctaagagacctgaaatcatatttttgccaagtgtggactttggtatctcctcccttttactttacccacacccccatcccagttatgtgaccctttctcctaattccagtttcatcatcagaggtctcctctcagccctgtctcattttaaacctatatgttcttcaggccccatgaccagtctccccacaatctctcctaatccctacctttaataaccctgcagtttaggcttgtttagggttgagggccctccctgaaagagagtgtggtagcatttttttggtcaattttgattggtggcattttcccctttaagcca

SEQ ID NO: 45930 - DNA, 662 bp, Bovine  19866881220379
ccccgcaccaactccatccctaccttctcactgaacaccccctggatctgcctgcccatcactgcccgttcccccttgtccacctctgcttttcatgacctctctgccttccccttctcctctcccttaactctgcccctctcacagagaccctgtcaggccggggaccccctggggactatgaggagatgatgcagatcgagtgtgaggtcatggataccagggtgattcacatcaagacctccacagtgcccccctcgctacgaaaacagccgtcctcaaccccgggcaatgccacaggtggccccttgccagcttctgcagcagccagccaggctcaccaggctgcccatcagccctctacctcaatcatctctgacctctatgactcacactgacttagaaccggggggtaagggtggaagcaaccaagtgggactgttttgaattgtcctgatccctgggcttgcggcaatttgtaaagggaagacaggatgtgggggttaagcacttatttggaggtgggtgggagttttcctctcttctcaccccttttttggaatatagagctcctcttatttctatgaacccccaatccctgcttctttccttgagggtgctgagtgaagttaagttttggggtgagtgggccccagtacact

SEQ ID NO: 45931 - DNA, 1542 bp, Bovine  19866881262020
gaaaagcctacagacgtccgggactgcccttccctggtagggcccagcaccctcagctcctttcacatccagccttgagcgctagagccgagccagcgtgggcaatggtcccaacctaggggcttccctggaacccctgcccctcccactttcccagggccgcaccctccttgccgacgacctctttgccgcctactttggacctgggtctccttcccgacggttccgagcagccttaggagaggtgtctcgtgccaatgccgcccaagacttcctgccaacttccaagaatgaccctgacctgcactttgatgccgagcggctgggccagggccgtacacgccttggtggaggctctacgggagactgtggcggcggccaaagcccttgactataccctggctcgccagcgccttgggggctgcgcttcacgccctgcaggtgagaacagagttggggatcgtcataagaggggtctttgcttccagtcttctggactcccggatggtgctttcttagtcatgcctccgcccaactctagaaggggctggggcccagcttgccaaggccctggggctattccctagtccccaccagtccaaattggcagcttcctgtgggaacagccaggacacctttgtggctggagtgaagcaagtgagaggagggtgctgaggtccagaggtgggccgtgcaggccactgaagggccttaggttgggctctgagtgagatgggaagaaacagtgggaggctcccacttcaccagagctctattccgggcaagggagagagcactggagggcaggtagggtgcctggaggagcagccatgcgggaggaggtgttcaggctggagaactggaaggaggggcagttagggctggagaccgcaagagcagtcagctagtgcttcttccccgtctttctcctgggaccaggatttctacagtcacagcaactgggtggaactggggaggcagcagccacaccctcacctcctctggccgaggcaggagctccggagcctggcacaaggtacagctgtgcccctgctggtaagggggaagcccacagagccacctcctctcagcccatccagccactgggtcacatcctgaggtcaactaggaggtgacatggcttcaaatctgagacagcctgtgaggtccctcagttcaaccaaaggccagtcaattagctggcttccccaagatcacgcaggggaggacagagccaggaccactctgcagactgcagggagttctcgttcatgaggtttcctccctgcactggatcgcaggggactctttctctcagtccccccttccaactgaactgtgacccagaagctgccttctgtttattacaagtacacttcctgtccacagctcatggagggtacactccccgtaggactggtctgcatgattttctagacattctcagtctcaaatatcgagtctcattgccagccatgaactccagggtttagttcagaaagccttgaaaggtacccataaagggtacctgtgggccttcac

SEQ ID NO: 45932 - DNA, 1255 bp, Bovine  19866881265709
tgcacacatgcaaatttataatcatgacagataaaaggacggcaaaatgaatacccagtaaaaccccctctccacccaggcaggctccctgctcccagatcaacccatggacatacctatgtccattaatcctgcctccacagacaggcaaacagatcccaccagccctcccctcgcttccagcgacactggaggcagagtggtccggcaggcagtatgcaagtcctcaccaagcgggaggaggagggcgaaagagtaaaagggtcatcgtaccacctgcctgggagaggaaggagctctggaggaggaagcgtggcatgcagaatcgcttctccaggctcttcctcccttcctccactccgacccactgttgggggcagggtcacaattcacaaaaacggcattcaggtaaacatctatcactcatatcaaggccaaaggcactcccttccacgacagaaggactgtgctccaaggtcagtccactgccaagggtgaaggtgacaggtgataggggaaacaggactgtgccagcactaggagagcaggctctgtgtggcttcattttactttccccgcaagctggaaccagcgtgtctcccctgcactacgtgcaacaggctcctaactcatccccttcgatccatcttccacacggcaaccacaggatgtttccgcgacaccaatctgagcatatctcttgcccagaggcccttctggacaggctgacttctgcttacatctttggccacatccctacaagagtctttttcactccagcacaccgattaactgcagttcctcagacacaccatgatctttcatgcttctaggtcacaacaggatgttcccttcgggggggatgttcctccacctcttcacttgcctcatccagtttggtgtcactttttggagttcttcctgaactcctccaggcttgtgttttcattacactttatcttgatcactggtcctcaaagtgtagaaacacaaatccttggccctcaccccagatcttctgaaacaagacttttgggcactgggcccatcaaccagtgttttaacaagccatctaggtgaatccaatgtgcatgtaagtctgaggaccactgacctcaacactaaacagcatgtagttgcttgaggtcaccctgtgtttaccttcctagcctgcaggcaagcctgatggcaggaactgtcttattcccaatgcccaggacagaatgaagcagagaagatgctcaataaatattta

SEQ ID NO: 45933 - DNA, 965 bp, Bovine  19866881302318
catccctggggcaggggtgggggcggggtgaggatcgcatcacaggaagcggcccacctcatcccaccgccagggaccagagataagggaagaggtagactgggacggcaggggcagcccgagaaagtaagggtgactgcaggtgtatcaccctgctcctgagggcagcagagggagcaagggggcgacgtcccagaggagggagggtggaggacccctaggggaggtgatcccagggaaggttcccagggcggctgggaggggctgctcaccaagcaggtcgagggagctctggtggttggagacaacgacgtagggctgtgaaggagggaagtggtgggcccctcgtacctccactcggatcccgtacaggtatttgatgtggagtagcatcagacgcaagatcctgtgggggtcccatacagcaaggggttccagcaggacccgctggcatacatctgccagcagggctcagctcccagccaccctgccaccttcctgggcatcttggcagtcttctccccttcctcgtccctgggctcggctcgctcagtgtctcctgcacactcactgccctccccatccactgctcgcttccgaccctgaggttccctccatcaccccaagcccctgggacctcacttcatgttctcgacgttgcgtcctcgcacggcacacacagggatggcgagcacagccaggaagaggatccagccgttgtagaaggccatcttgaagaagtacttggcactggggctgcagaaccacagagtgggcagcaggaggagcagcagcaggaagagcagcagcagcagagtccccgcccctggccacagctccattctggtcacctgcagggggcggggcgaagggcggtgggcctggttcctaggtgggggggcggggcggcaaggtgcgcgcggggaaggtttggggggctgtggggagcattaacacctgtccag

SEQ ID NO: 45934 - DNA, 1242 bp, Bovine  19866881314018
ctgcaggtgggtaatgttgcggtcaatgttcatggtggacgtctcgcagttctctgagatgtacttgtaatcctcggggcagggctccccgtccacaccattgacacaggggatggggacgttctcatagccccgagccacgtccctggcaggaggggagatggagctgggtggctagagtatggggtgagggcttccctagaagcaaggagagggccaggggaggggagagggtgttctgggggttcatccaggggtggggaggtaagggttgcagatcaaaggcaggacacttagttaaaaatctgaatttcagatcagataatcaggaaataatttttttagtacagggcttccctggtgactcagacagtaaagaattcacctacaatgtgggagacctgggttcgaaccctgggttagcaagatcccctggaggaggccatggcaacccagtccagtattcttgcctggagaatcccatggacagaggagcctggcaggctacagtccacgaggtcacagagtcggacaagactgagtgattaacactctcactttcatgtcccaaatatactctcagaacactcttaaacattaaaaaagtatgcgttgttcacttgaaattctaatttagccaggtgtctatttttatttgctgtatctgccaactctatctgtatgtgtttcagggggaacggaggtggttctggggactccgaggctccaagggggcctggggagggggctctgggtgcggagagagcccaggctcaccggcagatgatcttctccgtgcggatggcccgattccccaccccgagccggagcttgcggttgagctggagggcaaaccacacgtcggaccgctcgggggtcaggtcccacgccgtgtccccctccttgttccgcagctcagggttcgccccgcgtgacaggaacaacctgggaggggacaggagcccgtggggcacctggccgtgagaggtggcagaggggcgcgtgtggggctgggtgccgggtgggggctcacagcacgcagtcgtggtagctctcccgggccgcgatgtgcaggggtgtgtccccgtggtaattgacagcgtggaggtcgcagcgggcgttcaggaggacctcggcgatggcggcgctgccggtgaaggaggcccagtgcaggcagatgttctcctcctgtggaagtggaagggggcgaggcttgaacccagctggtgcacctagctcagg

SEQ ID NO: 45935 - DNA, 778 bp, Bovine  19866881342254
tttaaatacttaaatagcccacttcactaacctgtactacttcagccttccaacacaacttaattttcttggcagccagtgccatggcttaggaagtaaaaagctgaaaagaactgctcaagttaacgtgtatgaaaaatagcccttttgggggcacagatcatttctttccaatgctctgttttgtttgctcttgcaaatatcctgtattatgttctttaaagaatctttttattctttttaaacaaaaggtcgcatggataggaggcaaggcaagaggggaagagggaatgtgagaccccagccccacaccccttccccacctaccccttttctgtttatatatttatactctatctacaagcccctgggggaagatgacatgttctttgataatagtaagggatggaatagtgagatctttaagtgaaatgatcggtgctcttgaccctccaagctacaatatgtgtgatgagaatatctcacccccatccaaacaccctatttccaagaccttgcttcacctgtgtaagaaacaggcataacttacagagtgaaggtgggaatagcattttttttttggtgcctgggaggtttctcccctggctagggctcataccaaggtgccagctggtggggagggggtgactttcggctgtcacgaggaaggtgggacagcagaacgtgcatgatgtctccatcacagatgcattcccaagtagatacattttagggtagcctgaccagagcgaaggagctgcacatgtttcctttaaag

SEQ ID NO: 45936 - DNA, 2024 bp, Bovine  19866881396316
tcatttagggaattctgactgagtatgctgacttgtgctagattccctggaaaccaacatgaagactcagcttcttccctcatggctagtctcttgaattggaggcgagaacacggaatgtactttcagactgatgggaggtggacagccatgaccccttctgcacaggctgctgctttctctctctcttttttttttaattttttagtatttctttgtttttataattaaaattctttttatttatttatttttgcccgtgctgggtctttgttgctgcatgagggctttctctaattgcggtgagagggggctactctctaattgcagtacacaggcttctcttgtttcggggcatgggctccagaacacaggctctgtagttgtgtccatgggctgttagcccactgcatgcgggaccttcccagaaagtataagtgttactcactcagtcctgtccaactctttgtgatctcatggactgtagccttgtccacaggattttcctgacaaggatactggagtgcgttgccatttcctgctccaggggatcttcctgacccagggattgaacctgggtctccgacattgcaggcaggctaccaactaagccaccaaaccaggggtcaaacccatgtcccctgaattggcaggcagattcttaaccactagaccaccagggaagtcctttttaaatttattttaattaattaatttatttggctgcactgagtcttagttgcaggatattttttttatgaatagttgtggcatgcaggatctttcgttgcggcaggtgggatctagttccctgaccagggatagaaccctgggccccctgcattgggagtgtggagtctcagccactggaccaccaggcaagtccctgcacaggcttcttagcacggagagtctttgatctgagttcttcagccgatgtggagtctgaagcatgaggagattatccttggagcggcctgaactggtcctttcttggcatggaaaggtggttgctacttttttcccagtggacattcagctgggctttatctccccggcattcccatccccctcagaggcccatgtcactccagactagggaatataggcttttatctgggctttgtttcctccctgggaatagcaggtcccagacaagagaacttggtaagctctccccatggctgtcttatttctcctccttctgttcctatgtgggcttccccaggctgaaacaggtaaggagaaggggtagggggattcttcacttctccacagggttgggagggactgctgctgtttctccttaggggtctgggaaggtgtttggctcacgaagatagatctacccgttgacctccccctgcctctaatattaggaaagattcagagtcaatgagggtccagatcaggcacctttagaaaataagagcggacacgtaaatgctcattcagaaaaggaaaagtgaaaggaagggatacgggcatttgttggctattccagccttcgccctcctgccctcagatccccacattcgctggaggagaggtggggaaagccttatcctcttctctccgtctcgctttttgtagctgtcacttgagaaaggagctcacagtcaggcctagtgctgggggaccccagaagggaggaagccaggggtgggaggtggaggggtgggatcgctgacctgatggaggtctctggtctcacactgccccctccccacagacagcatccaggccatctatgtggtcttgggggaggcactagagctgccatgtccttcaccacctgccctgaatggggacgaattcctgtcctggttccacagcccggcagcaggctcctccactgctttagtggcccacatccaagtggccaggccctcccgagaccctgggaagcccagaagagaatccaggctcacactgctgggaaactactctttgtggctggaagggtccaaggcaggagacgccgggcggtactggtgtgccgtgctgggtcagcgctacaggta

SEQ ID NO: 45937 - DNA, 980 bp, Bovine  19866881409497
ttctacttcttccccgccgcgaaaagatcccgggatatgagccggaagaggcatcgcctggtcccggagacgtttgggttgaagaggcggcgggaactgggggatgtagaggcagatcctttgcggggcgagtcaggtaaccatggcaaccccggggcgaggctaaagaccccagctggcagcagcctcacctctggtaaccctgtatgttgagacaacagcgccccagtgtggtatccccgcttcccccgcctcagttcacgtcgcagtgactcggtctctccgcccaggatctgcgcgagaggcagtcgcagagatagtgcggctgttcccgcgagtcctgtttgaggatgcgctaccccccatcgcgctgaggagccaggtgtacagcctcgtaccggaccgaaccgtggctgaccggcagctggtgaggagcgtcagagcgaccaacgggaatgcgctttcgtgcctcgcgggcacttccgagggtctccccataactcactcagtccaccagctgttcagccattcagcaagcgctgggtctttctgggccgggctttcagtgccaggcactgcggtgccgaggagaatgctacagaccctcagggaatagcatgccaaatgatgaaggtggaagagcgaagcttttggggaaactgagtcaccgggcgtggttcgtgatgggaatgtaggcagacgtcagattagggtaggccttgtacaccagcgtcgtttccattttacaaagaaggcaatgagctggtagagaatgttaaaacaagagagggagtggtgtgttgcacggattggaggcagtgtcatgaggtgggggagatcaattaggaagatactgcagctgagaactggtgaaggcctaaattagggcagtgtagtaaggaggaagaggatggatgagggatgtggagcgagaaataaggacttcaggatagctctcggattttctggacgactgagtg

SEQ ID NO: 45938 - DNA, 540 bp, Bovine  19866881410351
cctcatgtggcagctcccctctcctgtccaggacgaggccccctatatgggcagggccgaggaagggatctgggtgggcatttcgaggcaggcttgaagtcctcagctgagcatctggggtggtccaggaaggtctggtcccctggtgtgcctagaattccttctttggaagctccaggtgctgagaaccgggcggggggaagactcaagactgttggaatagtcaaaggagaggtgtggtgacccctgaattggtcagaatggaggcaaaatggggagaaggccttgaagcctatttgtttctttctggatgtttctacagagcgaaggctccaaagaagacactactggggctgaggagcaggtgggagatgccatctgtgtgagtggatagctggtctccccgggtgagcaggaatacagccccctggtacactgagcgcacccacggcccctgtggccctgggcacacggacttctgagcgctgaggagaggcacgtggaaggggtactggggggaaaacagctggacctcatgag

SEQ ID NO: 45939 - DNA, 830 bp, Bovine  19866881439243
atgattcttataatgctttatgacttttctaaatctcaaatgcattatgttgttggattcaatggtggtgggtaaagcagatattatacccattcctcttctgctagagtaatcttgacaatgatctgcgcagatgtctaaagagatcccataagaacgtgcctaaacacatgggcactatactcaaggaagcccaaagccatggctttctaataggtatttagagttctcccagttcagatgcagttcactgttcaaggatcatccttgtgtaaaaccaatattgccaggtaacatggcagatttacaatctttatcaggtcatgaaaggatcagagctagaaaatcaactgaaagctaaattctcattaaaaactgaagactttgttgaccctttgtctacagacactaaaactaatcaagacagtctttgaccctttatcagtccccagtaagcgggaagctgtgagaagacaggacccttatcttcctaccctaatacctactcctagaacatattagctggtcagaaatactttagtacagggtggtcccttgaaaaagcagttctgttactgataggaaagaaaagaaaaaagtttcgcatttcttaactgtctccttgtttgacaaggatcctaggaaacccttacctcaggctgaaatattgcagtacatttgaatatcccttttgttctatagttaaccaagctccctgatgttctcattactgatacaacttcctctcccatactctacctctccaagtctcatccctaaataaaattcattaaaagatgtattcttcatctgaacacccatactcattt

SEQ ID NO: 45940 - DNA, 778 bp, Bovine  19866881454127
gtctggtagtcatatctctggtagctattaggagaattaaaacacttcatgttaaaatgttttatagcatgcctgtgtgttaacataagggagtgtaactgacttcagaatccaagctgttcagcccccaccttcctcagagagccagctgcccctcaggagaggccaaaactgattcctagagctaggaacaggaatcaggacagggatcttgaaaggactgcctctgtaaggaggggattgcttatacttaggagagaaaagccagacctcttctgggtgggcagtatacacgaactggggagagacgttcaagtgcttgcgctgagttgggagtgcggaacaaagggaatgaagcagttagttgtattgaagataaggcacgagttagagcaacctgcccaggtcaaagctgaggattttgctatgggtttccttttgacttcacgtcctgacaggtggatgaagactatatccaggacaaattcaatctcactggactcaatgagcaggtgcctcactatcgacaagctttagacatgatcttggacctggagcctggtgagacaccctcagggttgttttgtgtgtgtgctgtttttttactattcacaccctgtttatctgcttcttgaatttctaaatttccttttggttctctaacccttttaaccccaaatcctttacttcattttgatttcctacctcactcttgcctacttttgtgacttctaccacttgttctcatactctgatcgtataagttgctcctgtgctg

SEQ ID NO: 45941 - DNA, 886 bp, Bovine  19866881532058
agaaagaggaagaaaagaagaccgatgagggagactgcagcaggagcatcaggaggacatggacaaaggagatcccttgaggcaaaggacaagatgacccagcagatactgagggcagcccaggagggggacctagcaaaactaaaaaggctgttggatcccccatgaggcagggggagctggagggaatatcaatgctcgggatgctttctggtggacccctctgatgtgtgctgcccgagcaggccagagggcagctgtgcgctatctcctgggccgtggggctgcctgggtaggggtctgcgagctggggggcagagatgctgctcagttggctgaagaagcaggtttccctgaggtggcccgcatggtcagagagagccctggagagacaagaagtccagagaaccggtgaggggaagccttatcttttattattatttaaacttttaaatctatttttgttttattgaagcatagttcatatataattatataaattacatgtgtacaatatagcgattgagaattttttaaagtgatattccatttatagtcattataaaatatctgttaaatttctgtgttgtacacacactctgggtttaaatcctgattgtacttcttgggcaagcaacctagtgtccatgttggcacggttggctcagttttcctatctaagaaattagactatacttcttatagggttgttagggttaactaaatgggttaatatacataaaatgctataacagtgcttgtatttaatagcatagtaagcactgtacaaatgttaactatagtaattattatttctcacccaagaatcttttgaggccttaaccattccttcaggtccacgttgctaactggggaggaaaggcaa

SEQ ID NO: 45942 - DNA, 735 bp, Bovine  19866881561054
cagccttgtgctcaccatctccatgtgctccatgggtgacgctggcttgtgcccaggactttaccccgcttggaaccgaaggagtgttctggggaagcagaaagataatggtgacatgatgaggagctacaagccattcttgcccctgctccctaaaaaacatccagtttttcagatacctcgggggctgctggcggtcgtttcgattggttggaggcaggcgtctgtgaagccggcagtggctgcgattccggctgctgagcggttgaggcatcggaactgaagggatggtaaggtgggaaggttattcagagtctgagatggtaccggctcctctgcttctccaactggtggaggacaggaaccaaacccaggccttctcactactttttacaagttttaggacaaaacaccataagctcatcaagcttgcatagactgtcatctgttcttcaaactttcctcacacctgacaaaaaattaaaggtaccactccttagtcatttaacaggagtcctacaatatgcaggaaagggtctttcctctttgcctctgactctcatctggccacattagtacaagccccaattcatcctgaagttcaaagttaaaatattcctaactctagatcccccaggtttccacccacctcttggggtcggactgctcctgtttgcttgcccatcctgttccgtctttcgggcactaatgagacattggggtcattgcctttgt

SEQ ID NO: 45943 - DNA, 1149 bp, Bovine  19866881641494
ctcgagggcccagtaatgatgccaggtacaaattcggaaacatatttgtggaactctgagcaggtgggccttgtttttgaggggcctacaaccctgctgaaaagacaaggaaaatacctcaaaggaaatgtcacgatgtgggtcacacccaagttacacaggcaggaacaggtgtctctaggggaaggctcaggctggggcagctgcctcaaggaggaagtgagacttgaagtggtatccctcatctgcttcacctgttatgacaggaacggatttatgagaagcctcctcatgcccagagggtcaggattgccggaggaaagccagaaagagagtcctggcatgtgtcaggtagaattctgacagacagctgatgaacaggctcaaaaggcagtgcccagggacttccctggtcgtccagtgattaggaatctgctttccaatgcaggggacttgggttcaatccctggtcagggaactaagatcccacatgcctcaaggccaggtcctcattccacaactaagagccaaagcagtcaaataagtaaataaatattttttttaaaaaaggtagtccccataagaggggactctgaggtcgcactgcctgggtttaaatccctgcctccttgggcaaaccaccaaatacttttgtacatcagtttcctcatctgtccaatgggaataatctgacctacctcattagattctcaagagaattgagtgagttcacatgtaaattgccttgaacgggagctggcacggagtaggtgttctagatgtgtttgctgataccatccatgctccccagctgtaaagggccaagttctacacaatctcatgctgactctgcctagaccttggggaaagaagggatcaggggcactgagcagcaggggtgagtggcagctctgatccacccagaattttctctcttgcagacagagggggcgagccccccattcacagcacgggtgcccagctctgcctcagcctatgaccagagaggattagcccctggtcaggagtaccaggtcactgtccgtgcccttcgagggactaactggggccctcctgcctccaagaccatcaccaccagtgagagctggggctgttgcagggtggggtgtcatgggtgcagaatggatt

SEQ ID NO: 45944 - DNA, 1584 bp, Bovine  19866881667595
acataagcagaggctgcagcatgaaaagtttattaactgctgcttttctctcccttgatgggcctctgcatacagtggatcaggttgtgcatgctacggtggccatgaaatgaacacagagttgagcagtgtgcaagctcactaccatctgtggaagctcttttcctggggtgggggtggggggtcactggtttcttaaagttttcatctggggggtgaggagacggaaggagaagccttctttgctatctgaccccaactggcttcaggctaaccatgctctggaggggtcacgtcccagtgacttcagcactagttccctggctcctccacccaaggcccccttcagctggtacctggtgggcagaggcactggaaggtggcgagcaggtccaggcaggtgccgcccctgtggcagggctgcgacaggcactcgttgtgatcggcctcgcagcgggaacccgtgtagccaggcggacagaggcactcgaaggagccgggcgtgttgaggcaggagccgccgtgttcacagggactggggccttgctgagctgggaggagagaagacctgggagtccactgggctcagggtggaagggcaagaaggcctgagtggcagggaaggtgttggggggcctgtctgtggcaaatgagatcagagtggggaaaggggttgtgaccttaaagtggagaaggagtgggacttccctggtggccagtgcttaggacttcacctccaatgcaggggtgtgggttcactccctggtcagagagctaagattccacatgcctgatgccaaaaaaccaaaacataaagcagaagcaatattgtaacaaattcaataaagaatttaaaaaaatggtccacgtaaaaaaaatctgaaaaaaaacttgagagatgactaaatgcagtctggagggctgagtattggtgagaagactggctaagaaagagatgccaaataaggacaaattcaggaaaaaagagatgttcatttctttatttggccgctgtgcagcctgtggaattttagttccctgactagggattatatccgggccctcggcagtgaaatagcggcatcctaaccatcggaccaccagagaattcctgagatgatttttaatttgaaaaacagtttgcctgtttccctctttggcagaggctgtgtgggggcttagagagggtctgatgaggggggtgcctcacccatctgacactcgtccaggtcctggtggcaggtgggccctgtgtagcctggctgacatacgcagagtgtggagccactcagggggttggtgctgcactgggcttcctcatggcatggctgactcagacacatgtcctccatgtggcacaggaggcctggagggtggggtgggcaaggtgctcagaggctgcttgaagctcccaggtgctctcctggtgcttcggtcacctagcatctccgcctcccgcctccctgaacctctgcgtcacacctgtgcgcccaggcgggcagaggcaggagaaggagcccacgcggtcaatgcaggtggatccgggggcacaggtggcggccacacagtcgtccaggttctctt

SEQ ID NO: 45945 - DNA, 1392 bp, Bovine  19866881754304
gattttttttttcccattaaaaatttgtttttcagttataaaaataatttaatcacaagacaagaatttggcgactagggaaaaaaacaaataattcttggctgtttcacactgaaacaagtactgttaacattttaaagtgtttctcccactctcttctgcgtgtatattatttacatagttccaatcttgagagggttggacttttaagagaaatttccctaagaaactttagggaaagaattgaaataaacatttgagctagaaggagcttaaagggcaacagcatctcctgctcttagtaaatatgacctcatccttggtgttctccagaggcacagtctcccaggaggagccctgggctttctccctctttgtggggcccggggggatccagctagcctgtgtccagcttggccatgctctcagctcatctgctttgcactgggtatgggcctccatcacattttaggttctccctgatcctgggtgtggaaaatgctcccgtaaaattggtccccagacacctcccttggcctccacatcagcctgtgccgctggccctctgactatgttttctacgcttttttgtggctggcctctgggattgtgtctcttgcctttggccagcactctgtatccatttctgttggcacagagtgcgttcagtagctggctatccctctggccactgccatcttcctagaagcctctctctctaccttatccttttcccttttccagaaacacttttctctcaaaactcaaactctgctattcctggccaagggacacacctagttattggaatgattttcaaaacacagaagaggaacattcctcttttccctgcatacgtggcacggctacgctcagcggttctgaaagtgtgctccctggacctgcagtattagcatcacctggagcattagccatgcaaactgtcagactctgccccccaatctgctgaatgagaagctgtagggggaagagcccggtaacctgcatcataacatacccccaggtgattctcatgtaccccaagtccaaggaccactgctcttttgttcaaggaatgctgctgttttgcaaaaggcaaggtcttctatgaatgtgagacaaagcttgaagaaactgagggaggtgaacccccgaacagaaagacatccaggtgtttccagtttgaatgtattccacagactggaaactggggctatgtcacattttcattgggacacaggaacttgcagcctcagaaaagtttgtgttcgggtctggtctgaaaaagaggatgagggtgaggtgagctccaggggccagccaaggtggagccctccacgtggggccatgaggttaatatcgagaatagagttagaaacttgccaaggacat

SEQ ID NO: 45946 - DNA, 798 bp, Bovine  19866881855630
ctggacaatcctgatctccccctgctcttgcagtgccttctgcctcctagacatgagaatgaaaaggatatcaggggaagatgctctgctataccctggacacactgagcagggacattctgtgtccaagtattggggagttcttctttaagtaaaggaaaaactatggggagagaattaggtggatcgccaaacagtctttttcaattagtctttcacccagccacctcaggagttatctgttaaacagtcaacacaggggcttccctggtggtccagtggctaagagtccatgctcccagtgcaagagaccccggttcaatccctgattggggacctagatcccacatgccacaactaagagtttgcatacagcaagttaaggaccccgcatgctgcaactaagactcaaaatagccaaataaatactaaatatttttaaatgtctgctgaataaaaaaaaaaaaaaaaaacattaaaaaaatcatgacatattttctaagaccaatcataggcagacacttagataaagcagtgattaatgggctctcccctcaaggaattaacagttgagattttggatggggaaggtggagaggaatatgggataaaatgtttcaaacaaataaaaataaaccagaacttctgtttccgggaatatagcaagaccaactcactcactgaaaattaggtaaaatgctgcataaaatgttattttaaaagctgtttaagcattaaagcgctcataagataataaggaattaccaaactaatataggaaaacaaaattcaaaagaa

SEQ ID NO: 45947 - DNA, 956 bp, Bovine  19866882051539
gtgaaattactgtgtagggcatgaggaaaaaaatcagagttatggttgatggttcaacccaaagttagccgtctgtgtgtagcctgtgggggcatcaccattcaatatcaatgttggttcatgaggtcagggtgagaggctaagtggggtagtggatactgggggcaaggaagtcttgttttggaaaaacccaccaaattatggggggaaagcctctgtttgggacacaagggacagacttcccctcccagcctccctcctaatccctcttgtcctgcccttaactgcagcctccacggatgcctcccctgccctctgtgccccttccgcagactgggatgtggcctggatcctgacactgttgctcacagtgggtcaggggttcaccattgtggtccttggcgtcatgctctggaggcagagggcccagggggctcaacacagaagtgagtccttccttcccagaagggtggattcatatctcacctctctatccttcttctctaggggagaaggtgggataaggaagatagctctgagtcacctggtgacttctctgctgcacttcatatggctttttctctccagatgcttcatttcctcagttcaaacccgagatccaggtctatgagaacatccatttggcccatctcaggtgaggagctactagggggcagaggcttaaatctcggaggagactgaagttggggtggggatgggatgctggttcccgaggatgtggaggatggaagtatccttaatctgtctttctgctttgcaaaaccgacagcccacctgcccctaaaaccaggtgatctcgaggacatctgctaggaagtgtgacctgctgactccctggccatctggcacctgaaggattcacgaaaagcttgacaaggggggaggggcttggagtgctatttcacagtccggtggtctccagccaagctgtgtat

SEQ ID NO: 45948 - DNA, 1221 bp, Bovine  19866882237689
tctttatatttaatcatatttaaggcttactgttctttctcagttcacacttagaaggagggtgggtttgtgggtgggggaaggaggcaaaattgaaagggacaattattttcttttgattcacagaacaagaaacatacattcagactagtcctgaggtatctgtagctctcaaatgccctccccacatggggaaggtgataatactgtgtatattttcctaacaaaaagaaaagtggactatgggaagggattgcaggggggttcatttttaatgaatatttcttaattgccagcttaatcttttaaattatttcctggtgaaagatatgttcttattgacagtatttcaaacatattgttcccagttgatattttcagtgcaaagaagttaagatttaattcatagttcaaaaaaaagatttaagacagatcagcccatcaaacttcatcatcctctcaagctgagtttattttctcacctccactttcaactaataagtatatgatctctcaaaacttaacccaaagcctgagaactatgattcatctctccaatacttaaagatcttttagagtctacatctgattgtgctctaacgatcactaaattaaaaacctaataagattaacatcccaacaaagcccatgatctattttctaccttatttaactatcacagaattagaattattaatgtgacagttgtttcatgatatcacttagctttcgcaaaaattaacccaatttaaagtttttaatcagcttgaatacaatgatcactaaaattttaattaagtcttttgattatactataattttgtcatataggctattgcctgcaataaatggactttcaaccagggcttacaaatttttacaatacggagattatgtggttcaaaggaaagaaaagatttatgtatcatctagaaatctaggagaagggagagacgaacttagaatttgatcaaagaattatctgtggcttacttctgcaattcaaagttgaaataggggtaaatttcactttgtgggataactagttttctaaaaaataaatcctagaaaatctatttctgttaattaactttaaagtagaaaatatatagcaaagatattaaaataaccaagggtatgaagatactgttagaagtaactaagaggtattttagatgagaaggttcagtagaaaatcagctctttaccacaccacacccc

SEQ ID NO: 45949 - DNA, 777 bp, Bovine  19866880354659
agattacctgctgctgctaagtccttcagtcgtgtccgactctgtgcgaccccatagacggcagcccaccaggctcccccgtccctgggattctccaggcaaggacactggagtgggttgccatttccttctccaatgcatgaaagtgaaaagtgaaagtgaagttgctctgtcgtgtccgactcttcgtgaccccatggtctgcagcctaccaggctcctccgtccatgggattttccaggcaagagtgggatctttttaattccctttcagaatctaatattgcatgaagctaagaagagaccaggatgtaaaggtgggatctagctgtacctgcctctcatcatttggaggaaaactatcccatcagtgatgtgatctttattcatgtatttttaactttgtcggggatctcctgtttaatcattgagaatagtttcacttttgagtatgtttaaaaaaaaagaaaggtagaaaggtccctatacagtgggtaaataagttaatgattagaaaaaccacaatgaaagcttacttgcacaatttaactaggtcaagatcagcagatttttaaaaaaatatataatgctatcacccttggcttcatcatttacattcatttgtttaataattaaactgggtcagtgtaacagtgttgacacttcacctgtgaatttgtcttcttcagtgagttaaaaaaaggaacctgccttcggtttgctggaagtggaaatgaagagaatcgaaataacgcgtacccgcacaaggcaggctttg

SEQ ID NO: 45950 - DNA, 900 bp, Bovine  19866880369648
tgaacctccctccacctccctccccataccatccctctgggtcatcccagtgcaccagccccaagcatcctgtatcctgcattgaacctggactggtgactcatttcacatatgataatatacatgtttcaatgccattctcccaaatcatcccaccctcgccctctcccacagagtccaaaagactgttctatacatctgtgtctcttttgctgtctcgcatacagggttatcgttactatctttaaaataagtttaggaaaggccagttcagtggtgttcaacaagattttttactctaggcctttttacttcctggtcttgaagtgcatcatgtatctttatgaatctccaggaggctcaactactaagcccatgtgcctcagctactgaaggctgagtgtcctagaacctgtgctctgcaataagagaagccagcacgatgagaagccctcgaagtgcaaccagagatagcccctgctcgctgcaactagagaacgcctgcatgcagcagtgaagacccagcacagccaaaagttaaatacataggtaaaattatatatatatgtatgtatgtatgtatataaaagatctgctcactgggaataaggcaagaattgggtacaggaagtaaagcatcaaggccagataacaaacctgatttacagagcatttagtccaagttccctgaaaatacttttttctgggactggtttcttagtatagaactgagatcaggactgaaaggccgctcagaggaggactatgggaccctaggagaaagacagtcagcctgccagatcttgtggttctctcaaagccctccagtgcccacccactcacacagtaggtgctcattcatatctgttgcataatcactgtatttgctagagggatgtg

SEQ ID NO: 45951 - DNA, 1636 bp, Bovine  19866880393419
ctgctgctgctgctaagtcgcttcagtcgtgtccaactctgtgagacccaatagacggcagcccaccaggctcccctgtccctgggattctccaagcaagaacactggagtgggttgccatttccttctccaatgcatgcaagtgaaaatgaaagtgaagtctctcagttgagtctgactcttagcgaccccatggactgcagcctaccaggctcctctgcccatgggattttccaggcaagagtactggagtgggttgccattgccttctccaccattcacctagctcagctcttttcataagaaaggaagctttctgctttctcagtgttccccatctgcccatctttcccatcggcctggcctgttggttccccagcggcagggaccacagctgcccgattgactgcagggtcctcaggcctgagtgtctggtggcattccacatctctcggccacccgcgggcatctttgctcacagtctccacgtctaatggaatgatcaccgagacctatggccgctgcctgtcacgtgtctcaaatgcagcccttccatcctgtcccctgctaccttgtgaaatatggaggaatgggaagcagaagccgtgatccagggaatctctctgacttcccctggggacagtctgcagacagccagtacttggccccagggccactgctgactgtggatgtgacgaattaggttgtaatccagcctcaggagcgcactctccactccacatttgcagggtgctcgggagaattggatttggtggggagtgtagcgccctgcactgtcccaaccgctgtgattaggatacaccgttgtctgtgtcatctgtgctaatgcagccatctcactggtctccctgcctcccctccctgaccccagttcccttctatcgtcctccccacagtcggcagagttactttacttctagcctgcttggagaatagtattatatggcctcctccactgcattgcccagagaccctgacggaaaaggcacaaactccttagcaaagtagataaaacccttatgatctgcccacctgatctaagtctgcaggtctggccacagagcccacctgctcccctttgaagcccacccactgtgcccctctgctctgggtgccctgacacacagagctgctcatggtttctcagatgcccctgtgccttcagtacctgaattgcctgagtgtctcattcccttttccttaaatgcctttgcgtctttctggcaagctcctattcgtcctcaatgcccagcttatacattcctccccctgagaacccctgagtttgtttctttccttggtgcatccctgatccttggagatgtccctggatcccttctgttttacccggtgtattcactgacgcccccatttccaagaatctgggtcacctttgtccccccagagccaggcacaatgcttttcatcctttggcttggtatgtatttgctcacataagaaataaacaaaggctgttttccaggaatcaggcagcttttgggaatagctgaggatgtggaagcaagagacactttcagttcttgggcttttcttctttttttgttagcaggggtagcaggagtaacaggcctggggaggtcagaaggtcaggaaa

SEQ ID NO: 45952 - DNA, 1584 bp, Bovine  19866880471255
tttgttattcttggctgtgctgggccttcgttgctgcaggcaggctttctctagctgtggcgagtggggactactttctagctgtggagcagaaacttctcgttgcggtggcttctcattgcagaacatgggctctacaatgcaggctcggtcgttgtggtgcacaggcttagttgctctgtggcatgtggaatcttcctggcccagggatcgaacctgtgttccctgcattggcaggcagattcttagccactggaccaccagagaagtcttgcctgtctttttctcccctgctattgcttatattaccttcatagtccggtgcccatcttacagatggaataatggaaggacagagaacagtttcaccctctgtgctccacagtcgcatatgtttttgtttcttttttatcctactccaattatgctcattcaccctcatgtcatgtaagaagttcagggttgtcttatcctctgagcatccttccttggtcctaaatgttcctcataccctccaggctcccgtggagatttgaccttgtctatcaggagccgtgggctcccctgatagctcagttggtaaagaatccgcctgcagtgcaggagaccccaggttgattcctgggtcaggaagatcccctggagaagggaaaggctacccactccagtattcttaggcttcccctgtggctcagctggtaaggaatccacctgcaatgcaggagacctgggttcaatccctgagttgggataatcctctggagaaaggaaagactacccattctgatattctggcctggagattctgtggactatatatataatctatgggtcgcagagtcggacgtgactgagtgactttcagtcattatcaggagctgtgagcattcattgcctagttaagtgtttctcaggactgagtcccaaccgtctggttgcatctctcagctagtctgcaggaaccatccaatatctgctgagccaatgttttaacttattattggagacatttgggggttagaagcctggtgctcttcccctgcgtgcccctgatgagctctggtctttgtagaaagtatattctatgtagaagccatcatagctaccatgacagcctgatgccacctggacctgtaagtgcattacaccacttgtacaactatactgtgtgtgcggtggccgtcagagcctcattttgcaggggagaactctgaggtttggtgaggttacacgacacacccacagcccttcagctgatgcaaaccaaacactgtggacagggcagctgacgggggtcgctgtaatctgttttccctcccgacttgcttgacgtccaagctgggcatttttttctcctggttccctctcctttccacccaaaggtttaattctgagttgttcccagtgtgtcgtatctgaaaatgtttgttttatttattcataccacagattccagaacgtaaacagctctctgtcccgaagatcgagtctccagagggttactatgaagaggctgagccgtatgacacatccctcaatggtacatcctggggacagggctgggagggggctgaccacttcctg

SEQ ID NO: 45953 - DNA, 1198 bp, Bovine  19866880535082
ttagcatgcacgcgtgcttttaatgatctactgagctaaggtagcactcgtttcctttctaaaaactgagcctaataaagatataagcctcagcacatcactccagttggaagctgagggagtacttgtcaacagagccaatattttccttggaaagcaatttaggtacactctcaatatgagataaacaaccagaaattccatgccataaagtaggaccgaaaaatttttagcctagaaaaatatgcaagtactctactaaatgaatccaacatagtaaaacatctggtaaagtacaccctgtttttaaccaatataaattctgattataggcgaaattagacagtgtgtgtctttctctgatacattcatgtagtataacaccttctaggtccgtctatgttgtcacaaatggcgagatttcactcttttctatgactgaggaatattccattatatataagtattattatttttttaaactactcaaaataagctataatttttaaattaaaattttaataatctaaaaaaaatccccagtcatttcttgatttgtttttcacatggcagtaaataaaaaggacactgttaaacagtatactgcatgaataaccttttgaaattttgaaactataatccttccaatttaagaatattcagaactatcttaatcgaaaactgcaactaagatgaaattctttaacattagagaaatatataatctatcgtgtatataaaacatgcatgtaatgtcacatgttatatataattatatagttatcctaccttctatatgttattggtagctttgcttttatgcaattaacaaatcccaagtcatggatataaaagcataaaataactagtaatgattaatccaaatgaatgttcctgtaatattttaaaaatcttactttaactcagcaaaatttacttatttaatatcaagtttacatacctgaccttccaaaaactacatcccaaggggaactaatgggctgttcatctcctttagctccaccttctttatctgtaccttgaattccaatgccagccacagtgctcaccatctcagcttctaggtcaatctatagaaattaatacaagttttatacaatgcatctatttacaatagaacatatagaaaacatgtgctttatttattctatgtgtgaacttattatatatttaaaaa

SEQ ID NO: 45954 - DNA, 2094 bp, Bovine  19866880552857
aacttgttataacttgttataaataaatgtattcaaaactttagcatacctgatatgtttttatcatatcttgacaatttttcctaatctgatctgctttcttcctttgcttgagttaattttgttgttgtttctttgagtttatctttggtttcctgcattgacaaaaagatagtgtgagatgacagaaaatagatattggtctctgcccccaattcctgacagagctcctgaaaccccttcatagcctgggcccaggcctggcatctgaagtggcaggctggggaggttttgtgggactgacactctctctgaatagacaatatcaaagtgagttcaactgtaggtcactcggctggtgtcacacacaactgctaagggaaaagcctccacacactggtaaccaaaggaatcagcagtgaagtgttctgtgttaaagtaaaggggacacgcaagaagaaacccacaggagggaactggattttccctatgctagaggaacggttttttgtttttttttttaatttacagacagcaacaaggctggcacggtgatgtgatgactggtgagaaccatggccagagagtagagaaagttcttgtctcagcactgccactggagtcagaaactattccagtaacaatactttgcacttctgacaaaaaactaatgtggcctacacagctgattgatcaagtcattgaataaagtcaaatttgatagttttcagcaaatcagtagaagttactaacttgaaaagacaaaaatgcaaaatgtttaagcagttctttgtagacccacataaaagacgattctttgttttatggccaaggtacctattcagaacttttttttttacagattcatgctgcaatttggtttctcttcctcaccactctattaaaatagccattcggatggtttgcgtgtaagactttctcatcagatccagctgctttttctaatttcttattcctgacttacctattccagttctgatccactcctgactctttcaatagccttcctctgtctataaggcagtatatttctttcccccacccgcttcttcccttctctcttttcttaccttgctggacttcctgtagtgattgtccaagtacagccctacccttcaacttcaacgttctccaccagagtacccgtacagtgccataattggggtaccacgtggatttctaatgaaaatttaggtatcatcttctcctggcaggttccctttaggaagggacagaagctgctattctgccttcccacagatagaatccagggaacgccaacactggaacaaacggtactttctactgtagctcattacatgcttccctactgagaagacagttctggcttacagctagctcagtattcacatatgaactgttcatgtaataaataccgaattaatgaaggaatacttaacatgaatcttctgttctagtcaggctggttttcccaaacaccaaatctcccttttctccttatcttgttcctccacttggaatgcctttcccttcatctcttgatataaattccatctacacttcagataccacttcttatatgtcactttgttttttgataaatttactacacaattaagtgtctagtgacatactttcagttgcaggtcttttaataataatttggcttatattaaaacagtgacttttaaaatataaacatttgaaggctttttcaaatactgttttttaaaatatgagaatattagctcaacaagaggagggagagataaaggaactttatctgtagccccccaacttctatatcatcaataactaaagcagagcttgacacacagaggcactcactccattcattcagaacgtagcagctgagacattccagtacgtcaaatacaattttaaacggtgtgtagccatcccagtgtgaaccctaaggattcttgctcctattccttctggcagttcttccactgcccatatatcagcagttgcctaacactcatttgcggatcagcaattagctcagaatcccaccattctctaacctttgaccattgtcaacacagacacccaagacggacaggtcat

SEQ ID NO: 45955 - DNA, 1998 bp, Bovine  19866880580954
acctgcaatgcggagacctgggttcgatccctgagttgggaagatcccctggagaagggataggctacccactccagtactctggcctggagaatttcaagggactgtatagtccgtggagtcgcgaaaagtaggaaacgactaagcaactttctcttcactagtgcttgacacataatagggattgaggaatatttgtcaagtttgatttatttgaatgcagcagcagttgtacattatagcatacgtaactaaagctagctaaaatcagtgagccttttgtttattatccttagacaattaagttaaatattatattttagaaacttgttgattaatactcaatttttttccaggactaatggaattgaatggaagatgttctcacctaatgatagagctactgaagaatttcatgttgaatcagaatgtaatgatttctgtaaaaggagttatcaagaatgtccacacggtgtcagttgagaagtgttccgagaatggtattatcaatatagctgataagctggtgatgtatggtctggcaaaaaacatcacatctaaaaagccagctgctgtaaatacaggtattgttttttcaagtttaattaataacagatgtaagcgtgaccaggaacagacgtacccagtttagtaggtctgatctgtattctcacggctatgtttgttccctttgtcgtcctcttctgtgaatcctgcagtggggtactgactcatgttgccgcctcagaggagcctggaaggaatccggcctcccagtccagattttccttatatcaggctcagcaaccttgtccatagcattaatgctccaagctttaaaaaggtcaagcattcagagttacttcccacttccttttgatcctgatcaaagtgagaagaactcgtatacttgagactgggtcttactagttatttcataagatgattaggcaggcctgatctccaccagaaagagatacactgtgcaggataggcaagacctgaaaccttggaaggatgagggcactcattgggtagaacccaggacagagtagtaggtaacattaaagcgccgatgaaaagtttaatccatctactcctttgtggttggaaaggatctgccctgtggggcaggcttgtgtatgttcaaactccaggtttgttttttttttttcctgttatttatagctaagaggtctaacagctctttgcatttgcttttagaaacggcagacaggatgaactgctgctgcacgaagctacagaaacaagtgggtgaatttccctaaagtgaaattatactcccaacattttaaggaatgaaataacactattttctttctcaccctcaggttgaaaagcatgagcaaattcttctcttccttttaaacaatccaaccaatcaaaataaatttattgaaatgaaaaaattgttaaaaagtaagttaaatttgatgttttttctcttaggcaacccccaacaggacatcacccatctttttctcagggcagagtatgtgtttagaggctgtgaggtactctgtggtctgaggatcagagggctggctataatgattctgccgtcttcctaggttttgtttggtagcctccctttgacactgcttatggaactgagtccagggccatcctgtccttactgttgcttgacatagagaaagctcatgacggtatgtgcagggatatgtaaaaattgtcgtgaggtcaagcttagcctgaaattctttgtgtctagagtgaaattaacacttccttgtacacactcctatggagatggttaacactttttatgaagttctgagtcaagaaaatgggctgcagtgatagatttcatttcagaacaaagaatattcttcatctttagctacggtgactctagtggttaaagatgccaccagtgggttttatttattttttctttttaattgaaggataattgctttgcagtgttgtgtggctgcgccatacatcagcacgaat

SEQ ID NO: 45956 - DNA, 1366 bp, Bovine  19866880588782
cccccttaaacatcaccattactgggtgtaaaaatggtttagcttcaggaggaaacagctggctggcagagatcctggtggggtcctgggtgagagtctgttgtgtcactaatgactttcttgggtacatttccggcacaagcgcagttggcagttggggaattctgtggctgagaacttttgtcaaggcaagagctgcagctggagcagcttctggctgaggccaggaagggaagtcttcactgcattagggataatctagacctgtccaatgggtgtctcattggagaggtagaccttggtagcttaacttgaatgctaatgaaccttttccttctagaatattatgtctctgggtttctcttagacttcaaacaccttggtctgtagctaaggtgagcccagatttcttagggtccctgacccacgccctctttcttgaaggcaggcagtgtctaaagcaactctatgagtagagtgggaagatgtgtgctgctggaaaaagtccgagctccttctgcaataggcttgcctatttgtgcagttcctatggctatttctcaccttgttctatgtctcagccattctggattccttgtgctttcccaattggaccttggcaaatgctgttcctttaacccggaatgttctcccctcaagactgccagccaggcttatctgcaagggtcattcagccttgaccttgaccccaacgccctgaagcctttaaccccttactgcaccttacttgacctgccatggtcatcaggtccatattacagttgatggaaagtctgtgtgcccgggagactgaaagatcaaaggtcaaaagccattattcctctatgtgtccacagcacctaactgcatgggtgatgtattgtcagtgctcatgtatggtattgtatgattgagaaatggttgtcgtcctcaagttttctaagtttgattgcatcaaaatgaaggccttctggtcattagtgggcatcctgataaaggtagtaggcagatgaaataaaagagaaagatatttacaatctaaaagcttcagggggttaacaattagaatatacaaggaactgatgcacatcagccagaaaaaggcagaaatctcaacagaaaagaaggtgaataaagggtgtgaatgggagtttacaggtgatggagcctccaaaatgttaatgaacacctgaaggaatgctcactcggcctcctttacttatcagagtgaaaccagccagaacagccacccaggaggctggcggaagtgaagaactgaggaggccgagtgttctcagaacactcagaactttctgcatgggcccactctaggcagggttgaaaatacctttgcagcgttatgtgc

SEQ ID NO: 45957 - DNA, 2228 bp, Bovine  19866880677805
tattatatgtggcagacaccaataaccatcaaattaaagtgttggatttagaaaccaaaacagtttccgtggtaagtaatccttaagttaaggggcatcattttaagaaaggttctgaaatccctagcaacagctgaggcacttttggtcggccagcactggtggtgaaagtgaagcatatagacagagcagtgagtgggtgcctttcccaaggatgtcctgttatttttaaaataaaaattccatctgtgccaagagtgtttgagaaaaacaatagaggttggagagaatttgatcaactttcagaaaaggaaaaaaaaagactcatctgtttttaaatgtatggacatactgatacacacaaactatgtgggttggattgtttgagtgttttttgtttttttaatttttaaacaatcctcagactgatgtgtaatctttgtttcctatggtgaatccattaccaaataatctttaaagaaaggtctagaagccacatttctcaggacttaaaaataagatgagaggaaacttaaatacattctacttttaaagatatggatatggtctctaataaaatttcaagttacccctttctatgtcacatttgtccagaaaatgcaggagttctttatctaaaattctaggaatttccaagatgtgttttaaaataaaaacacagattgccatcataacaataagttcgtttctcatgacatagatctctgatatgagatgaatgatgtcttatagttggcagtgaagattataagagagtgtatattatatccactgcatttaaattgataaagttttaatttcctgctatctataaacatattaaacaattaatttcattccatttcattcataaatgttgacggtcttttggccaggatgaagttttttttgaagctacaaaataatcatgaggaagtctaagtaaacgcattctgattcagaagaaaatggcaatcaagtttccttgacattgaacctcacttttgtactgaagtctgaaaataagctctctcagtctacaatactgtaaagtacttgtgctttagaaaacagattttcttgtttttagttcccagtcttcagatctgaaaatgctgtggtggatggtccttgtctagcaggaaaaccaaagaccttacccaaactacctaaatctgctccaggcgttagacttgcccctgtggctgcgtctcccggacagactctgcagttcaagctgagattagacctcccatcaggaacaaagctaactgagggagcttccagttgctggtttctgtcagctgaaggtatgacagtaacctttgcaaatgcaaatattttatgaattcttgatgtttgatctagaaaattttctcatttgttatgtgatactttaactgtacatttaggctggatttgaagggggtcttataacacagaaagatccagatctaaccccactttagcagttttctttagtctttgagaattctttctctctctttattaataactgtgtaactcaccccaaaaggtaatcataattgttgccatttgctcccaggcaagttcatcacgaggtggactgtttgtggtcctgaataataaataggtccttgcatattagaactgaaaggcatcaaaagacaccctgtgttctaagcctcttataaatgaggagactagaggctgaaagagataaaattatttgcttaagggcatatatttaattaggtcaaaagacggaatttgaacccagctctgctagttcttaatttagttacttttcctttgtgctgtgtgtgcatgcttggtcgctcaatcatgttcgactctttgcagccccatgggctgtagccagccaggctcctctgtccgtgggattttccaagcaagacttttggaatggagtgccattttctcctccagggactcttcccaacccagggatcaaacctgcatctcttgcatctcctgcattgacaagcaaattctttactgctagcactacttgggaagcccttccattgtgccactccatctcaaactagctccagggttactagtgcttgaaatgaacttaattttctaaagacatataacactcaaggccaccagttacacatttgcatgttacagaagcttccaaaccttactcttcatttctgcacttaacttatcattgtgttgagttaacacattgtgttgaggaccaacagccatcc

SEQ ID NO: 45958 - DNA, 2109 bp, Bovine  19866880747843
aatcagggggctttctccactgccttgggtccttgagccctagaggggacgccagccctgctgcatagctcctgtcccttccctgtgcccaagttcaccagacctccttcccaaggagcctcctgaagagctggagttagaaggcccgggctcatctcctgggtaggccattcaagaggtgggagacccaggccacagtgcttcatctccctgacttgacttcctcatctggagagaagaggctaggagtccctccctctcaggtggctgggatgaagtgagatcgcccacagatgcccttagcacagaggtccatgccccgtgaccagagccagctgtcagggtgatgaatccacctccgccaccaatctgaaccttaatagtgtctggacagctaatgtctaagtaacaagattttagtatttcctcataccacagttgagaaataatctcaaaacgaattaaagacctcagtgtaagacctaaaacataaaactcctagaagagaacattgaacactctgacagaaatcatgcaatattttggggggtatgtctaataaggcaaagaaataaaagtaaaaataagcaggacctagttaaaaattgttgctcagcaaaggaaaccatcaacaagataaaaaagacaatatatggcatgtgagaaaatattttcaaatgatatgacccacaaggggttaatatccaaaatatataaatagctcatatatctctatataaaaaaaaagccaccccattaaaaaatgggtggaagaccagaatagacattttttccaaagcagacagacagatggccaacagacaacatgaaaacatgctcggcatcactaattattagagaaatgcaacagaaacaaaacgagacactacctcacacctatcagaatggctgtcttcaaaaagcctaccaataacaagtgttgacaaggatgtggataaaaaggaaagcctgttcactgatggtgggaatgtaaagtggtgcggccactatggataacagtcaagaggtgcctcaaaacattcaaaatggaactaccgtatgacccagcaattccgtaccatggaaaaagcaaaaccacaaactcggaaagatacatgcgcctcagagctcatagcagcactgtttacaccggcggaggtggaagcaaccctagtgtccatccacagacgcacggatgaagacgtacgcatgcgtacacacacacaccatggaccattactcaaccgtgaaagacgatggaagtctgcggtttacagcgatgtggatggacctagagaatatcatgcccagtgaaataaactcagagaaaggcaaatactgtgtggtgtcacttacgtgtggaatctgaaaaacaggacaaatgaatcacatatagcaaaacagacgcactgatacagaaagcagcccagcggttacccgtaggaagagggggagggggaaggggcgagagaggggtatgtggttaacagatacaaatcactatgtataaaatagatgagcaacaaggatatattgtatagtatggggaattatagccattattttataataacttctactggcatataatctataaaaatactaactgtgctgtatatctgaaacgaatataatattgcaaatcaactatacttcagtttcttagaaaaggccaatggatgttgctcttctctatcccaacacctcactgtccaccccagcactggatcagagtggttaaccagcttttatctggatgagtccccaggccaggcagatggtagcaccccagcagataaaagagaacctcactgcaccaagtcaccctcactgcagatgacatggagtccattcctcttggggaccatctaacgacctctggcattgaggcttcgggtcttggcagaaggggatggacagccccaggctgccacctagccagcatcctcaccgcggttgtcagctctgacacctccacatcgtcgtacagcagctcctggcgatcctggctgggcaggccgtcaatgtaagtgttcggctccgagaactttctctgcatcagcctggaagacatggtgagagaggattcaggataggggtaggggtaaa

SEQ ID NO: 45959 - DNA, 994 bp, Bovine  19866880779731
tctgcactggcaggtggattctttaccgctgtgcccctgggaagcccattagatgtcaataccacctaccttatgcaggtgaaagtagcctaatatatgctcaattaacatttatgaaaaatcacagatgttttggaactcttatgaaataataaaatgcattaaaactttcttttttggccatgcggcttataggatcttagttctcaaaccagggattgaacccattccacctgcagcaggagaaaagagcccaaaccacttaccaccagggaattccccattcaaactgtttttcaggtttgcaacactctctacagttataccaatgactagtatctttttaccctcacaagaagggtaacaatgcattatcttgtttccttcaaaggtgagtcattcttaagagtatctcatctcacttccggtttactacttatctggtttccttccttccttccagattgttaagtctggcctcattcaggtcttgttgactatttcgagcccactgtcttttttggaatcttacctgttccagagactggtgtggaatccaaacactcaaaaacgtgccatcgaggtgtttgacctagcaaggaggaaaaaggcatctggcagttgggacagtacccatcataaacctgccgtgtctttggagacatgtgtttggtttcgtgagtcctaccgcgcttttctggagtggtctccgtgtcttggcactgttgaacaccatctccacatatggagctctgactggaagctacagatgtctgactgtctgtttctctaaggcacgtttccggggtcttgaccttctttttagtttctacagtcctttttttatttctgtttcgttttgactggtgttgtccatctgttgctttttcaacagaatctggaatattctcagagcaattatttggacgtactcgttttggttttcttttggatttgtattcccagatgtcttcttccaaaaaagcatcttcta

SEQ ID NO: 45960 - DNA, 780 bp, Bovine  19866880804971
tggggtcacaaagagttggaacaactgagcaactgaacaacagcaatgctgcctctacccacccccctccccaagaccacttcttcccgagacccagtttgctcatccaggaggcagaagtaccccctgttggcttacaccagtgtgtgctgggactcagtaagggagccatgcagaagtgccgcctcttcagcaaggaaagcgaaggccaggagaggtgcccactctgccttcaggagctgctgctgctgctaagttgcttcagtcgtgtctgactgtgtgaccccatagatggcagcccaccaggctccccccgtccctgggattctccaggcaagaacactggagtggattgaacagcatctaattagagccagggatgtggtggctgtcccccgggccagtggcctggcttggctccttgctgggcctccctgagggccgctccctggccctggtcttcctgcttctgggggaacagggcccacccagagttcccagctgctcgaggaaccacgagaggctagtctaggccttgatctagaagcatgactaggagtgagaggtcctcgaatactcacagcagagaggttttggcagcgctcacgatacaggaaactctatcggcatccacatagtcataggtgaattcttccgggtctgtcttggagcccgactcagagagcaggaggcctagccagtggcccatttcctcggaagacttggcctgggaggaagccgagagggacgtgagcagggctggagcgtgctgcctggcgc

SEQ ID NO: 45961 - DNA, 2602 bp, Bovine  19866880851767
caggtgacattagtcttgttggccggggagcccattttcccaaagctgttttgaatcgccatgaacaaaacactggctagatgtttctcaaaaggcttatgtggtaacttacttgagccaacactcactccattgagcagaatgcagagagggtcaccatgttgacttccagctttttccacctcaagagccttgaaactacatttggaatggtactgaagaatacaaacacatgtaacatttagcacataccatgcacatgtagtatgttaaacaccagatccatcttgtgtcatttaatcttcccaaccctaggagataggcactgatattattcccaattaacagacagggaaataatgctcagagaggttaagtaacttgccccaagacacacagctagctcatgagtagttcaagtccagttctgcccctacttcctaactccctcaccccaattttgtcctgtttttagtctgaacatctcagaagccaggcctggatctccataggtgtcagaaggaagattccagagccaaagtggacgtttccgcagagccgtgggcatgtgattaatttgcaggtacaaggcagttccatgccctcccctcccagtgctgagctcgctaatgagctaagtctgagagtgcagacgcaaggatgctgaagagccggctgggcccaagttcggcctggggagcccccctcccccggctgcccccgccggcgtgccatgtaagtgatttcccactccggcagcccaatcaattggctgtttctctgcttaaaaatcactgggttaaaatgtttccctgtctatagtcagggcatgttcttggcccatcagggggcctttgaaaggggctggttttgtatttaagaataaagcctcactatcaaaaatttttaatgtattcttcagcagttgagagatgacagtagctttgggatctcctgaaagagatgcctctgaggggatttagaggcgtcccagggaggaggcttcctaggtggcgctagtggtaaaggaccctcctgtcagggcaggaggtgtaagagatgtggattcgatccctgggttggaaagatcccctggaaaagggcatggcaacccactctagtattcttgcccggagaatcccatgaacagaggagcctagtgggctacagtcatggagtcacaaagagtcggacacgactgaagcgacttagcacgcacacacagggaggaggcaggttgtgtctcaggctctcggctgcagagaggcaggcctgggctggacttgatgtcagagccctggagccgtgcctggtactcagaaacgtgggtggtgggcagagagcagggccctagggcttccgaggtccccatggaacaggaagccgagctgggcaaggctgtgtggcccgccgtccagagggcctgtaggtgcgcttagtgggtgcagggagcagagatgctgcttctcttttgctctggaacctaaatgccccccagagcttcctgcctgccttagaaaatgatttgtcaggtcctgacaagggtgcagcatgaactccaaggcaacgccagaatttcagcagcttggaacttagggctggttggacatgtttgaggcaggggcattgtttttatccggggcatatattagggtaaaagtagataggctggatatagcctagagttcaccaggaccaccaggagtcagtttctccccgaagcatcttctccatggccctggatggggtcggggcacaatgaggttgttcctaccagaatgtcacctcttggtgagggcagcaggaagacgagacagaggaagagagaggtatctagagaaatccatggtatttctggatgtactatcctcctgggaaggcagaggctaacctacctgtgcatagctggaaaaagcaattcaggcaaatagccagtcagttaatggggaagacccagaccgagtcaaaatatttgtttttctgataatctaatcaatgcagtcaaggtgattgatgcaccttccctaaaggtctaaggaaagcaacaccctatatgatatctatgtttctggaagcttccctcagccattgtctgcaggggaagcgcagcagacacattgaaagtaaaggcagctacttttttttttttaagactacactacaacttagaaaagagagtggtagaagctgtcagagtccctgcccacctcggctcctcagactctccctagtccaggagagaaactcctggaaccgctccagccctctgcatgctcagcacagttaattctctgattacaggtctcatgcagtgatctgaacctaaaataagagtttctgatcttaaggtcaatcattgaattgactgtaatctttattaagaggaaaattagtagtaatttcatatttcaacagagattttttgaagaagaaaatatgactcataatgggttgagaagatggcaaaatctaataaaaagggaaaacttcgactactcacagtgaattttccaaatgaacagctcatacatttgcatgaaaaataaaaatgtaacaactcacaggtgaataatcataagcaggtaaatgagagggaaagtag

SEQ ID NO: 45962 - DNA, 1718 bp, Bovine  19866880879381
tctgtgctgcctggagattgcatttcccaagagacaggaagaaagcaaaggccaaacaagggctacttttgaaaaagaagggccagaccgaacagcaatagctaaaggcggttttgcaggacaatgcccaccttctcctctatgatcggaaatgaaacgagggcagggtgaaaaaggagagcgcttccacctccttacaaaatgcaattccaaccccaaatattagattagcccttggcagcctcctctccatcagtagaatggaaatctgaatccttttacaaaaacagtccacaccagaagagaaagactttcacattggaggtaagtcagccaggaagcctgtggtctttcgctgtaacaaacatctttccttgttcacttggcaaaatacttggctcagacccaggcaatcaggggaagtggttgacacgtttctagtccgataaggcatgaagggcattttacaagttgttctggggcacgctatgctttctctaacaaaatcacaaattttcagaacccaacagtctggcaaccagaaatcagccataagggacaaactgtgccctttgggcccctggatggctagggagaagaggcagattgggtgtaaaccacaggctgcccacaccctgtacctgacaagagattctgatgcttgttatgatcgtatttgaaaatcctttattgaaactgtcagtatgtgtattagtcactcagttatgcccaactctttgagatcccacagactgtagcctgccaggctctctgtccatggaattctccagacaagaatactggagtgggcagccattcctttcttcagggaatcgtcctgacccagggatcgaatgggtctcctgaattgcaggcagattctttaccacctgagccaccaaatccactgtcataggattgtggaaagcgcacccacaggactggaactccaaagatggaattccaaactagctctgcttctaaccaggtgggtaactctgcaaacaccaagttcccacctcattcatctgtttcataactgacagtgttttaaagatccagtgaaacagtatgaatgtccccaataatggtaaaagactttttgaacctatgacgttaaaagattatcactgcatttcacatattaacgtcatataactacattcatatgccctatagggtagacatgatcaattccactttcacacttgtgaaaatgctcttggagaagttggggtccaaggtcaaagagctggtaaatcacaagtttggcgtcaggcccagtttttcggatgcaggcagcccagacgtgacaagcagcgtgcagcacacagttggtgtgcaaagggcaccaatctgacctcaggagacctgagcaccaatctcccaagtccattctttcagtcactcgattttctcctttcaaaaattggggtgacattacacaccctatttacctggaaaggttattgccaggatcccaggagccaacagtgccgaagtcctctgggtaagggcagaggtgcccaagtggagatcaggaaaactagttaagagaagggacccaggatcaggaagggaagtgaggaattgcaggctcacaatcagggaaacccagcaggtggttctgcggtggaagaataagctgccgaagctgtttagaagatgaaagggtgaactaaaagaagggcctttgagtgtgttcagctattttgggt

SEQ ID NO: 45963 - DNA, 1602 bp, Bovine  19866880888463
cttctgaccttgggcacacgcaggactctgaggctcaggcctattaattttttttttttttttttaacaaaactaggattcaagcagcctcccgtgaggacaaggcaaaaggcagcacagaagttttctgctgcacagcaggtgtttgtgaacacggggcccctccctgtaccaggggacaaacccaggcagatccatctggctccaccatgtgcctctgcttgcccaggtgaatgtttttccagagcctcttaaggttctgctcattaaaacagaattgagggtggcaatctggaaatcaagtgcctccttgtgagcgccaggctcaggcggtgctgaccctgagacctcacagcaccctccccccaccgacccccatgcccccacctccaccgcaatccccactgtcacacagcccacactgaacctgcctgccgcgtggcaaatggctcagggactaggggctgtgtctcagtctctgaatatgcctggcatgtagtaggtgagacacgtgcttgctggaaatcagcatcataacgcttcaggcaggtgggctggagggatacttcctgatgaagtattcttcctgtgctcactgcactcacggtatccttttttataccaagataaatgaacctaacgttgtttcaatgatgatacagaattaatagtactctacactatctattcccacccaatcatctcaaatattcagctcaatcccccttcctcacacagcaaaactttctttcaacactaattcaacattctaaatacaaccctacatctaagacttgaaaagatgaattccacagtaaaaaacaaacaaacaaacaaacaaaaccagctgctcccatctagtgagcataatttactcactaaagcacccagtaccaggctccgtgggcttccctggtgactcagacagtaaagaatctgcctgcaatgcaggaaacccgtgttcaatccctggtttgggacaatcccctggagaagggaatggctaactattccagtattcttgcctagagaattccatggacagaggaacttagtgggctacaatccatggggtcacaaagagttggacatgacagagattaacacacaccagactctatacttacgtatcttctctctcctaatgctcacagcaagcccccatttgacagatgggaaagctgagacagagagaagccaaggtgagacagttctgccccaggtgagacagttaataagtggatcctactccttctggcctccctgtgttctgttccatctgtcaccttcctgtttgtgggggatcaggacagaggaacagagcctaattaaaaatctgccaccctgaatctcacctgttggcagtcttccatccgctgccagcaactcccacacccgagcacataacttgagaagatttagagaactttctgcagtcttgtgctaggcagatgggagtggtctgcaacccaggggcagaaacagaacttccatctccaggtataccttgtcaagcctcttccattacgaaacacctggctcatcacatttgctcctttctattccattactcatgctaatcccacacatcgtcattcccgg

SEQ ID NO: 45964 - DNA, 1591 bp, Bovine  19866880952004
ttcagtcggagccgctgtgaaaacggcgcccctgccctagccctcccttattaaaataacagctccctgaaagtgggtggagaatgttgtgtttggtcctctagcacctagcagtgggtggcgcgccctgtcgtgcacctcgagtgtctgaggagcaaagacgtaaaggtgacccccaccgatgctgagccgtctgaaggctctcacttgccagtgtcccaagtgaaggcaggctgtgaacactgattttctagaagctacggttgttggaagggaagcaaacgtcatgcacttcagcttgattctctcatttctgggtttcccaggagggagcctgaggaagcgggggccatgccggtccctggtaccctgggctgggcagcagtggtctctgctgagagcctgtgtactcagaggctccgggggcgtccattgctgcccacagggcctcgccttgtctgggtgttcacaggacgggctgtgagcctcacaagacacctcagaagctagcctccttctccatggtggctttgatccacgttaggaatttggtcacttgggtgtagacgcctggcctcttcccacactccaggccccagctcacgatcccatagatgtaggaggtgccgtccttctcacaggtcagagggcctccggagtcgccctatgggaaaagatgcaagagtccactctgtggttcagtatacactcagacacccctgccttccgtgaggggatgctggggggtgaggggtgggattgttggccagccctggggaaagtggcaacaaggttcttcctatgcctcatatgatgcagtgctccgaagggagagaagcagataccaacctgtgtcttaagtcagagagggcttggcagagaagccatggggccaggcccaggtcataccctgacttcctaacccaccatgactcagtgatgcaggtattactaaggggctctcgacttctcattccatcctgggatctagcaggggctggagggatgccctgtttggatagagcaccttccagggcctgcagggcacacactggccaggaaggatggggttcagaggcagcatggccatgatgttcagcatggtctatgggctgagatttaccagtctccaagccaggctgtccatctgctggcctgtggggcctccatttctcacactgtaaaccataggtggccacagaacccacccgagggttcttgtgaggactaaggtttgtaaggcttatgggacagtgcatggttcacattaaacccccaattagagtggagaggaggaagatggtgaggagggcaggaatgagaaggacagctcacacacacacatacacacacacgtatgtgctcccacttacacacctggtaggatatttaatgaattatttctttcaatcttagccacaatctcccaattttatggataccctagttccattttatagattagacacttaatgttggctaattatttgagggcagcagattgaatgtttgtgtcctccctgccctgctcaaattcctgtgttaaagcctaatgttttatcagaagatagggctttggggaggtaattag

SEQ ID NO: 45965 - DNA, 1692 bp, Bovine  19866880978843
cttttaatctacttttgtttgacaaaatttttcttcatagtatgtagttaaagttgtaaatcatggtctagtaattataaattctgatttatgaaatcaccagattaattagattttattttctttcctttggagagaagggaacatggtcttcatcgatattaatattgctttcatgaaatctttaactgtgttttgcttaacttttcatttaaaatattttcatttaaatgaaatgaaataaaatatttaaaatattttgtatttaaggtctcatttaaatccagagcattttagctctttctcttatgaaattggcttaggtattttgtatgtttatcctttgccaacaaaggtctatatagtcaaagctatggttttccagtagtcatgtacagatatgatagctgaaccaaaagaaagcttagtgctgaaggattgatgcttttgaactgtggtgttggagaagactctttagagtccctggggaacaaggagatcaaaccagtcaatcctaaaggaaatcaaccctgaatattaattggaaggactgatgctaaagctaaagctccaatactttgatcacctgatgcgaagagccgactcattggaaaagacaccgatgttaggagagatagaaggcaggaggagaagggtacaacaaaggatgagacgtttggatggcatcaatgcctcaatggacaggagtttgagcaaactctgggaggtgctgaaggacagggaagcctggtatactgcagtccgtcgggtcacaaggagtcggacatgactgagggactgcacaacagcgtgtttatccttaaagtttaacactaacactgttcctttttgttatttattctattcttaagggtgactttaattttcaatagctcatttgtacctaatcatgtacctaaacccttttaatattgattcttcctccctatattttacctaaatatgttgatcttcctttcacacacagactaatatgctatttctaagagaatttggtagctttttcttactatatttgcagactgcctcataatagtagctttctatgtattaactcccctcttccttcctgtcccccatcttttcttacaaataataatggttcacattttaatggaaagttttagataaattatcttcattgtttcctttaatcattatttattttgtgtaaatttcaggattagaatggctgaatacggaagaacctatttctgtctataaggatctatgtggaaaagtggtcatccttgatttcttcacctactgctgcataaactgtattcacctgttgcccgatcttcatgcgttagaacacacatactctgataaaggtatctgctctttttagttggtttctaacagactgtcctggcatagtcactggagagtggctgactcattttgctcataggagaatgaacatttggcaagactgcagtgattctgaaagtaatttctaatcttgaattaaggactctgtgtacctttttgtgaagagttaagcttagtgataatggtttgccttcctaaagaaccagcgtttagtatatgatttttctttaaaaataaggatatagtttacttttttcatgatcaagtattttaaaaatgtcattttgtacatctggacttaactaaatttgttccatgaaaaaaagagaaaataaa

SEQ ID NO: 45966 - DNA, 1045 bp, Bovine  19866880983201
tacagctattcaaagctaacgatcgaagcagacagcattttgaggaatcaattgccattttcctcctctcttgttcacagaatgaaggaaggtgttttttactcatctttcgtgtcttcctgctcttcttgcaaatggtatcctggaactgcgctacgtgtataacaagtcccagataaatacttgttggtttgattgattctttgtcttccttggtgacaatggctagattagaattgatgggatgattttccccagggtggactggaacaccatgtacactgtggtctcagtaatttgattgatgatcatatgttctacaatgattactttcaaatctcaaacctccagaatctttcaaatccaaaccagaagttgttttttctttttttttttcttaaaagcttagcattattttagctctcaccagtgcttgccaaaactgcaaaccaaacccaagtaggtgaaagttattataactcacaattctatgaaaatcaatttcagctttgctaatgtttaaaacagacaagcgtggcactcaagttttgtttgtttgtctaaaaccagagtttccatgtggtgggaaattctaactcagaaaagccaaaatatacacggctaggtctttggcaaaacacacaaaacacaaactaaaatgaacactaaatcacaatttgatattgaactaaggatggcattttgtgccattttttaacttttctgagtatttcttataaaaatatattcctagctgccgaatacacacagataaagggagatggctccaatccagcccactcagcggctgaaagtgactctgattctgaatcttctccactgggatcgtcattgacgaagcatgcagtgaatagccctgcctcgcctgaagtgccgacagcccgtgggggagagctggctctattaaaggcttcaagccacagcagtcactcgctggagaggaagaacatggactcaaagagaagcaagagccacctaccggttcagttactccacccaaatgccaaaattcaggctcaaaatc

SEQ ID NO: 45967 - DNA, 1385 bp, Bovine  19866881006762
aaatatggctataaagaagcacaagtaccaaaacccacctaagaaaagctaactgatctgatttgattctgtataaatgtcaaggcttctgagaggaaggaaggataaaattgtgattactgagcaaggggaaaatgaagagtagatatttggcaggagggtggaaagagctccagagtagtagacctgaatcagatgtgccatttttgtgaataagattccttagaaccacaaattaaaaatcaggttcagaattctgtcattttttttctagtttcagtcaaatgccccaaccctatttatatgaaatcagacttttccccctttaacttcagtagcatgtacagccatctgaattttcactttataccctaacaaagttctgtgaaaaaattttaatacatgctgtttcttttcttttcaaaaaaaaagaatttatttgcttttggtgatgttgatggagtaggaatcaatgcaaggcttcagcatccacttggagtaacttgggaccagaaaaggaatttactgtatgtggcagactcttacaatcacaaggtgagtcttgacagaattatataataccctgcttttcacttgtggtatttaaaatgctgaaagatctgtgagcctcctacaactgccactctaaactgtagggaggagtaacagtctttgacaactgtacataagcctctctattccttttttggtcctttctttgcagaaatgatgtgttagtactctgagctggggaaaggactaaacaaattcccaatgacaatagccagaaattgggaattgcaagccactaaagctgttgagtaacatcttcagtaaataaggagaaggcaggtaacagggaaattaatatgtcagttaacaaatgaacatttttgagcctttgcatagttagcaaataattcgttttcatcaacatttctgttttctttgtctattttatttttactatgcatttttaaaataaaatcattggaacataaatattagtattttgtgatgagaagcttatgaatttaacgtaattgaaacacaggaatcacagcgtctaacataagtagcaaatcctcagccagtattagatgttcctaagaaggaggtcagttcaactgtgtcccattgtgagggaaaagaagaacatgaaataattttttcaaagatttcttctagaagacagactgtaactggggatttcatagtgtttagctctcaggatgaaatatctccccttagactaatttgaatgtttggctgttcaagaaaatatggaagtgtctgttctttctctgatgtttattaagaaaactaatagcaatcaggaattctctgccttcccaattaatatgttactcttccataccacaaat

SEQ ID NO: 45968 - DNA, 1626 bp, Bovine  19866881027669
tgtctctgaaagccttatgctcagcagatgttctccaagcattgacttttgagtaaagcattgtttaaccatagtgtgtcggttgctcaatcatgtctgactctttgcgactccatggacggtagcccgccaggcttctctgtccgtgggatttcccaggcaagaatactggagtgggttgtcactcatagtgggggaaaccaaaccagaaaatgtggtccctacctactcagagctgtcaacctcactggggactaaggacttgcattcatgggacaaatagaaaattagagatgggagaatcgccaagtaatagcccctttgctttagattgggtggccaggtggtgcttctgggcaggttgaagcagagggaaagtggcccttggcctctctgccttgctgtgcttagtctcatgtctttagcggttactgtgtgaatttccaaggggccatatctaagcggctccggttccagctggctccgtctctggggttggaattctgctcttggggagatttgttccatctgagaggtcaccagtgagcagctcgagttgtttttccaggagtgcaagccgtggcagagcatctgtccactctcttcaagcccacacagctaatatggaagtgcagaaagcagccttttcttgaagaaagtgtttaagtgatgagactctgagataggtgagaaaaggcagatcttgcaaaaaaaaagatgacagactgaccttgaaggtcaggctcagcagggagcaatgcagtcactgccctggtaaatggagcacagccgtctccccctcgctggttcttggagatggagataaaacccctggagtatttatcctggagaaagttatttacatttctggctactctcctgaggtccaagcagacaggatcagtgatagcccaccgaggagggtagcctgcaaatcttctgggtgccgattgtcagtgataagaactcccacttgttcaagcgggacaaagaactgagttctgtgatgtgtaaacacaaagacttcttggttcttgtcttccacacttcccttcctcactgtctagaagggaaaagatgttagaaggaaaaaaggatattttcaagtgtatctaactttatatacactttgccgacagaggtctgcatagtcaaagctgtggtttttccagtagtcatgtatggatgtgagagttgggccataaataagggtgaatgccaaagaaatgatgctttctaattgtggtgctagagaagactcttgagagtcccatggactgcaaggagatcaaaccagtcaatcctgaaggaaatcaaccctgaatactcactggaagggctgatgctgaagctgaagctccagtactttggccacctgatgtgaagagccgactcattggaaaagaccctgatgctgggaaagattgagggcaagaagagaaggaagcaacagaggatgaaatggctggatggcatcactgactcaatggacatgagtttgaacaaactctgggagatcgtgagggacaagggtccctagtgtgctgcaatccatggggtcacagagttgaatacgactcagtgactgaacaacaattttatgtaacaagcatgaacctagaaagt

SEQ ID NO: 45969 - DNA, 714 bp, Bovine  19866881044224
ctagaatattctgaaaccggctgtgaaaatgtagggcaagtctgcagctctcagtaggtgcacgccttatttggtttagaggcattttgctatgctcttgagtcatgaaaagctattaaaagagctctatgggaaatccagtctatatttcgaacaaaacaaactgtcttttccattatcactgaccccccttacagacacacagtacataatctttttttgtgcttcactggtatttattgcacatggacaaattcctcacatagtagttagttgcaccagagtataaatacttggtaaagcacacagaggaaatagtatttacacacaagtgctaaatttcaccagcagattcacgtgtgcctttggacataaaaatataataaaaaaaaatccttaagataattttttataatatggatacagtaccatgataaaagagtataaaaaggtatttttccaataaatcgctagctcaataacataacagacaacagagatagagtctgaattttattttagtttttaagatctgccccaccccacccccattaaaaaatatttaatttctttttgtgcaaataacgtcttctgtggactttacagttcctaatactgtgcaaaaaaatgccactttgaatcacggcttttttggtttgattttttggttataccacatgtgcagtaatctgaattggttccttttttcttttt

SEQ ID NO: 45970 - DNA, 2936 bp, Bovine  19866881078539
cctcctgttgacacctccctgggtgacagctcacccctgtgagtcacagaccactagctggatggcacttgtcttggctcagtgtttggcctcattgtgggggagtaatgaggagtggtgggggctgtggcaaagggcagagctaccgctcagctctgagagatggtgatcttgatcaaatgggactcagagtagccagacagtccagttatcccaaagaaaccagaaacccatattattatataaattcttacaattttaaatgctgagaaacagttcagtattttaaaacccactgacccaagggaaacagacccagtgaaaagcttgagatggcatctcttgcttggactcactccattcttgcctgttccaacaggagctaaacaacaattacgactgaaaaatagcacttactatgtgcctgccactactgcaagtgctttacgtttatttacacattgaatcttcccaaccaccctgtggggagcactgttatccccacctcacaacatgtgaactgaggcacagagccctgaagtgacttgctcaaggtcaccagccggtgtcagaaagtaagtgttagtcactcagtcatgtttgactctttgagatgccatgaaccgtagcccatcaggctcctctgttcatggaattctccaggcaaaaatactacagcggatagctattcccttctcctcgggtatcttccccaccaggggttgaatcccggtctcccgcattgcaggaagattctttactgtctgagccaccaggaaagtccctggtatcagagctagagttcaaatcccagcagtcggcctcccaaagtggctcccagactgcatactataactgtggttttgccaatgctggtgtgcttggaactgttacctgttatcttatagatgagtcaggggttccctataaccagagctatctctgcttacagaaggagatgtattatgacaaattagaaaacaaacaaaacaaaaatcaaaaagacttataaattagcttctagaacaagatctaagaacagagtgttccaagtactagactacagaatcttttgttgggatttggagaaaagggacagcattgcttcattctatttagttaacaattcaaggagaaaagtttttttacattctgagttttggacctggggtatgtagaaaaactaggaaatatgaagtcatttcaatgtcaagtattaatgagattacactatagtagcttcctaacgcactaagtcagagggaaaattatcatctcataatagagtctaatagaattcagaattatgcatgataaaatgtcacaaaactctgttttttaaatggcacatttcttcctgataattctgcattaagtatgtagcagagcacaattactttcctctgcaggacataattaacactttccatgattaattatatctttgcaacatcacagatgcttggtcaatgattcagtctactttctgaaaggtccctttgctgagggtagagtctcattttaatgctattagtgtttttaaaatccatctgaaaggaatgctctctaattaagggcccatgcttgtttatttgatttcagggatacctgaccaactttaagactaccagacagaaagagagacctcaaatataaatggattcccaaacttcctgaaaactaaagtcctacattaagggcggtaaaaattttcacacaggagccaggaaaataaaaaaagtaaagcaggtgaaggtgatagaaagaagtgggcactgagtccccatcaactgctgcgacgcaggaactagggccacagttcctgtgtgaactcacaatttctacatatcgtttcaaaaacaagttttcttaacactgtgtggccacacccaaatacctctgcaaccctggatctggctcacgggctgccagtgcagaatctacctctgcttccaattaatgtttctaatccagtctagtttaattcatctctcagacttctccaggttgagctgactctattgcagatgcctggtttgatccactgtcttatataggcaaatgtaatagcaagtcatgttgtaacatataacatgttataacatataacatgaccctatataatagttgtaggaccctctctcatttcatttgtgttactaagcattgtttctagaattctactgtcaaagtgaaagtgttagttcctcagtcatgtccgactctatgcaaccccatggactgcagcccgccaggctcctctgtccatgggatttcccaagcaagaatactggagtgggttgccacttccttctccaggggatcttcctgacccagggattgaacccccggcctcctgcattgcaggcggattctttattgactgagctactatggaagcccactcaaagaaagaactcactcagaagcccactgtgaaagaactcactcagattttatgagatgctcttgatttctcaagttactcaggtaatgtatgcagccaaaaaaagaaacctggctttggtagccaagtttaaacttgaatttcattaaggtgaaatgagtaagtcaatgcaaccaaactttctgggaaagggagaagcaaaatgggggctctttatattctacttcccatcccctgctttttcacacatctgaaaagtccctttcatccatcaagctgtcatttgccactgactggcctttgttgtcctgtatctatgttagatgctggagatgcccagctgaacttgccactgctcctactcggagcaaaagggaaacagctgcaaagacctatctaccaacagcacagaccaagtcaactgctggagctgtgctgactccagaagaatgtgaaggaaagtagccctgagcactcaatgggcacaagttgaataacatactaaattatttttttaagattttttttt

SEQ ID NO: 45971 - DNA, 764 bp, Bovine  19866881079169
cttcagtcacaaatggaccgtcttgccctctcaactgagagggaccgctggttacatcagctatgtggcttttaggcactggttgattaattactgaaaatcttgcttggtattcttacctaatccccgcttccagcacacatccaaatcttctggttttaaaattagctatacgcatttgctcttggtacttatattattttttaacagtttagcagatagaatatatctatctttataattccttcctgtcttctttttttgtttttcctcctcaccttcttacactcagtctcactgaagagcgtagctatgccttagaaccctctctgggctccgaaatttctaaactgttcaactgttacctcttcctagggtgcattctaccactggtttaaagtttggctgcaaactgaaatcagtgtttaacagcactgattcctggttccaccctcagagatcctgaccgagctggtctgggatgctgcccaggctctgggactggaaaagatctccaggtgattctagggtgtagccacgactgaggaccatcacatctagtccctctcattagggtctttagaactctcccccacccacttgcttctacataaactccctggaattttacatttatctctttaaattcccaaagacctagcttttgcttgatgattcataacaacacccaccaaaggaaatgtcttcttacttgattttatagttctttggagcttgcaaaaccctgtccacacatttttact

SEQ ID NO: 45972 - DNA, 1590 bp, Bovine  19866881099331
caggtatgtttctaatgagcagccatgtttagaaaccaattgggactatataatgatcttttacttttatctactttgtttcacattttctattttatattcagtgctcccatttcacttagtttatgttctccaatttctccctctcttttttttctttgatgttctttcttaagtctttatcaaacgtagtagaaaagcctttgtatacacatatatacaaaaataatatgtataatatatatattttagaaaacttgtgaatttttgtttagctaaaaaaattatgaaatgtgatttcatttgtttgacttagtataaatagaatgctagatttctaattttaaaaaatagatacacaataagcaatgaagatttagtgtatagcacagggaactctagtcaatatcttataataacttataatggaaaataatatgaaagataatatatgtgtgtatgtataactgaatcactttgctgtgtacctgaaatgttgtaagccaattatacttcaataaaatatatatattaaggaaaaaaggatgttttctgcattatgatggatcaatagcaaaaaggtcacattgaaatgtcccatctcaaaacagctctgtccaaactgccaccttactcttgggcaacctaaatgtgtgagggcaggtgctagttgtcttgggataaagaatctcttgccaattgctcaggagaaacaccttaagagctgtcaacagcagggaggtaactcatgtttttttggtgccacactttctccttttcaccatccttagcgaggcttcattcaaagccaataaaaataacagctaatatttattcagcacttactgtgtgccaggcattatcttaagcactttacctacataagcttctttaattttcatgacaaccctaagagaggaagctgaagtacaaagagatcatgttattgccacaatgactttatttccccaagcaatcttggaagggaaataatgttagtcccacttttgagatgaagaacagaagcctaaggggtaaaaatgacttttcacagtgagaggcagacacctaccagagcatcgttttgagtgcacctagatgccttgcttttgtagagcagcatgtgggagccatgttttgcccccagacaccattcaccattatcatgggccagtcacagcccaacatgcttccagaagcattgtattggatttaagaaaagataaggtaagatagccccaacattgggctatcatgaagaacaatgccatcaaatgctgtaaagatgtcctaggctattgctccgatgagaggagtttcccctaaaacagattccaaggctgcctttttcttagctggtcccagcaaaggtaccctctgctggctcaagtgacaggggatctgaattgtgcaaaagcacctaagatttctgggagctacagagggaaaggggagggagggtgagcgcatgtgagtaagaaggatcatgttcctggttttaggttagctccaggactggaatgcttaactcatgtggtttttcaagattaatcataagttacaacaagctacttcccctggggtatttca

SEQ ID NO: 45973 - DNA, 1180 bp, Bovine  19866881101384
tgatatggaaacctaggaccctgagtgtctcagtcccttgctcaaggtcggctgcaaaggggcagagctgcacatggagccagctgtccatcgcatgctctctccacagcttcacatgttctctggctcagtttccctgtttctaacatttctttccactttccataccgtggtgggattggacctgaattgtccgtgactttattctaggggttgggggaggatgagcagaagtgcaggtgggtggttagggaggagtgggcagagcttggagggcagtgggaaggctggaggaagaagagatggcgattatgcatctgactccccagaaagcccagaatgagcttcgaggatcttcaaacagctcctctgaggactggggtggagcttgaggtctacaaacaggcctcccccttcccgttgcaggatgcatgttgggctcttgggaactcatccctcaaaactggcttttcaagcgtccgcccactgctctcggttcccagatttactaggatgtcattgtttaatgcttgaagacgctctccatcggctagcatatgaggagaaaccctggtgtctcagtctgaacttgagaggatgataagaattgctggggagcaggaggcagctcagctatgcctcctcttgcttttcgaaagagagacaatctcgacttgaactagggaaccactgacattttatctgtcccttgaacttctgtattttccccaagtcggggaaccctgagcctgggtcatcccaatcaatgacccccaagagctgagagtggcgagtggcaggacctagagatgagtcctgcttattaagccagtgcccataagaatggaggaccggcccttctaagaacacccctcggggctcacctgggacagtcccagcacattgctctccctcatggccctgatgcaaacggcagctttgaaataactgtcgatctgtctgcccatctaggtgaattacaagaaagactttgaacactcaaaggcgcagttccatctgccgttggacatggtaaccctggtgcatgccaagaaggctcagaccctggccagcgaccaggactacagacacccgctcccccagtacacgtccttggctgaggacctgaggctcagctgcgccaagagagctcacaagttgcagagtgaggtaaggggac

SEQ ID NO: 45974 - DNA, 1135 bp, Bovine  19866881112970
ctttcacaagccctgttagttatctatctagcattatcttaacacattttcaagccattggaaggaggatcacagacacatacagggtatgtgggactggatcaaaaaggctctgctgctgctgctgcgtcacttcagtcgtgtccgactctgtgtgaacccatggactgcagcctaccaggcttctccgtccatgggattctccaggcaagaacactggagtgggttgccatttccttctccaatgcatgaaagtggaaagtgaaagtgaagccgctcagtcgtgtccgactcttagcgaccccatggactgcagcctaccaggctcctccatccatgggattttcaggcaacagtactggagtcgggtgccattgccttcttggaatccaaaaaacacagtgttagaggaaacaaaaatatctccctctctgtggctgcagtgcaatctttttcagatgtgacagcaacattttggccacaagagggcagtaaagacaaggctaccaggaccaaatcgcaccagattccatccaggcctcagaagcaagtggagaccgtggtcgcaattgtttcttctactgatattacggccactgtcataaatcttcagctgagatgtactgcacagctgatgagaagagctaacttacgggttctctgcagtttccaacagaaactaagctaaatgggtttgtattcatgaatgtattcgtgccacctgcatttattgagcacctactgtattccaagtactgtggtgctgctgaggatgacagagaagtaaactgagaattctcctgcaggctcctaaaaggcacctgcaacctcagaggagacacttcacgtcttcctggaagggcctggggtgaatggcatctcaggaggtgacatgggcgttgggccttaaaggaagtctaggattcccccatatagagaagcctggggagagggcatctcaggcaaagggaacaggagaatgggacctgctcaagtccctggcctggaagtgaattttttttactactttccaggggttggaatttgatggttatctttatatgaagattcctgagattttcccgtctcttttggtcagggtttgtaaacacaggagtggagctacaagccccag

SEQ ID NO: 45975 - DNA, 838 bp, Bovine  19866881148033
gggacacaggttcgacccctggtccagaaggatcgctggtccagaaggttcgatccctggtccagaaggatcccacatgccacgggacaacaaagcccgtgtgcctagaacctgtgctcctcaacaagagaagcccccacaatgagaagcccgtgcaccaaacgaagagaagtccccactcgctgcaactggagaaagcccgcatgcaacaacaaagacccagcacagccataaataaattaaaaaattttaaagtagcagcaatagtgtccagctagtgtggaactctacccttccaaggcaaaggacttgctgtgcctctatttattgaatggatctggataagcatttctacagtatgtaaataatgtcagttacctacaaaaacatatggaaaaagatacctgtttggtctactcaaagtagtgagtgaaaagaaagcaaggtaaatgatttcgtctgctacccaaaggcacagcaacctgtttttctcaatggttcccgttggcagttccatgcaattggatggcccagatccatctttcttgggtgaacggaaaacacaatgtcttcttttattttagagagtgtgctgtgtgctgtacttagttgctcagtcgtgtccaactctttgtgaccccatggactgcaatttgctaggctcctctgtccatggggattctccaggcaagaatactggagtgggttgccatgccctcctccaggggatcttcccaacccaggtctctcgcattgcaggtggattctttaccgtctgagccgtcagggaagcctggtgtatgtagagagtgtacataagcttttgggcttccctaaa

SEQ ID NO: 45976 - DNA, 1206 bp, Bovine  19866881193902
agcctggtgggttatagtccatggggtcgcaaagaattgaacatgactgagggcaagcacaaacagattctttagtaaaggctattttttaccaaaccccatggacgaaatagaattttagcctggatgtaaaagcaaagtcaaagtcttcttttcaaaataaattctattttagcaacattaatttttttctaaataatgaaagtagttcatatttcttgcagacattctcaaaaaacataggaaaaatcgaaactgcctctacatttcaatccttaccgagaagtagttaacaatttggaaacctcttatttaacgactttgccaccttattttcaataacaggtcattttgcttttgtttggtaagtcaaagggcaaggcagaattatctggctgtggctggtgcttcaacagaaatggagacaaatctttgttcacatctagagagccaatcggagaaggcaatggcaacccactctagtactcttgcctggtaaattccatggacggaggagcctggtaggctgcagtccatggggtcgctaagagtcgaacacgactgagagacttcactttcacttttcactttcctgcattggagaaggaaatggcaacccactccagtgctcttgcctggagaatcccagggacgggggagcctcgtggtctgctttctatggggtcgcacagagtcggacacgactgaagcgatttagcagcagcagcagcagagagccaatagcctcctccagagacggggagccagacaggtgtgagctgaattaaagagcttctaaatgtcatctgaatgaaggtcctaacagtggatgaataagaatcacacacgtggtcctgaggtttttgttctcttggcctatggtagatgttcttttccataactgaataatttgaagacctttccagaggtaaacagtgtttttcaattgaatcagttcttctcagaaatttttagagaacagactgagtcctgttcactttcttttactaggcaaacaatttacattctattatgaaaaagaagtctgcaaacaagattactttattaaatcaccacctcctcagcttttcttctctgcggtaagtattcacaaagatttaacaggcctcccaccagcctcatgagcattttttaaatcctttctcttcctctgagatttaactgagatgcaaagtgttttcattt

SEQ ID NO: 45977 - DNA, 1330 bp, Bovine  19866881201755
cttgtattttgtgggtctggaacaggtgtctgacaaatgttttacaatgatgatggtggtgatggtttcaaagcactggatggtctggtccttttctggtttaaagatacatttttgcctacatgggttttttttgtttgttttgtttttaggccagatttgcctgggagaagcagtggaaagtggatctagagggacagaaggagactatccagcattcctcttaatcacctcagtgtgagaaagttatgcagatgagaaatcaagaattttaattggtaaacttactcatcttgagataagagagtatgtttccagccccactaagccaactttagggctgggattacagttccccagagggaatagtttagcctgtatcctccactgaactgccaagaataatgattttaggtgtaagactaaggagttctcccagaaagctgtcttcaaggtcaaggggaccatctggagctgaaatgagagctgcgctgacagggaagggctgagtgaggcggagctcactcggagataaccagcatttggtccctgggtttgagattctttcccttattcttactgccttccgtcttattttcttaaagatgaaaatgcaaagaaagtatcaggaaagcaaactgcaataacagaagctatgaaaaaagataatgtaccccaaagtaatttcattatagtaaaaaatgaagtccaccaagggtcaagaattctgtggtgttggaaagtctggaagataccaacgaccgatcttggttggtgaaaccaaaaatccaaaaggattcttgggagcaacatatagaggggctggtaaaaggtccggtcaaggcctagcagagggcttggtccagaggacctccagctatctttgctctttggtttcaggtacaggtaggcagatgaggctggaaacacccatgggattgtgttcagacaatggttcggccactctggctctctgtccatccccctgaccaagcaggccctgcttcatttacatgactatacaactcttaattataggacttaagtagtccctggtaactgacgagctcatctgtagtcaattcccctataaatgggagcctccttctcccccagcatggcagactgaggcctcatccttcctgttgtctgctgtacacagtggggtgctgctccaggatgttttgagtaagaccccctgtccaaaaataaatgatgtctctgttgctttctacaggctctttctttgttctcacggctaggcaactacaaggcttgtcggcctgtgcggtgcagtccaacacggtttttccccagtagccaaaaatca

SEQ ID NO: 45978 - DNA, 1288 bp, Bovine  19866881220942
ccagagcctaggcagaaacgggagggagagcagtcagggtgcaaggaagaggcagctctttgggaaccgggagccccatgggttctgcttggtcgggtgagtcactccccaggcctcagtatccccttctaggaaacagtctccagcatctgtccatccggttttccgagcactcttcagcgctacttgctctgtggtcactgaggaatctctggagggtgaatgtgtcctggggaggggagggaagtgagagagggaatgtgagcagcccagtaaacgtcagtttaggattgtgattcttataaataaaaccaatttcctgttgagagtggagcacggcagccttggtgggaaagaggatgccatcagctgtgcaaggaatttgtggctcaaggacttttgtgtgaacaagcctccgaagcccggagcctctctaagacgcgggattattcgctcccatttgagagacaggtccactgagatgaaagagatgaactcggaaagtcagaacccagataagagatccccgagaaatgagtttctgatgggtagagtcctgttctaataacagcaagggcttattgagaaagaagtgctcagaacagtttcaggcacttgccttatcagtgtccttttagccaggaaacgattaagccgctcagtgaaactcttctcagtcttccggcccacatgctgccccttccaggaagccttccctgagttgctgtgtgttccctcactattttaggtacagcacatcccaagtgctcagaaactgtttgttgaattaaagtcacattgtcttatcattatatgtctctatgtctgtctgccctgaaacccgttcaaaacacggatgtttctctcctccaaggatggctccctctcagccctagagcacctccaggtgacatagtaagtgtctgggacatgatgggggaatgagcgaaggaatgaattccaggcaataggagccctgggcaccaaggaaaatgaggcatgatctcaaacccagattccagacgtggagactgcaggcccacggtggcctcccttggctttctcgacttgagcctctttctgtctgttccagcacagggctgttgctgtctgctgctgcagagaaggatgctgcaggtttctgcttgtgagtatgagcctgcctgtgccccctgcagcagctcacccggcctccagggctcccgagggcacagacctggctctgcccatgctctggaccgatttctgaagggatgtttggagctgggcacgggcctgggcactctgg

SEQ ID NO: 45979 - DNA, 1351 bp, Bovine  19866881229584
catatttggttgtcacaactgggaaagagtgccgtgagcatctaatgcttagaggccagcgatgccaccaaaagccctgccaggcccaggagagccccacaacaacgaatcaaaatgtccacagggccaacgtcaagaaacgctgacctagtctttaaaagatctgctcagggatactgtcctaaaaagggaggaaagggttcctttcagaagcctgtgagtccagccagggtggctgcaagtagacagcagtgaaattcaaacagaaatgagaccctccaacaaaaaaagaaccgtgtcacatgttcgacaccacgtgaatattcaaaaactgtttacactgcctgcctcggaaagaaagaggaagaaaatgtgcgtgaagtcaccaaagggctttctgggtgcgataaatgtgtctttttatcatctctcccgtgttgcttcattaaaaaggtaagttggtgggtagcaatcgagctctgtttgattgtcattattattcataatatcatttgtcacccactttgtttttgccagggctctctgggcccctactggggtgtgtttggtatgtggttttcctctaattaccggccctagtctgggtttggaggcctttcatgtagctttgcctttttctttgccttttgagtggaaattattttaattttatacagaaatgccgcacgcctaatgcagccaggcccgctgcacgctgtcagggaatctcacctcgctaatgagttctcctgccttcttcgcctgctccacatttaatgacccggtggcgacccagcccgtccctttcatccacttcacatctgccctgtattggttctgacaaaggagaaagggggaaaaaaaaaggcaggccattgttgctgtgcagacatttaaagggctattaatggctccccaatgccaccttggtgccagctgagtcaaattagatgccacttttgtcttatccatttctgcacagtcacaggtagggctccaaaatgtaaattaatttctcccttaattggagccgacccgcggatggtggctttagccccacccgacactgctgggggtgaactggacggaggggggcccccatcagtcgcatccctcattacaggtccacggcaacctcaggaagaagcgcggccttattgtctgctttccccggtttcttgtttaaaatgacacgcaggggagaagaaaatgagaatccacaacggaacccgggtggggagctatctgagggaatttcacaagacatgcgagacttcccacggtgccaattccttcttaagaacctcagcgcagggcagcaaggggaagggatttctcatttctttctttg

SEQ ID NO: 45980 - DNA, 1269 bp, Bovine  19866881248296
tttgggtaaattccgggagctggtgatggacagggaggcctggcatgctgcaattcatggggtcacaaagagtcagatacgactgagtgactgaactgaactgaacttgaatcccccatctgggatgacagtatatcttcccggtagaaaatgctggggagaaggatatgccccattattatttcattaggacaccactgggtcttccaggagtccctgagtaaatatcatgcttctcaggtgaattagacaagacagccagggaccctgagaactcaggacaataaccagagatttccatgcatgcatctcttcttatgactaaattcctcctttccacctcttgccaattttgtccttccacagcgagggaatagaaaaagattttaaaggaagcatcaaacatgaactgttctctcaacaatgtgagtagaagattcaaacgctagtgtcagcagcaaaggtttctacctcaaaactggcgattgcggtttgcctctaaaatcagcattgacggagcagctaaggcagacaatctctttgctccttcagctcagccggtctgctcacgcagggtgaggagaaaggcatggaattagcaagacagttcagcctctgctccccccaggaacagtcagcacgctctcaatcacttgactttgcccttaattttctgctcccccttcccatgggtgggtcagctctaacatgctctagatggtagattgtaaggtcgagtgctgtgtgtattcagtcactcagtcatttctgactatctgcaacttcatggactgtaactcgccaggctactgcccatggaattctccaagcaagaatactggagcgggttgccatttcgttctccaggggatcttcctgacccagggattgaaactgcatctcttgtgtttcccacattggcaggtggattcttaccactgcactaggtgggaagcccaggttttaggatcgttttaaggtcactggattctaattccccaacttgataaggtaaattctgtgttcattttgagtgtttgtttcagctcagagataccttcttctgggacgtttctttcctgtcatattgcatgaagtctccaactgacttgatttaggaatgacccatggaccttttggagaaggcaatggcaacccactccagtactcttacctggaaaattccatggatggaggagtctggtaggctgcagtccatggggttgtgaagagtcggacacaactgagcaacttcaccttcagttttca

SEQ ID NO: 45981 - DNA, 786 bp, Bovine  19866881335432
ggacactgagaaactgagattttctcagttgaatactgctgctccaaagaaacttgagattctgtttgtaaggaagaaagggaggatagatatagagaaactagcaatatttgtctcacccgtttattgaatgcccaccgaagttaagtgaaagtcactgaatcatgtccaactctttgactcctggactgtagcccaccaggctcctctgtccatggaattctccaatcaagaatactggagtgtgtagccttttacttccctaggggatcgtcccaatccagggattgaacctaggtctcctgcagtgcaggcagattttctctaccatctgagccaccaggcaagcccaaatgcccactaggggaatgtgcttttttttatgggagccctgcaggaaggtgatgatatacccccgtttgacagaggagacagaggatgctcagagaggttaagcagtttgcctaagttcacacagctggtaaacagtagagcaatgactgagattcagatgtgctggatccaaagtctgtgagggtttttctttttcccaccagcaccaccatgcagtagccatgagccaaagattcagtctgcagccgcacagcaggaatccctagtgattcagattttgcccaaattgaaaaattggggctgggaaactcagaggatgttcttgcccttccagcctgcctctgttgtttgcctggtttcaagtcacatgctaataaccacacatatgggtttcatttctcccggagctgcccaagtagcccccaaagccac

SEQ ID NO: 45982 - DNA, 1296 bp, Bovine  19866881340717
tcaggggctggaagactcttattctgccacaaaggttctttgagttcctcccctttccctccccagctccctgtgccttcagccctgtttctcctcctccccccaccagccaaaggatgctggactagcttatcagatatttggggtctgccagctcccatgagtagtgtgaactggagtcaggaagccggaactttcaacttcctttaatgttctcccctaattggatgcaaaaaaacaaagacaatgccaggaatttgtgggcgagagtagagagctacttctctcgccttcagcgctaaatttctcaggtcctccatgagttacaaggcactttatttacctttaaagatattcctgaatgggacaggatagattgctctgcatctggagcctgttctagaaaattctgggaaagttttcttaaacatcgacaagtctgctgggtctggtagacccttgcagtctctttccccaaacaggagacaacatgtcccttctgcagacaccatcttcacaaggtaatgcgttaggctagaaatctggactctttctcccctttgcctgtcttttttttttttttcttgctaattggcagaaaattaatgaacgaaatactgattgagcagatgctcctcatggaaagaggcagaattggagttttccttgctctcttttaaaattgttttgagcacatcaagaaagtagtaacatgtggcaggtcaaaaattaagggaaggtaacagtacagattgtaaagaatacaaaggaatcgtgtgtgtgtgtgtgtgtgtgtgtgtgtatgtgtgttttctcttttgttttaacttccttgcatcttttttttcttaagttcatattcggctgtagctcataattagcagctaggcctctgggacctaattaaccaattcaattaacaaaaaaagcacacaagtcaccctgacatttgtcagccattaggagggatgtcagactgacagtttcagctgaaacattaatggtgattagctcatttgcgactcattttactccactcttttcctagagaagttgcctctaaactacactgcccagagcagtaggccagtggcttgaccttcaaaggtcaccagaaggctccctcttagctctccctctgagtcaaggggccccatcccaatcagactaagacatgtctatactgcccccaactttttgtttagtctctttggatgagcccagtattcttggctctttgttcaggcggtgagaattcagcaaagtcttctttattagggatgaagcttttaaaat

SEQ ID NO: 45983 - DNA, 1059 bp, Bovine  19866881366387
aaaaaaaaagtgctagaaggggatgccacaaaaagtccaacaaggcaaagggcagtagggtggtgatcatcccaggctcctaagaaatccgggattatacatgggaatacctaccctcaaggagacccaagagcacgaagatgaagacaggatgtccctggcaaaccctccacccaataggtcccagctctgctatgagggacacccagcaccctccgagttccttcctaaaggcccatatttgaattttagtaaatcagctcaatatgttcaaggactttgggtattaaataaaagaagtcagtgaagtctacaaacaataagctcattcaacacaatcttttttctcccccatctggggacttgaatacagttaacatgaataaatcctgttgtgtaaaaactgggagagaggaaaggggggcatggaggatggaaggaagtggcaggactcccatttgttggtctaagagaaaggctaagacagaaccccaaaaaatgccagcatgccaaggtagcccagggagacggtggtaacacttttgcagttgaggtaaggaagtatctggaatttccccacctatgcattcccagtttctctgcagaactcagactaatactcatgtttgcactcaacctagaagtgggcccttgggcagccccaaagctcgccacaagccaggcctgacaacgtatcagggaagattctctgcagatatgcacaagtatttcctgcctctttcccaccctcgttagtcctccaacatagttgagaccattaggactagactgcaattattcgattattattctgtttattattcaggaattcttcctaaataccccaagaacaggtggaacagcctctgtgggtaattagcgtcctggacacacttatgattaagaagagttgcgtgtgtgaaattctacagcgtaattcaccgttaaaagtcatctgggcccatgcggtcctcacggatgaaggttctacagccttccaacccgctgtacttaacaaaaaggagaagacacagagtcagctaccggggtcatagagcc

SEQ ID NO: 45984 - DNA, 1191 bp, Bovine  19866881406104
tcattaaactaatactcattgagcaggacttatgtttcaggcagggaactagaacagacagcaagaaagatatattctctgtataaatatatatcagatatattctctgtataaaatttagggtaaaactagaaaggaaggtatataattagtacataattaccatcttgaatgatatgaagaatttattctttcctttctatgagtctttcttcatgggaatgggaatattggtgagatgtggggttttggataacctcagcctctccttcaaggactaatccctgcctaatgcctatagaagttgagctttctctgggaggtggcccacccctccaggaatccttcaaggctaatgatgggcaggagaattcaagggtttccattcacattcctgccgctcctcttgagaaagctccatccagcttctccagccctgggctaaagaaaactggaatgtatcccagcctcattacactctctgtgtcaagggagccctccttatctgagaacacagggttggctattgggttgccatcttgggaaaaccaagaacatctctttggtttgagtttgggggataagcaaagaaagctgaacaaacacgtaagtggaaatttggcgcttgtcttatacagtagctataattttcatagccttaaaaaagtgagaaactcaagtgttctgtcattaaacatgctgtaagaggctgttgtaagtcagtgagaggcggtcagcttgctgttgggtaacagtgtttacagaagcctttacctgcctatctgtccatctacctgcctggtgaacacatctggctctgccagccactgcagagcatttctgtccacatacctgtcagattccatttttcaccagaagcttcattaagaaatagaagctgagcattcttagaggcactttaaaccactgaaaataatggagaagtcaatgcaattagccaagcccttggcagtgggatttgaatagcaaaggaactaattatgtgccccgggcacccacacgttgtactcgccacatcatcaggccacaacaaagaatgtctcaaagctgtgcatctcacagcgccagagtgagacaaaagttaccttggtgaattcctttccttccccataaagaaggctgaatcttgcaagacagagtctgctcttgtttacccactatcattcaccc

SEQ ID NO: 45985 - DNA, 1246 bp, Bovine  19866881426743
ctgttatgttgaagggtagagaaaccttcccaacatacaaaaatgtatgcagaattttattcaaaaatgtctaataaatcaaagatgcacttagagtaagaagcattacacagcccagctctttgtgaggctggagagtcaaggggcatactgtttctgtagaactggttgatggaatgggagagattgggggaaaaaacacactctctgccatagataaccactgagcagaggagatttaaaatgaaagaggatacatcgaagcctcactgaaagactaaagaaaggaaagaagcacaaatagatcagttgttgtgtgaagaccttgaggtgtttagtacataatgggttgcattgtgtttggaggttatacagttgtactgcatctcagtggttttgcatttttccaaaccttatagatcacaggagccagaactaccaacagccaaagaccagggatccctctggcaagagggaaggagctctggatttggagtccatggtgagcccttgctgaaagagaggcttctggcacctgatctagcatggctgcccactgtctcttcattcatccattcagccaacgaataaatattaacactccataccagactgtgggccagaggataaattagggcagtaaacacaacagatgcatggtcttctggagaatactgtgtgtctgagatgaatggagaatactgtgtgtctgagaagaacccacaatgaggccagatcaaacagtatctatctcaataagaatgttggctttcattctaagtgcaaaaagaaaatatccaagagttttaagcaggggcatgatgtaatctggattaggcttttctacaacggtggtgcatatgtgctcagtcgggtccaacttttatgaccccatggactgtatcccaccaggctcttctgtccgctgaattttccaggcaagaatgcttgagtgggttgccatttcctactccaggcgatcttcccaacccaggaatcaaaccctagtctagcatctcctgcagtggtggcagattctttaccactgtgccgcctgggaatccgttttctacaagacatactattatatggtggaaaatgaatttaagaggaagcaggagtgaaaacagagaaagcagtaaaggggcttttgcaagagattaggcaggagattacacatgcttagactagggtgggtggtgctagaaggctttgagatgcattctggaggtagaaacatgctgac

SEQ ID NO: 45986 - DNA, 1327 bp, Bovine  19866881439015
atgtcaacatttatttaatacaattttctggaggaaaaaaaaaaaaaatcacatgggtttttcctccactaagtccctaaaccactcactcccttttagattaaaatattactgccccctttcacattttttacactttacattccagttctacataaagaaaggtctcacaatgatcatacctagaagtatcatccaaaaacccattctgcctttgcttttaacgaccatttctcatccagtctcgagtgctgaatgtgtcctttatttcccctttcaggccaaagtgcacttttctagggaaatgggtgataactgagtaggaacaaagtaaaggagaagggcaaagggggtatgagatgaatgctgggcctctgatgattgatcaagttcaagttggtgaaagatctgcagtgtgcctgttgctttaccaagtgtaatgactttaccaagggtaacaatagcttatctttcaaggatggccaactggctaacattctgcaaataaaaattattttatcaactgggttacagccaatttgataatcatactatttattttaatcagctattcctcttgagtgctcaatttctaaagtgggttattttgcaaagactctcctaactccacctgatctggctacactggtatcagcgcttgcttcagctgacctcaagcaagttatgtggtttgtccatgtcaatctcctttaaagcagacaaatgtgacctaacagtatgaacccaaaaagcagacgtcagaaatttggagaagaattgaaggttaacattgtgctttgactcagctctgaaaaattaaactgggtgtaggtttcaggaagcacagtctccagagtctaatttttcctctgcttttgtggctctgtgggttgtcccaatgaggtacttacatcactagcgagttcgttggctttcttggcgttctgataagctggggtgatcatggccgggaagctgccctttcctctgtgctcgccatactcttctgagtaaccctgctggggcaatcgaaaattttaatcaggggacttccctggtggtctagcaattaagaatctggagacacgggttctcttcctggcctgggacgtaggctcccacatgttgcgggggcaactaagcctgtgtgtcacaactcctgaggctgagtgcagcaactcccgaagcccaagtgcaccagagactgtgctctgcaacgagagaagccaccacgatgaggagctcacgcacaacagctagagagcagcccctgccgctcactgccaacacagaaagcccttgagcagcaacaaagactcagtgcagc

SEQ ID NO: 45987 - DNA, 777 bp, Bovine  19866881443227
tgtttgccttgcatgaattaaaatgaaataaaaatattttgcagtttcctgtttgttacccttcaaccctgataaataattttctgcacaaatgctttcattggtagtcccaccgctaggggtctgttggcatggtgagaataggtaaacgaggccacaggagctgaactggcaatggtaccaacctcttgatctgtagcaaggctggtgaaaacttagatttccttaggtctctctcttttctttgacctggtgacgctaccatcttccttttgacttacatggcaaaacctgcatccctcctgaggagtttttatacaagaggagaactgccaaatcagacaaactagcgtgattatgatctccttcctcaaaataatacttcctttctaaagccaggctcagaaaatctaaaccaacacaggcctccaaactctaaccacaaccgtcttcaaaaggcatatgagatgttccagttcttagcagtctggctacagctgacagagtcaccacctgcttaagtgactgagacaggaggctcccttccagggggtgatgtggctggaacaagtttcatatacgaggcctcccagcttattggtcctgaacctcagatatttgattaaccaagacgcccctatggttactaatcgctcttaatacgaagagatgtcaacaagcctgtgagtatccagttggtctcctcctgagtttactcaccttagcctagacagggagcggggagtggggacgtgcaagtttctatcgacgggtgag

SEQ ID NO: 45988 - DNA, 817 bp, Bovine  19866881484716
ttgccttccatcccctgcttgtgtgaccaggtgttcgtgcacctcttcagaaataaagacagcacaggcattccaagccagtggaagaggtagcctactttgacacacccatcctctcacccatacccaggaaaccacttggtccctgtttatccagaatttgttcagttttacagctgaaagttccatacctagaaaacctttcagtctcagacaagtgaagtccattggtcacccaatgcccattccccctggtggccagtggctagaagtcaggggaccaaggcaatgaagacagaaaagaacctatattgattcagataataagtgaagtggccccacccctagacagccacaaagctccagtgttcattccactctggtaagactacaaaacaacctctttgcttgtatatttgaagaggttattcgccacataaatggatttgataaaacaagtaaataagtaggacatgtgctttaaagtgcaaggattaagtagctaagccttatgctaaagtcagaagagaaacaagaatcttaggtcatgtatcggagtttacgcaaacatcatctaattcttatttatttggttaacactttggggcaggagaagaaagtcaaatgttatagtttcagcatcaaaaacatatgtaaaacagttcttactcttgatggaaactgcccctttagaaggagcgtggaagaatgtctttgtgtttctgagttttcacgttcttgacttaccagatcaaggacagatgtgaatgtatttttcaacttcataacaaacagggagtattgcaacttaaagcag

SEQ ID NO: 45989 - DNA, 1137 bp, Bovine  19866881549970
ggaggagggagagggtttctgaatcgtaagacttgggtatttgatggagcagttaataagctttcaaatgcaattgctccaacgatagactggagaacagctgctccaaggagaagctgacactgttctggcaatattagagcatgatctcagcagtcatcttagcagtacccaaggaaacctggaaagtctccgtctacaccccttacacctttgtctcactttcacgttgccttcattctgaacgcacctctgtcttctgtacctgagagagttctagtcttggaccaaccacatactcaccagcccgtctcttgagcatgtcttcatttcctcttgaatgagctagaaccatctagaacatttagttctagataaatttgtcttcctagaagcattaaaatctcatgaacggtttcctaaaactcttgattttcaacatctctcaatacttagaattgttgttttcttctcgctcaacattccctggctcatagcttttattagtatcagcaagagtacactgttttcttcctgtttatgacatagaacttacctgtgatgcattttaaatgtctgaagtttggatttcttcttgagaatttcagagttgcacataattatgagtagaaaaaaatttaaactcttgtctgtacctttcctataaaaagtcttcatgttgagtttaatatttgggatgtggggctttcttaacagactttattttcctgtttatctctatttttcggttaacttatgaccttgtcagttttttggcatcctgattgcaaaagataacatgagctgttccactttcaattattttgtagattagttttcctaatcattattaggctagctgatttgagggaattgtgggtaaatttctaccagaggagctcagaaaacttgttcaagcagacagtctaaagactggctgttctggctcctctgtatttactgctgtgcccagtgaccttgggggaagttagttggtttccctgctgctcaagttcacttcccacaaagcctgactattaacctttgtttgtaaatccctttgagatgctctgatagaaaggagttcatagatttgcaaagtctatcattactaatacttcctcctgaccttctttt

SEQ ID NO: 45990 - DNA, 1996 bp, Bovine  19866881596151
cttgagcttatttccatatgtggtcatgtaggcaatactcctggccagtgggtggagtcttctatgttctctggtacacacttggggattctgttctcgtacctcatggtagcctcgctttctcaccttttgtcttctcctgtctgtctggtatagtaatgttgagctctctgaactccatctgatcgtccatgatacagcatgtcccgtggaatcctaactgactccagacatagaccaaacagactagtcccgctactgtgtgctctcctgctttgcaactttgctgggttccctaagcgctggtcccacatcctgttggagtgaagttctgtctcctaactccggacatacgggcccacggtcacaaggttgggctgcctcatgctgtcaataccatatagtgaccttagtgagactgcgtgttccttcctgctggtgtcctctgtctttcagaggcttcatcctgtgggactcatgcaaaccagaggaagaggaaagaacaagagggcagcacacacctcagctgtgcccacgtcatcgcccatggtccacactcgcgtgaatcacgtttttctctcctcagatctcacacagggctcttcgtttcccccaggcagacactgtctttgaggccttacccatggtgctcagacagatgtggatacatacaaggcacatggctcatttccctaagttgacgatgtttccttctagaacaacagaagaatgcatgtaatgtaaacaagcttcttatttctaccagagttcaagacacagagaggttttttgtcctgtagttaatttctttcggttcacagttatccacaaaacttttagtcagtactaagtcgttcacaaacacagttaccacatatgagccatggaagagtgtagtcactggtatgctggtaaagtatcagcaaccagctcttgagagggcaaaaactctgatttgtagcatttgttcatttccatggtataaatactcccatgagtgccagtttgaagccaccaatgggacatcactgaaggtggaattgggaagagacatgcaggatcacaccgttattatagtatttttaccatgcagaatcaatagttataacctcaagggcataggtatttaataaaatatagtcaaataattaggaagtggtgcattttgagtatttgttacctttgcattgaatataatttatttaattgtaagcctctataacatgacttttaaataatggctatactgaataagtgctcacaaaattcttgagaatttaacagtcagttctcacaagccagcacagcctgcttccagcactccactgggtgtaatataacgaggcaagtctactactaatctcccagcgctgtgtaagctggtgctgcagtttgtcgtgagagaaaaacggatgcatgtgaaataaaggcgtctagcataacgcctggcacacaggtgctcaataaattccgggtgaatccagaatagtctcggatggtaggagaagcaggcattagtttggtgcactgaagcaggtcagagcgttcaccttaataattctgagactgtgtgcgtattgtgtcccgctcggggtggatcaaaccctgcagttagagacccagaaggaaaaagagagagaccaaatgacatcattttacttatgcgcctcgaatggtcctcattaagttgactgcacagactataaagagggattttaagagcctggaaaagttgaaggcagacaatcccttgttcagaggatgaaatgggggtaaaccataacatatgtaccaaataatatagtctttgttttatgtaataatttattttcttctctctccttcctggatgtggaagagacctaacctcgaggtcagttctcagtacccttgaaagctgaagaaagggcaggtctgctccaacggcttctctggcaggcacacggctggagcccgctgcacagtggcagcctcgccagttaaattacgagggctg

SEQ ID NO: 45991 - DNA, 1090 bp, Bovine  19866881622807
gaggtttgcccaggagagcagatgttgtaactcgacttcatcagcttcacacctttcattgactgtgaccttgaaccaggaaattgagaacagcactgctgagctgtttgcttaataatctgggtttttatgtgtttgcctcttcctcattgcatttggaggagtgaaaggggaaaattatagtcatttcctgaaccatttgcttttttcaggacccttgaaaaatgattatatgccttacttgaaaattaaggggcttggtatacatctgtggtcttttgttttattacttacagtactatcttgagtatcctgataaggaaaaaaaataaccttaatgaatttgaactctgattgaacacacactcacttcctactttcattcacttacataaaattttacaccttttcgcagttcctgtgtgtgctgttttgccacctttttgtgcatttgacacttcggtgggttgcctgcatctgcatgctcatcactttaaatagctgtgtagtattttattctccctatcctctgtcccctgctcggccattatcccatcgtttctagtttttcactcttaaaaatggtgctgctggctgcatctttgtggaagtgtgtgggttttcccttgggaccccaagttcctagaaagtcactttttctctagggagccgtccgggaatggggaggaggcagccacgtggagcctgggcatttctgccggtcagcagagaagggggaggccagtgtgatgttcccagccccagtgtgaatggtcctatggaaaagtccagcgtgcagttcactgctgattcagtcacaggccttcagggccgggcgggactgtgccagtctcctgcccctgctgagctccgagcatgttgagtttttattatttcagggaagaaggaaactcgctgccggtcatcgcagggcgaagtgtagttctgatgcagaggggggtgctttcggatggagacatgaggtaccaccttcactcttttccttcctgttggtcttgttctgtgccttggtgtgtcccaacctggggatgccctctccttaaatcttgaaaccatgaatgaatcatcg

SEQ ID NO: 45992 - DNA, 1008 bp, Bovine  19866881653674
agcccactgtgacacctgctctggtggcctcacctttcgtcctgggtgagggtagggtccgcagggctgacccaggctgggtctgctgacacgtcctcccgtcttcccttgcagaagccaagcggccagttaacctctgcaaacccagcccatgcatgaacgagggcatctgtgtcctgcgcaacgggagctaccgctgcgagtgccagggtggctgggagggcccccactgcgagaaccgtgagtgtggcatcagctccaatgtaggggctggggtggtgttctcagtcctcctcttccccaggagtgtaccaaaggaggctctagggcatcgaaggaaggagtcagtcattggttcattcatacatgaaacattcagtgggtgcccctacatcccaggtgccatgctgggtgagaggaacagagcaggaaacaagacacggagactctctgccctcctgagggttctagtctaagacacaaccagtaagagcagcatgtagtgtattagatggtgctgagcaccgaagaattgatgcttttgaactgtggcatcagagaaggctcttcagagtcccttggactgcatggagatccacccaggccgtcctaaaggaaatcaatcctgaatattcattggaaggactgatgcttaagctgaagcttcaatcctttggccacctaacttgaagaactgactccttggaaaagaccctgatgctgggagagattgaagacaggaggagaagggaacgacagaggatgagatggttggatggcatcactgactcgatggacatgactttgagtaagctcactgtgttggtgatggacagggaagcctggtgtgctgcagtccatggggtcgcaaagagtcagacacaactgagcgactgaacggaacacactctgatgaaattctggggagactcttgggggaggagcacagtggacacagagtaaccggaacacaggcagaggatgtgggcacaggttcgagtgggtggg

SEQ ID NO: 45993 - DNA, 666 bp, Bovine  19866881935157
acgcccctaaatgggaaatgacttccttaaggttacagagcaggtctagataggagctcggccttgaaccctcactgcagcccccttgagtagagcagtgcagaggacagcgctatgctggcctgacccccagcacagcgcatccgcagtgccaaggagctcctgcgtaaggcggcttggctcccacgtcctgctttcactaacaacatagtccccagggcagcctttctaagcctctccactctaggccctgctgacctattcctcttgcctccctcgttcccccaaggtcaagtacaaatcagacttgaacctgaccagaggtattggctggacacctcctggctcctacaaagtggaaatggctcggcgggctgcagaattggccaacgcgaggggcctgggtctccaaggggcttacgtaagtagcgggctggcaggcaaggccacgggggaaaggcgaactcaattgtttcttttcaaactttatttttggccaaaggttagctggctctaaagatgcgtgcaatgcagctcaggcaaggtgcctaatttcatgggtctgagatgaccaggcggatgacacctgggttaacttcctgcggggttttctctgaagtcacagccattagttcttcggaggcgagcgtgccggggctacatcaa

SEQ ID NO: 45994 - DNA, 1339 bp, Bovine  19866880450839
tgcaaactctatttcagatttctaaaattataaattctgaagttttttgagatatgcagccacttgattggtgggtgctaatctgaaaacaaaaaatactgaagcatagctccttaggtaatcacattccatgagatcacatttcattctgaaccctactcctctggagtagctcactttcagacatggatttttcctgttatttcccaaagtagtttcactaaaacccagaggaaaaaatctacctgataaggtctaaaccctggcgaagggcaaggcaacccactccagtattcttgcctggagaatcctcatgaatagggaaggctagtggctacagtccatggggtcacaaagagtcagacattactgaagcaacttaagagggactcttaaagattattttctcagaaacaaactagaagaggacatttgcaacaagaaaaaaacacatggtctgtgcattctagtcttgggctatagggattcatacagtaccttgagatgtgtacacatgtatgtgaaggcacaatttggatcaagctaaaatctgtgaggatttcctgaaagcagggcaaaatagtaaattctttgctctctctgtctcctggatctcgagttatgccaaaagttttccagaacatcaactaatgtttaagtctgttctttcttaaaggttgagatttgtgccatcttggcatggttcaggattatagacaggatacaaaagcacatttttatgtgaaactaacaatgatcaaaaatgcaccaaatcctaaacaataggaataaaaagaaatgtaacatctgcccttggaggttcacagcccagggaaagggcagcaccggaacctgataaatgtagataaaacaaccaaacatggcaagtcctcttggttgatgaactgggctttaaaaataataatatttataaaaaggccaactgaaactagtttttctttaataaattggatatcccacccgaagccaatgtatgccatttaaattcaaataattactattctccagatcttttttttttcactcctctatagaaattgttcagcactctggttttcctgaggtcattttttcatcttaatgtaatgcttggcaattccatttctctctcccctaagattaaccataaagatacagtggctggtgtgtgaaatatatctttggagattaaattagtacttcttgtgaaaacaaactttggaactggtcttgctgctgctgctgctgctgctgcgtcgcttcagtcgtgtccgactctgtgcgaccccatagacagcccaccaggcttcccatcccggggattctccaggcaagaaca

SEQ ID NO: 45995 - DNA, 2005 bp, Bovine  19866880514397
ccagtggtggtgcaggacgccctggacccgcacggctgagaatcctgagtagggtccaggggaggagccttggagtaagtaggtccccctggtgggtttgagagactcgcctactaagatttacaaagagctttacgtcttttaagtctggatgtattgggagttgagagttgattctgagtgatgccttagttaactaagtttactattaggttttaaagacggaattgcttccgtttgctgacccttttgattaccagcaggcctatagcctctggttttctaagtcagatttgtcttgttcccgacatgtatcaggaatatgatcaggctgccagtatattagacgtaggggttatatttgagtaaagttgatgtgttttcagggatatgcattaggtactaggtctcgcctaggttaggttgtgtatgtgtaaattaaaattcgtgaactcttctttgtcagtgttgctttaagtcttttcttttttttaagtcttgtccgatagggtgagatactggaagaagagaagagggtgagaataagcagttttaaaatctgtgatctttactcatattatcacctaagttacaactactgtggttaccaaaaataacccagtcctaaaatcacagtattaaatcatattccataatcagtaatctgaagtgtcccccttcctttgagttccgttgaggtgtgaaattttttttgagataattacatttaggaacattagaaagctgaactgttagtgtgaacttaaagatttgaaactgagggctaacagaaaacccaacttctgtggcctgtcgtaactgcttgtccaagcagaagtaaattgcttaaaaaaaaaaaaaaaaaaactcaagcactaggaggtttgaaactgcagtgcatacttttacattcctgagaggatcagtgaagatagcaaactttcaaaatgcctcccttgttttgatttcaaagaaaatataagctcctatgtgtcttactgatttgataaaaggatttattattttgtttgctgcagtgaagcctcggactctgtttattagcttgactgtattcaggagtagttaaaggagttattttggacagtaaccgtggttttgcttaaattgatcaaggaagtcttgatttgaaaacagtagctctgtactttgcactggaaaaaaattgctttgtttcctttaccttatctttgacagatgagatatttcactttagaatctgctctcttttataaagttgacagcctgtgagttgttaggtacagagaatgaaatatagtacattttctttttttatagtgtctgattattgacaattttaaaaagctagatttacacacacacacacacacacacacacacacacagtaggaacgggcaaattgttcaaaaatataaaatgaaaagtgttccccatccagtcttcccaacctcaagagttaactattattgatagttcatttcttgttcttctggagattgcctttatttcttattttaaagttttatacttccgttgtgtgatttatcagctttagatggtatgtagcgattccttcctctgaaagatgataaactgggtacaccctaccctctgcttccttgctcccctgtgcctctcatactttacttgttaaactacttgtttttagttcaccggtttacttttctgactcttgatgttaaatttaggtagttttcaatgattccaactatgaaacatgaaaatagtgcttcttccttttttctcctgtttttattagtttgacaactgcaaataggcctcgtgcttaattgctcagttgtattggactctttggatagtccaaagagcccatggatagtagcctaccagactcctctgtccatggaattttccaggcaagactactgtttgccatttccctctccaggggatctttcctacccagggatcgaaccagagacttctgccttgacaggctgatgttttaccactgataccata

SEQ ID NO: 45996 - DNA, 1880 bp, Bovine  19866880518681
caaagcttatttcaaatgtaaaaggaatagaaggaactatataaatgtaagattgagattctccatcactgtgcttgaggagataaatgtgtacagcagcagataaaagtctaggttttttaaataaaaagtttataatctaaggtgtatctttattgaaaatatgaacattgattttgaggggtgcagctactatgaaagcctctaagttcaaaaaaaggttcattttaaaaaatcaaagttgtacaccacactcttggagagttggtttacctcttgaagggaagtaaggaaaatttttaaactttcattttttccactttagggcaaaaaggaaataacatatttccaggaaaaaacatagaaacatacaaaaaaagttaattcaaatattcaacctatttgaattcattccctggattagcaaaaaaaaaaacctagaaaagcatctgctgtatagatgttgaatgaaggaacaaatgtgctaatacccactcacctgggatgtaaaaatgaatgtgtctgagagacatgatcaccttcctgttttataactggataccatgactgcaattccattcctggtggtgtatctatctgtagaaaatgtagaagtggaaaagtttattgaaggaagatatgatggttaatcttaggtgtgtattcaacagagccgtaggctgcctctggagaacactgactagtaaagaattatgtaattcaagaatcatctttgaatagggcagtctttctttaaaataccaggtctagtcacttaaaactcaaagagacattaactacctcatcacaagaacagcttcagcatgtatattaacatggactaccagaaatgatttcatcaaatatcatacttatggaatctgtgttaaaaatccattttaaataacagtactctgcaaatgtacagtatttcttagcatactacattagataacatcctacagcaatactttgccgaatttcgaaaccactttgtctgctaacacttatcagtaaaccacattttatcataaataggaaaagctctttttagccttgtacttgtaaataaaggaaaaggagagggtaactggctttcctcaaagttcatgataagaactttatatcctgctgaattctaacaaatagcttattaagttaggtacaattatctccgctttacagatcagaaaactgaggctcagaaactgagaaaaaacaaataacctgtggttactaacttcctcatttggtttgttttacacgtctcccctccccctacatacacatattgggagatcaacattttgttaagaattattgggcaaagaatttaaaagactaacaaggccataagattatagggaaaagaataatattttgaaaggatttaagaggtgagtattcagtgagggcctctagactctatatacagagtagaatttgttttaaaacttcacaatcctggtcaagtgttctaaagaagttcaggatctggggcaaaatcaactgcttatttataaaatacaacaatcatttgtttacataatttctcagcctatagcttagttctaccataaattagaaggggaactgactaatggcaacagaaatactaaatgatagatgccaggtgccagctgacagcctaaagagagagaagaattacaagacacaaacacaaaaactgattcaaaaagcaagacaatcagagggctttctcatacacaggctaggaaaaataatatatctcaactgttccctatccttattccaacagagtgtctaatgtttaaagaagtcttgagtcaatatgacatagttatagtcaatatttatactcataagtagtataccatatatatacatattcatacata

SEQ ID NO: 45997 - DNA, 976 bp, Bovine  19866880658120
atgtaatctttttaaaaagtaatttggcaatatatatcaagagctttaaaaactttaaaccctttgacctaattcctcttctaggaatctatctaaaggtaatactcaggaactcagaccaagatggtcactatcacagtgggaagcagtgcagtgcagtgcaaagagcacaggccttagtcagacttgggtttgaatcctggctctgtcaactcacagctgcataaccttgcttaacctctctgagcctcggtttcctcgcctgtaaaatgaggtttgtaagactgctgttgagaattagagacaatacgtgtcagcaaaggagaaaatggcaagtactgtttttataactgtataattcaaatgtcctgtaactggatgattagataaaatcagataatctgatcatggaacactgtgtagttattaaaaaatgggactatcaaagcactttaaaaaatatttcagtctacagaaatacttactcatcatcaggagtgagctggacaggttcattagtaaactgagaatcaaagttgtccaaaccaaattccccagaaatatttggtttaaacggaggtaccacctgcttttgctccatctagaagagacataatgggtgacagctcaagcccacattcttagaaaaattccacctctgtgcttctcctctgtccttaggtatttcccagtcttattaaagtgagtccctgggcctggttctacaatattcatatgaaggaaataatgacaaatctgaacactgatgcaggccccaatactactacaacctgctccattaaattaatattctaagctttcacagttttaaatgctttttaaaaagcacttagaattttgttgttttttgtcatttaaagtgattttaaaacaacaaaattctgtaaagcaattatccttcaattaaaaaataaatttttaaaaaggcactttagagagggttttaagttatgta

SEQ ID NO: 45998 - DNA, 1307 bp, Bovine  19866880658704
tcattaaaacacggtctaagacttaggaagaaacaccaataaattcaccaaacacgaagagagctaacaacgaagtggtggggtgggcgagatctgaagacctgactcttcctgagtgggtgccgctcccactcaaacgttcttctctgaccttgagccccacctttcccattgcagctttctggaaaacatctaagccctttcttggcaaaggttcccacaaaccagtctcaggaaatacctgatgaaacacttggcccccaaagagttcttatctcttaaagatacatactgaaatatttatagatgaaatgttaccaggttgggggtttgcttctgaacagaggtgtaggaggaggtgggtgggtagggatgaaacaagtgtggccgtgagttaatcattgttgaaggtgggtgatgggaacatgggggttcatgatactcttctatttttttttcatgtttaaaattttccataataagaaaagttaagaggagaaaaggcccacaatttaccttatgtcattgaaacaaacaacttttggatatattttactgtctaaataattgcctagatttaaaaaataaataaacacaggcaaatgaatatttgacaaacattttgtacagcgtctgaagtcacagaagggaagagaaagtactagacatctcgcctgctgcttgtaacagttaacaatcctgtcccccagggaagaaacacatcaaactctggaacattattccagtaattgaattcaaagggctaaagatatcatctgggaaaagatagtttaacttgattaagagataattgcagttctttatgacggagttgatgaactggcttgacctgtatcagaattttttatacattaatttccaagcaacatattagcattgtaatccctccgaatcatgaaactgtacaagtctgagaaaaacaactgtgatttggatagaactgtctttggaacatctccacctgccttttcagcacttctgtgaggcagtatcatatactggaaagtccacaggctctggagccaaaaaagttgacttagcttccatcccacacctgctgtgactttgggcaagttatacaagctcctgggacctcagtttcctcatctataaaatgggcctaataacctctacttaggatgggtgctgtgaggattatggataatgtgtgtaaaacacctctctcatcacagatactcagttaatggaggcttattgtatttgtacctgcagattcctctttagcccactccacatctcccaatatagtgcctaacacatagaat

SEQ ID NO: 45999 - DNA, 1400 bp, Bovine  19866880710448
gaactgtggtgttggagaagactcctgagtagtcccttggactgcaagtgagatccaaccagtccattctgaaggagatcagccctgggatttctttggaaggaatgatgctaaagctgaaactccagtactttggccacctcatgcgaagagttgactcattggaaaagactctgatgctgggagggattgggggcaagaggaggaggggacgacagaggatgagatggctggatggcatcaatgactcgatggacgtgagtctgagtgaactccaggagttggtgatggacggggaggcctggcgtgctgcaattcatggggtcgcaaagagttggacacgactaagtgactgaactgaactgaaccctttaaatattttttttttcaattatacctcaataagctgagataaaaaaggcatgagggcaaacctctcagaggatttaatgtcacacttccaaacttgattaaacaaagccacctggaaactctctttctctcagaggctgttattctttaactccctcaaaagcaaggctttgtggtgctaaatgcagaatgacatttatccaactgagtagcaccagccctgagggtcaaaggctttcttggaaaagccagtgtttaccccaaccactggagactggatgtggtttgtggcaccttttggagttctagattgttgagtgctcttcatccctcatcccttcagggacagtctggtcaatcacgacacagacttcagacgggtccctccctcaccaccgcctaacagctcaatcttccaaagagcctcagtgctttcattctctgcccacaaagacatcaaaaactaggagactcagatacctcctggatgcaggagacgcagcacgcatcacttagtttgtggaagtggagagctggagatggagccgcgatgaggaccatccaccatggatggggaagccagggctgggcttctggagaaagtaacccggagccgagtctggagctgacagtcaagtgtgtggatgtggtcagcatcgcaggagggtcaggcaggacacacctgcagcccccgaaagaagacattcatggaaagccttgtgtgttgtgatgggagcttgaacttcatcctgcaggcagtcaagcagcaggagagggttttaactaaggcagtaatgtggacaactgttagtaatagctaacatttcttgaatgaatgttttttatatgccaggcattgtcttaagtactttgcatgtgatggagtcacttaacccttaaaacagcccttaggacacctaccactattatccccatttcccagctgaggaagttgaggcatggagtgcctccacagtcacaaagctcctaagtatggagctgcgattggaacctaggaagtttggttc

SEQ ID NO: 46000 - DNA, 625 bp, Bovine  19866880716143
gctcgtggtaaagaatctgcctgccatgcaggagatgcaggttccatacctgggtcaggaagacccccctggaggagggcatggcaacccactccagtattcttgcctgaataatcccatggacagaggagcctggctgcagtctatgggatttcaaaaaagttggacatgacttagcaactaaatagaaaacaacagcaacacccctctgaatcagatattctttttattccaattttacagataaggcaacagacacagtaaggtagtcagagaataaaacctacacatgtagtgatcaaaattgttcagagtagaggctctgagtaggaaggaaaggacaggactgggaaggtacacaagatgtttagacagtgtttgtaatgtctgttgttttctgctggaatgccttaaatatcttatagtagaaatataaagatgaaaaccctgtaaaagttaattataataatgctgtaaattttatctttctagttattttggaaaaacaaattcgcataccgcgttctttatctgtaaaagctgcaagtgtcctgaagagcttcctcaacaaggtataaattgtatataaaatcgttagtgatttatctctatacaaatggcactg

SEQ ID NO: 46001 - DNA, 1768 bp, Bovine  19866880752142
gtccagtggttaggatgcctgcactttcaatgccaaggacccaagttcaatctctggttggggaactaagatctcacaagaggtaagaagaaaggtgtggtcaaaacaaatttttttaattaaaaaaaaaaaaaaatctgaactgtatatacaattatagtcctgatcatatgaaaatatatattaaaatacattttgtggtattactatttgctctgtacattttccaaattttcagtgaaaaaacaatacatattacatagaacagttacacacatttagtcttcacaataaccctaagagcaaagtatcatctccatttgctgtatgagcaaatgaatttcaaaaaggttgagtggcctgacaaaggttacacattcagtatatggcagagccaggatccaatctctgagaccagggagaaaagactgtttctccactcactgtatcagaggttcttagatccaagtttggttcttagatcctacacacagtaaactgcaaacaagggcaactggctacagtcaactatcactgtgccatcataatgccctacctgtgaatttgaaaaatcagatgcttcaatgggcttcaaaatacataattttgttttctcgtgtctttttttggggctttgattttggccacttgtcttggtatatttcctaaggaaaaatgttcatttctagacacaacatgtaatgtagctagcagagctataatgtataactagtctcaaatcaaattacttttagtgataggatacagcatctcaattctgatgtgtacattttgaagcatttttaaaatctgattgaagcctgagatttaaaaaataatgagaaaatctatttgctaattaaaaaccatcaactggataacttcagatgtataagatcattgggaagttactattttctgtatccaagttaaagttctcaagtatcacattatacaagaaacacctttataaaagaaaataatacagttctggtgtcatttcgatccccttaaaggggaaaaagtgaaagcttccttcagagtgaacatttaattgccttctctaaaaattataaaactaatatccttataccctgaaactgtttgcttccatcttatacatctaaatagctagcataaaattctagaactatagatatatatggaaatatataaaggatagacaaaaagaaattgtctttttttttttttttttttatcccatggtctgtggtcctccaggctcctctgtccatgggatttcccaggcaagaatactggagtggactgccatttccctctccagggagattaataacttttgaagtaagttttttattagagaaaatacattagagaccaatagatcatacattttaaaattatgctacgtgaataattttgaaaatgcaaatttgcttgctacttacaggaaatggctccaatccctcctgaatcacaaaaccttcaataacatgggtcaagatctgtggcttaacaatagcctgtggaggtttgttttcaacactaggtacactactgggcatagatgtactattacttcttgtggtagcagcttggaagtaagagcggaggtggaggaacagaaacatgtgaaggatctgaaggagatttaattactgaagcactgactgatgccactgcaggtaattctacttgctctggggaaaaaaaaaaaaaaagtcactttttaaatctgtaccattctgcccaggcaaatatgaaagaaaactggagaacattaata

SEQ ID NO: 46002 - DNA, 1960 bp, Bovine  19866880754427
tactttatgaagctctctctctatatagatataaatatatgtcctcctctctggttttcttttctgttctattttgtttttaacaaatcataatataatggaccctcttctactttttaaagagaataaatttaatggtgtatcttgggagtggttccatataggacatactaatccacatcattctctgtaacttctttcgttgcgtttattttaaatgtgttgtcctgcctgcttcctccctgattaacccacacactttcatatgatagccacatggagcatgaataggaaatataattctaaagaggttcattcttgctgctgtttcctgatatgaatatttgagtgaaggatttaatcaggcactaaagccacaggcaataaacagaagggtatggtttttaggcagttcgaataagcaggaatagtcacagcaagacatttttcagatagacctcgtgtgtttctagtcagtactgtaactacagctacccaccagcaatcacatttatatttggtgtttctctgactttataatacaattaatattgcaccaagaaataataatttttttaaagaattgtgcataaattcactatgctagaaaaccaaggtgttcctccttgttccctgcagtacttgttcatttgtgtaatagttttaattactaatcagagcaattatgtattctgcttttgtctcttacagtgaatcataaacattgccatttgttactgtagtgctatttgtttacataataattttgcatggttggataataatctatccggttgatgtattgtttcctctaattaaaaaacggacaactgtattatctgagctataattaaataaagcttacaagaagtcaatctgacacatattaatgatatatatacatgttatgaacggcagtgtaattgactataaaatggagagcagctcacataaatcataatacatcatattctataccctatgaaatcagaatgttttaggggaggagtgatggaaaaggaaactattgagatgccctcctaaaaaggaactgacatttctattcctttaagagttagtttcaggaaatgaggctgcatttttttccccttttctgcatctggatctctgcttgcacagagatggagggagaaaaaattgtgtgcctcaaatcagattagattaattagattgatttcctaacaactagctggcaagtgtgaatcactaatggtcttctttaattcattaacttatccaataaatatttattgagcatctatcatatgctgggtgtgaaatacatagggaagaagataacctctgctcccttactgtttacagtctagataaggtgtagaaccataactaactaaataataaaataattgcaagtttcaataaacgctaagaaagaaacagggcacaatcacagatagaaatgaaggtgggcatcctttagacaagtgatcagagaaggtctatctaagttgtataaacactgaaacttggagaagaaagcgtcagctatacaaagagtaggggaaaggaggaacagtggggcagaggctctaaggtgtggtcaaagctgccagatcgacatggccagtgggagtgcagtgcgtcaggcaaaaggaagtgtgggcctgggtgaggtggagaggcacgtaagggtccccgggcgcacagtccaggacaccatggtatgaaactggatttcattataaacacatgggaagctagatgaaacttaagcaggttcacagaataatacaaaccatagttcaaaaataacttttgacccctgcatggaaaatagactggggggtgggaaagagtggtagtcaagagagtaattaagagatggctggtgtcgcccccatgagaggtgaccgtggctggcacctgagtggcgacagcgatggtgggcactgatggtgggtgtccatcagacacaagg

SEQ ID NO: 46003 - DNA, 1424 bp, Bovine  19866880775655
tagtcaactctttgtgatgtacaaaaaggacgtggtttagaccacagaatatgggaagcccagtttctgaaatatttttaaaagttgaaatgtaagctaacttctgaaaacagatctgtgatacagcataaaaagcaacaacacttaaactgctcaagactatggatccataatttctttaaacatccactgtagttttattctagaaagagacgatcaaagaatgacttctaaagttcttccaggatctcaataaattagagtgtaaaaactttgggagttactatgtcaaattcctaaggaagacaaaaatcaaacttgttttttaagaaaacacactgtaaaggaaagtacaaaggaatgacaacaaggtaatgaaatgagtcattacactgaagggagatgtgtgtttgtttcaagttttaaagagttccttaggtttggtctcctaaggctcccaaaaatgttatatgaaatactgcctaatgtattacaattatattaatcatattaagtggattctacatgacataaaaaatttgaggggcaggatggcagaatgaaaagaacaggtttgggatgaaaatatctggagatacaacccaggtctacagtgtaccagttacgtgacggctgagtttcagcctctccttctatacccctgcccacctctgaggcttgttgacctttaacacattaaagtgtatggtaactacgtaaacagtttcacggttaacccttaaacaaaagaaagaacatttaagacatcttacttctggaaattattatttgaatacattacaaaactgcaagaagatgacttaggttctgctgggcactcgattcttaaattgtatgctaaaattttgctgtgcaacactgatatgatcacagtttaatatccaggaaggcatacgcaaataagaaatttcccaagattataggaagagtaagaaatgactactccttaccatgaatcaacagttcagaatccttgtttagctcataaagcctaaaggcttcttctaactccaactgagatgatactgtacacgggtctcctaaaaaatataaaaaggaaaagtaaagctcatattttaaatcctctaaatgtgattagtaaataatttctactatataaaatcttgaggagaaacaattacatacacacagagaaatatttaacaaggacaactgtttagatatttatttagataattctattctctgaagcaggtaatgtaacttccactctaatttctacaaaatattaaatgaggctcatagatacaaactttatatatatataaccatttaattcttaacaatatttatattcaaaatatagcaaatcgaatctaccctaatcacattttagattgtcactgcaatatgattaatggccagggataatttacttgttt

SEQ ID NO: 46004 - DNA, 1120 bp, Bovine  19866880793759
cattataactcactaataaattcaatctttaagttttttaaagatgttttaaaaagaaagaccactgaatccattgacaagaaaagagttacaaagaaccagctaaaaagtatctttattttcttgtaaaaatctcataaataatgggaaactgaattcccagctctggattggagtgagatgggtttctgcatacaacctccggatctgcttcgttctcttcttgctttccttattcctttgatacttgtccaggacacctggacagaagtagcatagccagcactaactaggagatttttgtggttccaccacatgactcaacatcccaaacatagtaaggattcctaaaagaccactggggaagcaattagcagatgggctccagtctaacactatggaaacagaattgaaagtcaaatatgtgctaaaacacaatgcttggagcatgtattgtacatttaaagaacatgggtagcaaccatgattcagtggtaattgagtatggtttctatggcaatatgattcatttccagtagaattcgtcaacctaaaatagtaggtttcccctcattaagagaaacaaataaaaagggcatcaatatttgtttttccattattcaaagattacaatgtttgcttatggcaaagagacgataagtcacatcacagaaccaacatgaaataaggccaccattgtttttctggaactaaatggatgctcattgctcttggggagctgcaacgaaggacaccaggggcttggatgtgtcaagtcaaggctgcaggttgctgcagtgcctgcaagtgtcctggaatacccgtgagttcacactggctttccttacgtgcaaacagaatttcaagagatagaaggattttctccaggaaggagcattcagccttgaacacagcaagggaggtgtagaactggaagaaaacaataggaatgaaagctaacgcttcccgtcttcctccctgtcagacaccactccaggcgcctcctacaaaccatctcagtgtcttttcccagcaaccccacggggtaggtactactactatccctgaattccaggtgtgaaggccaatgcacaagccattcagcgtcttgcccaggggt

SEQ ID NO: 46005 - DNA, 1340 bp, Bovine  19866880795909
tcaaaagcatcaattcttcagtgctcagcttttttcacagtccaactctcacatccatacatgaccactggaaaaactatagccttgactagacggacctttgttggcaaagtaatgtctctgcttttcaatatactatctaggttaataatcctcaaatcaatatttatgcatttgttgacattttttcttacattctctaatgatctgtttcttatttaagtattaatcataaaaaatacttagcacaacaaaaaagctttaaaattccctattgtgataagcactaggatcaacaaacatggctggatatataaacaagccatcagtaaagatgacttgtgtgtacttctgaaaagctggcattgatcaatgttaacttgttagtggactttggtcatggcatgttcactccagctgccatagtatttgtgatggaaactcacccagaagcaaatgtagcagcatcaatttcagctgattagattgttgccttaaatatgcaccagcaagagctggagagcaatgtattcagacttaagcaatgggaagtcaagagatgcatgatctgtgtcatatggcaaaactgatgtgattgttgaggtagagaagacatactgtgacccttaccatgacaccaggctttagaggagaatgcatcatggctttctctgaaagcagaaaaatgaagccttaattatagttactgtagtgagtaactaaatgtgaaaatatcactcagttcagttcagtcactcagtcgtgtctgactctttgcgaccctatgaactgcagcacaccaggcctccctgtctaccatcaccaatgcctggagtccacccaaacccatgtccattgagtaggtgataccatccaaccatctcatcctctgtcgtccccttttcctcctgccttcaaactttcctagcatcagggtcttttccaatgagtcagctcttcccatcaggtggccaaagtattggagtttcagcttcaaatcagtccttccaatgaacacccaggactgatctcctttaggatggactggttggatctccttgcagtccaagggattctcaagagtcttctccaacaccaacagttcaaaagcatcaattcttcagcgctcagatctctttatagtccaactctcacatccatacatgaccactggaaaaaccatagccttgaccagacagaccgttgttgacaaagtaatgtctctgctttttaatatgctgtctaggttggtcataacttacttctggaaagttaagtttccagaagtaagcatcttttaatttcatggctgcaatcaccatctgcggtgattttggagc

SEQ ID NO: 46006 - DNA, 1360 bp, Bovine  19866880799201
aaaatactcctagctgaacccaaacctaagtgtttcactattccttcagagccctacctactccttatatttccccaccttcctattaagttgttattgttgttcagtcactaagtcgtgtgcgactctttgcaaccccatggactgtagcccaccaggcgcctctgtccatggggttttccaggcaagaatactggagtgggttgccatttccttctccagtctataaagtacacagccacaactctatatagaaacacctagttctttaatttttcctttttaccaagttgcataaagagttacagaattaaaagtttagagctatttcacttaatagaaaacaaaacatttaccactattccttctaaagtcatggatatgtgcagaaaccacaaataaaaatgggttctttaatatctataacctataaattataccatatatcaaaagtaataacgtgataaaaatcactgcagatggtgattgcagccatgaaattaaaagacgcttactccttggaaggaaagttatgaccaacctagatagcatatttaaaagcagagacattactttgtcaacaaaggtccgtctagtcaaggttatggtttttccagtggtcatgtatggatgtgagagttggactataaagaaagctgagcatcgaagaattgatgcttttgaactgtggtgttggagaatactcttgagagtcccttggactgcaaggagatccgaccagtctatcctaagggaaatcggtcctgggcgttcattggaaggactgatgttgaagctgaaactcccaatattttggccatctgatgcaaagacctgactcatttgaaaagaccctgatgttgggaaagattgaaggcaggaggagaaggggacgacagaggatgagatggttggatggcatcactgactcaatggacatgagtttaggtaaactccgggagttggtgatgaacagggaagcctggcgtgctgcggttcatggggtcccaaagagttggacacaactgagcgactgaactgaacctgataacgtaagcttgcattttcaaattccatcagactgaagagttgtctgactctttcagctcatctcattaatgttaagcagtggattagatattcaaaagaaagtcccatagcagtccctaaggattcatgataaagcatttagaggtaaagtgtcatgtcaactacttactctaaaatgatacagcaaaaaaataaaaataagtgtttgttgtgtatatacatgtatgtatatgtgtgcacagatacagagataaagcaaacatagaaaatgttaataactggtgaatctaggtaaaggatatatgggtat

SEQ ID NO: 46007 - DNA, 2257 bp, Bovine  19866880836468
ccaaagcaagaacacagtacaggaagactaataatctataatggcaaaagagatatctgttaagcaaacagaatgggcaatttgaaatgaagggaagtaaggccattttgaaaggccattttgttcagtttaagaaaattcttaagtttaatcttgctggaactagagaatgttaagaaaacactgaatgagagagtaaaaaagaaaacttgctgttcagttgctaagtcgtgtctgactatttgtgaccccattgattgtagcgcttcaggcttccctgtccttcactatctcccggagtttgctcaaactcatatccattgagtcagtgatgccatccaaccatctcatcctctgccgccccttttctcctcctgccctcgatccttcccagcatcagggtcttttctgatgactcttcacatcagggtggtccaagtactggagcttcagctgaagtcaacccacaaaaaggagggggaagagatggcattcttcctaaagcactttccctagaaaggaagagttgaagtgggaggtgcagaggcgtttgctgggcggtgagaagtgagaatgtgtttccttcccctcaatcaaagactttaccgtgtcccaggcttgagagtaagagacatcgcacacataaataagcagatggctctttcttcagttctgaatcatccaatttgtccccagttttcagaagtcacttggcaaaaggcatcatcatgaagccattaactaatgattgcaaattcaccaagcctagaagcctaatttatacacaggaaactatttggacttttaaagtaattttctcctgttaagaaaaggggcatcaagcctttcttggcataaaaacaaaacaaacacagactcaaaaaatcaagggggaagcactggcattagaaaatgaaggaaatttgccagactaatctcgcagcttagcttgtttgcaaggccagtttctagtcaaaaagtaggataataagagttgtaaacagaatgttaaaatgtgatttatgactggactgtgtcatatcactcaaggtgatccattttaacttagctttaaatatcaaagcaaagttctcagtgttggctttttttgtttgttttttaatgaactataaggaggtccttattggaatttatttgctgctcagctgcttgcagttttttggagaagtgtttcattacaagctctatggctataagattagtaaaactcatctctcctggaccttgaatgctgagctaaggggattaagctttaagccacaagcgctgggagccaccaaaggttttagtatggtgaaagttatgaccagaagagtaagagaaggttctggcaacagtgagtgggatagctgagggagacagagagaggaggggaacagaaaagtcaagtcaggagattgtcaaaaacattcaaaagaaagagcatttcatagctgcagaatcaggggccattgttatttcttggctggtgttaaatcatgttgcctggatctggagatgagcacagctcccaggactagggctcaagagcgccctctccttgacttcacacctgacccacgccctccctctcctttctgtcagctgactggaacccctctccactcatggtgaaagggttggtggggatgggctggagtgcagagagaggtaaaccagaggagctttgcctgcctggaaccaagacggtgccaagaaggcaccacagggaagcaaagcaggggtggtggtttcaggccagcctctctagcagtgtgtgcctcacctcgcacaggttactttgcttttctgggcctgagatgccccaaccttcgaacagaaaggctactgtggatgcttgccatggttctttccagcttgagaatttataaaatcagcagtgcgttattaatttaaagatgcatttcatggaccacattcaattcagttcaattccagggcggacactgtgcaaaatgccaaagggtttgatttcctccttttattccccaccactccatttcttgtatttttccattatttctcagatacagtatttttcccccgttccttttttttttttttttcctccattttccagtggtagcagggagggggctgtttccataagacaagacactgggatcatctgtttattgacaggacaagggactagcccgccagctcttttgcacatcattctgctgatgtccccgtagtcctgtaccagcaggaagaggaagtgaactcaacctcc

SEQ ID NO: 46008 - DNA, 1702 bp, Bovine  19866880866180
ggtgattctgttgtataaccaggtttacaatgatctagaacagtggttctcaaagtaagatcccagacctgccacatcagtattacgtggaaactagtgaaaaatgcaatttcacaccccagcccagacctacagatagaatcagaatctctgagggcaatatagattttaacaagtccaccaggtaattctgatgtgtgctcaaatatgagatccactgatctagagagaagaataagacaataattagcaggtaggcagataatttaattacaaaactccctgttttttgctatataaaatatatccatcccacaaccacaaattggcttataaaatctttaacgatcttatagaataaatttcccatctctaaacatctgagtctccaaaatgtcagatttttcttcttcatctctctattcataatataagtttcccaaggagaacagtagagagatttctaaatggagcttattatgaaacatcctctactctttaaaaagatttacatggttgggctgagtcataacttgataatcttctcaaacacattttttacccaaatttctctaaatgaatcttaattacagcatttttgtaacaatatttagctaagcttttgtccttcggaagagcccaactcatagcgagaaacgaagcagttcttaatagatacccagcacttgtttcttttccttctgacaagagaaataacacacatagcaaaagtttcataattcccaacaaaatgaacacaaagccagccttcatttaccctttctcttaaatgatgcagttttgtaaaagaatacctcaaggagttgggcagagtcccagaaaccagcagagaccagtaagaacactgtatgatggtattctccaggcatgcgtcaggtcaacttgtccctgtgggcctttattgtaaattaatcatcgttagaccagctcacgggtacccttaccctgcatgccaagttgctccagtcgtgtctgactctttgtgaccccatggaccataaaccttactctaggtgttgtcaagatttcatttggaattttttcagtccctctgaggaaaaccaggtggctctagtagtaaagaacctgctggccaatacaggagactaaagaaatgcaggttgcatccctgggttgggaagctcccctcgaggagggcccagcaaccctccagtattcttgcctagagaatcccacagaggatcctggcaggctacagtccgtcaggttgcagagagttggccacaactgaagcaacttagcacacacacagctgtagagaacaaacgggacgtgtgatttgggcaacggacctcataaatcctggactaaaccatcaacatcccaaagagaagacacacttcacggttttcgcctgagctctcatctgaaaccctactggaaactgactcaaagcagccactgtgatgaagggaagagaagggagagaagggggccatgaattcgacctgagagggcaccaagataaacaaattcctgatgatatgtcccataaatcagttcgaaattctccttgtaggaagtgagaaaacaattggcagcttcaacatcaaaattatgctcagaagagcaagaaaaatcacagaggccaggatgaggatggcaacaaagccaagctattccaagagggaaggagggggcaggtaaaccctgaggctgc

SEQ ID NO: 46009 - DNA, 1192 bp, Bovine  19866880871561
ttcaagacaggcttcacttatgggttgacccttcatggaattgggcggcctgaggaagaagaaagccagatgagaagataactgcaaattgtaacaggaaacttggaattaaatctagacaggtgagtgtcagactgccagtctgtccaaggtttgtgtgcctttctccctctctagactgtcagcctctgggggcaagtcattgcattcccagcaccaggagcagtgtaagctgtaaccagaaacatccaaagatatttcatgtttggggtcagactaagaatggggataggaaggccaacaggcaagaatgatgagcagatagggtactttcccagatgacccctggcaaggagggcaaatgggggaaaattactttgttgagtgctaactgtatgccagacattgcagaaggtgagtgcttccaaaatttctgagacttgatttgtcccagattaactatgtttctgatgtttcagtgttttaactccaaagagcaaaataatataaaaataattttccaagtgtgattaaaaaaaaaaaccaaattttgaaatagttatgtttcaaaaactcttttatatttctacatcttgcaaatcaattaaaataatgcagtatgcattgatcttcatttagaaagcctgatccaggaatctagcaagcctaaccatgggattgctgttagtcttctgcaggacttgttcaagacaggcttcatttataagagttgaccccattcattactatgtctatcattactacgcattactttgcatagactaaaaacactggatgtatctgaaagggaaaacaaaatttcaggttatataaaatcgtaaatctctaggcacataagcatgtatacacaaacaatacattctatttagtatttctcataatgaaaaaccagaatttgtaatacttattcgtcttcttaaaactggtgatatatacacaaaaaataaatttccagagggtaaaacatttacatatatatgtgtaagatgttttattctttggaaaagcttgctgatctgtggcaaattccctcatccttgggagctggtataattacatctgcagaatcaaaggagaagatgatgcaacggctcctctgagaaggttgttggtgccatctgtttcctcccgcagagccttcctttccaaactcccctcccagctcgtgcat

SEQ ID NO: 46010 - DNA, 2518 bp, Bovine  19866880918682
ttttttttttttttttgtggaagatagatttggagggtaacactagtgattctagattcaaagccttccacagatgttcactggtaacttggtgtaaaggctgtctctccactcaagcctttttcttcctctgggggatgccgctttattttgctgtgacgcacaccctatttgctgagtgtgacacagctgagaggatcaagctgatgcaggtggatgctgggtcagccttttttttatacaaagggtattagcaagccttgggggttgagctgactccaaacggacaggttgtgtaaaatgtgttagcagtttttctgaattgcccaaatcctttccaagttatgctcaacaacaacaacaaaaaaacagagctcagagtagtgaacaaaaccatacacacttagggtttgtgtacacttctggaagcactggatacatcaatagaaagtcaacattgtgaaaacaaagtgagtggagacctgcctattacctgaaagagatcctatctgtgtgtgtatcctttcttcctgtcgtcactttgtttgcttcaggtatcatgaagtgtaaatacttagcaaggaactggttcctaaaatttctgcactttcttttccaagaagcctgtgttcaagaggagggccttggaagtcatatcgatacattcatccaacttgcctctggatttatcctataattcctactcattctgtcatgcctgattagtaatttggaaaagtacaagggagctattaaatttagtagagggaggaaagggaggcatagtcctcaaagataaacccacatttcttagtagcttctgtggaactgattttaatgcctcctttaagagaaaaaggtcaagtaaattatatctgtgatagctgaaacttgaagcgttagatgaatccctcagcataggccttgcccatatagattcactagcatgaaagttgtaaagatgctttaagtcagttctgttgaggaaatgccacagcacctcccagtttccttgtagtgcatgagaaaatgagaggacaagaaaaatccccttactgttggaaaatgtcatagtgaattcatgatggtccttaagtggaattccttagcttgtgatttagttttctttgtgtgaataaaagaacaatgcaactgttaagtagctttattttctacctcaattctctaaaacaagagcagggagagacaagagaaactcgccactccctgtgatcagggagtgacctaactttgctctccttggtgggaggatggtgggttttgggttctggagagctgattgctaatagccattttaaggaattaccacaaatgtgataccatcttctccttgcatagtgttataaaagggtatatacacgctgaaaagcaaattgcatactactttatcggactagaaatgagagaaaagggtgttggcaatccagtcagtaatcatcttctaatttgtaagcactctcctctcatctccatcacttcatcccatcctgtgaggaggagcagccgtgctggaggattattttcatttttaacagatgagaacgttgaaaatctaaagaagggatggcttgccaggtggcttctttcgtgatatgggggaaggaaatttaatattcgttaagagttcaagtcatcttcacacgtgtttttaattctcacaaagctctttaaattggatattttcaacccattttgcagatgaaattgtagccaagagaggttagtagttcacttgaggtctggcagctgagagccaggattcaaactttgatcggctggatcttagagtttatgctatttccagcctctgtgctggtccaaaggctagcagacagcaaagcttccatctctagaaggttggttgattaggcaagctgtctttttcttagctttctattttgcattggtgcatagcccattagcagtgttgtgatagttccaggtgcgcagcaaagtgactcagcctcaccgatacatatatccattctccgctaaagtcccctcccagccagtctcaggcaagctggttttttgtgccacactggttaaaactgggggcatgtgccaattgaaatgttttatcagtccagcacagagtttggggggaaaaaaaatgaagccgagttaacattgacaattgagagatttcaagtattctgccccaaatctcccgaaggcaagtagtggggcagccttctggaaaaggtagtgtaccccagttgcctctggtctccaccactccttacagtggccccatccttgaggcaggggaccatcacacttgccccgttgttcttaccgtaagaggtcttcctatgtgtgcgagtgtgtctactccactcggagtaaccaaaggcagcttgagggctcttgccgcaagaaaagggaaagagcatattccttggagagagtgaagactcttgtgtttagtctgcagcaattctgtgacagaaaatacaagggatgtcatcactttcctcacatcctgtctgcatta

SEQ ID NO: 46011 - DNA, 3872 bp, Bovine  19866880938531
ctctgctgggttctagttgtggcatgcaggatctcagatctttatcgcagtatgtgggatcttttttggttgcagtatgtgggatctagttcttcgcagtacgggccaccaagacctgggcttgatccttgagttgggaagatcccctggagaagggaatggctacctacctactccagtattcttgcctggagaatccaatggacagaggagcctggtgggctacagtccatgggctcgcaaagagttggacacaacttggtgactttcacttcatgtgtgggatctaatcccctgaccaggggtcaaatctgggccccctgcattgggaacacagagtcttagctactggaacaccagggaagtcctgagagttctttttaaaaaacatccccactaatgtatgaggaaggagtaaataagtgcagcccctaaggaaacaatggatccaggcaatgatcatcagaggttactaaaatcaattactgaaaactgatggggatctttgtaatggagtggctgtaattgctgagtatgagaatgtgtgccagggtcagtgatagggagtggtggggccgtggtaaattctatctgaaatcatttaaattcaatgccagagagagaaagagagaatgagagagtatgaaccaacactagagaccaaacagcataggcctaggctatatccttagcctaagtagtgattcccactgcagacctgaacctatacttgagccatatctcaacttttttccagaggtattaattcaacttttggccatttccacctcttggacagtcagtagagaattctagcatctagtcagaatggattaaacaatactatgcttattgaactgacaaagcaagaattggtaggaaatgccctaccaggaaaaaggcagtcccttggggagtctgtctgtgttgatttaatgataaagaatctgtacaccaagggtgtcagccagaccggaaattccttctggtggagagtcagaagtgccccagttggactgataggctgtggccatattgattggctccaaagggcatccttatacacatacaggcaaagggcatatctaaactttgcagtcaccggagactttcctggcctctgaaagggagtggaaggaagtgggtgaagggcctaagatagtggcacaagacctacctcttctttcctccctgtgatcaattgatttttattcaatttaaagacaattctgagattcttcctaaatactagagaaatgtcaaaagttggtataaattatttattttttaaaaatgggatttttgctctgtttcaggatcttgacaaaaggattattaatgtatttggtgggttttagcagaaagactgatggtatcaacttttgcacagtcaagaacaaacacttcttgagagtatgatataaagacccataccaacccctgtggtaagacagacataagtaagatgcagtttccactctgccaggtcttaaaatatagatgaaaatctgagattgtaaaataacactgtaagacataatgtggtaaatgtaaatgactgtgaaattaggaaaggcagagatggacagataaagcttcacaaaagacccggggattgactctagctttgaagggtggtctgaatttcagtaagcgttaaagggagagaacgctttattcccatctaattcttccatggtatactagatgttgtcagggcatgactgtcttcattccctctgaagaaactgccttgcccaaaggctcttctaggcagtcatgtttcaatgccttcgacccccattccagcagtttaggcaagagatggtctcctgtcacccccagggcagtctaactactacagccgggcttagatagacattctgagcccatgaaagtcttctttttgataatgtaaatgtaggaacataaaagagctcaagttaaacaatgccacgcgtgctcagtcgtgtctgactctgtgaccccatggactgtaacctgctaggctcctttgtccatggaattttccaggcaagaatactgaagtggtttgccattcctgacccagggatggaacttgcttgtctcgggtctcctgcattggcaggcggattctctaccactagcaccacctaggaagcccaagaggatgccatatgtaagtcaaagttacgaaggaaagaggatggtgctctcttggagcatgagagctttctggttccagtaacaggtcttcttataatcctccacctctaagtgacttgaagtaaatgcaatggataactgttccttaacaaaattatctgattaaattctatggacaatactatttcaatggaaatagtaacaaacttttttttctctcttagctctgagactgtcttggtacaaataccttgaaagtcattttagtaattataaggtggacattggccttgcctttgtatgtgagaggatttgacaaatggtgtaagttagtcagaacttctggtttctctctgttttacctccaacttctttcccaccctcctttatttcttgtctcatggatgaaataagagcaatgagagattaggtgggaaataaaatcaaaccaagtgtagagtgaacacacaactgtgtctggatatagcctacaaatttgcttctgagcatcaaagcacctgaagggaaacctggttaataacaacctttttagtatttgcgatagaagcaaaacagttgaagctcaacagaaatttctctcatgagtccttataaagggaataccattcgcaaccagcagatgacaggtggctcttacaaaaatcctgccaaggaggcgatctctccttgtttcaagtatgaagactttgaatggttgatttgatccaaggtgggggaaaaaatctaagggggagaagacataacatgcctaagaagagtgaacggctttccagtgctcaaggaaatctttgttgaatagcattcctcacaactgtattttgataagaattaaagggcagaggacttccctgtagctcaaacagtaaagaatctgactgcaatgaaggagatcagggttcagaccttgggtcgggaagatcctctggagaagggaatggtaatctgctccagtattcttttgtggagaatcccatggacagagaagcctggtgggctacagtccatggggtcacaaagagtcagatgtgactgagcgactaacacatataacatataaagatgcagagagggacttccctggtggtgcatggatagaatctgctcagcaatgcaggggacacgggttcaaccctggtccaggaagatcccacatgcctggagcaactaagcctgtgcaccacaactactaagacccactctagagcttgctagcagcaacgactgagcctgcatgctgcaactactgaagcctgtgagcctagaacctgtgctctagaacctgtgcaacaagaaaagccaccgtaatgagaagcctgtgcactgtgacgaagagtagtccctgctcgctgcaaatagagaaaaccccacgcaaagcaacaaagacctgctgctgctgctaagtcgcttcagtcgtgtccgactctgtgcgaccccatagacggcagcccaccaggctccgccatcccccgccatccctgggattctccaggcaagaacaaagacctagcacggtaaaaaatttaaaaaaaaaattaagaaaaaggggaggtggcagagagactgtatcctttaggatagaaattgtatacagctgacaacagcagatgtgtatttctgacatttttggtgttctgggcagtcaatggtgttagtgtcatagttggcatcactttctggaagcaagggaccaaacttgggagagg

SEQ ID NO: 46012 - DNA, 968 bp, Bovine  19866880959142
gctgagcactgaagaattgatgcttttgaactgtggtgttgtaaaagattcgagagtcctttagactgcaaggatatcacaccagtcaattgtaaaggaaatcagtcctgaatattcattgtaaggactgatgctgaagctgaaaccccaatactttggccaatactgatgccaagaactgactcattggaaaagaccctgatgctgggaaagactgaagacaggggagaaggggacgacagggaatgagatggttggatggcatcactgtcttgagggacatgagtttgagcaagctccgggaactggtgatggacagggaagcctggcgtgctgcagtccaggggtcgcaaagagatggacacaaccaagagactgaacaacaagtcttggccccgccaaccctccctgggctagggaggaaagtacgtgactaagaaatcagaatcctggctctttctttcccattctgaagctaaatatacttttttaacaaaatcaaggccctacttccctttgaggggccttttggaattgaaagtagttcagaaagacctcttgacctacagtggtctttttttaattttattttcaaattctaagccaaaactggttgacttcaaaggtctctgtacaaaaatcacagcattgttttcctaaggaggccttattgagtgattgatattttgagggttttccagcccagtgatttctttgctaaaaaaaaaaaaaaaagtgtactcactcatcttggcatttgtttgcaaactaaacccatggtttgaactctgtttatcatcccccacctcacccctcgcccttgacactggaattgctaacacacagagaacacagtggtctgttgctagcaaaatgtgctcccctgtgactttgctttttatgcacagattatcatctctgtcattcattataacttcaaaggctacaagagagtatactccctttag

SEQ ID NO: 46013 - DNA, 1748 bp, Bovine  19866880974860
tagtcatgtatgtatgtgagagttggactataaagaaagctgagtgctgaagaattgatgcttttcaactgtggtgttggagatgactcttgagagtcccttggacagcaaggagatacacccagtccatcctaaagaaaagcagtcctgaatattcactggaaggacggatgctaaagctgaagctccaataatttgttcacctgatgtgaagaagtgactcattggaaaagaccctaatgctgggaaagattgaaggcaggagaagaaggggatgaacagaggatgaaatggttggatggcatcaccaacttgatggacatgagtttgagcaagctccgggagttggtatgaacagggaagcctggtgtgctgcagtccatggggtcactgagttggacacaactgagcaactgaactgaacattatttgtaaaacacagatgctatttcccaaatgagtgaaagcacgaatggcaattactgataatgattagataccagaaaattaactatgggaactaggttagttgggaagagagagaataagtttgcaaagagaatgtctgttagccccaatttgcacatagatgcaaattgcaaatgcatgttagccccaatttgtagaactagaaagcagttatgattgaagaaagactaaacagatcaaaagtagaccatctggaggttctactgtgatgggaaggccatgaaatttaactcaaatggttcaaatggaatgatttcgatgaagggactctaggggtcaaggctgagaggaagtgaggaagaagtaccctggcctgttctcttctccccttctgatctcctgattgatatctcccattggctaaccctaacaggaagccaccagcagggggtcttctggagcacagaccagagcaggaggagtagagaggtgatctgagggagtgtgggcaaatggaagaaaagcagcacacctgccaggatggaacagactctggcctagaagatagagattaaataaacagattatttaagaaaagataataccttaacaaattgggtcaccctttttacatgagttaatttcattgagtttttttttttgtgtgtgtgtgtgtccttcaagcaaataatccctggttggtaaatacaataaagccatgaaatgaaaccgcatgggtgtgtctctacccccaaaccgctaaatctgctctctacttcactctacccagatttcagatcgagcctctggtatttataattaggatacacttccatgcttgaaagaatgtgtttagtacccaggggtgagcatctgtgaattaaattagtgggtgaagcgtgtgtgtgtgtatacatgtttctgccttcatcagtatttatcctaactttgctttaatgtcttacataaataaaaaccagtattgacttttcactttgatgacatcactggaaattattttccaaggtcaacctggtaaagctgcccagccagacgatgcaggtcagtctttccctctacagagctttgtggggcagcagtacctgcctcagttgctggaggactgttgcttaattcgttgacaaaagaatgtcattgccagcctgccactcaacttcagggatccctaaaagctgggatccctgtgccttgctgatatttgagaggcattaggatgaggtggctctccacattctaccttagatatgcccacgagataattaggcacctttgtgtaattcactctcaaggtaacaaga

SEQ ID NO: 46014 - DNA, 1147 bp, Bovine  19866880982049
tctgttctttacatctgtgtctcttttgctgtctcgcatatagggtcatcgttaccatcttgctaaattccacatgtgtgcgttattatactgtattggtgtttttctttctgacttacttcactctgtataataggttccagtttcatccacctcattaggactgattcaaatgcattctttttaatagctgagtaatattctattgtgtatatgaacacaatagctttcttatccattcatctgccaatggacatctaggttgcttccatgtcctagctattgtaaacagtgctgcaatgaacactggggtacacatgtctcttttaactttttccagggtagcttggccctgaattcttacttaggaccttcccaccctcctgtcctcagcagggagctcttccagtatctaagaccatccagcactgatcactccaagtggtatggcactgtagccctgggacatcctaattggaattgattgcatcatcagactgattgtcataaaatgtcactgtatgatttttaagaggtgtgtgtgtgtgtgtgtgtgtgtgtgtgtgtgtgtgtgtatgtatggaaagaaagatgttaaaggaagagaaagcaggacctgtttttctggaagctgtcttaaagcaaggccttcctggattggggcagcttggtgagcctgaaattccagcatccatccatccttgaacaccagaaacattttttagacaagtgaaaacaagtacctttccaaacctgtgaacctccgtgtaccatgaggtgagatctctttgatctccttgtctggaggcaagacactttccacaccctgaaatgcaggactctgctggagtgaaagtgggagttatctcctctcccagatagtagccccctggtgacaactgcttgtatggaagttctttctactagaatagatcaggagttcttagacttttgtgtgtgtagtagactccttggcagtctggtgaagcagatgaactcctttgggattgtatttatattgtatataaactgtgtttataaatgaataacctaattacatagaagttcgaaagaaaccaattacagttaacctatgaacagcagcagtttgaatcaggctgttacatttttttttcaaaagtaaata

SEQ ID NO: 46015 - DNA, 2612 bp, Bovine  19866881002447
gttttttgtcccgcacctcaggtagaaatattcgctcatctcattctatgtgccagacgcggccttgtcctctcctgggtgaccttcacttctagaatggcttataaccacttatatgaggcttactatgtatcaggcacaactttaactgatttatatatatatatatatgtatatatatatatatataataaatataatatataaatatatatatatattattcttttggagaaggaaatggcaacccactccagtattcttgtctaggaaatcccatggacaaagtctgagcttggtgggcgacagtccatggggtcgcaaagagtcagacatgacttagcaactgagcatatattgttcttacaacagccctatgagggagatttatttttaaccatctccaaactgaggtacagaagagttaaggcattttttcaaagtgacatagctatgaagtggcagagctgggatttgaacctaggaagtgaatctccagagcagcggcccatctagagcagcagtgtccagctgagtcctgtgatgatgaagtgttctttgtgaagtctattgggcacttgaaatgtggctagtgtagctgaaaaactggatttaaaattttatttaattttaaatggccacatgtgggttagtcgctatgatactggaccacatagctgtagagtctaataactttcaaaatagcatcagaaaggtggtgatatcctttagagaagaggacagtgagtgtcagtgaaactggggggatttattcaaggttctgaagctggactgtggaagagccaggatgccacatgctgaaatcacaagctctggtcaccagagatgcaccccccagcccccatccactctcctggctcttcatctctttccaaacaggatcggaaagcatctttcttccttcacccttattaaagagtctctttttcccctcctccattattaacgccgtaacagtagaacagtgctttgtgacaggacatcacgctctatgttcgggggatgtggcatggtcctgtatcgtttaattgagtagactggaacagcttaacttggtagtgagcagtgtgctcactcttaacattcttaagggcttatctcaaacattattctgttgtctctttcttcttggttattcttccttccaatccactccaattcttttaccattggtaacaaaatgtatgggcttcccaagtggctcagtggtaaagaatccacctgccaatgcaggagacatgggtttgatccttgggtcagaaagatccagtggagaaggaaatggcaacccactccagtattcttgcctggagaatcccatggacagaggagcccggtgggctgcagtccacggggtagtggaagagttggacacacgttggcgactaaacaacaacaaaacaataacaaaatatatgctcccaaatcaaaacagcctttagttaaaagtactaaatttatgtctacctcaagctttgttctttaatttgaacccacctcccaccaaaacacccagaaactaacaaaacaaaaccttttgttcaattaggttccccttagctagtagtattattaaagaaaagatacacaatcatgtatggtttgggagaccgtcagttttcttaagcatagttttgaataagccaacctcatgttacccactgtgaaccacactcagtatcttgtacccagtaacctctcaacaactattaatattaacatttcattgatttgcctgcctctacatccctttagagacttaggacttatgtgaataggaaaccctactttaactcttgggcatggacagagaaaacagaactctattaagcaaagaaagccctgattcttactggtgtacccaggctttgggtactgggtactgctgcctgggaggccagtcctttctggcatcacaagaaaagaaatgctgtgacttcttcaggtagcggttctgcccatctgatcaccaaacgcgattgctatcttgtctggagacaagactcatccaactcacagtcaggagggagaatctaatgtttcctattgaggaggagcacacaagtatttccagtgacctggaaagtagttcattggaaagcagcttgagagactgacgaggactcttctaggccattgaatggtggggaggaaaggcatctgtgtttgaatctccttgatgcttccaattcccctgtgacaaaccctggacttagtggctctcaaatgatgactgacttatgcaactacagccaacctgatggtacttaaaaattcagagcactgacgtagattagtgttctcatttccactgactcatttagagggaacaaattcacgtggtagtacaaatagagaaggagaaaggggtaagaaggcactttataatttctcaagggatgaagtctagcattgtacttttaaacagaagctctttctattcccagtcaggcctccaagccacctcctggagcaattctactgtttcctgatgtgcccaccaataaagcagttgggtggaccctcacactgatgctcagagatatagaagctattggttgagcctttcactgtcaaatcctttttctctc

SEQ ID NO: 46016 - DNA, 940 bp, Bovine  19866881007188
tttctaacatacctttccctccttatattaattagaatttttactacactttaaaaacagacaacagaatggcatatgaaatcgaatgctcacacaggcagccctctctttgccactcaccttcctcatctatccatttcatggtgaaaagttgttcgttgtcaaaagaacacatgtctcgaacctcattacaaagaccctcgaaggatattgaaggttcaaaatgtgttatcatgatatccctgaaaaagaaaaaggagttttaagttagagagtgactaataatgcctgatgttttgatggacttcagagattctgtgtggacatcaacacgtgtcacttccagtaaactatctctgtaaaaaataaaacaccaatacttaataatgcttaaaaataaaaacagtggttttgtgagaaatcttaatctcccctcctcattcaagaagcccaccctacctgctttaacaaataggaggtccacttttgttttaatgctagttatcagaagctcactcttttgtgagtactatactccaaagacaagtagctctattattggtcggcttctggattatacttaactgaaatatcttacaatctctaatcgctaatctccccttccctagaagtctatcttcatcaaagagatggcccttcaaaaatttaataaggatctgtcacgtcctcttcttcagccttaacttccacagactaaccacccagattagcaatccaattcccaaaatcgactttaaaatataattcatattataaggtagacaccccaaaaacaaaggaatagacataaatatgcatttattttcacattactgttagataaatcataacacttaaataaatccactgagcagctatttactacaagactcaaaaacacaacaaaatgttttagaacaaaagcctgggtgttcctcca

SEQ ID NO: 46017 - DNA, 2055 bp, Bovine  19866881098742
tgggctattgaacatttcttatgaggctatgctgagtcacttcagtcgtgtccaactctgtgcgaccccataaacagcagcccaccaggctccccgtccctgggattctccaggcaagaacactggagtgggttgccatttccttctccagtgcatgaaagtgaaaagtgaaagtgaagtgctcagtcatgtctgactcctagcgaccccatggacggcaacctaccaggctcctccgtccgtgggattttccaggcaatcgtactggagtggggtgccattgccttctccgtcttatgaaaaccaaattctgagttttcattaaatttaagtgaacacatagctagcggctaatgtactaagcaacaaagctctagaaagtaactttattcttactttgatatcatctgatttctcacgactacaagtagacagaaattttaggtaaagctttgagttgggggacttccctggtggtccagtggttaagaatccacccctcaaggcaaagaactcaagttccatccctggttggggaactaagatctcacatgttgcaggggaactaaggcctgcccggcacaattagagagaagcccacctgcccgctgcaactaagacccgaggcagccaaatacataaacattttttaaaacaaatattaaaataaattttttttaaactttaagttgggatgtcacattaaagttaacagaccaaaataaaaatgtttctaattgttagtcataaacactttgataaattcaaggcagtcgttgcactgtttgctacccagggaactcttgtcacttcagcttagcacactttttccgatttctgctcatactgagtaattttctaactgacctctatgcccacagagaaaaaatgtaatttttctttaatagcactcaaatcttacagccgtgtacattagatctaaagaaaagatttttaagtcttacccatttgaaagacctcttagactatttcactgcatttgtgcagcttgtacaataaggttttgctgacaacacactaagtccatccccacaaggtgtgtatagatatacatacatagacgtgattcatgtcctaaaaatgtatagatcctaagtggaagtcagagtaaagaagtgaatttggaggctctgaattgctccaactggctttctaacagcctaaattcactctattagttgtgaactactcacatatttaaggagtttatatagattacctaagatgctaaaatctacccatatgttaataacttcaccttacttaaagagcaaagccccatcatgtaatatttttatatgagattgagaagatgtattttccttccgtgaatagagtatactcaaatagaccagctgatctgattgaccaaaccttccctttccagcacagggctttaaagatctatgatgcattttttttatctttctctggccacagattccaaatctggcactcttggagaactgcttggctattgtcatcgttataatctggagtgtctgagccagaaggaattgctctagattctccacatcaaaatatgatccagctacacacacttaaataccaaaagggggcatttgttctgagatgggcaaaaacagcaatctagcaagggcttccaaacacccatgcttgattagagggaaaagctgaactccataggaaaaaaaacagatttgattcccagttgatgtggctcaatccaattgatctttcctataaacaattaactggattcaaaacaggttatggttcaagtaaagttttatatttttccaattatttacacacatcacacatacacactcacacacacatacacacacgggcattcttcacatttcattttaatctcacttaacttccaggtttggtttagattttacagagtaagatttaaatattgcctctaatatcactgaattcttcctcttttactaagcaaagtaataaaactaggtcattttcatatagggaaataatcaggctcaacataccaaaagtaaccatcagtcttgatttttgagt

SEQ ID NO: 46018 - DNA, 1438 bp, Bovine  19866881233612
cctaggaggcatttgtaccaattaatgtatcatcagaagaagtagtttaaactataatgggaaatgaggcaaacttaatcccatctcacaatagcttcaagacttcaattgttttgtccagaacagatgctaacaatggctggtataacaagtaactgcccatctcctgtgaattctgtaagtggttttaactcccggattctttactaaaagaattctgcataaaacttgggctgcctcacacatgccaatgtatttggttgcttaggaatcttcataaaagaagagtcaatgtgaaggacagcaaagataaaatgtttgccctactcaggatgggaaaagtctgtttgtagtcaagggaatatcatgaaacttttcaagaattaggtcttccaagtcaggtaagtgaattacaagataaagaaatcccaagttgaatgtattgtgtttatgccaggggagggggtgtggagtgtaaaataaccttagtgatgtgagatgtggaaatgattgttattccctgaggccttctgtgatgagacttgggtgggtttaggacagttgttggtggagctgtttattttaacaaaatggggaagatgcaagtgaaaaaaaaaaaaaaaaaagcatttttttgggaggggaggaagggtgatttcaacctggccaagaaagccagaaaatgtttaaaagttaaaattataatgactaacattcatagggagctgattagatagggctcaagaaggtcatagatattagtcattcattgactgagtcaaataaactccaaccaaattagtggtagaatctgatgtatgagttttcaaagagaatttcagaatacctgccttgtggaaagttcactaaatgaacatcgtgtattaatggatatttctcaagagctgactgcttgcatggtgaccaagtagggcctttgtgataaaggaaaagaggaaaaacagaactgcctacaaccaagttgctgagtaaaactaattttttaaaaaatatatagagcccaatatggtatgtgtatatgaagaataggtaggggtgagatgaaattggtgtccagcagtttagctagcttgctgggcgatacagagaatgtgactgtggcctggccttttcaggcttccctgtgcgtgaccttctaaatgaagttaggggcttcaggcacagctgggtccaggtgctgagagaacatcaagaggtgtctgtcatcctttctcagttctgtttgtttcagagttagcttcctcctcagccaagctctctactcaagggcggcagacagctgccaggggccacataatcactttttaaatttttttaaaccaggttgacaatccaaatagaaggagaggatctcttttctaatccttcctacacaagtcccagggctgactcaccttgagctgacagaggtcatttg

SEQ ID NO: 46019 - DNA, 1540 bp, Bovine  19866881262643
atgctgtaagtgtagaatcccactggagtgcaaagacttagcacaaaaggaagagcataaaaatgtaattgattacatattgaaacgataatgctttgaatgcactggaataaaatagaatatattaaaaattgatttcacttgtttacatttagctttttaatgtggctcctaggacattttaaattatatatgtggctcaggttatatttctactggacagtgctgttcaggggcaacagtgacccctcccctcctccttcacactgataatataacccaacactggagttatgacctacaaaatgggattccctaatgaggcaatgatcatccaggagacattgagggtgtctcttctcctgctgcaggggaaagtggggctcctgcagcacagcccctcatgtgagaaagcacggagcagccttgggaagcagggaaagcagggaaagaggtgtgtgagtgagcacagccataagaggacacttttgattctatgaggagacaaggggtgtgagacctacagtcttctgtgtccacaccccctgaggccctcttgctccattcatgttcacagtcattacactctggcaagttttcatgaggtagagagggtccggcaatataatcacaaaacttgcattcttacaaagctgtcataactgagcaaatattttggtcaacatgaagattatcttttctccacaagttaatttggaaatactttccactaggttataatctcctaatgtacacacatctctacaaaaatgattagtccaagtggatatttccaaagaggaaatgtttgccaaccattatgctatcagctaatgaaattagtatttttggaaaaatactaccaaagtagattgcaatctgtttttttctaacagcagactcataacttgacagactttctggaatagaaaacaaacaaaaatcaatttgctatatccaattttgttcaaaatttctaaacatctacatacatatgttcaaacaaaatgcacttagatattattacctgaagatccaataaaaatgagattgctttatagttccccttatactgagccaattcctttactatgcctagaatagataaaggagtttgtgtgatacttggcagttggtatctgatggttgcctatttatatgacttaaagaagccataatgtccctccttaagagacctagagagcatctaagttccccttatgaccacatgtaaccatcacgatacagtgaataaaatatcttttcaatttttcagcatagggcagaaagacttactcttgaatccctgaccagattccctgtagattactagtagagatcaacgaaaaagtttaaattgatggatgatacctctggatacaacagaatattacaggccagttttgcagacagtctgttattttattgcacagatttcacttaaagaacaaaatgcaccatcaagtttggagagtttagggtcttggataccagtacaccatcagtgtttgcacccgtaaagccaaattcaacagtacaa

SEQ ID NO: 46020 - DNA, 1325 bp, Bovine  19866881269480
actataaaactccctgaaggtatggatttgtctgtctcattttttgctgaatcttcagggaccacattagggactggcaagccataggtaatcaacaaatgtttgtagaatgaaggtttttccacagtgctaaaaagaatattctgcataaatatttctttatgaaaggtgtctttgacaatagcagtttgtaataatccctgttctctgttacaatgtaggaggagttcctttgttgagtaccctgtgtgcataaaatcaaagaacacaaaatctcagaaatcatttaatccaagtctcagattttacaaatgattgaactctattttccttggctgccttcacaaatccctttgggaaaccaaattatctatattacatagttataaataaatgatctttctatgtttttgatcctttaatattcagtcaagggaagacagttaaaaattcacactattataatattaaaaatatttaacattaaaatattaacatccagttagggttagagttgtattttttgatgttgatgattcatgtagctccttgaagacctcaaaaagtatttcacctcatcggagcagtaaacgtctcataaatcatacagtatccaccatagcagagagggtttgagttttagtttgcgtcattttttttttttcaatctgtgtagaatatagttgagaactttgacaacctggaattcaatattttttttgaaaaatggagatcactttgccctgtaggtacatgttcatttcagcttctgggcttccttggaagatagcacccattcaggattcatgggtctgaggcccttggggtgcactctggatacatagccagagaactccctggaggcaggttcctttcctgacaatcagcatgtcttttcattaggaaatctgaaaattcagagagcgtatttcaatgtcaatggtgagaaatgccagatttcatttggggacttttaaatgaacttccagactgcaagctatttgactgaaaagtgcttgcttccatgctgttgagttaatatttttgcaaactgcaagttcttgagtttgaatgtattcctcatagagccctttaaggagcaattgttaatgcaaacaaatattaaataatatggatcaaagaaatgatactttcatactttgatggtgggagagtgggctgacataagtgtgtttggaatataaatctatcacgtgaaaataatcaggtacaaaaaaaaggtttttttcccccaatggttgttgcaatatcatttatagtggtgaaaattggggacaatacgaatgtccaaaaataagggcaga

SEQ ID NO: 46021 - DNA, 795 bp, Bovine  19866881272195
acgtcgtagcgctggtaggtgctctggtgcagggcttcttctcgggcgctgatttccagggtgctattccagatgccgtacccaaaataaatgagcatacctgcaggggggtggggtgagtgggaggaagcacaggtgaataagctgttgtttggggatccacgcgtcaagcagggggcttactctcaatgatgagagcagacctggtggtggatgtgttttctttggtctgcgcagtgttttgaaaagatttgacttagatgccatttaaaaatggtaaatctttaaacaaccagtacttagaaccgaaggactgacaatgctgtacccacattcctacatggaaacttctggctggaggtgagaactggccatctctttggttaggatatggcgcacttgaggtcccctcagtccccactcccctgttggacatctagctcactatactcgtgtaggtgccagccaggaatttgccttttcttgtttaaatagttacggatctcccacagtgtactcccagccttctcatagcattttactatcccagatttccacttatgggctcattcttttatttcaccacatgtgtgggtactaagttggtttggttgtgtctgactctttgcaactctttggactatatagcccaccaggtccctctgttccatgggattctccaggcaagaatactgggatagattgccatttccttctctgggtgatctcctcagcctgggattgaacccacgtctcttctgtctcctacgttggcgaacgggttctttactgcta

SEQ ID NO: 46022 - DNA, 1313 bp, Bovine  19866881364868
cccatccctctcttgtttctgacctttgtttcctattcttgtacctacccacgaagagagacccagaggagggggttcttaaaaaaacctaccttaaagatcatctagtgcagtcctctagcaaatgtttgaatttcctatacaaggctcctgatgagtggttatctggcctctgcttaagtagcagcttgaggtcaaggactgtcttaattactttcgtattttcagtacctagcaccacgcctggcaatgcagtagagactcaataaatattcgttgaatgaattctgaatgacagtgtagctcattaaattcccagggtggccccctttaaggttactctgctactagtccctttcacatttactaatacccctttattccatgaagtgttgaagaatctcaactgtctctgggtgcatttttagagatccgatttacaaattaaataatataaatgatggggaaatgcacaacactaaccatgataaaatgttgggagttaattttacctaatattctgtggtaagccataaacacatttacaacaaattatcctaactgcatgttaaaaacaattaagaaaagaacacaacagaacattcacagtcatgccagattttctcatctattctgcatttgtggcaacatacaaattaggtcgtcaaaaaaataacagtataattaaatggcacagcagtaatgctactactgatcaggaataaaaatgaaacaccaagatacagctattgccttttcttttacctttcaatatgagggtaatttattcccttcaagtaattaaacactaaaacagactacattacattatttggcaaagaaaagaaatagatcacttagtagctcaagttagagccttaatattttaaaatacttttatcattcaacttcccccatcattatctaccacaaaatgaacagatggcatcctcatctgaaacacataagaaaaatttcaggcatgatttcattcctaaagttctttctctaagtcataaaacaacaaatacgtctaagaaagcaaaatttaaacaagtctaaaatgtatagtagaagaattaattttaaataagtaaatattagaaacttttacacaaagtttctctaagtttcaacttaactgttacgtatacatgaccttttaataatcaggtttcctgataaagaactactgtatttcggcacaatgcttattagtctcacaatgacaaataatatagaaaacctggtttcatttacaaaaagaccaataagtatttctgtcatcacttgagaacaaaagcaatttcatc

SEQ ID NO: 46023 - DNA, 948 bp, Bovine  19866881651180
aaacaggagttccaagacaaattatttttcttccagacacatttgtaaaaattggcccaagcttcactgacaagtgatgaagtaaccaaggttactcaggtagaagagacagcgtgaggtgagaaggagagagtgcctgatggattaccccctgaaaaagaaaccccacagtttcttggctgacgaagagcataggaacaggacgttggggcagggtcgtaggggttcaccacacttgacagggggctgaatagatgtttcttagatcccaacaatatgcttctcaagggaccaaatgatggggatacttcagtaccacctcctggaattcagtactgctgagaaaacaaatgtttcccagagaattcacacattatttctctctagggtcctatgatttctccttacaccccactccaaagccacatgtaagcagtactagcatccacagtaaaacaggaagtcccctacatacgggtaagttccattccaagagcctgcaagtccaattcattcgaaaatccaacagagttagcctaggtacctaacacattcggctatacagtactatactgtaataagtttataatacttttcacacaaataatacataaaaaacaaacacaaaaaataaagaaaacatttttaatcttacagttcagtaccttgaaaagtacagtagaaccagctacattactgctgcttttatgctgcttctagacatcctgggcttgaaatatagatactgtactctacacagtaatgtacagtaaagtacacaaaatcacaaccactcatagagggtttacgcacgtgataacgtacgctggacacaggcactaacttacgtgattggacatgtgaatgcatgtttacatctttgaaagtttgcaaccgaaagttcatatgtaggggactcactgtatatacaacatctaagccttgctg

SEQ ID NO: 46024 - DNA, 697 bp, Bovine  19866881847266
cccactcaggttgcagggtggcaccctcccatgccagggagtatcagtttctggagccagcttgaagtttgtgttatcagcaagattacaaaaggttctctgggaactttcttctgcctgataattgggaaggcagcctgagtcagaacaggttcacgttgtactcttgcatgtgacagctagtctgggagacaatgaatcatttcagctttttacaagaaaggcaggaaagaaatagttcttactgctttccctgctgttttcttgtttaagccccaaactgcaactagatcaagtctagtagaatcatctgcatttttacagatgagtaaactgaggcccaaaggaattaaatgaatttcccgaggtcacaaggaaatggcagagttttgatttggacttggggctgtctgactccaaaggcaataggccattgcatcatttttgcaaaattcctctggtgttccagaaacatagatattaggtaggactgactacataatttataggtcccagtgcaaaatgaaaccatggagcctcttgttaaaacattgttaagaattcaagaagacagcaccagagcattaagccaagcacgaggccctgtgtgactatacagatcatccacccatgaagccagccctctgttaatctgcacagactacatctcaaacattctgggcagatacgaaggtct

SEQ ID NO: 46025 - DNA, 751 bp, Bovine  19866881418651
taaatttatacaatgttttatgtcaattatatttcaaaaaatctgggaaaaatgaaatttaaaaaaggaggctaagaagaaaatctcattaatagaaaaaacattctgataaatcaaattgattccaatattaatagtcagtttaaatcatggaattagttaacagcatcaaattgggattaaagaaaggaataaaaatctattcttacaagttgtttaaaaacaaaacggtcattggctgatgccatagtctataaatctgattatgctgtacatgataaagcattccctaagagagaaaaaaagaattccaagcctatgaaagtagagcattaaagcaagtgccaggccttactgatcagaggcctctgtgcatgagttgtacacccatgatgattttaaatagagcacaccaagaagcggagtgggaaacacaaatgagggtattgccatctcacaaggaatgttacaaatgttccttcatttattctccagatgtacctctgacataacctttagcatgtgaaatactcaccaagaatatatactaaatattagtttgaaaatagcttcaggacttagtttaaacaactgagctaaaaatgttcccagcccatctgtcattttctttaggctcaatgctagaaacttttgatccattaatggaacagtttattcatcttttaatgcatgcagtatcatagcgcctcttcctccttctcatgctgaaatcacatttcgattcaagtca

SEQ ID NO: 46026 - DNA, 804 bp, Bovine  19866882186912
aggggatgaaaaacactagctgtgagtagccttctcccctccaggggactggactaaattccccacatccaacggcctccttcagagctgatggtcatttagagaccagtttcaaactggcagagggaggaccattttcgagttgctctgacattcagtgggggctggcagcatgacgtgaactccacctccaaagggacaagctcagaaaaacgcaaaactagtacactccgcggaagaaggggaaaagtaagttagaaaacgtttcatgtggtctgttacttctgacatgtcttccagagatttggtttaaaatcggtcagtggcatagaaaggttgtcttgggaaatgcgtgtgttggtttagttgcggttggagccaaacaaagctcgaagctggctaagacggcaattttaaatcactactggggagctgttaggtgtagtcacttgtgtccattaaaatccctgccaacagaaaatcttcactttgacttgattgctgataagcttagaaatgaacagtaagtggaacatggtgattaagcaaaaccaatttctgttcatgacttctgaaaagacaaatctgaaatcacagccactcagctcacgcttacgtgtgggagtaggctgggatggggtgtgtgtggagcacaagcgtccacagtggattaagattgattgcaggagctaaagacttttctctttgagtcttttgaatccaaagtagctttcactcaaataatatcaaaggcatctgattaaacacatctcccagcagaattttatcgcgggcatgctttac

SEQ ID NO: 46027 - DNA, 2163 bp, Bovine  19866880431658
attaagcatttcttttcctcaaagtgactcccccgtaaaacgtttgatgatcatattcttgaggagattaggtttattatgcatctgtctgtagttatttgtaaacataaagttttgtgtttgggacccctgagcaaattgcttctaaaaactaaaggtagattcctctggaaagaaacgttaggaccagtaccttaatggatcacagagtagggccacaaagcacctgaataaagagtggattcaagttcagcaagactggaatgaaccgataagcaagtgttcccaggtctaaagatgtatcacttgagatggacttggtcagatatgcaccctgcaacagcaaagtcctagaaagagaagctggccagggcaagaggcgttttagccaacggactgagatctaacggacagatgggtggacaggctcacaaagaaaagacctgatgcattcctgaatccagcaggcaagtcacaccttctcagaaaaaaaggaatcaagccacctcagcctgatgccactggagcatttaaggaccctcattctctgttttgactccacgttcaaacagactctggatggccactcagcttcctaagattgtgaccacactgagtgccaatgttctgacgtgtgcagctacaacacacgtttgcagattagtaacatggaacgcaagtcttacacatcagtcacactggcttggcgaataggatttggattctgatgaatccatttctgtttgcttctgagtctgagaggtcaatgaccaaatgctggattgtgataaatctgaggagaggcgtcttgcaaaatgacttccctttgacagtatccactcctatgcgaccagtgtaaattccaattggtagtttagttatcttcacaacacactgtcagcgatcttgtcaagcaatgaaatatccaaagtaaatataaaatgcacataaaacaaacaaacaaaaaacgcaaaaattccatttacatttctgttttcaaatataaatctgaaattacgcttttgttttataatatacatttattccaaatagcactgcctgggctactgaactttcagaagcgctttttacctatgtgattggttattaaggttcagcgacccagtctggtacatctcttccagctgcttccggttcccgaagtacagagcgaggtccgtggcgatgatggctttgcggatgatctcaagcacctgctcatattcgctggagctcagggtggagaagatgttgtgcccttccaactaggggaagacacaagcaaacacacataagcacaaacacccacacgccgacagcaagcaccggctcccacctcgcgacacaggcggtgccaggaaacaacagttggttgtcgtttaggtcacgaacagaatctgcctgcaatgcagacccgggtttgatcctctggacaaggaaatggcaactcaccccagtaaacttgcctggaggattccatggacagagaagcctgatgggctacagtccatggggtcacaaagagtcagatacgactgagtgactaacgctttcaggacacatttgggtggaataaaaggacagtttgaaatgaccaatgaaatcagtgttttggtttctccttatgatacaacaatgaagctaccacttaaatgaactatttaaaccacataacatttcccaccacagaattccagcaatttaaatatatacctagtttggagatatttccagtaagtaattaaaggattggaatatgtaaaatatttaagtgaaagaattttccttttacactaattaaaaattttggtaattttcatattatagtagaaattaatgggcttaaaaaatcatctatacccttgtccatttctgcaagcctagtgaatatgaacctaattactctgtaccatagaagaaaatgtcccagtactggaaaattcataggcatattaaaaactctccctacagacaggaatgcttctacataaaacacacatccctgaggcacaaaaactggaaggccatcgctttttgtcctcacggtacgtggacacagcagatcaccaccctgaacaagaccaaacatctgtcatccggattctatttcctcagaattattcttctatatgcgaatctcttcaacctttttccaataatttc

SEQ ID NO: 46028 - DNA, 764 bp, Bovine  19866880722444
agccctgtttcatattgatacgtttttgtcttaagttgcctcatatccattgagagagttagtggggctctaaagaagtctattttaaaaaaatacaaaatctattaccacactgtagagtaagagcatgcgtcatagtctttcatgtactgttaagtatttgagtgtgaccatctgccactgccagttgataatttgagtgtaccacagtaatttggattccttttcaaaggatagcctgtcatctagaaaattcttatggtgtgcacgtttgcagtttgtgaacgtgaatgccctttttttagaagaaactctcagaacacccttgagcagggtgatggtatgttgctgtctgttgaccctgtgggctgcaggagatggttgactgttcaggaagcggtgatgggattcgatggtagggaaggcaagcagattctggggtctgctcgctggtgggcccgttacagtgtctgagaggaagccggtaaagagtcctccttccttggtggctggaggaatgccagggagctggtgaacgaggctcactcagcaccccggaagtctccccggggcaggtgtgtgtgggcacagacccatgtgtctagaccagagctgcctcctggagcccgttgtttctttaccagtttctgtcgtgacggtgtctcttccgcacagcttcgagctggagaagttgtgccgtttcatcatgtctgtgaagaagaactaccgccgggttccttaccacaactggaagcatgcggtga

SEQ ID NO: 46029 - DNA, 928 bp, Bovine  19866880889708
cacattcaactcaaatgaagatcaaaatggaaaatttaacacaaccgcattatctgtggaaattctatgcacgttgagtactgctgctgctgctgctaagtcgcatcagtcatgtctgactctgtgtgaccccatagatggaagcccaccaggctcctctgtccctgggattctccaggcaagaacagtggagtgggttgccatttccttcttccgatgcatgaaagtgaaaagtgaaagtgagtcactcagtcgtgtccaactcttagcgaccccatggactgcagcctaccaggctcctccgtccatgggattttccaggcaagagtactggagtgggatgccattgccttctccgatgcacgttgagcacagatggtaataaatatctttaatttatttaaaatatcttaaggtctcttcaaaaaattttcctgtgtccaccaattggcttttatatcttgagacacatttatgttaaatacactctacaaacagctaataaaatatttcacccgcaaataattacagaaggaaacaatacaatcatcagagttcatagatggcagaaactgggaaacatactgcaggtgggaagaaaaataagaaagaaaaagaaaatcagaaatatgactggagacttttctatttgctcacagaaacaaggatgtaagatccatccttctcatggtcctcaagttcgaagcaaccgtccctgttaacaaagagtttgaactgaaacagctgaacaagcaagcaccctatgacctggatttcagctcaccccagttgcttatgatctcatcctttcatttgtttggtcccagaagatgcatgtggagcacacatgccacggcagaggctatacatgcacggcgggctctgtgcctggtgggctctgtgtcaggtgggctccgtgtctgggggg

SEQ ID NO: 46030 - DNA, 2144 bp, Bovine  19866880982309
ggcccaccgctgtgttgatggtaaaatgagcccaagcatctttcatcttcttgaccttgtcagatagcctttccggtccaaagacttttgactcccggggcctgttggcattgggccagtgatacaggatggtctccgggggcctgtagagcttgttggggttcaggtgtccggaagtgtacatgtggacatcatctctgtggtttttctgcagttggttcagaagcgtccgcagattgcacagagtcttaacacctggtgtctcacagtgcttccacctcaggtaaactggtcaggaaagacaagaagaccagtaagtgccactctagttccccaccaaggccataaaagggcctgtgcacctgctgagctggagactacggagaggcaagagggcaggccagcccggctgcagaggagggctggggtaggggcacgtgacgggcaattcccatcatcaagcccggacccgcagagccgagaaggaggaagcagggacttgcctccaacagggaattaatttttaattttaatttatttatttttaaattgaaggataattgctttacagaattatgtggttttctgtcaagatcctggataaggaaggcattcccctcggccagcagaggctcatctttgccggcaagcagccggaatacggccacactcttctgattacagcatccagggggagtcgaccggcagcttgtcctccgtctgaggggcggctgttcgttcttcagtcttctattcatgacgcccaatgatggcatcattctgccctctagccatttaccccaactgaagtttagaaatcaccattctcagcaacagctgaacctgtccaaaatgttgatgaaggttttgttgcatggtaaaaaaaaaaaaaaaaagagtcggtcacttggcccctcccttccccactcagaggaagacagtgacccacagagtgaacccggggcatgttgatgcggaccccagctccctccacaaagggtcccagaagtaagggtccatttggacacttggcccaggacagaagacgacggaaaaagcgagcttttggagtccgtttcctactgcgcgagttcagagatcttacatcatctctctgaagcagtttcttcagcaaaattaggagactcgtcctactcaggacgaggctaattgacaaccagatacaatcgcttttggcagagaggcacctggcaaggaggggccgttccctaaatgctgcctgcgtcatccaaggactgcggcgcagggagcaccgcctaagggcttccgggaggacgtgagcacgcagacgccgcagaggagcgggaggggcccactcccggccggcgagacccgaggcaccctgcccggagacgcgtgcaggcgcccacgagcggacgccacgctgtctgcggcctgccttgtcccccgagctggaggggccccgacgcagggcatccgaccaggcccatctggaccctcaaggctccatcgtgagctcccggaggccgaggctttccccacgtccacacccactgccgccctcggtccgcacggcccgaaggaggaggcccatccggaaggaggccctttcagttccagggagggtgagagcagtggggtgaccagcacgggtccccccacccagtgagtgccagcgtgacttctgaattcagcctttccaccccacctgtcgctcttccctcctcccgagccaagggggccagggcaaggcgtcccgggacgccccccctcctctggccgagacgagttcaggacgcgtccctgacctccgcattatcaccttagagggaagggctgacagcacaaaggggtgaggggtgacagcgactccgctgtccgaaaagccctgcatccagaggcctcacacccgcgtgggtcacctgccccgtggtggcacctcaggctgtgggctggctctccacgctgggatcacaactggcacgtcagggtcgggcctggctggctcctggactccttggggaaatctgtcctgggccctgtcctgttgggacaggatccagctccttgcagctgtaggacagaggtccccacccccttggtggctgctggtggggatctttcctggctcctgggtctgcccatctttcccgatcacatgg

SEQ ID NO: 46031 - DNA, 3119 bp, Bovine  19866881007674
gaattttcctactgagatatcctcattctattactctttacatctctaattaatatctaattgaagctattgtatcctgatcctcgctgacaccgtccccgctttgaactccctggatcagccggggctggaccccagcagccttggtctcccttcttcatgaaatggggaaactttggtggacttatatgatctgacttttgtttttaaaaaatattatctacatttcatgtatattttttctcctgaattgctctggaaggatggaggtaccaggaggctggcaaagtggcaatccacagctgtgccccctttcctgtgtaaggacaggtctgtaagctcaggagtgggtggaaaagtgaaagtgaaaatcactcagtcgtgtccgactctctgtgaccccagggacttcagtccatggaattctccaggccagaatactggggtgggtagagtgggtagtctccgacattgcaggcagattctttaccagctgagccaccagggaagcccaagaatactggagtgggtagcctatcccctctccagcggatcttcccaacccagggatcaaattggggtctcctgcattgcaggtggattctttaccagctgagtggacggaagctgaccttcaaagagccctgaaggtgaatgggggaggggcctcaagagccatctcctcctgcaggagaggtactatcttattcccaagaaatgaaactgttctgataacgactttcaaaacaaaattacaagatctttcttaagttatccgcattcttccttcctgcagtggttcactttgtacatccgtttgcctccccatggtgcccacatgtgtggtccgcacggtgcagggaaggtgtcctttggacgagatgaacactgacgctcacagacgctggtgctcctcttcctgtctgtctctttctccccctcaagtaaccccaatgcttttggttctgcttctatgtagaacacttccccaggatcccttccttgttgttaaaccttgtatttagaccttgctcttcagtatttccagaaaatgtttctgtattatctcttactaagcaacaaccttttgggatttcttttttttttttttttaatttaaactgcaagggtgaaagcacaaatcctcatagcaattttacttgtattccaaaatacagttggtaaaaatggcctccatcccctattcagcttgccttgcagagacagtttgtcttatgctactcactcctcgccaggccccagccccagccatgtcctttgccaaatgagtctcaaaccctctctccgctgtattggatcacggccctcatccacccacaccagcttctccttctttcttcctccctttgtgctaacaggttttgcacataagctcttaccaaaaaataaaattctctttgaatgataaattagcaggcacattcctattcacacgtggtggaaattctatcctagcaacagtcaccaaattaattgtcatccacaaggattgggtctgttttcttctagaaggagatttaaaaccattagccagacttttccagattcttttatgttaaggagttcattaggagataaaagcagggaaacaaatcccactgaaatgatctgtttgaacttctgactttttccaagcgtattttgataacattctgtatgaaaaacatttgaagtgtggagcatgtggtctcttcaggtagctgtggtctcggcgttcagacacaacagcctgtatccgtcagcgcagctgtactttgaacaacctcatccggaagggagaacaaaatgtgaagggataagaaaagagagctgggtgagataatgtagctctacttaaaaactaatttaggcagataaatctcagcccaaataacctgatctttaacaaaagggggagggaaggaggaagcttcaacgttgataaggaaaagaggtgcagagcctccttgagtcctaacaaacctggaggcaggtacagggtcaggaaggctgcctggcaggggcagtctggattttgatgcagcccttacctctcccaggctggaggggctgcctcctcctccttctgacaaaaaccctccagagatgctgtccacgtgaagctggcctctggaagctgtctcagtacaggaatgccaaggaagtacttcacagtctccttaggtacaggctattctgcttcactttggaaaaatatatgtaatacagttggacctatgaaattgctggtactcaaccggttttgccctgtagaaatggtatttcacatggttgagttcaaccctctttcactttaaagacacagggtaacaggatttcttgagtctagtttcaagatacaaaaagaaaagtttgggaagtggcacttctgaaatggtcttcatccacagtcaccatggatatgttagatacggctgggtacctactgtgggtagtgttaagtgttagctaccccactgggtgctaagtcacatcagtcatgtccgactctgtgcgacccatagacagcagcccaccaggctcccccgtccccgggattctccaggcaagaacactggagtgggttgccatttcttctccaatgcatgaaagtgaaaagtgaaagtgaagtcgctcagtcgtgtccgactcttagcaatcccatggactgcagcccaccaggctcctccgtccatgggagtttccaggcaagagtactggagtgggttgccagtgccttctccattgggtagtgggatggaaacaaataattttggatcttgttctttggtttttctcctaaggagtataacacctaactgggagaaatgaaaaaactctaccatgaaatttcttctttaaggtatagggagtaatacgttaattcagatgaccattatatctactactgtgggcaagaatcccttagaagaaatgcagctgccctcatagtcaacaaaagagtctgaaatgcaatacttgggtgcaatctcaaaaacagcagaatgatctctgttcacttccaaggcaaaccattcaatatcacagtaatccaagtctatgccccaatgactaacaccaaaaaagcgaagtgactggttctagaagacctactagaa

SEQ ID NO: 46032 - DNA, 1940 bp, Bovine  19866881055991
cccccacccccagttcggaggccccctctcgctcccctccacacacggctgcgaaaggtacccggccctgaggagccaccggccagcccccctaccccaccccgtacgcgcatcgcaacagttctccaagtaagtcccgagcggaagcggaaggcggccggggttgggatgctgggaagacttccgggaagggagaggcagtcggtgagcgtccagggagcaggctcttgactggctcgagagggaccttttgtgtccatgtcgctgctggctcgaccacagagacctccaggccaggggcttcggggctgaatgtgactgctaccgcttgagcctcttttctttgggaccctgggcccaggcttgcatattttgagaaccttgtaaggtgatgatgccgggccagccaggcacgaggattactagcttgacgagacgcaagagtgtttctccaagtatgaggccagggtcagtggctccagcatcatctgaaaacccccccgacccacagagtcagaagctccggtggtccagcacttggtggtctaacatgcgcctaggggatacaggcttatccctgcccctaggtgcaggcttgagtggtatgaacaccgggccagaccacgaagacccctggacctaattccctctaataccacggatgccccagacttcattttgtctggctctgaaaggagggaaaaagcaaatgaacgccataaaacaattaagcaattaaagctgatttgaaatggaagaagcttatttgggaaggaaataggagtccagctagagcctagatcatattttaaattttgccttgagtaaatggttttcaaagcccttttaattcttaagcaataatcctttgcagaaaagacaggtaaaaattacattgatttttcagtataattaattcttaatcatgtgactgtaggagtccattttgtacaggatagctattgatctaatgataaagaaaaagcctgggtgctggaatatattccagtatgtacactgacaatgagtattggcctctgatgaccgattaagcaggtgggtgatgtagcgccagctgttggtagcggtttcagtgtgttttttccctcttggaagcccccatcagtaatgacactttcttacatctgtagcctattccgacagttcatctgcgtgtctgtccatgctccagccccatgacaactggtccagccttggaatgtctgcccacaccagcatgctgcccatgggtccgaacgctggtcctcctgcaggctccaggtaacgcatgtctggggagtgaggcagagtgtgggaacgtgagtgcctgtgatgtcatcccatcccatccattagcctgtatcctgctcttcacttatgggtgacaggttgttattggtaacttgactactagccagctatgtccggggctccgggttacatgactgctgtgagttcctgcttcacctgtcctctgggagttcagtggtgctttcagggtggatggagctggaatctcatggtagggagcagggaccctctcctggctctgctgtttactggtccatgcgatggacaagcctcctgagcatcgcttcttcaggaaaagggcaccaaacaaccccagcctcagcccatcttcccaggcttgtaggtgtacaggattgtggggtcagtaggtgaatcttgaagacaagtttccagaacctcttttgacaggcactatcaaattaaggaaatacatttgttggatttctgtggatatagaatcagggtgtttcttcacatacaggtaacttgaaaagaatgatgactattttattattaaattgaaaattgtatagagggaggttggcttcaaaaaatcaagctggtcggtcaatgtattatatttcttcataggatttttataataaaaactaaaaggcaaagtgagagcc

SEQ ID NO: 46033 - DNA, 1928 bp, Bovine  19866881067204
ttggagcttagcttcaccgtcagtccttccatgaatattaagggttgatttcctttaagatggactggttggatctatgtgcagctcaagggactctcaagagtcttctccaacaccacagctcaaaagcatcgattcttcggtgctcagctttctttatagtccaactctcatatccatacatgactactggaaaaaccatagctttgactatgcagagctttgttggcaaagtaatgtttctgctttttaatatactgtcacggttagcacggggtgattacagagggctggcctccggagaaaccagaggatttcctctgtggtttcagagaattcattgactgcgttcataatgtaatacttaaatacgtttctgcctcggatgctttgttgaaacgtttagcaatcagagagccgcaagtgggcttttaaggctggatgttgatttgatcaatgacttctgttctttactgtgtaagtgaagtgaagtcgctcagtcgagtccgactcttttcgaccccatggactgtagcacaccaggctcctccatccatgggattttccaggcaagagtactggagtgggttgccatttccttctccaggggatcttcctgacccagggatcgaacctgggtgtcctgcattacaggcagactctttacatctgagccactagggaagcccaagttgctcagtcatatctgacattttgtgatcccatggactgtagcccacgaggctcctctgtccatggcattctccaggctagaatactggagtgggcagcttttcccttttccaggggatcttcccaacccagggatcgaacccaggtctcccacattgcaggcagattctttaccagctgagccacaaggaaagcccttgcaccacccgggaagaccctaaaaaaatcttttttagtctctattaaaagcgcagatactggatacctgaaactaacacaatgttgttaaacaactgtgctccaatataaaataaatttttttttaaatggagatattggtttccactgcatttttcaaactattatttttgtatatgctaacaccaacaattttcatatattaattttgtaatctgctactttattggattttcgtactgtttctagacttctctagtcttctcaggcctgctgttgcaggggtctgggattgaggaatcaatgtggtgaggcgcacacactcaggatttcggcccatttaccatgcacaggattgaggagttggtgcaatgaggctgatgggaacccaaaccaggtattaaatcccagagggaatttaattcatttgggaattcatttgagacataaaaatagacaaaatggtgcactcactcacgctcacaaatgcacaagaagtgcatcagtaagtccaaacaaagtcaccaagttccaagaaaggctcgtggggacgtccctggtggtccggtggctaagactgcgtgctctcaatgcagagggcccaggtttgatccctggtcagggaactagatcccacatgctgcaacgaagagtttgcatgctacaacgaaaagatcttgcattccacaacttagatctatgcagaaagaaggagaggcttctgagtacaggcgagctcacagcgggatgtggtccaggagttgtggactgggtctggcagggaggcacacagacacatccgaccttggaactgcacatccacagttccttaggaaatcctcggccaggtgtgattcagaactcagcttttttttctgtttgttgtgatttttagaaaagtcaagcgatgcacatgaagtgttacatacttctagagtaatcagaccccacttgtaatcaaatgaattgatattttggcagcaaaatatcaactattacaggaggagaatggagaaagactctaaatgacctcaaga

SEQ ID NO: 46034 - DNA, 1216 bp, Bovine  19866881073920
atggggaaaaagtggaaacagtgacaaattttactttcttgggctccaaaaatcattgaagaccatgactgcagcacaaaattaaaatgctgctccttgcctgaacatctgtgacaaaactagacagcatattaaaaagcagagacattactttgccaacaaaggtccatctagtcaaagctatggtttttccagtggtcatgtatggatgtgagagttggaccataaagatgatgaggtatatgacaggaatggtattttgtctatctgtgtgggtttgtagcttttttttgtgtttatgttattaatctctcacacttctccagatctacgaaaaggtacatttcctgttcagtgaaacctgtgctcaaaacctaattgtcaggaatttttgctgttgatcaaatctcattgatttctgtcccctcttaatgtcggcacactggtgcattcggaggtttgatggtaaggacagaagcgcctctgaggggtctgagtggtgacaggataacgtatgtcacctttgtgtgaactcgtctgggagggagcactggacagggaagccttcctgccgccagctctccctggagcgctctcagccaggcccccagcagacaggctgtggggatggtggctgactcatagtttacgcgggttctcctgggtctttgctcgctctctttcctgaccccacgctactctccctttctttaaaggagcacatgcgggttcctccagagctgttggcattgtgtgcccctgttcagctggcagtgggtatcgctcaaggaccacagccaacaacgcccacagtgtttgctggcccagagcctgagaacttgagcccgttcccaaacgtatacagaatttctctgttagggacaactcaccgtcgtgtgtgatgctgccgcagctgggtttaccccctccttggtgaacacgtgtgaatacgtttgggggtgtgtgcagctgcctgggaaaatgtgtggagaaaggaaatgcttagaagctgtgttccccatggtttgacaactccagtagctgattgttgcttccattcttcctggcaagctgactttctgacttgcgaagtcacatccttactgctgagggactggccacctccacttcttctcagagaatctcagggggtgtgcaaagaagcagagacaggctggctgtccccggtcagcttctcagccccacgctgtccacg

SEQ ID NO: 46035 - DNA, 1263 bp, Bovine  19866881210937
cttatttcttataatatgtttggaggtaattgggatgaagactgcttttttcttttacgtttagaaaagctagaattcattgagaataaatgatgaaaatgggaaatatttgtgaatcacagacttagcagtgatgggacctttgggaggtggtcccaccgtttttgcagttgaggagactgaataactgctggaattaagaggagatgctcttgggttctaggtgtatgctttaatgaaattctgctggtttccatggcaggtgacaataatagcaatggaaatagtcagtgtttgttgagtgcctagtatacagtaacttatgctaaactctttttgtatttgttcatcttgtcctcttgtccttattagcaagctgagaggtattatttacaccatttttccctataaagaaattggggcttagataaattaagtaatctctttcagattaaacgtctagtgaagagtacagtgtggacctcaggctttgggtggtgttcattcactaagtcgtgtccaactctttgcgaccccatggactgcagcatgtcaggcttccccgtcctttactatctcctggagtttgctcagactcatgtccattgagtcgggtgatgttatccaaatatctcatcctctgttgccctcttctcttaccgccctcaatctttcccagcatcaggatcttttccagtgatttggctcttcacattaggtggccaaagtactggagcttcagcttcagcatccgtccttccaatgaatagccaaggtggatttcctttagaattgactagtctgctctccttgctgtccaagagactctcagaagtcttctctaacacaacaattataaggccttagcaagaattttattttaaagtttgatttatcttgtccccattcaatttggcatggagaccatggttgagtgcctggctgaaaagctctgtataaagtttagacaatgaactggaaaccctagcagacagtctgaaggcttttgcaaattaagatcaaatcaccatgcaattgttttgttctgcaagctagctgaatttaaaaaaatattacacccatacttttattgtttattggtcatgtggcaaacgcttcctgccggcaacttgtccaggctggatttttttcacagcccagcagatgaagcccccagacccgccgctctgcggtgatcctgccaagggacttcaggagatttaaatacaaatgcagagagcgacaaacaagtggaaataaatg

SEQ ID NO: 46036 - DNA, 1473 bp, Bovine  19866881267919
ctgaatctgaagctccatactttggccccctgacgggaagagccagggcattgttcgaagagaccctgatgctgggaaagattgaaggcaggaggagaaggggacgacagaggataagatggttggatggcatcaccaactcagtggatatgagtttgagcaaactctgggaggtagtggaggactgaggagcctggcgtgctgcagtccacgcagttgcaaagagtcggacacgactgagcggctgaacaacagcagcaagaggaaagacataaaatcacatggttcaaagatctccccacctgacctaacctcgtctggaacaaaatgtggggaaattcaatcccaaatgtgctcttgaaaataatggagactgtggggttaagcaaataggatatgaaaacactgagtcaaaattattccgtgcagtggcaagatttcagggtgagggaggcttttagctggtgaacgtcgcaactgcttgagtcagtatacgcaataggaaattcttctagaggtcacctgaaacactcgcaagagagggagcatctgttgtgtgaccaggtcactttttagttcaagtagttctatttcggggacctgatatgcttgatgccatttcaattttagcattcacccttggcgtcatccccttgaggaaaaatcgtgacagctgtgtcatgcagctgacaccaactggcttccatgccttcccttgacatcctgacctttgcatccacagccggcaaacagtgatgctttagtcaacatgcatttgctgcctttttttttttttccccttgcacatagtacacatgggaaatgggcttcccggagggctcaacagtaaagaatccgcttgcaacgctagaggcacagaagacactggactcggaccctgagtcgggaagaccccctgtgggaggaaatggcagccccctccagtgttcttgcttgaaaaatcccatggacagaggagcctgtcgggctgcagtccagagggttgcaaagagtcggacacaactgagcagctgaacatgcattcacgggtgagaaatattaataactggcccataaaaattcatttctgtcttattcctaaacctaaaaagtgtccagtgcctttatcttccagtgttgctgtattagtatacattcaatgcttaatgtattacagcagatgagacaatggtatggggaaaaaattaactaattgatagagatttcagcttggcttccagtattctaagaccttaactcatacagacatttcatttttctgaactggacattctgcagagataaatgaagacagatggcatcacccagaagctggttatcctggtgaaggatctcaggaaatcacagctgtaagcaaacgtgaccctttgacaccttacatgtagacaggttttggaagagaggggcggcagcatgttagcacagctgcgtctctgataggaatgctgacag

SEQ ID NO: 46037 - DNA, 1422 bp, Bovine  19866881293020
cacagctgatgggctgtggactcccctggtttcgggctggagctgtcctcagagaaagctttggatttcactctggcagagacaaacgggcaagtcagaccccaaagggaatgagcgctgtgggcgcgtgcccagcacagggaatgggtttttaaaaagcagcagcacaggtggtctctgcagagagatctcacttgtgatcacttgtaaggctccacggttattgcttatcccgttaccaggctgaatggaggtgccaatttagtcttggcataagcaccccatcacagatgggatttggcttcggggcacagtcaaagagggtctctgtgtgtgtgtacatacatgtgtgcatgtgcatatgtgttcggtgtcgctgggaggcagggggagtttaaccacatacaacttctttctgagtgtacagtcgcagtcggcccattaaatcagtgagtgaggaaggagacttgcaaaacctcttaggtctgcatttgtagacaattaacttaggaagcctctgtgcatgacaagcaacaaaccagacttggaatcgtgctgtacaatagaacaagtggatacgctagttagagtgtagttatatccattttactgtactttaaaagggatttgtgacaagtctaaacattttcctagctacgcatttagtaaaactttttcagaaatttggaactgcttcttagaacagtttaaattatattcaaataaatgaataggtctatttaaataaaaaatgttaaagaccattgtctttgctgaaatacgtaatttgaggaattcaataaagaagatggctttaataaccacctgaggagtaatcatgaacaaaaaaccaagagaaaggaatattattttttaattgaataaaaaccaaagattctactttcttaacagaaaaatattaaatgccacataaacacagtaatctgcctggaggcagtgtttcaaacagtaacattcaaaataactgcaaatatctcaagctaagggttatcattattgtaagcatctcagcataattcgagccattcccatgacctctagaagtccctcagtgtttattctttactttttctacaaatttcagatgcataattctctctatattctatctataggtagacacgttcatgtggtaaattcaaaatctctcattcacctgggataacacgtggtgcacgttaccaaaagaacctcatattctaccctcgggtgcacgttaccaaaagaacctcatattctaccctcgggttacggtgaatcgtgggaaatgaatctcatacgcttaccccatgcactttatcatatcagcaaatgaacaaatcagttcactgggtttgattctgacacagaacacacacacacacacaaaccccgcacacacatccctcgaaacaaagttct

SEQ ID NO: 46038 - DNA, 1449 bp, Bovine  19866881406693
ggctgatgctggaactggaactccatactttggtcacctgatgggaagggctgactgattggaaaagaccctgatgatgggaaagattgaatgcaggaggggaaggggatgacagaggatgagatggttggatggaatcaccaactcaatggacataagtttgagcaagctccaggagctggtgaaggacgggaagcctggcatggggtccatggggtcacaacgaatcggacacgactgagcaacagaacaagaacaacaaacttcctagagatgaatgctccagggatggagactggtcaccatatcctgcttttaagccttacatttgggaatggacagtaacagacccttcaagcagcctgatttcaactcagctctgatatgatgctcactttcagcaggaaatgacaacaaacttaaaactccatcaagatgcatttaaaattacatatggatagctttagaagtgtctgtgtacatttatgctcagtggataagagtttatattataattaggaagctttagtagaaaaatatgggcttcagaagtgagctagctgggtgtttttctcacatggcccacttaagactcatgtggctgcacgcatattcctttgactctccatgagtgattttcctcctgtgtagaatggacaccatgaaacttgccagaatttctgtgtggcctgagctcatgtgtgcaaaactcatgcatggctctcaactgttacctgggagatacgtgtttctattaccttaatttctttcaagatatcaccaaataccaaagaacttttgcaaatatcttcaaagacttctccaaagacctggagtctgttgaactcttcagggtcacagacacatattttctggagctcctggaggaaaagagaaccaccctgcttcaggatgacttcattttcctttctggtttagtttctcgggcggggcattctgtcagctgggtagcaaaccacttggtgctgaggctctatgatcgtctgacttcatttattcccttgcatcctgtaagtcaagggaacaaacagtgcctctctgcctccacagtgtttccaaggtccttctctttccaccagtcctctcagccaaagctctcatctgctgctgctgctaagtcgcttcagtcgtgtccgactctgtgtgaccccagagacggaagcccaccaggctcccccgtcccttgggattctccaggcaggaacactggagtgggttgccatttccttctccagtgaatgaaagtgaaaagtgaaagggaagtcgctcagtcgtgtccgcctcttagcgaccccatagactacagcccaccaggctcctccgtccatgggattctccaggcaagagtactgcagtggggtgccattgccttctccatccacaggtgcagaacctcacaaataagtggctgccacaaggcccgttaag

SEQ ID NO: 46039 - DNA, 1110 bp, Bovine  19866881793488
ctcagtaatttgttttcttcttaaaaagtgtttccgaactttaactggttgtgagttgaaaccgtaacataaaagagaagtttcatgaataaactgaactttgaattgtgtgtgggaagaaagatgagagcagatgtttaccacataaagcagacatctctgtgattgatgtcaatgaatcattttcccaattcatcagaaactcctgttatttttaacaaataatgtgcagtagtctagtctatggttctttttccactgaacctatttctaaaaatttgatttttttaaaataacttgaatgcttttttatttcttccttgagtcagcttagtcattatgactactgttaccaatctcctttagtttaaatggtttaactttagaaatatttttggaaatgtactgttaccacaaaaatattggataggtcatcatgagtttgtttgaaataatgaaaaaactaacttatgccctgccactgcctggcatctggactgatttccagccctgtggccagtctccttgctggtgttaggaggtaaagggccttatccaggccacctgcagcgctctcagctgcagtgaccagcagctcgggggtcaggtgcacgccccgatgcatgaagctcttcttgaaaaggtagggtcggctgagatgtcaaactttgaaccttttctttgttttcggttttcatgtagtttttcatctctagcctctaaaaaatttgtgctaataaaagttttcatagatttatacaacattagagcagaaattaattttagagactcatctcaacactggatgttatagattataaatgtatgtataatcaccttaatatatttaatgttatacagtgatatttgatgaaagttttcattcatcttcctgtgaaaataaataatgagtataatcttttttcatcttattaatttgaacatcccagtcaaattcttatgtcaaaattcgtaagaattgacatgggggcatgggaggtacaaaccttggagtataagatagccttctaaggatgtgttttattacaatatggaaaatacaaccaacattttgtaataactttgaattgaaagtaaatcttaagtatt

SEQ ID NO: 46040 - DNA, 876 bp, Bovine  19866882105237
cttattatttcttactgtttttttttttcctgtgttgaattaatatttatattttttatcttttctcttctttagttatttttgttctacttttgagagtttttcaattttttccctgaaattctccactgatttttacagtttttaatgttctgttttttcaagaattctttactgttctccagttgttcattttatagcattccttttaccatgaatgtaatatattttcttctctctctgagaatattatagtgttaagaacttttttcctccttgtggtctctttccaaggttcttttaactgctcgtgattttagcctcagtcttccatgttggaaactttccttgactattgcattatccttcataatcctttcctacttaagaatgacacctgaaaagcaaattggcagctccagtgaagtgagagggatgtcagagattgtggtctggtgagctctctgtagagtgactgtatggggcgatctcgggtgtcagtaccggcaggtcttgtttctggcacggtctgttctggggaagaggccttctatctcctgtcagggcagggtgggtgcaggagtagacactggaagcgcacattccagcagctgcgtgggaagaggcagctggggcagtggcggggcgccctgcattcagaaatgctgcttcttaactgtgttcctgtcggtctagagcctcagctctgccctcctctgtgtgcagcgttctccatcctctccccagtgtgtctgatttcagagtctctctgctttagtttgtcccaagaataaatcctttgcttcttctagggatgggggaaagtgtctgcaggtctggactctcgatgtaaggctttcaaaccaacccccttgt

SEQ ID NO: 46041 - DNA, 1004 bp, Bovine  19866880411632
gatcttcctgacccgggtatggaacccgtgtttcctgtgtctcctgcattggtgggcagattcttcaccacttttgccacctgggaagcaatcattaaggttacttcccttgatggatgtcacactgtctctgagtgctgaacccaggattctgacctaggattgtccgactctgacatcttgcaggatctaacattcacgtcagaagtgttcaagtcataatgtttcagagagcggaaaatttacttttctccttctgggtaaaattaggtccccattattctggggaatcccttcctgataagcattttcacaatatccatagcaataatatttacatttgtcaattgcttccatttttaagatgctcttgctgatatgatagcacattaaggggctgtgttttgctcaaggatctctgaatctagtctttcacagacttacactctagtttccttctttatgcagggtagagctgtctcctggactcttgtacactcgttgttctcaaataggctggccctccacttctcttccatttaaacccaattaaccagcctgttttccaaatggactctgctgggaggaggaggaagggcaagaggctcagcttgcaattcagaagcatcatcttcattcattggcaaagaaaagcctggggtcttaatggaacataaagaattctacagatgaatccttcagtttcctgtcaaaggcccagattgagaaattcagagttactcagcttgtggtcttttattttaagtaacagtgggataaaacaggccacggtggcagccgaggactccatttagcttcctaaatggatgctacatctggctacttcacccccttcaatttcaaatgcaatttgtcttgaagcctccaatttaaatcacatagatcttctctaagagaaataataggcttcccatggaaaggcttgtgtgtgtgtggtggtggtggtggtggtggcaatggattggggatgatgagaagaggtg

SEQ ID NO: 46042 - DNA, 2141 bp, Bovine  19866880742203
atactggagtgggttgtcatttccttatctaggggatctttccgacccagggatcaaatccaggtttgatcaggaaaggagctgagggtcaaaggattttgggagactcagggtgtcttttctccagatgattgggtaccttctacctatctacccaaatctgggatggcaaccaaccagaaccaatcaatccaaatgatgcacatgccttagaagtctgcacattgactcatcatcttatttatttatttaattcagttttataattagagatcagtaaaaattcatgtactgcatcgtgaagtattaaatagctaccaaagttttaaaaagcatcactggtcattcaaagagggtagctctctacatttcatcataatgagtgtgatctgtgctctggggcaaccagaatttgggtctggaatgtctctttcagaatagctttttttttttttttttttctgaaatcaatcgaagcctgaagaaggtggcaggctgcaaagcttcttcttaatttaatcatttgtttttcattcattccctgatctaatgattctactgagaactagagggagcacaatgaaacagactcttgtgactgccctcctgcgggtctcccaggattgtagactgcacaagtgtgtcacatttgcccttctctatgtatcccaccagctccatgccctcccctctcttcccacaggaacctacaccaacgcacacactgagatgccgcccgtcactgtgcgttcatgccccctccctgtacagacccgccgtgtcccacgtgatgtcctgccttggctgtttccaggtctctgccagagagctgcacggatgggcagtggggactgtaggtgagacctgctctgggtcaggcccacctgctgtctgtgctgtgcttggcaagggactcatacattctgaacctcattgacaaaacgggtgtattaacacccacctcgcagggttattgtgagtgtttaaacggaataatgtgtgtcaagcagagttgtgattgtggcttacctatgcattgtcccaatctcttctgcttccttagtaacagaaccctatattttaattttttgtaacctttaagaaacatttatctatttgtttggttgtgtcccaccttagctgtggcatgagggatctttagttgcagaatatgggatctagttccctgatcagggattgaaaccaggaccctgcattgggagcacggagtcttattaaccactggactgccaggaaagccctcagaaccctatattattaaaggtagttcttgcttggctgaaaactttttttttttttcaatctctgttgcaatggggcagccaatgagattgaagcagaagtcactgggtgggaacttcagaaaatcttcttgaagggtcctttcaccttctcccccactctacattctctttctttctgtctgaaatatggatgtgatggctggagctcctgcagccatttctgactatgggatgaccttgaggataaaagccacctcattaaagatactgggatagaaacactggagaaaggcattgatttttttgagcctcagtttcttatctgtaaaacaggagcaataaatatggtatgtgttactagatactaggagtgcagtgcctagtacagcagctgacatggagcaggtcctcaactaaatgcagtctgtgctttttttttctcctttctcatcagggtttacaggaactgcagacagttttcctacttggatatattaactgcagaaggggtgaccttcacatggccacagtctgtcataccaaactgatgagtagagccaaaattggctcagagattcccttctctatctagtgtggccagaaatccttagaggcagctgtctgaatatgctttctctgtaggctggttgctaatctcttttccttgagaactctgccttagtatcttgccttcctgcggggaggtgtcagttgcaggagaagtcagtttgacaatagatgtgctaagaacggcatctctaaatcctgtgagtacagcttgggtccttgtcactcaggcccccaggagtttcttctcattccttaagccaaatggatggcaccggggagagagagaaatctttgatgtagaaggca

SEQ ID NO: 46043 - DNA, 683 bp, Bovine  19866881082453
tttcttgcatggagaatcccatggacagaggagcctggcaggctacggcccatggggtcgcaaagagtcagacacgactgagcatgcacacacacgctcacccatttatgaattggaatagtaacggtccttataacaaggcacccacagttgttttgagacttagatgattcttatagaaaaaaaaatttttttttcagtaaaatgttgaatataggacctaacctagggtaagtgctccatactgtttcctttgagtaaatttggaaaaaaccaactcggcatctcacgctagcctctaaaataagctagagctagtcctgctctcagtgctacgtgtttaaaaatatttcaaatgaaaggcagcctggtgggagggaggggatgggagaggactgaggtatctgggaaggaacgacatcacagatggcccatcagaaacttcagagtgtcgcatccagaggtacctgccagctcatccagggacgagtcttctatgaggaccagatgctactaattggcgaggaatcctgtggctgccacccagagaagagaacaaattctttgtcaacacatggttgtttttttttacccccttccaaatggaatgcattaactctttccaacaggcataccagacttcagtctccaaaacccgtgtccacatttaggaaattcttaag

SEQ ID NO: 46044 - DNA, 1000 bp, Bovine  19866881120055
aaatgagtctctaaagactcatctagagagagactggagttgtcagctgttgccccttccttaatataaagagcagaggcagagctttagaggggctttgagtgcgtcccgggaggagtgtcaagatcaagcacctgtgttcctgagggacagtggactgggccagttttccgtttaggaagcagagagggaaatctagggggtaaaatatcagagaatcagagaaccctgcccctgacctctctggatgaaatctttctaacagaggatggaagatttccttccataatgagcattgattctcaaatgcaaatccactggggacagaaggcacatgaacctcaattctctttaaagtacggatgactggcattggggtctttctgaaaagcagggtttcagtacaccgagttcttggcgcaaatcagtggaggaagtgagaaaactcaagtgcagaaagaggaggtcattgcctaatgacattcacaattttccaacattcaaaattttgcacattcacaatttggctggaagtcagtcttccatgttggtccaataacaattcctgaataagatgttctgtccctgtagggttttccagaccttacactcacccctttctctccacccagagatcactagccactgggagtcaaaatagctgctggacttgtgctgagaaaatgcccaggcgcctgcaaaacagagcacaatggaacctcccacctcaagaccatcaaaggaaggctcgtccacggatgtgctgtggcctgaagaccccacagccaatttttcccacggtcagccgagtgatgaggtccactgaggccagccggcaccaataggcacggagggccagaggagaaagcacttccgagaacttgcgggctcaataaacatcagccagtggattccaggctctgacccataacacaagcctctctcctcccatggaaaggagtaaaaacacaggaaaagcagaaatcctctctctctctta

SEQ ID NO: 46045 - DNA, 736 bp, Bovine  19866881473858
tcagatcaccaggcattagatcccagaggtgggaccactgtgatctttggcaggaccactgatgatacaggctccacatgggacatccactgaaggtcccatttaggactggggatctcagtgttcccactctgcccgttcctcctgttacatcatgtttcttcacatctctctctcccttccaaactgttatctgtttcaaagacaaggtctggtccttgtcccctctacttgggactcctggaacccagtaaagggcccgagacacagtagagatttgctcaacaagtcacataaatacgacctggacctcaattccattttcagtatttcccacttcctcaattcccacacctctgattagcaccatctgctcccatctcatcaaattattttccatctcttgaatacatcatgccctcccacacattcaggccttcctacacacctttctgtctagcatcccctgcatggaacaggccaaaccccataaaaggagaatattatagagcagaggtcatcaaaactacagcctgtgacaccagcccactgcctgttttcatcaataacattttattagaatacatccgggcctgttgtttacatattgtctaaggaggcttctgtgctgcactggccaagctgagtagttactctagagactgtatggcctgtcaagcccagaatagtcactttctgggccttttgctgaacatgctgctaagcctcgtttcag

SEQ ID NO: 46046 - DNA, 1438 bp, Bovine  19866881652762
tccccgtgcttacctgtggtctctcttgtttactttcctgccaggcccctcttatttccacacacgggttcaagagagaagggagacattttcctctgaatcacctctgccgccgggaggcaggtggtggctttcttccaaggatttttcttcctagtctcataaacttctttaccgtggtgagggagaggctatcagaagtctgtttatctgcagagctgagagccgaagagctactcttatttataggatcctgagagtgtccgtgatattgggtaagaaatcacactgcagcaaacctgctgacacctgagcgtcaagaaatctgtctctactaggttagcccgagggcagcagaaagtcaagacaggctggcatcagacgccagtgctgtccctccccgtttgtgatctgggataagtgacctccctgagcctcagtttcttcatctctaagatgagaaagacaagaccccatcaaagggctgctgggagggttacaggtgaggatgtatttgaggcacgcagcctccagctcacagcctccctcccgtccctgctgccacccgctgctccgtgctctgctgggtctgtgaagcttggctcttgctccgctgttactgtccagtctggaggactatactcttcttttccggagaccttgactttgaatttatgatgccttcactggtactgtgcctgcctcttgggatgtaggtgggatgtgatcccaggccagagaaggtgtcagggattgagagtgagtttggctgggtttaggtggcctggcttaagcaagaacactgtgccagggcctggcttgcctggagacaaggtaggactgtcagagaagccgccgagaatcatcattagttgggccttctgtctgaaccaggtggatgagctcactgacttcagactttgatctccagacgtcagtgttagcccgagacccaccccaaagcgggaggggccctggctgcaaagagagacctgtttcatcaccccccctcccaccacgtccctcttcgaacgaagctctgtgcacaggttttatgaaaacatgactacagtgtgagtcaggtcatcccgcctgtaagcctctgccgactccagcgataaagaattcgggccttatttatagggcagcctggagaatctgacaggaggaattgagcttgctgccagggtgcgaaatgagatttcccagaaagacgttccctgggctgaaggggcctctggggacagcggaggagataggcaaggtgaatcagacggaatgatctgggcggcagcccaccaaggccgggcctccctcctcctacaggggattggcagcagagatgtctccaggccctgggccttagcatcttcccacgggagccaggcaaaggtcagaacgctcagatgccctacaagtccatgtaaccaagcgtgtt

SEQ ID NO: 46047 - DNA, 861 bp, Bovine  19866880385802
ctgcccttccttctggcatccaggcatccctcagctcatcactaatgttgtgcccactggacctaggaatgtggttacaatttattgtccaagctggggtgctttaaaggatgctataattaggctggaacagcaggcataaatggggatggtgcttagtcactcagttgtgtctgaccctttggactgtagcccaccaggctcctctgttcatgggatttttcaggcaagaatactgcagtaggttgccatgccctcctccaggggatcttccagacccagggattgaacctgtgtctcctgcttcccaggcggattctctacccactgagccatcggggaagtccattaaatggggattggttcagggtaaactaagacgcttctgctgtacctgggggcaaggggatgctttcatgctcctttggaagcagaggtggcacaatgcacattgccctaccctggcttctgcagtcccctcctttcaccaggagtcatctgaggtccctgagagccccgctggcctgccacatgcctggtgccagagggcatgatgagtttgattccgcaacatctcaaataaccactgccccttctgctcagcatgcagcctccatgcccagatcaccttgaaggatctgtttaactccctctacccggagggactggccttctctgcagcctttgagcacacctgggttgaggaaatgattctttttcccagaatgggctctatttgcattccaccagcaatcttcttactcagagggattccaaagacattaaattaacagaaaatgacattagcgctaagaaccaaactcgattatctgaaatacgagtatttattgtaaggactca

SEQ ID NO: 46048 - DNA, 931 bp, Bovine  19866880439405
atgggtcaccaactggaaaattcactccaccactccagaggtgggaggtgtaaagaggatgggggaagggaagtcccaattaaggaactgggcaggggtcagaggggggttccctccaacagggttcagtcctcctctccctcttgtctaccagccccttgcctcctgctaaaaaggaaaccgtgacactaagttatgtgagtggagtgtagagaaggagattctgtctacattaagccagcagcacaatccatcaatttcaggcacatcaaacagaccaactgaaaacaaaagactttgcactggatttctgcatttcccatgtacgcaaataatacgagaggagacaagcaatgcccgagcatctcaatcttcctccttccagatcctaacagaagctgacactctgcagggcaacttctcaaataaacagccagggatggacaagaagcaaatgctttgtgcaaacaccaataattctcattctatcctcttatgtattgacatgttctagctgtaatctttaaaaaaaaaaaaaaaaactttctcctttgggagaaggtaaagtggctcagaaggcaattccagtgacagagagagcagaggagaaagaagggtgacatggaaggtggtagcctggtggtggcctcatctgggaacccatcccagatctcccatgcatgaccaataacctctcctttttactccttccacacgctgaattatacatggtgtctctctgttcacatggtccaccctccttaagggtagaggcagcttcctacaggtagaggctgcatttttctcacctgtacctggctcattaaacatgaggcatttaatagcgtgaagtaggattggatggggcttcccaggtggcactagtggtaaagaaccctgccaatgcaggagacgtaaagagatgcgaatt

SEQ ID NO: 46049 - DNA, 1319 bp, Bovine  19866880506840
ctagtaaggcatatacgtcgatcccaatctctcaattcatcctatccctcctttccctgttggtgtctgtctataattttgttctctacatctgtgtctccatttctcttttgcaaataattcatctgtaccatttttttctagattatgcatatacagaggtgaaaaatttgtaaagtaagatccaaaatcaaataccagcagatgatacaaatgagtgagggtgagaggttgcaatgagtagggagtggcgggaacgctggagaaacgacaatacacacaggttctctagagagggcacttcttgcttgctgtggccatgcaaagtttctagagcttgtcttttttaaagacaactaaaaaatctggaactttatgtaaaatatactaaaatttaaatgttggaaactaaatttaaaaaaatatatatattgaaagctaaataaacttgtcatgaagccatcaatttacaaccaaccaatgcattaaaagctcatctctatccccaaaagaagtctgtagaagaactccatctactgtgcactttatttctgttattattacatcacctccgtttcagatcatcaggcattagatcctggaggttggggacccctgatctagagaacaatttcatgtcaggcaaggtgaagaaataaaactgtagacttgcctttggctggctgccaagaacatggagcctgagtacaaaaatcaaggacagagtgtttagtcggaggcctcaatgccttattcataactatgttcatctggctggtatctgggaaggtcctggctctcatctacttgtcactttcttgtactgtccaatttgacagcatattttccagttttcccttctcagatactcccaaggcctgaaatgagtagataagtagaggagaaaactgggagaagttagggagactgggtgtctgggaggaagaaactggctggaaatcactgccttaggaagatgagcaggaagttgttattctcagggtctctgtttgtagctcctccctcttatctgcccaccatactcttcctaaccctaaccctatccctatccctaaccctaaccctggtatagacactaatgccagctctggagaaaagctgaagctggttcaactgtctcagaaatttgagtaaatcaaaagatgagagccaggtgtgtccaacaggaaagaacctcttcttttgtttccacatccttgtgctcagaagtggaagctgggtgcatgccacaaagggcaggaaagaggatttcttccccaaagagccctatttccttctccaaagccctcttcaactag

SEQ ID NO: 46050 - DNA, 1548 bp, Bovine  19866880725084
ctcctcctcctcctcctcctcctaccaagtcacttcagtcgtgtccgactctgtgcgaccccataggcagcagcccaccaggctcccccatccctgggattctccaggcaagaacactggagtgggttgccatttccttctccaactgacatctcctagggatgctgaaaatgcagtgtatttgaaaggactggtccatgcttgctgctcagtcctgtccgactctatgtgaccccatggacagtagccagctaggctcctctgtctgtgggattttacaggcaagaaatactggagggggttgccatgccctccttcaggggatctttccagctcaggaatcaaacctgtttctcttgtatctccttcattggcaggcagattctttaccactgcacccacttatttgtctaacatttatacttccccttagttactttcttgctagaaataaatggtggtattctcaggtactgaaagaaatgtttttacaatggaaatatcaatttatttccatgatggaaaattgactatgttattgatcaatgtgttccatctgcctaagtcttcctaattataaatttgaaaggtacacccagtagcatagtaactgtcaaataattattgatgggaagctgttgttatatgtcttgatatgggttcctctaaagacggcctaacacagaaggagatggcaaattaaatatgtttcatttactaagtaaaatgttttgttttttttttttgtctgattctgtctcttaagagctgattaacaaaataatcctgtgaattgttgacttctcaagagacactggaggtcacccaggacaattcctgaaccatgtttacaaaattgatatctcacagcccagattaatgctcttttaatttaaagaattgattggtttatggagctctttatttttgttatctggtcagagattcttataatccccagtccatttcactttatgaacaatagttgtctcacttaaacatgttaacatctccaataaatacattccaatattatccaaacagattgttacatgaggttgttgttgtttttagcattttgcacactttatatgcaataaaggatcccagagatgattccttattttgatttcccttctaatttggcaaggatgaaagctttagcctgtcacaggccaagactgtgtcaaatggggtgaacttctaatgaatatacactactgagactaacaaacttaattacaccacaggcctcttctgaaatggacacttccaattccatacaccacaaatattggccccgaatcaaggatgaagtctgagccgatgtttttattgcatttcagataatagaggagaagttgcattgaagatgagagagaaaggagaacacctccagataggcatgtgcctaatatacatgtcagggctgagggtgaggaaccgattgcctctgagcaatctcatgagcaaaggagccaaatttataacatcaaaatattgtctttcccatcaaacactcagcattttaatgcccatggagtctga

SEQ ID NO: 46051 - DNA, 2843 bp, Bovine  19866880766028
tggactccggggagttggtgatagacagggaggcctggcgtgttgcggttcatgggggtcgtaaaccagtcggacgtgactgagcaactgaactgaactgaacctgatgcctaccttatgggatcactatggtgatcaaatgagataagataagtgacatggggagaatattattacttattagtcaagacttatcactattaaagttctgaaggatgagttcaagctcgttcaaccatgtttaagtcttcatggttcattatttaatttgaagtgaattcccataatataagctctctccatattcaaatataaatatgaaatccattttgctgtcaaatatatgatgatatggaaggcaattcatgcctttggttaccttcaatggtgtgcagaattgctagtgactatgtcatattctcctttagttgaaaaacatctcttccacactcggccttgttttttggctacataatccctttcagaggcttttaaaaataaattacccagcaaaaaaatgcatctagtaaatacaagattccaacaaagaagaatctaatacctggaataaagacagaattaattcagaataattgcataaatctcccatttaaaatcttcagcatcaggtttacatttagccacaatattaagtagttggaccatgttcaacttgtttttgtagtgaaatctccttggtaaattcaattttttctaagaggtcctccttgttcacatgatacaaagcacaaatatattcaaaatggataaccaacaaggacttggtgtatagcacagggaactctgcttagtgttatgtggccacctggatgggaggggagtttgggggagaatgcgtgcatgcaaagttgctccagtggagtccaactctttgcagtcccatagactgtagcctaccaggctcctctgtctatgggcttctccaggcaagaatactggagttgacttgccttccaccagtggatcttcctgaccttgcgatcgaacccatgtctcttatatctcccgcattgtcaggcagtttcttaagcactagcaccacctgtttcctgcccatgggggagacaagtgtgaaagtcaaagtgttagctgctcagccatgtccgaccctttgcagccccatggactgtagtctgccaggctcctctgtccatgggagaatggatacatgtatacgtatgactgagtccctttgctgtccacctgaaactatcatagcactgttaatcggctctacatcaaatataaaataaaaagttaaaacaaacaaaagaaaaagcacaaaataactagaggccattgttaaaattaactgcacattgtgcagaattagaatatttagtagtgttgagtgctttgccatttgttacatggaggagcaataagtaggtcaagccaatgacaagaaacgtcacatcagttcagagcttctcaaacaggcatgtgtatttctcagcatctctttagctcctgccttgaacattgcctgttatcattattttttcttagtgaacttttctgactttaggtcagtctgtgcctttgcctagaattaaaaaagacagtttaccaatatgatttcccaggaactggtaaattctaaaccattgtttctggggagctgctaggtagaaaagtgagactaagacagatgactgaaagaggaacgtatttctgacttgtctagattctaaatgatcctgaaacatgagccatatggctgaggcctcaaagacaggaagtggtcaaactgggatttttagctcaagtctgactctaaacattgttcttttctacagaaacagtactgtctcttatgggggaaaaaaatcacataatgcttataaaggattcagatggaaaggagtgacaaccagaaatgttaccaaaaaaaaaaaaaaaagccatttcatacagtggtttgaaatattctgtctccatttgatacagggatttgtatggtcttcatgacctatcatgtcagtgataaaaataaccattggcccaattgcttagaacttgaaatatatcagagaaaggcaatcaatcagtcaaatatttttcaagtgtcttctgtttgctcaacactatactctactctgtgggacatgacagctcacacatcaaagttctttggcaagcaagaagtgaatgtgaagtagtattattagaggaaaactacatgcagtggtccaacttcaaagaacttaaaatcttaatgtggaagaggatgtttgcatgtaacaatagatcttcatcatcataaacagcacagaaaatgtattcagttggtgattagaacagggatgggccaacttttttctgcagagtgtgagatagaaaatattttaggctttgtgggacatctggtctctgctgtagcaactcaacttggtcattgtagtgtgaaagcagccatagatgataaagtaagtgaatgagcttggctgcatttcaataaaactttatttacaagcacagatagcctgctgtttttgatccactggttgtgctttgctaactctgtttagactgaatgtgagagagggttgcagaagaatcgatcactgtggaacaatcagggaagctttagttataactactttttattcagggttgacccttccgcctggcactctatgaatcacagttcattgaattttgagattcccaatgtaaattgcccaacatcacacaatttagtaaaaagcttaaatccaggtctgtgtgtgctgtgtgctcggtagattcagtcgtgtctgactctttgtgagtccatgaatggtagcccgccaggctcctctgtccattggattctccag

SEQ ID NO: 46052 - DNA, 1635 bp, Bovine  19866880781039
ggacttggcatccagaacctcctaagtgatgatctgattcaatttgtgtgtgctgaaatctctctggagtgctggcatttcacaccgtgatatccatcattgaaaatggatagatagaactgggtgctcattaatggaggcagggcccctcagccctgaggccatccatgttgggggctcacaccagccccttccagaggtgacacccctagatctttctaggcaaggacaccagagtccctgcactcatcctcagatttcatgaaggctgtccctgcccaccccacaccaccccaactacatcatcctacccatgatgaagacaccgcatccctaacctttatacagcaaaatccccctacgtacaatctgttgccagggcctgccaattttcccttcctgatgtttgaagcacttgtttctcattctatttcaaacattccatctcaaacccagccttttaatggtatcctaaaacaggggtcaaactttttctataaaagcccagagactaaatatgttttactttgcaggccgtgcagtctcgaatgcaaggactcaactggcatggcagcacaaaagcagacacagaaattcctaatgagtatggctgtgttccaacaaaactttatttaaaacaacaagtgctgggccagatttggcctgcaagccctagcctgggccattgttctagcacattggtctcctcagtttgtctccccacttccaatttctctctcttccagccagccttactcacaggtgccaaggatcatgttcttaatgagaactctatttccgtcacattttgcaatttgaaaaatgtacagaagccactctgtctgcttcaacgtcatcaatcaaacacttcgtcagttcctattgagcacatgtcctgcgcttagaggctgtgtcatttcattttaattcatataacacttaaatgaagtgggtgttctcactgtgttagacaaatgggaaaaagaagaagaaacaggctcatgatttaacttgttcaatgtcatcccagcaacaaacagcaaacggagcaatttgaacccaggttcattggctccagatcaacttctctatttgccccaaccataatgtttcctatttgcccctctccaaacaagtacaatctagtttgttgtttcttctgcttcatctcttggtcccttaggcaagtggttctcagtcttggctaccattacaatcccttgagaaacaacaacaacaaaaactcccatattaattagctcagaatctctggaaattaaggtctagatatcagaattttaagaagcaccactctcctggttctcctgtgtagctgagattgagaaatgctggcttaggaatttcccccagttctcaggctgagataccacaagccccagccaccactgtttgctccttaaagcaaatttaagaaactggcttagatacaaagaggtctttagcagcactgctgcacttaattctggtgctgctctaactcagggcccagattctttgtttgagtctctactatattcttagaagctcccatcacataacccagggaaacttaatttcctttataccctaggctaccccggtgttctagctcctccaagcttggggctgttgctg

SEQ ID NO: 46053 - DNA, 1744 bp, Bovine  19866880787849
ttctttaccatctgagctactggggaagacttgatgtaataacctatagctccttaaatttcctttgctagagccataattaatttattgaagacctactatgtgccaggtctcaacgtggactatgaggccaatcacagcctgatcactgtcaacctatcatctctctccctccaacttcctgttgccctaacacatgggtgggtgtttctgctcctgaaatagacatgactcagggctttgcacttctgtctccttgtctggaatgtcttcccttttcatctttatgggctggttctgtctctttattcagacctcagcttaaatgtcaccctatttcagtccactttattcaatactcctcccaccttcccttaaagaaggggtggataaaatatagtccctgggcctgccacctgtttctcagaataaagtttcattcctcatttctttatatatggtccatgactgcttgcatcctgcaacaggtgagctgagtagttgtgacagagaccctacagcccactaagccaaaaatatctactctctggctcttgacagaaaacagttgccaggcccagctctggagtcactctatagcaataagttctattttccttgttatactgttctatgaaatcatctcctttgttatttcagtctccccttccccactgggatgtgaattccatgagaatggggacctctgccttgattttggctttaactccagagtattcagaggcattcaatgcttgtatattgtctgactgactaaatgctctgaaaacctggggaagagctcagcctgaccaatgtacatcaatgaggggaggagagaatggaccatctggaagtagggtgccttttcaatttctggatttttgtagaccaaccacagacacccccatttgctatttaaaccatgaaaataaagtacaagaaatcaatttaatagcctggcctaggattcaatggggtctgatctatgacaggctcttttctcaatgaacctctaaacctccttaaagagctctggcaaccatgagccaaagaagcctgagatcggctcaggtcacttccctccatgacacgaaaccccacaaggaatcagcacttcatgaaatgttacagccccccatcccatccccacactgttgactcatccagtgccttaccacgcctgagatggcatggctttccatagaagccatcagcccccacataacgctttcctgtgtacaaatgatgttttaaaaaaagtaaaccagcctcccaaattacattttgctggagaaatcaatagcaatgacttgcaggcttaggccgtgcttttgagaggaaaagatgcaggaggcaagtggagaagggttggaaaatagaaagaaggcagcccagtgtgctggtagatttcatgctccagcaccttccgccagatccgtggaggggcgaaactgagagcgatcctctctggaagcaaggaataatggaaatgtattagtttataaatgcatttgtgcaaacaaccactcccctccactctcgtctttttctcactctttgcactgactacaccagcaaggtcagtaggtcccacctctgaaacatcttccgaatcgcacctctcctctacatccctactatacatcctggaccagctgccatcagctgacaatggactcatgcagtgggtctcctaacttgttttcctgtgttttccttccactatagcatcaaacccatt

SEQ ID NO: 46054 - DNA, 1407 bp, Bovine  19866880828852
atatgggatatgtgtatacgtatgagtgattcactttgctgtacagcagaaagtaatacaatgttgtaaagcaactatactccaataaaaattcatttaaaataaaaataaacttatacacacatgagtcattaaggggttttaagtaggagtagtgtggtcaagtataaattttgaagagatcagtctggctacaatgttgaggatggaccaacaggtcaagagaagagataaaagaccttaggaggaatctgggtgaaactggataaggacatacctagagaattagtgggagagtcagaaagaaagaaacagatttctgaaatattcagaatctaaaatcgatctctagactcccaagtccagagcatctcataacagactgcctgtgctgtaaggtcattaggagggcaagaccacccattggcattcttgtatttagaccctaagctagacagttctgtttcccaagatcaccaccctctgaacaccatgggtctgaactccttgccaaccaccccatcccttcacagatttcagttcctggaggaccgatcacctgtactgtaaaacacaaatcactaaactccagctttcagatgtttctgagcacatgctgtggttattttattttcacagcttaagcttccatatttcttattgagtgatcagggtgcatgggttgaagccttggcgcctgtgttcttttggaaagtacaagtaaagcaaagggtcttaaataatttagaagtgtcctaaatttttccagctttctccctttttccatctctccaagggatgcaaaaaagcagcctctagcactctaaaatgttcgtatttctagaagctccgggagaaacgaaaacccacaaatgttccctctttaaatattccttcaatcctattttttttccttagactcaatgatggcagttaatagttacaattttagaagaaaacagtgatctagtgaaaagactctgcatttttgccatggttgcatcgaatcatagaatgttagcgccaaagttagaatttaaaaacaatccacttcagagctggagaacacttggcatgtgtgctgcagttctcgtcacccgcatccatggcagacattgctaatccatcactgcggtctttttctatgaacccaggtgtagcctcaaagccttgtcagtacagtgtgtaagtgactgctgactgactggagttggcacactaaatgatactcatttgtcaccactgttctactcccagtcgcacaggggggaacctgagtgggggaaatgacccaacacctgcagcagaacctacgaataggtttttctgctaagacctgtctgcagtggaagaaaagctcgtctgttcctgactttggatctctctcatgtttctacgtctttgcat

SEQ ID NO: 46055 - DNA, 2149 bp, Bovine  19866880840622
aaaatgtgataaaaaattatacctatctcatagggattttgtgacgtttaagtatccattatatatgaaaatagcaaaatcctcgaaggaagaggagaggatgtttctaccttaaaagtgacatgataagacttgggttcttctaagagcatttcaaaaggtgctcattaaagtgaaaccctacaaaaaacatgagaaacagatgggttatattcaatggaatactactcagccacagaaaagaatgaaattttgccacatgcagcaacatggacagacttggggcttcccaggtggcgcagtgataaagaatctacctgccaatgcaggagacatgggttcgacccccaagtcgagaagatcccctggagaagaaaatggcaacccaatgcagtattcttgcctggaaaattccatggacagaggagcctggtaggtaagctacagtccatggagtcacaaagagtcagacacgacttagtgactgagcacggggttaagcacaggaggatggacttggacgacactatgctaagtgagacaagtcagacagagaaggataaatcctatatgatactgttgatatgtggcatctaaatacaacagactagcaatgataacaaagcagcagcagactcacaaatatggagaacagactagcagttgccagtggcagggagggggcaatctaggggtggggagtgaaaaaggtcaaacttcctgggtgtacaacaggctcaaggatgtactgtacaactgggggaatacaagccaacactgtgtaacaatcataaatggaagtaacctttaaaaattgcagacaaaataaaaaataaatttaaagaatacattttttagaaaaagaaacagatggagtgggtgggtgcataagtgggtgactggatttcaagtaaatgtggaagtaggtggatgaatgggagggaaggacacccctcgcatcccggccatccaccttcccagctgtgccttcagtccctcagctaccatcgccttctcggaaggagccctcatagccccaccttgccttgtgcaggtgacctgaggcctctgaaacttgtcatccacccgctttacctcccaggcatttgctcctctccccacctcccaaaaggtccccatgacctagccctttgggtttggaggggggttcatcacctcaggtcttctggttggttgcattcagtgtaattaaagcccccatgccagtgactgactcagggtctgcatggggtctgagttgctctgatgattgtagaacccacagtggttgagggaagagaacacagcctggaaacacgcctgagacagtctgtgccctggtcaatcttggcctgaagatcagccggtcagtcagtggcttatcttgttttactgttactgttttttattttggcaatgctgggtcttcattgcagcccatgggcttctctagttgcagcatgtgggatcttagttccctgagcagggatcaaacctgggtcccctgcattgggagcatagagtcttaaccactgaaccaccaaggaagtctctcaatatctttttttcctcttaacagactcctctgccaaaacagcattttaaattttgattaagcccaatgtatcctttttgtttatgagttgtgacttgtgtgtccccctccccctcttttttaaccccaaattagtaaagacacttgagtcaatccttaaccctcctatgactcagtttcctcacatgtaaaatggggagagtaattatagcacctacttaatgagttattttaagaatgcagagttgagctatataaagcacttacacagtacccaacacacagtgcttgctgttattattagtactattattagaaaatgtgtaataccttcgtttgctcagacgaccttgggaaaatcctgacagcaaatgccggataataaactatgaaaaaaatgcaggtgaacaaacatctgtgcaaagtaaagacccggtggaggcagagatgactaaagaatgccctgaatacataaattgggccaagtttctcaaacaaaaggtaaatcagaaacaaaaggaattgtgacccaaggcaaagccaaaataaaatctataatttggcttcttcccctcacaactgcagactccatta

SEQ ID NO: 46056 - DNA, 1694 bp, Bovine  19866880892005
acgcttactccttggaagaaaagttatgaccacctagacagcacattaaaaagaagagacattactttgccaacaaaggtccgtctagttaattaaggctatggtttttccagtagtcatgtatggttgtgagagttggactacaaagaaagctgagtgccgaagaattgatgcttttgaactgtggtgttggagaagattcttgagagtcccttggactgcaaggagatccagccagtccatcctaaaggaaatcagtcctgggtgttcattggaaggactgatgttgaagctgaaactccaatactttggccacctgatgcgaagagctgactcttttgaaaagaccctgatgttgggaaagattgaaggcaagaggagaaggggatgacaatggatgagatggttagatggcatcaccaactcaatggacataagtttgagtaaactctggaagttggtgatggacagggagacctggcgtgctgcggttcatcgggtcgcaaagagtgagacacgactgagcaactgaactgaactgagctgggctggtggggggcaggggagccagtagcctgagcaatgcagtttactgcaggctttgaatagcatccttggatgtatttaccctcaaggtgaagttaaccacaggatcaccagtcgattgagagtgtgagagcgacttttgagggcatttaatatatagagatgaagctacacaatcgtttttcttcctaaactctgaatatccagaccagtgcagcaaggagcaggcagtggacacagcacgatctgaacaacttcgtgtgctgactcccacctgcctttctttccacagatctgcttgtcgcccaagaactcaaaggaaaacagatctgtgtcttgggccagagcatgtgttggaacaggaactaaactctggaagcctgagagttccttgtgtggagtaacaaatcaatcagagggtgtaagctatgtattttttgcttttgttcttattttcccttcctttggttatagactcactcaaccctgtggttggccacatgggtctctcaaggtcaatcagatcttttctcaaaagaatgggggtgttcaaatcaatcccattcagtccccctaggaggaactgtgtccttattgccaacacgctgtctgtttgtcctgttctatttctgaattgctgaatgaactcattgtctttctaaacaaagctccctttcttcctttcttttttttggttgcttgcgtcctggggatcctgaccaatagacccaggtagtaaggtaaaagaaaatcacagcaaaaagaggtgtgtgtactctcattaaaaaccacatagatagttattttacatgagtgtagatgcatagacctgaaaccagcaatagttttcttagttggatttgaactttgtagactatgaagtaagtgttttttctgcatccaaaatactgtcagctgaacattccttaaatacagttacacttagaattagcctgacttctatgccgtgccaccattgtctttttgtcactttggcagaatcttaggaaaagaacaaaaaggggatattattgaagggctgaacattgatagacagagccacaatgaaccagcctatgtctgacatcctttcaagggaactctcgcgatgtagtaattcatttcctgcaggaacaatttacttcgag

SEQ ID NO: 46057 - DNA, 937 bp, Bovine  19866880930958
gatccctgcttctagaataatttgaaaatcaatcctctttttttccctggtgctcttctgtctcctgcaactgatgcatctcatttcactttgaagctgcaagtgattatctacaattaaaaacactgcaaagcaatcgtaagttaagcaagttaaatattaagacccttctaaaaaattaatggccgctatggagacatcatctaaaggatggagtagagtttctcatgatatcctgtctagttggtctcaacatattcttgggactggggtttaccagattaagctctcaaaattaattcaaaccatgatctgtgatttgggcttgtaattactgtttgaaccaaatagttcttctccctggtgatggttattgattatcatgtagttatttacccaacatcatttcctcagtaagtgcctcccctttctctatggagataatagccctgattgaatgtacttccagaaggggtgattgatttggactttcctaacctcatctactggagaaggaaatggcaacccactccagtactcttgcctggaaaattccatggatggaggagcctggtaggctacagtccatggggtcgcaaagagttggacacgactgagcgacttcatttcactcacttcatactttatcactgaagtaggaaatggcaacccactccagtgttcttgcctggagaatcccatggacaggggagcctggcgggccatagtccatggggtcacagagagtcagacacaactgaagtgactgagcaagagcaaacctcctctactcaggtgctgggcttctcttggcttcaggataccaccatctcctgctttcacttctacctcactagcttggtcattctgccctgatgatttgttatcctctaaggcctgatgtgctgtgattcatggggttgcaaagagtcagaca

SEQ ID NO: 46058 - DNA, 1763 bp, Bovine  19866880933216
agcattgctatgagcgttgctcatataaaaggctgagcatcagaggccaagattttctctggctccctcttgaggtgctaaggattaacagatagacagagacatgccgacagaggtccatataaccaaagctaaggtttttctagtagtcatgaatggatgtgagagttggatcataaagaaggctgagcaccaaagaattgatgctttcaaactgtggtgctggagaagactcttgagagtcccttggaaagccaggacatcaaaccaatcaagcctaaaggaaatcaaccttgaatattcattggactgatgctgaagctccaatactttggctacgtgatgcaaagagccaactcattggaaaagaccctgatgctaggaaggattgagggcaggagtagaagtgggtgacagaagatgagatggtttgatggcatcaccagctcaatgaacatgaacttgagcaaactccaggagattgtgaagtacagggaagcctggcatgccactgtccatagggttacgaagagttggacacgactgagtgagtgaacaacaactactatatataaacaaataaccaacaaggacctactgtaaagcacagggaccgttatggggggtggatgccaatatatctccagtctaagtcatcttgaaacaaggcttttggaatctagacttacttttcaagcttttctttctgcgtttttatttgatgttattgacagattgcctagtagaatgttactgaccacttggaaagctacagaggttgtacatttgtgctgagaaggttggtgactctttgttagttgcgttgactgtctctgtgttgcagggttcgtttgtgttgcaagtatgagctcagtatagtggtcaccttctccttttctgatttcacttcctacttccaggtgcagttggtgctctatttcaggaattctaataagactttatatttagctttcactgcctaatgatcatttgaatatcttctttgagtcagtttccacaatgactaagacttttggaacgaagcaaatcagattttctgccccagctcctatagttcttcaggattatgcgacttccttgaagtcgactttattagggttattgtgtaacgtaaaagataacatttgtaaatttcttctagtgtctgttacaaagtgagtattcaacaaatgtgttattgtaattatcataaatataatactcttttcctttaactgtgatctcctaggaaatcgaaatgttccacgtttgttttttgtttttttcccataacatctagtacagaatctggcacacacaaagaatgtttagataaatgagtcattttcagaattaggtgatttttttttgaagggggttttaaagcattaggaattcctttgatcagtaaccaaatccccaagtggaagcaaaggcttaaatggtattatcttgtactatgcaccatcatctgtagtactttctaagggtgacattctgttccattctgcattctcacgtatgataaattgtaagttagacaagtgaggcagctatcctcaacacctggtttccttgacaacccttcatataaatagtaagggcctgttatggggggtggatgccaatatatctccggtctaagtcatcttgaaacaaggctttcaaggtcaaggttaaaatatttgaaatgataataaaacctttggttaatgtttcctagatgcattataagagttgagtaaaggcatcatctcttcagg

SEQ ID NO: 46059 - DNA, 1661 bp, Bovine  19866880945277
ttaattgaaatgtttgattactagtgatgcaatattttcctctgtttactggccacatatatttttcttcaataaattgcttgttcatgttcttactaatttttaaatttaggtttaatatttccctgcataattataaaagctctaggactaatatgtgcaataaactttcaattcataatttactttaatcctcaaaataattttgttaggttgttgttgtttagtcgctcagtcgtatctgactcttccatgaccccatggactatatagcctgccgggctcctctgtccatgggattttccaagcaagaatactggagtgggttgccatttcctactccaggggaatcgtcccaacccagggagtgaacccatgtctcctgcattgcaagcagattcttaatggctgagtcaccagggaagaccaattttgttaggcaggtttgattaaacccatcttgggataggatgtaggatcagagaagttaagtaaatttgtagcagtcgtcagggtgtgattcaaggctgagtacaggtgcacacacaataccagcttgacatctgccatctgaagtgactcagctgtcacccaggctctgttctttttctagcaggtgagctttatatctgggtaataatctagttctccatgaaaaagagatattggtaaatatatggatgtattttttccacttggtatgtttcctgttcttttgatataacctcagctccctgagagtgacatatttcctaccattggaatgccccccaatgcagcaactgtagcgataaacacaaatgtttctaatgcatgaaatatgaccagtaattgccttcaccacctgcttcttgcttgttagcaattgcagggacaattgcatcccatgctcacacagacagatgacacagtggtcgtgggacactttgagctcccactttggcagaaatcataaaaagtgatccaaagaaactggtgggaagggggtgggtaacatatctgggttaggaaccatagagcaccagttttgaaaccacatataagaatcaccagagagatttttaaaaccatcatgcttcaggtcacactcaataccaagtaaatcaaaagctcaggtgggtgggatcgagacatcggtgttttttatacaacctctcaggtgactctaacatgcagtcaagtttgagcactagtgctgtagaatcacacctctgattttctgtcttgcaaaggaaaccttgcactcagagatgcaggaaggctccaggagagagagaagaaaggtagggctcaggaagagcttggagacctggcaggagcagtcagaccatgctgagatggcttctacactgcctgcctcaactccaggacgttctttgatttaaaagtaaggtacctccactggcttaagtgactgatgttgagatagttctatctttgagtaaactcatacactgaaaaagtcagctcattggagaaaagggcacgggtaaaatactgaggcgggtccttggcttagaaaccaagtcgctgttaggagatggagcttatgttcttttaaaaaggaaatttctcttgagctcaagaaagatacaagcatgaggtgaaaggatccagggaccttcttaatgagcatgatgatgctataagcacttcccaaa

SEQ ID NO: 46060 - DNA, 2132 bp, Bovine  19866881004150
aaattgactagaggccaaacaagacatccaagcaaggtcatggaacccctgctgcagcaagaacaagcaacaggttccttgcttgatccttcctgagcagggacaagcttgttccttatatggggtgacataaggtgtgtccaagggtcaggctggagtggagcttgggtggcttgcccctaggtggaatacagggtgcacgtgcagtacactgcttttgctcctggctcttcagaagtggttgttgtggttttggtctttttgtatcttttgtccagaatttgccccagttgcatgcatgcagttatttttagtcccttatagtttcttagtattttgttgttccaggagaggtttgtccaggtgcaagcattgcagctctgcagcaaaagatcccaggtcctagcctgtttcaaacatgaataaaagcagaggtgagaagtggagagagatcaggtcctcccatctacccagatggaaccttacctgaaggcaggtctacccttgggcttcgtagataataaaccactaaattctgtgttttgtttagttttttttaccacttgctactgggaaagccttttttttttttttttttaaacacatttctaagaggaaataaacaatgagtatttatctatgacctagggttgttgtaatgacaaaggaaagaaatatattttcaaaagcattttcaaagtggtaaaaccataattggatattagatatctgcaagggaaaatgagctagaacctttcaaaatggattttgactttgtcttcgttagagagcagtaacttttcacagatgaaagctaacggaagagattagactatatcataacactctgtattttcccaaagtgagttgactttcaaaaataatcttaaatgaatatacgtaaaagcagttctaaaggactgggagtaaaactgcaaaaggattctgtatttatttttaggaccactttcacttttctgaattagattcttttcttagtatatgtgcatgctgagttgcttcagttgtgtccgactctttgcaaccctatggactgtagcctacgacactcttctgtccatggggattctccaggcaggaatactgaagtgggttgccatttccttttccaggggagcttcccaatccaggatcaaacccgcatctcttctgtctcctgcatgggcaggcaggttctctactgatgagccactaggaaagcccctagtatgtgtggcctcgactcattttccttgatttttttttctttgaactttttactttgtgttcttgcctggagaatcccagagatgggggagcctggtgcactgccgtccatggggtcgcacagagttggacacgactgaagcgacttagcagcaggagcagcagcatagctgatttacaatgttgtgatagtttcagctggacagggaatggactcagccatacctatacatgcatccattctcccccaaactaattttcctagatttgtaagtaggggctgttcattgtgaggggtgcctatttggtgcagtactagctggtttgcttatgatgtcattaaattgagtactttgtgttaagtatgaagtaggaaagaatccctaacctggtcagtatggatatgtgttcttcatattacacattttcctctgtaggtttgcataagcttttactttttgcaattcagaggcattttagaggcttgttctcaagtgatttggccagtgcatcatttcatgattttataatccacaagtgactggaatgaacagttttaagtcacatgcagcagaaagggcctagattttaaggctgtgtggatctgggcttgaaaccctggtgcccgcaacaccctgagtttgggtgacctcatctgaaaaaccaaaggaccatagttctgtatagtatgtttgttataaagattgaaagaggcaatgcatgtgaaagtgcctcataccaggtagatagtcagtaatcacatttcttatccttttatttattcatataaatgagatattttaaggcagtcatcctggctctagggaaattaagaattttattaagaatcgattggtctctatagctttcatcttgcaactctttaggctactaaatcttattct

SEQ ID NO: 46061 - DNA, 1447 bp, Bovine  19866881008417
atccttaaattaattacatccaccaagaccctacctacagataagttcacattcactttaccagggattaagacttggacataccttttcagggagggactctattcaaagcactaccccccctcacccatccaaattggtacctccatcaccagctgctctctggggtccagatccacattgccaactccctaccacacgtctccaaccccagggtgcagaagaatctcatagacacaggtccaaactgacatttatcattttttcttacttctaatcattctcaattttctcttgtggtggaaggctcaccatctgtccagtcttacaagctagaagcatgaggctcatcttagattccttcctctcttacctcccacctccaatcaggctccaagctgtgttgatatgactgggaaatagcccccagagctttccatttccagaatttccatcttgctgcagccgtcagtgtttatcaccactggtttgcccacagctctttcaccagcttccttctctccttcctccggtttatcattaatgctgctgccaaagttttccaccaaaagattatgaatctgatggtgctagagatccataatcctttatctaaaacttggagtgttgcaaaagttcagaatctttcggatgaaagaaaatcaagattcaggacactgtgtaggccttgtagtgtactctgagccatcactctatcctgaaatgcaaaagagcacttacatgaagagggacaaataaagattacaaatagcgttcatgtaagtttagtgttcactgacaaatgagtttgtgccaaactcatgaaaaagtcttcgattgttggcttttagaattttaagataaaggttaatggattgtggagttgaaatctttttctagaaacttctgtcagcttctgactgtctcttttagcagcatttgaaaactggtgccttgcaactggtttatgacctacagacatgttgtatttggccatcatcatattttggggcatgcattcatgctcagtcatgtctgactctttgtgaccccttggactgtagcccacaaggcttctctgtccatggaatttcccagacaataatattgggtgtgggttgccatttcctactccagagtatcttcccagcccagggatctaacgggactctcttgtgtcttcagccttgacaggcagattctttcccactctgccacctgggaagccccatcatatttttaaacatcacttacttacagctttcaggagaacatgcaccaatagttcatcaagttgtcctggttttcaccggcacatattgtcttgacaacttatgacctcacacattcatgtagcgtggtctctaagttaatagtcagccacagtgaagcatgcaagggtgcctgcaaaacagattcccacattacttctccaggaccattccaa

SEQ ID NO: 46062 - DNA, 913 bp, Bovine  19866881014984
ttcatgtcctttgaatcagtgatgctatctaatcatctcacttcctgtcacccccttctcctctggcccctcaatctttctcagcattagggtcttttccagtgagttggcccttcgcatcaggtggtcaatactttaaatggtgtcaaaggaacagcataaaggcaagttctagaacactgagttctagcaactgacttcatgacccaactggaccctcactttcttgaggcctcagcatccgattaaaataattacaggttccataactgatctctgacacccaaaacacaacatctgcttatcagttccaaaatccatggggagatttaaatcccttctctgcaggactccagaactattcatggtttctaacaatcttttccttttctagctgtaggtaagaactttcagctaacattcctgccactttcaaattaaatcagattaaatcgcaggcatccagccttctataaaaaaatcaaattgttccgatatatctcactcccacagcacattagacagatgcagcacataaagtaaacagtctagttaagaagtgcgagttcattagttgtggggctgtcaggagcacccaagagctgtgataacacaacgcggttcccatcttagaagtcaagctaaatgctttccatttttatcacccaattcataaccttgctgtctggctttaagaatcaatagcctggtggttttggtatccaataaatttgtcttcatttggacgtttttcatttcccatgccacttgaagagagaggaataaggtaaattgttcctctcatgacatttgtttttttttttttaaatctataatttcacactgacacattccacaaaccagtgaaggcaaagacaggtaaagagagcagatagcagaggccccatcctga

SEQ ID NO: 46063 - DNA, 1178 bp, Bovine  19866881086488
tgagctgagccctaatccgaatgattgcatgggtgctcagtcgctcagtcatgtctgagtccttgcgaccctgtggactatagtccgccaggctcctctgtccatgggatttttccaggtaagaatactggagtggatggccatttctttctccagggggccttccggatccagggatagaacctgcatatactgtgtctcctgcattgcaggcagatctttattactgagccaccaagtataatctgtgtccttttaaagggggagatctgaacacagggactcacacagagggaaaacgatgtgaaaacacaccgtgagaacatggtcatgtgacctgagtgatgcatctcaaagccaaggattgtcaaggactgtcggcaaacaccagaagttaggagaggcaagaaaggattgtcccccagagccaacacagagactgtggccctgctgacacctggggacagcttgattttggattctagccttcggaactgtgaaaccctgcacttgtgtcgttctaagcccctgagtttgcggtgctttgttacagcagccgtatgtagtccatacagtgtaggaaggtgcctcatccaagatgagccgtctaataacactgtgctcagtgaaaacttcttgctcctgggtcctgttctctcactgggatttactcttaataagtcagtctccaaatcagttaccaccatccacactggcatatgaaggggtgatgctatgtggatgggtttttcgaaacctcatcctcctcccaggtaacacatgtgcacttcaaacacatcctgtagcaaactgctttgcaaagcattgaagctttggaatttctggattgtaggcaagctaaattcaggtgggggattttttggtttctgacatgaaaagattaccattttgacaagctcctacctactctccacatccttttggctgtgatgttccattacaaacatcgacagaccagacaatgaacacacaagccatattaaaacaataattaatgctgggaaaagaacagtgacaactgcttagcagaagagaataatgggctggtttgtcatctgcggcgtttaaagaggctgagccctggatgcgaatggaaagtgatttctgatgcaataacggtccttcagggacctgggtcaaagtgactcattaagccc

SEQ ID NO: 46064 - DNA, 1594 bp, Bovine  19866881107391
tatatgtgttagtatactgtattggtgtttttctttttggcttacttcattctgtataataggctccagttttatccacctcattagaactgattcaaatgtattctttttaatggctgcataatattccattgtgtatatgtaccacagctttcttatccattcatctgctgacagacatttctccaaagaagacatacagatggctaacaaacacatgaaaagatgctcaacattactcattatcagagaaatgcaaatcaaaaccacaatgaggtatcatttcatgccagtcagaatggctgcaatccaaaagtctacaagcaataaatgctggagagggtgtggagaaaaggggaaccctcttacactgttggtgggaatgcaaactagtacagccactatggagaaggtgtggagattccttaaaaaactggaaatagaactgccttatgacccagcaatcccattcctgggcatacacaccaaggatttttatttttattatattcgcttacttgcagatatgtttgctcatccttagcatgtgatccctccaatcaagatttctttcccaggattccagtgaaacgcagaggaaagcctggagacccaagcctgggagagtgggtccagtggtcctgattcagcccaggcctcatgttgccaaccacgttgaattaattatgtgtgtggaggtggaggggtggggtttgaggcagagtggcatttataaatgagttcttttcctttagattctggttagagaagtttcatttatttggaactatggaatgggagcagggagttttatggctcagggaagaaattttatcattccttctgtatcttgcttttgacttgtggaactcaccttcctcaagatagcaagaactatgtcttgtgtttaaccttttcacatctctaccagtgtatctcattgaatacttaacatcttccatcgaagcaggtatctttattttgcagatgtggggcctgcggttcagagactgacttgccccaggttacccagtttgaaagtggcagaaaggacttttcacaaataataggctttctgatgccaaaccatgagctctttctagggcttgctcctcagttttccacctatctgcccaattcttttggcacatcctcatgcgttcagcccagacagaaattcctgagtaggaagtttctctctgctgcagcttctacaatgcctgttaggagcaaatgcttggctttctcagatgctgtgcgaattcccacccactctttctgctgatggagtcagaggagccattttgctagcttaactagatgctatcatcataatacacaattgctaatttgcctctggagtctcctaacagcccgtttagtggaactcaggagctgccttccttttatctttttaatttttataaaacaaaatgcataagccaaagaagagaaccaaacttagatctgcttcagaaatgcctctcttctttggcttgttcttgtccctggcaattctgggccaagacagagtctcaatgtcttcctagagatagccaagaaaagacactctgataaaaatcgaagaggcagt

SEQ ID NO: 46065 - DNA, 1281 bp, Bovine  19866881125054
atatgctatggattggacctgagctgcagatgaaaagaaatgagtgaagaatgtcctcaaggatttgacctgatcaagtggagagacagttagtcttttccaagatgaatatgactgtgggaggagcaggtttgggacatgctaagtttaataagttactcattaaacatccaagtacaaatgtcaaggatgcagctggatactgagtctgaagttcaaaaaagtagtttagatgataaagaaattttggagtcatatccagtgtagaaaaatggaaaatacaggaaaacattttttaaaaaaggaaacatacagaacagatttataattgaaatgcaaggaactgcacatgtttaatgtctgtagtctgataggttagacatatgcaaacacctgtgataccatcaccacagtcaaggaaacagacacactcaacagtttgggatggaaatcctacgggatgtataggtgaggcttttcctacaacctagcagtaggaggatttttctcttggaagtacagactggcccaatcaatcataaagtattcattttgcttctcatttttccactgctccttgtaagtacagtttccttaagaaccgcacaggaaagaggtcactgggatgaggtaggatttaggtattcccaactttcttggcaataatgatatcagaactttgtcccatttgtaagagaaagaattcctaatgttacaaccacttatctgttacttgaatgttatcttcaacatcttcaaaaaacactgatgcaagctgtacatatacacctcctgtgacaaggatctctttatctcacaaagcccctctttccatctttccacacttatgaataaaatgttccttagtgtatcaaaccaagtctgacttccagtaacctccatctcatagtcctatttctacccctcggggctaaaatggaatgaatttaacaaacgtattccttttttttttttttttttttagtgtaacagctcttcaacttgcctacaattccctctagttatgtcaaggtctgataacccacgaaaaggagatattcccaagtgtcggcttcttctgtgtaattgacttttctgctcagtgctcagttcaggcaagccactgttgatctgctgctcttaagtcccctctgtgtacacagccaaatggagtgcaacagctagggtacaggtaatggcaatggatggatgtcaagggtcctgatacatctccatttcatttgttaagaaattgcccattcttagggccctaaaggagac

SEQ ID NO: 46066 - DNA, 1851 bp, Bovine  19866881151484
aactattttatgtatggagaatggataaatcacaggatcctactgtaaaccacagggaactatattcaatatcctatgataaaccataacggaaaagaatataaaaaagaatgcatatatattaatatatgctcagttgcatctgactctttgcaaatccaaggtctgtagcctgccaggctcctctgtcctctagttttccaggcaaatactggaatgagttgccatttcctacttcagtacacacactcatacatacacacacacacataattgaattactttgctgtacagcagaaattaacacaacattccaaataactatactccaattaaaaaacaaacaaacaaactgaaatcctttcctaatgactttgcgtctgtctcttaggcacccagcattgagtttactgtgtatccatttagtaaatattttcataggccaggcatcatgccaggtggtagggataacaagagtgataaaaaacagaagcctagctcttttggaccctacacttgagggaaggtagacatttacctgctcatcacacaaaggcatgaaagtttacactcagtggtgagtttacagaagaaacgtatgtgatcctccaagaagatataacaaagaaacccctatgagatgatgaaagcagagaaggtttcctcaagtacatagaggttcagcaaaataatagggaattaattagcaatggggaaagaacagactccctaatacgacagacagaagaaatacttgtgcaaaggcccccagcagaagggaaggagcacagtagcctggaaaatttagcaggtgagcagcggtgctaacaatactagaagttggaaggaggcaggagccagaaacacaactcagttaaggagtgcactctccatcctaaaagcactaggaaaccatcaaaggttttacacagaggacagggatggtgtgttgggctttcctgtgggaaagttgatttgttactgatgaagaatagattcagtaaaggagatgtaggcagataagaagggaagatacttgtctgggggaaaatctcacgtgcttagactatgatagtatcaggggagacggagacaagcttggacctcaaatggccagatatagagagagggaaagggacacattgaaggcagactcttagttccggatgagcagctaagtagatggtggtgctagatgtgaggaaggctcaggtcgggagagtgggcagatcatgatttaggtttgtcaagcagaattatgcataaattattatgcatcattctcatgaattatggaaaaattacattttacagaatgcctcatactcattgtccttattggattctgacaacttgcctcatgggatacaggactgtgggtgatagatgtttaagtggtagggaaatgaaatgcaggtgggagggactttgtgttgcaatcatcagtagaaggcagggtcaagggcaggactccggagaccatatccttcagaatacatcacatggcaattttctttttcttattttttaagccatgcagtcttcaaatggataaaaattcagtgtgcaggcttccctagtggtctagttgttaagaatctgcctcccaatgtaggggacaggggtttgatctccaggccgggaagattccacatgccaaggagcagctaagcccttgtgccacaactatggagcccacactttagagcccatgctccataacaagagaagccaccgcaatgagaagcccacgcaccccgacaaagagtcgctcctgctcgctgcaactggagaaagcaacgaaacaatgaagacccagtgtggccaaaagaaaaaaaagtgtgtaaaaat

SEQ ID NO: 46067 - DNA, 1442 bp, Bovine  19866881189448
tatggatgtgagagttggactgtgaagaaagctgagcaccgaagaattggtgcttttgaactgtggtgttggagaagactcttgagagtcccttggactgcaaggagatctaaccagtccattctaaaggacatcggtcctgggtgttctttgaaaggactgatgatgaagcttaaactccaataccttggccacctcatgtgaagagttgactcattggaaaagactctgatgctgggaaggattgggggcaggaggtgaaggggacgacagaggatgaaatggctggatggcatcactgactcgacggacgtgagtttgagtgaactccaggagttggtgatggacaggggaggcctggcatgctgcaattcatggggtcgcaaagagttggacacgactgagcgactcaactgaactgactgatgtgacctcagacaaatgccctcagttccctgagccttagttttctcatctttcaaatggggacaatgatacctagttcatatgaatgttgtgtgattatttcaggcataaacctagctcttggtagctatgcggtaaatgctagctttgcttctccaacattaggagggagaaggaaaagcaagtaagggaaggtggtgatacaaaaggagagaagaagaacaggggtcaaagtggatggaaaatgtggcaagtgtcttcctggggattgtgacctctgtgctgtcttaagtatttttccccattctgcccacaagattttctgcaactgactgcatttggagttggaacatcaagcatttttgagcttttactgcagcaattaagggctcataaagccatttttatgagtgtataataaactgagctacatttggggttgccaaagtgaggtttctgtgtggggaactcgatgttaactacttgcagcctacaggaacctatgggagcatgctggatttgatttttggatcagcacggtccagtagaaatgtaatgggagccatgcgtttaatttcacattttccagtaaccacattaacaaagcacaaaaaggagaaattaattttaataatatatgttagttagaccaatgtatccaaagcattatcatttcaacattgaatcagcataaaatatttttgtttggttgatttttattaatttttactataatatagttgctttacaatgctgtgttagcttctactgcatagcaaaatgaatcagccagacatatacatatatctcctcccttttggatttccctcccatttaggacaccacacagctttgagtagagttctctgtgctatagagtactttctcatcagttttctgtcttattgtttggttgctgtttactgtttagttgctaagtcatctccaactctttaagaccccatgaactttagcccaccaggctcctctgtcccttgggatttcccaggcaagaa

SEQ ID NO: 46068 - DNA, 1202 bp, Bovine  19866881190201
actcttcctatctctttggcttccatcctagtctccggaaattcaaagtactgtcccatatttttgacaattcccagggcctgtacattcctcatagctgcctttggcagaatttttggcttccttcttgtgcaggatatctcacccaccagtgtacagtcttggctccatacatggtcggcctatataggaactcagccacccacacactcatgcaccatacgcttatattaagctgtctttgtgttggttgatattactgaagatgtgtgtgaagaggaaagctgaggcatgatttagatctcaagagcatcatttcattcacttaaccatctttcccttcttaggaacaaatgagatttcctctcctttacatttgtttcttttatcttctgcagaagggcttatttccgcttagagttcctgccagcatcactgctttcagagtcccacctcctaccccaagaaacttcctaaagcatttcccttaaaaaagacagtttcatcctcaagaaaaatgctgctaccggctcctaagataatgcattttcactcccactctactttcaaagacttttgctttctaggagttgtacaacagactcagatccagtggcaccaactcagtgcgtgcatgtttgcctagtcgctcagtgctgtccaactctttgtgacacgatgaactgtagcctgccagactcctctgtccatggggattctccaggcaagaatactggagtggtgccaacttagatgcaagtagacagcatattaaaaagaagagacattactttgctgacaaaagtctgtctagtcaaaactacggtttttccagtagtcatgtatggatgtgagtgttggaccataaagaaacctgagcaccgaagaactgatccctttgaactgcggtgttcgaaaaggctacttgagagtctcttggactgcgaagagatcaaaccagtcaattctaaaggaaatcagtcctgaatattcattggaaggactgatgttgaagctgaaactcaatactttggccacctgatatgaagatctgactcactggaaaagaccctgatgctggaaaagatggaagataagaggagggggcaacagaggatgagatggttggatggcatcactgactcgatagacgagtttgagcaaggtctgtgacttggtaatggacagggaagcctggcatg

SEQ ID NO: 46069 - DNA, 1254 bp, Bovine  19866881252129
aagagggaagagaacaaaggggtggagtgggcagaaagagcccgaccttgacaaaggtaaccaagttgagggaccatccccatccggccaactgggtccctctagccaatgaggccagctctaggaaggggtccactgggctggtcctcccatagagcatccaacactctcctggactcatccagcaccacaaagccactgctgctgcacagaacaggggctcccacagaccctgcctcggaacctcttcaaagcatgaggatcccttcctagcttcagaagttgcattacagctgatgaagcatcaggccccacagcccttgcctggggagcacccagctcgactgtgcagccctggcagttgcacgcatcaccctttggctcgagagcagagtaaatttgctgtggacgttaccaagagaaaataaatactgaaactccacaaggactccatgcaaaggctttccaaagtccagccacgtgctgtaagcagatgtggagtcggccccgactgcaaaatctgaattcaattgacatattcagggaggaggggaggaggagattaggttgctggtcaggaagaacggtttcatacctttctaaaagatgggaggaagggggaattaaaaatagatttgttgtcgccgtaacactgcaagccacacacacgacattgatcagagagaatccacgtggctgagtattggacatggaggtaccagtggactcatttctcacccacaaatattgactgtgcagtaagaaagcctgcgagtccaagactggatcatggaccttcataggccatgagtgggcgagtcagcaagcaaaatccatgcctctcagctcacatccacccatcgcccatacacactcagacacaaaaactgaccaagccccccagtcacctctcctaagcttcccagtgtgtcctggcccactcctaacaagcatgggcaaaggccacgactcctcttaacagtgaacctggcccaactctctgggccagcctcttgatggttcttatatggacacaatgggaggcctttaaggaaccagggagagagagggtctaggagggacccacactgttcatcttcaggtagcaccaagaatctgagggagcaggcttcttccttcctctgcacccacatcccttcttctgtgtcttagtttctgtcacacacctttaaaggcaagcatctcccttatcccagtaattcattccttaaataaaatgtcctagtcacaaag

SEQ ID NO: 46070 - DNA, 1217 bp, Bovine  19866881295608
cagtgcatctccagctttcaaaatcctgtgaagcttaaatgaaggcatttctctgctaagagattttcatttgttattgagaggtacccctgatgtgcttgggctgtctcagaacctcatttcttcataatggacagcctagggttataaatatacaggaaagacgttttccctccccaagctcatgtggttacaggtgatttccttgcagtctcctttgttccaggatatatttttttctgatccactattttacccacagtgtaacctcttgagggttccaggtttatgcagagtttcatttgcaacttctacttttaaaaagtcaaaggccttgttttcttctgtgacagctactaaagctcaagcttcttgcttaataagcatggcaaatgctctcacagttgatctacatgagtgtaacttacaatttgaattacatctccctctgtttcaggtccctggggatttctccttctttctcagaagctcagctatgcatttaaaagaatgcttgcaacattttatctatcatttccaagtattttttcctcattcaggagctttccaaaaaccttctcagatagccagaaatagagatgttctgattgctttctgtattttaaataaacatcagaattatggttcgcttatgacattctcttatgttttccagtgctgttaagtatttactatcttttacaatattttttccatcattcaaagagatttttatgcaaaaggtattaaaaaaaagtgaattcagtctaccatcttgatccaatttttataatgggtcttgaagattaagagggtatttgccagatagaaacagagaccaaggcaatgcagttatgaaaacacagagagacaagatgaatctaaaagttagataggtttagaggatattactaataaaaagagccttgtgacttccttggcggtccaaaggttgaggcttcacctccagatgcaggaggtatgggtttaatcctgatcagaaagctaccatctcacatgcctggggccaaaagaccaaagataaaacagaggcaatattgtaacaaaattcaataaaaattttaaaaagattttttaaatgtgttacctggtattataggagtctagaatctgccatataattcagcaaaaccacctactatttatttattacttactaggtggtaggcactgtaccagagattttacatagggta

SEQ ID NO: 46071 - DNA, 1361 bp, Bovine  19866881345693
cctcttacatgaagggggacatatctgtccccatgtacacatctgtccccatgtacacatctgtcccctgtacatgaagatggtcttccaacctgattctctgctctcacttgttctgtgagatgtggtggaatattgtgaaaagcagaaggagattggaggtagacagaaaggactttgatcctcaagactgacatttagtaaactgagagatttggggcgagtgatttaaccattctgagcatctgttgtctcacaggtaaaatggaaataatgataaacaaccttgcaatattgttagaaaatttctataaaactcaaggcacagagtaggaactcaatagatggtgattattgtcatgattatccctgtgagtagctgtaaggaatgaaaacggctgaggtctaaaattaaaaaattaaagatgagcctaaaggagttgaatctagggaactaaagaaaaaaaaaaaaagggtcaacattggggtcaaaatcaagattcagacccgctggtgagaaacaggagacctgtcagaaacagaagcacagaacagagagaagataagaggccccaccttcagaagatacaaacttgagatcaagtcatgcctcagcccttgcattcttgtacttttccttctggggcagaagtctacccatcagctcagttcccctgtgatctgaggctggcccaatggccagagggagcaggtgtctggaacatagatggaagattctggtgttctttctgggatgttgaagttattgacctattcacactgagcccctactacctaccagtgactctgggtgtagcctgtatgctctatttaccttctctacttcttctctcatccctaagaaatggattgggatgagacttcagttacctttcaaagactgggtgggtgactacagagaacaactggtggcctccagctcatttcctcccccttgccagttgtctgcattcctcttcccatctccagtggtgggaggtggttggattatagttatttcctaggaattacagctgtggagatgacaagatggctaagaagtaggtctacctggcacaattcaccctttttgggtagatatttatgatgccagggatgaaagaaagagctcatgaactcacaaaatacagaagttgcaaactaaactgcctcacctcaatcctatgtgcccttgtccctgggagacaaggtacccaagccagagggatgcactctcccaggtgtccaccaaccagtacatgcattcttctgtgggtacaggactgatgttgtcacaagggaatgagcttcaagacattcattcagggttggcaggtaaaaagtcatctctcttcttctag

SEQ ID NO: 46072 - DNA, 1680 bp, Bovine  19866881389606
gggtgccctgctgtgaagtcctcttgtgttatttaccatcaaattttgtattttaaatttaagtacatttgacctcgggggcttccctggtggctcagacaataaacaatctgcctgcaatgcaggagacccaggtttgatccctgggtggggaagatcccatggagaagggaatggttacccattccagtattcttgcctggaaagataagaggagccaggcgggctacagtccatgaggtcgcaaagagtcagacacgactgagtgactaacacagctgacttacaatgctgtgttagtttctactgtacagcaaagtgactcacttatacatgtatttgcattcttttattaaaaaaaataaacatgtatttgaccacactggatcttagttgcagcatgtgggatctagttccctgatcagggatcaaatccaggccccctgcattgggagcctggagtcttagccattggatcaccagggaaattcctctttttaatgttcttttccattatagtttatcccaggacattgaatatagttccctgtgttactgagtaggaccttgctgtccatcggttctaaacataatagtttgcatctactaacctcaaactcccagttcattcttcccaatccccttccccatcttgggtccttttgaaagaatgccagccttttggtcacctaaactggagagctactgtaggagttaacacgaggccattatttgtgaagctgtaagcaatcccaaggctgtaaatagagatggacctattttgccttccgtagtctatgcaacagagaggaggtgggggcagaggaaagatacacacacgatgataaaaggggtcaggaaggctcagctgccagactcccaccaggcaggagaagggaagaatggggggaatcagaacctttgtctgccatcaacagaatattcagaggctggttggaagcagcagtctccagggggacctagaaatggttaactcacagtttctctcctgatgagtagcttcagctgctcatcaatagaatctccagctgataattattaagtgaaactgggggcttgtatttgcatatgtaaagcatacttccctctgaagccacaatgggagggagaagcacttcctgattgtgcagccctggggaggctggggccgggcggggctccagcctgctttgtacgtgcttctccatactcatcaagccagatactcagcagaaataaaccccacatctcaaaatgcgcctttgtcaaaatccccagctcggataagagacctccctctcagctctggtgaagaggcagtctactgtggtaggtgtctgtaaggcctgagattacccaatctggtacatgtgggcaggcacacacacacctgggttattgtacaggatgatggagcggttattagtttctccaaaaagaaggcttttatcctcctcacatatttgacacttttcaatcttggcacctgtcgattaagaagcttcagccccaaagaagcaagaaggaaacgcaaacagcatcaaattccaagtatctgatggctcatctctgttatgacatttatcttggcttgcgaggaggaaagttactgagcttgtctctcctcccacgggaaaagatggcacacagaaaaaagccttcattcccaggagtatagcg

SEQ ID NO: 46073 - DNA, 707 bp, Bovine  19866881477844
tctatttatttctcgcaacaacccttataatcaatgctattatgatcccattttgcagatgtgaaacctgagatgagagactgagacaagagacaatttggccagaacctccgggttagaaaggggtggaaacaggaaggaagcccctcagcctcgccctaggtctgggttttaaccaacacatagcactgtgtaaaaccccttgctgattggtgaaatcggtggggtgtaaccctctgttggcctgaaagagtgtttgcatttattgctgccagttgcctcaggcactgtcagtcctgattactttgaattaaattctccgtttgatgtttattggagtaacaggtagcctgagtatggtagagcttacagaatgggtgctcattctcaaggctccctgcctgtgtccagccacagtcccccgccaggtttaaggaccaggtgtttcctgtcttttctctcccggatggtggagtttatttctagatcacctttatgcagggagtagtctttcaggtcctagctttatacagtgccctctctccttactagggcagaccatgatccctgtcttctctcttctgcaccccagccacggcaatgaaagcagagttcaaggactgcttccctcagggcaacagttggtttcaggaattacttatagtctaattgtccaactttgctttgctcttaatgttttgtagttt

SEQ ID NO: 46074 - DNA, 1626 bp, Bovine  19866881514698
gattttgcccattgaattccttagatttttttttttttttttttttgaaggttacttagatttttattccctcttcatgtgcagtgtttctggaaaatctgcacatcttgaacacccatgaagaatcatttctaatatctgatgctaatgaaaggacagcccctgtgctgatgagagatggctgaacacagcagtgtttggaatgtaaacctctggctggtcttttgagtggtaaccagccaaccatggagggtatattcccaactggcatcctacagatgttaactgactgcccctagcatgcaaagaaggagtaacacatacatactacactgtcagcacagaggtattttgaatcacaagcaatacaacaagaagtcatggtgatttaagtttttaaatatttttaaatgataaaagcaatgcatgctccttatatactatttaggaaaaatatgtgttcgtatttgttgaaattacccatatgctatacccagcgataacttcccaaaacatacctttttcatatctatagctatgatagtatttatacatttataaacagtttatcacattggatgaaggatacttgcaatcacatttaatgttcaactttgaatcctacttttgtggctaaacagatcatgatcatttttctggcacatacagtgtattttgtagatttgaatttaattggttaagatagatgggagaagacaaatggagtagatacttaggaggagtgttggccaagagattggatttggatttgagagaggggtatttaaagatgactcttagacacctgggttaataagtgaggccttctcccttcccccaggcaagaacagtttagagactggttttctagttaatacatgaatatttgcatatgcttgggatgtaatttgcagcccacctctgtttttccccttcctttcttcttcttgtgttgattccagtattaacttcctggaggaacctctgatataaattgagatttttctttaaaatgtgtttttggtgcacagaggtgtcatttaaaagtcaaattcatgaaggaatattttttacctgctgggtttaatttcagatgccagtgttatcataaaatgcaaaccaccctagacttggttctaaaactttgtacaaattgtgccagttgaaattaacttctgcagatggagagaggagaggacgaaaataagtgttataaagagtcttaaaaaatgttatttaaatattaatgccacttgagttccgctccatatatgttccatcttttccctaagtatcaacttttctatagctttccaattatatttttgtctatttaacctttttgtgtgtgtgtgtgtgtgcaatgggagcaaacaatggtgatatgtttgaccctgggaaagaaaataatcataagattcaagatgaaggatttaggtttgatcagaaagaaaatgccccccagcagagttgatagaatgaattatttaaggagagcaaagcttgaggtgtctctgccccagatgtgtgtaacctttggtgagttaattcatctttctggattttagtattctcatccataaaatggggaggaaaaatagtattaatacctacctcaggttattt

SEQ ID NO: 46075 - DNA, 724 bp, Bovine  19866881529153
cggatccgatcctccctcttgaagtgtctggtcaggtggctcatcttccgcctccattctgcctcccaaagctccaaattggagtcaggggcccagaaaggctgattactgaagcccagaatctgcaactcaggttttctttctcctctgttgactctcttgagaacatgtgtgctgtagggttccatctgcttctgtaataaaacataaattattaaaaccataaaatattgatgaactattttataaaacagagggactttaatgtattgattatgaattaagaatgccttaatgagcttcagaaggagaaataattgggaaataacagggagttgatttcctcctgtgtccccaaatgataagcagttttgaggtgatgttgccctcatcccatttggcatcactgtcagctagcatttttgccacggtggctttaaaacctacactttccatggacgttaaatgccacccaaagacaaagagaaggaggagggaagaaaaccttcttattgaatagcagtaaagtattctggttggaaatttacttgtttttgtttatctccttgggtagttccacagaggaaactggtccacagaggagaagtattttgttcaagatctcacagttaactggggtcaggagttggcctggcactcagctcccatgactgttgtatgagtggattctgctataccccacatcctcagggactcttgaatg

SEQ ID NO: 46076 - DNA, 1045 bp, Bovine  19866881535455
tgagggcaagtggagaagggagtgacagaggatgagatggttggatggcatcactggctcaatggacatcagtttgaacaaactcggggagatagtgatggacagagaagcctggcatgctgcagtccacgggatcacaaagagtctgacatgacttagtgactgaacaacaacaataatttcacttcattcatctctcacatgccatccagactacaagcccctaaaggggaacagcttactgcttttatctctgtacccctgatattcagagatcctggcagaatgtttgcatttaaattttggttgaacacctgagtggatgaacaaataaaatccacacagcattaagcagtagacctgcactgtttaattcctggtctaggactctatagtatgaagcaactctatatttaatacaccccatattcctgaagatgactctacggcagaatcacagaaatgcagtgaatagtttacaacctgcaacacactcagcaactcaaatgacaacattaatttaatgaacttaaacactggtgacctctttaacacatccaaagttatttatgttgggatatgcatgcccgaagactgcttaccaaagagagactcaaatagaggtgacacatctatctttcaaatgttaatttgcatttttaactttgatacaaagaacttagctcttctcttttggaaccaagaaagattagctgactttttgatccatccatccatccttcctgtatgacatatataccattaagccttaggaattcaaacaggtcatccctaccatcacagtctattcagaggcacacacagaattaactataatgtaatgtgttaagtataatagtcaaatgataaagagctacaagtagtaaatggtttgttggagaaaactattcatgaagatggtacacatccatttcctggggccgctataagaaagtagcacaaacaggatggcacagacaacagaaatgccttccctctcatttctgcaggcggatgtccaagagaagatgccagcagggtggtt

SEQ ID NO: 46077 - DNA, 1258 bp, Bovine  19866881551932
cacttcctgagttctttttcttcccccacgttgccacaggggcaactggggagtgagtagtggcagtccacgtggtggtaacttcatgggcaaaagcttagaagcagggaagttgtgggtctgggacacagcatcctgatttacttgattcagacggtctcagggtgggggagtcatgagaagcaagtgctggaggtgggaaggggcccctgtaaagagctcagagttggtggcagaggaaatagggatccttgctggacatttgagcaggggaatggtgcctatctgttaggaccagggaggatccatgcaggaaaagtctggaatctggtgggtcaggtggctggtggctgagccctgagaccccagataagatggacaggaagaagtgattctcaggaacctgggggaagtgtctctgtggagctcgtacagagcacatgctctgcctttaatcagagacaaatgggtgctgatgacctctggccatgcatgcaaaccccactctgcacagccccaagtgatttgatgcctgctaatgaggttttctggagggctgttgaagatcattaaaagcagtttttgcaaactcaatattagtttttaagtagttagcaagggtaagcccttcctgctcagtgtcaaccaaagcgagtgatgagttgccatttaggaagcagaagggggcaatggtacgccctcaggtctcatggacggcaggggtgcttccaaatcaattctttcccacttatttccatttgagtcacaaaatgttttttgaacactctctcattactagaactgtgctaatcattaaagaattaatagtgatgatagtaataacagtaattataaaaatagaaatttattaagcatctactatagattaggaactgtgcttttaacaagaacaaaatactcacactaatcctgcaactcagctgcaaagtattagcaaccccatttatacatgaggattttgaaactgaaataaagcaaaattgagatcctttgactctcacaatctaagggaacaaatgcttaaacaaatgaatgtcatatcatataagacttagaaagtagcaagagtataaattgccaacactgtcctgtcccatgagtaggacactcttttgttgttcttgtttctttgctaagtcgtgtccgactcttttctgacaatgtgaactgcagcccgccaggcttcctcggtccatgggatttcccaagcaagaatactggaatgggttgccattgc

SEQ ID NO: 46078 - DNA, 1117 bp, Bovine  19866881584252
cccaatttgttcttgtttacaaatacttttaagttgtttgtcaaacaaaatgattctgtctgccagatgagatcccaatttcctaagctcattaccagctgatgaacagaaagggtcaccctgatgatttagtaatttggccctgctgctaagtcacttcagttgtgtctgaccctgtgcgacccatagacagcagcccaccaggctcccccgtccctaggattctccaggcaagaacactggagtgggttgtcatttccttctccaatgcatgaaagtgaaaagtgaaaatgaagtcgctcagtcgtgtctgactcttagcgaccccatggactgcagcctaccaggctcctccgtccatgggattttccaggccagagtactggagtggggtgccatttggcgctgactcttgtcaaagacacttaaaaaaaaaagtccaagctgtcaggagagaaaggaaatgctgctgctaggtcgcttcagtcgtgtctgactctgtgcaaccccatagacagctcaccagggtcctctgtccctgggattctccaggcaagaatactggagtgggttgccatttccttctccaaaggaaatgctatttaatccattttgtgcactatttttgtgcaaacaaagagtagatatttacaggcatgagatattaagtctccacaaccagggcaggacgatgaagaaacacaagaaaggagaaagacagagaatgtttaaaatgccccgagttggaagccatagtcagttcagttcagttcagtcactcagttgtgtctgactctttttgaccctatggactgcagcacaccaggcctccctgtccatcaccaacacctggaatctactcaaactcatgtccattgagttggtgatgccatccaaccatctcatcctctgtcacctgccggggtccagccccagtggatccagggaattcgaagcggggatggcatcggtgaactggatacaatagctttaattaaatattaatcagagacataaagagtaatagaataaggatagctcagtaggaaaattcagcagagaaaagaggctgaataacttggtttatgtggaaagccaataaaattccagacaagga

SEQ ID NO: 46079 - DNA, 553 bp, Bovine  19866881587006
tacacctagtactgcatagtgtcatgtgctgcctcagccgcaggtttctgttataacttttgagccttgaggaaatcctgtctttgtgcattcagggtgtccctttctgcttttgtatagtattggcaaagcattctcatcccttcccccacttccctccacgcccccatctttggccctcagtgattctgtattaatagaagcgattaagcccgcctcatctcatcagggaggagatattaatcttcatcaggcccaggaaggggctgcctttttttccccctgctctcgcctcctctccctggactccctccatgagctcagagactactccagtgtctgtggggagctttctaatctgcttctgcagatgcctttcagggggtcacttccctgctcacctcccttagcctcccggtatccaagcatcacacactgtaattgaagaccactgttggaggatggagggaagggaaaaaatgttccctcaaatggaaactcccagcttcattgtcctcgctgctgctagggaaattagagcagggcaatacca

SEQ ID NO: 46080 - DNA, 735 bp, Bovine  19866881626539
ctagataagtcagcacatttagaagaatctaggtgaatgacagtgccatttcaaactttattttgtacgaaatagtggaaagaatggggctatttaccctggagaaagagaggctccaggtgtatatgaccagcttcagcaaacaatcaaatggccaccatctgaaatagagattgggcttactctgacagtccctgaatctatggagggatgtggcagggagccagatatcaagatcatcataataagggtcattctgtccagtgctgggatgagagggaaggagccctgggagggagagatgagaggtgtgcagacagaagggtgatcatcaaggcagttgcacagggggaactgcctgcctggtcctaacccagagatcctgagactctagaaaagcctgaatgtttattcagaaacaaaaatttcctccttggagttcttgccagttgccgcaggcatcagtacacttccaaaagggcctgcagagacattcttttctctgtagttaaacataacaactttgaaatccatttattgacacccttgagttttctgtctcgaggcaagtggaaccataaataagggacagagttgctgcctgaattcggagttttatgtgggtttatttatttctcaaccctgtcctaatttcgatggatgatctcctgagagcagagcctagaactcttcctggagatgtggatgcttttagatagaatatgattttggagt

SEQ ID NO: 46081 - DNA, 1742 bp, Bovine  19866881714382
tagcgtctcaatgagacatctgaaagtcaggattctctttgctaaatgcaagaagaatctgcatcttccacccttcatgggtgggcttcgccctttccaaaaggcaagagtctgttctttgggacccaggaggatggcacagctgttcagattgtttttcatgtgcctcccaaaagcttgtcaggtggggcaagagttgctcccagctaatcgttactgtaaaacctggtggatacatgtttgtttatcaaagatctcctttggacttcctctcagttctgaagctgggaaggttcagacaagagactactgactgattttgatgtaaacatgcctgtacctctgaattcatgtgagggtatttgccccggaaatggttatctcatttacctgtccacttactcccaatgcttatttccctttatcattgctcagaggctctgtgaaagtgttagttgcacagttgtgtctgactttttgtgaccccatggactgtagcctgcaagctcctctgtccatgtaattctccaggcaagaatactggagtgggtaccccttccattctccaggggatcttcccaacccagggactgaacctgagccttctgcattgcagacagattatttaccttctgagccactagagaaactcggtgttcagaggctccatggaaatcccattttttgacagtagcctggagaatgtggtttcgggtggcccagctgggaaccgtgaatagctccagactggaatggaatatccttggtttggagtccctgtgtattagtctgctagggctgccatgatacagtgccacaaactgagtggctcaaacaaacgaaatgtattgtcttaacatttctggaggccagaagtccaaaatccagatatgagtaagtccgtgctccatcacaggtgctagtgaaggtctgtctagggtctccctctggtcatccctcagcttgtggctgcatcactctggtcttttacagccttctcttgcctgcatgcttctttgcagatttcccattttctaagaacaccagtcatactggaataggggcccactctgctgcagggtgacctcatcttagctagttacctacaactaccctgtttccaaggttagtgtgtcaaagtacaaacttgggggatacgtgggccaacccattacagcctgtaaccagccagtggctgtacatggatcggttcctacattcattgttcagtcggtgaagacctgagaaatttgtgccaggtgctgttctagacattggaggtaaccagtcagcgaaacagacttcttgatctcaggaagtttacttcatgatgggaaagacagacttctaaaacaatatatttatttttagggtctttagttgtggcatgtggggtctagttccctgaccagggctagaatcgtggacccttgcattgggagcacagtctcagccactagaccaccggggaagtcctgggaaagacgaatactaaattttaaaaatataatggcaaatcgtggtatgttctaaggaaaaataggaaggcagataaccagtggcacttggcatgggaggctgtttgagacagagtgctcaaggcaagtgtcttggacctgcagacatgtggaccaagtttcactgaagtcaggagtaagccatggagaaatctcgagaacgagtgtcttcgagacaagtgctcattgtacgttcattaatagtatgtgtagagtcatttcaag

SEQ ID NO: 46082 - DNA, 730 bp, Bovine  19866881963467
catcctctttcctttgtctctcttactttttggactccccccaaatatgtttctccttccctttttgtttattttttccccagagattcccccttccctttttgtctccctaaatctctcctcctagccctctgcgccatgcctgttttttgggggtttttttctcctttctttccctcatctctgtctcatctcagtggttttttcctgtcttgatatttgccaaactaaatcctgaaattccagcagggtttgaagtcggcccccagatgcacagcatgacatgagccccaggatctgtggggcctcccacggcatgatggacaggagcagaggatggagcatggctgcttgagcgtcatccgggctcactctgtatttgctcctgttagaggaaatggaccacatgctgacggcggtcactgccacatgactgtggctgaggatttcatctccccaaatcagaaaagttccagaatgaatttttgcgttcctcataacttaaccaggcacatgcgcatgcacacacatatataaaggaggtatgtttgtcagcccatacagtaatacacggttctaagtaggaacacagtaggaagagagatggttactgtgggatctgtaatttttaatttactgacttggaggctctaaaccagggcctggtgcttaatgtagtgttcttacattggatggaaaggcataaaatcttacaaaacgcagaccagtg

SEQ ID NO: 46083 - DNA, 1668 bp, Bovine  19866880353682
cgggcaagtgcagtttcacagtgagacccgggtttcctgcttccaaccaattaatcatcccaatggcatgatccacaaataaaaatactggatgtggtcaccttttaaagaaacaaagtttaattggtcagtgactgatcgattcacaattccgggcttgtaacaactagcctgacttagcatgcattaaaaacagtgagcaggatattgagagtgccacctaaagtgaaaaatggatagttgtgtccctgtgacaaggaagatattatgaaactgggtcaggaatttagagcaacacattagacacaggaacccagtcaaaagtctctccttcagtcacgaaggtccttttccacacagctgccctgtttccaaactgtgcaaattataaacacatcgtgactaacttacccagtctgccctgacgagatgaacaggtaaattctgtggaaatcgagaaaggatatttttgttcacgttctagtttttactgtgtgtggtccactagctcatggagtgtttattcaaatagttgttttcactttcttcctcctctttcctcttctttaccctgggccacagacctcaagggccccaaccagaagggctcgtttgtgggacaggaggagcagggctgggatacaggaggcagagagacaggacaagcctggctacagccactgaggatgtgatatcctgtcccatgggcaaccagagcgcttagacgtcacgggaggggagtggtggggatgggagggcgaatcatctctagtgagtacctctcctccatctctcagacctcaggatggagactgcctggttctggtccacaggggaccatggagctgtctcctcggagggcaggcagattgaatgggacggtggggagcttgaacttggcagatgacttggagcggggtggacagagcaacttaagagaggctttggaagcagaatcaacaggtctgtagacagactgcattgtgggcaaggggggttggtgagttataggtaagtcactctcttctaacagacctcctctcccttgctctgtttgtggggccccctcagtggaaagaagcttcccagtggttcagcagtaaggaatccgcccacaatgcaggagacacaggttccatccctgggtaggggaggtcacttgaaggaaggcatggcaacctactccagtattcttgcctggagaatcccatggacagaggagcctggcaggtaacagtccatggggtcgcaaagagtcagacatgaccaaagcaacttagcatgcatgcatggcatcggtggaaagaggtgcaacttggatgtaagatgtggatgtggggcccacctttccatgtaagacctaacgtcttacatcgatttttagcatgaggacccaactttagatcgaacacaggatcaaatccttcttatcattaaaagaaaatactttttaaacgattcacaacaataaagccctctgttttcatctgctatcaccatgcctgtttctcagaaggttttgaaactgaaatttcaaaatatcctgagtaataagactctcttctgttactgaccacatggaagcaaaaataatgagagggctgagaatcagcatgtttacagaccaattcttaaaaaataagattaagtatttgatgttttgaagct

SEQ ID NO: 46084 - DNA, 2676 bp, Bovine  19866880482318
ctctgatgtgtttttaggcattaagcactatgactaggcactgggctatatcgattctatacctaggtttacactcaggccttagacttgatggagactagatatttctagtccccaggaatctacattgtatttcttctggtacagcataaatttgaacccacatataaatggacaataattactagcaaaactgagtgacaaaatcaaaagttctcaataaggctctgcaatcataataatgtgtcagaaacattaaaatgtgtttccatatataaaaatgagtatggaagtgagggttgaggacattttaggacatttcttgaatccacaatcttaagttattaaattttgacaagttcaaatacaagtcaaaaccttaaaatttattgtgatttatttccaatcattttcacagagcaccatttgaattattatgtttgaagcttattaaagacaaatgaatggcacatttatagtctatataaatgcacagcctctttcgggaaacagaaaatccacagtaattctttgtcacagacttcgtttctgagctgaaggtgagagctggccaggatgattgatcaaagtgaccaaagatgctggtgaagttcagggcaggtagacaagtgtctcctgttgtctagaaacacctgcaaatgtctaaactgtgctggtcctggttctcagatgctgtttcttcctctttctgcattaggaattcctatgacctggttaagcaaatactcagtggaaggacagtccaatatttcatgatgaaatgcaggggaaaataatactcaccttgtctttctatgactaatgcaaaaatctaatcattccctccattccatgacccacactgggtttaaacagctagtctgtctgccaggtaaaaagacttaatgtccctcttgagaagaaattaactgctaaaacagactcaggtgaaacggagttctgtcttctgtcctcaatgccaccatttttctctttgaatctggctcttccgttcaagtagaatgaaaacttggatttttgccttgagcaaattttacttcctaggctcaaattctgggactctgtttaattgcagaggtgagtttgccttgtagcaactctgaaatcactcttaaattcaccatttaagagcaggagggggctgaagtggtattccacttccttagttctgtgttgctcctgagggaaccccctgcctgtttttcttattcaacacaactttactggattagttaacactgaaaagttaacaagacccaggcactgagtagtagcaaaccaaatggactcaggagtatgacttgggcttctctagccagcatggctctgcttctgatcctggggtatcaggaaggaggaagctgggttctaaaaaactagaaatgtttgtttactaaacaagattataaaacaaagttaaaaaaccaaaacaaaaaagtaaacccgatgtattaataagaaacagaacaaaaaagatattatttcaatccaactgcattctagaaaaagtaaagctattaataggataatagttcagcagtttccatgagtttggagaatgggtgaagcattgcaagggtgaaccttgggggatattttacaccagtgaaactattctatatgatgatgtaattttggatacatgatgcatttacagcactaagtgtgatcccaacacagctaatttttaaaaattgttcaggagtttggcagatacaggatagaatgcaaaatgagggagaaaaagaatctaactctacaaatgtatgaaacaatttcactgaggggagtggagagggaaagatgctgacctcagcaactctggaaatgtgtggactccgtgagactgaaggcaaaggaaacgacacataagtgctgtactccggttgatgcagtactttcacacaggggtccaagttaacaattctgatgctgctatgcatgtttactgaaagcaaacacacgattgaatatgaacggtgatgatggaagtcagctttctctccataagatttaaagtttacaggtaagcggggagaggaggttgtaatgatccatgttgtaataaaccaaagccagagacttaagcatgaagtcagatttagcttaatatggctacatgtacaaatatgtataaatatgtatgtgtaaacagttagtatacatacgtatgtttccggcctctgtcatctcagtggacctagaagtaacaacacagcgtagcagtgaacacattttccaataaaaggaagtgattcttgggggaattactggtttgtggactgaatcaagaaacacatgagtgaagtatctggtagtgccataaagtaaggagtgtccaaaataaaataagagatggaagtaggtcaaaggaacgcagaatccaacctacagagctcccagttaccaaagctggaaaaatttacacaaaaaataagtaatgtactactggatttacaataactcaaagcataaaataaatgtctgtgagtctattttgataaaagtattgtgtgcttagtcattcaatcatgtctgactcttggatggtctatgggctgtagcctgccaggcttctctgtccatggggattctccaggcaagaatactgaagtggattgccatgccttagtccaggggatcttcccaacccag

SEQ ID NO: 46085 - DNA, 2276 bp, Bovine  19866880589819
tcaggagggtgagaccagtggccttgctccccagcgcctgtgttctgacaatggccccaggggatgttaggtgagaatatgtggcagttgctttccgtgccattaaactcataagcctaagaatgttcacagcatactccactcatacgtattgactctcaaataaataaagcaagccatattctatttttcaaatacacgagcaatttaaatcaagagtaaacttttcacagcagtttagtttacaattttaatgttctgttgtgatgattcatttctcttcctcctcgatttaaacgaaaaaaaaaaaaaaaaagaacatatatgatttcaaaggttttaggtatatgactgatccactcactttagttcaccaacacaataagacacagaattgtattgtatggatcattgacatggccgatgatactgcctcctgtggagttattgtgacccatcttgtcgatggtagcttcctcattttaaaagcaatgccctctatgtggtcgctgatccaaaatgtgtctcaaagaacaatagagaaccatggattgattctgacttttttattccattgtgatcatcagaaatgtctaaaagtcaactcatcctattagaatttcacagcctataatagatatacattttgaagcagctctgtttaaactcattttattcagtttttccttaaatgcacatgacaaaactaaatagagaatagctgttatttaatacataagtgtttaatgtgatactcaattctccaggttaaaagatcaacaaccacagcaagaaaaacaagccagtgtttctcaatttatgttatcaaatactaaatcatcatctacattagttggcatgctaataattttcactcagtttggaaactttgcatcagtggttcaccaaagcagcagcagagacctgttaaagtttaaattcttgggccccatgccaagatgctggggtttcctaggtggtgctagtggtaaagaatctgtctgctaaagcgagagacttgagttcgatctctgggttgggaagatctcctggagtgggaaatggcaacctgctccagtattcttgcctggaaaagcccatggactgagtagcttcaggctactcagttgcaaagagtcagaaacgactgaagtgactaaacacatcctaagacgtacttaaatcagaaacccatcaaactatgttttcataaggtccctagtacttctgctgagtccccacttgctccacgtggagatcaagtttagactggtatgcactagcaggatttgctaaaatagttgtatctttagtgaaaacatatggttgcaagcactctacaattgttctgatgccaatctttagaagtcagacataaaatgcattgcttaactaattatcaaattaaaaaaaataaaatcttctctagctttcttcttccctacagcaaatgggatagttagcttcagctcacctccctcattccacaaagattatccaatatcattcggcctggttctacctggatatagtttgttgattggcggtatttggactgttagtggaaacatcatactataagaatattgtgcaaatatatgtaataaggtattttttctctgggtgtctccagcctgcaactgtatccaccttgctcatttcctgctattgttgtcgtttagtcactgtcgcacctacatcttttgtgtccctatgagctattgcctatgaggcttctctgtccatgggatttcgcaggcaagaatactggaatgtgttgccatttcctttcccaggggatcttcccgatccaggaatccaacctgagtctcttgctttggcaggcggattctttactattgacccaccagggaagcctactcacttcctgtatgcttctaattttctaggctctccaattatgaaattatgttaagctctatttttttctctacaattgtatgttttggaagcttttatttccattaactcaaaacggtaagtcacattccctctgcgttctagaaagagacacgctcatccaaattagtgttaattactgatacatttctacgcattcaatcagttcagttgctcattcatgtccaactctttgcgaccccatggactacagcatgccaggcttccttctctgtccatcatcaactccaagacattgcttaaactcatgcccattgaatcagtgatgccctgcgaccatcgacagacatcctctggtgtccccttctccttctgccttcaatctttcccagcat

SEQ ID NO: 46086 - DNA, 1556 bp, Bovine  19866880740771
tgaaggacccagtgtcaaccattaagttgaactgctctctgactctcctgggactttacacagaatattctggaagcgatgccattgctttcttttttctaagaaacaaacattcagaacgaaaaccctcacacacatatccaacccaaatgaactctgaggctaatatctaaggaaaaataaaataaaaccttctcccaatactgtgtagcctagccctaaagttattgtattataagactattttaataatgatttttgaaggaagagatgcacatgatgaggagactactacaagctacaacaagatgaatttttaaaaacaaatttagatccaatataaatacaaacaccattatggaccagatttctgattctttaatatataatgatatgtcaagttaaattactatataaatattctttcttttagtactataagtactctcatttgatcaaaaaggtcattaaatagtatgatggctatttagggacacatggaagagtcgtcaagtcattaggatttcctagtaattttagtttaaacagacatctgtggtattgtagtgtatgccacagaaatacgtttacaaatgacctgggctcctgccagtctggggctaagtggattattaacggggtgaattcccagacaactgctctttcttgtgggaaatgcaatgaatagcatccttattttgttcatttaccgatatcagtctaatttctctccatccatgcggattttagctcactgacaaatgagagcgaaactccttaatgaaactgtgcagtggaatgcttaccacatagcaatattttggggggacactgtagcaaagtataatgtattttcaagaaggagtcaaaaaataggtttgaaaacaacaaagtcttccttctttttttctttctttcttccttgaaaatccagccccaaactctggagtgagaagaagactggggaaaatgtgggagtgctggggtcaggatgccaagaggacagtgaccaggcagcccagagagagcctggctgggctggggctggggtggggcagcccagcaaaggagggcagagggcagggaaggagcgcactggaaagcagagtccatgtgagtgctgacccaccaggtacagccatgcattacaaataggagctgacatgtttcttgctgcagaggaagggagttatatatatgaaaaagggagaaactaaaatggacagttcagctttgaactggagtcaccagtatcagtgtgaatgcaccattttttcagtatataactatagacataaaaacatgtaaaaacagctgatcgtgggtgtatataaattccagttctcatgattttctttcttgaatatcattctccattaaaaagaaccagggctccatagcgaaatgggtaattctagggctgaggcgaggaaaatacaacaaggtgttgtcagttttatagcaattaggttagaacttccattatttcagaaaatgagattcgctttggtcatgggatggctctgcctacctcacaagatagccgtgttaacaag

SEQ ID NO: 46087 - DNA, 1734 bp, Bovine  19866880834321
gagaattgttttatgatatcactgagggagactgaatagagtgagtagagaagggggtccagaatagcaccctaagaatgaacaacatgaagcacccaaagtaaaaagcacagaagaccaagagcagtaaatcagcaagttgggagaaacattttaaaagggtagtataaaaaaccaaagagggtcagacactttatatgaagaaggagtgagaagagaacactatcaactgtaccagagagatcaaaaaccataagcaatgatgtgtttaaatgtggcctcttagaatatctaaaatacaaagcactcttttctctaccaaattacatgataataaaggcaatggcaccccactccagtactcttgcctggaaaatcccatggacggaggagcctggtaggctgcagtccatggggttgctaagagtcggacacgactgagcgtcttcactttctcttttcactttcatgcattggagaaggaaatggcaacccactccagtgttcttgcctggagaatcccagggatggggaagcctggtgggctgccgtctgtggggtcacacagagtcggacacgactgaagtgacttagcatagcatagtatagcatagcatactctgaaacatcttagtaaaaagtagattggttattgcagccaaaatatccctgcgtgacttcatcctatgagctgtgaaattgcaaaagatatattttgtgtttcaagcatatctagatgctaacaaaggcttagagtaaattcaaagtaagacaattctgagacttcaattaaatgaaggaaatgggcaacctaaattgtacagtttctgctatccatactgaggtcttatatccccacacatgcacactcttgggcacatcctacatggtcaagatcactgagggtatgtgaccagggacacaggtaggggcagaacagaggtggccaaattagttaaccaagaaatcactgcactgacaaggaagtgataagtagctttccatattccctttcctgtgttaactgggtcatttagctgaaagttactgggctgtgagaatccttatccagagctgacccaaaagatcttggcttagaaagaatgcctgaaaggtaagagaaatgtcacacttcttattgtaaataggataatttctgatattaggtaggaatattttcggaagggttttttatggaaaaaaatgtgcaggtcaaagcatccttctttggggaattgactgtcaccttcccaggagtcctgatggactatagggccaggtacagaatttatgctggactattcagagaatctccaagctctgtcaactgctggctcagagaggattatctgatctaagcagaaataagccagtattttttcctaggattgtctaataggattgggaagggaaaagataaaaagcaacagagagtgagatagagtaagagaggtggaggggcaaagagagagaaagagagtctgtgtgctgaacttggtaactgggaatgtgagtctagtgctgccaagagctacctacatgcatatgaaaataagccatagagaaaaagcagagtagagacgctgggagaaagagatagacctgacattattattttagttcctgagtttcactgggcctgaagattctcccctagccctctcagtttggtaaaccagtgaattctcaagctagttgatttaactttctgatacttgcatgtaggaattttta

SEQ ID NO: 46088 - DNA, 1462 bp, Bovine  19866880868513
aaactattctcaaagaatgagacagagtgtgtcagagagacagagagagagagacacccccagtcctcatcatgtagtcccttctataaattcaaatcaaacattgatttgatctgctcttagctttattaaattaatgcagctgagtagacccaaagatgaatgtgggaggagataaagtattaaaacgtctgccatttcaaacacagtaaataattttaaatttgccacctgtgcagagcacttttctacatttcagtttttcgaattgtggaagatgagcagattctagataggaaagccatcagcaggcagcaaaaccactgattcttggagagaaagggaaaacattattttataaatgattccattaagtagattttgaaagcttcctacttctctgaaagagttatttcttctttttcttttcttcttcttcttcctctttttttttttttttttaacataacaaccatggggactgtttagaaatcaggagctacttcactctaaaaaaattactcttaaataaacagtttgcaagccctctcagtatgtggccagagcaaagaaaaatagataaacatttcttaaaagctctatcaaagtataaaaactccttaaatctttctcaggcatctgagtcctcaaggactatttccctttttctttttcttagccatgttgaatccaacttgggtgatctttgtcacatccgaaagtttctagagagttttgtcaagagcctagggacactgagcttatagattaccatgacttttatagtaataaagcattaataaaatactatatcaactttcatctgttttcaaaacaatcattcacctttttattacaaatttgattacaaaaatctcaatgtaaagcagagtaaactggggacgggtgggaaataatttctgtataaaagtacatggtgctacaaattatttagtacatttcgcatgtacgtgcatttgtagcacactgatgtaaccatagagggaagaatacttaaactgtgaaatgttagatacatttgggcttcacatttttatttcacaatatgcttcatcagatctttgttctatatagggacatgaaaatacttcacagaagtgtttgcctataggccgagagcaaagtgactcagattgaaactcagtcctgggacttccttgatggtctagcagctaagattctgcacttccaatgcagctggcctgcactgaaccaggttcaatccctggtcaggggaagagatcccacatgcatacaacaaagatcaaagatcttgtgtgccataactaagacctggcacagcctaaataagtaaataaataaatattttaaaacaaaacaaaaaggctcagtcctgctaatctctgggccatcagtgttggctgtctccacctgaaacaaaaataagagggaaataaaacattatgatacagtttattcg

SEQ ID NO: 46089 - DNA, 1126 bp, Bovine  19866880907919
ttaggaagaagctgatgcgtaaaggaaagcagaagacctgacctatggcaagttgtctgtggtgtgagatgaggcagtgtgaagggaaacttcgatatttcacgctcagacgttaattggagcacatcactcagctccctgcccatggttggaagtactggttgggaatggtcaaaatggcactagagcaacccatggtctggggagctcaccctattatgtacagggctgggactgatgcatcatgccacaacccctgatgttccctgctcataattaaggacaaaaattttagtttcattttaaaaaaggttaaaattgaccttgactctttaactcacagagtagttgggagtatcaacaaggtcatctatgtaaacgcagttcataaactgaaagtgtacataagcgcaagatgtaataaaatttaaagaaagaaagaaaaagtcataagtcaagtcaaaaaacataagtcaagtcaaagtcaagaaaacataagtcaaagctggagagaaaataaatccaagatttatttggatttggtcagctcttcctctgctgaccatcttacccatggctttttaccacatctttcctccatcagaattgatcaagttttccttcaggctggcacaaatctcatgatgtcaatccactggtagaggttcatttttcttttaatggctgggatttaaatgcactgctgggagtgggggtttggggagtgtgaagggtcaggatcaaagctcagtggatatctagttatcatggctccttcacattgctcagaaaagtgaaggtcagtgggcaaatgctctagtgcctgctggggatatctgaccctaaccacctaacatggtgaaaaaattacattaatatttgtattgtacccccagcaaaaacagttatagtcagccaaatgtcagtgtgactgaagcttgcggtcatcatagtgatgtgaggcaagttcttatagagcctggagcctttctctaaatgttgtaattatattacatcattattgatcttccatggaaaatgccatgtcatttctcctagttaacgcttaaatttctacctctctctagcttggcatgtgaatttaatcaaacactaattgttgcaa

SEQ ID NO: 46090 - DNA, 1051 bp, Bovine  19866880919024
ttcaatggacgattcagactgcatgtcatgcactgttcaccaataatttattatatgcataaatagccttctctattagatttatatctttgcatttgaattcagatccacttagtctgatgcctcagagtctagctgaaaatatgccaaaagtttggctttcaagttttcaagcgttttggggggattaattcatccaccagaagcactataattccatatgtccaagtttagatatattcgctacttctgaaagaaacaatgatgacactatgtggactttcaaaatgaatcaaataaaagggaaaacctaattcaaagccaaattgggattcacttgcacacattgcagacttaaaaaatttttgttatcatttgactggagctctgttggagactatttataagtcatttctagagagttctttttaggatactcagcttaaaattgcaccaaaaccctgttttactttccctgatcatgtaaccaaccaagggactgactttttataattttgtctctcaagccgtgtcagcaggaagactgcaaagccatctttaaatccagtaaaaacatgaagcctgagatgaaatttagcacttgaactcccaactcaagagatcctattgtaagagaagatagagtagaattgaattataaaacattttctggacataaagccattcattcttaagacctcaaaatggctgcctgggagaaattatagctctaaaatttttaatagcactcttgaatatcaaacagatttagtggcaagtctacagaagatgtgagtatttaatgacaaacaaagtgaactttactgtcagattgcctttattggtatttttccattcattcaacaatggatctccttgaaaggtcacattgtaccacctgtgctgtttctcaaaaatgaatcagaaacattcactgagttcctagggatgctgtaatattcttgataaaatgaaggtagtatatttttatgacaagcatataaacacctgttccatttaagaacagtagactgtatcagataaagacaaa

SEQ ID NO: 46091 - DNA, 972 bp, Bovine  19866880925349
gttaaaggttgcttctctgctagaggttatcctaggtgaagatcagtctgatttatatccagcctcagatttatctatcttatcatccactggtcagatgttttgtataaaccaaaggggagaacaaggatgtagcaaaccagaaattcctgtgtaaatcagtttgtaagatctacgagtaattgcacatggttaaattgtggaaaatatataagaattaggtattttactgacaagtacatcattttgtgttccaaatcaacaaaaataaatgtatttttaaatattcttatgggtctaaatcatagacctactataacattttcccatttatatctatcttgttataaattagtttaacctaccaaaattctatttttgtgtattttcgaaatatccggataattccattgtgtttaatggataatctattctttaaattcctatagctttaatattttcaaatccatttctatctggttatctgtttactttgaaaggagagtcctatgaaatttgtaggacagatagttactttctctgtttaataggctcttagagattgagtcagttgctaaagatcaccagccagctgggctgaggtcaagtctacacacaaccattcagttcagttcagttcagtcactcagtcgtgtccaactctttgccaccccatgaatcgcagcatgccaggcctccctgtccatcaccaactcccagagttcactcagactcacgtccatcaagtcagtgatgccatccagccatctcatcctctgttgtccccttttcctcttgcccccaatttctcccagcatcagagtcttttccaatgagtcaactcttcgcatgaggtggccaaagtattggagtttcagcttcaacgtaagtcctaccaatgaacacccaggactgatctccttcagaatggactggttggatctccttgcagtccaagggactctcaagagt

SEQ ID NO: 46092 - DNA, 829 bp, Bovine  19866881008707
tacaattggtgataccttgagttttgttacagcatggaaccttccatctgctctgggcaggtggtacagtggtgtgtgttgatgtgtgtaatgacaatcacaaagtttgcttattcggcatcagctgccttgggttaaagtctgaacctttcttaagctctgcacgtcaggggtgtttaggacaattcaatcatttatttagccagtactgatactgctctctggcaggtggattcagagctaagctccaagtctccagctctaattggagaaatctctgataaattcccacagcattccatttggatacgtattgtgttctgttatggatgttctctgccctgctcccacccataacaagtctgctggtataagcctgtcctacaaactgctgtggtggacagtatatctttgtattgatttgatggagctgggtttttctttcctagtctcagtggagatatctgtcagttcagtatcctattttgtaggaataatggacaaggcaaagtggtgataaattctgatggtaagccaagctgtattttcttgctacatgagaagaaaacactcatcctaaaggcagtttgttctccattttaaattactcaaagaaagcatttttacccagatgctaccccctgggtctcctttgtcacctcaagcagcctaactcatccttcccccccgcgccccctgacacacacaaacccttcgttaattttttatgacttgtgaaagatctccactaacgtgaaactgtcctacagacactgtgttggccaaaaagtttgtcggtttttccataagatgttatggacacttcacg

SEQ ID NO: 46093 - DNA, 1373 bp, Bovine  19866881019854
aatgtttgagaaacttaatgcttttaaaatgttgtggacctgaatttggaaatctaattttattaaattttcaaatatgctttttcttctcattttgtttttccctcttttaaatttttcttttccgcctatatttccctttgtgtttctttccatctgcatgaattacctatcagttaatagaaactttagcaggtgagggaaataaaaggtttaaagatgataaaatagaaaaaaatagttacatcccagagtaaatcttatattgagataagcagaaaattcttgaacatattctcctatgataaagtacttgatatagcttcggagaccttattgttaaaaacaactgacgtaatattcttaaaaaaggaaatttgcagaggtaagaaacggggaaattgcttcaatcttttctactcatctttgtacacacacacacacacacacacatgcaaagaacacaatttattaacagcactacagtggaaaaacaatgtatatggaaatgaaagctggcaaagaatcgcatttcagttttagtcatagatgtggatgactttgagtctagtaagtggactgaaacacccattttcattccacaggttcagggatgtacttcatacagttcaggggtcacaggtagtggagagctaggaggagaagggttgatttgtcattgcaattctcaaccaaaataaaattccagtaagagactggaaaatatttcatttcaaatataagttgtaagcattttcatcttacattaaaccacctcagagcaaaaaacctttttctttttttacatagatagaaaaaaatgcatactgaaagtcaaattcttgataccagtttaaggcttctaaaatacactttaagaagtgcttgaggatgacgatattttatttaaatattgttacctttaaatctttcctcataatagcttcatcaacattcattttatatcaacattcattttttcccttattttaaaatcagctaaagcctatttttgctttacaatatacatttcaaatttaatttcatttaaaataccaattcgagttctcattttttccttagcaagcaaatatcccaacctcatagctctttgccaagccttggcctcaaaatgttgtatttaaaaagcaaataaagaacacaaacttattcaaactctcggaatgcctgagcctgcaactccgggaaagtctttatctaaaaccaatgaacttttcagggctgttgagaaatgaccagaggggccaattagttgttgcacaattggaatcttcctgacgctttgtcaataatttataaaaggagagggcagaggggtcactgtcacgagggagttaaattaaaatgtttct

SEQ ID NO: 46094 - DNA, 1627 bp, Bovine  19866881243913
aaccagtgtcaaggaaaggaaaccttgaactgtaattagtgaattgttggaggctcaatgtgaacaactctgagggttaaaaactcccagggggaccctgtcatgggggatctacccacgcttttgtgaattttatctccaggagctctatcagggtctcacagtgaatgttggagataaaaaatcccctgtgctcctggcagggggaagggaaaagacatcattttgaaacataccacagcactctgttctcaacaggcaaggagactctatttgccagaccctgaattgggggttttattagagcctaatcaacctaatcaatgtatccaggagatagtggaggaaagaggagcctggtatgctacagttcatagtgttgcaaagagttggacatgacatagcaactgaacagcaacgaccaacctgggagaagggaaatacctgtctcaggcccactctagccttccattcggaggaaacgaaacacacaactccagccccttccagccattgtgccacctaaggcagggggtgggggacaaatgagaagcactgatagttcataattcagggcgcagggtcgccaaaagaccaagatttaatcacaggactacagaatactttcctcctacatctcactgctactttactaaaggcctatttaccacagttccttttacccagtatatcatgtctgcctttcaacaaagaaaatacaagacacattaacaggcaggaaccacagtttgaagatactgacaagcatcagaaccagagtcagtatatggcaggaatgttagaattactagaacagggatttaaaaaaaaaactatggtaaatatgggaaaagtagacaacatgcaagaacaggtgggtaaagtaagcagaaacatgtagtttttaagaaagaaccaaaaagaaatgctagaaattaaaaaaaaaaaaaagtaacagaaatgctaaatgcctttgatgggctcattagctaaggaaagaatctctgagcttgaaagcatgataatggaaactttcaaaattaaaaagcaaagagaaaaaagacttaaaaaaacccacagaacaaaatatccaagaattgtggaacaacttaaaaagtgcaatgggactagcaggaaaagaaagagagacaggaacagaagcaatatatgaacaataatgacccagacttttccaaaattaatgttagacaataaaccatggatccaataagctcccaaaacagcaagcatgataaatgccaaaacaaaacaacacaaaaaaattacacctaggcttatcatatttaatcttaagataatcaaagacaaacacaaactcttgaaagacaccagagggaaaaaatcctgcttacagaggagcaatgataagaattacatctgacttctctccatgcaatctaaaagaaagtagagttaaatatttaaagtgttgagagagaaaagactccaacctagaattctgtgtcctgcaaaattattcttcaaaagtgaaaaagagattaagactttctcagataaataaaaattgaggaaactagtcatcatagaactgtcttaaatattaaaagaagtttgtcataagaaggaaaagacataggtcagaagt

SEQ ID NO: 46095 - DNA, 809 bp, Bovine  19866881367924
ggctcaaacctgcgtcacctcccattggtaagcagcttctttaccactgaagcactagggaagccgtctaaagatatactgtagttaatctagaagattctttaaaagaaaaaaactttccaatgcagatttattttgtttagtaatttcaaagatacctagaaaatgaagaaaaaagttgtgcatatggctagggaaaaatataggtttgcaaattaaatatgcagaatagcattacagattggatgtccagtcattccacagctcatgccttttctacttttgaatgttttttgaaaaatagagtagtgactagacatgtgggttaggaaaaagaaataggcatttgttacacatcttttatttgccacgtgctgccgtaagttcaaatttaatgttcatgataggtatatagtaggtgatttttaaacacataataaaacaaaggctctgaataaaaagtgaaagtctacttctctgactttctaatatttttcatcaaatattaccacagttagttttgtctgtaccagtagggaaagtaatatgttttgtaaaaacctgtgtacgtaatgtattgttttttaacccattatgccaagggacctagaaattacaagaaattagaggagggttgtgattctccaggagtttacaattaaacattcaagagtcaaagaacagtttaagaaaacactggaagagactctactaaccaatgtgactgtcatataaatagtaccatgaataaatggccaggagttcagatataagagatgctttaaacaagggaaagcttcacagagaag

SEQ ID NO: 46096 - DNA, 1221 bp, Bovine  19866881374367
gagccggggcagtgggtattcggccttgggtggaactgctcggcggatgttgacagctgcagcgctcccagtgtgcagcagtgggattagaaatccttctcccagccaaaactgcttccaacagctggagtcacgccccctccccgcctcccacctctgctccatttcttgctggagaccatctgaaaggggagcttaaaatgactcagtgtctttggggtaaagagctttggcttttccagactgaaccgccagagaccttcaggaaattaaagaaagaaagaaaaagtgagatgctctgtgtctggtgaatggcatgtctcgaatgtggtggctgtagggtgatgaggctagagccgttgggaattctgcagtgttatttatttgccttggcacaccgagttagaatgccgagcagtagagtgaaaacggggtgacgggataagggtaatgagaggaagcaaatccactgtgagacactgggttctgaaagagagtttctttccccagaggagggagacaggactattacctcattgcaaaagagtcattaaaacatcattgagggctccacggacggcaaaagctcacagctagcaatgtctaacttcattttcagtggaagttaaaatcaaaatcaacaccctgatgaaaagttgtaacacaaattagagaacaaaacagaaatcttttctgggaggctttagactatgctttggttaaaataagaaataataccgagaaaggaaggaaggaaggggggtggaaagaaagaaagaaagaaaattgttgccactgtcttcatagcccgttcttggaaagatgatgctagactgggactcattaaaaagagggtcttctttgagacacatgaagaataggtgggatgcttgagaggtcaaaacttctgtcctcctttccttcttcctgaagatccacgtgccctttgatccatattaaactggaacaatgcggaagtagcattagtccaactacatgcataccagcacttcacaccttctcaaatgtatatcgaagaagaaaagattaaagatgtttataagtaaatatttattaagcacatatgaagttcagaggtacttttcctcgatatagttgtaggatgtgaatggattgatagttattctacaaccagccacagaggaccacctaatttgaggctcttctgtacatcactttccacaatatatttttgactca

SEQ ID NO: 46097 - DNA, 709 bp, Bovine  19866881731075
tggacagaggaaggaaatcagaactaagtcgtgcaaatagcctgtgaacaaccagaaaggtggctgaggttagaagcaaagacagggtattaaataaaagacacactaaataaaatgtctatttcaaagctatttccttacttatagaggctgaatttgaacaactttatctcttctaacttacatcccttttagagccagttggcatcccatatctgggagcatcagagacccctgtgaatctgagcactgtggttccactgcgggctttgtagactggtggctccaaacaagatttcagtctttgccttgctctgaaaacttccttttttttcaccagcgttacggcgcttgccaagagtgacataaccttgaaattatttgttacattttccagtgaacaaacccagcttgttaaggaaatgggcagcctatatcattagcaaagagcacaatagtggactcagaattcagcctcgactggtgggcccgcagtattcgacgtttctgggaaatctctctgattttagaaacaattcagcattctaactgtgctgctaggggtgggctggcctctgggaggttgttagggaagcaacaccacatgagagccgaggctcacatggtcctcaatacattcctgtccagggaacatggacactcattttaattgcacttctcatctattagtgtctttctttaaactggg

SEQ ID NO: 46098 - DNA, 898 bp, Bovine  19866880741751
gctattagtataagcactcttcagtaactaattatcttttcacacctgggagctggagatgtcctaaaagggaggtttcctggctcccaaatggttgtccccaaatggatattatggaatcagttgttcagtgcttttctgcctaaatctgaatcatggtagggtagtagaagtatttagggatgaagcatgaaaaaaattaggagttttatgtgcccaaaatgcatcaaatgctcagatttgtgaaagggtgccagttactgcccagcacttctaggcctgaagcccttctggttagatcttcaaaaggcagtgggacatctgattaaatcatctggaaaaggtggtttaggactaatgagcctaataaggatatcttaaaaccactctgttgcaagatgggggcaggttttcaagtttgatttatttggagaatctcacagagaaacacatattttctaaagaaataactagttgtactcgttatttgaccctattattctgtgagaccttatcgaatgccaagcctatgaatcatttatttactcaaaaaattaatgagttcctattcttggtaggcataaacaggaaaaaaaaaaataggatccccttccccaacaccttccccatatgctttttgtccagtttaaagaggaagaattgggactttcctggtggtccagtggctaaaacttgttactccagtgcagagggcccgggtttgatccctggtcaagaaacaagatccctcatgcagagtttgcattccacaactacagatcctgcaggctgcaagcaaggtcaaagataacatgtgtcacagctaagaccctgtgcagccaaataaatattttttttaataaataaagaggaaggattgcatagaaaaacttattaa

SEQ ID NO: 46099 - DNA, 1329 bp, Bovine  19866880774093
tggggtcgctaagagccgggcacaactgagcgacttcactttcacttttcactttcatgcattggagaaggaaatggaaacccactccagtgctcttgcctggagaatcccagggacagaggagcctagtgggctgctgtctatggggtcgcacagagtcggacacgactgaagcgacttagcagcagcagcagccaagcgaggctggctttccccacgaccccagcctgtctgccagcagctccacgagcagcagcttcacatctgtcaggaaagcattctcttcaggtgggagctacagaaaacctctcaagtctcacggatctaaattagacgtcatgcaaccacggaccattgaaaacatggttattgccactgaaaatctaatcgtacattttattcacttttaattaaagcaccgtatgtgacaagtggctaacttatgaggcagcacaaccttgggttattctgagaaaaaaatgcaacatcgacatgactttgtaaccacacgcattaaggatgttaacaggtggctcactttcacagtccactctgctgagataaagactttcttaccctagttatttactcagcagatatgtcccaaatgtagcttttcagttcagagactgagagctgaaaactatggttttcacccttttgctgcaaggagtgcctatgacttaacccttggttagttttcagctttgggtagaaggttccatctttctgccaaaggaaacgcaagaggcacataccacacacactgggtacaaagcaaggcattgctaaaaaaaaaaaaaaggcaaagaatctgaataaaataatgaatacaatcgacaccataaacttcagttgactttggattatgttttgaatacaaagtaaaacaaaatgcttttcctgtcctacaatgctatttaatcaaataattcctaagcaagtttagaagtacctctctgttgacttttcctgctggttagatagtccaaaatgtcaaggcatcaaaccttctgcttggtagatttgccacagtgggcgtgttcctgaataactttctgagcaatgcagcagagaaaacaactggctatattcccaaattcactccagctcatccctcacttggagaaggcaatggcaccctactccagtactcttgcctggaaaatcccatgtacagaggagcctggtaggctgcagtccatggggtcacgaagagtcggacacgactgagcgacttcactttgacttttcgctttcatgcattggagaaggaaatggcaacccactccagcattcttgcctggagaatcccagggacgggggagc

SEQ ID NO: 46100 - DNA, 1831 bp, Bovine  19866881317121
caagggttttgcatagtttgtagagggtaatgtgaagccgcaggaagcttatcatcaggactgtgacgtggtctgatgagttgacatctaaaagctgtcaactgcaaaagcccaggcaagctgtgatgatgtcctggatgatgactgaagcattgctcacctaagatgatgaagggaaagcaggagccaggagaagcccaaggaagggttataactaggtaacgttgtgacgtgttggctcctgggactacagctgaaacttacaaggagacaacatcaagctgtgaggagggccttctaaagaagacacagtgtgttgggaggacgcctgcatttccagagtttagaaaggctgtgtcagtaccctgacaccttggcaaacgtccacagacagcagagttgtctctgctcagtgtccaggatccagcatcacaggtcgtgcttctggctgtgagatgggaagtgctttaatgtatacgtgctcagcatgatcttccagaaactcagaaaccagtgagggacagagccattgaggactgccaagagatgagtttgaaccacaggtccaggaaaacgactgtatttaaataggcgagtgtttgcgaattcagtgggtgatctggatggaatgagctcattcctgcttctcctggttcactaaaacagtctaggcatcttctggacctcactcttcaccagcctgtattgcctcctgggggcgctttactaacctgcagggcggggcgttttatgttcctgctaatatgctctaattgcctccaatagcagcccccatcttaaatatgggatttagactattaactttatatggtatctttaaaaagcaattccaacaaatagatattagccattaaaacaacttgttcattagtaaatagagccatttaaaactgcattttaatttctatgtctaaaaatgaaagtgcacggttttgttttgtttttaaaagaccccccaccaaaaagggcatacatactatttctttccttctttatccataaatttttaccaatattatatatgttgatctgaatgctgagtattggtaaaagtaaggtgaataggcaaagtaaactggaaaaggcatgcaacgtacatgtatgtttatttttttaaactttttattttgtattggagtatagcctgttaacagtgttgtgacagtttcaggtggacaacaaagggactcagccacacacacacacgtatcccttctctcctaagcttccctcccataaggcttccatataaccttgagcagggttccctgtgctatacagtaggtccttgttgattatctattttaaatctagcaatgtgtacacattaattccatacttcctaactatcccctttctttctttcttttcttttttttagtagttaagtgatgggaacacaactgaaatcagaaaggtactttatttgtacataaatagaagatcagggttcctgattgcaggaacccggatgcaggaactcaattgttatatatccatggcatagtttatctttccaacacagcgtctcttccttgtcttggctccatttgtatggttgtctcctatgatagcaagatgatgatagcaacactagccttatggttgctcaggttcaaatctctatgttcaacagttggggcaaaatctcctgacctattcttgctgctggttgtatccactcctggaacatcctttatgttaaggggaacaaagtgccctgatacgatcatattccctccacctcttgaagaatggattgaatccaccctatccaaatacatcgctaagaagagggcagggctggctt

SEQ ID NO: 46101 - DNA, 907 bp, Bovine  19866880695965
gttgagttttcttctttgttggagtttactcatggcaacaccctctcctcccttgttattagttattaagattcctaacacagatgttaagaggctaggatccctgtccagccccttccccacccgacacctaactcagaagcatgtcctttgaatttgggagacagactgtctccaatgcaccttccagcagggtttccatagcaaccactgccacttcaaaggtgccagaatgtctccatcttacatctgactttctccctccctgtgtatgtgccgttcaggtaacaccaggcggttgaaatgagcctcaggtcaccttaccaaatgtttcacagctggcaggagcaggtgtacttattaaataaattacgtgagcgacatagaggctggggcatcatcttcctgccactccagaaagaaggctgctttcatcggatctgctgttggtcaggaatccctggtcttaaagggctcaatgtctcggtgctccgtgatgatctagatggtgcggtggggtggggatggggggaggtgtatatgtatacacgtgactccttctcttcattgtacagcacaaactaacaaacattgtagagcaattacactacagtttaaaaaaagtgactcagtatagttttatcttttcttatttttcccattactcatgcttgcttttgaatgttccccatccttgttttggaagtcaaatggaaaggcagcaatagtaacacattttgaggggatgaggcttcagaccgggtatctcatttttgtcaggaagccactcacacctagaatcctcactcttctaataagaagatttcgagttgtgttcccagggtctacccaaactcagctgtgcacagcactcttcagtaacatagtttatgtttacttatttatt

SEQ ID NO: 46102 - DNA, 1659 bp, Bovine  19866880826051
tgatgatccaatggatgttggcaatttgatctctggttcctttgccttttttaaatccagcttgaacatctggtagttcatggttcacatactgttgaaaccccacttggagaattttgagcattgctttgctagcttgtgagatgagtgcaatcgtgcagtagtctgaacattctctggcatttctttgggattggaatgaaaactgatgttttccagtcctgtggccactgctgagttttccaaatttgttggcatattcagtgcagcactttcacagcatcatcttttaggatttgaaatagcttaactggaattccatcacctcccttagctttgttcgtagtgatgcttcctaaggcccacttgactctgcattccaggatgtctggctctaggtgagtgatatcaccatcgtggctatctgggtcatgaacatcttttttgtatagttcttctgtgtattcttgccacctcttcttaatatcttctgcttctgttaggtccataccatttctgccctttattgtgcccatctttgcatgaaatgttcccttgatatctctgattttattgaagagatctctagtctttcccattctattgttttcctctatttctttgcattgatcaccaaggaaggctttcttatctcttcttgctattccttggaactcttcattcagatgggtatatgttttcttttcgcctttgattttctcttctcttctttcctcaactatttgtaaggcctcctcagacaaccattttgcctttttgcatttctttttcttggggacaatcttgatcactgcctccggtacagtgtcacgaacctgtgtcctagttcttcaggcactctgtctatcaaatctagtcttttgaatctatttgtcacttccactatataattttaaggaatttgattagggttatacctgaatggtctagtgattttccctactttcttcaatttaactctgaatttggcaataaggagttcatgatctgaaccatagtaagctcccagtcttgtttttgctgactatataaagcttctccatctttggctgcaaagaatataaccaatctgattttggtattgaccatgtggtgatggccatgtgtagagtcgtctcttgtgttgttagaagaggtatttgctatgaccagtttgttctcttggcaaaactctgtaaggagcatctttaatttttttttttttctttcggtatttcagactgtttccttaggctagatttatggaaggggattgaaaaatcaaagggtttggttaacttcatgactcttgaagcctgtctcataagattttatctctgcctccggattataacaatacaaatgtatgtcaaacttcccaaggatttgctaaattgcacactctcctttttaagttaactaaaagccacagttgaatgttaatctttcccctattcttttttgcttttttgtttttttggttggatgtgtttgatgtcggtctggtttggttgtcgtctttctaggtttgtggctcatgcagaaactgaagaaatccgggtcgcttttgcagctgaccttcagggataatgctgatctgcgcaaatgtttcctctaccaactaagccaaaagacaggtgagtggatcccccagctgca

SEQ ID NO: 46103 - DNA, 1320 bp, Bovine  19866881011556
tggtttgatggaatatatttttgagaaagtagatcgcctataaattcatttgcttcacaataattaatttgaacaaactccaaaaatatgctttaataacttctcagatcccaattagggccaaattaatggcttccatttatggcagggccaatctgattaggtctcttgtttggttgtgctgcaagcattatccaccctgaggggaaccaggctaaatacaaatcttcagattgatttaaccacaaatgtgtatttataaattgcaactgacttttctaattaattttgcatcgtgctaatggtttttctttgtaaccactgattatatcaggagggatccaagccggatctggagccatttgcagtcactgttagtgtagagagaaatgagaggaagcaataaagaaagcagcttctagggacctaactcctggaaggtagttactgatttcaacaaatgtctagagaagcaatgcaatccagagcatcagttaggaagatccaccctattacccgttttacagctgggtttccttgcaactgaatttttttttttttttgctgaagaaaatgtttaaatgattattgcaaagtctgtgtcaaggttagacatcaaagaatatgaaatggcttccaattatgggaaggaaaagtcatgaggacagattttcaagaaatataaggtgtcaaagacagggctaaggaggaggagacctggatattcagggtacttttgcttcttaataagattcatttccagttggccagctggtggtattgatatgagtacaagaaaaaaaatgagatggagctggcatgagagaatagaatatgtcagatggaagaagtgtggttgagccttagcaaagctagaacaaactaaacagagctgagtcaaaacacaactatcaggaactatcacaacattgtaaaccaagtatatttcaattaaaaaaaaagaaaataatggtaataaatttaagtcctactggaaacaagggagtagagatatgaatggagaagcatgaagcaattcagagtgtcctattagagtcttgggcttcccaggtggctcaagtggtaaaaaatccacctgccaatgtaggagcctcaggggactcaggttcagtccctgggtcaggaagacccactgtagtaggaaatggcaaccatctcaatattcttgctggagtaatcccatagacagaggggcttagtgggctccatggggttgcaaagagttggacttgactgagcacacacctgcacacgtattagggtctactagaacctgctgctgctactgctgctaagttg

SEQ ID NO: 46104 - DNA, 1200 bp, Bovine  19866881026716
ttagtggtcagtccttttccttatctctgacacctgctttgtgcaaggccatgcactctgcagggtgaagggacagacatgtgaggaagaggaaagagaatcatttcgaatgtcttcgatgtgctgagcacttgtacctgtttgctcttttaatcttcacaacctttctttgaagtgtggaccttgttgtctccccacggaaaagggaacccatagtcagtccaacctggaaagccccagttgggggctccttttcttgatattgaatcctaatttgtagcccgaaggtcaggcatgggcacacacccaggatatgccctgaggcttggtggaggaaaacgagcttgcgcacagagcctggccttgtgcaactgccccctcgacacccgtttcgtctctctccttccagatggacacgtttgcggattttgataccatgaccgatcggttactggatgaaataattcagcacatccagttgtacaacctctccatatcgagaattaggtaaaaggaaaccacaggtagttaatgctgggggggagcggtgccctttttaagtgtttgctgtgtatgagttcagcacgatgccatctgaataccaggctgggattagttaacttagggctttcaagggactagattacttccagagcagccgtggatcccaagcctgcttgacacacccatgtctggcatagccgctgtgtaggagcctacagcttgtgcagctcagtacaaagagaactgggcttaagtatgtgtgttctgtgtgctcagtcgtgtctaactctttgtgaccctttgggctgtagcttgccagactcctctgtccacagaattttttcaggcaagaatactggagcgggtagccatttccttctccagggatcttcccgacccagacatcaaacctgcgtccctgcatttcctgcattgcaggtagattctttacctgctgagccatcagggaaggccttaaacaaatactctaggttttaaatccctattcttttgacagttacaagtttgtgtctgcattctaccatgtaaccttgaacaagctttctacatctctgatcctctgtttccccatttattaagtgggaccagcccgaggggattcactagctgccgcatagaagggcttcattcagcactaactgtgaccttacactgtaatagacaactgggtgtcaa

SEQ ID NO: 46105 - DNA, 2106 bp, Bovine  19866881386085
aaatgctccttatttggccaaaaaggagaagatgctataaaccatggtcccgccctgcacttgggcacttgtaaggaactgtaagttcataggctgcactgtgggaaccacaccccgctctgggtcacacagcagactggtcatgttcatgagtaaccagagtctatgcccatcaagagcttggagaaatacccagtgggagagtgacacaaggcattacttatcccacacgtgttaagactaagatacaatgagatttcgaagaagacccacagagaccctaaatctcttgtgtgggaggtttttccaaccccctctccagcttttcctttctttagaaatgcctcagtctgctctcctgaaaagttgtctgcctggacttgattgccatggtctactgtgttttcaaagtcacactgttaatacctgaggaactgaaagtctcagctgagaattccttggcttactaccatggcactagtgggcatcactaaggttatgatccaggtgctgggaccaggagtctggttccagacgagttttcagtttcagaagcaacttttgcagaagtgggaggagcttctgtctgcagaagacgtgtcttctgtgttaatgatccctgtggtccttggtcatgtgttccttcattacaactaaatgatcctgcaggcttctgttagcccatagcgcatactcagtctttggaaccatattaaacactccagtaatttttcaaaagtccccttaagtctcttaccaataacaatttgaatccccaacctggctgttgttctgtctgatctcacatttgtcctgttgtctcgtgtgtgtgtgtgtgtgtgtgtgtgtgtgtgaatcaatgataaccttccctagccctttattttcctaaggcaagaagacatttctagtgaaagataaccagcacccttctcagagcccccctgaggttttaaatccagcactcctccattgagatgtctttccccttccacggagaggagaagcagctggccatgtgatggttttcatttgtttgcgagtgcgtcaaatgctaacataggatttctttggacgggtatcagcaggagcttcaccaggtgtgtgcacatttaagggcctccttctgctagggttagtctcagtctgttttccctactacagacagagatgtcagcaatcacaaaaaattatgtgtgaaccggggttatgcatagaaaaagtctggaggagtaggtggagcagccagttcaccagttaaatttttctctgcaacaaacttgcatttactgatagcattgctctatacctcaatcaccccaccggctgctgttaagaaataaaaccagaggttatgaagcattcctttgtcccttgttgagaaaatatgaggagagcataagaatatgggttcacacggtcttgaacaagtggcacatttgaatcaattaaggattatatttacacaaatatgttccacttctgcacagaggttaacctgagttctgaaatgcttgagtgcatcaaaaatgataaagctatgaactagtcacatacccaacaaacctagttaacttggagccatctctctgtgagccagtgggagttaagaaggtgggctcaccaactccaaggattctgtttctttattttctccaaattgtgctagaaagcatcttgaatgagactccaggtggctagacaggttcgggcaaagtcttgtctttgacactatcgattcagctttcccaaactctccgaaaagggaagcacctcgaatgtccggtcccacccccaccctccacccctcagcgccttcctctctgagctcaaccttggaatgacagaggtctgtaaaaggatgtctcagccagagctctcatggatcttaaacgtttctggcgagctccccaaggcccgcgcgctcaaagccactacttgaagtagttgagtcccgccaccaagaagaacttctccaggaagagctcggagtccagcacagcgatgtgagccgctcggccaatcagggtgttggcagtgttgggcaaggcgtggaatacattgtgtcggaatcaaagtgcagtcctggcgtccaccagagggcga

SEQ ID NO: 46106 - DNA, 1312 bp, Bovine  19866881399053
agggaaggcgcccaatgatcatgatgtctggtgatgtacaagaagcaagtcatccctggaaagccaaagatgatgactaccgagagctttctctaataacccattaaacacatacatttaggtatttcttggactgttttacactcttataagttgcaatcccgtagctacagcctcattaagaaaaaggctgcaaacaggcattttcccttagaaagcaactccacattatgtacgcagggtagatgtttaatacatgtttaataaatttaataacttggtggatgaatgaatgaatgagtaaatgaacatgatgactagaggcacatgtgccttttcttcctgcattggcctgcccacgatgtcctcctgctagaatgatgtaaaatgcccaaacaccaaaacaaaaaccaaaccaaacctacccgaaacagtgcttgctactgtgacatttataagagcgtgctgacgcctgagggcagagggtcagctgctgggctgagtctccccccattcctagttcccagccccttacccagctccatgcgcggcagctcggggatgtccctcaggatggtcaggaagtaggcacgcagtccccggtaggcgtgcaagagcaggaagcacagctcccggtgccacttgtaagcgtgctgcatgcagttctcagacggcacgtagaagctcccctgtggggggaaacagaagcagaagctgaggacctggtcctgaaaaaactggggaagacggtcaagactccagcaaaagagttggaatctcctccctccccttctgcatgggaaacccactgaaattggccaagcctctgtcttataattttcaaattaaaacaataacgatagtaataacaacattagatgatgatgatgaccatgatgagggcacggacctcacaggtttggggcaagtgaatgtcgccccctcttctaagactctttcttgccactgtaagaagaagtcatgtgaccgacagagggggctccttctcacagggaggtaaggcatttagaaagacctctgtattggtggatgaagagcacagtgctgagaaggagaaaaacgctttgctgtaaaataggaggaagtcggtgagtttcagctctcggtgttgaaagtgtcagaggctgtgggtgtgaccatggagtctgagaatgctccatattgtgtttgtaggtgtaagacacattacacccataattacacattgcaagtcatttatcttgcaggaaaagatgcctgagtccacaagttacttgtaggccaagacatgaggaggaggaccaggacagtt

SEQ ID NO: 46107 - DNA, 1180 bp, Bovine  19866881493586
catgaaagtgaaaagtgaaagtgaagtcgctcagtcggttccgactcctagcgaccccatggactgcagcctaccaggcttctccacccatgggattttccaggcaagggcactggagtgggttgccattgccttctccacaggtgatgctaatttcagttcggctcagttcagtcactcagtcatgtccgactttttgcaaccccatggatgctaatttaggtaaagttaactgcgccttgcttctcctcctgccacgaatactgcattattctctataaaagcacttaccattttgtatgtattagaactctccatttttctggactgcattacattataaatcccttaagagctgccatcttgtattattcatttatatccctggtataaggtatgtcatctggcctacagaggtttagcaaaataactcttctcactcccctctttatcttattaattctttaattggatgtaaaaacagaccagattagcttgaaagaaaaaaatgacgctcaatcatttgaataattttgtagtatatgaataaaatatgtttaaggctaatccctgagttacatattggacaacgattacaggaacaatttcacaatgtaaagcccatattgtacatcttcctaatggcagagatgcactgaaatgaactgcatggcgttttcccctttttggggttatttaatcctatcaatcttatttccagttcaattatgaaaccaacataccacacatgccatacattcaaaaacaaatttagtcttctgaatattaattaacattgtttcaaagagacaaccgctgtttatcattgatttaaattaaatattgaggaggaaattaaagagatttttacttcatttatgcagcagcaacattacaatttatacaaatgaaggcataattaaacagtctgccattaaattacaatctgcatctcatgtaagcaaacatattaaaattgaaaatgcctgtcatgaatataaagccagcttccctgaataagaattattccaaatgcatgatgcacatttaagcaactcttttattttccttaaaggaaggactgtgggttttgtgatatgaccatatttataggttgctttatttttaagatatatagttgataatcccaattctaatactaataatagctaatactgtg

SEQ ID NO: 46108 - DNA, 2066 bp, Bovine  19866880376772
ctgcaatgggtgggtcccccgacttacccgccccactggggcccgacactgtacccagctggttgggaggaccagggcctgtctcagggaattgccccccgggggcggtgcagggaagcagggaggtgcaggggagaggggccagccttagctgtcaccagcacttttgaccaaatcctactactgtgtcccctgcccctgggcttagtgcctgggcccccctgccctgggggtcatctggggccagggctctccgggtgccttcctgctgccctggccagggctggggccatggcctcaggatccaatgaagccaaataaactccccaagctgtctccccaagcacagcctgtcagcgttcttcgagataactgggggatccagaccatcccatgaccctggtgacctcaggcccccagcagaatggcaggtggcctgggccaaggttgggatcctctggaccgcatctctctcccgggatcaagttcaactgatcatcaggtgttacaaggcccttgttagcctccctgacatccacacacttgggccttacttgcctgttcccaccctggctgggcctttcccaccatttcaagcaactgtttgccctgattgttcctgtttcggggtggttcccacttattctcagggcccacaacaacaccacctcccctggggccccttcctggccatgctgcacccattccaggcagcttgctgaactcaggagcccacagttctctgggtggtatcttaggcgtttgtccagggtttgtttttatcctgaggcctggacacagaagagggtcatccaccctgacacctggcttcactcacacttctcttaagaaggcacgggggttctacagaccacccctcccatgccacgccctaggacaggggcccctgggctcatcctccagtggtttgtgggagtcgtggtccaggctccctctccccctcccctttgcacctcaccacagccaggtctactgtgttcagcagggcggggactcgggagagcacaaaagtttctcaggaaggattgggaatggcggaagcctcacctctccagagcacccagcatcctccacatctgtcctgcctgccccatcccaagtcctaccatccttcttcccattcttctgcccaggccaccaccttctcatctggggtaccggccgtagccctgtccataggtccccatttttctcaccacccaacctccttcccacctggcctggcctcttctcttccccagctgaactgtcgctctccaaagggagcttttcaggccaagttcccctcccccagaacactctcccatcatccagggcgtttccttcagggagtttatgacaatgtgaactcgccctgccttcttgctaacaggtttctcctgggaacactgggagggcagggacctgcctctgtcctctcccctagggtcctcagggtctggggacctgctgactagtgaatggggtctgtgactgggtgagctcacatgaaccaccactgtgggagggggaactggtcaatcgccttgctttcacctgatcctcaccgcccatcactcaaccacccagctttggggacctgggtgggaaacttgttgcccccagaaacagaggagtgaccccagctccctcccaagcctgagccgcctcgccttgccctcctggctccactcaccccagctccatcccaggcttccttccctctccagccacccacgcagcccctccccccagccccaccctgcccagcccctcccaggtgcctgtggtggagagttggctccccgggcacctctgacagactctggtggcataccatgggggctctaaggccctgggcccgatacgggctcttggctgtggcccacctgctggccctgggccttggggccacagtgctccaggccctggaggggcctccagcccttcggctccaggccaacctcagggccgagctggccacctttcagggcagagttcggggcctgcctgccagctggggcgctggaagagctgctgggcaccgccctggtagcccaggccca

SEQ ID NO: 46109 - DNA, 1200 bp, Bovine  19866880411501
ctccgatcatggctggggccccacacaggctgaacatggccattatgagccagcgcctccaactcccggccaaaacaggttcctctcccaccttctcaatccccacacctgaaggatgtgtcacatgactgtcagtacagaacagacggcaggaccgaccgattttagcccggaagggcagctggcccctcaggtgccctgccccagcaacttgctggcactgtcagccctgggggcccccaacttttcagctcagctgatagcctggccccctcgagggctcctgctctggccacctttccaagtcacaaggtgaggagaaagcgctgagccaacccgctgtccacccgacccggcacctctctgagacgtagccctggaagtgccctgctcaggggacatcctctctggcctgggtaggtggcagcctccttaccagctgccccctccctgccacacgccctgcctgctgaccttaccctcaggccacagctgaggggggtctccctaaaccttcaccccgatagtgtcagtctcctcactcgccttctcagtccccagtctcgctgccaaggcctgttggcagttccaacagtaactcctactgccccgaaccccatccggacaccatgcgccagccccaggggtggactttcacttccccaaatcgtttcctcagtctggagcagcctctctcttgggcggctggatgtcaactctcccttcatgacccagctcagccccacctcctctagaggctccttcacccgccttcttcctccctccctgactttcatgcctcctgaagcctcctcaaaccccagcacggcccccagggcctctcccattacagctccgacgccgctcccaccccaccatggctgctggctactcctgtctccttaggcagaggctggggtcaggaggacacactcagggcacagcgcgtaacagtaatggcaggctgtgcattaagcatctgtgtgttggatgctgtgggtgccctgactcatttcatcttcccatcagcgctgtgaggcaggggcccttaccttccccattttacagatgaggaaactaagggtcagagatgacactcaaacagggcctggcttgggccccactgtctaatccaacagtctgttcccaggcttggccaccaatttgctgtctgcctctgggccagtcatacccacctgg

SEQ ID NO: 46110 - DNA, 662 bp, Bovine  19866880424836
tgttcacgtccacctgctgtcggaggctgagcaggcccccctccagctgccccttgcctcgacccccgcccctccccagccggcactcacctccccccagcgcaccttcctcccgcagctccccgcgccagccaggctggttggcagcaggtcccctgcgggcctcggcagccagcacagtgggctcagcggcagccagctccacccccgcctgggcctccagctcagccttggagcctgccgggggaccccgcagggcatccccccctgccccgtccatgctcagcacgcgggcgtgcgttttggcgctggcagtactaggcgtccgctgggtcccatagggccgcttggggggcacagccatcccctcctcagccccgtggggggcccgtcgttttcgggctcccccagcagccccccgagaactcgcgggggaatagcatgaagtggaagaggagctgtcggtgctgtagcggcgctgggaccggaggctggaggctgggctcagttcactgccctcgctggtgtcgtcatcctcgaagaagccccggccttccagcagcggccgccgaggggcacggccggtggcaggggagtgtctccgcacaggcggccgccgtttgctgggccggagcagcgccaagtccttgggccgacaacca

SEQ ID NO: 46111 - DNA, 760 bp, Bovine  19866880437671
ccccccctccccattcttcccgccaaccaaaaggagccaacaggtggaaataaatgatagactttattaaaacacccgaagcagccttttccttcccccttctcagcccgggtcccaggcttcagtggctctcttcccggtactggatggcgagaaactccagggacaggcggttgaagaacatggccccgttgagcactgggcagaggagagagcccccatcagccttgcctgccccctccttgctgtgtctctgcgttccaaagctccctcctccccccaagtccacctcccttccctactcactcaggatggtcagggaaaagcagcgaagaaacttgtcatatgtcatctccgcgtagagtgaccccatggcggcccagcagatgctgatcacctgggagaactgtagggcccatcccttgggaaagtggcccctgacacaacagtggggtttccatcagcccctgggcctccccagaccacctctcgagcccccgccccagcctaccatcaggacgacggtgtagcggaagctcatgcggtcgtagcggtaggtgacccagaagttgtgcacgtcgctggcaaagacagccaggtgtatgaagaagagcatcagcgcggccatggtgagaatcatgccttgtgggaaaaagagcacagccacacggtcccgccagcgcatcatggcaggagtacagactcaagggcgggtggcagagcttgagcagcggacactgtccaggaagagcagccaatc

SEQ ID NO: 46112 - DNA, 1179 bp, Bovine  19866880461604
catcctgctccgggagttcctggtgagcaagactggaggctagagggtcaggcctgggatcctggatggtacagtgaagggaaaggaaagtgaaaaacaaggatcacaattgctcctcactgaccaattgtgtaaccttgggctgctgctttatctcttgtggcctcagttttcttatttgtaaaatggggagcatatatctgactcccaaggaacagggaaagacatgtggtgatgctctgtggacagtaaggagctagaccaagggttctaaatccaggtacccactgagccattctgtcttctcaggtgacccatcacctgcccgccgagagggtgtgaagaagaaggcggccgagtacctgaagcgggcagaggaaatcctgcacctgcatctgtcctaactcccaccccgagatgggagtggacctgttcccaggactctggctccagcactgccagccaccctcttctctccctggtgcctgatctcctggtcctgtaactggctctttctgtatgtaactggaccaggaatgagaaaaataatgagttctcagctccctgaaaacacctgccaccttggaatcagggactcacatgtctgatcctgactgtctctatcttgatatgggaggctgcagctctggtccgtaagccatctgtttatccatctagaacaggggtctgcaaactaccgcccacagccggatatgccccactgcctttttttgtaaggcccatgaactagaagagtttttacttttttttaatagttgaaaaaatccaaaataataatattctgtgacaggtgaaaattataatgaaatttaagtatctaaaaaataaaagtttattggaacgcaaccaggctttttcatttagtgttgtcgaccgttgctttctcactacaccggcaaggctgagtgagtggttgtgacctgtaaatccaagagtatctactgttttgtagatactgtctttgtagtatctactgtctttgtagaaaaagtttgctgacccctgatctagaagacagggagaagagtcctcaagggaacagaaaagaacggcagtaaggccgactgagtcaggttatcgggtaaagaggaaccaaagcgggtctccccacttgggtcgggtggttcagagctaaacaatgatgggattagagggagg

SEQ ID NO: 46113 - DNA, 1330 bp, Bovine  19866880520637
gtggggccgggctgaggtggggcttgttataccgtaaaggaatccaaggcagggtaagcagggccttggcattgccccatttgtaagtgagggtccagggctgtagccctagcttggccaggtgggcagcacttcttttttcacacactgcatgttacactcattcattccatcgttcattcattgattctgttgcacagatgtccattgatgacctctaaggggtaggtctgagctgggggctggtgacaaagaagacactatgcataagatacaggctcattcagagaaagacccaatgtgtcatgacacagggcgacaggggctacgacagggccacccacgaggcggctgaggcacacagcacagtccagggtgtgggtctgcagtcctggagaccccagaacctgaagattgagaggaggggctgtggggcggggagaggagagggggagagagagagaaggggaggcgaagcatggagggaagggaaagaggacggaggagggaaggatgccaactccatcagagccgtggtgtgcgctgcgcttcggggcatctctgtaccctcaggtagtcagcagtggctcacccacacagtgcagtgcagcctggatgtaggcaggatgggatcgctgtctgaagcaacacgcagaggccacgaatgaagtgaaatgaaatcttgatagagaagcatgtgtgggctgtgcccgcgtttgtatgaaaaagggggatggagcacatgtgcgtgctcaggactgttgttcagtcgcccagtcgtgcccgactctttgcgactccacggactgcagcttgcccagccttggattgtataaaatcataaaacatctctgtgagatacacagaaccaggctgccctagaggaattactggagtgcagggcagaggggagaacgctggcctgcatacccacttgtaccttctggaatcttgaaccatgcgaatgtattatataataaattatataatacatatatctactttaaaataaatattttaaatacatattaaatacattaaaatacatattattttaaattttagtttaaaataaactttaataaagaaaagttaatgaacagactggggaaaccctcgcccccaaaggctcacctgtctgcaaggctgccaaacacagcggcgcctgccagcaccccggccatgtaggcggactgagccaggtcgcggagggtgcgggcctcgcacaccaggtccactgcgggggagggagggacgctccagcctcggcctggggtgcagcccccaccaaccccgcagcccctggccccacctgacctccgtcacgatg

SEQ ID NO: 46114 - DNA, 1431 bp, Bovine  19866880656319
agaaaaaccagcagctgaaaggttagataatttaatcaacgtcaaacagtgggcaaagtgtgggtttgaagcccagatgtttggctccagggccatatcctttaaccacacaccataccgccttgtaacaggaagttcttcattaaactgagctgaaattcctctctcggtggcttcctctatcctgttctcactcccgggagcaaaccgaggaagtctaatctttccccaagagattgtacaacccagcctcccctccactacttcctcccaactcccccgaatcttccttatatgacacggttttgcatatcttccccagctggccattctcctctgaatgcaaatatgtgacagaggcgccgtaaagaaactctgagaacacatctccccttagcgtacatgctagagagaaagcactgtacacgtgctagattaaagtatgacgtggacattattcacagcacctgatccctgatgacagagaccaaagaaggggagagaccatgagtcaccgtttctggaaatcctcactttgctgctgttctcatatcctgacacttgaatgcttaaggccctcaatcttgtttacacgcaaggctctaacccaagtgcaaagcaaatgacttaatctggtcacaaaaccagacagcacttataacccattttaccaagttcatccaaggtagatgttctaactagaaggtagacagttagtgaaaaggaagctggaggttgacttttcatcattgatttaaaaaaacagtatcaatcaggaaagactattagaacaactcttacctgtgctgggactagaataggagcaaaagcctcaattttgtaatgttccttgagttcactgccaagttcttctatcttacaggtcagaactgaaatcccagagggaaaaagtgtgtttaagacattttacttgccaagcagagaaaacacagcaccttgtaaaacactaaagtcagtcatttcacagaagcaggcagggtgccaaggacagcagccagtctgtaagctgctcaagcccgagccaattgcccaatatttggttgctgaacccggccttccatttggccatggtcggggggagggaggggtcacggatgaggtcacagtcccaaagtcggcctggatccctccccagcctgcctcttactcaggtggtcaggggggtttcagggaagccaagaacaaccctaagagccttccagtctttccaaggaagaagccataaatgtctccgcttcctttaacactctaattggcttcctctacacagttcaagtggttgttactgggaaacggttatgtgctttttcttagcaaagtgcttgtgatttgggagaattattgagagtggtcatctcatatccgtttcctaataggggcgcccagaggacatctgtcaatcaaagggaa

SEQ ID NO: 46115 - DNA, 902 bp, Bovine  19866880675822
cctggtgtgagcagcattagactcccaggggaaggaagggctaagcctaggacccaggtcggggcactgggcccatccagccctggggaatgggggagctgggcccaaatgcgaggccgtctctgtggcgccacccacaggtggactcatcggtggcggtggggacacccgactacatctcccctgagatcctgcaggccatggaggagggcaagggccactacggcccacagtgcgactggtggtccctgggggtctgtgcctatgagctgctcttcggggagacgcccttctatgctgaatctctggtggaaacctacggcaagatcatgaaccacgaggtctggctgccaggccctgggattctgggcgggccgtgggactcctgaggctgtgaggttggagatgccctgggtgggggtaggattccagacactcacctgcacccgtcccccgggacctcaggaccacctgcagttccccgacgtgcctgacgtgccagccagcgcccaagacctgatccgccagctgctgtgccgccaggaggagcgtctgggccgcagagggctggacgacttccggaaccaccccttctttgaaggcgtggactgggagaggctggcgaccagcactgccccctacatccccgagctgcgcgggcccatggacacctccaactttcgatgtggacgacgacaccctcaaccatccagtgagtggagggacccacagcagcagtggctgcgggaccctcccctgccccgcaaagttccccaaagcagttgctgggctggggatgggaggcccatgggagttacggttcacctgggctggttcacctgcactgaagtggattgtgccaagtgaaggatctttgaccacaagtgtcatcctgtcatcca

SEQ ID NO: 46116 - DNA, 1136 bp, Bovine  19866880697597
atttggctgttttcatagcagctgttaatgaagcctgaacttccaagtgatgcttgaaggggagggaaagggggaaagcgggcaaccactttttccctagcttttccagaagcctgttaaaaagcaaggtctccccacaagtgacttctctgccacatcgccaccctgtgcctttggcctagcgcagacccttcacccctcacctcgatgctgctggtagcttggatccttgtgggcatgatccataatcgcttttaaggtaattgccaaggtcttccggtgggttgcactactagaaaagaccattaatttacctgtcaacaggtaatatttagaccacaactaaaaagctcttaaagtgttgtaaatgtgtggcattatccaatgactttaaaaaaacatttcaaaccagtaagtggagaaatagcatctaagaactgtcatattgggtgggagagtacatttatgaactgaaaagtgttttggcagttgagagggctgttgggtgggattgcaaaaattctctgctaagactttttcaggtgaacataacagacttgaccaagctagcaccttagctgaagcagattctccagtgctcttcaatagggttattgataaaggtttttcttttcctgagaaaacaaaatcttttttgttttctcaggttttgcttttttgccttttcttatcttaaaaaaaaaagcaaaagatgctggtggttggcactcctggtttccaggacggggttcaaatccctgtggcgtctttgcttgacttttactctccagactctacttcctgtctctcaggtgctaggccttagaattaggggaggtggaagataatagtgtgaaactctgcatttgtgtttacatgacaacgtaatggaactaccatgcatctaatttgcagatattcctcatgcaactagtgattggagaagcctgttttgaaaaattgattacacatatcaataaaaattgaaaaaacttcactggtgtgattcatttatgtatataccaaacttctgttcgtgaatagaaaatggatgttttgtgagtgttctgcctggttcctgtataagtatatgggttctgtcatgcagccccatctccaggaagagcagggatcta

SEQ ID NO: 46117 - DNA, 1095 bp, Bovine  19866880742117
ccgccccgcttccgcggggcgcgcgtcagagctgcccaccctgaccgagctgtcactggcgctgcctctgcccggctgcgcccccccagcgccttgccttctcccagaccaggcggcctgttcccgcttctggaggtttctgcatcccaccccatcaaagtcacttttaggggcaaagggagcaggtccctcctccgactttgccgcctttcctcattcttccctagaggcggcggtctggcaggcagcgtggaaagagccctagatttgaaacaggactaacccaggctccaaggccttgcgtcagtgtgattacttaagccctttgagtcttagccttctaatttgtaagatagagaagcatatgttattcttgacgccatgatggtgaggatgaagtgaggttttccttcctttctcctgtttattaacactgcgtctcaggcacggtgctaagcttgtacggtatgggcatcaacaattctttattttccccttgcaggtcctcaggccagggcaatgttccgaactgctgtgatgatggcggccagcctggcgctgaccggggccgtagtggctcatgcctactacctcaagcaccagttctaccccacggtggtgtacctgaccaagtccagtcccagcatggcagtgagttcagggctcagggagggaggaactccctgggaggcaaggaggagtctgcttcagacaggggtggggctaaaagtcaggtaggtaggacaaaagtgaagtagctgccagacctaatttggaaccagttgtgatggggatgtggagaggttcttgaatgatgagccccggacagaacaaggcagaaagtgacctcaaaacatagcctgtcttcactcctaggtcctgtatatccaggcctttgtccttgtcttcctcttgggcaaggtgatgggcaaggtgtttttcggacagctgagggcagcagagatggaggtaagatgttcatggctccgaaggtgaggggcagggagctgggcaaacagaatgtctgagttccatatccttccttgttcaacctccagcaccttctggaacgttcctggtatgctgtcactgaga

SEQ ID NO: 46118 - DNA, 1013 bp, Bovine  19866880743302
cttcctcccgccacatcaggcgtcatgagggcagggcgctgttgctgtccccacccacaccatcattcaccctgctctgggcatcgtgggcttcctccagctgggagttcagggcttgggtctggttggccatggccgcctctctctcctgggcctcctgcagcttccggagcagctcctcctgccgccccttggcctcacgaagttcccgcgcctgtgcctgctgccccgcccgagcctcggccagctcctggggtccaggtgggcgaggggaaggccagccagaagttagggcatggtcctccttagcacccagccctgggccactcacccatctcaccacaccccaccttggaggagctggtctctctcctgccgcaggtcactgtcctggcccaggctgccagccggacacccgtctgccttgctgtcccccagcgtctctgccaggaattgtcactgagacctgcacgtacagcctcagccaggagctctacctgcagtgtctcacggaaccctcaccccagcttggttcggggcaggggggcagggggtggatcttctcagcccattttctacacacagactcagagattttaagatatttccttaagatcacacagcacgtacagacccagggacaggactggaacccaggttggactcaggtgtgctgggaaaccagctcagcccccaaggtgaggggagaggggaagagacgaggtgctgggggcagggtacctgacagcctgtcctgtagagtctgcatttccttccgcagctgctccagctcccgatggtccgagggggtctgcagagcctctgcagtgtggggacacccgtaacattgaggagcttgtcctgtggcagggcaaacccaccctgcccaggccctgatggcacctgtaccttggagcttccagctcagctccagcttctcctgctccagacagcggagcttccgctccaggggagccaactgctcagagctgctctcagggccaggactgggg

SEQ ID NO: 46119 - DNA, 1898 bp, Bovine  19866880757846
gtgatgagatgtgggtgtcagagccctacagggaagatatggccagggaggtggctgtagttgcagccccagtgggcaaggtggttgcttaaactaaggaatggccgtgggggtggggataaccgggcacagctgccaggaccaagtgaggaagtgaactcaagttgctaggggagaaggtgcagaatccacggtggtggccaggtttccgacaggagccctggaggctggtaaggccatgactgcggggaaagggcaggccagggatggctagggtcccttggagcaccgagattttgaaagacctgagggatgtcagggtgagatgtccagagtgcgggcgcacaggagagagaagtctgagctggagacaaggattttggactggtgagccatggtcatgatgaggtcactcagggagtgtgggaagggccaggagagggctttcgggggagcgcgggaggtcacttcaggacactggggaagccgagaagagcgaggcacagcctgaggtggaggacccaaactcactaattccctccggggctcaggttggcgacactgcggacagtttcggccatcagtttactccggtgaggagttttaccaccccgccaggtccttcccggcgctcgccctggccccgcccgcagcgcagcagctgcaaacctcacctccgcacgcactccggctggggtcctgacccggccacggctcttgggtcccgcccctcgggcgttagtacggctgggccaggccccagggtggcacacctgcttcagaccccgccccccgacagaaacgccgcagagcagcacgagtcgctagatgctttccggttccccaacattccgccgccagctggcatcttttctcgtagacgccatcggaacctgcaccctgggcctcctgtgttcccaggggactcgctagatttgcagcaacgtctcactgatacctgagtgctcctgccttcaccctccctgcaaccctgcaacgccattggcctcaggatgggctttttccgaagcgcactgcctggccgccccgttgtagaaagctatctgtgcgcttgcgcactcgggaaggcaggccctcgcttatctagggccggtggctgactgctttactgcgcgtgcgtcgggacaaaacggaaggatgtccggctctagcccttgggccatggcttggtttttgttcaggactcctgggccgtgcgcggtggtggagaggaggcggcttcggatttaagatttccttggtcctcccagggcagggtatgaaaggacagaccttcacctggcacctccctccccaaccacttaagagatgaaatccaaacctcttagccgagcctcttcatcttttacagactgacccatcgaatctttccaacatcgtctcttaccccgcttacctataaatgctggctagcccctctgtatagacctgaagctagcatggcctttgtgaagcccttcctgaaaatgctccatccccacaactcctgggtacaaccgggcactcgctaggctaggacttcctctcgccaggctaggacttcctctcgcccccacacagccgcctgctttcattcactggctggtagctaggagtgtccacaggtgtccgtggactgcaagctccccagtggcaatgtattctcaaacgtgtccctccaactctgtatcaccaacatccagcctgaaatgaccaggaaagagtgtgctcaaagaagacaaatctctagccagcatggcaacaaatttattagttcagagtagaaaaagcaatagtctataaatggtttgattcttcagtaaaaactgagcctcttgactggagagcagccagcctgctctccccgactctgaacagcttgccctaccattaaggca

SEQ ID NO: 46120 - DNA, 843 bp, Bovine  19866880828942
gctcagccttcagccctgcctcctcccgccgcaggagaccccttgcccccttcctcaccagggtccaaaaatttgtccacgtaatcaaaggtgtcaaaggctgtgtggtaggtggggtagatcccgggctgaggtcttgctctgaggaaacaagacccacggtgacaggcttgggatgagaagtggaaggaggagttcagtgtagagccattatctcaagtcagttgtcaccacacctgtgaagcaggttctaggtgttcccaccttacagaggaggaaatgggctcagagaggttaagtaaccttcctgatgtcacacaactaagtccagagctgggtcaggtgccagcttcctgtttcgcatgaaggagaagaacctgaggctttgcagtcaaacaggaggattcacatcccagctccaccactcaggagcagagtggccatggaggggagaaagggtattttggagcatcaaacagggaaacagtctggcactctgcagcccttatctcattttaccctcaaatcacccattttatactgtttcttaatgtactctgagacaaactttttttcacattttaagatctctgaaatcaggatgcttcttacagtcagtgtcatcctgcaatcaactgaccgtgtattttttcccttctgaataatgcatatcacaacagtgcatcttatactcagtggtgtcttaaatttgataaaataatatagatgaggatgaacatgctcaagagaggtaaagaaacttggtcgaggtagcacaactactgagtgatggatgcagtttgcacaggagcagccccgagagaggagggggctagtggagca

SEQ ID NO: 46121 - DNA, 1201 bp, Bovine  19866880838902
cttccttggccccagaccttactgctgcaaaaaatccttgagcccttcttctaggtcagatctggcttggtagaggctagagaacccaggatgacttagacacagatcctggaggtcttcatttccaagtgccatgcacgtcagaccctgggctcattccttttacccatggagaggtaaaaagtggcctccttctcattctgtatcagagttggacctgactgggtttctagctccaggaatctaagtgattagctggcctgcagggctccctgagagttcctggcgcagcccacggccatccctcccaggttgctgacctggtatcaaggctggacaatactcaggcaggaagatactgaccttttgtccctatcgtcctatcctgccccagccaaggaaccttcacacttgcctcaccttgggagtcctaaaggcaggagacctgagatccacccccacctcggcatcaggctgcctcaagacagggttcaaagcatggctcccctacttgctctgacctcaggcaaggtagttaccctctctggggttcagttttttcatatgtaaaatgggtttatcttccgaagaccttaataattcaacactgcccagggacagtactgctttgtataaataaacccgcagattccaggccactcttaagtctacaacctgagtttagaaaaagggagtgtggcacaccaatcctatcacaccagttccaccagtcattaatgcaagtttttatttggctgtatatacaatttaagctattaaaatttgtacaatatttacaaattaaataatcatctgaaactgtctccagcaactcttgtaacataaaaccaaggggaaaaagacaggggcaggcaaggccttggctcctgtgggccctacctggcccagagccttttctaaactggaaagatgaggaactcagcactcctgcttccctttcttgggggtcaggcattccaattcaaaatgtaagccagaagacagcaaggaaataactcccactcttctaaactcaagaaaaattctgcaagttaagaagtggcctttccgtaggttctgaggcttgcagtggttcagaatcagacacacgagctctcagcctagagtgaggctgcccggtgcctgctgggtgagaccagagtctcaccttaaactacagggagaaaagggcccggggggg

SEQ ID NO: 46122 - DNA, 2276 bp, Bovine  19866880841143
tgatggaggccgccctgcacaatgggaccactctgggccccctgagcgtaggcgggatctccctcagttgtgggcttatacgtcagacctgggttctagcaatggcctgccttgccatagtacccataggagtgcagcaacagttggctgggggcagacaaggccactcaccattgagcattgggggtgtggaaggagatcctaggggggatgagtcatctgaatccaggtaccacgtggcttcatccatgcgggaccttctcctagtgagggaatgagaaggagtcgtgcttcgtgaatctcaggactgctgggaggcaggagctgctgggtaggtggcagtcaggcactcacctcccgttctgggcttctccaggcttggggggagctgggaccccaggcccagcatgctcggcgctctccattgcttgagtcctctagacgtcttggggactgtcggccccatgcctgccctggctctgcaggctccactgtggtgggtagggtgagggggggaaccgaaggagtctgagtcaagatcaaggaccctgatccttgtcctcccatcgtaagaactgggctccaggggcaacttcttggaggatggggagcggatagtcaggctgggccccattccattcccatggtaagctttgggcttacagagaaattgcacaaactggggtggggtaggtgagtgtgggtcctgagactggcagtggggcatctcttctagtccttcagctggcatttgctgcttagcacagacactgcagcaaactgggtctgaattctgaccctgccacttatcagctatgcagtattaggagttacttctttcacttttctcatcagtaaaacctaggtaataataaagacatctacctcacagggtcattgtgaggaattaatattagcaactgttagtcactcagtcgtgtctgactctttgtgaccccatggtagcctatcaggctcctctgtccatgggattcttcaagtgagaatactggagtgggttgccattcccttcttgctgctgctgctgctaagtccctttagtcgtgttcgactctgtgcaaccccatagacggcagcccaccaggctcccccgtccctgggattctccaggcaagaacactggagtgggttgccatttccttctccaatgcatgaaagtgaaaagtgaaagtgaagtcactcagtcgtgtccaactcttagcgaccccatggactgcagcctactaggctcctctgccatgggatttcttagataggtataaaatacatgaacagttaagaaaaataatgcacttcataaaactaaagcacaaatgccccacaagtgttcattgacacatattgataacactaaattgtttttaacgtgtaaattaagcatatgaactctttaggaaattaattaataaaactaacctaccaacaatagaaatctatagcaaactatgaaacaaactggaataatgaatgtaaaaattttaagtaataccttaaatattctgagaaaactcttttaggaatcatacagttttcagcttataagcaaaatgttctgtatcactaaaaatgttggaaaccttcctagttcattaaggaataccagaataaccttgatatcaaaaactgacagaatgaacaatgaaactccagatatatctcacaacccgaatatagttgccaacattttaatttaattctaacaaatcaaattcagctgtatattaaaattatgacaaagtaaaatttattctaggaaccaatgcttgattccacattatattttttgtgatttacagttgcgcctttcagcactttctaaagttcttgtactcacaaaagaattttatataagtgagatgtatatactgactaactttacttatgtttttaaaaacccttgaagtaaaggaggcctaagaataagaactaaatagaaaagccttttcatttcttccaggttttcctgcgtctttcttgcaggtacaactatatcctcttcttttggatttccaagtaaacatcaccttataatctttgctgcacaaattctccatttccagagttcttccaattaaacaaatagctgtagttcccctagttaaactacaataaaaaccatctattaccacatttcctttaatctattctgtacaaattctaatggcttcactgtgtaatgctctcatttatgtccccagcaaggagaagaacactgctgtttaaattattcaatatttcccaataagtatattctc

SEQ ID NO: 46123 - DNA, 853 bp, Bovine  19866880892137
cacctgttgattcgtgcatcctacctgtaggcacacccaaaagtgtcagggttctcagtgtctttttatcctgcccctgcacaaggcctgtctggatctgcggaggagtggggtttatcaaagagctgacctgaatcttgtccctttatactttcctaaagtcagattactcataattcctggtacttcagttttatcatgtacaccctcttgacacagggtggcactttgggaatcacggcccttgatctgagacagcagataaagtcacctggagctagcctggcccaagttcaagtcccaatcctatcactcactcactttgtgaccttcgttaccttatttgaatagaggtgttctaattcctattcgcagggaacgtgtacaaagtgcttggtacccagcaatgtcagtacagacttggaggggagcttgagtctgagactcgtgtgctttgtgggttactcagtggactgtcttagttggtctggaaggtgcctggcaccttagatggggactcagcagtgtaactgaacgcggcccgcagtccctgcctgtacgtggtttacaggtctgtggtacagaatttcaaggagtcacgcaacacgtgttcactggcgtccactggtgacgtcggtgctggccttcaccctgcgaggtgcaccgagtgcagagtctgtccagtcaggccaggacgccacgccctcctctcatcccttctcttcctaggcccccccggcctgccaccgcagctaaccccactgaggagactgcccctagcgctgttgctgccacctcttccaccatcatccccagctctgaggccaccaccccatccccgggagcctcccca

SEQ ID NO: 46124 - DNA, 1559 bp, Bovine  19866880899729
cgcacggggagaggggaggccgagggggagagggcagccccagggtgctggtggccggacctgaatgcgccgggaggcacagtactggatccactccaggtgcacggcgcagaaggagggcagcgagaggccggacaggcgaaggtcatagtcctcatccacgctcagagagaaggtggggtcggagtcagcatagccaggtgcccgcacaggacgcagggccgtcgcaatgccttcgtggctcagccaggcctccagctttggagagcggctcacgtagtagatgatactctgtgaggagagggcaggggtcactgggggcgcgccctcaccctggccactaggagagatagtgtcagggtacagagacttctcccggtgagttccctggtggtctagtggttaggactctgcactttcactgcagaggtcctgggttcgatctctggttggggaactaagatctctcaagctatgtggcctaaccaaaaaaaaaaagaagcttctgccttagattgcgctgaagtcagcttcccaggacacccatcccctctcccatttcagctccctgaagccacacaggcctgtctgctccttctctcagtcagggaagaggaaggggaaggggaaagctgacaggaagcacccctccttacggagcatccactagagagtgctgcctgtggcaggtgctcaggtcacgggtccttcaagatagcatgagtgtgatcacaggacttcccctcaaaaaaaagaggcacagcatctgtacccaagccaggggctcctcgaccccttaagagaatctgctggggacttcagtggttaagactccgccttgcagtacaggggacgtgggttccatctttggctggggaactaagatcccacacgccgcagggcaagtaagcccacgtgccacaacttctgagcccgtgtacagccagagaagctgcatgccacgacgagggtccctcgagccgcaactaagacctgactcggccaagaaagtaataaaatacgtatttaaaaatgagagattctgctggtttctaagcaggggcgtgggtgaatggagaagagcctttggacagtatgcggctggtacagacacgatggatgggcggtctgaggccgacagttggcagccagtcaggttgctgccctggatggagccaacgcacggtggccttctgcctgggggagggatggggaacccagagctgcagaggctggtccagctggctatgaacaggggcctctcggcaacaggagcccagcagcatggtaggacgtggggccaagagcctgggcaaagtggccatggtataagccctcctaggagcgagtgcgggcacggggcatctgagaaggcagttgctctgacaagtgacgcagaggggccacccactggcagcaagggtcagctgggggacacaggaccgtccaagagagaacctcaggggagcaggctccgtggactccaacaagccgcccaccccttctgggcccacgacacgccgcagggcagatgctgagagagcatgaggggacctgat

SEQ ID NO: 46125 - DNA, 1420 bp, Bovine  19866880920167
cagggagccctccagcccccactggcaaggccaggagcaggtgtgtatctctctgggcccctgggcaggagggagggtggagggactgatagctctgggtttagctcctccccttctggggatctttagctctgacctccaccggtgacctggggtgtaagccgctgcagcggggcctctttggccccctgggtcccctgtaaccggcgtagccgtagctcctccaggccttgccacagctcctgacgttcccgggccttctgctgctccctggggagagagggagaggcagtccccttcctggagctccaactgcaatctaactccctcaccactaccccacctgcaaagagactcagtgggaatcttccacttggggagaaaacaccaaggagagatgggtcccacccatggtcatggagtaggtggatcagcctggccctgagaggccccgcctgaggggctgttgttatgttgtttagttgctaagtcatgtccaactcttttgcaaccccatgtactgtagcccaccaggcttccctagccatgggattttccaggcaagaatactagagtgggtagctatttccttctccaggggatctctccgacccagggatcaaacctgcatctcctgcattggcaggtggattctttactactgagcccaagtacttcctacatgtgtactttaatacttaagcttctcaggcggtgctagtggtaaagaacccagctgccagtgcaggagggacaggttcaatccctgggtcaggaagatcccctggagaagggcacagcaacccactccagtattcttgcctggagaattccatggactgaggagcctggtgggctaaagtccatgtggtcgcaaagagacagacataacttaagcaacttagcacacacacacacatacctgcaaaactgaggtattacagaatacagaaacttcaaaggctgtctttggcttcaagaaaattatagacttggaaaaacaaagcataaatagatgaaaaggcagataaccccagaagaaattaatattaattatttctaaagtactgaagcactctgaaaacacaagacccatgtttcagtacatggcagcctggccatgaatacagcaatctggttcctagacccagttctgcagcaatcttagattggtctttccttacttagacaagttagaattagaataaaaaatctctcatcatttccacctcaaaatccatgtcattcaaatgagtgtagcatagggaaaaccacaagtgttgagctgagacaagacactagatcagagggaataggaggccttcctgaaagacagcaaagacctaagcatggttgggatggatataaataagattagcatgtattacaaggtctcatgcaagagcagtggtaagggagg

SEQ ID NO: 46126 - DNA, 748 bp, Bovine  19866880942145
ctccctcatccttgatctcggcctcaccgccaccatcactgcattctccattctaaccccgctgccgcgctcttccccagccctacccgactctagtctctgctcacccctcttctctgcctccctgagtccctccacatgaggtcctctgaggacctcgtggctcctgggtgaggggagaggctttgcatggctgtatgtttgtgttcacgcatgtgtgcccagggtctggccagctctggccagaagcagtgtcagtggggtgcacaccccccctcaccagcagtatcattggtggagtagccagcagctcccccttccagggactgagatggggtcaggggtcctgcccatcactcccagtaactgtgggtgtatgcaagggaaagccaggactcggggctcatctcctgaatgggggtggggacagcggctgcagcccatgtgtctttctgcagatctccagcattctggacatggaggctgtcaccttcaagaagctggtgaagggccacgcctactctgtgaccggggccaaacaggtactgccccaggtggaggtcttccccaaagggtggttccagcctccttgcctctctggcctgtggccaaggctgtgggagaggccgactctccctgtgaccttcagcagcaccttcctatctcccagggactctcgcccaaagatggttatcttgtccctccctgatttactgtacttttgtgtgtagagctgcttctctcagca

SEQ ID NO: 46127 - DNA, 966 bp, Bovine  19866880943086
gaaatgatgaaacagctggtccgggggatgattccccggtatgaagtgcctcgagtcaaactcacagaaagaggaatggtgggggccaggggctggagatggggaggggagctgtactttaatgaagacagagtttccccttgggaagaggaagaaacttatggaggagaaagatggtggtggtatttgtacaacaatgggaacgtacttaaagccactgacctgtgcatttaaaatatggttgaaatggtaaaccgtatgctatgcatgtttcagacttcctatagctcagacagtaaagaatgtgcctgcagtgcgggagatcagggtctgatccctgggtcaggaagatcccctggagaagggaatggcaacccactccagtattcttgcctggagaattccatggacagacaatcgggtggcagagtcagacacgactgagtgactgacactttcatgcatattttacatgggtcatatagacaggaggccccagcctgcccctctggccttggccccgtccccagcgagcctcctgcaggtcccagctgctccaggggttctgcccctgtggcgctgcctccctcctgatggggtctgccttccagtcaagagtctcgctccccaccctctagcacagagaagagggaagagttgggattcagcctcgccccagcccagcatcctccaaacacaggtagttccagtagctggggggggggaagctgcttcagctattccagaagtttctagaacgcaaacaatagagggtttgtctccagtcgatttttgtttcctgccattcaagctgcgtgggcctcggcgtttcttgccacagctcccatcacacatgcttaacccgcgctggggcccggagcaaggggtgcaggaggacacgagagattaaagagcaaagagtacacaccgtgaggacttgttcagagttccctggggctacagatc

SEQ ID NO: 46128 - DNA, 1183 bp, Bovine  19866880955239
gaaatattaggaatggtaggaaagaaaattggaagtttgaagtggaaaattcggaagacagaagtacaggaaggtgaagaaaaaactagagaagatagagacacacgttttagaagacaaaaaacctgagcctagtaagtaggcagaaaaaaagacaaatctaggagaaaattgaaaatacgggcgagtgcttaagatagaatgaaaagaaagctattggacgcaaacatacaagatagacgtctaaaaatttagatagttcaaaatcaataatgttggataaattacaggaacaaaaactaaggaaatttttatagccaataagaatttattgtaaaagcccatcaacttatttctggtggtgcaaaagttagatctcagaagatgagggtttttttttttaaaactactgtagaccaggaccaacttagaagaaaatccggaaactaggagagtcaatttaaaatctcagcaaaaagttactgaaggggactgaagtaacttaaaagttaagaatgtatttgggagagttaaaaatctgaaaggccttaaatgcggtagcgtagtttcctttggaaaatgtaaaggactttataagtgaattaaattgaagagcaagaataaccatcgagttattggactttgagctaagatgaatgtttaaatcctgaggactaggcgctaaataacagctgacgcaggtgctacgcagaagtggattcagtgaagctaggaagacaggagcggcagacaggattcggagccagtgttggtgaaaactaggactgaggagccagcggcagttcgtgaagataggaaagagaagcccgggagccagtgcgacttggtgaaggaagctaggaagaaggagcgagtcctaacgatttggaggtgaagctaggagaggattccaggaaggaggaagccagtgcggtgtggtgaagctagcgtgcggcttggcttggcaaccacgcggaggcggcgagcaggcggagtggaggatagatagaggatcctagagcagcagaccagtgtacgagccccgcagggagagccagtggtgtggtaaaaatccgtgaagtcggcactatcgtgggttttttttcctcctgtaactcagtatggtaatatctcttattaaattttcctaatagtaatgggggagttgtgtacttaagcataa

SEQ ID NO: 46129 - DNA, 661 bp, Bovine  19866881011578
cgacgggggctgacgaaggacagcggctcagatcctgaccacctgggcggcagcacacggactctgccgcccctcaccgcctgtggtctgcctcctgaggtagagtcggccgaaggtgccccccacctggcctttggtgaggcgccccgggttcacacagacgcagccgaggatgtcctggaggggaggaaagagtgactgtgggtctggaaaggctgaaaccatgggcatggatgtgaagaagctggactcatctaggggttcagccccagaggatgttatagaaactggaaacaaaggcagacgaaaaccatctttgggccaatgtgttaatttattacagaaaactctgagtccctcttgtgtctccaaaacaaaataaagaaggtgactcagccaattcccaaacgtggagacaaacttgctctattggtttcacagcgtgaaaggtttacctcctgaggttggactggctctgctttggcaagaggaggttgatggggtacattcccccacgagagcccgaacctgaacgtgcccaagagctgctgggagctcatctcagaattcagggaggggacaggcaagcccaggtcaccccaggtggccatgggtgagaaccgggttcgagggccttccagctgcctccggggcttccagg

SEQ ID NO: 46130 - DNA, 1709 bp, Bovine  19866881023966
cttgcgccaccgcatggccctgccggagcagagctggcactcccaggtgagccaagagggtgcagcgggcaggtctccaggcctgggtgaggcaggtgcgaggggcagaggctgcgccagagctgcccttggactggagatggctcatgggtggagcccctgggccaggctgcggtggacagctggtgggcagcacatagggggctgggctggggcggggggttgggaagaaagaagctccctcaccctcacatacctctcctctggccaccaaagctattggagttcttagatgtcctggatgacccagtgctgggctacctgcctccaacggtcatcaccatcctacacgtccacctgttctcctgtgccgtggactacaggtacccaggctcagggacctgggggcctggggctggggccaggctctcatgggcaaggaacctgccccagcccaaatgtgaccccttccctcccaggcccctctacctccccgtacgtgtccttgtcactgctgagaccttcaccctctccagcaacatcgtcatggacacctctaccttcctgctcaggtatgcaacccctcctacccaagctccccatccatcccaccccaagtcggctgtagctaccccttccccagggtcccacatgcctgctgtgtgtcctcaggcctcaggcctttctgtgcatctgagtgatccctctctgaggaagtcaaggaggtttcccctacctagaggcagtcagacctctgaggcagagcgtttgagctcttgcctgataatctcacttctggaggtcgtcctcaggataaaagaaaggataagaagggtaaaatataaagcctccatagtataatttaaaatagttaaaacttgtaagcagtttatatgacctcagattacgacctcagtcagcaaacgtggccttgtgctcagtcacttcattcgtgtccaactctttgcgaccccatggactgtggcccgtccggctcctctgtccatgggattctccaggcaaaaacactggattgggttgccatgcccaccaccagtggattttcctgacccaaagacggcctacccaaccattaaagtcaaatttaagagtaacattgaaaaacgccatcaaataatatttactgaaaaaaataagatataaagccatacatacatatatttttaaagattcttgggggtgtgtttgtatacgtctccgtgtcttcacagaaaagactggaaggagatggatagctatccctcagtatctgcaggggattgcttccaggacctctcgtgacaccaaaattcagggctgaagtcatttatataaaagggtgcaacatttgcatgtatcccatgtacatcctcccatattctttaagtcatctctagattacttttaacacccaacacagtgtaaatgctacataagtagtcaatgctgctgctgctaagtcgctccagttgtgtccgactctgtgcaaccccatggactgcagcccaccaggctcccccgtccctgggattctccaggaagaacactggagtgggctgccatttccttctccagtgcatgaaagtggaaagtgaaagtagttgctagcatgcaacaaatacaagttttgctttttggaactttctagatttttgttggtttgtttggtttggttctctgaccaagaatggattttttaaaaaatattt

SEQ ID NO: 46131 - DNA, 685 bp, Bovine  19866881044471
tgatgctcttggaacggactttcctgaactcacaagccttcccagaagaacgctactacaggtgagcctgtccaaagctcttgggaggtgcagtgagatgaggctgggcagtgggtacccatccaagggaggagaatgtcacttttgctggcctttagagcacaacccagtcccttgagatggctggggagtgaggctcaaagagggggaggcaaatcagttaaggtcaccctgggactacagcctacatctcctcccactaccagcagagaggtgcatttgtccctagctgtatacaggagctgttgcaggctgaagctctgctcattcttggcccctgcatgaccttgatcctcccccatttctcccttcagccatgtgctctgggcaccccgcaccggctctgtggccacgttccctggcctgtccaatgcctattcccaggccaagaacacaggccatgaacctgcagcctgggctgaggtgcagagacagctcagcatcgtggtggcagccctggagggcgcggcagccaccctgaggcctgtggctgacctctgaccccgccctcattcttcagctcccacctactctctatcctactcactccccctccaggtttctttgactatgtccccatctccctttatgctaggaaagggcacgaccacaggaccctctcaaa

SEQ ID NO: 46132 - DNA, 1877 bp, Bovine  19866881170726
gccagatggagagataagagcagtttcagcatgttctgatgcaatcctatatcgacaggggcccacaagccaggaaaaaagagcagcagcaggctttctcggcactgaaaacagggcccccaaccccctcacagacacactgcctcccaaatctcaggctgctggcttctgctgtgaagctcactaatgccaggtggcctactggggaagggggagagacaggagaggtctgcgagttaatgataaacaaatctggccacttgtcctcaaccccctctgaggctgattctgtttcacttttacatttgcagctgcaggctctgctccgagctggcccccatgctcctcccagaaagcattcaaacccagaggctcccctcccttccacagaaaaaggcagcagcagaaatataacccaggtcaggcacatcctgaaccagatgtttagaaaagcttggtgaagttgagacaggagtttagacaactaaaatgggcctggtacactaatattcagcatgcaaaccttaccaccatgcacggcacccagggaggctgctgatgaacagtatttaagcaaatttaaacatgtttccacagcccaaaatgtttaacagatccctgccagcttctccttttggctcgctctttcaagtcaaactgttctctcacagtcctgctggactcgctaggaatttatccacctctgggaggcaaagctttcaaactaaggtgaacgagccccaggggaaccagaggctcattgagagcagcaatgctgaccagggtacctggacctcacagccagccaggatcctgccctcctttccagaaggccccagaggctgggaaacttgaaaaaccacatacagttggctgtcgtcttaccctgacaacgcctataacctcagcagagggagccgccatgcagatagcaaggctgatgggaaaagcgttctcactcaggctgggagagccttgggcagcctctgggctgtgtccctggcatcagatggaagttgtctgatgacaccgggcgccccaggctgtgccagagcttgcttacctctgctgatgcgctgcttctctccagacaggatccccggcgtgtcaatgatgcttatgctgtccaggaccgggttgggcagctgggcgcacatgaacctgcacgagagcaagagcccggaagagcgcggtcaagattcggtatcgctgctccgggtgaaacagcagtgatttctgtactcccctcatctctgcctctggcttccctttcagaagcaaggaacctaaaggaggtttctctaatgtcttaagtttccaggggtgggaacccctgacggttcagtgtggaggatgctgcacttccactgcaggaggcacaggttcaacccctggtaggggaactaagatcctgcataccgtgtggccagaaaaaaagtttccgggatggccaacagattgcttgtattaactgggaatccaaccagcaggctccaactgacccacatcagcacttccctcactgagctcttccccccacagttcgagagttcaacttccaagttgctgatgtgttagcgaaaactgcacacacaagcttcagtcaccattcaaacccagaaagaaggcaaagagtgacaactgggaccttggaattgcatattaagattttcagccacctggctaaacttccacacgccgagagagatggtcctttcctatacctgctggggccagccctcccttccacccagctgcttgggtgaaaggactgcggtgggcagccagtgacagccggggaccacacaggctggtggatggtggggcagggaagcacagacaccaaattctctaaagtcgaagcagatcagggaaga

SEQ ID NO: 46133 - DNA, 711 bp, Bovine  19866881200581
ctgtcctgggagtcctgcccagggcccgtgaaagataccaggttacagaagacaactcaagcagcacactctacagctcacagcccttccgcaggcttccgtgtccacctaacagtggcccccttaggaggggcactgtaatccccatttgccaactgaggaaaccaagacttggatggttttcacctggaaggtgaaaaagagcgcctagcgcgggacctcaatcggtgccgcctcactcctaattccagcaccctttctgcccagtaccccttgttcatttttaaagcagtcactaaaccccgtgccctccttatgtccccttcatttcacccagcttccctcctcccccagacctacctcatcagtgcccaagcaattcgatttccgcttccgccccggctgagctgccactgccctccgggctgatccattctgcaaatgatacgggagggacagaaggggtggctgtgaggtgagcccaaaaggggctaccagagggtaggagggcagaagagatggcttgggggactcacctgggggaaaactgaggccggggcagtctcgctgggcactggagttgctggtgaaaccacctccaccttccgtttctgcagagagaaaccaggacaggtgggtcagaaggtagagaaggcgggacctgagaggaaagcaaggtccctggaattgctgagggtaccgttgagcggt

SEQ ID NO: 46134 - DNA, 896 bp, Bovine  19866881205697
atgggaacccgggctgagagacgggcccgttgtgtttgcagggctgcccacttcgggcacttggtttcactggcttcctttgaggccctgctagctgacctgggggcgggaggagatgggtgcgggaaccctgcccttcctgatgagggtgcaaggccgcctgacagccagggctgtgctgacgcttggggctccctctgccccgattcagggctgagctgagccccgacccgctcccaggtcggcgcagccccagcctctgggaggcggaggctgggtgtcctcacacctccttcagctgctctgcccagagagcctggccctggcctgaggccttggatggggaggacccagcaccctgtctggtatttgggccaggagcttgagggacttgctgaaggccgaggagcagggagaaggccttttgggggggtagagggagctgctctgaacccctcatccaggtggaggcaagctgggcagacagaaggaaagccctcaaacccctgaggctgcggggagagggcccagctggcgcggcctggccacgctcctcagccgtgggcgggcgaagagtagccacagcggccgccaccttgccggaaatgtctaattaagggacagagagcagcaccggcaggacccaaccagttctgcttcctgcgactcggtgacacccagccagaggagcggcacgcgggcgagcactccctgtgcgtgcggcggtggcggggacacgctcctggaggtggcaggaagacaggtttggcggggcgggtgggaggaggtgagcaccccaccctgatggcctcacctgcccctggcgcggggtagaagcagcgtggaagcaggccaggtgtccctggctccccagcactgtcatttcgggggtttct

SEQ ID NO: 46135 - DNA, 1582 bp, Bovine  19866881221347
cagcaggaggccgaatctgtgttggctcagcgggatgactggagtactgggaaccaagccagccgggctgggcaggtgagctgggcgggacagagcgtgtgtacgggggagcggggtgcccctgctcctccctccccttctctagcactgtctccgctgcctcttctacaggccagcaaccctggccacagatcccaggagtcagactggagcagttgggaagctgagggctcgtgggagcaagactggcaggagccaagccccccggcgccaccccctgagggcacacggctggccagcgagtataactggggtggaccggagcctagtgacaaaggcgacccttttgctgccctgtcagtgcatcgggaggctggggcgcaggtactggtgcctttccagtgggagggtgcagacctggggtggacctcagctgagagtaggtctccactccagcccacacctcccttttcagtcgaggcgagactcatggggtgatgacaactgggaaggcctggagaccgagagcagtaagtgtttctccccagccagctggttgatggcctgggcctaccttccaccggggcaggcatgggaagggaagccgagacccaggttgtcctgacaccttcagccctccctttcttgtttccaggacaggcgaaggcggagctagcccggaagaagcgcgaggagcgaaggagggagatggaggcaaaacgcgctgagaaaaaggcagccaagggtcccatgaagctgggaacccggaagctggactgaactgcaggtgtgggcccttcccagtctcggaggccccacagatgtatttattgtacaaaccatgcgagcccggtcagcctggccaggcacatctcacatgtacataatcagagccacaataaattctatttcacacctgttgtgctgggctcagtccagcgcctccaaggaggctagagtctggcgctgccctttggagtctgcgcccatcacggacatgaacatcaatttacttcgaaaaccaagagtaaagagaaacgatctgatttatcagtttctggggaaatgccctctggaaggaaggccggcagcgccagacagacccaacatctgcctgtgagccaggcggaaccggcaggggcgcccttggaacatggggcgcggggaaggggtctacgggcccgaagggtccctgggtccgagccccgagtcggggcaccagcgagaggccgagctcgccccaattgctgggcagaaacccctcggtgattgcgaaggtccagaccgagggtggtgtcagcggcgtcgctggggcacgcaggctccatgcgtgcggctgcgcgcgaagccagctttgcagacgcagcggtaggaaccgctcgtgttcacgcagcgctcggtcttacatagtaacccgcgctggttcagctctcggcactcatcgatgtctggaagtgggggtgacaagtgaggactttaagagggcgccaaagctgtgcgaccccttggtttctggtccgagccgagcttctgcagggcctgaccccgccccgccacgcccacatgccctctggccccgccc

SEQ ID NO: 46136 - DNA, 1417 bp, Bovine  19866881230359
ccggggcacgctctgcggagggggacccggcgtcagggaggagcccaaagcaggggccgccccttcccccgctcaatccaccctcgtgggaacgacggccccgggcctccacggggcacacagtgttctggagagcccaagatgaccctcgcccttaccggccgggctctcggggcgctggcagtcgcggcctgagggtccgggtacccagggcgggcggcactcgcagcggtaggagccgggcaggttgacacaccggccagggcggcaggctgtggggtcctggcactcgtccacgtctgcgggcagcaagtggatgggtcggggtggaaatcacagcttggctcggctagcctctctcccgtttccccagaggaccgacccgggcctcacccatctcttctgggctcagacactggcgctgcaccgggctgtactcggccgggggagtgcaggcacagcggtaaccaccgcgcgtattctcacacactccgttccggcaattagactcgtccaaacactcgtccacgtctgaggggaggaaaagcgcgagtggtaggaaccggcctgcagtcgggtggttttgcgtgtctcctggctgctttcccacggccacgggggcagctgcactcacccacgcattccagcaggttcgagtcgtagtagaatccgtgctggcaatagcactcgtagccgggctgcgtgttcacgcacttgccctccttgcatatctccgccccaaacaatatgcattcatcgatgtctgcagagcgacaggccgtgggcgaccgcaccctctacctgccgggcctctgaggccccgcagcagaggacgtgggggtggcgcttaccgtggaaaggcgaaaagtctgctatggccttttcccaacgcctacttaaggcgatagggcggggcttgggagaggggcggggcagtcggtgagagagtgggcgggccttatcccagtacccgcaattgacaagcaagcactggagggatcggggtggtccaaaccggagggcagagcgggcgagccaagtgggcggagccatgttggggcttaccacggtgggctgggatgccatagttgacaatgttgttgtcctgggtatagcccttcccgtctgggcagaggctgtggaactcagctacagggagacagtggccatggggaaggaaaagagcaggattgagcacgtacgtcctggccatagggccagagctctggcctcatttcccaccaactcaggaaggggccctcttccccagtccggtcccaaatgaagaaactgaggttctggaaaggggaaaggcctgcccggctcctgacctgagctgtagactgggcagggatagatctcgcagtggtctccccagccagcccccagcgagcagcagcactcctgctgggtgacg

SEQ ID NO: 46137 - DNA, 976 bp, Bovine  19866881259930
attctggagcagtgtaggccttaagcatggggttggccaataagttcatcaggtttttttgtaacatctgtggcgaaaccgaagggactttttggccaacagtacatttttattttttgtatttggctgtgctgggtcttcgttgccgcacaggcttttctctagttgtggtgagtgggggctactctctagctgtggtgtgcaggcttctcctggtggcggcttctcttgtgaagcaggggctctagggcctgcttctacgagttttaggagttgcggctcctggtctagagcacaggcttagtggttgtgcacgggcttagttgcttcttggcatgtggaatcttcccagacccgggatcgaactcgagtttccggcattggcaggtggaatctttaccactgagcaaccagggtagcctagccaacagtatatgttgtgggatgaattatgagcatctggttagaagatgatacattttcacatttatcatgtaggtcaggcaggtactcaacatactttgatatgtggtcagagaggggccctgggatggtgtcaccagcccgcagagcctggggacttctccttaacctggcgcacccccaggggcctggacaatgccggcaagacgaccatcctcaagaagttcaacggtgaagacatcgacaccatctcccccacactgggcttcaacatcaagaccttggagcaccgagggtaagcggggtccccgagggcgggcctgcccagcacagggcagggagggcgggcgggggccggactgaccctgcagcccccactgccctgtccagattcaagctgaacatttgggatgtgggcggccagaagtccctgcggtcctactggcggaactactttgagagcaccgacggcctcatctgggtggtggacagcgccgaccgccagcgcatgcaggactgccagcgggagctccagaacctgttggtggaggag

SEQ ID NO: 46138 - DNA, 1668 bp, Bovine  19866881298558
tcgtcctgcagggctgcaggtgcgccgagtgcccctggagatcccggaggtgagaagccagcattggggaaggacctgcaggaaggggtgggggatgcagagcaccaagcgcttgtgcgggccccaggagggccaggtggttccgagtgagggctccaggggccctaaggtggctgtcctgacctttgatggccagcacggtgcacagaacatgaaggactcaagttgcttatttatttactcagtaagcttgtctggagtagcttcgttaccctggcagggtccgcagttaggtgggagggtgcagtggcacccgcgaaggggacagctgagatcactggacagtggcgacgggtcgcttgaggcatgctggtcgagcttgtctgtttcagtagggttagtaagagcaccttttcttgttcctgaaagtgtcttggtgtggacaacaacttatgtaatcggtcaggaagtgacaaaaacactaggattgtgtaaggcacagattcagagcttaaagaacaatcatgagagtagtgcccacgcagccagggccactgagagaccaagggcagcacccagaagccgtgcgtgccccttccctacgtgcttgttctccttccctgtcccgtgggagagcagtgcggtcctcacatgggcgagggctcctccagaggcagaggctgtgctgtggtggctctccttgtgtccctggagtctggcacaggacaggctcatgaatgcgtcccgtaaacacttgttgacttaaagacccacaagcccagagaggttaatgtaggcagcccagggcctcacagcatgtggcattggcacccaggcctgccctcagggccaggcctccttgtgctccagggtagagtggtcaaagtgaccctgatggccacatctgggcaaagggtggcatttttactggctcccgaattgtaaggtggatttcgctgaccccagaaaggggccagagatgcctcctgagtggggaagacagacacaggagctggtaaccctggcccttggcagctcccgcagccgttgagccatatcttgggaagctggagaaaggagcaggccctggggtggagggtcagggcaggctgtggggctgctagatggtagggactttctgtatagaccagctcgtgtgtgccgggggtggcatggacgggagtggatcagagctaatggccaatgtgtgccgggggtggcgtggaccgcggtggtgggggatggggctgatggccagtgtgtgccagggggtggcgtggaccactgtggtgggagggcggggctgatgggccgcggccgtggggaccgcagtttgacctactggaccaggactccctgcacgaatcccaggagcagacgctgatggaggaggcgccaccccgggcccagcacagttacaagtactggcttcttcctggccgctggacctctgtgcgctacgagcggctcgccctgctggcgctgctggaccggtgagcactcagcccctcggctcccaggcctctgtcattcctggccccagggcttccagactctgggaacgtgtggaggccgtcatggccacagagagcctaaccgctgggtcactgcgggtgcgtggagggctggaatttgcagtgggattgcttcaggttcttctaggggcaa

SEQ ID NO: 46139 - DNA, 1124 bp, Bovine  19866881302147
actcgagggacatggtttcctccctggggtgggaagatcccttggagaaggaaatggcaacctactctagtcttcttgcctaggatattccacggacagaggagcacagggggcaacagtccatggggtcgcgaagagccggacacgactgagcgtgtgagcacagacacacagggaacatgctctgctcctcgatgcctgaagggcccactggcagcattaaccttccctttccagacactggaggcttgtgcagcgctcggccaggcgctgaggctccgaactcgagcaattcagatgctgtgcgcagacaccagcaggccctgagcttccatggagggcagggatggtttgcaaggcctctagggcggaggccacccagtggcttccctgggcccgcaggcctgcgccccaattctccacgaactacctcctgttccagctgaagcatcacttccggcccgggtccccccagtctggtccaccctcctcaggacagctccccagccacctgcttggtagcaaccaagacgatacaaataaaccatgctttcttttcatcctctgctttcccctgtgcggcggacagatgctgggaggctgggaacctggcagttcccactgcatccccgcacgtgctgcaggccctcagtgcttggcaggcctggggggccagccgatgaggcctcgagcggctccccacccatgctccgctccccacccatgctccactccccaggccgcccctcggtagagtggcatcttcttgttttgatgtttatgtgttaaaaggaatctcagtgaggaagaggttgtacccatgggtgcacaagaggacagattcagacgaggcatggcacagtgtggccaacgagtgcagggctgggtctggggcacccagtcccagggccccgaactgacaccccagagcgccctggcccgcggccgcccgccccacagtctaccttggccagccgcgccctcttgattaggtcattgagcttcctgagggcagcgtttcggggcagagactggatgtctttgaagaggtcctgctcctcagcctcgaagagcttgcggttgtcggggatgaggagcgggtgggaccagaaggagccgatgta

SEQ ID NO: 46140 - DNA, 1231 bp, Bovine  19866881312657
gatggcgttgaggacagtgctccgggcaggtcttgcttgttggcaaagatgaggagggtcgctccggccaggcgctagagaagagaaacagagagtaaggggaggcggggtggaggctcagagggcagcccagcccctgcgctaatcacccagagcagctggggtcagagagcagtctggaagattagagcaaggtcccatggtggttgcaaagacaccattagtgtgggcagtgtgaacacagccttcctgtccagccattatgggctggagggagctgtgggctggcctgagaccctgcttccagcacagtcacacccagtgggcacctctcttctctgtgcatcagattcctcttctataaatgggaggggatgatggacaaggggagggggtgatggacaaaggggaggggttatggacaaggggagggggtgatggacaaggggagggggtgatggacaagatgatcctcaagcctctgcttctagattgctgtgacctgatgacctgacatcaaaaagaacgcgactatcccaggggctgtgggggctgagggcaatgagcttcccctcctccaagttcacacagtcccctaactgtcccattaccctgacagaccttcctctctgcctgtgattccagttacttccctctgtgtgtttgtgaccgggagtccctccatgtggatggcggctctaccctttaacaagggccttgaggtgccaggccagggctgaacattcaacagccaggatctcactggacctgcttgactgctgtttaggcctattgtccctaaataattattaacaactccctctttaactctcaaaagtgtcctgaatttcagctaaatgcagtggagtaacctggattaaaccctggaacacagaaaggacattaatggaaaaactggtgcaatccaaacaaaacctgtagttcagttaacagtaacttgttaatttcttattaaatagttttaacaagtgtttggcagttctgtaagatgttcatattaagggaaaccaggtgaaagatacatgggtaacttttcactatctttgcaacttttctataaatctaaaattttatttaaagaagagcattttggctcagacagtacattttaagatcaccgtaattattaatataatgcccatctgagagatgcagtggcaattcagagaaactaagtgccttgcctaaggtcacaaagcaaacagtccaa

SEQ ID NO: 46141 - DNA, 659 bp, Bovine  19866881343873
cctgtaatgcatgtgctgctatgtctcagaggaggaggaagaggcactgctccctgctggctgctcgggcacaaggttgtgcccgttctgaaagcatcctttcctctgaaggctgtgagagctttgtgggccggggtagacaggcagggctccacggaggtgagcctggaactgggccctacaggggaggccagattggctaagaagagggagtaggttgccggcggtgacaccacagggaagggctgagcctcagcactcaaggcagcggctggggcacagaggatggggggcgaggctttctctgacccctgcctctctgtttctcttctccagctccccagccctattcctttacgccatctctcagcaccatcaactttgaggagttttcccccatggtctttccttctgggcagatcccaagccagacctcggccttggcaccagcccccaccccggtcctgacccagacccaagtcctggccccagccccggccccagccccaggcatggcatcaaccctggcccaggccctagccccaggcctggctcaggctgtgaccccgcctgcccccaggaccaaccagaccggggaagggacactgacagaggccctgctgcagctgcagtttgataccgatgaagacctgggggct

SEQ ID NO: 46142 - DNA, 3352 bp, Bovine  19866881360268
tccgagacttcatgcgtgaattcacccgcctggagatctgcaacctgacacccgacgcgctcaagagccagaggttccgcaactggaacaccaccctgtatgagggcacctggcggcgggggagcaccgcggggggctgccgcaactacccaggtgacctggggagtggggtcctgggccctgctgccctggacaagacatatcttctctctgagcctgtttcctcacctgtaagataggggtagttgtacttgttttgcaaatttgctttgaggatgaaaaagtgtgaattcccaagagccacctttgactgccttgctggagcctgagctcagggtgcggacagaggagacttccttgctgtccggccacctcctgtcactcctccttccgggccttcctcctggcccgttgtctccctccttggtccttctgtcgcctttccctggggtccatgggcatccttcctctcccaccctgccttctcttcttaacaggtttagcatcctcatcctccccaggttggagtcagcattttaatgctgtccctgcaaacactcaagtttcttggctcctagctccctctggtcctcttacctggcacaaccataatcctaattgaaccctctcgaccggcttcagagccgctgactgggcctggagagagaacacacacttcgggcagtattcggaggaggcaatggcaccccactgcagtactcttgcctggaaaatcccatggacggaggagcctggaaggctgcagtccatggggtcactgagggtcggagacgactgagcgacttcactttcgcttttcactttcatgcattggagaaggaaatggcaacccactccagtgttcttgcctggagaatcccagggacggggaagcctggtgggctgctgtctatggggtcgcacagagtcggacatgactgaagcgacttagcagcagcagcagcagtctctcctcagacctgccgccactgtcactgttttccgacctcacaggacacccatcgtagtcccacctccaaggcccccagcctgtctggacctgtgcccgtctttgctgccttcctgcctgagacagtggcggaactgtccccactcaggggcaccgcgccccccacctctgctctagaccccgttctccctcgggctccttcacccgtcgcctctcgctccggggcacaagggagaattgcctgcctctggaacccacttccccgctcatttctctgctccccttcaaagtcaagtttctcaagatggccagcctccccctttccttcctcactaagttcagtgcttaacccgctccagtccaccttgcgtccccaccatgctgctgcggctgctccttgtccgctttggttttgccaaatccaccaccgctgctctcttcgcatgtcctgcctcctccagcagttctcagcctggctcccagccctctgtgttcaagcattcttctccctcgcaggaatctcatttcagttcttccccagatgaccactgttcgcggtaccgttttctgagaagcctgtcctttccctgcaggtccagccctgtcatagagttcccacgtagctgggtccgtttctgagttgcctttccgtccctcggcctatctctttgctactgccgcgttggtttagttgctatggatttgtacgtcctgcagactttgctgtggtccagtggttaagactctgcttccagtgtagggagtgcatgtttgattcctggctgtggaactgagatttataaatcctgcaattggacgggatgaattccttcttcaagcgtctcttagctcctcttgctctttgcttctggttttctttttttggttttgttttatctgtgtgaattttaggatcagtttaccaagtcctacaaaaagcccttttgagattttaatttggaattgcatagactatatagaccaatttggggagaattgacatctttccaattttattcttcttatccaagaatgtgctatgtctctttattttggtctttagtgtctttcaataaaattttataattttcattgtaaagggcttatacctctgttgagatttgttcctagatactcttatcatcttgttgctgttgtaaatggtatctctttttaaatgacatctgccaggtcattgctgatactgtagtatgcagctgaccttttaaagtttattctacatctggcaagcttgttaaactgtaatgaattttactcatttttctgtattctttttggttttctaactgacagtatagcatctgccaataatgatacatttgtttcttttccaatgcttataacttttgttgcatattcattcttgtttaatgtgctggccaggcttgctgcatgcccactagcactcactatgttctggtcttacccttctctcaaaaggaaaagtttttactattaaacgttgactgtagatttcatcactaaaaccttttctactttaagttttttgtgtgtgtgtgtatgcaccttttatccgagtaatgaaacttaatgttatgaaataactttattattagaattagctgttttaaattacctgttaaaacaataagttacattgatcacttttctcatattaaattaaccttacattcctgagataaaacaacagagtaatgatataaattttttatacaataattttacatccatgttcatgagtgaggtctgccagtagttttcttttttcatgcttactttatctaattttgatatgggtgctatatttggctggcaaagtgaactgggaaatgttctgtcttttcctgtttttctggaagagtttgcataagatggggatgatttcttgcttgaatgttcggtggaacaggtctagaaaactaccaggcctgcttttttatttaaagattaacttttgatattgagtatcttttatggtcattaaagttttcaggtcttctacttcctcttgaaaatattttgaggagttttattttctaggagttcatcctttgcatctggttttctctattattaacatgaagttatccttaatatactatacctcatctgtaatgataacatctcttttattcattgtctcttttgtctttattaatcctgtgaggggtttgtcaatataagtctttaaaataaaatgattttttactttattctttatagtatttttttttccatattatgaatctttcttgcttgttgtttcattcatctgctttctttggatttatttttagaatttattttatgacgttttttccttccagttttattgtgatatattgacattcagcattgtataagatgtacagcataaat

SEQ ID NO: 46143 - DNA, 977 bp, Bovine  19866881371630
aagtttcaggtattacatgaggtcagaataatacaggtttcaggggtcaaatgaattcagggtcagggacaacacgagaatcaaggcctcctgtgccaaagaggtgaggtctggggcagctgggaagaggggcgtgggcagcgttcaggcccagatgcccatgcccatcactggcccctgcagcggacaagccggaggagaagagcctgtgtttccgcctggtgagccctgaacaccagtgccagcaccccctgaccacacgcctcacccgccaactctgctgctgcagtgtcggcaaggcctggggtgccaggtgccagcgctgcccagctgatggcactggtgagccaggggcctttgaggctggggggctgtctgtgagcctgcttctccaggaagggctcacttgcctgcctcttgctctggccacagctgccttcaaggagatctgcccagctgggaaggggtaccacatcctcacctcccaccagacgctcaccattcagggcgaaagtgacttttcccttttcctgcaccccgatgggccacccaagccccagcagctgcccgagagccccagccgggcaccaccacctgaggacacagaggaagagagaggtctggcccgatccctcctgtttcctgacagttgcagaacccctaggtctgacaccttgacctttgacccacaggacccaagtctaacctctagctcctaatcccagactagcattggcccccggagctgacactcttgacccctaaccagtgttgtaactaagcccaggatgtcacccctgagccacgggatttgatcatttattgccccccaggttcaatcctctgacaccaagacacttttgatttccagatcaggacactaatgcagctcaaatgctgcctctagatctgaccctctgaccccgactcagggattgacccggctataagctcccaagctaggacctgtccagcca

SEQ ID NO: 46144 - DNA, 1244 bp, Bovine  19866881390852
tcctgccccagaccagacacagggtcctcacctccgcctttagccgggccacaaaggacccatttgcaccatcccgggtcgcgggcgttttgggttttgccgctacccacaacctctactcgatgaacgactgcgcccacaagatcctgcctgtgctctgtggcctcactgtggatcctgagaaatccgtgcgagaccaggtgaggcgttactggggctgggccctggggctgggggtccgggggtacctgggccccagctggcctggcgggctcacaggaaccttggaggctccagctctaccccttgctgccccacaggccttcaaggccattcgaagcttcctgtccaaactggagtctgtgtcagaggaccccacacagctggccgaagtgggtgagtggcccacgctcacgttccctgttcctcttgccactttcttgactggcctgttgtggcccccgtctgcctcgctggagtgtctgcagagccccaggggacagattgttgcgcactcttcaacctcccatttcacagctgggagagcgcaggcctggggaggagggcgcccactctaggttgctctgcttcagttagtgccgtcctgtcgccctccccacggaggcctgaggtgtctgtacttgtcgctcctgtccctgcccagagaaggatgtccacgcagcctccagccccgggatgggaggagccgcagccagctgggcaggctgggccgtgacgggggtctcctcgctcacatctaagctgatccgggcacatcccacggctgccctggccgagaccaacgtcccccagagacctgcgcctgagggtgagagtcctggactgagagggcttggagtcccccccaggatggtgatggggacacccccagccccagcaacctctgccctgtgctgaggccttcctggggcttagtgggcggaaactcagtgagcctctgctccccaggacttcctgccccagcccctacccctgtgcctgccacgcctacgacctcaggcccctgggagacccaggaggagagcaaggacacggaagaggacagcagtgctgctgacagatgggatgatgaggactggggaagcctggaggtgaggggccaaggactcccgcggggacccagctgcagggccacagactgccattcggggagctctcgtgggcttggccggagtcagatctttcctcatctgcaagtatcctaagcaggagtcgtggagcag

SEQ ID NO: 46145 - DNA, 2057 bp, Bovine  19866881396594
ctgggtatagggtccgtcctggggtccagaactgccacaacagaggccaaccacagggcctccagagtctaacaagtgtgagttaatcactaacgacaactctggatcttggcttgtccttccagatcactggcccacggctcagagtgacaggggccagagcagaagctgccctggggccgggccacgcctccctgcctgcctgccctgctgacccattcaatcattcctgctaagtgcccgggggctgcagtgtctgcgttcacagaccctgagggggcaggcagacctaggttcggttccagcagccaccacctactggctgtgtgacctgacacaacttactctgtccctcagacatggggactggagcacccagggcctgggtctgtgtgtgtgtgtatgtgtggggtgacagacccccacacaaggggacctgaccctgggggatgtggctgtgatgctgacagaactcctgccacgtgtgcggggcactcacactggcactgaggtaggagccgatcttgcccaggcacacggtggtgttgcaacggatggggccctgctcgtccttggcctgcagccgcgcgaagtgcttcatcagctccacattgaggttggtctcattcagctttggggccagaagcagcatggactgcagggcgggagaccggacagtgtgggccggagtgggcagggtaccacacatgggaggggcctcctgggagggcaccagtgaccctgagtgctgaggagacccgccagagccctccaacctgctcctgggccttacccagaaggctttggaaggggaacccccgtctgcactccagtctcatgaatgtctgttgcactcaggactattagccatacccacccttcccccgaccacctgcagtgctatacccacagccaggacccacgtgcagaacagcctgcctgcccctcccataccctgtttgagccacagaccaaaaccaaggcctctgtgtcctctgatgagccgcctctgagccttagaaaaccaggggtggcccctttgggcctggccacacccaccttgactgtctgctcccggatggcagggttggtgtccaggaaaccgtgcacaacgtggggaaagatctgggtgttgactgttggctcatcaaggtactggatgaactgctccatctgcggcccgggttggggcatgagaacacggtgaggccttccacccctcaccagagccagggggccacccttggcatggtttctctacccagcaggcactggctggccagggagtctcctgagccccgcaccgtgcctctggcctcaggcccacatggaatgaagagggtactgggggcgagggaggggactgagaagaaccagggactgggtgctggagagctggaatggtcacaacccctctcggagcctcccaaccttttctataaaaagcgtataacctctgcctagaggagtgctgggaggaggctggagtgtttggagttggagaaggactgatacctggatacctaacgcagcggccccccatccccgatcccatcaaccctgtctgatgctcccaactgcctgggggttggcaagagagacgctatcccccctcaagaggaaatcaaccctgaatagtcattggaaggactgatcctgaagctccaatactttggccacctaatgtgaagcaccgactctttggaaaagaccctgatgctgggaaagattgagggcaggaggaaaagtgggtggcagaggatgaggtggttgaatggcatcactgactcaatggacatgagtttgagaaaactctgtgagatagtgaaagacagagaagtctggcatgctgcagtccatggggtcagcgttggatgtgacttagcgactgaacaacagaacaacaggctcaacccgggagactgggcggcacagggagaagcgtttgagccatgcggcctgggtggggggcgttccctaagcctccaatgagcccagtgattatcttgacttcctgagagcacagcctcactggtccctcacctgtgtgtatgttt

SEQ ID NO: 46146 - DNA, 960 bp, Bovine  19866881426271
ttcctcccaccacacccttgctgccccaacccccgttgactggcccctctctctccccaccctctgcagagagctggatgaccaggtccaggccaatctccccgacgaggtacgtgccctgcccccaccctgggtgcacgacggggacccgggtgtcctgtgtcttggtctctagccagcaaggcagagcccctcctggcaggagccatacacatccctcacttgccaagcactttacagtttgcaaaggactttgcgatagtaatggcgcagggcccctgggttcttgctctctgcagggtctgtgctgagctgtttacctggatcacccggtttcctccataacaaccgtgtcagggtgctgtcaccgtctctcctctcagagggaaactcaggttcagagaggttaaggaatttacccaaggtcacgcagcagggatccaggctcacccctcatcattgggctgtatttccacctccatatttagaccacaagagttctagacaggaatacagtagggactgggttcccattttacaaatgaggagagtgaggctctgaagtgaagtgacacctagctgatgagtgctcccagccccgcctgctgctgctggccacgcagaggccaggctggggcgcccctgacctgctctccccaccttccctctccagcaagtgctctcagaagaggagattgatgagaacttcaagtccctcttcagacaactggcaggggaggtaggctgggcctggtggcgggtgtctggggcactgaggggtttccccagggcaggtgccatcctccatctccccccaggacatggagatcagcgtcaaggagctgcggaccatcctcaacaggatcatcagcaaacgtgagcgtccctgggtagctgttctccaccccgtgtctgcctccacgcccccagcccccattcctccagactccaggatctagg

SEQ ID NO: 46147 - DNA, 1373 bp, Bovine  19866881674802
gagatattccaggaggacttagacttccagaatatgaaagctgaaaaatttccccaattcctttatttcccaaggctcagggatgttgggggaggcacccatggttacatagcacagaagtattctttgggcctacccatggactagaacctgggtgggcggagtcccacagcagccatcgtgggtggaaggaggaatcacccccttcttctgccccaagcccagggcttggtgccccactcagcactgctcatccccttcccctcactcctcctgcctgctgccggcccctctccccacccagccccttgcactgagggctgctgcttaccttagccccgcgccctacacccccatagcgggtcaagacgatgctatcttggagtttgactcccttgttctgcagttccttgaagtcttcttccgagccctggttggcatagacgagcgggccctactcccaagagaaggtgacttgaagccaggcccaggaaagagagagaaaggctgaatggcaggatgaagggtttagatcccgcccccctaccctacccagagcttctcagctccccaagaccaagtcacacctggttttctctgtgctctgtgtccaggtaccctgtatcaggccaggcctggagcagggcccgttagtgtttgttgaatgactaagcgatgggcaaaaggagtagtaatggagtgtggaagcgagtacattctgggtgggggctgcgccccagttgaggcatttctcaacagcccctggggtcaggatgggagcagctgaggtgggaacaagggggaattgggccagcagtggggagggggcatcccaggcccacctgcggggttccggggggagcataggcagcatagggcggcaccacgttggggcccccctgctccccagtcaggttctcttcactgtgtcggcaggagaagaggatggccccagtggagttcactgttgagagagggctgtgtcggagccgggcccggcggctgccccagcccacaggcatcccggagccagggccggaactcacccacagccacacggttgggctgctccccgctggggaaggacagcagcacctcatactcagtggtcctggctgagtccaggcctgactccgggtcctgccagcgctgcagcagcagctgcaccagcgcctcatcccgggggggtggtggccagatgtggctccttggagagttctctgcagggtgggcgagagaggggtgggtccagggtcagggaggggcctctggcacacgggagaggtgcaaaggcaggcctctcacctaaggttctcccggatcctgttggcatctagctgttctatgacggtctcgaggatcttcaggtccag

SEQ ID NO: 46148 - DNA, 540 bp, Bovine  19866881706167
cgtcttgtgctctcctgcattgcaggtggattctttaccctgagcccccagggtaagccctcaagtacctctggtgggggaggcaacctggcgtcctggcagtccaccctggggccaaccctggcaggcctgactcctttctgcctcaactcccacaggtgatccgggggctgctcaaatactggccaaaaacctgtacccagaaagaggtatgaagaaggactctggtgtccactgcagggaggctgggaaggcttggcttccggaaggcagttgggtgtatgtcgggggagatgggaaccatcgcccctgtgtccctgcccccaccccaggtgatgtttctgggggagatggaggagattatggatgttatcgagccctcgcagttcgtgaagatccaggaacccctcttcaagcaggtggcccgctgtgtgtccagcccccacttccaggtacaggtggggacaggtggggtaagagccagggtacggacggaaggtggcaggttacctcacacagcttcctctgccctcagtttct

SEQ ID NO: 46149 - DNA, 589 bp, Bovine  19866881713931
cagaaggtgacacggcggccgcgggtcgcggggactcacgggtgccctgggagcggggctgggggcccagccaccctgactcccgcctccccccactctcgcccccgcaggagaaggcagacagggcggccctggaggaggaggtgcggagcctgcggcacaacaaccggcggctgcaggccgagtcggagagtgcggccacccgcctgctcttggcctccaagcagctgggctccctggccaccgacctggcctgagctgtcaggcgggcctcagcctggctgcccatttgctggaactgcccggctgctcagggcccctgggctgcacaaactcctcaggaactctccctgcgcgaggcgcgtcttagcactgccccactccccggcccattattcggtgacacagttgccctcaccccacccatttgtaaatattctgtggagaaaaggggacttcagggaataaagaagccactgctctttgtgtctacacaggtgtgcacgacgtgatgggggaaggggttttgctcccataggctccggccaagctcccgggactggttagggaagccctggggacattggtt

SEQ ID NO: 46150 - DNA, 695 bp, Bovine  19866882123933
acccctaggcctacaggactactattgtaaggggccagagcctgtttggtggggatgcgaacacactgcaggagagagggctgttccccaggggccctgggccagatcagggaccccaaccaacacccgcttcctctcccaactggggggacagacccaaagctggaaggggaggtagctccgcagcagcgctggccagggtgacctcacacaccctggtatgagaacagcagcactcagagaggttaagccacttgctcaatgtcacccagctcctaggaccctgctggctgtcgggccactgaggtgctgagtgctctcccagaaggcagcggctgatagccctgttcttagcattctgtgggggggtgatgtctcaagcaccttctcccacgctccccgccccccagctctgtctccttcccattctctgcctgcccctctcatcgccctctcttggcgcccctgcctcagtcttccgctttctctgtctccccttccctgtccccccaccattctctccatctcatctccagcttcgtgtctggtgccctcctcagggttctgggcattcagaggcccctggagatcgcaggtgcccagtggtccctcgctgtgtctctgccctgtggctgcagcaggaagggtgggcaaagggcagagagtggaggccgcagtggcaaacctgaacctgg

SEQ ID NO: 46151 - DNA, 824 bp, Bovine  19866880417075
acacacatgtatatatatgtatctatacatttatgctagttgaatttctattttaaagcatttatttacagatgataggagagggtatttgtctgcatttctcatttatatatatatatatatatatatatatatatatatataaaatcatatcatataagaacaaaagataaaatcaaataaaatggcttgaatatctactatccaaatagggtgcactttcccttccatgagccatcccaagacagatataaactgagtgttcgggatgctgacagatgtgctgtattatgcagggagacattttacgactgaggctactgccctctggagatgcagcggactccatggaccacttcacctgagaccacagatcacactcaagtcgccggccccagaggccttatcatcccagggaaccactaaagtccatttttggcaagatctcaattcttttcctttccttgaggtcaatagagtcaagggcacggaggtggcccacccagacctacgcacattcacttttggggggaattcaccttagtaaaatctatctaccttaggtcaatttaaattccaccatggaacatgaaatatcagtaagtatccattacttacagaatctttgaatccttagagaattctctacctttaaaataataataaaaatgataagataaaaacactatgaattttccctaaagagcatcttaagcagagttcctgccactgcttttttttttttttaaatctgtgttttgattcctggggatttctattcagtcactcctgcttttatcactaggcttccatgcgggtttatg

SEQ ID NO: 46152 - DNA, 880 bp, Bovine  19866880435750
ctttcttgagtatagaaactctgtcaatttagtccttttatctacaaaacacctcacgtatttctgagcatgcaatagatgcttaaaatatgcttatatttaacttatataacattccagtcctaacctctgagaatcaaaagtatttgcctcatactttacagtttacaaatcacttttataaatggtacaattaggaggattatcttcaatgtaaataagccatagaagctagaactgagaaaaatgtaaagagtttcccaagatgacatggtttttaaaacctgtgtgttgatgaacccaacttatatcatttgacttgagcgcctacaatcttggtttgtatgtaagggaagactttgctgaattaatggatacctcaatcaataatgaaatcattgaaaagtaagcactgaaatcagattgtgaagcaacaagctagttgatgataagtaccaaggttattatttatgtgatcttcattattttttctaaagaagagtgaggtagatgaaacacagaacaaacaaaatgatacctcgcacaacaatagtcccacagtcatcaaggggcatgtatgtttctttacactcagagaagtacccaagagcttgcttgatggaaaagactcacaaagaaccgaatagtttggcgtcacagaccaagtggttcctcgctggcgatgaccactgtcacaagactggatttagcttcagacgtattgcgtgccatctggctccaaagagcaaacctatttttataatatcatatttgcaataagagaaaacgacacacatgctcagagttggatgggcttccatttttaacacgactgactttcatcttcctgggggccccaaactgggtgggctctctttct

SEQ ID NO: 46153 - DNA, 735 bp, Bovine  19866880566250
tagtttcttgttttaatttttaaatttatttattatttaaattggagggtaattcctttacaatattgtgatggtttctgccatacatcagtatgaatgggccacaggtatacatgtgtccccccatactgaaccccctcccacctccctccttcccctatccttccagcttgtcccagagcaccagttctgggtgccctgcatcatacatcaaactggcactggttatctattttacatacggtaatgtatatgtttcaaggcagataatttcttattgtcagtttctgcttttagaggcaaagatcatacacaatgtgtttctcttctgcttaccaaagactccaaaaccacttgccaagtttctccaggttgcaaactgaaatcacgtttaacttctctgcataattttggagggatacacacccaaagactaatatatgtaacgaaaaccttgagaggaataaccatggttactgatatagaggctgatggcagaataaattgggtcattgacctcgaacctctaaaggcctgaggttagatctggattaaatcacgagtgaaatgatcacagaggttttgcttcaaaaattagcactcaggttgattcactttgacaggagggggtgaggattccagtgaataaattaaatagaattagattgttatgccaaagtggggcatctgttgaggataaagctttattcttatccatcttaacctaatgaatgc

SEQ ID NO: 46154 - DNA, 1563 bp, Bovine  19866880584579
cttttctggtctggggtaacacagcatgccacatgttttcctaacaaattgcattcggacactttccgacaccttcattattttaactcaggtaataattagtcactgtcagaggaaggacttaggttgtgcaaatcagaataaatttaccttgccttagcagcagtcacaaatgaagcaataaattagaaatagcaaattgttacagacttaagagatcacaaatcaaaaattttccctgaaatccaggaaaaggcagagtacggccaagatttctttgagaccttaatttttccagataacttctgtgttgaatcagtttgtgacaaatcgcagagatgaggcagacactgatcacaaagatgactttctgggacttcgctcctgtaacacaagctatttcataaggcttcttattaaaaagaagtgctttttcttcttatgctattcaggagctcctaaatcttttcgtacacacacatacacagaaacacagacccatagagaaatacacagacatatacagaaacccacaaagacgtgcagagagaattaagaactcttctgcaaagtccgtctgagtatacagagcctttcctgatatactagtagtccaaatagtaaaatttgaggtcatgaaggagtcttggacttggctgaacaagttcccagaggtgagtaattaagtgaattaatgtcactgagggacaatgtttctaggagcatgtcatgaccacccagcactcagcctcatcttgttccacatttttatttgggatcagaaagatgatgtagatggcatgctcatcaaattttcttacacaaacccagcaaggatcttgaacacagtgaatgaaagaatgtgaatggatgtgaatgatgagccaaaatatacagtcatgtcacgggaacaaatgtaaagtcttgcactttcatccaaagaaaacaaaaggcctggaataactggatgtgaaaactgtggcttaatcaaagcctctctggaaaagattggtggcttcaattgtgaaatagagcccatgagtgtcaactgtatgatgtgatacccagtaagctagtacagtgttgctttggttatcaaaatagaggtactgtatttaagaagggatcatcttactcgagatcagataacaaccagagtggtgtccttatctatcatgctacatcttaagaaataagtagaaacactaagacatgacagtcacggtgaaaaaataccagtccgtccataggaaaagcagaagtctgtattactcagagaacagaacctcctggtcagagtggatattcctgaaaactgttgtccattactgatagaatcaccatgtagagtgaataatagacacgttcagtttggaacaaagataaggactttggtcccaaaggatggaactctaatcgatgggagtatttctattaaaatgacccctggataatgagcacgtaatttttcccattccagctgccccgccccccaggttatcagtaaacttatcaaagatttgctaactagggaaaagcctgtatcatccaggcaggcagaga

SEQ ID NO: 46155 - DNA, 1387 bp, Bovine  19866880588522
catatggaaggatgaataatcttcctttttgtttccatctttcctaaatattctttcgctttgggttttgcaataccttttgcactcgctttggtcaaaattgttgttggccatttgccagtttggaatgtcctacaaaatgaattgcttcttctgtaaataagaaaacctttgggaaacagtgctttgaaatactgtgctggagttacagctagctggtagcactttctgtgggggcaaagaaggcagggagtttattgtctgtgcatcatgtataaatcatgatccaggtaatattttgtgcttgccttcatatctactagtggctatagtttggagcatcacaaatattctttcaggaaaaaactgcatatttcctgtgtcatgatggcatttcaatttggtcacttttcaatgacactagtatccgatagaaacagacacattttagccaccagtttcttggctgacacttaataaagacaccatgattttcaagtgaatgagtttacccatttttattggcttccttttcatactttctactttaagaagttaatttattcctcttacaatttaaatgccaagttcttctaatattattcttgcaaggtaactgaatttggccagtcttcatcttccttctttcccatattaccttatgcttttcagaaaaaaaaatctttaaatggcacaacaagaacaaatatcagagttgaagatcattttgaaactaaagtgattgtcaaaattaatccaataatgcactgcagctcagttcacttataagatacattatcatataaataataatgtttttaatttcttgcaaacttagaaatgacagtgagagcacactcgaaggaaattttaaagctcacatttaaaagagaaatagttttctatttttgcccattgaaatgcagtgaaattatatatgtatatatactacgaatcactacataggattattaaaataactttcctttccatgattttcttccgaaatacaattcttgaatcatatatcttaatttaatattcaaaataatgagaacagagtgaaaaagtttactgaaaaaatggtctgtttaagacagaactggagtgatggtcaattaaaactgtgtctccacactccagagaaggaagccttcctacactgctggtcggaatgtaaattggtatagccactatggagaatagtaggaggttcctttaagaactgaaaatagagctaccatattaccctgcaatcccgctcctaggcatatatccagagaaaaacatgatctaaaaggatacatataccctaatattcattgcgggattgttttcaatagccaaggcatggaagcaacctaaatgtccatcaacagaggaatgg

SEQ ID NO: 46156 - DNA, 888 bp, Bovine  19866880590122
aatgatttcctgagagactgagtgtttgcatttcttcatacactcatgcaagtctgtacacgagaaactattgtccccataacagtcctttactcttttctagaaagtgtccctgtgcttgtgacttgtacagagaatgacaagtaaaatcctcaagtctatcaccaagaggtgatagactggaaaatttaaattctagatggcaaggcacaagttgaaggaaaacatgtcctaagtttaaaactcactgaaagcatgggtgggggaaggtggatttaacacacagtaaaataagctagaattgggtgttttcattgggatttaagaaactatgttatcacaccttaaaaaaaaatattactatgcattgtgatggatacagagcacattcatcctttacttacatttttgtacttttagaacattctccccctttaaatacgaagccatatttcaagacccactagcagtttctagaattcacctattcctgttcccacctgcagtgatctctccctccattgaactaatataacagacgctttacttatcaaaattctgtcataatatacatgagcatctatggactacgaactgtctctgacgagattgtgagttcttcgatgttgtacatcaggagtgacacattgaatgcaatgtgcacgcggcttctcaccaaatggcaacatttccctgaagtcctgggataagaataatgctgaaagtgtgtaatattctcccaatcgtacttagaatgagaaaatgtcattacttatacaagatgtgatattgtctgtaaattttgaattcctaaaaactggtagggcaaaatttgtagcagagaaggaccaacaatatgtaaaagaagaaattaaaaagaatgtaaca

SEQ ID NO: 46157 - DNA, 1662 bp, Bovine  19866880594532
aaaatgaacatttttctgcttagaccccgagcatgatatgccatgattattatcattttattaaaatgcacatttctttctcccgtactcctcaatagtaccctcctgggaattcatctgtgataaaacagaagcattgagactggacccctgaatattcgggctttattagaagagtgtaagacattgatagtccattgtgcaaggggatcaaggacaggcggcattgatttatttccagtcaaggttattatggactggatttcagatagtgctacgacttaaatttgccattgatacgacatgatattagaaactggtgacttattctccattctctgagtccgaatgtactgaaggagatcacccctgtgctaattccccagattctctccttctatattgggtctgaaatgtatctacaagcacaaatggttctactgctttgatgggaattgaccagtcggtcagtccaacagctgtcaattcagtcacagaatttttgacatttttgactgaattggccaggtgttagactaaacccactggtcaatttcatcaagaattgtcaaaccggttttcatgattggagaaagccagaatctatatgtccttatgggtattcctctatgtatcttgttaacaacatactgattttcttatttttttctggatctagatacagaaacatcatagtttacacatatattcatgtatgcatatagatgtaaagatctgtgccaatgagcagtcttcctgtttttaattcccaaatggtatggcacagagcatccatccatgtagctgcatttccaaataaaatcatttaatcacctatcaatttatttcactagttctttttatttctagccataatatagcagcatgtggcaacggcaggatcattactgcctggcagatcagccaaataattccagctcagtaacttctggagaaagtttgtcttttttcttctccagaagacttaccaagattagaaaaagtttattatgattgttggtcattgcctatacccaaccctcacctcccacaggaatttaaaacccatgagagcaaaaatccacatctattttattacctgatgattcccaaatgcctagaattagtacattacatctagatccttgaaaatggtgctttgaggtttctgaaccagcaatactcatcgtaatgagtttggtcaagaacattcattctgggacttctttttcctgtcaactttctaagaactttgcatttaccgaatttgaattacttagcttattctgcattatatttatgatgttgttttatttttttccctagactatgaatacccagaatatggatactgccctagtgtggtccatactaagccaaccacaggacctaataaatagtggacaggaagaaacacgcatggaattaagaacataatcacttatgaatgaaacagcagtattcactactactgatccatgctctttagaagaattccatgaacattaataaacaacacctaccattctcaggcagttcaatctggatgggtggatggagaaatggaagtgaccaatgagtgattagaaatgaggatatgataattcatggatggtcttgattagagcccttcactgacattaagcctaaatgttcttaaaa

SEQ ID NO: 46158 - DNA, 869 bp, Bovine  19866880596704
tcagtgatggttttatatctctggcaacactcatatccagcccaagttggcacacactttggggtgtttaaaaattgccttaagtgtttgcctgggcgggggaaacgacagacctgagtcttgaaccccctgcagacattctgaagagtgatgatggcccctttcttcctcctgccccttcctgacagctctttcccctctctggacagtctgcattgttttaagaaaaaatatgcttttgaaaattgctgccctcaggttggccgggcctggagctccaacttgcactgagttagcaggcaaacttttccccctcccgccaggggcaaaccttcccctgaggggctgataccaggactgttccagcgcctacaggcatctcccggaggctcagcccgggtgacaggagagccatgggggtagaggagattcccgctcagctggcccagagtgcctgaggtgagggagggaacaggagcgtgcatcctggtctggcggaagggcaacaggcctgcgaggcgtccccatggcccattttgagacagtcaagtctgaagcatccttcccgtggcccagccttcctctcctctccccagaacaagcctgccggagccccaccgctaggcagagttcccattccaagtttccctcgacagtgtggctctgggggctcccaagagttttaggccctaactctcagctaggagcccccaggcacgagagagcagggttccttcctacctgaggtgaacaggactatggccttgaggcagctgtactcggcggagtcgacgtgcagcgcttttagcttctccacttgctcttggaagatccgtatgtggtccataaaggcgaccacccggtcggcg

SEQ ID NO: 46159 - DNA, 839 bp, Bovine  19866880610877
tatgatgttttacactgtaattactaatagtaaggctggatgtatacggtttgaagaagagttaaaaaaaccatttttcaaaagtcataccttcttaataataataacaatcctactaatcacaaactagcaaagttcaactaccatttccacccaagttcaacttaacatttatcatatttcagttcttataaaggattctgtggcaatagctgaacaatgggaaagtttgaagtcagatgcttcctcaagtgtttccaaaataaacagttacaggaagctcactcccctctgccctaaagctcagggtaggggggtggatgagcaggggtgggtctgttactgtactcccgaccggagttggggagccgatcagtgcatggttaagtgtttctgctgcacttttattatgtttgacagtgatgacaatgtagtacgcactgcacaaaatgacaaatgcacacatttcttcctctcgtacacactgtttctatttttctctccagcctcctgagtgaaagccagtcatacaaaaagcatgcagagtgggagttcagattggccagggccaaaattacccacgaattccagatttccagagttgcagagggggagctaactactcaaggcagaaagaacaagaaaggctacatgttcaggagttaatagatgaacagggataggcttggtcacgtggttgcgtttcttttatcacaaaaccaggtccctttcccatgatatgggcagtgctcatggatgaaggtgtcagaaaaaaaataaacaagcatctctaaatagaccgtcgatttacattatacagggcaacactttttttaatg

SEQ ID NO: 46160 - DNA, 1267 bp, Bovine  19866880646388
cacattaacaaagactttgtgagcaggaagaataccagttattcaaccaactttaagaaaacagctgagtgctagcccagcttagcagggtgttaagcatccattaataatggcaaggcaacaaacttgaaggttttgattttagttcagataagcactccagattcgggacttggcttactgtatctctgggtttctcttagggaaaaggtggcctattctgacaggggagcttagctctttgaatgttggaaagcagacattttttatagtactttgtgtaatcattattatgatatgatgcacattaaaattgttatcaatgttgaactttgtaggatagcccagatttcaaatgcttgactctgtttttccccataactatgtttctcaggtcacatgtattgattttttgttcagcaagtaccatcactatagtctaaagcttttattcccatttagaaactgtcttcaaactaattccactctcagtagaaaaaaatcactattctcattcaattttcattgactatcacataatactgtacacacatctgtcccctccactaagctatatgttccttgaaaaatgtggaccccactgtgtatattctatcaacacctctcagtttttggtgcccaacttcatgttactaagaatctgttttgcaaaaaaggaaattatttacctgctaatatgaggacagtttctcatggtttatgggaaatttcatcacctttgaaatggttagtttttctctcatttcacaaaagcagtttgtttttctggtaagtgttgagcgatgactctgtcagtcactctgatgtcattttacacagattttcttattttgtacccacaactcttctgtgaagtaagtgctattattactgctcttttatgcataagaatactgaacacagttcagtgacttttccatgattaagcaggccaagagtctgtggaaagtctattcagagacagattctcaactcttaaaaccagaagttccatttcattgttcttctatgaagaaatctaaaacagaagttttgttttcattgggcttggtttcttatgcctcattttttccccgaagaaaaatgaagtcttttgatagttcgctgaaatgaaaatcccagtgttttctttgtgtcttttcttctgttgatttccaaattctggtccatcagcaagctttgtcatctttcaaaatctgtccagaacctcaccagctctcatcacctccaccgttggcactctgta

SEQ ID NO: 46161 - DNA, 3270 bp, Bovine  19866880659291
ttttgtaagaaattcttcaaaagatgaatgttccagcatctcacatggattgcattctacagtgagaaaataactacattttaagagacgtatagaaatggtaccacacatttctcctaagaatacacaggtattcatgtatgaatatattaaataatacattcagcacatatcccctggcctcctgtggataactgtagattgtgcatgtgtgtgtttgtgcacacatcacacaggcacatgcagtttgggcaatcacaagtccatgatctttgtttttcttactgttcattgtgtcactgattttatgcatgtgctcatttatgttgcttagggggagaaaaagctgtacataaaaacagattatcttttagagcaccccagggttagtttcattttaccctcatctttttatgaagaaaatgataggaaacataaaccggtgcccttaaagcagaaaatgcatgaaatgaaacaagtaaggtttcagaaaatacgcgaaacacgacaggcggacctccagcttagcgggagggcgaggggtaaaatatgcactgtgtacacacagccagtatatcttcagcccttaaaaaagataaaagtgatcttgaaagtgaatgaagttgactctcaaaaagtgggttttagatgttgaatatttaattcactgataaaagggacctgatttcctgcacacgggtgccataaaaaaaaaattaaaaaaaaaagcacatcttaaaagagaagcaatgagcagaaactgacctttctgtgagcaagcagatgagagaaggtatttggctaatcccagctgtctctgattggccagacagcaccgtgttgaaaatgtctccatctgggctaatctgctctcagttggatgagctgaggccttcagagttaacctgacatttaacaataattaccctttcgaatgaccctggcccaatcgtctgctctcttagaaatctctttttttgtgcgtgctcccaaaccccttgacttttgtgttagagatagggaaaaataaaaaagatgagacgatagagcttgtgtgcaaacatccagaagtgtgtggctgtgtgtagttatatacctatacattatatataaagacatataataccatagatgataactagggatctccacctggttacagggcctcatttaatggctctattttactgctctgcattctacagtttagcaatgccttgtaatattaaaaagaaaacacaggaataacaccaccaattaaagtggggcagaatttgtttaccggctcttttatgaaagtccaagttccaatcttgccttgctcaagcccttgtgtgtcccttatcagacactgcgagaaatggtgcatgaaaagaggttcagatagaaaaaccaggttcaggggtcatgaaggctaactgtggatgaaatgtggccatttctttttacctgaggctggcttcatcttttcttagaaaggtcattgtgatgaaacaaacaaacaaaaaaaaaacatctcggaaagaaaatccattttggggttttatttgattaaaaaaataagaaaaagcctttcccagtttagctttgcattttcccagagcatccttaatgaaagccagtataagacaagatggtttctaacactaatatttagtaaggaacttcccacaggctgaagattggaactgaatagccacccacaagtttaagtacttgccctaactttgtcaaagtatcagacctggttggcttggaaaaaaatggtctggacctccaataagcacaatttctttaaaactctatgtttgtgcttctttcgtacactttaaataccaaaagaataattgtttatgaacattccttttcacctccttgataactaacatagaagatacaaaatgtgaaaatatagatagtcacaacacgtgtatgtaaggagccctgtcagtgtatttccttttgagctggtccttcagatgcatagctcagctaataaagaatccgcctgcaatgcaggagacctgcgtttgatccctgggttgggaaggtcccctggagaggggaatggctccccactccaagtattctagcctggagaattccatggtctgtgtagtccatggggtctcaacaagttggacacaactgagcgacttgcactttcactgtctttcaggtatatacaagacaggtggggagagcaggcacccagcttggcctactgcactcttgttccgtgtttacgctccaaggctctcaagcccacttatttataatttggagtattctttccttgaaataaccctcagcccctcctatccctctgcctacctactttaatttcccttcctggatttgtgtgtgagggggtagctcaaatcctaactatgttcaactatcaactaacctcatggggctgttaccatggcctgaacttcatcagaagcctaactaactgaacagagatctcttaggaaacaaatgagtaactcaaagaatgacttggcattcagaattaaacaggatcttgctaggaaagagggaggtcccttaggggagagtaatgcttttcagaaaagatgaatgagttcttagaagactagacagggggtaggatagatagaggagaaggcaatggcaccccactccagtactcttgcctggaaaatcctatggatggacgagcctggtaggctgtagtctatggggtctctgagggtcggacacaactgagcgacttcgctgtcacttttcactttcatgcattggagaaggaaatggcaacccactccagtgttcttgcctggagaatcccagggacgggggagcctggtgggctgctgtctatggggttgcaagagttggacatgactgaagttggacagcagcagcagcaggatagatagaaccagaggttaaattgccaacatctgctggatcatggaaaaagcaagagagtttcagaaaaacatctatttctgctttattgactctgccaaaacctttgtgtggatcacaataaactgtggaaaattctgaaagagatgggaataccagaccacctgacctgtctcttgagaaacctatatgcatgtcaggaagcaacagttagaactggacatagaataacagactggatccaaatagggaaaggagtatgtcaaggctgtacattgtcaccctgcttatttaacttatatgcagagtacatcatgagaaatgctgggctggaagaagcacaagctggaatcaagattgccgggagaa

SEQ ID NO: 46162 - DNA, 1335 bp, Bovine  19866880672519
gctctccctgtgactctgtggtctatcccgggctatttcccccccttcctttctcattcacctactcaaaaccctcaggagctgccctagttcaaattccctctccccatcatactatcagcttgtttggccttaccttcaaggacctgccgcttgccctcctacaactgaggaccagccacgtttgcttggcttgagaaaattagagttggaaaaacagagaagcattttttaagggaagggaagagatgatgaaaaggatgaagaagcagaagacagccatgagcgtgggctgggttttgaacctgggtctatcatggaacctcttcaggcctcctgtttggaaaatgaaaggactacaaaatatactctaagatttctgacaaccctcgctgaactgacaaaccagtgattctagaacagtgaaaaaaatagctgttgctcatgaattgtgtattacagagcaaataacaaccgtgtctagatttcggatatgaccaaattaactttgcaaaactgcctaactaaatcacaaattaaatgagctaagaaatggaaaagttacatgagtacgtgtttttaagacctaaaaatcacacaatagttttaagattcagaatcatttagcaggaatcaatatcgaatatggaaccaaattagcaataattgctacttttaaggaataataattctggtaaccagaaaggatatatgaaattaatactaaaaattactgaggaattatttaattatctgacttatcaagagaatacaaccagatgttagtaaatagaattgaaccttatattactttactcttacgtcagtcaaattggatgtttcggaacaaagaagcaacgttgaatcgatatattgtgtgtatgatacataatgtggacactaattatctgtgctaattaatttaatttattgtgtcctaggttcacagaggtacataaatggcaaaatatttgggaatattatgcaatgaggcaaatgttaaggaaattgagaccctttcatgaactttaaagcaaacatgtcaataagaagatttatgaaataatagctgttatacagaactccacatgctagtgaacagttctcaaatcctttggaaaaaaataatttttacttaaacactgaaaatcctttcaagagcattaagtacaagcacatagtaaaataacttataatcaggactatgtgcctgacactcttctttttttaaagcagtgaattttaattttacagttacatatagtattgcaaaaagtcagacatgacttagtggctgaacaacagcacagtatgtcccatagtcttttttttttt

SEQ ID NO: 46163 - DNA, 1377 bp, Bovine  19866880700548
tatggatgtgagagttggactgcgaagaaagctgagcaccgaacaattgatgcttttgacctgtggtgttggagaacactcttgagactcttggactgcaaggaggtccaacaagtccatcctaaaggagaccagtcctgggtgttcactagaaggactgatgctgaagctgaaactccagtactttggccacctcatgcgaagaattgactcattggaaaagactctgatgctgggagggattgggggcaggaggagaaggggacgacagaggatgagatggctggatggcatcaccgacttgatggacatgagtttgagtgaactccgggagttggtgatggacagggaggcctggtgtgctgcgattcatggggtcccaaagagttgaacatgactgagtgactgaactgaactgaactgaaccaggtcctgggaaaagattgcccaaagctagtctcttatctagcatgtggcctgaggacagaaggagctaagaagcagcagggagaaacattctactttaatataagccacaaggggctttctactttcaagtggtgtttgcccacttgtcagaactaagtagaatataatacaccatattttgctcagatctgatgtttatactcctttaatgttggaaaacctacttataattattatttagtatgcaataaaggaattattctgtgatatgcttataatattctatttaatctgctttttagaatgaatagtgttgctactactcaaatgccactctagtctttgagccaaactgctttctaaaattgagtaaaaaataatgtatccagtaaattccttagataaccaataggcacacactaaagaaaaattcatagttaaaaataacttttctcttagacttttatagttcacagactacctcatttatatcttcccacttgacattaaaattaaatacccccaaaaaattaatgagaagcatagccttgattttgaatgtgtgcagtagtggacagaactctctgatgaaaatgataagaacaaaatgtagacacacaagtacacactgcatttgcaggcgagtgcacatgccagccactcactgcacttccttcctttgacaaggaagtctgtattaaggtcttagtctctacatttgttcagtggggtctatcgcaccttctaccttgtagggtgtctatgtcaatcatctataaaaaatacaagccaagttgtgtccctctccttgcactgaagctttctctgtctccttatggctttccattggtttctgagcaaaaatcgtatccttatgatgacctcaggacttggcatgatctggccctgttactcttgtcagcctcatcccttcttccttcagcccca

SEQ ID NO: 46164 - DNA, 854 bp, Bovine  19866880753715
taatttttacagggtgtctttaatttccctaggattccttcccttgatcttgggaattcaattttgtacatttcctgctcatcacctgaatttccaaagcccatttttctcttcctctatcacattgtatgtgattatcttgttctaattagcaggttgaacctctagaaccgtaagccaagtttgatattgtaaatgggctgaaatacaagacatcatttcctatacaaaatgggatagcaaagctattgtttgaatgaacgtttcctatggaacttatgtattgttctagtttgtgctgtaaattttataatctagagtcaagcatatgatctagggattgaaaagtttttcagaggctcaagtatcctgcctgaggtcttttcacttctttttaacaggtataaataaaggaagacatttttgaggcatgaaacactgtctctaatgctcatttatcctcttatcatctctttcatttcttcctgctcaggattccaaaaaaacaacctctattcctggagttggcagaagatgagaagcagagaaaaatgaaatggaaagattggtcagacggtacttgtctttattatattattttttcctaaaactaattatgttggcttgagaaggaaaagaaaagctaatcaaaccctctgtgaatctttactcagtgtcaagctttgcttagagccaaaatataaggcagggcttaaatgaaaaccctattagttttctttctgttagttacaagttcaaaccttattatgtggtcatttttctagtagattatttccatggaattcattcccattttcaaataaacataaatattcgatttagaagcaataagt

SEQ ID NO: 46165 - DNA, 3255 bp, Bovine  19866880779461
aaataattgtagggatattctcttaggtaacgaaatagactaatcctagatcccattgatttggtctctactacaatagggcactcctgccgatttagaaccgtattcttgacccactgttgcacttaactttgatggactcactgaccctcctggctaatgcaaagactcaaacatctgcatacagtaattttgtgggctgctaaatattcaaacagacctcatggtttctatcaagggagatggcttttacgattttgtgctattagcaaaatgtgcatcctaaaaaattgtcatcgaagaataggtcaaccttcctgctacaatataagagggtttctaagtgagaaatcagctcatgcatttgtaaacctctaaacactaaaaacctttcaagcattctaatcttagacttttttgtcatgactccaagattttggaaaaaaaaacaaaaacctcaaaatgtttgagttctacttttaaaatatggaaggttcttgaagtaaagaaagggaagaaaataaatgcaaggaagacaaacctggttaattttaataaaaaaaaaaatccacagtgtcagaacaccacagtacaaaaaagctcccatgttaagaaatttctttcaaagttgagtgcaactttttttctcaatatgtgaccgtagaggagatggaatgaggaaccgggttttagctcctcaactttctgaagtcacagacctctcatcagcatatagctctgtgtgatgaacacttgctgtgaagaaccagaaatcagtgcaaaaggaaacaataataataaaagggacgctttccaccatcagaaccgggaaaggtgtgtgagctggaagaaagtacagtactgaaacccatgacaagtcatgataaatgggtcgttataaaattcatgtttaggcagcaccaggccggggataatgccattcgtcatggtaacactcggccgctaatgagccctcattgcatattcatgtccgtggcgtttcttctctccctcccaccccgaactagtgcctggaaatatctccacctcaaactgcagctcaggccttcttcttcttcttcttcttctttcttttttttttttttttatttgttatgttgcagcaattacagtgtaaaagtgctgcccaagattgattgctctgatctgtagttcaattgtaaattagaatacacatccccccagggacacacggcccctatttgtgattaagaaaaaagccccataatagactaataggtaaagttctctctcttttactttcaggcaattagcttgatgaaatggcctctttttgtgtaccctggaagtgtaaagcgatatcataatgaagtatatgatgtttattctatgattttcaccttcctgggtatgcaggaatgcataagtaatggctgctttgtctggtgcatttactgattcacaagtgaactatttcttaaagatgcagtgtgtgcattctgaggcttgaggtaagcaaccccctgactttgggctaccctccacagaaagaactctactaaagaggagagaaattcccaggtagtggtgagagcaggactctgatagtcaagagccatctaactgcctgctggctccgaggtggatgaagtggtaacacattggaagcactcagaatcagtgaagaccccgggagagtctggcaaagtgtccagaggtgactttgagtccagtgagcatccaggtggccaaaatgtgtgtttcatctcccgtgcttggttttggaacactagctcagtctacactcctgggttagaggagttaaagctagggttaaagctagccctacaccatgtatttcattatacaaccatctttaagtgaattgcagccccccctcaacaaaaagccttgtcttttcaagttgctaaactgtcataagttgtcaagaaaacattcttcaacttcctacacaggctggctaacaaaggttttgaccagtgagccaatgaatgcagctggtgcatttccaaagctgtttgtgctctccatatgcaatattttaatatctattttatttcattcatgagagtctcaggagtcaaggaagaaacaagtgtcccaactggcaagatagaaagagaaaaaaaggaaaaacagaacaagacaaaaatctatcttggttgaaaatagtttatggtgggttacttaccaagaggttgatttctatttcaattccatattccaacctcctgccactcatcaataacccagtttgtataacccaccaaacacttcctgggcttgtgtagtctgggtcaatccaaccctctcctctttaatgtgaaccttatttgcttttctcaaaaaaatcactcttatagcaaaaagatctcactgacttcttaatgctgaaatggacatgcatgtttagatttgttatattttaaaattaatgtttgcgatagtcttttgttacatataaaatgtgtttgcatttcctccaagttcctggttaaataaaaccttttgggaaagtttattactatatcctgtaaagtgatactaatgttacataattctgaatagtaccacaaaatgagctacacagaaatatttcagaaaaatttacttgataacccttcttgctaaaaatctaaagttcatatcagtccttatttgggggtttttgccttaatttttataatattgaactctgtgtaaaatatagacctgaaatataataaatgcatattttcattgctccttgaaatgtttgactgtgtagctgccacatcggtgctgtgtttggaaatatactattgtaaacttccaacctagacagcatattaaaaagcagagacattactttgccaacaaaggtccatctagtcaaggctatggtttttccagtggtcatgtatggatgtgagaattggactgtgaaaaaagcttagcgcagaagaattgatgcttttgaagtgtggtgttggagaagactcttgagagtcccttggactgcaaggagatccaaccagtccattctaaaggagatcagttctgggtgttcattggaaggactgatgctaaagctgaaactccaatactctggccacctcatgtgaagagttgactcattggaaaagactctgatgctgggaggaattgggggcaggaggagaaggggatgacagaggatgagatggctggatggcatcaccgactcgatggacatgagtttgagtaaactccgggagtggtaggacagggagg

SEQ ID NO: 46166 - DNA, 954 bp, Bovine  19866880795285
actggggaggtgacaaagtcggagaagcttatagatctgacaaggagagcaatgctttgtctgtaaggccacaacacatttatgaagacacattctttgccatgaagtcccacagaaacctggaaatgcatgtctttattatgatgtgtttgtatttcagttttgaaattcaggggcagttgctcaaaaaagaaaaggaaagatgtgaccgaagtgattgcacattcaacccagacaggtttcttgtcaagagcttaagtttatcaagataaacttctgtctctcttagagatgaaaagtatttgggagagaagaggatgtacagagttcttgaataaagcttattgtttccagctgctgctgcttatatacttcagtcacgtccaactctgtgcgaccctatggactctagttcaccaggttcctctgtccatgggattctctaggcaagagtactggagtaggtaaacatgccctcctccaggggatcttccctccccagggatcaaaccctagtctcccatactgcaggcagattctttaccaattgtttccagtgacatagaatttacagaaatgtaaaagaaacttattaactattgactgaaatgtttatgtaaaaggacattgtatttcaaagaatttctaagatacaagaaataaaaaagattaatttgatcaccaaagcaataattttggagcaaattttaaataaaggcatagtaaaaaagcagatatatgataatttttcatagacaatacaatttttaagcgagagtagaaatatgatgagactaaaattgccggacaaaacttttttcttccctcttaatagaccctgaatcaaagggtgaaaggctgaactgaagtacataggaataaaactaataataactgagtgtgactgtgaaataaagggaccctgagaaatgagaagacacaaacatccagaat

SEQ ID NO: 46167 - DNA, 2594 bp, Bovine  19866880855610
ttctgggtattcatcggaaggactgatgctgaaactgaaactccaatactttggccacctcatgtgaagagttgactcattggaaaagaccctgatgctgggagggattgggggcaggaggagaaggggacaacagaggatgagatggctggatggcatcatcgacttgatggacatgagtctgagtgaactctgggagttggtgatggacagggaggcctggcgtgctgggattcatcaggtcgcaaagagtcggacacgactgagcaactgaactgaactgaactggagacattttaacctgtcaaactggatgagggcatctagtgagtaggagccagagatattgccaaatatcctgaaaggtacaggacaacccccatgacaaagaatcattcagcttaaaatgttaatagtgcccaggttgagaaatctgagttaggatgactgcagactttttcagtgaaatctagacattttgaaagagaaagacagccctctttatgcatccagacaaaactacaattcaaaatgatacattctcctctgtactcatagcagtaccattcgtaatagccaagacatggaaacaaccgaaatgtccatcaacagatgagtggataaagatgaggtgatatacacagtggaccactactcagccatagaaagagtgaaataatgctgactgctgcaacagggatgaacctagagatgatcatactaactgaagtaagtcagaaagagaaaaacaaataccatacgctgcctcttatatgtgaatctaaaatacaacacaaatggacttttctacaaagcggaaacaggctcacagacttagaaaaaacagacttatgcttgccaagggggagaggggtaggagagagatgaattgggagtttgggattagtagatgcaaactattacatatagaaatggataaacaacacggtcctactacagagcccaggaagctatagtcaataccctgtgataaaccataatggaaaagagtgaaaaagaaggtatatatatgtgtgtgtgtacataacacaccacatatatatgtgtataacagagtcactttgttatacagcagaaattaactcagcattattaatcaaccatacttcaataaaataaatttaaaacaattttaaaaagaaagatagcccttttagcatttaagtttagatagcaggtataaagcgggactagctttgcaggtatacaagatctatggtcctctatgctgagcttgttttcttttagaatgatgagatattttttgtaggtataattttaatgtactttcttattttcctacggtctttttcaccaattagattcttagctacccaaagataggaggttgtaacctctatattttcctctctctgtctaggactttatacaaagcacttacttgataaaccttcttgactaactgtgcttatttataatctgtgttcacaacattgtccttgagaaaacctactataaacttttcaacattcaattagattacacatcaaaaatgtgggcaaaatgatggagaagaattcaacaagtaccattgctcataatgtagagaagattctaccttctatgatatgtaatttaatgaaatatgctaagcaaggtacaaaccctttaattggtactcagttaaattactcatgtttactgtaaatgttcttactgcacaaaatgtgcttctatcgaattagataaaattttattttgaaagcatggttatacatgtaaaatgaacaaaatagatttgatcccagaatcctaccctggatgtagtagatgtataataagcattagttctctttgtatttcctttacatagaagagcttaaaaataatttaaagccattaaaatttattttgtagtttttgaaatattgattccaggggatatttaaagttaatgaaatggttaaaattaattgatatactagttttctagggctcggtaaccaagtaccaaaggctaagtggcttaaatagtagaaatttattgtctcatagttctggagactgaaagttcaaaatcaaggtgctggcagctttagttctcttccaggcccctctccttggccatatggatacatctttctccctcttcccttcttccctctatgtggatctctgtatccaaatttcctctttgtacaaggacagcagtcacactggattatgccccaccctgatgacctcatcttcacttgattacctctgcaaataaagaccctgtccccatattaggtcccattgggaggtactgggcattagaacttttaacgtattcctttagggggatacaactgataattaagaaaatgccataaagagattctaatctaaatttaaattttggagaaagaaaagttttatcatttgctttaaagggaaaattagagtcaatacaatttggaaatataagatgagcttcatgttactgtagaccactgtatcgtaggagagtagtttatctttcggagaaggcaatggcagcccactccagtacttttgcctggaaaatcccatggacggaggagcctggtgtgctgcagtccatggggttg

SEQ ID NO: 46168 - DNA, 1355 bp, Bovine  19866880912256
cgcaagagggttggatacgactgagcaactaaacgacaaacaaaaacaaaaatcctggtttctaccaccctttgacttcttggttatgtttatacctataataaaattaggagaatgatgtttttggcttctcacatcgctccttggaaaacttctacactgataaaactcaataatatagcccagtcctgggggtttgtctttagtagtttctccaattgaagtgggcagggagctaattttctttcagctggaatcaattttttctactcaagtccattcactagaattaatcgtttcggaagaagctcaattttgctggaaaatccagaaaagattttagttacagctccacataataaagcaattgtgtaattaataatacatttgtcactcctttagagagtgggaaaaaaagtaacacatgtatggctttagtgtaaatcctgacagtggagatttttttttccagggaattatactattataccataaaaatgtcaaggtgcaagtttactgttcctactaatattctaaaatattctcttcagctgacatctctgtcaattaaaattaaacaaaattgcattctgccatccacacttcaaggaggaagctttcagttttatggctgttctttgaattgatttttaagatggcatctgtaaaacttgtctgaaacaagatgaggtgggatgaatctaaggaccagtcaatgtaaaaaatgtttttaaagatcgtgaattgacagccagaatagactgcacatgtctccaggtttctcaactattaaaatacatccagcaattcttttgaatggaatgtttgtcctgatataattcagtgccaacatgcttctggcttgttttgggtttccaatatttttacagagagtaacataaacaaggaagctggtgagtgttgcttccagttactcaatttgcacagatttgggaagagtcctcctcctggtgtttcccacagagcagcactgtgaacgtgctttctcacgggactgtggttctctgggaggacaggcaagagccatgtggacagtggatgcttttggcaggatgaggctgccaataaaatcttcagggagatcatcctctgtgataggaagaggagcaaaataaaattacaattcccctaaaagaaattgaagaagccatctttgggcttagccctctgattgccaaactttaatgcgaaatgttttatgagtgcatttaaggcaagtattatttaatgatccagagtttcttagggccaaagtacccccttcattcttggttaagcaccttttggaagctcagtgttccttttcaggtcacctggttaccacttaagggaaa

SEQ ID NO: 46169 - DNA, 643 bp, Bovine  19866880915786
atgcctctctctaaaagcatttaataaatgtctattaaagcgctacaaatgtaagatgaatttagtggcgcggctgcctccctgaatctgaacggtaatgatggatttatcaacggggattcgccttcaactcagcaagggaggtttactcagcaaatacgtctgcgagcacccacccaaatacaatcatttgaccccctgcgggcattagccacctcacctcttccgcagcctgcttggggcggggatggcaggggggcggttagggtcgcccggggccagcgccaccggaggaccagaggggcaccgcccctctcctggccttttgcctctcctctgggccttcgggtctctgtctcaccttttggacgagtgggggacccggcttgcaggtttgggcatggggagtggatgatggcagtgttagagcacacgatgaactgtgggctgtcttggttttgccaggtgacatcaatgagcggcctttcgctcctcagttttgaagagagagcaattgttcctgcgattaggttctcgagtacccagctgtcaagcacatcttaggtcctcggatcctcgctgggccctgggcaccattctaggagaggcggctccaggacagaggcctgggctgccaggtcct

SEQ ID NO: 46170 - DNA, 1142 bp, Bovine  19866880935559
aaatatgcaaagctgacataaataccaaattaaacccagccaggtataacactttggtcacttggatgtgaggcagataccaattccagggaacaagagcctgttgatttgtaagaaaaacccggtcttaccctctttgtttgctgcccattagttttgcatctgggggtcactctgctccttcctgctgagacaaaacctaataaaaatgattctgctgtgttctctgccagcgcctccatgctacagctcatgtgttgttggtacggtacattggactaataatgtagtgtgtttttatgaaggaatgaagggccttgagtgcgactgacataggtgttttgggattttaaagccatttctaaataaaggaggctgggtgttctccaggaaggcctgggctctgggataactgtgtaatcaacactcgggagagtgggatgattttcaattcaacccaatataggaaaggggatcagcaaatgtgaagaagccaaacaaaacccatatattttgtatttattttcacctgtttttatatatgaagagtattgagggaactcagaagctagggacttgaaagaggaaaagagaaaacaattttgaatactgtccataatttatgctagaaagtattaataccagtgtaccaaccatcagtgtgaaagaccagcatttttgtttgctgaatacatccttttgcttaatgagtaatgaatgtaggagtttccaggaccaatagcttaatagctccaatgttgtcatcctgcattgttctaattaaggattatacattttgacagatataatctgtaatgtatttaattacgcaaacacagtctatcaaactcaataagttggaggttggattcaagactttttctttgaggtttttgttgtggggtgctgactctttctataaccacagttggtgtgataccaaggcctgttaatgtaaaatagcccttttgaaaaatactgttgaaaaaattgctctttggtcttccatactagaaatggctcaagacaatgattttcttttgaagtcaactttgttctttgccagcagggaacaacataaggatgatactggattctttcttcaggcagaaaccatttgactacatgatggaggacgaaag

SEQ ID NO: 46171 - DNA, 1449 bp, Bovine  19866880950612
tttggtcaccttgaggaagaaaattttcatttcgacgttgtcaatccctcagctctcacatgcagtaactcgccaccaaaggccagagtattctctttcttttctttcctctccttccacaaacccagctattatttagtctctagcaaagctgcacaaaccaactgttcctcctcagattattcctttcaaggctcaagtgatatgcctccttgggttacaccttccaggttttgtggtcagatggggctgtcagtctccagtattccaccttgcaagaaaatatttatatatgagtctcaccaggtcccatttcctctgggaatggtcctgcatgccgtgccttcatgctagtggtgacagttggatcgctggttttcatgggaccactggacagctggcgggaaaaccaggaaactgccttcccctctgtgacttcactcagcctgaaaactacaaggtgtgtgactgtgagctggaaagtttctgagcggttatatgcaacactttgagaaaacacttggaaggaaactcactgatgctgaagcaatggaaacttgtaccattcacagaatatttattttcctagatctggaaacaccagagcttgcttgtacagagtcttttcattattattttgttactggtaaatagtaattcccgttattcaccaaagggtcgtgaaactgacacttctatatggctgagaggggggtacatttgcaaaacccttttggaacctcaattgaccacatgtgtcaagagccactggcttttttttaacaacgcttgactaaataattttacttctaggagtctgttctcagaattaaaaagataatgcttgaagatgttcatcaaactattgcttacaatagttagaacctaatataaacctaccaatatggaaaatggaagtataaaatattttctttatatttactgttatgcagctgatataataacattgaaataggatatgcattcttaatgattacaaatatgtaggcaaaatatccacagttataaagtagatgaaatttattgtctgcttaatatatgataggcaatgtggcacatgctttatagtcgtgtttcctttaatctgttcatcagattaagccaaatttattatagctccaatttacagaggaggaaagagagtcataggaattggtttatctaaagtaatacttctggagtgaaatttgaaccccatcctagttggcaacagaccttctacaacatacaattccttgtgctatgtgattaatttcaagtaaaaaacaagcattagccaccaaaaatagagaaaaaaacaccccaaatcaaaaacaacccaacaccaataaataaaaatctgacgagccctaatcttaatggtaaccacagaaaaagtaagtaggaaaacttaaaccaagagaaaacattcaaactgaaaagattcat

SEQ ID NO: 46172 - DNA, 805 bp, Bovine  19866880954775
taaagaatagaattttgtctttgtctggaaaccactgtattactgtggttattaaacaagccggcttcccttcttagtgtcaaggcaaggagagagggataaagagaaagggtgagcagacaattcattttcaaataatacaaattaaaagtaaatgtgttttaaaaaaattaaacctgactgataaaggcagatgtgagatggcagtaagagagaaatgggaggaaaaaacacagaaaagagtctgaatttttaaaaaagatcaatctgtgcagagtaatcaggaaaaacagcctgggatggaaaaaaataactgccatttcctatggggtagctccatgaccttaggaaaaatggagaagcagctctaccttggggtggtagttttacactttgattttagcaacaagtatcaaaatatctgaactaattgattgtcgagttccttggcccttctccaaacagcaatatagatttaattgtatgttgtttaaaactccatttctcgaacagtgtgaaacatgtaataaaagtcataaaccgtatcggagattcccccccacctccagtagcataaatacccgactgacacttggaaatcttagctaatacttttaataggctaaaaaaaaaaaaaaaaaaaaaggcatctgagaagggtagccacataataaaatctaaactgttaatccattttaactcattcaaaaagaacctgtggtttttgcagaggaggggtcggggtgaggagaccccacgtcagagatctgatttgttcgaactcggttcagctaaaccacactcc

SEQ ID NO: 46173 - DNA, 1164 bp, Bovine  19866880992602
gcataatgaatgtaaaaacactgaagccgagattcaggtagaattttgtgagaagcaaaggagggccgggaaaaactgagcagagagggtaaggacgagttagaaaaatcatttactagcagagaaagagaatataacttctcatttcattctatgcattttttattacataatttattttgtgtcttgataatgtggagttgtttttattgtcaaaaacttttttattgtgaaatgatctgagagtaatagaagaattcaaagatagtgcagagaattcctgtacaacttccagtttgccataatgctaacctatgatcctaagaaattaactacaattaagtacaataatattaacggaagtcaagaccgtcagatttcaccagtttttctttgaatgctctttcaatttctgtcccaggctccaatccaggatccagaattgcctttaatctctaacttcccaaatcttccgtagctagcttcagaacacagggcgttcacataccatctctccagtccatctgaagtcaacaagtttgggatgggagccccgaagcgccagttccaggcccgaatcagtcattaatgaaacactaggactgtcaagtggatggtcggggggctcaaacctgaaagcgtcctgctaatgatggagaaatattctccagtgagatcggttattcattcatccatcacccagaaaatttttcctgagcagcagccacacctgagacacagggctgcacagcccatgagtcccattcatcgcttgccagcagttctaatcctgtaaagctgatcattaagtatttatcgaatgcctaccatgggccctatgacacgcattatgaactttccattagcctgtactccatgaatattccattacaggcctgaaagggttaaggtgccgcaatgcctccccggggcctggggagtcccgcaccactcagggaaggttgcagacgcattaggatccaagtatgtattttcttttcccctctgtttatgtctctgttttctgtaaagtctcctaaactgcagccgtatctcccaacgtctctgacaatgctataaatttcattaagaagatgaagcctgtggggcaattaactccaaaagcggtacaaagcaatagcgaggacatcctggcctgtagta

SEQ ID NO: 46174 - DNA, 1528 bp, Bovine  19866880993569
gtcagactaactctagccaacttgggactgaaaaagcctggcagatggattttcggtcaccactccgtgaagctggttgacagagctccacagaatccttctggagggaggcaggcttttaacttgattgatgaaattatatctaaatctcgtagatttggaacttcaaaggcatttttccctacttagggcatcctggatgaagggcgtatgctatttgtaccaaactcccaggctcaagtggtttgcaaattgacccctttgtaataggttaaaggtttcttgctagataacggtggttcattttgattaattatgtcagggaattaatgtatgattactaacttttagcagaccctgctccttctgaccccgagctgcttgtttgtgtggctggttgtaattttcgaccgatgggttaggaggggtcactgcgtggtcagcatattttaaacaaagggagaaaaagagaagcagaagcttccaaatggagtggacactgcagttcaaggccttgacagaggagatctgttaagtgttttaacagtaggcttttctatatttactcttgctaataaaagagggttcgctggagtggagagtaacctgggaagagtcggagaacaatttaacagttaaatgttcacccataaatttcactttgtactggtttcaatggcctaggaccttgttaaagattaaatggcaaagtgtggcgtttcagcttttgatagatccagagaatccaaatgaagggatcttgttaataatgaggttttccagtagatggtgtgtagtttcaacagtttttctcagacgaagaattgcatatttagaataaaggtaacagagagtaagctgatgatgcctcatgtcaagttaattttacaccagttatttttgtcatttatgggatgacattcctcctatatggaaggattctgtgctttggcatgaactaggaacatcatggctcatgtttcactctacacggtcagttcaaaattcccaatgaccacaaaactagactggttttctcgatatttttgactcctggaaagttaaatgcatttaccacaagaattaggtcttcagggttttgagaaagacactacggatctattctaaaaatgaggactctcttcctgaaaccttgaggtgtactctctacaaatgcctatagatgtcatgttgtcagttgtcttccaactgtgatcttggtgaaatagagttattaggccaagaagaagaaaggcaggccaaggaagaagaggagagctttatggggaaagcagaagagcccacggagaaatgatgaaggaaatgcaaggaagcacaattacaaagagggttgaacacagcattagggtgaaggagggccagattgtctggttttggagcaaatctgtatgttaaagaacttgaaagcagagattaaaaataaaattcagaaagaaagagaaattgttatacatggaaggtgttacttagatactgtattaaacatttaaacattataaaacaccct

SEQ ID NO: 46175 - DNA, 1347 bp, Bovine  19866881011930
ccagtgaataaagaatgagcttccccaaactccattttggagtgtgactttgccaaaagtcactcattcattcactcattcacgcaggcgtggtgctgggaggtggcaatggaaaggtcagcaagacagatgctttgttgcctttggagggggagggcagcatgagagctcaagcaagcgcaataagcaatggatgctgaatcggattcatggcactggacaaaacctaactggaagataatgtgacggccaaatgagagaggaaagggtggactcggatacaagtgccaaaccaggcgtttctggggaggggatatttaaagtgaaatcagaagggtgcaaatgcaccagcagagccacgtgaaaggaagaacattccaggtagaggggacagcaagggataagccctgaggaggagacaggcttgattcatcttagaaatagaaaaagggccagcagggcttgaccctgtgagagcaaagtgggtttgaaaggttgctgttcaagctgaaaaaataaactaggtgggacatggaggagtgctgttcccctctttcttgttctgggtggtgagttatacttagaaaaatggaggggatgttctggctcattctttttatgcttcatctctacacaaacttttcttttttggccacttgttatttttataatttttaaaaatgtaaaaaaggatagatgccacagatgctgcatattataaagggagctggacatggtgggaatgggttagtttgaagacaaactggcctagatctgaatacctcttcagccacgtgctaatctgagtttttagttaacatatttaatctccctgggcctccctctcctcttcttgaaaacagattcaagacttagatggcaaggtgagtaatatagtgtctctgagtatctcttgatttggaagaagcacatgcattgttcagcttgccctgaacacaggtctagatgacgatgtttaccatattgaagaaccttctagcaaatgcctagggcccactggaatgatcaaattcactaaaatgtatgtttgacatgacagtgtggaaagtatttgtttcaataataggaaactaaaataaaacagaaatggatgaaaagctgtttgtaacggatagaaccttccgtccaggattgaggtacacgattacaaaagacattgacttcctactgggatgtttctcaggcgaccctgggtagagttctatcaatgctttgacagacataaattctgaaattgattatgtcacttttctctgaaatatgtgaccagggatactgatctattttctctttttaaagcatagatggtgactcaatgtgtcatgt

SEQ ID NO: 46176 - DNA, 1571 bp, Bovine  19866881029548
cctattggacaaagctgtttaacttggtctctgttttccagaacacagaagacaagaacattagcgtgtttgtatggctttcatgttcatagacgggatttcttgttttcctgtgtctaacctctgaaactctgttcacactctactctaagacttgagacacatttgaatccagaaaatattgatttcatcactgccatgttgttgaaatcataaaacgacataatcagagtgcagaaagccaaattttataaacaccctaacgtatggcacatgactaagtgataaatcttgacacgtttaccaaacaaagtgaaaatcttcatttgtcttcagaaagagaagcgctcccatgtgttcggacatctgtacagtcaacatgtggcaattactgtgcgaaaaataggatcactgtaactgctgttgtaaattacggcctcattgattagtatcttccctctccgactccccacttcatcacaaataaggagacacacacactcgtggcctctgaagagattttccccaaactgatttaaatttaaatttagatttgctcccaataggctctcctacagcattacacattctctgctttttgcttaaggatatctggagtatttctcacacaccgttagtgcatgtttacttaagcactaaaattaaatacacataatgaagacatctgtggcaaacagaattaataagtggaataccatattgctgtgaagatgtatattcaacaagcacgggacgcacaccgttctctctggaacttggcattcctcatgtgttgctgagaatttttgaatgggtcccaagtgattttggtgtctagggattgcttactgaggctggaaacctccccaagaagctcatctcgttaaagcgtttccagttcctcgtacaagacttttggatcgtgaaactgtaatgtgatacaaacatgttatgatgtttgggaaattgatcaaatgaggatgagaaaatgccaattgttacttactctgaaaaagattcttcttagagttccattttaatgtgttttccctccacattaactagacctaatatagggttgattatttttcaggatatctctgaggtcatattcccaaattgccccactacatctatcagagttgcttggaaaagtaaagaaataaagtacaaagcaatcatccatgagctgtacctagattctacataaatatatgaaggattgattatttatgccatttctctcaagcctgtgtttgtctttatttcacaagcaaatttcatataatgctggagatgctacaaagcctgaatgaggtagagaaatggcatttagcctttgaacctgttgcagggggaaattaaactgaagctcagattcatttcctttatgccgcccctagaaaaaagagggtaccagctgatatgtgtatagtaatgcatctggccttaggaagtgaggatggttctgctgaagggaatacatcatacagaagggctctggataaacaaactcggtcttaaccagagctttcttcatgctgtcctagcagtatggctccaccagaagg

SEQ ID NO: 46177 - DNA, 618 bp, Bovine  19866881093092
ttactgtaaaattgcatttacagttgtagtttatttttaaatagttcttgagttagtgaaataccctgtgcactcaaggatttcaatgaagctcctgaccaatcagaactcattcactgttacactggaaaatgaaagaaagaaatcttatgcccatcttgaaaatgatagaaagtactaggactgagacaaaggaattttccattaaagatcagctagttctctagttctacacgacacaaagctgaagagtaaacattttctatcttagcacatgtagctaaatgagattacacaagtttgtaggtgcctggaatttcagttttgttccctataatgatcaaatgaaataaaaacacttgttttatacttcatttgtagagaggtacaaacatatttttttaaaaatcaactgaaagcagaagaagttaggaaggggaggcagggctcatatacttcataataccaacacaaaccctccaaagagtgtgaacagattgcatgctgttaggtctataatatttttaagttatatatattaataacacctagtactctacttacagggggtattcccaggtggcccagttggtaaagaacctgcctgccaatacagga

SEQ ID NO: 46178 - DNA, 1281 bp, Bovine  19866881219920
cgaggtcctgtgagtgtgatgatttgctccctgcttcatgagtagagctgattttaagtgcggctaaaattattccaaaggacagaatattaatcaaatcaatcagagctgacaaatgagaaatatttgaaagtcaggggtaatttacaactttgttattagttaagaatcgcctgccttgtaacagtaattaataacacttaggaatgatttggaaatccccctcccatgctctttattttcctctgtctcttaaggaaggaaagagaaaaaggaagcaaatgagtgatcactagaaacaggaaaaacactgaatcgtttgtggggagaacaaaactggataatataaaagaaaaggaaaaaaaagattagccccatgggaggccatcaggaaataaagaaaatacaggaggagggatagtaaatcagaaaatgaattctgtaaccataccccatgagcaggctggctaaaggttgaatttcaaatggcccagaaaccccatcaaaatgaacagtgctgctaaaaaatcttgaaagtagctcagctctgaatcaaggcagagctcagggcattgtctgttttgttgttgttaacaatgtatttctttatagcccaggagcagacgtgtgcaggctctttcccaaattctatccctggagacccgactggctttcatgtttctgatgttaactctcctcttggtcattggcaatcccctccccccatcttaggttgattattagattgtctcaaccccacctaaacaacacaccaaaataatgacttgttgaaaaactataaatcatttcagtgtctgagcttggaaaaccacttcagtcaacaggcttgctgcgagaaggtaaagaaatccccaaccttctgctgaggaaaagctgctacttccctgaagttttatttgttagatggggggaatttttcaggctggtttaaaaaaaaaaaaaaatggagaggggggaggaaaaaaaaattttttggtaaactttatctggtctttattataagccccagtgttgtctcattgagctcaggctgggtctacacaaggtagctagagattgagatttattggtctctaaatgaaaagattcatttgatataagaggttaactcaaagttcctatactctgactagcttcagcaaatgtctctgtcgagtcagcacaaaagcagttcaaagaaatctgaaaaacacacacagatacagacacacaaacacacttgcccacttaagccgcaaatgcaattctcttttctttgtt

SEQ ID NO: 46179 - DNA, 1802 bp, Bovine  19866881300984
ctccaggcaagaacactggagtgttgccatttccttctcccaatgaaggaaaggaaggtttccttcctttagcaaactgtctaagaaatatgaattccctggtggctcagatggtaaagcgtctgcctacaatgcaggagaccggggttcaatccctgggttgggaagatctactggagaaggaaatagcaacccactcccaggattcttgcctggaaaatccccatggatggagaagcctggtaggctacagtccatggggtggcaaagaattggacacgactgagtgatttagtaaattactttcttttaatccaaaatcaattaagttgatttaaagctgagcttaggcctttttcagaactagtttatttccactttctctttaacactagaaattgtatattctgagttcccaactcagaaccctggctgtttatgacagcccctagactttatgggctctgaactccaatattgtcaaactgggtacaaaggactgcggcaagtattgctcagtctttcagattctcagttgctcagtggacactttctgcagtgcatatcaattggtcttgggaataaaaaattgcctcaaggagaaaaatgatgtcaaatgagaggttaatttctctgtgcttcccttgtctctggaatcttggcttccttatctttgttgcctaagtagcacttggatacttagattggatgtgtgatatacgtgtgtctgtggctcatataattgttatacatatttatatataatgccatttgtgtatctatatctatacctatatctatatatcttccagatttttgaactgttttcatcaagagttagcctgctataccatctttccttatatccaggagcatattctggatctttctaatcaacaccattgataccatgttttcattgacaattttaaaataaaaacttggttttatctaaaataaatgaacagatgggatatgataaataatgtagtacactcagaaattatattacgtgatttgttggcactctaatatttaaacttaatttctactttaaatttgtggattatggctctgaaaggtaataacgttcagatgttatatcccttgttataggacacttctagcaaaattctgggaaattgtacttccaatgataatattaatgagtagtaattattaatattaaggaggcatcaacagttttctaagtactttacacatttaattcaaccttttatcattaaaacactataatagaattgtaagatgcatttcacagagaaagacaggtagagtattcccagtgttatttaccatatggtgaggagacgtgattcacattcaagttgttcagtttttgaacacaaattcttcacctaaagttaaagaaatcattgacttggtatatgggcagtccttttctcttatatgggagctctatatttttcttttgacgtcagttaaaaatctaagttttaatttcatttcatagctaaccaagtgatatatacctattctaattttgtatgtctactgataatttttaaattttgccccaaaagaacacttcagaactatttctttcgaaaatgtaatttccaaagtgagaaatattagcaaggataatttcttagatgtttgaaaaataatctatttttagaaataattgtctgatttatagtgtacctgacaattaacttatactctattaagctggaaaataagtaggtattagttttgcaatttcatagcacatctatggatttattagtgctactattttaaaatagcctttgcta

SEQ ID NO: 46180 - DNA, 1611 bp, Bovine  19866881308128
atggaagatttagtatcctttcgcacactttaagtctgagaaacttctccttatggcttctgatgagtcctggagactgggaaagaaatcaagttgcttgagattggcggcaaagattcatattaagccgctcccatttgcagcagagacgctggtggcactttgcaaatattgtcaccattgacccgcagaggtggtacatctccacctctgagcaccgctttcatgtcagcaaatgagctgttttcaatccctgttccacatttttttttctgctattttgtcaggttccaagctgagactgtcaacattactataacttgtgatctcgcacagccatcagttgaaaacaatttccatgcacatttattcaggccaagccacaagcaggaggtcccaaggtggcaggttcttgcattactctaatccagttaccactgagttaaaatgctttcattacagtttcaaacccccgggagaaagtaggtatgacaagctgggctctgcttattatgttttaaaccaagattgactccaagaaatagtagcaagactgagctagtatatttttacctacttcccttcttctgtctttcgtggttcatgttttgaatgcttcttaatttgaactctcttcaagatcattgggcccaccttgctggagatttggagaacagaaatacaagcaataattataaatacattacttatttctgcaaagtccttcggaaaccttagatgtcttgggcaggctttaacctgcccctcaccccctctgctcaactcaaatattttgaaactgtctaaacttattcaccgaagcagtggtgaattattaaaaactaactactttcttaactacttccttaatcattacagatgaacactctaaatcaaatatttaaggtataatttgatgtaaagcaacttatttattcaattaatatttatgaaacagctacttaaatgtaagtactgtgctaaacctgatacctcaaaggaggagatgtgaccatcataccaaacttttctgggtttacaatcttcgtgggcaaactggacagataagcatttaatgcttataatttaagacatgtgctataacaggagaaggaaagaagctgggaagtaaaatctcaaggtgccttcatagatccacctcagagaaaagctatgaaggcttcctgcaggaaataacacctatgatatccctaaagggatacaatatgtgttagaggaagatcggaccactttcatgtgacagaatcagcaatgcttaacagagaaagactaggaaggattttgaaagagaaaacaagctaaagtaaacttcagcttatcaaatgcacattcctgcaacttcatatgcattggctgctaatgatgtccattttcaagtatctgaagcttatatcatttaagggtccaaactttattactctattttcgcttcagccaaagacctctctcttaaaggcgtcacctcattctttgcctttccaatcaggaaagccccaataacttctgtacttgcctagtgaaagaaatgagaaattattatgaaagtgacttctcttcccatccagtttttaagatctttgaaatttctgg

SEQ ID NO: 46181 - DNA, 809 bp, Bovine  19866881328798
tataatattttagatgatatgaaatccactgtaatacagaagcaacttaagactcagagaacaatgcagaatgcagtgcactaaagagacaggggtcttgaagaaaaatcagcttaaggcatgaacctccaggttttgaaatatcagaaagatttacccatgcctgaaagccacagaaatgctttggtgacatgaatgttttcagatgtgactaactttgtaaatattatgattctaagtgagattaagaaaaatagaagtgtccagttaactagaaatacaattcttttaaaatttacaacaaaaaatgaatgatgacagactgtcctttaagatattaaattcaaagggatcttaagtttatttcatagttcaaggaaaacagagctcttctaagctgaagtttcataatttttctttaccaatgagcatgtatacactgtcagctatactttcgtaacttctctcccaaaatcttcaaacagccatatctttctgtttttactgcacagacaattatgcaaacttggctaaatgactctcctcaaaaatagaatctatttggagagaagactttatggaaaggcaaatggaatatctagtattattgcattagaactactgcagtcaaactctacatttaaactaatttctaagtcatcataggctttatcgtcaggtgaaataatgtattgcctgtctcttgtctctttttttcctttcttccccatttccacctctttctcagaaattccatattgtccacactcactccttcagacacacacacatgccattccacatacata

SEQ ID NO: 46182 - DNA, 1576 bp, Bovine  19866881333513
tattgctatcgttactgttatcattgtcattatcccagtggtcagtcttgttcagtccaactgccttggctgctcttcctgaggacctctgtatgtcactcactgcgctgggtgatgaggaatcctcagcaccggaggtctggctgagaagagacacttgaggcatgtttcagtgcaatgtggtaagggctacaaatgggatattcccagtgtctcctggggccccagggcagaggccccataggagattgcagggtgggaaagagggcaggtttcctacagaagttaatggccccagtcatcacacacctctgcttcacagtgggaagtgatttcggagccccctcacacccccgtcctgcccccaggagaggttcctcagcctgagtacactcctgacactgctccagcagttcatctgagcgttttgagcaatgcataacttgcatcattctgggccatggaccaagccagcagaggagaagccaagacagctcagggctgccggcacattccgtaaacccaaatttccagagctgccttgaacagggtgtgtaaaggaacattttccatgtgtcaattaagcctactgaccacgttacacagagaggaaatgtaaatacgggactctgattggcactgttcagagcctttgatttccatacccggagatagatctgcaggcgatgaagagtacttgacttccaaactccagagtttggatgcctgctttgcacatcacaagggaaaaaagtacagccgtgaagagcagtcttgggaaaattctctgcttggttcccacagtaaaaggtacattcaatgagatcaagaatcaacgcggctgttctgcttacctatcatttcaaatttcccaatagacgtcccattttcgaataaaatgatgtgggttttttaccacatttcctccttagaagcacagaactgacatgaaattgggatactaaaccttgactttaaattgcttctcatctcatgccactggaaacttagcataaaactctggaccctgtgtttccttggaaagtctgtgttctgttgctggcaccatgattgaacccactcgtctattccaagactctagagtatctcactgagtcagaacaccccgtgtctcgcccatatatctatttattaccacactcactgggaaagacaagctgagttatcctttaacagagaaaacctgagcggcatttatgagtataaagtactgcatcaccgtcaacacagagccaggctgagaggaaagccgtcacatggtccacgccaatcccctcagtgtggcagccactgagccgaaggagtggcccaaggctctcgaaggcttatcttctccccagcccccagccctaccctcaccgattacaaatacaattgcttgtgacagattgcccccccatcttccgccttgaattctatatgataaattcaacacgaagtgacagtcacagcaagtgttcagggccgtatctaaaaacactcattttactggagttaggactcaatgaatgagaaaatgtgaatgtacacctagggcatatctcaacactttaat

SEQ ID NO: 46183 - DNA, 633 bp, Bovine  19866881346929
ctcgggtggaaatccagcgggaacccgggcttctccaacccggtggaaagagctggcaaggtcacccattcagtcaccaggtggtgcatttaatttaaaaggagtgttaaccttgtttatacaaaataacaccaatatgccgagaagcagtaaatctattgtcgttaaacagcggggagcccctggcgctggcagcctgcccacccgcgacgtgaacccggctggcaccaggcggcgagcgcgcgggccaaggccggcgctgcgagcccgcccgcctccccggagaaggccggagcggcgccctttccgccctccagatgactctttgcattcttgtcaaatatatttagaacaagaggtgtccacttaaagggaaacatttgttaatcacttaaatgcaggcgcttggcagccctccagtttcacctttataaatatgtaggatcgggttccagttaagtggggaactcccgggcaaattctctttgctctccgcgtcccctcgaattgacctaaggtgaatgtccctcgcaccttgttaattttctatcccagcgggctttccggagtcgatgccagccttctatctgctcgttgacggagataaataaatgatgcgcggcggagggagaa

SEQ ID NO: 46184 - DNA, 732 bp, Bovine  19866881387916
catcacctaaatatatgataactctgaaatcatatccccagcctgagtttcttcccttaactccaaatattatgtagcatcagttacacagtaggatattgactgggggacttttcctggatgggatggatcatggggatcaacttcctcaggacgagttgatgactgggattccccatcaggggatataaagaagctagagtcagcaaatcgagcagagttggaggataaaaaatgagtcgccagaagcaaagactcagaatcagatcaaggaagaaccacagctggcaccagattcctggcaaggtaacatttaagtcaaacatggagcagataagagggtggatcacttccaaaaaactcagtcagcaatatatgggagatttcctatatgacagagagtaggttctaggcctaggctctagtttcagcatttaagttttgagaaatacagagcatgactacatggtataccccagcttgaaatcttattcatccatcgcagactcaaagctttgcctagtataaccaattctgacctgctatgagtgtctgactggaagagagatgtttaacatcagttaaaaaaaaaaaaacaaactaaaaacaaaaacaaaaccaaaaaaaaaaaaaatccactctgcaatgccagggtcctgattggctaattctgcaaaggcctcatctgggaaacccaccatcaggtttcccaaaccattccactggaatcag

SEQ ID NO: 46185 - DNA, 2451 bp, Bovine  19866881420908
acctatcataaatgtgaatctttgaaatacacatcagtaaattcagaaatggaataacttgaggtcataaaaatgagactaagtaagtcagtctagtaatgaggatatatctgatgatatattaaatggaaaaggctggttacaaagtgtatgtagtataagatgcaattttatttatttacaagaatatgtagtagtgcaatcacaatagctgatttgtggcgaaagggaaaattcactttgagggtgtcttagttttgctttgtatattctaatttttctttgtaatgagtatacattgctcttatagtatcaaaaaacaatagaagcaactacattttggtggaaaacacagtcggacacttatctccaccagctgaaactctcctcagttaagccttttaatctgctgtctcatcaggccatgcatttgtttgatagatggctcagttgcctctggcctgtcatgttgttatttgctttgaactctgaacatctgggtggcagggactctagctaatattgttttttagtgtttagatatacagaaaaatacattaaaattcttctgatcattaggatgaatcaagaaccactagttcaatatgttgaaggcaaatatcaacctcctaagcctggagcataaagagaaacgaaggatgacccatgtccccatcctctgtctccttccagccacatctacagagcaggtcatactcagcaacatttaaaacaaccacagacgcaggttccttgaccacggactgcattttcttcctgggggtaactgcgttttatcttaaactatgcttttgcttcagtacaaatgttaaccatgttcattaacaattttttaaagttttctttttttcttatcactcctaaagtatgctttatttagtaaaagatagtgaacacatgttctggaaatagtaaaagccaagcttagatatttattgaattcatattttatatttatattttctgattaaaatcagaagggtagctggcgtttccttcatttccacaggacagaaagacaggggctgtgtctgttcaaaaacaaaaatgtatctgaaaaaaataaaaatatatcctaaaaattcagatattacctttacaatgtcaaatacatgaataattggatagttgtcctgtattatttttttcatatggtcagttagcaatatatagaatgccacaatggaactgattaactttttttcaaaaattaagatactcaataaaaaccaattaaaaaaaacaacaaatggacataattaaacaaaaacaaaacccaggcatttaaaaagaatcctcacatctaaatgcaaaagaaattattctataataacttatgaatccaatgtaataccaataaatattcttagactatgtcttattttttattttttaaaagcataatgataaaaattaaccacacataaaagtgctttatactagacatggaggaagcataggtttttaattagacagcattgagctatttgggtactttttcatatcacatagcacaaacttaaaaaaaataaaactatgaatggaaaacaaaagaaaacaacagttaagataaaagtaatttaaatagtttcttgcatcttagaggcttttggaaaccatgaaaggcccaggtgaaggcaattaaaatatatttgttaacatatgacataactgaatattaagaaatatttaaaagcaaaaaacatttaagaaaaattagcctggaaaagagaggactagggtctactttctgaaatgttgactcatgtccaggagaaagaaatcatgtccaaaaaagaatacattctgaataaacaacagcgtgggaggaaaaaaaaaaagagtaactgctctgctgccaacctgacttaaaaaagacaatgactcttgagacctgcctttaaactctgtcctgtcttggaccaaacttagcttgtgctggacacgttgtgaaggtccttcaacacttccttcctcaacacatctgccacataaggcactggtggccacctgaagtaagacacagatctgagccatactgccatggagggcacctggaatattcccccagaaaggccactgataacccaggcaaacgtcagggaagagaagctgtcgacgaaaggcatcatctgtctgagatgagtttgataggtggagagaggttgcccaaggaaatagaagaaacaattccaagcattccaggcagaggaaattgcatgttcaaaggcactgaggtattcggatgtgctcagagaatacacttctgtgtaactagagagcaggataggtggccagaggtggtcctatagagtcaggtccagtgcacattagcaaaagtcttcctttctaccatgttaagtttgggttttgtctttaaggcagttgtagagttattactacaaggatgtttttacagggaaattacat

SEQ ID NO: 46186 - DNA, 1044 bp, Bovine  19866881430250
ggaaattgggagtaagaaagttgagtcaacatactttagtatatgcaacactgactcgatggacatgagtctgggtgaactccgggagttggtgatggacagggaggcctggcgtgctacgattcatggggtcacaaagagtctgacacgactgagcgactgaactgaactgaactgagacagaatatataactttttaatcactggaaagtaaacggaagagtaaaatgtgtaaagtgtttattaaaaaacttatttttccttaataaattttagggatttttctgactttaaatattttcctcagtaacaccacagaacattctatttaatactctcatggctttcctggtggctcagatggtaaagcgtctgcctgtaatgcaggagatccgtgttcgattcctgggtcgggaagatcccctggataaggaaatggcaacccactccagcactcttgcctggaaaatcccatggatggaggagcctgataggctccagtccatggggtggcaaagagccggacacgactgagcgacttcactttcactttagtattttaacttacatcttatatttaatgtactgaatgtgttgtcaaactttattccaaccagtttatatcattttacagtcccactaacaatgactaaaaaggcctgtcacctatatgctagctaacatgctgttacaagaaaaatgtaccaatactgtcgcattttagctcagccactaaatatttcattcatacaggagatttttcttgacttgaaataaaaatttaattttgcttaaaaatgagttagcaatatacttatatgctgagtgtatttttccccacaaataattcaaaatgtgtctttcaaaatagaccaaatgctaaacattttctcattttagcaaatgtggtttctggccaaaattactgtcaagtaccttcaaaatatttggtaataattaatataattttgtttgataagacaagagatctttggtgaaaatacttacaaaaataattgtgaatgtggttaaggtagataatca

SEQ ID NO: 46187 - DNA, 729 bp, Bovine  19866881595628
acttgatactaaggcaaaaaaaacaaaaaaacataaaaacaatgacaactgtttgcaaaatctctcaaggaagaaaatgattcattaatttaccagccaacgttttctaaccattttcttactcgttaggcagcaaactcctagaggtcaggatggtccagaattaacttatcatatatttctggactcagacatctctctgccaaatgggggaggcagaatgtatgtgtaaggagcaattagagagcactaaatactaaatacccaaacgcaaccatagttccagtggtcataacaaaggggagatgtccatggggactgatatgtcccaagaaaacttcgcacaagaatcaggtcttgatacacttgagcaatgtcaaaagcatcttggtctactccaaactggacccaaaattgggtcaacttgtaagataaataagctagatcacatttatgtctcaaaattagcctggccatacaaaattataccaaaattctttgtttctttctttcttctggcatgtaccactctcacatgtcttcaactctattcaatgctacatcactacgtgtataagataaaacacttaatcatagtccattacaaagattttaacaagatgataaaaaatctatagattcctttgtgggagacagtcaaccttcaagaaggaaactttcaagaaggaaagaggtcttgttgggggggtagggaattcaatagcccat

SEQ ID NO: 46188 - DNA, 947 bp, Bovine  19866881770114
ctcatctccagggttgtagttaggactttgtaatacgttccccactttgcatagagaggcagaagctagagatgaggccaccagataaaatccaagacgatctgtggtgcggaaatcaggatacgtagcgcctttcagaagacatccgggtacttggaatcaggtttttgcctttggcagtcgggggcataatggggttgatacctgttgtatgactccagagcattctgccacttggctggttaaaaaggtgggaggggagggtggcgggagggaggaagctgtttcttgatccttatggaagccagttaaaattaattggaaaaagcttttaaagacctaagacgcagaccaaatgtatcgccaacccgcggcctcatcccgcacggaacatgaaggtcaccgcgaagctgcagatttatgcagaagggttgggtgatggaaaatgagacaaaagcatttggattttattattccatttactctgaccctgggccataaagggtttggagagcctgttttatgtattcagctggttgccacactgacaggcatttggagccacttaaataaaccaccttggtcccacagctgcaacaacaccgtatcaaatataggttaggctggaaacctggagcctgcaacacagcgtctccagcaggtgcacggggaggattttttgtttgttttttgtagcctcttgtttttggaatagcttccttatccatcaattgattttgatttaaaattgacccggatatggaaactaatttggttttttgcataaaggatgtgcacacttgaggtcgagcccgactttcaaggaatgctcttttcactgagtttgagctgggtttcggagacattgactagtggtagaaagctggtgaggtttattttatgtttctggagatttgtactgattcatatttactttttttaagttg

SEQ ID NO: 46189 - DNA, 748 bp, Bovine  19866881935139
ggagttttgtccttggagctaatgaaatggttataaatgatcaccgttttggctttagctgcatcccaaagtgacagaatataaccacatctatgaaattatgctgaaccttaaggagcatggtcgccattcctgaaccaagctctctagggacagtttcacaattcctatatttaggagcatcagaaagatagattcagtcctcagtccttcttcggaaacagcacagagggcccagagcctccatatcacatggtccgtgtagaatgaatcaccaggacaaaagttctttgaaataagaacctgaggccaaatgccctggtagaagcaggagccgctaaagtgacagtgaaaacagtgtgtatctgacttcgctaggctttcagacctctgttctgcatagaacttggagccttcccaggaactgctagtgatggagtggggcattttccatttggagtggtgatttttattattattacaggcttttgtcagtattacagaaattgaggagagaaaaagaaaagggactaatcacaaatgctatttaccaaaccacattagtcaaaatactgcattttaaaaccccttaagttgttatacatcatcatataagtcatcgccaagtagtaatacaaattcttgagagttatgttgacatggaatttgtcagccgaagtgctggaaaatttacctctgctcatatatctgtagtcatatcctccaaagaaattaacatatcataacg

SEQ ID NO: 46190 - DNA, 812 bp, Bovine  19866880423285
aaaaatgactttgacactcattaactctgtctgcacgtttatgtctccaaaaaccaagcaaaataagatcagcttcagagatatttcaccaccgaaacagctctttctcagaatcctgatggagataagaagctggcccagatgaactgcaggattagtttagactgctctgtgctactgctgagaaatcagcgctgtttaaagagaacatcagttccgcgtgggccgcctacctgcggatggtgaaggtgcctgggggagctggctgttactctgcactgctctgctcgggagctggagcagggttctcagatggtgcttcacctgccttggtctgaaacacacgataaaaccacaaaccagaaatgaaccaatttccgcagcagtggagagtccaagactgaaaggtctcacaagtagggatcttcctgcctgcggaggtaaaccactgtgcaaaatcttaaacactcttaaagttggagtcaaaaattagaaccaccgaagaatggcctccaaacggcaactaaacaccatcattcttcacagctgagagtcataaaaaatatacagtcactttcaacacatgctgaaaggcaggttcctctctataaatgctgtcctttgtttggagagctctaaccattctgactagagtgttaattggttgaatgcaaatatttggtttgcgatatgggcaaggcattctctctctcaccctgtgtatatacataccttcatgaaaatgttattatatatacagatgcatatatgatacatatttttggcctcagttttcagactatgaaaccact

SEQ ID NO: 46191 - DNA, 2746 bp, Bovine  19866880445163
agggttggctccggagttggggcatcgacttcattagcatttaaaggcgcccgatgccctttttcccacctccttgccactcggaccgggatggggagcagggaaggaaagcaagggtgcgccggggcttggccggctgctccggagttttccgcgcagcgcgcgctgccgccccgcttggttggagcaggggccgcagggctcccctgcctctccaagtcttccaggaggggcacactggggcatccaggagacgcggcgcttctctctccccaaatgcacgcttttaagtcttttctagtgaaaccgttcagcatttctgaagcaccataaactgtttctgatacagcaatgaagaactggaataataccgtcttcaggctatttggctacttcttcctgaaagagaagttatggatgacttgtctatgagcctcaggtgaggaaattgaagtccagccctcggcgaattcatgtaaacgtcagtttacagcaatgtaaggtcttacctggtggctcaggcggtaaagaatctaccagcagtgcgggagacctgggttctctccctgggttgggaagataactctggaggagggcatggtaacctactccagtattcttgcctggagaatccccatggacagaggagcctggtctcaaagagtcggacacgactgagagactaagcacacacagggcagcacacagcgagctgttaatatgcatagaataataaacttggaggaagaagactaaattcacaccccactttctgctcgaattgcctctgccagccagtgaaaacttaagcagtcgagccctcttagcctcgagggctaagaggagggtcacagagaagcagatcactcaataaacggtattttcagtttaaggagtccacctgattttaagagaatggaactggattatgcgaaacacaggccaaagggcctctactcaagaaccatgggaatacagggctgttaggtgttctttgcctccagggtctagacagccctaggtatacactcgagtgctgcccttaattaatggagtcaacttggactagacattcaatgttccagagtcaatttcctcctttatgagggtttctccaaggtaccctggaaagtagatgggattatcatatgtaactccagtgtctggtccaacaaaatctccttttcgttctccattctcctgaactatttaccttcccccttcccctgggaattgtgtatcatgtggctacataaggagggtagcaaccaagtgtaattccttattgcaatttccactggttagcagagtacctagcagcgaagtagaacacaggaaatgtttactaaatgaaaacaaaagaccacactttccaaactcagttgcttatcagcacattcattgtcaataattataaaactatcctgccttattactttcttactccatccatgaaaaaacataaaaagctaaacttgacagggaaaaaaagcaaaatatggaatatttgacttttcgatgtaactcacctgtatttttaaaattataaagatgtaaattctagattcatattttagttggactacaatatggactatacagtgatgttatctatatgcaggtgtgtttaaaaaatttctgatccaattctaagtgtgattaaattatttcttaattttaaagagtgagtcttaattacaattagataatatgtatgattttattctggtgaggactggccattgactttcttaacaagacaattataactggtatgcagaactgaattgcaagggggggaaatgatctaatagccaaatccttaaaatattatatatatatatatgtatacatatatatctacccttggaaaataattcataactaacaggtgtggtctccaacctctggaagaccctaaaataattacagatgcatcctgggatttcctagaattttgtgctggaatggctcccaaaactactcatcattttcatccaaaaaaagtagtgagcagcctgggagttcttggtactgtgctaaataaatctagagagaattaattagagcaaacatgatctgtgttgttttaataatcataacaagagagcaactttgatgtagacgcacatggagtcttccatttcttcatttactcatgaactcatgcgcttgctcattagcacataattactgaactgcacactatgtgtcaaagtgctacactatgagtatctgatgttgatcaatatgaagcttacactgtgttttttttcatgtgagatcattttttttcactgtcatttacactgaaagaaaacatcatgtctgaaatttgagattaagtggaacaatgaaaaagaatcataatctatttgtttgacagcaatcatttttaagctatgactggtttggtcatgaagacaaaaggcactctgtttcagtatgaaaggagttagcgcgtccacaactgctggaagggctgtgggagagaaagtcggagggttccatggcggatctcaagactccagccccaccaatgcggtgcttctcaaaaggtttcctgacaccaccagagtcacaggatctctgggaggcccccaacctctctggactagagccaggtttcatgagacttaaagtttacatgatttagagagctatctctgagactaaataaacgaaagtatgaacacaaaattgccagccactttcagagtcttagaaagagcccatgcaagaaaag

SEQ ID NO: 46192 - DNA, 1373 bp, Bovine  19866880779659
ctgggttcgcaagttgggggtcttaactgggggtaccctaggagggcgctgtcgctcagtcccgtggcgacgcatccccgggtgcggaggggaaagaagcggcagtcgggagagaggatccagggtgggatggaagtggatgtagggatgggacaggcacccacgtggcacgggaactttggagtcctcgcttaggatctgggcgaggagagcatttccttggagggaagaggaaggcgctcggaggagacagggcaggggtgggggagttgatggtggtggaaaggcttcttgctgggaaggctcaggtgtccgtcccagacgcccttctcacgggggcgcgggaacgaggccaggcttctgtcggccacatgctggcggaggggtgttgcaatccctctccggggaaacttgggtcttggtcccgcgtcctcctccctcgctctgcccgctgctgcaagaactacttggtgtttaccaatcactcttgtcttcccggattgtgggaaagcgcttggtgcagcagctgaaaaaacttggtcggaagtgaggggatgacgttagttcgcagcctcgttatcttggggacttgtaacttaggaaggggaatcggaagaggagatgttcaggtcccgggggcagaacgttacaaaggatgtctgtagtcattgttggttttgtcacggatctcagtgtcctctcattcagtaacgttaacgccctgtgtgaggcctaggcagtgggtggggaataaggtctctaaagggtgtgtgctgtatatctcattctctctctcttttttttttttttaaaccagggaaagttaagagatggtgtaagatgcttctgagaaattttcagtattttgcatggggcatgtttggtttctgtgagccttgcctgcccaagtttctaggaagaaaattttataggcagaaacttggaggaatcatgtgaagaaagtttaataggatcccatttttcctgccttgagaggcctgtgttcatttttttttttttttttagattttactcagttactgtcaaacgagctgctaaatgtaacatgtgcaggttaagaaacaaaatagccttcatttctctaggctaaaagttgctccagtctagtccgggttgtactgtgatattgttttcaacaagtgtttcttggaacacttcccatgccaaatgtcgagagacaaccttggtttatctgaagcagtgttaggatatgttcttaatttatcttcttataaaggaaatttctcagtttttcactggatccctgtatctttcttgaatctaaactgaattttaaactgcagtagatatctttaaagatgaaggaactagataaattactcagccaccaa

SEQ ID NO: 46193 - DNA, 1786 bp, Bovine  19866880993575
gaagaccctaaagttgtcttactcgtctcactctttcctaccaacaggggcacctccatatcctgaagtccctcctaccaatatcctacagcatctccaaagagggcaagtcatggagagacccagtagttgcacacacaccatgtaagtggcttttaaaatcttttttgctctttatcagtcatgctgtttgtaaagtggctcagatgatcctcagctgtcctctatgtgctaaggtacaaccttaaaccaaacctatgcagaaaatacatctgcttatatatatgtgtatatgtgtctttacatttgtgtgtgtgtatgtgtgcgacacaaacacacacatacacaatatggaggcagccactgaatgctatattagaaatttagatttgctaacattgttaaatcttagttcctctggaatcttttaaaacagatgaaatccaatgcaggtacagcactgttttagttatataaatgtcagtctcagagactaccagcttcagttctaatatagttgtcataaaatccacagttattcactggttcttatttgatatttaacttaaaaaattttttcctggttctaagcatgttggaagcccatcagaagaaagacagtgagaagaaattagacagcagaaggaagatatcaaattgccagcagaaagggacagttggtgaactaacatagaagcagaaaagtaaaaattacatgcagaatttcataaacaataaagtacaaagcaggttatgatagactataagaaaggcttcaattatttttaagaaagcaggagataatatattgatatacgtttctgtttaaattgctgttattttgtaaattcttcagtactgaaaaagtaactttctagcacctgagtttcccacaaatacaaacagtaattgtatcaagcatattaaaaatgctaaaaataataattgtatatacttatacacacatagtatagtgatgatactgctgggtatactagaatgaaattattgacaaatatttcttgaaggccatatatatatatatatatatgtatatatatggctgtccttgatactggggataggtagagacatttaactgaaaaagtacctgatcttgaaccatgtaatatttggatgaggaatacctgacagaacatgaaaatcaacagaaagtgtgaagcaatgagtagactggttaaaagctcagattcatgtcatagtcaaaaagacacatgttcagtcttagtcctatatgttacattgtttacttaacttaaaataggtaaaatgatagtcctgcctcaaagtaattgtgaggctgcaatgaaataatgcatgttaagtttcctttccatgccttttgggcttctctgatggctcagtgggtaaagaatctgcctgcaatgcaggagacacaggacttcaggttgggtccttgggttgaaaagatcccctggaggaggcaatggcaacccactctagcattcttgcctagaaaatcccatggacagaggagcttggtgggctacaatctgtggggttgcaaagtcagacatgactgaatagtcgactaggcacaccatgccttttataataagtatgttcttggtaaatggtatcagtattagtagagtaacataacatcttatacaaagtctaatggtacaacattaaagagtattggggaaacacagtgtgtttcccatataacacaggttataagggaaggaattgaaaattcctacttatactaataggaaagaataaccagggagaggatatt

SEQ ID NO: 46194 - DNA, 1118 bp, Bovine  19866881011934
atcccaatttttttaaaaaaggaaaagaaaaagaataaggtgataaatagatgaaataggattagaagattttagtattatgctgaataaaggaactcatgtgaattcacattcatgtaaaaaaagtttgcattcatgtaaaaaaaaatgattctttgttgactgagccactagggaagcccatagtataactattgactagtattaactagtatactattcgtgtgactagtataactattctctacacttatgtgtgttcaatgttttccataataaaagttacagtagaaaaaaatcatcagtcattcttattataaaaaagattaagatattaagagatttagtatttaggaaggtgagaaggaatagtattctctgggaagagtgtgggacagggtgatgaatagattacagaattgtagggttcttttgttaagatttgtaagcgaagaagcatgtttttcaaacatttgccttgtcaaggaagtcagtttctcttgctcccctttcaggtatggtctcatgaagtcctgctggcgttggagtgaggacagccgcccctcacttagaaagctacactcgtgtctcgaaactgctgctcaaagtgcaaatgacaaggctgtgttgcaagtaccggagttggtggtacctgaactgtacgcagctgtggcaggtgtcagcgtggagagtgtctcctactgctacagcatcttctgaaggtcctgggacaacacccactttggggagatcgtatactcttgaaagcagtttctccaagaacaaagacttttctagtgggagttaaaaggagaaatgggacatgaatcttgaatcttcccctacacatttcactagaaacctgaaatgatgctgggtgagactgccctcaccatgtacccttgagacggagaaatgcagttcatttctgctgtcccaattctgaagacacagggtagatgggttggacagtgtccgttcaagggaggttttacaaatttgcaatctttgttgcaacatggcatggataagttggtccctcctaccacaggcttgtttcctttgtttccaaactctgactatagtaaggtccagaaaatggaatcaaatgagggaag

SEQ ID NO: 46195 - DNA, 1890 bp, Bovine  19866881139096
attaatttcttttctaaagtcctgaatgggaaaaaaaaaaaatacctgcaggtcttacttctgcccaagatcatccttctacccaagttacaaagagtacttaggaacgccccttaaagggagatgatttaatgggttctattcctagcccagtgctgcctgttaagcaagttgtttgtgacaaagtttaatttcaaggaaatgaatagaagatgcctgagtaaggtcaccaggaaatattaagtgggagaccaccagaagtatcactcacttgggaggagaaaaccgtgtaattgggaaactaaactagttaagacagaaaagatctgagttcctagttcatatgtcaaacaggagggactcagcagagacacgaagggagaagagttaagggccagcaatgaaactgtatgatagaggggaaaaaaagagagagagaaaccactgtggtttcagatgcactttccatgggattttccaggcaagaatactgaagtgggttgtcattcctttctccaagggatcttcccagtccaaggatggaactccagtttcttgcattgcaaacagtttctttaccatctgagccaccagggaagcccagatgcactttagtaggggccaaaataaaatcttaagggaatttaagtaggcattacaagcccaatactggcagtgaagagacaaaatcagaagtgtgagctctgaaattcttctaggaaagggagtgtgaagatgagaacgtctgtggtgtaaagacacaaaagatatatccattagtgtgctaatgggtctcactactcctcaaagctgtgtacccaaaataaacagaaaacctggaaaacaatgagaatggacctataagaaaagtgagttttttattagaaaataaggtttgctattaaagttcttgtataaaaccaagattttacatcatgcaggctgttttcccacatctcagcgtcctgacagatgccagcctcagcttgttatttccaacaataaaaaacagtgagtgacctaagggattaagaatttctataatctctccagacatcatagctaacttgctttctttcataaagtcgctaaatgttgccaaaagacaggccaggtagtatacaaaaaggaagaaaagaaatgaggtcactgttttcctggcctccacgtgggcctctgtgctggagtctctggagcctgtaacactggatttcatttgtttactgtatctccacagggatgtaattaaaaagaaaaatgagatcaatgacacagtaaatggaataatagcaaacaggttaaacaatgtcaatgggtcgaagtattgaattttactcacatggaacaattcggtgacgtttcttttatgttttgcaattttaagaaaatcataatcagaatttgttaacgttgcttgtataaggctgatcaacatggaaatggccagggaccccagtaggctccagtgaaccaccctctcaattctccacttcagccagagaaaaagtcggtgggagaaattggctatctcgaagagacagaagacattgaggcaggtggcaaaccacatacttaagtagttggtgaatgtccagaagatattaagaactacctttattttctcattttcataaacacctgggtagagtgccagtatggtgccgttgagtgtcattacacaaagcaaatacattctggagagagctaaactggtgaggatgtagtcagctatggagatctttttcttcttaatccaatcaacacatattactagtccaatgcatccattcacaaacattcctatgatgaattatgcagtcattatggtcagaaagatgtggtcttctatactgaacatgttgggagagaacaccctaatctcaaatatta

SEQ ID NO: 46196 - DNA, 1021 bp, Bovine  19866881830572
aaactgcactttgagttttgatcttctctcagactaatgacatgtggtacaatactctcttgtgatactgggcagaggcaactacagttcccagcaacccatgcatcactagaggaatcaacgatgcatagacaaccattctgtatccctacaaccattctgctttccactttcggtataacatttgataaatattgaaatatttgatatttgataaatatctcatgaaaacatgagacattcaattaaatggcctccctggtggctcagatggtaaaggactggcctccaatgaaggagatccaggttcgatccctgggttgggaagatcccctggcgaagggaatggctacctattccagaactcttgcctgagaaatcccatggacagaggagcctggtgggctacagtccatggggtcgcaaagagtcagactactgacacgcacacacatgcacgtgtgtgcacgcacgcacacacacacacagacatacacacagagattctagggcgcgagggcttcagtagttgtagcacacaggctccgtagttgtggtgcatgggcttagttgccccacagcatgtggaatcttcctggaccagggattgaacttgtatcccctgcattgcaaggcagattctaaaccactggaccaccagggtagttcctgaaaatttttagagaagattgtttctgtttcaaatggtgtccaggttgagatgagtagtgggtcaggctctgtcctcaacgatcactttcttccttctttatttaaagagtcttcagtgccctggcatggcattgcagtgactcttgggatcctctgtttacttctcttgatgacaatcaccgtgctgggtataaagagtaagtaactgaaatacatccaagtctgagtactagaaataaccactcattgtgtaggtaccaaccacgctctatcaattgttccatggtataatcagagaatgttccagggagttttttcttagtattttttccccagatataatcatggt

SEQ ID NO: 46197 - DNA, 1656 bp, Bovine  19866880180813
aacttgactcttcggaagagaaaaaccccaagcagtctaaaaagtacgactgctgtaaacccagaaaattccttttaatctcatttcatgggcaacactgataccctgtaaggcatgaaatttttatttcatgtcaatttcactgggatttcacatgcagattaatttgttcatccacataaacatatactgctctgactccttgcctccacagccactctcacttagtgttatagaaatcccgcatctcatgaaagacacttaagataacagtgagatctgcaattccctgaccctgccatattttgaattgctgagcacataattaaattctagtgtcctaggaggagaaggcaatggcaccccactccagtactcttgcctggaaaatcccatggacagaggagcctggtaggctgcagtccatggggttgctgagggtcggacacgactgagcgacttcactttcacttttcactctcatgcattggagaaggaaatggcaacccactccagtgttcttgcctggagaatcccagggacgggggagcctggtgggctgccgtctaagggatcgcacagagtcggacacgactgaagcgacttagcagcagcagcggcagcagtgtcctgggaaggaggtaaatgggcatttgtggacggaacctcgtgtcttgcttctaagggacagactacaattaaagtgatgggatgtcacttttgtgatcaggtcacaaaagacggtgacttcctcttttgggctagtatgctttgctgaagcacgctgccatgatggggagcctcacatggcaaggaactgagagtgggcttctggtccatagcctgtgatggaacgaattctgccaacaaccatgtcagtgaacttggaagagggcccccaacccgaaatgtgccccaagatgtgctttgagatacctgcagccccagataacaccttgaacactgcctgtgagagacccacctaggccatgcctgaattcctgagccacagaaactctgaaatgataagcattgtttttttttttttttggctgcaccttattatttttttggcagcaagtgggatcttatttccctgaccagggatcgaacccacggaccctgcagtggaagtgcagagtcttaaccactggaccaccagggaaatcccaataaacattattttaaggcactaaattttgtggtaatttgttatgtagcaacagacaatgaatatgggtacccttagctcctgaaaaaccaacttcaccagggtttctcactccctgcggagtcaaaggtaaatctcctggggtacttagtggaagagctatgcaaaggcatcacaattctcccagcatggaactccagaacctccactggatcctctgttcatgctctgctggcatcaagatgttgtcaggtatggattcctagggccccagtatacagagggaagttcttaaggggtacctgtgggggctgttccaatattcacagttcagctcttttgctgttgtttggtcgctcagtcatgtctgactctttgcgaccccatgcactgaagcacaccaggcttccctgtcctttaccatctcctggagcttgctcaaactgatgtccattgagtcagtgatgccatccaaccatctcatc

SEQ ID NO: 46198 - DNA, 1737 bp, Bovine  19866880445726
caagctagtgatataagactagaaaacaaactacatctacttgcagatacatgataagtgaaagtgaagtcgctcagtcctgtccgactctttgcgaccccatggactgtagcctatcaggctcctccgtccatgggattctccaggcaggagtactggagtgggttgccatttccttctccaggggatcttcccaaccctgggatcgaacccgggtctcccgcattccaggcagacgctttaacctctgagccaccagggaagcctgatgacatgataggatacctggaaaaccctagaaaaccaatgctaaaactaactcgaccaaggttcagaaaggtagcagaatatcaatataacacaccgaaatcagcttggcatcaaaacggtggcctctaggacagctcacatcaatgagaactccctagtacctctgccaccagtgcccttatcctcacagagagccacagccaccccccaccccccaggagatcctccaagaccagtagggcatttgcttactcactgctcactacagggaggccttttccagatgtattccttttcagaggctttgtcttctgcatgggaaatggactcctccaaggctactatctcgtttactgtgctgaataccctgctgagtggtacacagacatacagtttagccctggtgtcttcttatctattttgataatgggaatcaacattcatagtgactataatgcccccagctcaggaagcctggagaaatcatctacaagattccacaaagtggcttgttcatgtacatttctggaatcaatttcctttctgagatcattgaatggatcagctatgccctggccacctggtctcttctcagcacttatatttgcattttttctcactttctttccttgggctatgaacctttcaccaccataggttctacctcaagattttgaggactaccccaagtttcggaaagcctccattcatcttttaaggaaaccaaacaaaaaggtaacacagctcccatgaccctgtggaaaaccataaagctgctgagcctgtaacttttacagtcccactgcgtttatgtgagagctggcctctggagttctggcagctaacctaagaattctgcaggggcccccttcatgtttcctcctaccctcccagggggcctctgtcctgatctgttgaagcttcacaaagccctttttcacacagagacatctgcttcttagcctttcctcctgaaaagtaaaaagttccttatgtatttttcctttggatgacaccagtacaggtgcttttatacctgctctgtatcagtataagacagctctgtaatcgagacagttttgagttgagggcagtgtttaaagaatttattataggtacacatttgattaaacaaatcagcagagatttaaattctgaagctgcacagacccagagcaaacctcctcccaaatgaaaacccacccacactttacttttccatggttaatagtgaaagatgggaaataattaagtggacttttaataaaggagtcctctcttcatactgctgaacaaatgcaacacgcatagacctcatttaaaattctgcttggtcttagtgcctctgtcttcctgaagattccacaatccctgacagaaatactgaaggctaatccagaaagctgatatgggttttaccaaaggccagggttttaatgatcacaaagaagaaatgactctggttga

SEQ ID NO: 46199 - DNA, 1175 bp, Bovine  19866880460151
ctctgtgggctcggcggcccccccttaccctcaggtccgtgctccactgcattcagctcagggatccaggctgggcagatgatcctaggaaatagctgattcttaaacttcatctcaatgcctcgagagaaatgaaaagccccaagttgcagggctcccacctctgcagacagcacggatttcacatgctctgtgggtgtctcgggatttggaggtgcaatggacaagacatgggataaagtgcagtttccacaagatcagccaggaagctatgtctttttctctctcatcagaactcaaataagatgaacttgacttcatgtgtgtctatgtgcatgtgtgtttattcacaatattagaaaaagggcatgaaaataagtcagaaacccttctaaacactttacataactcatttaatcctcataataaccctatgaaatactgtgattttctctgttcataggtaagaagggtttcctggtggctcaacggtaaagaatctgcatgcaattcagaagacatgggtttgatccctgggtcgggaacatcccctggagaaggaaatgtcaacccactctagtattcttgtctggaaaaccccatggacagaggagcctggtgggctactgtccgtggggtcgccaagagtcagacacgactgagccactaaacaacaatagataggaaactggagcacaaggaggttaagtttctttcctaaattatacagctaagaatgggcacatttcagtaccagggcaattattagagttgggatataatagtaatatactgtgaaggtctaactttcagacaaaaaggaaaaatgactgagagaaaaattcaaatcaactcctagttcccaatatctgtctgagttcttacggtgcatggcttgatgagaccgaatgtttgtgtttgatttctgtccttccagtgaaccaagaaacctctctgaacagacctgcctctattcctcagacccagtcagcacagcacccctcccagccccacccacagggttgcaaatagaaaaggttaaaaaggaaatatctgtgcattgtccgcattgtgctgcgaagggtctctgaagggtggagcaggctttgagaagcctggtctgtttgaatatcagctcatagaataaagaagggagagggcaataagtggttcat

SEQ ID NO: 46200 - DNA, 1532 bp, Bovine  19866880526455
taggtctgttgcccatcctgtaaggacaggggcagcagtcagtagaagactgatgagtatggactgtgctgggcctggtcaggggaggccacagttctgccagagggttctagctagtacaacaacaaaatccaaactgaagccctgtcctgctgtgttgactgcttcagagggaaggctggagggcgtcatttttataaggctaattggggtttgtgaaaggcagctcagcagaccccacatcactgcatggaaaaccagccacctcctgtgacatatcaacactgtctgccatttcaaactatgatacttgaacagagtgtatcagtttaattatagcttaagagctaccagcttcaactagttaagagagcagcctggtcacttaaagagaaagccgtttttacaagatgtattagtctcccttgactgcccaaagaggaactaactgagtggcttaaagaacagaatgtattctctcgcagttctggaggcagaagtcggaaatcaaggtgtgggaggactacactctctctgaagtctcaagggaagaatccttccttgtctcttcctagcttctggcagtggccggcattccttggtgttcgtggcttgtagctgcatccccatcatccctgcctctgtcttcacaaggcttccccccaccccacaccgtgtgtctgtctctgtgtgtcttctccccttctcgtgagaacaccagtcatattggattaagggcccaccctgctccagtacgaccttatcttaacaaattgtatctgcaatgaccctattttcaaaataaggtcaccttctcaggtactggaagttagaacttcagcctatgttttaggggacacacaattcaatagacaatacaaagtaacatttcttttttcttttggcattcccccaggccttgtgaagggatattttacctggaaacctgaccagttctctacagttaaccttgaccatgctctttgtgacctctggttcctgtatgcctcagttgaatccatcgagtacttctttctggctattatatattctttactgggtaaaatatacataacaaaatttcccattttaaccatattaaatatataactcagtggcatcaggtacgctcatcatgtggtacagccactactgctggtctctggctattgttttttatttcccaacatgagaagcttcaacatttgcaagagataggatgctggagggaggaagaaaatagacagatggccacctggaagagtcaggccccgaataattgcaggctgatttgtaacagggacttcaaacagatcaaacctcaaccagtgaccgctgcttgattgtatttataatcattcctctcttgtcttttagattctacctcaagatgtttgatgactaccccaagtctcgaagagccctcattccattcatcttttaaagaaaccaaagaacaagggaacaaagctcccacgatcctgtgaaaatcatcaagctgctgaacctgtacttttaaagtcctactgtgt

SEQ ID NO: 46201 - DNA, 1376 bp, Bovine  19866880577591
tatgcaatttctgagtttgtttgggtttgaagtcttggcttcatataaaagagaagcaatcaaatacccttcaattgtttggtttacttttttcattttgaggttcgttctcttgcctggagaaattatgttcttctcattcaaaatctacatataaaatacttttagatgggctttaagctttcctgatgatttatgccaggcttcacacaaaggcatccacatcgaagttctcctatgtgatgagctcccttctatccgatttttgtaggttaatcaatttaaatatgcgctcatcagagatctccctggtaagctactcaatacttaattatgtatttgctgagttgaagaaatgagtgctattcttccacaaggactttctaagccaagaaaggaatactcaactattcttcacaaactagcagaaatcgttattttctctaccatgtatctctacacacccaactaagcaaaaaaaaaaaaaaaaaaaagagctattttcccaagctgcataaattcctctacctctatcagaccacacgacccaccctggtgtaggacacggctgctggggagaccagtgggcattcacatggcccatcaggagaaagagaagcagacccagagttcagaaaagtcgtgtcccctgagtccaacaggaatgactgaaatactcacctgaccagggcatgtggttcaggatattctgcagttggattgcgtttatttctggatactgaagtggaagcagagggtcaggagaaaatcatcattcctgaagtctcattggatgtagaacccacagataaacagggctgggaaaggcctctcccacatctgcttagcacagcatatatgccatttctgggcagaataagttacaccattttcttatacataaggacgtgactagacatatgattaaatccaaaatttcataagaacttcaacaacagtttaatttgggtgtcaaattcagagtgccccagcggggcaggactcttaagaagtagactaatagaggtgtttctcaaactgggttctatagagatgctgcaaaagtttagcaattgagttttaatgttattcttatttaactatccttagccaagagtccagatttccattctagacttcatcagaagccactctttacatgggcatttgactttaaaacatgttaatgaaatgtaagtaccataaatttgaacttataaaatggatatgatacctttatatttatctgttctatatatctttatatatctggattctctatgtgattccatttgataaaaggactgcagcagaaaatgtttggaaacccctggcatggaggaaaattcttaaaaacaacacacagaagattttga

SEQ ID NO: 46202 - DNA, 1634 bp, Bovine  19866880589124
gcttcattgcagatttggttctctgggtttgtgtctgctttggtgggtatggtctgcaatccaggaaggatcagggattgcctgacccaggaagttatattgaaatggcagtgcaggggaaagaaagggtgttgatagttttgctcactgtttctccctattagaagtgactctgcagggtctgtacttctgggccagtgaattctcacagagtctcagtgctagggaggcagtgttatctgctggtgaatgactttaccaagtgatagcgcgtgaagtcctccagtggccctttcgtggtgatcttcggatttacctgactcagttttccaatttgcaagtcgattttcttctttcctgattctcccttttcctgctactccttttcttcccaactatttcccctgtcctggagctgcctgtaggaactatgcctccttgtctctgttgggaaaatcatctgtaaatcttcatcttgcattttcaccaaaaggaccgatggcattctgtgggcgagctaaaacatggtggtctgccttgatttttagctgttatactgaacttaaaaaaattttcttttgtgaaaggcgagattttacctgtggaacctctactttataacatacacgttttatcattaggtagaacatttaagctctctccatcttggttccttcatcaatggaggtggtaatataaacactgtagtgtcactgggaggattacatgaattactatgtgacatgctcgtcactcctggcgtacagtcatttgtaaagtacttattgtctcctctgccccctcactccattctcgtgcttgagatgcatacatgctctctggtggatttgctctacagaaggattctggggttctagttcagagagtcgatttggtttgtcccaggagaaacctaggaatctgggtctggattcccaaagctgcccaggtgacaccgactcagatgttcttcagactgtacttttagaggctgttccgtgggctgtaaagacggcgacctgcaccttgagcatcctcggggcagtgctgtatgctgtcggtttgtggtgaatcacagtgtctgtcacagaagagacacccgatgcacactggtcaaagttaaatgagtacctccatgcactttccatgttacctgatttattttgtcaagttttactcctcactgggcaatcagaaggctatgcataaagtacactagtgtgacaactcatcctcaagcctgaaacgtatcctaggcaacatttgagtccccattcccctccattcctgcaggtctacatctatccacctttccataagccccagttccaagccatgttctctatgactccctctctggttagaattaacattgcccttctctccaaccagcttctgcatatcatgtaagataatttaactcacacaggttatgtatattcattgtctctctcagcaaacctcacgctctcagtggtttccaaacccacccccttttcccatctggaccacagttggctcagtcccagctccatcatcttgcttgtgtttatgacattagctttcttctttgactgagtcgggtgactgtgagttctatatcttttcaataaactctcctttaagtaggctag

SEQ ID NO: 46203 - DNA, 2479 bp, Bovine  19866880646716
tgcccccaggagccagggcatctcggcatttccccagaaggagcaattctagttccctggtcttctcgccacatcctcaagcagttgctggcctcctgaggctccactggagacagataagttttggcttggaggttcccaacaggcctgggacacgcgtactctccagtcttaggaatatcaaggccacacacaggatgctgagaccattacatggacggccaagccttcagatgggcccgaaccccaggcagccatcaggccactgtgctgtgggtcacagtgagggctggaggtgagaatgtagatcaggacagggccatctacagcaccacacaagcagcccagagctgacgcccctgtggtgttctcacacgggacacagcagtcatgtgtgtgagcacgtagcagtggccactccttgacagcagcccctacccatagcaatggctgacaaccctcctgggctgaatcctgacatccaggacctggaggctaaggaaccttctttccccttgacagaggctcaactgggaccacgtggaaccctccaacatttagcaggaagtgtaagtacatcagggcttcccaggtggtgctagtggtaaagaacccaccttaggagttcataagagacataagaaacacaggtttgatccctgggttaggaagatcccctggaggagtgcatggtaacgcactccagtattcttgcctggagaatcccatggacagaggagtctgacgggttatggtccatagtgtcgcaaagagtcggacatgactgaagcaacttagcacacacgcaggtaagtacatcatggcagatgtgaacgatgctgagccagtcctcagcacaggtctccgccagcccccacccctctagcagaaatctccacgaggacagaaacctcctaaaataagggcaaaagtgctgttggcctggcaaaaggtcctcttggtttctggccaatcttttgagcctctcctatggacagcttccctatagcacatgacagagggaagggccaagtggtaatgaatcttcccaccccacccttgccctgactcacctaatgggctcagtggggtccaggcgtcgagccttctgctctggtgtgagctgctcccactggaagtgcaggctccagtcaaaccctgaaacacagcatccacatgattgactcagtctctctgatgtacctgcaaagcttgctcattcgggctcatgaacatatccagcttcccaggtggtcctgggataagaggtctcacccaggctggttggcaacagagctgcctgatttcccttccactgcttcttctctttctccagcccctcctgcttctctgagccttctctgctgggtggacttagggaagaagagcagaggctacagagtgggagttgagagaccccaagagtggtactcaagggggacatgatggacaattccagagtgaggcccttggtcatgagtcttgggagttgggggtgtaagcaggtctgtgaggggttgaatcacccccagtcagtctttgggagccagtgctcagccctgggcacaactgtggtgggcctcaaggagagagaggcacccagtgctgacgtgtcagaacaatgcaggcctcacagggcggggcggaggggggccctgcttccctcccatcttcaggccctggggtgacctgccccctctctgatccttccatgcacagtcccccgtggtcagggccaccctgaagctactgacattacaggatgcagggctggaggctccagaaaaaccactaggagacctttcttctctctcccttggcagcaatgactaggaggaaaaagtccctctgggcgagggcattggctggccccactcaccccctctgagctctgaggctgactcaatgtagttgaaggtgtccaggtgaatgatgtcaatcacggggcacaccacccgtgtgtagtcctggaaaacagaaggccctcactcagatggtggcatcagggaggcaggcctgggatgggggggtggggtgggggaagggcccgcagaacggtttcagggccttgaccaagcacttccccctctgcatttcaacatttctcatgtatatagtgggccatcagacactgtgacctctccacaatgcctacaatgctaagagcctttcctttactcctgggtgccttctcatggccatctaggcatggtggggacacggggaggctggctggagtgtgctgctcactgaggaaacggacatcaggaagaagggggcccttcagtgtcacggggctctcaggaggcagtggacacagtcagctgggaaggtgacctcaacagctcccctcacagtgggaatttcccagtacttaactttctatgcctatggttcatgggcaagttgagaatagcatcgccagagattcttaacttcattcgtcacctgtgatactcgagtccgtaacttcagcccc

SEQ ID NO: 46204 - DNA, 3012 bp, Bovine  19866880882079
ctcggtttcctccgtgtccccaataagtatgaaaaacagttaataaaattcattaaactgattgacacagttgttggtctaagaaggaagacagataattacttgtcgtcaatgaaacacatctcagtttactttccagttgggagggcctggaacactgtggtccttgccgtcggctctcacactttagcgtgcgtcgggtcactgggggctcagggtaaaaaggtagctccatgggactcacccttagaaattttgattcagtaggtgtggggtagggtccttaaacctgcatttaaaaaaaatatatttatttatatttggcttccctgggtcttcgtttctgcgtgggctttctctctttgcagagaatgggggctgctctctacctgcagtgcccgggctctagaggacaggctcagtgactatgttgcctgggcttagttgccccacagcatatgtgatcttcccagatcagggatggaacccatgtcccctgcattggtgggtggattcttaaccactggaccacgagggaagcccaggcctgcatttttaacaagtctccctgctgactctggtatgcgcagtctctgatctatgctttgggggatgaaacggcctttgctagaaaatagtttccatcctgttggtcatgatacctctgtttcagcaacttgtaagtataattatgggaactgtaaatattggtgacagagttgcagatagattattccctgaggtttattgctatgaggaaaggatcagatttttttttttttgtctgtaaaatataatgcttcatacaacttttagtggtccattatattcgcatggtgtcatcagagaaaatcacacagtgacatttaaaagacatgtgcccacaaggaggaatcatttattagactgcttgttctcggcccctgtttagttttgagctcctgccttgctctggggtccctggggtctccagccctgcagctgtggaggttggccctgattccctgtctgtgctctgctcttgtctactcaggcggtcggggagccgcccctcttcctgggcgcctccgtcttctttgccatcaaggatgccatccgcgcggctcgagctcagcacacaaataataacacgaaggagctcttccggctagatagccctgccaccccggaagaagatccgcaatgcctgcgtggacaagttcaccacttctggtacgagggccccgcagtccagggaggtggggccacaggctggggaaagttctgctgcagagggagggctgagatgttaggctgtctctcagccttcctgtatttttggctgggaagccatgggtccacaccgccttctgccatgaggcaccgcctccaacatgcaggaagataacaagaatccccttaaagctgcagcttgggctgggtctcctgagaggaaggagggctgtgtgatgcccttatcacccactgattccattatttgcataaagatgagggtaatggataaaactccagaagagcctgatctttagtgtccagcagtggcatttttgagacccttctttgttaaagacactgtgtgcggtactaaggagacagggaaaaaaatgaatctgtgagacagagcacatttgtcctgtggtcaccctgtgccatgctgattccggggatgtgtaggtgccctggaaggcatcgcaaccttttcagacaccagttgattgccctgtgtggtgactggttactgccttggaggtgtgtgtagcagagaactccatggtctctggaatcatttggggaagtccctgtgtgatacttgtggggaacaatgcctggtgaaaggagacaatgccaggacagattcgtccactgtcggagcctcagaagcagcccagtctctgagttgggccgagtgggccttgcactcactctccaaaggctgttgcagcctcttttgagttagcagaaccagattcttcctgatacccaagtcatatctcctcctgggtatttgataggaaatttgatagacattttgggtttcagagggggaaggtacaggagaggccctggagacaggcagatctgcagtcagcacagagggtgagggaggcagatgggtctccagtcaggcggcccttcaagttttgcaatagctttagcctcagggtgaaacacacacagaccatgtgcagggctcccaggcagcaaggatgcctacaaatgtacagcaacctcgctgtagcccagaaccttcccaccatggcctcagggctgacagtaatccaaacccaccttctctgagagcagagctgctgcctggctcccagtaagctcacagagattgtaaaattagctccgtgcaaaccgtctgatgcagaagtcagtgatctaatgcagaagtcagtcatctgatgagcccctccctctgaggccccggactcaagcagagattctaacccaagtgccttggctatgctgcaacacagaagtgatttaaaaatccctgctatggattttcatgagcagctgatccatgagccagctgggcttttgaaaagctgtgagcgccatgtgagaaaggaccacttctgtatctggtcatcccagtatctccagagtctgccgcagtgcttgacacatggggcatgcacagtgaaaattaacgaatggccaggatgggatggggtcctgccccggaggcatccccccagctgggactgcagagtggtgtttggtctgggggtggtggttggcggtgcggggatgtggcgcagcgtcctgagctggaggaagaccctttcaaccagttctctgtcgttcttcctagtgtgtcactggtgcaccaggaaactgtaaaccctggtctctgagggtctgaagaagaagccccataggagtcttcttatgctaccctggggattccgtggaagatggaacttgccctgcagaacatgaatctctgaaagtttcaggatgacagaggtgttattcttcaggatgatggttggaagaaca

SEQ ID NO: 46205 - DNA, 1504 bp, Bovine  19866880939348
tcaagcatcttgcctcattatcgttgctgaaacttacatagcactgcacagaaatggaataaacaaggggtgagttgtcataaactaataatgactcctggctttgtgtttttctgagagtcttcccacacaagatcttattggatccctacatgtattagttttctattgctgctgtaacaaattactacacatagagaggcttaaaataacctttttttctcttaaagctctgaaagtcagaaattcaaaatgagtcttgcagggctgcatcaaagtgtcagaggggttagggagggttttccttatgaaggctctgggataatctgtttcttccctcttccaacttgtagtccttggtctgtggccctttcttgcaccttcaaggccagtcacacaacatctcctggtctctctctgcttctgtgaccacatcaccttctgtccctctgattctctgcctcttccttacaaagacccctgcaattacaccagacccatctgcataatccaaggtaatctccccatctcaaggtttaattacattcaaattacaaaatttaattacatctgcaaagttccttttgccatatatggtcacacaggtacaggttccaagggtgtgaaaatcttgggggagaggggggcgttgctcaggtaaccacactctaaaaatcctatgaagcaggcacacctgaatcccatttttcagaggagcaaactgagatccagaaggcttcttgactcgcctttgttgggtaagttcattcatgtgtcccaacatttactgagtgtcttctgtgtggcagacagttatatacacagcagaggaaaatctaccttgaggagcttacagctggtaggaacaataaacagttatttaaagactcacatagatacaaatgggcttcctaggtggcaccagtggtaaagaagctgccagtgcaggaggtgccgaagacatgggtttgatccctgggtcaggaagattctctggaagagggcatagcaacccaccccagtattcttgcctggagactcccatggacagaggagcctggtgggctatagtccatagggttgcaaagagtcagacacaactgaagcaacttagcacacacacaggctcatagatacagatatattgtgttgtaaaggaatgggaaggtaggaaagaaaagcagcagaggaatcatcatttagatttgtggggagtaaggccaggggaagcctccctgagaaaacagtgtttatgcgaagacctgaagatgtacgggaggagatagccaaaaagaggggggaacagcatttaattttgagggaacagagaatgaaaattccctggtgttgggaggaatctgtaacagcaggacagacctgcatagtgagaaaacgtcacctctgcctggaagcatttcctgctcctggactatggatcctccctggatttacatgaccccttgcactgtccccttaccagaacaccatgctgacttctctttaa

SEQ ID NO: 46206 - DNA, 1381 bp, Bovine  19866880943103
catcctctgttgtccccttctcctcctgcccctaatccctcccagcatcagagtctttcccaatgagtcaactcttcgcatgaggtggccaaagtactggagtttcagcttcagcatcattccttccaaagaacagccagggctgatctcctctagaatggactggtggatctccttgcagtccaagggactctcaagagtcttctccaataccacagttcaaaagcatcaaatcttcggtgctcagccttcttcaaagtccaacgctcgcatccatacatgactactggaaaaaccatagccttgactagacagacctttgttggcaaagtaatgtctctgcttttgaatatgctctctaggttggtcataacttttcttccaaggagtaagcgtcttttaatttcatggctgcaatcaccatctgcagtgattttggagccccaaaaataaagtctgacactgtttccactgttcccccatctatttcccatgaagtgatgggaccggatgccatgatcttcattttctgaatgttgagctttaagccaactttttcactctcctctttcactttcatcaacaggctttttagcctcttcactttctgcactgtaggggcccacaaattatttttcgagatttgcagtaaattcagttgggcatgagccagctgcatggcccttcctgcaagagtgggatgtcagggtagccctgaggtcatgttccaagcacagatgacagctgtcaggctatggcatggcacagcccaggctggggtttcaactcccccgctcagtgtccccatgtagcagcagtatcacaggacattaataaaatcaattattggataaaaatcactggtttccaatgcttcattttgtgctattagcaggagaatgctgtttcaaaagaagataacagagagagtgtgaaagggagagatcaattacctgataagctggaggggtgcctgagatgaatgtgcatgtgggcacgagtggccccccccttacctgccaagtgtgggctgagtgcctgcactgatgtctgcggtgcctgccctgggctctcctgttaggtgcctggaggacagaagggcatcctggtagtgatgggatgggtggtacccaggcagcttcagatacttgcacagggccaagggtcagtaacacatgaatgaacatctcatccttggtgactatgccagccccggggctccagccctcatggtccaggtcagggcctggtcaatagttttttccagatgcagtgttcttttggctttcttgaacctaaaaggtctgagctttgctgatacagactgcctctcccctagtgggggcagtactagcatccactgggcagtgactatcaaggg

SEQ ID NO: 46207 - DNA, 1545 bp, Bovine  19866880991893
cgacgtatcgaacatgcggtagaaaaggttcgttgtatttcccaaaactggacaatcactgagtatatagaaacttagtcataaaactgtttcttaagtcattgaacagcggtgtggggagcccctcctatgggcaggcactgagcttggcatagcagacacagagatgctcagcgtctggtctccctctgaacacacttgtttagccgtgatggtgccacataccatgattctgagcagtgaggctgggagagcagacacgtgggccagcagagcgtggcgtgtgcccttcaagagatctgtgagctgcagcaggggccgtcttctcccagagggcaggcaggactgggagttcaaaaagcctggaatctactaaccacgaaagtcctgtcttgtgctgcgtgcttagtcgctcatttgtgtccccctctgtgcagccctgtggactgtagcccgccaggctcctctgtccatggggattctctagacaagaacactggaatgagttgccatggcctcccccaggggatcttcgcaacccagagatcgagcctgtcttgtgggactgccccaaagtgcatggtccctctcagtacacggggggtagtggtcccctgagggacaccctcagccaccatcaccccacgagctcacttctcagctcgggggtgccgtttctcctgtggcatcatggaaggaacatctgcatcggccctgaagtaggtttcataggaaattacgcctaccactgcctgtcccgctcctggaaccgctgacaagttctgaaaccgatttcagtgtccctgcctttgctctgcctacaccaatgctggcaaaggcccagatcggttatcccaggctggggcaggagccggagaaggaagcagtagggggctgtttccagcttctctccggttcgcctgggcaggtggggcttggtgcctgctgtggaaagcagcacctgtctttggatgaggggtgggaggcagggtagccatggtttctgtctgtcctgcaggtggaaggggcgtttgtccagggcctgggcctcttcaccctggaggagctacactattcccctgaggggagcctgcacacccgcggccccagcacctacaagatccccgcgtttggcagcatccccacagagttcagggtgtccctgcttcgcgactgccccaacaagaaggccatctatgcctccaaggtactattgccctcggtctgtgctgccttccggtctgcattgtgggaaaccacccgccatgggggtctgcagggagctcgcatggaagagagagagaagggcctggggcagatgatgggcgggcagggctggaggtggggtgaggggggcggtgagcagacctgcctggaagcacagggcactgggttgaggatgacaccacctccctgtcatttaagccagctttcggggtgtactcagagggattccttaggtcagtcttataggtcaagtcctgacctacacccacgtctcaggtgtgcatccttgaggctggtcccagagatgctgtcgcaggt

SEQ ID NO: 46208 - DNA, 807 bp, Bovine  19866881012617
cgggttcttgtttgttatgaaatcagacagtgatagctagcagagccggtaaactgccttgcatgtagttgacactcaagaaatgttagctcccttctctgcacaccatctgtattctatggggttcttgcctgccccgggggctcagctctgctcgtttagtttgaacatcaggactctgggtgagggagttgggggagtccggggcatacactgaggcaagagcagcagctggtgggcgaagggaaggggagtggggaggacgctgtcctgccagggcacagcccagtctcaccccacagtgggtctggcagccaatcagggttctgctgtacatggctcgggttaggacatcccagaggctgtcaggggcttctgacagcttgatggtcattgtcacccctccagtgaagtccacaagggcttcagacacctgtccacgctgcaagtcttcataggagccagagagcctgcccaggaaaggaacagatgtgagagaaggaagagtgtttctactgtacacaggacagtccaaacaagtctaaagaaccccctgcttggttattcccagggcatgtgtctgctatcccttcctcccatcccaggggcaaaaaagaaatatatactcagtttctattcctactgcacaagtccatccatcagggaaaggtaagactccagaaaggttgttccagtggggtgacccttacataagagaccctggatgtgtcacttctgtatttgctgagctaggcctcagtatctcacttgataaacttcccctgcctcctcttgccctccctcaag

SEQ ID NO: 46209 - DNA, 1049 bp, Bovine  19866881070513
acttaccaactccctctgtgtgtaaattccccagtaaacctcctacactagatgatagcaaaaactctccttctcctagagaatctagggaattgctgaggtagcgagtctgttatgtacctgactttgtgatgtggtgcccaggtctcccgtttgctgggagaccttgtggaagggtgcccaggaaaagacagagggatttagggtgtgccgtggagcagagaccatcccccactctccccttgaccccacccctgcctccatctcagcatggaagccaaagagacaggttagactgggggttgggggtgggaaggaagagtagcaaggagaataatgggaatgagaagatctctaggaaaaatgagaacaccccagaaaacagatgcttccatttgtcacaggtactccaagaaaaagccttctagggacaagtgctacttctcactatctaccccgggttctctagcactctgacttaacacaagcagcaagaaggaatgagaaatacagtggggagaatcctgaaatagccctgatttcacacatgttctgtatctgtgtgcccagaagtctagttcggggacatgggaaactatggtcactgtagctccaggggcttctttgttctccatcagaaggatatttctgtctgttcctgcaggagctgcacagcaacccccttttctactctgccaaggccaaacggctggatctgtgccagggattggtaggtaagtctgcacagccccgagacacacctggtacctgccagcccagcccagccaaggcagagtggggtggggaggagggggtttgagagatcccaagagaggaaatggccaccctgagctccatcttgacatgctgtcattttctgggagaatgatcacaaccagtcggttctctgaggatgcatgggaacaccacaccttgcctaacgatcctcctccctaaccagtctccaggtctgggtttcatcttgggaaaatggactcactctaccatagttcctgtaatgagtccttctggcacaccagtcactagat

SEQ ID NO: 46210 - DNA, 942 bp, Bovine  19866881126923
cctggtgctgggggaaagagaaccccacccctctagaaagctgcacccgcaaccagatgggcagcttgacagagttctatgcctctgtgcaaattaggacaaaggtgtcccatcttcccactgggcacagcccagggccagcacacacagctcggccagcaaagccccctacctcctcagctaggtgccccggggaacggctctgcccacagccccgtctttgcctggagaagctgccactttagctgcgaaagcctctggcttccatatacacactcaccttggggcgacttcatctggccaccagcagtcctcccattctcccatctcccctccagcatggtgtacgaccacttctggcccacctcctgagtcagcaggcctgggctcagtttacagatgaccagaagcatgaaatgtgctttaaagtcctgcagtgacatcctgtgcagacaataaaagaaagaaaagaaagtgtagtcgctcagttgcatccgactctttacgaccctatggactgtagcccaccagtctcctctgtccatgggattctctaggcaacaatactggagtgggttgccatttccttctccaggggatcttcccgacccagggatcaaacctgggtctcccgtatcacaggcagatgcgttaccctttgagccaccagggaagcccatggagatgacattcagtcattaggaccagagggaagctgcaactaaggatcaggcacctagccctctccagacccagggccccatcctccatgccctcatgcagacccaggtgagtggggctggctggagcagcgtgagggtccatcaccagcaagtggtgctacggagaaaccctactctgtggctgaaagcagcctccaacaacggctgcctgagggcaatgatcctgtgccactgatggtggtataaagcagaattgggg

SEQ ID NO: 46211 - DNA, 1188 bp, Bovine  19866881238560
ctccccaagcgtccttttctactggaagaagtctgttcttcagacagaaatgacctctctttcctcaacactttatgcaaattattctcatagcaagtatcctcctagtgcgtccttacactacttctaatcttcctccccaacctgtttgcttgctgcctgctgggagctgtcttcatcctcacctttctctttcatgtcttatgtgaagtgagtgcttaataaagatgtgctatagggctgtacagctgtccttttcctttttcttattcatgttttgctgttgacatatgctgcccccattaaattataagttttgtaaagtctgtaactgcctttgtttttttacatccatccttactgtacaatccccattgcatgcatgctcagttactaagttgtgtccagttctttgtgaccccatggactatagcccacccccccgactgcccgtttgtctgttcattggatttcccaggcaagaataccagagtgggtagccattcccttctccggaggatcttcgtgacctagggatcaaacctgtgtctcttgcattgacaggcaggttctttaccactgagccaccagggaagcctacagtcctcatctctctccctctctctctttagtcgctaagtcatgtccaatgcttgcgaccccatggactgtagcctgccaggctcctctgtccatgggattctccaggctagaatactggagtgcattgccatttccttctccaggggaaggaaattcccaacccaggaatcgaacccaggtctcctgcattgcaggcagattctttaccaactgagctatgagggacagtctccatagatggtgtttattatgctaagtgctgaattttccattagcccttgtgtttcaaggttgtacagccctaatggtagaaatacagcaaattggcaattcatcccaggcactctggcctttggtttgtttattcattcattcatttatttatatcccacgtggaaggtacaaatttcaggccacaacagtagggtgcaagaaatgtcacatttctttatttctctaaatcaaatttaatcagtgccaagcttccacctgctgagctggcaggaaattcaatctgtcttttgagaggccccgctcccatcctccctttgaggattgtataaaagcctcagggttttcactagt

SEQ ID NO: 46212 - DNA, 1056 bp, Bovine  19866881290711
taaggtgggagacctgggttcaatcctctgggaagatctcctggaggagggcatggcaacccactccagtattcttgcctggagaatccccatcgacagaggagcctggcgggctacagtccgtggggtcacaaagagttggacatgactgagcaatgaagcactcatggagatacttcgaagggtttcaaagaacggaatgacatgatctgacttgttttttaaagagaactgactgttgtattgaaaacagacattaggagggcaaggatgcaagctgtctgctgacccaccggggaagcccgagatcttttaggagactattgaatgatccagccccaagatgctggtggcttggatcaagatggtagccacagtagaggtggagagaagagtcagatactgggtgtgtttcagagggagggccaggagggcttcgtgatggactggatactgtggaacccaaggttttccccttagcagatggagggatgaaattgccatctaggcgatggaagggctgtgggtggagctgggtccccctcccccacccactgcactggttcccttcctgggaaggaagaggagtggagagaatgtggaagaccacccatcccggtgagatgacagtcgccccttctgttttgaaccttcaataatctttttttcttcaccaattcaaatgctgcctgttcagtaccctcttcaagattcatcccctcctttatgacatctagcttgattaattttacctggctgaaatctcccagttcactccatattcatacagagatatgttttacttaacaggggagtttttaaaaagagaggtgtaagtcacctttaaaaaaaaacattaaagcctggcttatgttcaccaggggaatgacttagagtgctctattattaatgcttttgtaaggtgaagaatccttttgttggatgactatggatctccagtaattttcagttttgaaagatcaggttgaagacatataatactgattgcacacttagatgatatgtctccgtacatgaggcacctgctaggcatct

SEQ ID NO: 46213 - DNA, 1134 bp, Bovine  19866881327414
tgttttcactgcacgcacttgatcttggcgtgggcccgggtgctggtgaccagccggaggaacagctcattctcgtagcgagggatgtcgtcacagtatacggcctccccagaggcttgcatggccgcggccaggtggggcaggggccggcccactgtgtcctccttggactgaccattgggcacctcctggaacaacatggtcacaggtttcagaggacactgttcctctataggccctggggaaccgtggagagcttcaggccaaggcaaatgtgaggagtgagaatggaggaggcaggagagcacaggggcaaggaaacagtaggcaggtaagaagtcacttgaagagtggtcacagtatcactgtacagtcatcagcagtgtctgtgggggactgggtccaggtcaccccccggagagcaaatctacaggtgctcaagtcccttctataaagtggtgtggtccagccggccctctgtatccatggattccacatacacagatgagggctaactgtatacaggaacaaacaaaacaaggagcctaaaggtccatttgttgaaggttgggtaaataaactaggctatgctcacaggatggaaaatacacaattgctaagagatatttttgaggaattttaattagaaggaaatgctcatgttaagtgtaaaaacagggcatacactattgtatgtgtacatgtaatgattcaaattctgtgggaaaaacatggtaaaatgcaaatatgtccatatacacataggaaaaaaatggagagaagtacacaaacatatgggcttccctgatagttcaggtggtaaagaatctgcctgcagtgtaggagactcatattcgatccctgggtcaggaagatcctctagagaatggcaacccactccagtattcttgcccagagaatcccatggacagaggagcctggtgggctacagttcatggggtcacaaagcattggacacaactagcaactaactctctcactgtctcacacaaacataataataattttctcttggaggtaataagcttccctgttggctcagagggtaaagcatctgcctgcaaggtagaagacctgggttctatccctgggtcaggaacatcccctggagaa

SEQ ID NO: 46214 - DNA, 1074 bp, Bovine  19866881336300
tgatgctggacttaggtggccccaggccctgcacttcctctgtcttctttgggtagtgatgtgcgtacatgctgacgtgcatgtacacttgcctagggaggggaaactctacccatgaaaattctacgggaggagctagaactgctatttttttttccaaacatttcctcattttatagtcttaagtgttctgagtgcatacattcataccccctagattcttagaaagagattattactttgaaaattccccagtcattattctttctagaaagccctgtcatctcctctcttgctcatttatccagcaagaaccacttcagtgtatcctcccaacacacacacacacacacacacacacacacacacacacactgtggttcttgggtatgctaggtatggaaggaccgaaatttctaaccctttcaagttgggtgacacaccccacccctcctccaggaagcctcccctgctgcagcctggtcctctctgcacatctcagcggtgctcaggcgccctagttaggtggcgtatgatcatgtacattcctgtcactattgcagacccctgtttcatctgatgtcacaagcaagtcttctagcttcttgagcacaaaaaggaagctgtaaagtcaggaagcttctgtgttagctgctgggttcacctctggcatgatccacttcagcaaactctcccttgagtatatctggttggcaggacttaaaatcacaaggatgtgacttgaaggatgtgaacctggttgccagggagtctgggaattgtagttcttctctttccaacctgtgcactctctgtctaactcaaggcagacaaacacttggtcaatcctcagtgtctatataatcacagaaagaagacaggtcctaagtatttgcctccattagtgcaaagttcttcagcttaaaaagtggcattgaaggaccgggtctggaacattacagcagatgcctcaggcactaaggactttgtgccaatcacctatgccctcagcttcaggtgaccttggttcttgagaaagcagaagctcagtctcctagaagacttacctgtaca

SEQ ID NO: 46215 - DNA, 958 bp, Bovine  19866881366591
attcttgacagctggtaagtgaaggggacccccggacagagtctcctcagagcgtcccagcatcatggacagaacaaagggttgtcctctctactgagggtgagtgagcagagaaagaccccctctgaggaggagggtggaagacatgcccaggggaaggaccccaagcccctcttgctctacttgtcctcggaatagagtgaccacagtcctccaaggacttctgaaggggcagtgacgtcataggcctgttttggggctgatttccaagctcttcaatccataagtcccatgtctggtgtctaagggcccagagcatgtacattgtacccatgcattgggctccttggttcctgggctcatgtgaatgcccagaaagcttctgaacacgcattttcaccttaacaagccttcccagcccaggaagtagaatgctgctgctccaaacaaggacacaggagcccccagagggcccaccccagaactgcacccactcccacgcggctccccccaggctgccctcactcgactttctgaccaaaatttattcagtccagagtgggcgtgtttccaaagaggggtataaagccacaaacagaaacaaagatcatcttttaaacagaaaatttctgactaagccagccaaccccctggccaagaccagtgcttaaataacttggcaccaaaatcaaaagctcaaaagcacatctgttaagctgcttcatgtctttcctcccaccaggcttctgtgagaaatctggaaccccttccctccatccttccctggcctattttctctcgctctgttttccagctgattatctggctcaggaatacgggggtagccttcccttctgttaggttctgaggctgcctctctgttcactaatgggttttgtctccttccccttgttcctgcagcttggcacttctagttttctcttattgctctaattct

SEQ ID NO: 46216 - DNA, 979 bp, Bovine  19866881586005
ctgggtcccggggcggcgagggcgcagcggtcgagccgcccgggggttggtggtccgtggactctgcgagatagtagctggtgggggtcgagtggcagggccggccggcgcttggcgcccgagagaagtctggcggccgcgctgacctccttccttcccgcagctgccaggccggagcaggggaggccggaggcccgggggtgctccgcgcgcgcgtgtgcggcgcgggcgagcgccctgcagcgtcccgggcggctggcgcccgggcccacccagcctgtcgcaacccttgctttataattgtcttcgatctcttcatctgcattggaagttgaaatgaatgtgccctgaacatcactaaagagcctgtaaaaacagacgccttggtattggtggggagttgggaaaatgagagtctaagtggcttttccaactcctgcccaggcggttcatctgagcggagccactgggctctccctgcaggctcagtcttacctttactcagagcccccattcctctgtctcttcttccacagacctggccgtgggacacagaagggggcctcaggggggtttcctgaccagccaggcaacatttatgaaggggtccagagaggtcatccagtaactgtgaaagaccccttggagaagcttatggtcccaagcaggagactgaaaataatggggagagaggggagtaagtacagcgcaaaggaccgactaggtgccaggtacatgtgggtgcttcataaatagttgtaggagttgggtgggattctccttattccatatattaggaaactgattcagtcttgccttatgctactgatttgaactcagacctctgatattcaggatctttccactgtatcaagttgcctctgagattgccttttaactgtctttgggcacttacattctgaaatcttgccagtgcttgattgaattccccaagcatttattgatgatctgctgtgtg

SEQ ID NO: 46217 - DNA, 1130 bp, Bovine  19866880470067
gaaacactggtctatatcatataatatcttttacattggtagattagattactgttcaaaaatattctctatattcatggaaagcgtatatttcccctatcttcaacttgaacttagctctgtcactttcttttgccattgaatattggcaggtataacacaaggaggttgaaatgttgttgtatatctggactccttctctctttactttgtatcattaggagaacggcttcttctgggtcactgttagtctttcatcttgggtaccaaaatgaacagatgtggagcagaccttaggctaaccttaagagacccagctgtacctgcttctagaaacagaatcacccagctaagcacatcctaaatcagctgacctccatgtgacttgtagacatatgagaaataaatcctttttagggtatgctactaggcttccctgatggcttagtggtaaagaatctgcctgccaatgtaggggacacaggttcaaatcctgatccaggaagataccacatgccacggggcaactaagctcatgcaccacgactactgagcccgtgctctagagcccaggagccacaaccacggaagcctgtgtgcctttagagcccacggtctgcaacaagtgaagccactgccatgagaagctctttcactgcaactagagagtagcctctgcttgccgcaaccagagaaaagctcatgcagcaaagaatacccaacacagccaaaaataaataggtaaaaaaaataaacattaaaaaaagaatatgccactaagattttgtagttactacacagcaacagttaactaatatacccaacaaagatagctttcttaaaagtaagatttgtcgccaatcaaacatacctttgaatctgggcttcccaagaggatcagtttctcttgttggacttgagctaaagtcagtgatgttatctgaggatggatgatacaatgaaaaagtagtaaaggctataaatatttataatgcctcctggtcaattgcatgcaactttgatttacatattattataatccatattattcacatttcaaggcctttaactgtgtcctgctgcagctgttctgggagtaacaaattatttaaagattacaacggaaaaaa

SEQ ID NO: 46218 - DNA, 2001 bp, Bovine  19866880565802
aattctgactgtatcacttactatctgtgtaaccttgggaaaatgactgaacctatctttgccttagtttcctcacctcttctaaggggataataataatatccaccactgttatcccccttattgtaaatgtcttaaggatattactcaatttatttacataaaatttgatagttactagctactatgatagtaagcacactaaataaatattagttttcactattatcattgttattgttttaattaataaaaagacatatgccagaatcaacaatatgaagacagacagatactctcattgggactatctgcacatgcaatcatgaaagttcgaattaaagtaataaaatccagatctgtgcttcctagattcatcttacaaaaattccaaatatctttattcataaaagttaatgtatcatttccatgttacccccaaggagagctctttcacatttaatttatctagtattttcatcctccatcaaactctggacgggctaatatgatataaatggttggcctggaatagtcccctcattccaccaatagtcttttagggaaaaaatgaagaggtatgaggggaattactggggctcaaaaacagtcagtttgattgttcttaatatgggcaaatgatgaacacccagaaccaggtaaaacaccagataattgttatctgatcactttctaaataattgtgtattggttttagtcaacaacaaaaattaagatgtatttaaagttagatgccttcagccacacagcataagaagtggtgattttaatttggtgtggttgaatttctacagctcttgagactatatctctatgcccaaatggtaaaataatcagcagattccataaaatattattgcaagaagtcatttgatttctagcagaaaaaaaattatatattcttggctttcatagtggtatttggaagcctgttttagaataaattttattagcctaaaaaaagacagtaaatgaacatcccagctgttagtccatgaagtaaagcaaagtgattgtccttcttgggggtttttcctgcttcactttatacatatacatacatacacgcacacacatatatatgtatttaattatcaaatgtcaactagtccttcccaaaattcaatttttaaactatattaactttaaaagttggacttgaggggcaagtggcagtgttcctaaagggacaagatatactaatatatcttattgactgtctttatgtgtttgatttccagaactgttgtttttccacttctggaattcatattcagaaatgtgtatcctcttatgaaaccattttttaaacacaataaaaaaaatcctgttgattctctaggtgtctcatgctgacactgtacctttgctgagaaattaacaataaagtaaactttgggctgtttatacaaaaatttggcatggtgacaatatttatgtgccaaggggtagagctgaacaacctcaagatggagatgaacaacacttggaagctggtagctcatgtttgatgcattaaaacacctttatgacctccaccccagcaaaccacaagactatggagagacaaggaatttgtgctctgtaatttcatcattacccgagaggttatgaattttatttcatcctcataaatataaaatgagatgacacaagaagtgtcgaggtatgttctaggacacagattttctccatgccgcctcatatttgggacctcctcatgctctcaacactgagcccagctatgttagaagaagctacattccaggctctttcaacatggtaaacatcaagtagtttacaaatagcaagaactacaagctccttaatttgttttctaacttatcatgtctaacaacatgaaacagcaatttatttatgcttgtctgattgcttactttttccaggaaagagatattaggaaaggttgtgagagctaataaaaccacagtattctacttgggaatatttatgaacaat

SEQ ID NO: 46219 - DNA, 1534 bp, Bovine  19866880594910
aatacttggaaaagtcaagccccaggattgccaaactttacacgtggacttaaacctttgttctaatgtcagagctatttattgaagctgtggaataaaaatgaaacatgtttcatattaaacacaatgaatcatgtacatatacctaatggtgaaaattctaaatattgtgaaatgcaaactcccattccaaatttaaaagagatatattaaaaactactttgtttgatatgtgtgttttaatgtatgattgtttcatacagcagttctatagaaaacccagtattgagtagtcctagtaataggacaagaaatatattttttcattctcaatgaatttgctaagtttttataccactcaaatcgtgtttgtattgaaatctaaagcacttctagaatagggggaaaagtcttccagctcttaataaatattttgttctgtgttgttcagtcgttcagtcgcatccaactctttgcgaacacatggactgcagcatgccaggcttcctcgtctttcactgtttccaggagtttgctcaaactcatttgagcaaagtccatcaagtcagtgatgccatccaaccatcacatcctctgctgcccttcctcctgccttcatctttcccagcatcaaggtcttttccagtgagttggctctttgcatcagggggccaaactactggagcttctgcttcagcatcagtccttccaatgaacattcagggttgatttcctttaggattcactaggttttgtgcataaatgaatgaataaaggaaatctaaaattaaaacctaaaaaataatatagcctaaaatttttaaataaaagaaactaaatctttatatttgttagttaagaaggaagatgttagaataagctattaatgtgttgcataatcttcctcagtctctctccagaggctgtgcaagagctgaaatcaggctacaatctagaaaggtgtatccatttatgatccaccccaacctacataaaatggatcatatctctgaaaacttactttatcgttacaactggcatagagcatattatagagaaattatgaaggccttggaaatagtatttcaattaagatactgccaaaatttaattaatagtcacttatgaagacagagtattttaaaattcatcttaggatattcttttacttaattacataggaaaaggaaaaggaacatcttgtgcattttaaacagtctgtgacttgatttaaaggaaatcttcctctaaatttcagtagaaatagtttcttgaactttgaacaacaggacttgaactgagcaggtctacttatacttgattttttttcggtagaaagactgcgatattacaccatatgccattggttgaatagcaaatacagtaccatggatacagtggaattgcctctaaggggcttttcaactgtgcggaaggtcaacaactctaacacccctgagttgtttcagggtcaactgtactctcttagacaagtgcttttcaaactttaatgtgtttacaaatcatttaggga

SEQ ID NO: 46220 - DNA, 1744 bp, Bovine  19866880645886
atactatgttagtaaaggtggtactataattcacagatattgctataatttgcagatatggctacttattcaaggtaagagaccacatttcacttggtggcatttcttataaaaataaaagacctataattaatttttaatacctttcagaatgatgaataaaattaccgattgtttttcctgctgtgagcaacgtgcttaggtttttgacaacaaagtaaagatattagtaacttctgtgtatttaaagcacaccaataagatagagggaaaggaaccatctaaagcaagagaaacaatgttttatcccacaaactcattttgtttgggatcttttaaagataatatgtcatctgttcctactttttaggtgaggttaaagtgataccttgattgatttttctctagattttccaactagtaagtggttgaattgggatttaattatagatctgtttgcttctagagcccatcccccatccctttcacaatattacattgccttttgtccctgtaaaatctgggaatgtagatggatggatgattatttgaaattatttgtatgtgtttcttttatctatgatatgatttagcctctttttgcccctccagggataatacccctcaagctgaatggccctcagcagatgaatccaccacgagcagtatttcaccacttggtttcagctctggccttccttcagccactggcagggaactctggtcagaaagccctttgggtgatttagtgtctacacccaaattagcctttccctcgaaggtgagcctcagttcttccccagaggttttagatgttagcggcttgactcttcattctgtcaccccagcagtgcttcagactgacctgcctgtggcttctgaagaaaggacttctgggtctcactcattagaagatggtaaggaattttaatcacttttcacaatttattgcattagatgacagaggttttgaagagagcaagagactagggttagaagaaagcatggccacattcactgagaggaaatgtcttggaaaagttgtgtgagaaagggaacaattggctttaatgggttggaatggagagtccaaatgggtaaataataagaaatgaatatcttgggtgagatcacctaatagatattttgaagcttctgttaaaggatatataattaaattatattactatttaagaactactctacttgcttgaatattttagtagtaaacaaacagcctcaaagattatgccagtatcttttaataggattaatttggggccaatagagatttttagcttgcattaggcttgagaaggggaaagtctgaactggggaagctgtagcagagattaagaaatgaagtcaagtagatggtttagatgtggcaggagaggacaaatcagtgagactcagggctagagtataggtgaaagaggaagatgaataaagatataaataatgagcccagctttttgaacattgggtgaacctgaagaatggtagacaataaacatagccagaaaatgggaattcaatttctagggaattttcttcctaaggttttactagagtcagtctttgttgtcaatatggctacccagcagttctctgttttcacggggtaaaaaaacccaaagtgtttgaagatgagttattttagtccctgatggttttgttatccacagggaaaggggggtataatcatgagtgactgtaccacatcacaaaaatataatcatcc

SEQ ID NO: 46221 - DNA, 1423 bp, Bovine  19866880659247
tgcagtgattttggagcccagaaaaataaagtcagccctgtttccctgtttccccatctatttgccatgaagtgatgggactagatgccatgatcttaggagcctcaggaagcccaaaatttcttgcactgtccaagtaggcataacacaaactgagtatctttttttaaaatggggtattcaggcagtgactagcatcactgaggcagtaacctgagaagatgagagtttcaactttacaactatcctttcactagacacctgacgctcactgaagtgatagcagttcttcctttcctgtggtcataagaccattgtctaaaatggcaccacaggactactgaaaaccaagaaaaatttactcataacaacagttgtcaatggaacataccctatgtggatagaaaatgagggacagtttttaacagctgattttctcatggtataattgcctagaacactgatgcctacaggtaaacctattattttctaataaattttggtcatttatctctatgacttctgaaacctaccagatgaggagctcagtttacactcttatcaagctctctacatccctcatttctagcactgctatctgtaatcacatcaatcaccaaaggtaataacttcatccatacttattttctaccttgtactgtaattctctatgacagcatgacctgacacataggttgttaattctaattattagccaataaatatatatacatgtgaataaatgaatctccatggaaaaagtaaaagcacattaagatctcattgatgggtccccttggaactgtattataaagtctacttatattttctcaatagacctgagacctattcatcataaaaggcataattaccaattactgacatgtcaaaataatattagcttttgttttacactcttgggtgattagacacattataaaaactgtagctccttggatctaccatggatcatgtcatgtgttgttaacacatgcagaataatgaaccctctcaaagacatccttattgtaaattgcaaaacctgtgaatatatcaagatgtgacaaaagagactttgcagatataattaagccgaagatcttcagatgaaaagtttactttggatttcctgggtgaactctgtgtaatcacaagtgtctttataatatagaggaaggcaggagtgtcagagtcagagaaagagatacaatgatagaaaggtgaaagtcactcagtcatgtctgactttttgcaaccccatggactatacattccatggaattctccaggccagaatactggagtgggtagcctttcccttctccaggggatgttcccaacccagggatcaaacccaggtctccctcattgcagcaggattctttaccagctgagccacaagagaagctctgcttctgtaatg

SEQ ID NO: 46222 - DNA, 2148 bp, Bovine  19866880666453
cctcttgatgaaagtgaaagaggagaataaaacagttggcttaaagctcaacattcagaaaacaaagatcatgtcatctggtcccatcacttcatgggaaatagatggggaaacagtggaaacagtgtcagactttatttctggggactccaaaatcactgcagatggtgattgcagccatgaaattaaaagacactccttggaaggaaagttatgaccaactttgatagcacattgaaaagcagagacattactttgccaacaaaggtccatctagtcaaggctatgattttttccattggttatgtatggatgtgagagtcagactgtgaagaaagctgagcaccaaagaattgatgcttttgaactgtggtgttggagaagactcttgggagtctcttggactgcagggagatccatccagtccatcctaaaggagatgagtcctgggtgttcattggaaggactgatgctgaagctgaaactccagtactttggccacctcatgtgaagagttgactcattggaaaagaccttgatgctgggacggattgggggaaggaggagaaggggatgacagaggatgagatggctggatggcattaccgactcaatggacatgagtttgggtaaactccgggagttggtgatggacagggaggcctgatgtgctgcagtttatggggtcgcaaagagttagacacgactgagagactgaactgaactgaccaaccagagtcccttggactgcaaggaaatccaaccagtccatcctaaaggagatcagtcctgggtgttcattggaagaactgatgttgaagctgaaactccaatactttggccacaagatgtgaagagctgactcattggaaaagaccctgatgctgggaaagattgagggcaggaggagaaggggacaacagaggatgagatggttggatgacatcaccaactcgatggacatgggttggggtggactctgggagttggtgatggacaggggggcctggtgtactgcagttcatgaggctgcaaagaatcagacatgactgagtgactgaactgaactgaaagaccagataagtcagactagggttgggatccaagggtcaaaaattcttaaaggtccccacgtggttccaacatgcagccaaggttgagaatctctaattttggtgcaaatttactctatatggtttaaatttctttcatattaacctataagcctattttctatcatatttaacatttcaagaccttctaattcatatgtcttcttagtctcagaaaatatggttcattaccaagtccaaaattcagagtgggcacatatcctgagctaagtagctagaatgtaaaagtggccatttcagataatcttaagaaagcaggaagtaagttgttttacttaatatttatttcagctattatttaactccatgcttcaaacttcaatataattcatgcaaagctgaaaaagagtcacatgtttttggtgctctgaggagtatagcatcagtaaagtaactgccaccgggcccccccccacccccaccccaggatgatagcttagtgtcactacctaaaagcaaagaattgggctgtttaaaatattagactcatcctctacaaactgctctatgctcccagatttatctataatgtgtatggtcaaaggatgaaagttagcattcagaggaccaaaccaaatactgtgggaagaatgtaaaaaggtctttcttattaccaggtgggcaaaggatcaagcataaacagagactaggggctttccaaagtgtttctcagttatttttctctttgattataaggctgtcttaggctgtgatgtttagagatcagccagctggcctccaaaatcaagggcaagtgctctgggttagaattatgatgccatgaagatctctctccctctcgctggacaaaacaaagtcttgccattttgcactcaagtttctaagttttattttcctctaggactctcccacagttctaaactcacaagtaaatctttcaaaaagtttccctatcccaacttaatcatgcaaaaataaaaccacaagaacaagtctgcagtagaaaagagttactctgcaaagctaaagacacaggaagggattccttaagaca

SEQ ID NO: 46223 - DNA, 1106 bp, Bovine  19866880731470
tacatttttagaaatgtctaaggctcttatttttcttgcatcaataaaataaattgataaattattacatattttagatttaaaaaggaatcacaaaactatacagcaagataaacaacctggtatcaatgtgtaataagggatgccaagaaaagttattattgaacaattaatatatgtccatttaaacaaaatctattctcattgtctataataaaaagatcccaaagcaaaggaatgctgtgtctagtctgtaactattttaagcattaactcttacaaatgtttacctgcatttgtcatgtggcttttgtttccctcctctcctcttccaagcacaccaagccaactttctgtgcttcaaatctagtttataccatccacactccagttttctctggtctgtagacttttcctctgctaagctttggtatttgatatcaatatttgatattaatggccttctacctctcagtgtccccagctctaatgttaactaacaagaccgacttgtcagttcctgtatccccaccagtcagttgcatatttgcaaaccatgactctaggagtctctagtgctgtgtacagaaagccaaagaatgaaaggcaaactagaccctcccttcagatggagaaggatgatgtcatttcactcctttgttatgatttttacactctcagaattcacctgtaatagcactggtggcttaccttgtgtctggttttaggttttctactgtggagaaggtttgatttgttgtttgaatggacttgttcttcccactgaatgacccattttctctggatataacttcatattctgaaaagcaagaaggccaacagacacttgtctttatgctctggcaaactgaatgttcttgaagctaacagcctaaaaagtcactctcataaaagtgagcaactgagattgcaggcctgagacctattgatcatacacatttgcaacttccagatgggagattatcagttgatggtgaaggtgccaaagcatttggggagttgctcatggaccatttttgttttctctctaccagagcaggaaaggcctggtaactgtgtaaagtgatgacactcctggggtagca

SEQ ID NO: 46224 - DNA, 1482 bp, Bovine  19866880827134
atatgtaaggaaatgaagttatctgctttgctccaggtggaaattgctgtagatcctgctagttcgtgtgtgtgtgttccacactgcacactgccttcatttctgccctcttaaattgtagccatcttcatattctacctaaatgttatttattctcacaaatctacctacttaggataattaacctctgttttcaaattaaagtgttccattacagtgggtactatgggctgcccaccgctaacccaccattcggtttcttctctagcaccaactgaaatagattatgtctattccaccgccaaagcaccactcaggccagaggagccagagacagaaggtggtaaaggttttcatgctttgattcttttattcaaaatattttaattagtatctattacttttcatagaatactaaagtccaagctggggtacttgttctaaagttcaatagctttgaagagccatagtttctaaaatccttgaattcctaaaattaaaatgatagttgactctctgaatacagaaataaacttcagtttctctgtggtatctaggtattgaggcataataacacttgacagttaatgacagttaaaacatcaatcttagttgggaggtttaggattatagaataggatgtccctctcagatcgcttttttcttatcctaacgctgttgtcctatctgtaaaaatgtgatgcagattcccaagagaatgaggttgatattcaagaaagagatacttgactgcagctgaacatcttacagtttttaaaattgttctcctttgttttgatacagttgtgggatctattacacatgtgtctgaacccacctgagaccacgctaggtaatgctacaccctggcagcttttgtcctcattgtcaccatcaccagaaaacccatgttctccttcattgtgaatccatgttgcaacatcattcttcatcacagttcattttctttctagatgcttctcttcataaccattgtccaaaaaagtgtcttctctcattcagctttgtatctagatcttggcctcttgctatttcagtcaccaaaactgtcaaacctaaagcatctttttcctaatgttgcacattctgccagtttggtattatgttgaatatttcagataatatatttttgtacaatgatccacttgtaccttctgccctagcaacacacttttcattagcagtcatttcattacgttgatttacttgtttgattttctctttgttaaacaaaattcaatgctgctgaatggcttatgctttaacagtttttattactttgttttatggttactcttgaacacatatttctagcattattgggggaggtactaatatggagtgatgatttaaaaattaaggatattgcttaccttgaaagtcttttataacctggcatctctaagcagtttttaaactaaatacattattaagaagtaggagtggtattcactgcaattt

SEQ ID NO: 46225 - DNA, 1783 bp, Bovine  19866880893528
gcgtccttaggcgtttaagtctttatcccggcagaaaatatttcttagttggaagcagccctgaagtgctgcttagaaacttgctgattttgaatccaaaccccaaccagtggttgagaaagaggcatttgaaatggtcttttatcccacttctctgattcacattttatttaggatattggtacttttaagtaattcttggttatgattcagcagcaaataaatcctgaaatccaagtgattgaacaataagggtttgttttttatttattaatatatcaatcccgcacaaatcagctgagcaagcagagactcagggctctagcttttcaatcatgcaactctagcatcttggatttcttcacttccagttacacagataaaagaaagaggtggggaaggcacattggtcattaactgccctgacgagagagacagagagagagagagagtgtgtgtgtgtgtgtgtgtgtgtgtcctgaaggagtcacattggtctcaccctaactgcagagactgggaaatgtagaaatgtacaaggatgtttagttattattaacagtgtctttcacagtattttattttaaaatttcaaataatgttaaaggacacaaggtttatcacaataggacaaaatttaagaaaggttataaaacactatattagcaaaaagtcatttttcaaacattaatatacttgaaaaaaattctaagaggataagacaaaacagactcttgagatgaagtggggttgaggatgagattaaatagagttgaaagcaagaaacaataccctaacacttaccatcctctgatttccaaaggttctacatgaggccaaaaaaaaaaaaaaaagtggggcctttaaaatgtcccagcagaagttgagagttgcctcaatttgttacaaaattttatttgatttatgctgcttacagtgaacttcaaagagattcatgcccatggttcctaaatgttacataaacacaattttctataaacatcagtctggaactctagcaacctgtacagagttggtagacactcagcagagcaaactggcaaaggactttactctcaagccttcacaattgagcatagctttgtccatttttctacttatttagtagaatgcccatttaatgtttctattttcaggtagcaatgcacattctctatggttttgcacatcggtttagatttctcaaaaacattatgaatttacgagaaagaccattctccaatcatgtccactgcctaatattgtgctctgtatattcagcaggcttctataaatgttacagtttgatttataaatatagtaagtaaaatcagtgggagatacacttgaaatatgattatgctaatgtatatgcatgaaataattttttaaatggagcctcattcctattacttggattaagcgcattagtgccaaaatgtgagataagttactatatcatattttcctgtaagtggccaagaaagatttaagctagaataatgcttaaccaagttatatttttcagatatttttaaaggatgatccttacttctccacttccacaatcaagatggaggaagggaacaatagttttgcactatttaaagagcatttagtattctctttagatcataggtcttcaactttgtttccctatagctctcaatggttttataatgtctagatggcaaactataaaattcttatttgctgttagtgtgaaatcaataattttattcattaaggaatggaacctctgaataaatgattttctgtggct

SEQ ID NO: 46226 - DNA, 2645 bp, Bovine  19866880921768
ccagactggatgctccactgagatgacccctgggggaaaaggagagaccacaaggggaagttcgcttgggccccacaagctcttttcatgttcctattgttgtttttgttgcttagttgttaagttgtgtcctactctttccaaccccatgaactgtatagcccttcaggctcctctgtccatgggattctccagccaagaatactagagagggttgccatttccttctccaggggatcttcccaaccctgggatcaaatgcctgtgattaaatatgatcagctcaactctgtgacctaccttcatgatctgctttcacttgagtaccttcaactctggacctccgtgtccagttgctcaggtttctgtttcaagggcagctgctcgcaaccttaaagtggagagaactagggctgagcagggcaaggacattctggccaaagggtggtgcccagggcaggaatgttcctggctctcgctccgtgaggacctctcagctgtcacaagaggggctcttctcctagaatagcagcgaggttgccaccagcctcgtgttctttgtacccggactgtacttctgggacagctggtccgattgcacatcaccgacattccaagcccggggtgccctgggcctcagggcaccagcagactctctgagaattactgagtgatactcagcctccccccacagtttctaaagatctggatgtgagatgaatctgcaagagaaaaaaatagtaactggaaagcaccttagagattaaattggccagagtcccgcctggtttgcatatttttgtgtgtgtgtctgtgatatgcatttaaaatcactttcctcaactttccactaagtcttctggagaattcaggattttcatttcccacactacgggcatctctggagttttattgtcgtagctgttcttgttggtctgaggtcttccagaaattaacagtaatttacatgcaaatgtccattccagatggacttcttgactcttctgccctacttatatggttgaaagagcctagaattctactttcattcagaaccctagatctgtcttcttagctggccccagtgttggttctagggagagaggccctccttcattacaggctaagaaagtcaaggaggaaagggaagaaaaaaattaccccagaacctgccaccaccattatcagaccagataggaatactaaccaacagtctggggacttccttggagatccagtggttaagactccaagcttccattgcagggggtatgggctaaatccctagttagggaactcagaacccacatgccactcagagcagccaaaaaagaaaacaaagaataagcataataaataatctggtgtgtgcctgttcttttcatctagtaaactcctgctggtcagtcattaaagtcttgtataaacagaatgggcttctttactagtggtaaagaacctgcctgccaatgcaggagatgtaaggactctcaattcctgggtcgagaagatcccttggaggagggcatggcaacccactccagtattcttgtctggggaatcccatggacagaggagactggcggggtacagtccatagcgtcacaaagagtcagacgcaactgagcgactaagcacagcatagtacagaggtctaagtgccatgggtgctggcaaattctaccttctccctgagtgatttctattagtccttttcagttccctcaaagcatgtgtatgtgctggtggttaagactcactctgtcattgagtgaaacttgacttcttcctctgttgttttaggctgacttctgggcctcatctccttaggggctgtgcagcctccaagaataaagccagcattcaagcaatctctctaccccatgtcagctcccatccagagccaaaagaagactattgtctcttcctgtttcaaaaaccttcagaccactaatgaatctcttatccacctatagttttctagaaaccagaagctccatgtttactgtttcagttgcctctccttacccagaacctttgacttattgaccacatagttacatctacctggcatatcctaattaaatgcccatctctcctgtgaaaacttctgtgattgttttagtctttgcttatctcccttcaagagttttgcagtactttagtctctaatacacattttaacagttgtgatctatcttgtgatatttactattagctcaggttagtcttatctgctaactagattgttcacctgcaggaaaagaccttttttcatatctctcacagcttttgtcatactgtcaaaattatataggtactcaatagacacttatttctgttttaacagatctgtttcagaactactcaaatagtgttcagttgtttggaaatcatgttttatgtgcttttaagtttcactctcatattgctcttgaaatattaggccaagaacttgtgttctaatgtatttttatataacattaagcagtagcttaaagaatatcatgaagaatatatactaactttcagtgaggtcatatgtagttcctgtagtcatgaagagttttgaaaatctgttcatcatgggggggactgtgaactggattgcaactcactcacagctgatgggttttgaggacatt

SEQ ID NO: 46227 - DNA, 1916 bp, Bovine  19866881013127
tttcgaatgacaactttttttaacttttgtaaattcacagaaagcaaatagtctctgaggctaggagcaattcatcgcagagagtaggtacaacctttgaactctgctatgaatcctagtatggtcaacatgagactgacctaggtgtttgattttctgattctaatatggaagcttgcattagaaaatctgtttaggcaatatatgttaaaaatatgtgaaaggaatttgttgcatttcttataagttgggtaaaaacctatggttatgtactataatagatcatgtgtgtttaactgtagatgtaccatgactaactatgccagtattgctacaaataaaagtgaccaagaactcatccaagaagcagctgctaaccatactttaatgcctcaactcttagggaacatgaagtctgttactttccatcaaaggcactgctttgggaccccacatggacagactgctagggtttacccctcaaaccatggaataacacatttacccaatttggtctgaggtgcttcagggcttgatgtggttttaggtctgggacgtggacgacgaactcgtgttgttttataagctgaaggaagaaatattggattattattggattattattattctagtgaatgtggtattggaaataaagttctagattttctaaaatatgtttccttgaaatttaaggcatatatttttaagatccaaatgtttttgcctattttgttcattattttatcacagagtcttgaggtaaaacttacacataaaattaagtcaagaagtgaagagtcttataaatctctaattttaaaaaaggtaaggactatcatcaaaccataggtagttcacagtaagaaatgtaaatattcccccaagccatggaactatacattgttatgttttagttcatctagagaagatacagacattcctgactgcatttgaagctcagctttaaaaatgagccccatttagacaaaagtagaacatgatacaaattcaattaagattacacagtagaaaaatactctgacctaatcccaagcataggttttaaaacaataggcaacttcttttagagtcttcaatactgttattgagaaggataatcaagttgcagaacagcagaggatgacaagatagtcttaagaagctagtgataatgtgatgatgatgaggatgataatgatagaatgagttgataatgggcaggaaaaaaatgttgtggaacacagaatatcattacctaatgttgtttctggagccttggttgtatgagtgacaggttcaacgatggtaggaagaactagccaaaaacaataaaataaaccaaagagatttttaaaatgtatttgaagactaatttcagaagctaatttttaagcttcaggacagagagaaaagagacacatacttgttctttgcagatctgaccaaattatggccaatatccattaacctcgtaagacaggttatgcactttgttcaatatcactgtggtcaacaagaagctctagatgtttggttatctgacccttgctagcatggaagactttgctagatgagctttctacacgtttatgaatataaacatgttagacttttctaactactggaaaaagcatttatcagtctatttgcacttctatacaagttgacatataaatgtctactaatttgttcactctttcaataatcgtgggtataataatgaattcacacattcaaaaggataaggatcaatgtaaaaaatgggacatgctcatcaaaatttcaaagtggttcttcattcagtaaaagataagaaactcttaaaccttgttaaataaggagaaataatcagcctattctatcataaaagcccatcatttaaacttttaagatttaggcatgttcaaaaattcgac

SEQ ID NO: 46228 - DNA, 1395 bp, Bovine  19866881020591
aaggaaatggcaacccactccagtattcttgcctggagaagcccagggatgggggagcctggtgggctgccgtctatggggttgcacatagtcggacacaactgaagcgacttagcaggagtactatacacagagaaggcaatggcaccccactccagtactcttgcctggaaaatcccatgcatgcaggaaggctgcagtccatggggtcgctaagagttggacatgaccgagcgacttccctttcacttttcactttcatgcattggagaaggaaatggaaacccactccagtgttcttgcctgcagaatcccagggacaggggagcctggtgggctgccttctatggggtcgcacagagtcggacacgactgaagtgacttagcagcagtactatacacggagaaggcattggcaccccactccagtactcttgcctggaaaatcccatggatggaggagcctggaaggctgcagtccatggggtctctaagagtcggacatgaccgagcgacttccctttcacttttcactttcatgcattggagaaggaaatggaaacccactccagtgttcttgcctggagaatcccagggacgggggagcctggtgggctgctgtctatgaggtcgcacagagtcggacacgactgaagcaacttagcagcagcagcagcagcagcagcagtactatacaagcattttcatttgaagaaacatttcagaggaaatacattaagagcttgtactttgattaattatatgacaattataacttgcttaaactctgcttaacactttctatttttattttcaggtcccctaaggaaaatggcaggtagagtaccttttgacactttctgtactgttgacctaattaggaaatagtttagaaaatatggtagccctaggtctaaaggaacatggctcagttcttttattacttccagtatcactgtccaactttttaaagatcatttggcaaacattatttgttaagagtcatatattaagtattttatactttttcacactacataagctctgtcatatctattcactttggaagtagtgtaagcgatacattgaaaatgaatgagtgtggctgtgttccaataaaacttatttatagatcctgaaatatcgttgtcatatgggtgttcacgtgtcacaaaatgttattttgagttttttcaaccatttaaaaatataaaatccattaactcatggacagtgggcctggagttagctcataggttgtagtttacagacttctatcatagactgctgactaacaagtacttgtattttttaatctcttaatttttattttaaaacttttatttttttgaggtatagttgatttataatactatatatgtttcaggtgtacta

SEQ ID NO: 46229 - DNA, 600 bp, Bovine  19866881024060
ctgctagggataaaaactaaaatttatttggcttaagattcaaaacaaaatttttcacttagcacttaaaaatctgcaaatcagtaacatgtgtaaaatggatttgaattcaaaattatttcaagttaggcaagtttttaagaacaagatacagtttttgaactacaagaattaaaatttccttcccaaagaatagggaactgtcacacacaaatgaacattaatgaacaaatccattactgtgagcctgcttaataaagatgccagcagtcaggaagagaggaaacaaaggtaggtcactcactgcattacctaatgttgttgaagatttagtttctagcattccaggttctaagactgcatgaaaaatgaccaagaaggaatcaaaatccaaggaaaaatgatgaactttattaaaatacgaaaaatgcttaatttttaagtactaagttgagcaaacataaatggtgaaacttttattcatgtaagaaattgcttttctatgtaaatagattactatgtttttagacaaaatgaacaaaaatgcagctggtcatttaagttggaaagagaaagtggaaaaaaaaaaagcatgactct

SEQ ID NO: 46230 - DNA, 968 bp, Bovine  19866881028109
cctccctgtccatcaccaactcctggagttcactgagactcacgtccatcaagtcagtgatgccatccaaccatctcatcctctgtcgtcccccttctcctcaaaaagaaaagcaactatgagttttacagagaaacttgacagtttggaaataaacaaggtgcattgaacatacaagtaaatagcataagaaacctcagcttttactactgagctaaaaaacacatcttaaatccatcatcccaaagcccattgttactacagtcattaatggaagctttgcaagtctttgttgctgtccttataaacacaagagtcacctaaatctcgcaccctagtgttatcccaagtaactcactgattgtacatctcagtcctttccgttcttctgggcaaatgcatctgccattttcccaggtcccgcattcttgcagaactctacaagggtgcttaatgtggagattaacagttcctaatgaaacaataacagagtagtatatgaactggctgattagtttctcttttgggttctatggcctgtaatttacatatgtaaaaccattattttgaataccactgctgaaaaacattctttgtaatatcatcaaaaaatatatacactgagaatctatacagggtatacaaagcttactagatgttatggatacaaaaaaaaaaaaaaacatatttgaaagataacagcatcttgaccaagaagattagaatctactggaggaaaaaggagacttatagatagactgctgctgctgctgctaagtcgcttcagttgagtccgactctgtgcgatcccatagacggcagcccaccaggcttccccgtccctgggattctccaggcaagaacaccggagtgggttgccatttccttctccaatgcatgaaagtgaaaagtgaaagtgaagttgctcagtcgtgtccgactctagtgaccccatggactgcagccta

SEQ ID NO: 46231 - DNA, 2011 bp, Bovine  19866881054059
tggttttctctactttcttccatttaagtatgaatttggcaataaggagttttgctgactgtatagagcttctccatctttggctgcaaagaatataatcaatctgattttggcgttgacccttactacagtcttcggccccagtgtagtagggatcaatttatttcttctcaatggcaagccctttgcccaggagcctagaaagaggaaatgctttcccctcatgccaggctaaggttcatctccttatcctctgccccaagctctgagttttctttagggatattgacagtggtgttattcactgtttgccagaattttatctctctctgtatttgtgtggtttaatccaatatcaaaccacctcaaagacatcagaatactattaccaacagaagttagtttccccaaatctgcatcattcagttctaaattacaagcaatgaagaacaagtctttggagaaaatcttgaacttttctcattcttactacagtctttttctccccaaatgctgccaagcaattgctcaaagaataatacatagaatgttggaaattacatttcagagacaaagaattctaaaatcaaatatttcactctgaaacataatttttcagacttagaactgcaaaaatgtcactctttactaaagtgcataacttctcaccttaaattcactttacttatctggtgaacaactgaggaacaagtgagttcaaattgatttttgctgagtcttcatcttagaaagcaaaagtttccagcaacttttaagatagcactcccctccccatgccgattccatcacctattccccgcctcctcccaaatttcaggcttcagtctaaagccagcatacttcttatataaacacgcatattcaaaacaaatgctttagataaatgaaaagagtatgtaatgcacgcccaagtatcttatttccaaaatggctctgggatccttaatgagttctaatttcctagccttcaccttttacacatccataaaatctgccctgtctcgtaaacgctgttgggaactccttgttcagaaactgattcattcccattccccgcacagtgcctgacaaagcgtaggcgcccaataatgaatgaatgagtttgtagaaggaaggcggggaaaaggttagttttttctagataggactaggagaactacaatggctacaaaacaacaaaaaaacacaaacttggacaaacgcctactcttagctctcagagtccagaagaccaaattacgtcccgcccacgggcgagaaacgggaaatactactgcttaggaaaaccggaagtgcctggtcacgccccgcgcatgcgtccatccgttctgcgtgcacttcctacacttatccagtcatccagtgagaaagcagagactcagacccctgcagaccccggcgtcgttagtccccgccctatcgacgtcgcgcatgcgtcctgggtcggtccgatagctctgaggcggagcgaaaggacagattttcttcttattcccgcccctcttcgttccccacctgccacgtactgggcccgagctctcgctaggcttggtgggtcagtgcgattggtcggggcccgcgcgagtctgccagcgaggtgcggcggccccggagggcaaccgagtgggctgtgaccgcagccttcccccaacgccccaaagcccgacggtggcggcctcgcacggggtcggatcagcggagacccgcggaggggcggcagtggcggcctcgggaagacggtatggccgctggagacggggtcgcggcagatttctccggccaggctggccgggagacgtggaaacgctgcgagggcctcgttcgaaccggcgagcgcggggcgggtggggtcggaggggtcgtgggaaggttctggaggccgaggactgaggccgggccgggcctcgcctcgaggagaagccacggcgggggaggggcggaagtgggggtgccactggccaccgtggcaacgaagcggacctatggggag

SEQ ID NO: 46232 - DNA, 1897 bp, Bovine  19866881111312
ctcaaaccaaaccgggtaaatgtgggtttctcatttaaggactgagtcctcgtggctctggagagtctgggattgatccagcagtgggaatggtagtccatgtgatccctgcgtgggtaaaggcacgaaatggcctgctgctgcttccccctgtcgagttagcaaaggaaaacgtgatgagggggtggcagggactcgtgcgatagctgattactctgctttctacgtaaggatctactcttttatgtactatgtcctttatttgcgttttcttattccattcccttcttcacttaaagacaaaatgtcttaaaccaatcttttttttttttttcaagaaacaaacatgaagtaacttacctgtccccacagcccatcaacagttgtgaggatatcagagaaggcagcgacttcttacttctcagtctggagtagagtcaaattcagaacccgcctcagtgtgaaacattgaaagattgaacctaggcagtatatttgtgcaaacagagttcttttatgcaagggttctaaacatctctcagctgaaagagagaaaagtctgtgaaggacagaagtaagaagtcttaaaatcatggagactgacagacaaaaagaaaggggaagagaccaaccagcgagcacagacttctgaagtgaagggaggttctgcttctcagtggtaatgaagagaactgtgtttggaagggcccataagagtagttgaagaaattccttgaaagtatgactcagaagtttggatctgacccaaaagtatcagtggtctctcctgcaatggtctcttcccccctatacagggtacagcctgtgattagaacagagcacgttaagtgctctactgggcaccacacgctatttgttcttatatcctgatttattgagtgcttttgcctcaaacaaggtctcagcctacttccaaataggtcttctcaacaagatctgtatgcttcacttggcttaattctgttccatgtctataaatacaaaatctacttactgaatacatgcttatatagacatgctattttcttccgattttattgagagaaaattgacatacagcactgtataagtttaaggcatacagcataatgatttgacttgcatgtgtcatgagatgattcccacggtagctttagttgtttagtttaatccatcacctcatatagatagatgaaagcagtaggaaaatgtttttccttatggtgagaacttagacatattgttttcttaaagcttccacagaaaagtcaacagttgtcagaacagttacataagtatatatttggtaaactgtttggataattttcctagatcagtgttctacaatgattggaattaggtacttagatacctaggagaaactcatgttgactttatgaagatatttaccagattgtgtatgctatggctgtctcataaaagaatatctacctggctttaggtgaccaaatcattaaataggaagtatgtgatttcaaaaaaattttcaaattgttatgtacctactgaagcaatattatactggtaagatttaatttgctgacttttcacaagtgtttgtttcattgttttttgactagttcctactacagatcttgaacctggtactcttagaactgaagctccagaaatcgtgggtaatgagcatgtgtgtccttcaaatggtgctcttcctgttcattgtcataccattatagccacaggttctcctgcatcttaaaccatttctaacccctctgttgtcatcctattacaatctttatcgtgtaaatatgctaagctctatgtcatctgttgagtctaagagaactgtgtatatactaatttcaggatgtcggactgctgtgtatctactcgactttgtcatgtgatcatg

SEQ ID NO: 46233 - DNA, 1785 bp, Bovine  19866881150681
cttgcctggagaatcccccatggacagaggaagcctggtgggctgcagtccatggggtcccagagtcacacatgactgagcgactaagtacaacacagcatacctgaaattaaactcaaatttgatacaaactttggccttgtgagccaaatgatttagttgggttcttctgtgtaaacaaaacaaatggcttatctatagagacttgggaattattgctattttaataatatttttcattgtttctttttcaatgaattaaagttcaaacagaattaaacatttttgaatgcctaaaatatttttcgatattgaggatattgaaatttctcatgtgtatgtatctcattattaacttctcagatgttttgtgactaatgtagcatttgaacttttctaggtgaggaaaagaaaaccaaaatagcttggttcattgcctactggtctaacactattaaaatttctcagcctgcatggtgaatttgactcaagcttaagactaggttcttaaaatagaattttataacatttataaagtgttaggaacatctacctgaatgaactacttggaggaaaaatgtcttcttgcctcaaaatttgaagaaataagaaggaagccttcctcacaactgttttatgaaacaaaattagaggtattctctctctctcttttttttttttttttgtatttagaatttaggagctgttgaactgatgaattgtcccctatctattccaaattctaaactataaaataaagaaatgagattgtcctttgagtattccaagcactattcatagaaattttttccttaaatactgaagatatataaaaattcctactggtcatgccattccccggtgtggggtgaatcaaagttgtaagggaagaaaataggtgaggggatataaaaagggaccacagtaagttgaagttgggatagtaggctgttaagtaacagaagctatgaggctgagaaaaaagataaagaatacagggccaggtagcttattactagcagaaaacagacgcaaaggaagactagaggaaacatccaggttcactgctgaggtgccctcaccttccataactccacgactggtatgacctgaggaggcaacaagttcaaaggatggggagcaatcagttagactgtgagtgcatgtgggtgaggacccagggcagaacggcattctcaggcagccagaagagcaggagcagaggtgctgagggaagaagtaattggtgcatttaagggtcttcccaggtggcttaaatggtgaagaatctgcctcccaatgcaggagatgaaagagacacaggttcaatccctgggtcgggaagatcccctggaagaggaaatggctacccactccagtactcttgccttgagaatcccatggacagaggagccttggtgggcttcagcccatgggatcgcaaagtgttgaacacgacttggcacgcacaaacacacacacaccctaaagatcacctgcatgactgggacgtgattgggcaaggagatgcaatcacttacttactttcagagggtaagtaaggcccctgtaggacaccttaaaagatctataagtgtattaaaggcaaactaaattattttcttctactaagctacatatatgcagttttctgagaaatgaataatacaaaatataaacgtatagttataaaaggtatccacatggtaaaaaaccttgcttcacatgcccttagcaaaaagcagcaagacttggtaataaaaaagtatgctgtattttaattaa

SEQ ID NO: 46234 - DNA, 2094 bp, Bovine  19866881171886
tccagaagtaaccatgtaacactgtgtataatttcaagtatttatggattattttcctggtttcctactaagcaagtttcaaatttctaccttactgtttttatactgaaaaaaaaaaaaagactatcaattaagaaacataactattatacttgtcattttaaaaattacttatacaaaaaaagtaattgtagttctccttacttttgctgaaagacatattttgaacatttcctgaagactttttggtttcagaagaattagtaagaatggacacatttctcaccctttccaccccaggaattaattttgttgtatagtcactaaatttatataatctctttgctcgagcatgtgtccttaattatgacacttacagccataaccattatgctaatttttaatacctttctcttaagcatcgaaatgaccccaaaggcctaaaactacacgtagaccagatgtaccagcctgggtaatccctactttcagtattaggaaagcagtgtgtaagtaacactgatcacattcacagctctgccatgactctaattatagcccttttctcttcagattcaaaaccagcaaagcaattactttctaaacccacagcaaaaccagatactccaccacctacatccggtaaacataatttccaatgctttgacttaagatgctttctctttggggatgttgctgagaatgcttacaatttgtcatgttgtaaagcatagaaacctaaatacaatgatttctttgttcattcttctcaaagtagccacactgatgtggctactttgttcatttcatatgttaaatgaacaactcagtgtttgggaaattagtaaattttataacagattgtctgggcttccccagtggctcagtggtaaagaatccacttgccaagcaagagacttgggttcaatccctgggttgggaagatcccctgggaaaggaaatgccaacccactccagtattcttgcctgggaaatcctccggacagaggagcctggcaggctacagtctatgaggttgcaaaagaataggactctatgacttagtgactaaacaacagacaaaattttacatctgattatctaacagattccatttttcttaaagcattttcaggctttctcagtttgtgtttgtaacgaaagcttgtttttctttatgtggaacattttcagagccatttcagcagcaaccactagggaggctgatcttgtgttcctcctttacagtcacatggagactgactttctctaaaataccttacattttaaatggtacctgttaattgattttctaccaaataaaaagatactatgtaacagttctgaaaattcaattgtttttcaattgaagttttcccctaagattccagttagtacaaaattctaacttactaagagagcatctctcataataaataagtccatcaagaaggcaacttatatcaacttagaataaaccagattctgtatcctatgagttaagcatcagtgagaacctaaaagtctagccttccttgcttttgttacttatctctgtttatttttttatggtgcagtttttgagcctgttacatctgagaccgaagcgccagccacaagcataggtaacgatggatgtcttcccttttggtcattgtttctctgaactcacccctctcatctctgtcactgtctgtaatgtcctgtgtaaacagtggtcattcatccacattttcattcattccctaaaattgtttgctattttcaacaggaacctttttcatatcattaggcattcttacatctgcagctcagcttgttacacctgaatgtgaattgtgctttgatcaccttcagagatagatttcttgcagcacttgatgttggcaagagtcacagatgctctctctgtgcatccttcaaaccagggacgttgttgaaatctctgctttcatatgtgtataatttatgatgtgggagagaagcaatgaaaaagctgattggggcttgaaaaagaatacgtaatcacctctttcttggcagaagtcctttcttttgggatttcatactggtccattgtaactggacctttct

SEQ ID NO: 46235 - DNA, 867 bp, Bovine  19866881311675
cacagacacagtcacgactctcacccctccaagctttgtggattagagggctggcattctggttttctatgcctcccaagaggctggtaaaaagggtgtgcagttagcatctaacatccagagctgcctaaaatattagtcaccaggatcaaggcatgttgttaactctttaagggaactgatccaagaaacaggaagatgaactactccctgtaagggaggaaagaaaagtggggaggatgggaagccaagacactgaggttatttttctatgagggttggggtggtttttgtttttaaagaaaaaaagaaaaacttctgagaattacccagtgttgtttctgaaatgtctaatgcactagacacagtgggcttagtggttcttggaactgattcaggagtcactggaagggaaaaaagatgactttacaaattaagataaaatgaaacaactcaggaccatagggtactgctgttgccctttagaattagaactgacatgtatacagaccaattcttttcaagttaattatggtaagggctccctggcttggcccagtgtctgaactgacacctccttccaactattcccttctgggtttgtccactctccaggtatttcaaaaggcacatgggaattgaccctcatggaatcacttaacagattattcataatttcttatgtctttttttctctttatctcctgaacttagcacaaactctggagaataataagcaagcacatgataaatatttattaaatgagttaataaatgggcagctaaaagaatgacccagggcaaaaagatttatttagaactattacattataggaattctcttttccaaactgcagtgaacatgca

SEQ ID NO: 46236 - DNA, 1478 bp, Bovine  19866881364465
caacatgggagcaccgcagtatgtaagacaaatcctaacaagtatgaaaggagaaattaacaataacacaataatagtgggagactttaataccccactcacacttatggatagatcaactaaacagaaaattaacaagggaaaaaaaaaaaaaaaacatgtatctataaagttcactaaagcaaagcacagtaaaatgagggattgcaaatttttatcctctacactgtgagaacaaaaatcttccagagcaaagcttcggaagtgttgaagtcattgtcgtccaccgctgggagagtgaaggtgctgccatcaaagccaaggctgcatgtgaggatgtataacatgatcaggtcatttccagccctaaatgaacgttttaggctgctggagccatctacacttaccgaggagatgtctgagagtgatcaagtaaacccaagcacctagacagtaaaactgttaccttttgtggccctctttttattcagctcactttttccatttccttcctttattatccagtcttctcataaaatctccctcagtatatttttgcttaaagttaagacttagataacacttgttgtttattatcatcaggaatggtggatttggtagtttttctattattcaatagagtcttaccccagtgaaatgaagagttccactcagctttcaagataattcgattatcattgctccctacatcataaagtctgtgtgacaaagtttgataaaaatatagaacctaaaacaaattcttttatgatttaccaaaaaggacatgaagagaaaaatttacccccccagaacaaaatgatttctggtgaacactacaaggagttgcttgtatgtatcatacttctgatctgtgaatatattaaatttgtatgtgcctgtacttttatttccagtcaagaactttgcacttatttaacctctggaaaggcttttttttttttcctgttaaaacaaaaagcatattttatgcccagagcaattgattccatgagaattgggaagtgagacatagaaaaatgagctggttgctaaagcctctatttccttccagttcttgatacatctaaccttttattgatgaaatgacagtgaggctcagaaaatgaaaacttagtcactatcaccccttatgacttctaaaagatccagctgctcatgaggtttcaaacactggaattatgaatggcttcctaaataaaaaatgacctccactgggttggagagcactcccaccggacttcggacttcggagatagagtctttgaaatgctgtgttctgttttgtcacgaacgaggcacctgctgtgagtgcactgagctaagggactaacaaatgtcaagtaagctgtggcataccattctcaccatgcctcaaagaacatgtgttttttatagaaatggttgtaaatgactgtcggatttctaggtgagccaagggcctactccatctgtag

SEQ ID NO: 46237 - DNA, 730 bp, Bovine  19866881389050
ttgcagtattatatacttcggtgatggataggaggagtgttgctttgaaaaagagatttctgagttttgaaccagaccttgaagttattaagagctaattatagagaggcgtttaaatgggttttagatggagaaatgggatggggaaaagacattgacattggcactagccagagtatcaggggaacatgcagtagattgacttgtttggaggggcatgggtttgcaattatgagaaattgaattcaaaaagagagggacagtcttgttgactactttaaatgaaaggttgggaggttaaagaaacatggatctttttcatttcaaaccactgtatattgagttatagcatagccaggttcaaatgatattttgaagcagatttcattgagagctctgtggcaagatggctttggagacaaggagtaaccctgaggcctatttaaaaaaaagtaagaccagacatgagagagccacattatgatttggcctatatttactgtcccgaagagaatattcctgggttactggttttatttgctatgtacaatgttagagcagtgagaagcatcacaaatcatgtagcatagtccttttcatttcacaggttaggaaagtaaattctggagaagtagagtgactttctgagctatgagtttgtaaagtatgtaaaaccaaagtgttaagaataaatttattgaaaatgatagccacataaagctatgaattt

SEQ ID NO: 46238 - DNA, 1615 bp, Bovine  19866881530831
ccgtttccttctcccaatgcatgaaagtgaaaagtgaaagtgaagtcgctcagtcgtgtccgacttttaggtgaccccacggactgaaggcctactgggctcctctgtccatgggattttccaggcaagagtactggaggtggattgccattgccttctccgacttaccccctttagctcagtctaattctgctctgtatatttcctgctgttctttcatcctgtttcatgcctctctcttggctgtcttatccttggctcactatccccagtgaggactccactgtaaggttaacactaaacgtgcccctagttcaagtcactctctccatgacatccaaacttaccgtgggacatctgagggaatttggaagaagggagaagtcacagtcctctgagacctgcccttccaattttgaggtcctctgggcattaagacatacacaattgttaaacctgcaggctttggaagtaggcatgtctggatctgagtcccagctctgccttcctggacaaggaaaagcttagcatcaggagttcacagtgattgtgtgcttgaagcagcagtgggacaccctgtaacaattgtagggttggttgattggtttttaaattttatttatttgtttaattggaagataattactttacaatgtggtgatgctttttgccatacatcagcatgaatcgccccaggtatcatggtggtctcccccatcctgaaccccctgcctcctctctccccaccccgtccctctgggttgtcccagcgcactggctttggatgccctgctttaggcatggaacctacactggtcatctattttacatatgataatatacatgtttcaatgctattctgattggttttaaaagaatgtgtagcttaaaatctttttttgagagggaatataaagacagaatttgactggttcactggttcaaattaagtgaaaatacactaggattcaatccaaaggatttcacttctttccattgcagtttctgagtaaactaaactaatggaaattttgaaggaactgcttctgtcaaatctttggacatttatgggaaaaaactaatgaaagcaataaaacagaggcagatatatgtactaaagatctttccagcaaccgttaaaccagtgtcatggagagcttcatagaaggcaagaaaggactacttccagttttaaaattattttttaagttaaccataactcaaaagctgtatctcttcctcttttcagccagcatatgtcccaagaaagctaatcccagtaacaatcatcaagcaaggtaatttgcatgtctgctctggatatatgcttacaactattttaatatgctttttaaactgagataattaaacatagcacatatttttaaaatatatatttatgcttatttttttgaaaaataactgctctagtaaattagaagttaacagataattttgactctacaaataggccaagtcttggcaaggcatattggttgaacatctggagaaagaacaaccctaacaagtattaaatttaaaaaaaccaattaaatatatgtgggtttcttcaggattaagatcgtttagatgtaggaagtcattaataggatat

SEQ ID NO: 46239 - DNA, 1124 bp, Bovine  19866881650027
ataaatgggtaccagagttcagctagttattacagaaaaagtgctgtttttcataaattatttttaaacattataggattaaaaggattcattttcaagataattttctttcttttcccacatttcttaaatctccattgtttattgaattgcttttggtcagttcctgccacagacattgaacctgtaactctaagaactgaggctcctcggacaacattaggtaatgaccttttgtatcttttaagcaagaacattttctgctcattgtccactctattccattatcatcttggtcaaagggttttctcttttacaagattctttcatcatccttttttgtcactcaactatattcttcattttgaatgtattgaagatgtttaaaataggtcacttggttagaatataagtctgtatgaagctatcatccatattatcccagctttcctaaaactttacagagcctgtggttctgctggattccagataaagttaggagtctcttccctataaacagggcttcccaggtggctcagtggtaaagaatttgcttgccaatgcagcagatgcaggatacacaggttcaatccctgagtcgggaagatcccctggagaaggaaatggcacccactccagtattcttgcctggacagaggagcctggcaggcttcagtccatggtgtcacaaagagtcgaacatgactgagcatgcatgccttataaacatcagatgtaattctatggccagcaacggaaagttgttttaagatatggtatatatgcctaaaccaagtaatttctaagtataatccaaattgatttctaaaccaactaatttctaaatataacacaaagcaggagagtctgggcccctctgtaatgtgatatagaaagttatacttctgatttcccttggatcagggtcctttttgaaaatttggtaccagcaataatagtaaagttttcagataattaaaataaggttatatgttctttctcaaaagaactgtcagcagacacccccacacatttttttgtgtgtagatgaaaaaatttcaaaccagagagacaaatttctcaagactcaagaaaatctagcacaattttagaaaacctacagc

SEQ ID NO: 46240 - DNA, 1288 bp, Bovine  19866881819734
atctctttcttagaggaagtatctctaaccttgtgaagccgaaatctctccctacgacatacctacaaatggccccatgtccaggcatgatgtcacacttcccatcattcaagcagaagttgggctgtaggtcacagagactctgacagggcagatcttccacactcaggtacccagggtagcatctgcactctgcctctccactccagggattgaccaaacactcagaaaattcattgcatgcttgaaacttgcaagggttggcttgatcacctaaaataccaaacaaaccaaagaatggtataaggaaaggcaaaacataggaattggggtataagaagcccctccaataagggtctcccattcaaagtaccatgggacaatccccttcctgaatcactgaaatatatcaccacccacaccacaaaaagtttccgattcgcccttgactgatgatagcttttgtcaaatttctttgaaatgcagagccaaattataggatccagtgacctgggcgagccttgacctgttttatataagaaggatgtagaagatttaaaatctatgtattataggtctaaattaaacagttttcacgtaccattcatttccaccaagcctattctgctgtcgtggtcctctactccgcacatcaggctgcataccctactcctaccctcacctcactgagaacatggcatggagagacagagtatagagaagaactggtggaagcctcagggatgagtacagccacaaaagagcagtctaagaacatttgagatttgtgaaagttaatatcatgaaaacatatcagccccacaccacctcaacagtattttggctttagtaattccaatttcaattcatgggatgagagaaagtaacatttaaaaaaattatttaggacaaaaaccagtcaaaaatgatataaaaactgaccatagatgggccttccatcctatcatggtaaaactgcatattcttcagtggtgaatggcaatctctgaattacaaaaaggcaaatggtaaagaagataccacaaatagaagaaatcactggaaatgacccatgaactcatctatatgaaaaagcataaggtttagctagaagatgaagggaaggttgaaaaacagaaagcatagtctctcagtttccaggtaaattaatgttgctttgagaatcaataacttccttgctgctgtgaaaattcaagacattttgcatgaatctgtgaccttggaatatgtagattctctgcagctaatctttcttggccttatgtag

SEQ ID NO: 46241 - DNA, 1132 bp, Bovine  19866881939735
atgaaaatgtattagtatattttcattaaatactattctgtgaaatattatttttttaagtttattttctaatggaatatttccaaaatcatccaagatgatgggtttatagcacttgaagtataggttttccttttgtagttttagacactgaaatgtctaaatattgatttgatgatcattttgtttctttatttttccagctcccagtaaaacacaatttatttctttgaaacctaaagtccctctcagtccagaagtgacagacagcaaacctggtaattaccctgagctttgtgttgatattatttcaaatgtagggttgaaaaaattttttatgccactctttggaacaaaacttttgattcacactttggtatttgattcatctttccatggaaagagcaaaaatgtgatgaaatgatgtcattagagccagctcctctgatattatcatagcatctctttgagctgtgtggtgtttgattatgtgcatgaccatcacagagaaagcacagaaagagagtggacggaatgattgagaactcctttgtctaggactgtgaaatagtttccaataccaaagttgcttggagttcagatcagccgcctttcagctgagaagtggagaagcctttccatcccctcagaactctgccttgtttggggccttctcagctctcagggtgcatgactagtaaggattgtagtctcctaatgttccacgacttctttctaaactggggctgatttctgaacactgacttttgtttacttctcaggagacattaatttgctgaagaaaagtaggtgttttgttttgttttgttttcagcaaggggttattctatgtatataattaaaaacagataatttcttgcataaggattgcaggacatgttaaataattaaatctttctttttctctatctatacagaatctatacaatagtctgaaatgttgatttatgagagtataaggggaactttgtcacaactcattattgtcataaaaaatttaatgcctgagctttgggaagaatatatttctcactgtaatatggatttttcattaatgtgcatttacagagtaggattattaaagcaaaagattgcttaagtgggcatgatt

SEQ ID NO: 46242 - DNA, 915 bp, Bovine  19866882151033
agggaggaaggaaggaagaagaagaagaagaagaagaaaaaaaaaagccatacattacattaaaaaaaaactttaatggccatttaaaaaagaggtctaatttttataagagactgtagctttctggatggtacaggagagagctacagaaaacaacagacttttcaaaaaaaggtggaagttgtggctactacatgaactgctctgaataaatcagacgtatatttctaaggagtatggagacatttgctaacatttctaagggaggaggaagacatttgctaataacgatacaggaatcactgggtaggaaatatgatacaacacagaactatatcctggctacatatcacactgaatgggaggtatcatgaggaaaaaaaactaatcgtgaaataatttccattctttcttgaagcctaagtatacacatgaacacacacacacacacaccccagcagagcaacaacagaaaaaccaagtttcctacctctctggaaaggtcactgttctcatacatttgtctgatctcttccctgctcagaccagcaatcatctctctgtctgtggagctgtagaagggccgctgaggataggggccctcatactgctcgaggtcggcctcgtaactttcaaacacggggttgtgcttcacggctctttctacggatgagaggccatcacgctgcctgctggagccacaaaaagaaaagtataattgactcaggttcttttctggatgctcagctattcaggagactatttacctggagcaaaattcctgttgaggaagaaaaagagactaattggatacaaatgggagggggagtgactgtggaaaagatccagatcaatctcaaatattatttaccaacttgttatcactataatttcctcaactacttgataagtgcc

SEQ ID NO: 46243 - DNA, 2098 bp, Bovine  19866880642890
tgttgggttgggggtagtgcggtttaatgggaactagtcaattctcctgttcctttatgactggccctttttattgcttctttggcctatggagctaaaagcctgggagcagcagggaagtgcgtctgaaattctactgagtgaaaaatctttcgtggtgtgtggattaaccttcacggggtatctgttagtagctgatgatttccttgcctgtgaatatagctgctataactcgatgtttagagcttgtgctgtggataaaggcccattttcttttttagctacgaccctcaggtgccttttcatatattcattgcaggcagtcttcaagatttttgttgtgagccgcacgattaaatatgactatgaaaagaatacaggttttctcctctctcttctacattcactgagcagtgaactgctctcttttaaagaaatttggtgaagaagttgcattaaaatctttagcttacagtatgttgtcttccctgcccgtgtcctgcagcctgcctatagcaagtgaatccctcataggccattttaaatttgggggttttgtgatctaggtaggtatagttttttcaaagtcagtctcatacaggctttttccagctaccttcaacaggattctggaatggtcctgaaaaaaatggctatttttaaacactaaagcgttttgctcaatggttgtgtgttcttttctcccactgaggcctgggtatatgtgccctgtagtattttcattgggtctgtgtatctgtgagctattttttccttcagtttttccctcctttctttctctttctgctcttatggctgaaggaggttgttgatcagctttcttcaatatctgaaaagattttaaagaagaaagtactgaaaataaacatgtagtttccataatataaaggacttccctgtagctcaaatgataaagaatcagcctgcaatgcaagagaccaggattcgatccctaggttgggaagatcctctggagaagggagtggcaagttactccaatattcttgcctggagaatcccatggacagaggagcctgtgggctacagtctgtggggttgcaaattgtcggacatgactgagagactaacacacccatttccataatataacctcaatagcattgcaagggagatgggtttggagtgggctttttgggttttacttcatgtttttatagaaatacatactcctttgcaataagaacgtattacttgtaatatttttatttttagcaaatcaagctttataagattgaaagatggagtaatgttttctctctttctctttattaagcaaatactgtaatcaccaagttataagataaaatggcaatgtggatatttatcagaatcaagttaaaacttttgagaagcagagtgtttcttcctgcctgctgtattccttcacttctctgaagtcattcttgtgttctctggttcctcctgttcccagcagtgtgtttacacacctaccttggcgcgtgctgccgccctcctcatacctggaggaaatttccctaaggtcagcagccctcacctctgctttgtccgctgtgccttctcagtcagaggactttgcctttgtgtttatttcttccctacgcagccctgagtatgtgtatgtgtgtgtctctgcactcggtcgtctagtcagcagctataggctacccactgccgcattcttgggcttccctggtggctcagacaggaaagaatccgcctgcaatgcaagagacctgggtttgattgctgggttgggaagatcccctggaggaaagcatggcaacccactctaatgttcttgcttggagaatcccacgaacagaggagcctggtgggctacagtccatggggtcacaaacagtgggccacgactgagcaactaaacccagcacactcattaacactggccctgtcccacaagctcttgtctcctggttgccctgccaattcagacttagttccttccttccttttttttaaatgtctattttaaaattgtggtaaaaatcacaaaatataaaatactattttagccatatttaattggtgccagttcagtggcactaagcccatt

SEQ ID NO: 46244 - DNA, 1272 bp, Bovine  19866880647460
tgaagatccttttctggtacccgaggaaattgccatagaaggagggggacttgcgaggctggactcagggtggtgcagagagggcattgctctgagtgttagcatcactgctggggcagcatggggagggtctgaggtccactcttcatgaggaacacccaccaggtgcccaggggctgagttcccttcatcctgtcccagaaggaggtgtccgctcttatctccgacctcatagtgccccgagcccgtgcccctcacctttcccatgtatatgctcagaaaagaatatgatgaattcatttacactcgtgagggctacggaggattcatccgtgcccttcataggcaaggttgccagagagaatacaggacactcggttaaatctgaatttcaaatcaacaatgaataatttttagtttaagtatgagaatattacatgggacatcctaagactaaagtgatgaataatctttaatgtatacgtgccccagttattgcacgggacatacttaaaaaaaaaataggttgtttatctgaaatgatgatttaaccagtgccctgtatttttatctgccaaatctggcagctctatcccagtcaacaaagaaagtacttctcatcaacactccaataaatatccacgtacaggagaaagaaatccacggggctgcagagaaaagcaggaatatctaaacaggcaggaacatggcaaattaagctcctcttcctgcctcaaacagcttgaaggtcatggtgatgacagcccttgagaaactcaacccaaacactcctttttttccagaccaaatcctagtaagttgcaggaaatctcggcttcttttacggttctacccaaagacaccatcttgaatgtagctggcgacgccagggacgtggtttgggatgcggcccagtgcagtttttcccagagctattataaggaagtagtcatgaaacaaaacgaatctgtgtggttgaaaactgcagtgctgacccaaaatatttctaatgtgtggaaccagctggcaagctgagagcctgagaaaacacaaagagctgtctggccgctccgagatgcccagcgcctccaagggtggcttttgctccacgctattagctgtgttccaacaggcagggagccaaggcgggcaactccgggggagatgtattggcagacacaattcggccttgacagcttcatttggaggacaaggaagagtgagagggagggagcactaggggagcagaggccccggcctgcctccaggggg

SEQ ID NO: 46245 - DNA, 1506 bp, Bovine  19866880760506
accttctcctctgactttattaaaaagctaatttctacaaaagagcagggtacttgagaatgccaaaatgacaataaatattaagaaatcataattatggaaggaagtacatgggagctattctcttttgacatgttatatgacacagttccaaaattatgccaaagaatcattataatgaagcctttccttaggattgacctcagtttataaagagcttctgtcattcaaattgtatcagttaactttgaactgaatttaaagtttaacactgacaaacactatgtttttgatgtacttccttaaaaatgttaaatgcaacaataataattagaaaaaatagtatctgttaactagaatgaaagcttgtccaacttcaatcattaaagcatctatatttagtacttaatccaatgagcattctttgtcactgttgtttagagtgaacacagtttttttttatatatataaaatatttgtaagtattggcagaatgcacaggcagtttctgccttttgccatataatctcatatttaataaatgaaaatcaagccagattctatgaggctccatatcaattatataactcaaggtcagaaaaatgtttaaaagaaaaccattatttctattttatgttgagtgagcataatctttctaaattagcttctgtaacatatgtaattagcttctgtaatacatgtaatcatttatttttaaataccatcaaaataaactattcatttctgtattcaaaagagtgattcctttaatggcaaataaaatttcacttcatttaaaaagttcatactagagcataaggtggtaatataacaattgtatattaaacgatgaatatgcctatatcagagtaaaaaggcagaggtacttatgaactaacacctcggtgacaatggaaaatattcttcctctgttgagagaccccaagcagaattttatgttgtatacaactctatttgtgctccttgatatgcttttgcttaaaaaccaagtcctgtcatttacctgatattcctgtattaacaggaggagacaggtttaagctgatatgattctgtatttgcaaggggcttcaaaactggagtgagactgtcaattcctgatcaggtcaaccaagtatttggaggttaaaaaagccagtcaccagaaagaaggcttttgtggttcacataaagtccaatgaaagagtatgatttaggaaggaaataggaatctcagagtttacagcactggaaatcctacaccagatgaaaagaattgaatggtctcagtgtcaggatagggaaaagtttctagtaaaaatctgccaccaatggccacgtgacctgcagcaatcactcaacctctcttgggttcctttccaactaaccgtgggagatggttgacctcataaaaggagaaacattctttataatgacaccattttgagggacatgatttaaaaacacataaaaatgctcagctagaagggatgattaacggcagtg

SEQ ID NO: 46246 - DNA, 2019 bp, Bovine  19866880764426
ctcctaatgactgaaaacactgtgctcttattacccagtttaacagctgcaggtgacaggatggcatgtgacacgccaccagccaatgaaaaccttaacgctcagtctcaaagtcgagcttgtgttttaggataaaggggtccagccaggtctatggaggcccctgccctccaagacgtcaaatcaactttgggaggcaaaccacaggtttgtggaaagttcactaacaattcctaggtatcaaaattaactgccaatcaagtggtacaggaattacaaaaacaaatagcagaaacaaagaacacttcacaaaggaattatgtcccctcaagtgggggacatcttcagacaaaggcgaggaggccaagatgtgcatggcatgattggacagtggggagtaaagcccagacacgacacacacacaccccctcagcaccttgtattcgactcctctcttcacaggcccgggatgcggggagctgagccacacacacaggaactctgggggccaggctgcagaagaggctctctaaacctgagtgggaatcactgacactcaagcccccaacccaaacatcatctccagcttcgtgtttgctctaaacaactatttaagcaagctgtcatccacagaagctgcacgtgtgaacccagttcgagatccaacaagcattttgaaagaccccaaatcacactggttaaaattccaaaactgtaaggattgtgggattatcttgggtaatcttacattctccaacccctcatctctcctctttttaaaatgaaatcctatatgggcttaacagtaaaagtccttcagacaccccctctcagccctgcagcagcacttcctgtttatcaaaagactaacgtgaaaagcaggtcaacaaaactccacaaggaaaacagaaaacccatctgacatgtgctgtgtgagccagagaagcacccccacctttcagtcgccagccccacataccggcggcatcaggcgtgtccagcccagccctctgaccacctcccaccaccatgacagggctctgttcacatcacagcagagcctggactagcacacaggagactcaagcagcataacatcaaacatatccaagcatctgaacaccagagcccattcttaactaaaaatctcccgacaaacaagaggcaaagtccatttggaccaggtgagtgtttgttttgacacaaagcctctctggggcccagctcacagtcacatgacattcctgcaaaaacctgcctccattctggatggaaccccacaccagggtactggcaccaaaatttcagtttatgatgcaagatatgtgggaaacaattgctcccacgggtaaatataaaccaagcgtagactactgacactcgtttttctttttttccccttactttttgggaaaaaaaagtgcctttgaattgatgccattttgtaccttgtcaagaattcttctcaacgcacctaaaataatacctatatatacacatataaatgccactagagtcctaaaaatgtgccgttatttaggaaagcaaaatccattgtaatttaaataagataatttgcctttaaggactgtcactgtcatttaatgagaagtcacaatgttatgaactaagaaagaatttttcagactgatttgagggcacttgacacagtgttgagccccatcacagcagaagggcaatggaagtaccttgagaagggcgatgcattaattctgaatctacagcaaatattcaagcccccttgacaaagcttatgcaaagtaatacgatattgaagcaaacttgactaggttacatataaatcctaagcaaggtccactcttcacaaagaccagtgacaaccaagtgaaatcaattccagggctgaggagactgcattctaaaaataacaatctaaccttcaaattagggttctttctatcctgtatctccatgctggctttgaaaacagtcaaacaactgtggaaagaatacagtgtaaaattaagcccatgtgaa

SEQ ID NO: 46247 - DNA, 1579 bp, Bovine  19866880826908
aactgttagtctgaaatcttgttccacccttgcgcatcctctctgccgctgaagagctgctctgattggttggttccctgaaggccattggaagggtctggggataaaggagaagacaggaaaaagggaaaagaatccacttggtgtgagccataataaagtaagagtatttggggagagtcctgagtgttaatctagttcctttgttgggagaagtgaatagagctctgtagatatggggaaggaaggccagtttctcattgttagaaaaatttctaatacagtgacctgagtttattctagtcaaatatttctgaaccagcaaatgtacttgtttggctctgtagtttcagttattaactgaaggacttcatgattacatgtaagaactgcatgaaaaacacgttgaaagttgttcagtcactttgccttgtgttcaaggaagatggcatttatttaccccagaggaacaaaaattaacatgtattgtcattccagaggagatttggctttagtctcatattcgtcagccaccaaagtatgtaccagaagatgtagcttagtttttgtgttgggtgcacatttgtgttgggttcatgattttatgggaggggtcttgcatggtttggagacaactgtaggcttgactacgtatgtgtgtgtaaaaagttgcagatcatgtcctttcaatttttttgatattctatcgagtaaaattcaggcttcatggatttgtatggacaaaaaatattttggtatatggacatgtcgtaatcaataactaaggaatgtcagattttctatttttatatggaatcagccgaaagaattttgggaactcaaatagctacagtagtgaatatcggagattcttcactgccagtcagcagtaaaggctgtgatgtgatgaaaaaaaaaataagatttgctgatcagacagggtaaagttaacatgggaaaactagttcacctggttggaaggaagagagcaattgaaggataattgctttacagaattttgttgttttctgtcaaacctcaacatgaatcagccataggtatacatatatcccctcccttttgaagctccctcccatctcccgccccatcccacccctctaggttgatacagagcccctgtttgagtttcctgagccatacagcaaattcctgtgggctatctattttacatatggtaatgtaagttttcccgttgctctttccatacatctcaccctctcctcccctctcgacatgaccataagtctattctctctgtctgtttctccattgctgccctgaaaaattcttcagtaccatttttctagattccatgtatgtgcgttagaatatggtatttctctttctgacttacgtcagttcagttcagttcagtcgctcagtcgtgtccaactttttgcgaccccatgaatcgcagcacgccaggcctccctgtccatcaccaactcccggagttcatcactctgtataataggttctaggttcatccacctcatcagaactgactcaaatggggttcctttttatggctgagtaatgtttccattgtgtgtatgta

SEQ ID NO: 46248 - DNA, 1317 bp, Bovine  19866880843196
tgtcccgtgggaggcttctgtagttttcatctttctattcaaaagaaacaaaaaggtgtcttgtaaaaaaccagactttgcaaattaatgatgcacctggtttttctaaagtagcagaaaaaaaaaatgattctacatatttaaaatgttttcccctagtcgatatcaaagagctgattgaggtcacttcctccaggttagacctcagaaatgcagtcacctgcctgggaaagggagtctgatggctgtggccacacaggtaggagcacagtagacagaacaacacactctaccctcctctggggtcaacctctgcagggaaatacttctatactagactttcatcatcactcaatcatggcatttctcttttcttcttctttccaatcttagaataatgttgtaagatgttttctataatttaccaaaaacatttagaacagaagatgaatgaatttgctctttatttagatcctcatagtttcaggaatttgggtaagagattgaagactctgggctcttcagttacctccttcacaagctagttgtaaacattaattcaaatagtgagagaagaaaaaaattagcctatcccaacacatggtacataatcagatcagatcagatcagtcgctcagtcgtgtccgactctttgcgaccccatgaatcgcagacacattatttgttcaccccaacatacttgagatgagatgtctttgattgataaatatttatttaatataccccagagcagccaaggtatttctttcaaataataatttataacaacttgctttggctttagagctttggcttaatctcaatgttctgaaaagatatgagaaggctaggataaggtaggaaaattgagcatttcagttcaatagctaaatctaagtatcttctaaaagaacaaatttaaaatgttagcctcacttcagctaacttacatcagtgccccacattaaatacccaaatattttccttaaaaactttgttgagggtagtctggctgtaaaaatcttcatacacatgattgattcttattcttcattacttaaaccacattagcaacaaacacacacatagaaacaaaaagtgtaacataataggattgattgtatagaccttggaataaaccaggatactgttttctgttccatcagaggataaaacttaaaaatgaactggtcatcctgaacctaggccaatattgtgacttttgaaaaacaatttaatctataattataattacagtataaactgtagcgtgaaatagctacagtataaactgtagcgtgaaactttttaactttt

SEQ ID NO: 46249 - DNA, 1270 bp, Bovine  19866880847914
tttcgtaagaaaaaaaaaaacagaagaatggcctccaagcctttacatctatgtccccctcggccatgtcctatctgaactcagcacccttcgatctagtcaccctgctttccagctgttcctcatgcactgtgtcctcctctcttgcaggaggccttccctgaccaccctactggggttgcacccttccttccccccacactccccctccattcgccggctctgatttatccacagcactgtcaccatctaacactgctacggttcacttggttattgcccgtcctccgccactaggctgtgtcccgggagagtaggaattgttttctctgttgtgcatcactgtggccccagactgagaccaggcctgctctagagtggcacccactccataaagatttgttgaatagctgcactgatgaatgaatatctgtttctttacctttttttccagaaaactcaatcttttgaaataaagcagtctttaacattggtttacataaccacctttaagaaagatttttgccctttagagagtaattaactgcacagctcatgagctaggtgaacccaggcagccggagccacagggccaccttgcagccacatactcttcattgcagggaaatcctgtaaagaaaaagaaatgtcttgaaagcggtgtttgtaaacctgaaagaaaaataacattctagcagtattctttaaaaagtaaaggttgggaatttttaaggatgcttttaaaggcaaattactcggggtgcttggttcatttagaagagacctcatcctttctaccatccatctggcaccagaaaagccatcattcttggggacatggggagtttccattcttccagggttgggatgatccttggagaaacagtatgtggactccttgggacttactggcaggaaaaaaggaaaattatctggaacaacagtggttccagtgtcctgccagggtccacgtggatctgctaatagcccctgcccaggatgcaagtcacaggcagcctgacctgggccttcatcctccaccaagccctctccggccccaggagggagcctgccacttgtgatgcagccaagaactgctactggcaccccgtgttctgatggcttttgcagagactgctgacatgtttttcagaatgtcagaatctcctcttccagggaaagccttctacagaacagatttaaaatcatatcaagtcataaaaaatattctttctgacaaagaggcaggaggagccaggggctgcctgac

SEQ ID NO: 46250 - DNA, 1523 bp, Bovine  19866880902035
tatatatatgtatacattatcaccctgtttatctcacaagcatctcctctgattaaaaatagacattctacagatcagggtcagcaaacatttttctaaaaatgtacagagactaaatatttttggagctgtgcaagtcatatagtctctgtcacaacattctactttgcattctatcatgaaaatagccattcacaaaacataaataaatgacagtgactgtgtttaaataaaattttatttacaaagcagataatgaaccaaacttaacccatgggccatagtttgatgattctgcactagattgctcatccctctcataacatccaatttaaaaatttccgtgtgggaaataaaactaaaagtcaaggttccttggtaaccctgctaagctacgaatattcatttcaagctcttcatcgggattttgaatttctgtacttgattttaatttcatcagacttcttacaaggtgtgtggcttcatatgcattttgaagatattaagttttgacattttggcgcttaattggaagcaaatgaaattcaagttttgttattaacttttcacaatgatgtgttctcctaagaataaagtcctttctgcaaacggaaaatggagattgaaaattacagagaacaagtccttaaatgccacacatgatggaagaacttacacacgtatattagtttcaataattatctccagcatttttagaaaacacaagtattataaaatctggactgtgtcatgaacaaatgctgtttgaatttcagtggcagaatcacagttggtgatttgcaatatgccaaaaacatacaattctacagctctcttttaaaccgaaatttaaatgccaggtgcagatataaagtaattttgtgttaaattgggaaggatatataattttagaaaatctactctacaagaatacacagtagcacagcaaaagaaaacaagaccttcacagaaacatcacatattaaaaaactctatcgtgcccttcaaaaaataaaggaaacgtcttgctcttcaatttgtgaaacatgactcaaacccatattttaacagatggaaccttcactgctgcccatgaagtagactgtttttgaaagttcatttttaatttcgacagttattatttcatcactcttgtgatccattcacccaaaaagtatccacaagaaaagagagaatttaggataacagccatgacgaaagtgaaagtgacggatgctcagtcatgtccgactctgcgaccctgtggactgtagcccaacgggcttctctgtccctggaaacacctaagatgacccacctataaataaaactccgaacttggccacatatttccacctcccttggaacaagtcatttcagctgcctgagacaccagaaccttacagcagaaaacccatgtcataaacattgcatgcaaatgcatatgtaaaccacttgaggatcgagggtggcctcttttagaataaaaaactgcaggagcaaagggataaggacatagaacc

SEQ ID NO: 46251 - DNA, 1393 bp, Bovine  19866880918818
atgctgcatgtgggatcttagttcctcagccaaggatcaaacctgcgtctcctgtatccactggaccaccagggaaatccctatacttgtctaacatcatgacttctgaggcagtcgaatcctattttttctcctctatcccttaaaatagacaaaagtatttgatattattgagtcagtgggcagcacagaaatgaggatgtgcctagtaattatatacatcaattacatgcctagtaattatatacatcaataagcaaaaggaccatccctcctagggatgaccatggaaggctttagtgacaattaacacaaaccatgtgaagcattatagccgaattttcttactgccctttctctggggtcttttatgaatctgtcagcaaaatgatatttcattgttgtggctttgagctacactcaagtccacgtgataatagcttatctttgaatgagttttttggttcagcatagagaaagaactgccatataaaggagaaacccaccacttgaaatcctcagatgctgtcacatttactgctgcattttatgtctttttctgaatgtgaaagtgatgacaaagtaaggattaaatatttgtaatattcatcataggtacaaaagcctttaagtcgacactgtgatgaggaattatgaaggcagtcataggaatagatctgtttggggccttaagaagctctgtactggtgaaaataaatgaataacgaacagggccggagtgtggcattaatatccctaaggggattcataaaatggtgaggacttgtatgattttgctgtggggaatgtgcaggagttggaaaagaatatgaatgaagggttatccaaacaagaatggcagctgttctgaatcacagcagaaaatgtaagcttttccagtctgacaatatctccctaatccttgatgaaaatgttatgaaaacaaaagggcaataaggcaggattaataactggaattttaataacgctgggggggcgaccaggatatggttacattctttaaagaatcagctgtcagtcctgcagacaaagttgcgaagtatgctagtgtattgtttcctgagtctgaaattagtttactaggtatattgatagggcagaattaattatgttatggtttaagaatatttagttattttaagatgcttattaactcacagacttatttgacatattcaattgtgtatgtttacagttcgctgcacaattgtggaaggttaaatatgtcaaatggctaaactttgcatttcttcactgacagaatatccttttattcaatccatgaattgatttaggaaacataacagacaatgtttgtaaggtgaaaaaggcaaaaacagcatattctaatattagtgacaatgtaatttca

SEQ ID NO: 46252 - DNA, 1591 bp, Bovine  19866881018443
gagttcagtgtcgtaaggaagaaatgcgttactgaagtaatgtgtcagtaaatataaaattacactaatgtgccacaaagaaaagggatatggtacaatgagagtgtacacaggtcttgactcagggggtgttagggaaagctttcttgagcaggtgttctttcagctaagagccagaagttgcggagggattaaatggaagcttgagggcgtgtatgaataaattaattagtttgtgatttgatttagtatgttattaggtttggctgtatctgtacccttcaccgtttaaattccttcatagcctcaacgttaagactattcccacagtttgcatgaaaaggtatttttgtgcattgcatcagagttgaacgaagtgctcctggtgagaagagcatttttatcatccgcctctctcccacaggtgattagccagtcaagagctcggtttaaccctagtatcagcatgattaagaagtgtattgaagtcctgatagacaaacagtacatcgaacgcagccaggcgtccgcagatgagtacagctacgtcgcctgacgcggcgtcctccagcgttggtgtgagaggtcgttgccgtcagcgtccggtgtgtccccgtgggagaaggcaggcctgtgcctccataatttggtcatttggcagcccctgtttctctgctgtttacaacatcaccagtgccacgtcatgagcgtcagagaagatgcctagagatatttcaagctcatgtcattatgacatttcttaaaactttattaaaaaaaaggatgagtgaagtattgctgaaatgtggaaatccggctgggtaccatgctttttctccccttcacgtttgcagttgatgtgtttgtttttttttttttaatgtatcttaaaggacataagattaaaaaaaaaaaaaacctaaatattgtaatatgacagataacctaataattgtatctacattaaaatgacaaacatgatattgctgcttgtcaaataaaaaaataaagaaatagaatgccttttttatgtggatggagtatcacaatgctcagaaatgtccgtgagtcctcgtgttcctgtttaaatcctacatgaaaacgtctcagttattgtttctgaatgccttcagcgtaaaggatgcgttcagcataagtgatgctttctttttatggattagaactacattggatgtgaggctcgtgaggagtgaggctgtgattctgttcgagtttctggtggtgtcctgctgcagcgcagaaccatgagcgaggggactgaggggaccccgcgtctggcttagaaagcgccgtcattcccaggctgtgttactcctgtctccgaggtgcatcagttctaatgaggtctgacgcccctctgctccttccctcccgcttcctcggggtcggaggtcatcctgcggtaccggtaccggtgtctgcctgtgcgttccccccgtacccctgcctgcctgttactctccacctccttccactttaacactagattcgctcctacatcacagatactcttagcaatgcataacctaaatactttttttttctgtatagtgcagtacaccaggtgccg

SEQ ID NO: 46253 - DNA, 643 bp, Bovine  19866881019644
aatttaaagtgaaaataaattaaaagaatcctgaacctgataggggtaaattatctcatgatttttattaatatggatcaagccaccctagttgagatttaatcttttataattaaaaatttattactttataattaaaataatccagaggactgctggtaccagtgccccagtccctgcagtgagccactgctgacccacgcctctagaggagaccctccaacactagtagatttcaacactaaacttgcacaatggctttgaaaccaagagtcgtagattttgaggaatcctgaaacaaactctttacaataatcaaaattgtagtcatgttggagtacggaaagagagcaacgtggaacaatctcttctcgtatccttcaatggcactgacacctccatccatcagagagataggttcataagcttgttggaaaatgagaacaggtttaaggttttctaagtggaagaaaattccagtgtgacactttgcaaatatattattgttcacatttctaagttcattgtccatatgtagcagtcaaaaatctttgctaaccttttatgcaataaacacgtttactgagcacttaaataattattcctttaagggccaccttacctttaatttaaattgaaaaat

SEQ ID NO: 46254 - DNA, 2048 bp, Bovine  19866881019700
tgagagatgttccgaaacacacatccttcagaaagtatccaaataaatatcacatatttgagctgggtctgaactgtatgaaggaagttgttctgaagaacttcttctgtaatgttaaaagcacaattcttcccctagtagtggtgtggatattaccactgcttcttaatggagctcaaaaataaccattctacaaaagaccactggagggcacacataacccagggcccttgtccaaaaataaatgatgaagtaaaaagaaaatcacattctatgtgagatgttagttgactttttattcaattattactgttctttggtaactgaaagggagctccaaaaatattaacattaagaggaggaatcttttcaatcctaatagacaatactattttaaaaattctatgtactattctatgtactattttgggcttccctggaatccgcctacaatgcaagagacctgggtttgatccctggattgggaagatcccctataggaggtcatggcaacccactccggtattcttgcctggagaatccccatggacagaggagcttggctgactacagttcatggggtcacaaagaggtggacatgactgagcgactaagcacagcacagcacacagcacacatgtattcttttaacagctgttaagttacagtataacacatagatagtaaaactaaacaagaaagcacacagccagaatcgcttcctatcattttttatattcccaaggagtagcctccaattatttttttaatataaaaaatattcttttaatttaagtttaattccatatagtcctatagaacaatattcctatgaaagtatataaacactaatttgcattcagtgtaatattttgtttatgcacaaaagtcaactaatcctttcagtgagatgttttggtactatgagagtcttcattgaaacaaacttttaggagaagaattcatattaggaatcagaatcttctgataccatgacaactttgtgttgtaacagtgaataatttaaacccatgtaataaatgaacacacacaaataatacacatccattaactgatggatggcgcagaaaatagcaatgtttttgaaaccttgaaagaattttcaaattaaattttcaaatcaaattttcaaagcttttctcaaaagtttcaactactttcgactccaaaggaaacttgaagagatcagaaatttctgtaccaacctgccttttgctgatttctgaagtggctcttttaaggttcaatgaccttgaaaatctcagggccttcactgaatctttccgagaggttccagaaaaggagtaatatctctttgcaggtttccttgtcaatctgtctgccatctcagtccatcagaaggcaaaaatccacagtgactcaggttccaaaactaactacaggaaaaaacaaaaatgatcccccaaacccagatataagccctgtgtttcgctcagtcctctagaaagggcaacaaatgagagacaggtgggaaacacaggaaagaaccctttccatatatgtaagcccccaggaagacgagagctttgcatagggcagggagaccaagcacacggcttcctctgcaccagacgaaaacaccctccaccagttaaacagtccagaagtacttgtcaggagtgacacagggtgtaacaacacacctaggagtcagcaaggtgtgagtaaacacagcaggttcagagaagtctctttaactcattccttgccaaaacagacagctggtgccaggataggacggagccccaacccctacttcaaaggcagagccctcttaattagcaaacactgttttctaaactcctcgaacattctcttcttccaatgaatgagaactgaagagatccaatgctcaaatacttttacccagaaaagtataggacaaaagagtcacaggagaaatgaacaggagtctggaatacctgtcctctgccccagaaaggagaggagggtgttttacatcctttccaaaggcagcatcataccttcagcttgtctcaagtcca

SEQ ID NO: 46255 - DNA, 1045 bp, Bovine  19866881096935
ccgggtcccttcaaccaaggggtatatgttaaaggagactagagatgaaggtatgattttattatttatattttcgtattgaaatgtgcacagtaatgtttttcgcttagtgctttattggcttctctggtagctcagctggtaaagaatccacctgcaatgcaggagaccctggttctattcctaggtcaggaagatctgctggagaaggaataggttacccactccaagattcttgggcttcccttgtggctcagttgataaagaatctaccttcaatgcgggagacctgggttcgatccctgggttgggaagatcccctggtaaagggagcagctacccagttcagtattctggcctggagaactctggacagagggaggagcccgcaggctacagtccatggtatcacaaggagtctgacatgactgagcaactttcacttgtatttataaagttcaaattgatatcattcaaaacagtaatttctgaatttatgcaaaaagtcagatttgcaggactgcggtttggccgtgaaaaccacagaccgagttgtaagtgaaaagggctggtctgatatttgcataatctttattaggagcttttattttgcgttttcttatctataaaatgagtaaatatactctgtgggctctaatgtctttttctaacatgaattttctttttgcttttttattgtagtgatagccaagtaagttaggttgtcgtagctgaaaataatttgattccttttttcttttttacagtttgaattattttacagccagcatttcagtggaaggaaacttacatggttacactatctttgtacaggtaaaatgcatttaattatatctagtttaatgaaatttacctgataatgattatgttaaaattttggacagagatttcttagagcctaattatagttgtctttttttttcttttctaattatagtttttaaccttttcttcttcatctacctttctggttacccttaaagcaacaataaagaagtccacatgcagcacttttaatagtgtg

SEQ ID NO: 46256 - DNA, 1625 bp, Bovine  19866881134463
gctacaacattttgataggctctcatcagctcatgtgttccttgcctccagcccagacctctgaatgcatgaatgcatcctctgcatatcactcacaacacctttactaaagtacatgtcagacgtcacaactcggagaggttgatccggtggggtcacaagacatcagattaagccctggcacctctccacccaatgctgagatccagttggagtgctctgaagtgaccagaggccacagacccctccatcccttcttgtccattgtcttgaccactctaagagcctggagggcacctccttctctaagaagtccctaggttctgaaagcatagtgaatccatgccttgtgttaatttcactgattagaaccagtgctctcttacccctctcccttgttaatctcagaggttccacccttagatcccagcccagcaaatgtttgctaaaatgttgttgtatgaataaatgtgactacccatctatctccatcctttcacattgactgtctcaagtattataagggcaacctttttagcaaagaaaaaacaattacagatattagatggccagagaagacaaaaaaaaaaaaaaggtggggggtggggggggtggtttctactaggagaagctcaaagaattatgaactgatatattagtgataaactctctcgtccagaatctcatcaacattctactaactatttattattaactttgtactattgttcttcactcagtgtttgctctcctctgagaatatttgagcccgagtaaatctaaattcttcatatataattttatatgtatatctatcaaatcccttatatgacttccactgtaccaatttagttcaaccaccatgtaaattaaattttgaaattatcagcttcacctgacaagttatttgtctttcaaaattgatgttacctattgatggtttcggagatactctctaaatgcgcactgccctttctcctttgacatttgtcttctattattttattaaggattcaagtaactcagtaactgtcaagttaacttttgattagaattattctcccattcctttattattttaacctttatttcataatactctacaaaagtgtaatatttttctcctaaccagggaccagcgtttcacctatttcatgagccaactttctcttctttaagaatgtaatcttttctattatttaaggaaagtacaactttctgttatataaggaaggtcctctatgtaagtagactttataattatttcacgagcacattaaccatcatcagctacttcacaatgacaaggaactccttaagtgttttttttttttaatgtggattatttttaaaatctttattgaatttgttataattttgcttctgttttatgtttttgtttcttggccacaaggcacatgggatcttagctgcccaacaagggatcaaacccataccccctacattggaaggcaaagtcttaaccactggaccatgagggaatttcttagctggaagggccagctaagaagcaaagcccttcttagcgctcaggtggtaaacctccaccagagtcgctacacatcattatgctcatatatagaattcttcatcttgaatttgaa

SEQ ID NO: 46257 - DNA, 1911 bp, Bovine  19866881251737
ttctgtctccttaatataaagacatttaaaaatgtatgaatgtttttatacggttggattcttttagaggggaaaggtttcagctggaaaatgcattgacatggatatcgtcagacattttctcagtacaaataaaaatcatttaatactatgtcagatataaaagacatgcaaatgccaaatcagtgatgatgaccttcactcttgtaaacctgcactgtatttaggtcaatgaaaccaccagtgaatatcgtcagtcagaacttggtgagatctggtttcatgcagtcacatgcacgcacgcacaggtttgtttgcttatgtcagtcatgggacagcagcagctgaatggcagtggtagttaatgtggcattttataaacacataaatgaatcagaaaaaagtaaattattctcaaagagtgaccatctgtaaataatgtcacgtccattgcatgacattattcaatacctatgaataggaaaaaataggacaaaggccactgattgaatgagactagacaaaaaaagtccaaatgggagactggaagagggcctagaaccttcccagcccttgacttcatcttcagccttgggactgaatttgcaaatctcttctctgcctcttccctgtttcagtattatattttcaggataactttttgtgacattccaacctttggaattaaaaggatatttatacttctataacaaaataatcttactttgaaaaaaaaatggatgcagaaagcacagcaaaacttaataaattcacattgagtaggagaaagacctaaccaaattagtggcctgaattatagaatctttaaaaaatttaatagtaatttaattactttcagattcatggagttccttggagaaatcgctttggtaagtagctaagaaaaatttacaaatagcacatcagtgggtaaataaagcaatatttctaaagaatccaccatggactaggatttttaagtggttttgctccctgaagtatatgcacgttatgaatttgccttgcaaaaaaatgattctctatgagacataggagagatattcctgatttttaaattatttgtggtatttggaagtccttcatttactcattcgttcttgcattcactcactaagcaaacgggaggtcattgtactggggacccagtggcgagttcaacgtagcccccgctgtctacatcctgtgggctggagttaaggaagtacattttaatgaataaatatgtagttaccaattatgctaaggatgtaatcacagtgcagaaatactttaggaagaaagagatttctttgacatgatgccatttgggccgaatcccgaaggatagagagaggtcagatgcggagaacagaacaatctgggcagagggagctgcatgagctggtgagaggcagggaaatggtcagtgtgttccagaaactagaaggaagccaaggtgatctgggatgaaattggaaaggtgtgtggaaattgaatctatccaggcaaggcttatgagatgagctttgttcagtgtcatgagggagttattatagagtttttaattattttaacttacttatgtatttattggtcatgccacacaatttgtgggatcttagttcccagaccagggattgaactgagaccctcaacaataagagtgccaagtcctaatggctggaactccaaggaattgcctagtgtttttacctcgtgagcacaatcgggtttataatttttaaatacaccaatggctgctctgtgcaaagtagattatagggtgggtatatcaggtgtcgtcaggaaaacagaaaccacactagacttttcaaacagtaaggggcctgatgacacagggggtacagaggaaaaagacaacacagaagtttctagcgataacaaggtgca

SEQ ID NO: 46258 - DNA, 2022 bp, Bovine  19866881277027
tttagtgccaaaaccccaagctgcttcagggaaacaagagcctgaaaactagcactacgtcacatggaatcgccgcatacatactgtattgccccgtgctagtctgatatatgctagtcggcactgccatagcagcgatgttaggcggtgttccctcttcctctgatttttcttcttcaatcttgggtacaccaggcacatcagaggaaagttcattcagtatttttctaaaatataattcaacaatacaaagaattaagatacatgagtgagatttaaaacagaaaagctatcacaggagaatctgaggtatctttatttctccctttttggaaaaacttttcatgactgtaggaaacttaacttacctgtaagagggtcttcgtgaaaggatttctctacgtttatgagaatcaattacaccttctgattctgcagactcatctgtttctgcaatggttgctacctataacacaagaattcctgagatgcatcataaaacccatgggatctccttcattcacaacccggtgtctgaaggggctctgcgtgcagcacaaagccggcactgccaacagagcacactgagccgggctagccgtgctcacaacctggctcaggacaggaagtgcagacactgacacttggctgtaaaccagcctgtctgccaaggatgacacagacgacatgtgctacagaaacgcacagtgccagacaggcttcaggaaaacactgaatgtaagacacacaaggcctaagccccagccctgaaaatgtctcacaaatccagcagagggtgagctagcaagtgacagaggagcaaacaccactgctgacttaggctgggtcttcaaattacacattagatagacccagagaagaaagaatattaagtaggtaaacacttgtgttaacaagcctggttaaagttatgatttatattacaacaagtaggttgggcttgatgtcagtaggtcttgtcaaaataaggaattactccttaaaagaaagagcagttttaaatacaatttcattttttgaaggaatagtataataacatgagtattaaagaaaggaaactaaaataataaatctctccacaacatgactgttctcaatatattcagccatctatcacaggttctgagtttacaaaactacctattaatatcatctatcatctagttctgagcttacaaaactcctccaatgaatatgataaggacatgggatttgatctgggtataatcaaaaaatcatattaaaataccaacaatgtaagcaggaacatatacttcccaaggtacatggatgtgcatgtatgtttgcccacacgtatgatcatgcatctttggtcacggataccttatacataagcacactcaggcatgaagagaatctttagagaaactattgttgcagtcagacaaccacacatcatcaccaactatttatcactttccattgggctttcacacatctcttgtataatcataaccacccctttgtgtaaggtaggctattactgtagaaagtgaaaactgaagttcatcactcaccaggttggaattctaagacaagatccacaggcccctacctctgtaaagataattaagtcacccatttaacaaaatccaaaacagcctattgaaaatgagataatactctctcttccagtgccaccgaggttaaagctaagtagaaatatctgcatcctaataaaagtcacaaaaaggagagtggaaagtcttgttttataatcagagtcagaaagagtcagaagctcctagaattaaggtcctcacaagaaaggaaaaaaaaaaaaagacactactgagaatcactcaaacttttgaacaactcggaagagacatctgtgccacaaaaataaacagacttttattgcacatggatttattacttcaagtatcgtggtacaacccttatccttattttgcaacaaactggattcaaatacacaggaaaaggacaagaccaattaagtataagcaactacttttt

SEQ ID NO: 46259 - DNA, 1506 bp, Bovine  19866881487332
gccgtgtgccctgagaggctgggtttccatttaatgcccaagggagagaggaaaggcacttcaggaagaagggatctggccactagggctcacagagaggcaagaatcaggatgaaagggctgtgagacttattttagaaattgcggaatgacattcagggttttgaataggaaatagtatttggtattctagatttaaagctaatctgggctgactctacagggaaagtgtgaaaggtttctgaaggtttcccttgtattgtcttcatctgaagatactgcaggttgttcacaagggtgaaataagtccttgctctgggttgtgatgctgaagatagctgctgagctttttaaaaatacatggattgtctaataccttaaattttatttcagtttgttatcagttacgaagtctgttttctactgaatcacagttcagttcagttcagtcactaagttgtgtctgactctttgtgaccctgtgaatcacagcacaccaggcccccctgtccatcaccaactccaggagttcacccaaactcacgtgcatcgagtcggtgatgccatccagccatctcatcctctgtcgtccccttctccccctgcccccaatccctcccagcatcagagtcttttccaatgagtcaacttttcacatgaggtggccaaagtattggagtttcagcctcagcatcagtcctttcaatgaacactcaggactggtctcctttaagatggactggttggatctccttgcagtccaagggactctcaagagtcttctccaacaccacagttcaaaagcatcaattctttggctctcagctttcttcacagtccaactctcacatccgtacatgaccaagcagcagacaacttgatcttcttttatctcaacattcaggagtaaatatttcaagagtcaaacagtttctatccccatgaatgacctaaaatcttaagtatttcaagacttttatttttgtaactgaaagtcaccaggtatctgttacattttctgttaatattttaatttgtgctatcactgctgcaatcattttatactgaaaattgtataaaataagcctcttgctctgaagacctctctttctagtaaatattgataagacagtctttgatacaaaatgagctcaagttttttaggccatgtgcaaatcacaaattctggttttaattatatctcaagggaacaacctgaggaaaccaaaagaactgacataattggatcaaattgtgtaatcaaaagcaaatgatgtggttattaatcctaatgaaatgatttcccagcatttaattcatttctctgattccagaaattttagtgataagtgtgttgaaagggatattctgagcaggtactcttcctaaatagtccttttctccacactgttttttggttgaaatatttctgaagtttaaaccttagaacagagagtctattctatatatgaagtcacatgctatacatgaagttttagtcctatt

SEQ ID NO: 46260 - DNA, 910 bp, Bovine  19866881531987
ttatgttttgaaagatactgtacttgctttttttcccccccttaagactttatatctggatctcacgctttctggtgtgtgtgtgtgtgtgtgtatgtgtgtttggtttggtttttaaaatctttggagtttatgatgatgctggtaaagtcaaaattgatactgtgctaggctcagtttcttaattgctttactatttcctggtctgtatccttccaggactcctgcagtgtcgggttactaggcatatctgggcatccttgatttgataacacaagccccacaggggaaacgtgcttgtaaggacacttagtgggagtcccaagaagggcacgttgtccattaagggaccatctcatttctgaaggctgttctagcttggttgagtaaaagctatgttttctttaaaaaaaaaaaaaagtcacctatttttttcctggatgccatgcaacacaaatttcgtttattaaatctaatcagactagcgctgatgaaaaccgtacacaatcaaataatgatcctcaagtttgtgaatttccttttaaagagaaccgccgctacactgcactggcttaaaacagcatcctatttgacaaaagcactatcgagttgtcatgtacactttccagggctgcttctcatcatggttgattaccaagatgttttttgcctaaatgggagctttttctgcttttcctaatcagatctgtcttccctgattcatctagcatcaccacaaaccactgctgagcaaatcagtacatgatcatggtagcaatttctttaaatgtcactaaaatatgaaagatcctgtattggaaagatacattggaaagttggaaaggatttttttttctcattgataaaatggaggctgaggcaaaaaaaaaaaaaaaaatagggccagaca

SEQ ID NO: 46261 - DNA, 1121 bp, Bovine  19866881722494
tttgttgaactctgatcttttgctaatattggcttgtggttgtcagaatgaagactgactctgttacgaatcagcataaagccaactttcattccgagcttggagggagcagaagtgatgggtttgatgcgttttcagtgggaaagaaatcaccgagaagcggtgactcccagttctttcactgtcaccttttctgactcaccttttttctcctgtgtcccctgctgctcctcaaagtcagtgctgtagaatcttctgaatttctgtctgttaaagcagttaaactctctttttttccgatgatgccttttagttggaagctaagctatcagtgggagtctggttcaaattgtgaagtcagcagttaagggattactaaccctgagtaagtcccctatacaaatggcaagttgccttggaaacaggctggttcctttagttggaagtgtgatattgtctgtaaatgccggggatgatggtttttacctttattgcaccacctctaggactagcgtactgagaggctttctgcttgactcctcagtactgatgccttgatggagccagagccaagttttcatttcttgtgcttttaattttaaacacaacccgcaaaatttagaactaaggaagcaatcctttaaatttctattttaggataggaaattctcctttgctgattgccaaaaaaaatgaaagtactatggctccctggatttgactggcaaggaattttagtgatgagtcatatattcaacagtgggatcagcaatgggtgattagggagaggatccctgtgaatgcattgttctgttaggtggttattttgatgaatcgggtgggtttctcctgggagcctggaatcacctgatctgcagtccatcgagcacagagtcagggcgtaggttggtgggaggctgtgcttgtgacttgaagcttaaatgcatccctgcttccctcttatgtagatgtttctctcatgctagatgcaggggtggtgagggcatatggagacaaggctttcaggccagtggaagaggcactggctgaatttaacctggctagctgaggaggtaaaaagactagagggtcttccggggaggtctcaactggtttctgca

SEQ ID NO: 46262 - DNA, 1205 bp, Bovine  19866882027675
aggacttggataaagaactgaataataatgatggtgatgacagtgtcctttactgttgtccttcactctggtctgctattcgcttggttctgtcctaggtgttttaaatgttgctgtttattcaacaggcaaataactccatggtgctgatctgaagaaactaaactttcaagcgctgctgggccaagatgccctgcattcaaaaggccagtgttaagataaaagcccaaatctgacttattttagggccatgtcttttcactgtccccatctgccttcagaggaacttcatggccctgtctctaactgttggcatcacttactgctcgttctcgggtttttctgttttctagcaaagttgtataagaggagagttgaggagctttttacccaggcttcagtgatgtatttgtgtaaatgagcctcagaatccacccaagtacacttccttatgacagagctgcctgtgtactattctattgaagctttccagtacaagttggaaataggagttgaaatgtagtagccattaagtatgaattgtgggtcatttcaaagacattgtttttacaaattgatgacaacaagctaggtctttcatgtagccgtcttggacgggacagtctttaccagccgcacacgttcccagtgcttggcattgttctcaggacatgcgatcgactgttgaagtaataaacctctttgctgtctgagagctgaaagggaggctgtagtctgtttgggcacgactgaagtgacttagcagcagcagcagcagtctgtttgggaaaaggcgtaagtcataattgtaggctgtaataaatataaatccatgagaaatggttcagcttcaaacagctaggtagcagaagcttgtaaaaccatgccctagtcctcctttctggggcccagatcacagaagaattattcatcttttttttaagccgtgaaattttgaaggattcttacaatctccagtctcttggcttcctgcaagaaaacaaatatcgagtcttaaatgacagaaatgattcctaaataagttaaactttttcaaaatttttactaaatttgaataataataatgctccttacagatgatagctcaggccagcacttcctcagtggcgctgagctaacattctaaattcgagatggcattctctctgttctgctgtcgggataatcactgatgaaacattaat

SEQ ID NO: 46263 - DNA, 1269 bp, Bovine  19866880410595
gaatatattgggttgaccaaaaagttcatcttatggaaaaactcaaacgaaccttctaaccaacccagtagatttctgttggtgtcgggaaagtgcttgtgactattgggaactttttcttcaaccaaagtagtttacatttcaagtgattactgaaaggtaaaaggaagaattatgttttttcgttttctttttttctctttgtaggtttttttttttttaattggagtatagttcatttcagtgttgtgcttgttgcagatatacagcaaagtgattctgctgtatacatatatatatacacacacatacattctttttcagattcttttccattataagtaacaatcatgcttttaatttggacaaactccatcactgtgtgaaaaaggaaatacatttattacactaaaaagatttgtttctaagggattaagttgtagggaaatcagtgaattttatggaggattatggagacatttaagatgcagcatatgagacattttaacaccttcagaaaccgatttttacttaaacaatttttagctcatgaatcagttataatccaagtgttaagagcactttttcctgtagaaatgatataagccatggatagattcactggaaggccctcaaaaatctgcttaattcctaatgccactaaatacagtttcttggggaaaatgtattctgagtcctaactcccagtaacaataacagattttaaatctcctcctttctcctctcatgcagtttaccaaatggactgtttttctccttctaaccaaggccacaagagcagtagggattccagggacctttatttttcgggaggagccatctggtgaccctggcaagaagcttaggaacaacccagttagggttctggtagctggcccgccccttcccttctcatcgccctcgtcgttgctttgcctctggagttttctgggagattgagaacagccctgctaattattgactccttaggttcctaacacacggagctttggggagtgatttgacttgtttgatttccttctctactagggcgtacatttttttgacctttgtactttgagtgttcagttggtaagatgctgattgtattgcttcctttgcctatcaggtggtgataagggttgctgagaagtggtaaatgcactcagatccttagaggaaagtgttcatcaagtgtgactactgggacacgctataaagcctgtcccacaaaatatcgcatttttatccagttaaaattttcaggcg

SEQ ID NO: 46264 - DNA, 2621 bp, Bovine  19866880422617
gaagcgcttctggaaaagaagaaggatggggtccaggttctaaaatccacacggagccctggactcaaaagagtctgtgcccaagccccgtgcatgtctccttttctatccaagcctggcttggctatatttagttgcgggaaaacgagtgagtgtggaaaagaaaaacagtggatgtggtgctgacggtcacacttagcgttatatttgggctagacctgccgagaggggcacgagttcgcatttggcctcggagggaaggctcgcccctgctctcccgacaataaaagccccttctgggatcatctgtactctctttagcctgacattgccttcgaaatcgctctcggtcggctacggtcaagaaacacttgactaaagcgtgtcattctttccaggtcacgtaaagatgggctgcctgctggccgccctacacagagagcgcatgtcaccgccgcaagaagtttaaagactgctgcatcacggtgtccatctcctctgcagcagtcggacagtttggggaaaaacatctccatcactcgccctgctcaggggaccaggcaggccgggagggggcgagccccagcagtcaccgccttgcctggcacacctgagactggaaaacgtcggcgccccgacccctgcccgcgtcgggccgcttcttcacccgtgttcctgttctccgccctcctcaccttatcttatgaattccgtattgaattcctgtatgctcactcatccaggaaagttgtaaaagacttaatggaaacctaagataaccccgaggaagctggaggcatttacaagctccttccgaagcaagccataaaaatatttgcatgatatattaaggagaaaaggcagcctttcagaaaatgtacagtgcctagaacccaataagtactacagttgaacaaatcccttagaatcccattgttccttaagtaaatctttataataaatacagaaggctacagattagcatggtaataatggctatttctacgtgatgggattaagggccaatttcagattcttttcatcagtttttctaaattctctttgtgtcacaaagagagaaaagcaataaaatttagagtcattcttttatgccgtgtcatcgatttatttccaaatgtaaatgtgaatatatattcagatggcttttggatagtaattactatagtagccacatttactgagggctcctccatgctgggcatcatattaagtgctttatatccattatttcatttaacccttaaaacaactccatgagatatatcatacaattactatctccaagagcagaaacagaggcttggagaggttaaatgatttacccaaagctccacagctactcagagtctaactaaggcttttttgtttttgttttcctgaccatggggtttgagatattaacctttaggccatactgcccctgcttctgaggcaggattcattctaggaaatctgttcctaccatacatagcctctggggaacagagcagagaatatctattcctaaggaaaccaccatgatatttctctgtagaccatggtttcaaaatctagcaaaattaaagtctatctcatcaaaattaaatcatgaattctttgatgaaagcaaaaaacatgagcccataagtgaggtggagaacagaaaagaaagtgtacaccatctgaggaaattaaacttgcatgagcccttcttacacgtctctcctcaaaagctcaacaggttaggacaccatgagtttgaataaagtagtcacttcacacaactgcttcattgtactggttattgatttgttctgaaagcgttctaggaccccacgacctgcagagccctggctgctctcatctgtgatgctgtcgtggccgaccgtctgtatcaccaaggcacccctctcatctccctgcagtttcagggtcgctagttcctgctattgaaaacccagcttttttttttcccccatgggtttataaataggttgttttaagtgaccctgagctgaaaccaggcttacaaggtgtcaggcctgatgcaagtttcctgctcactgaagctttaaatttgccaggcctgatttctaaacctgagtgtaagggcacagtaacggaagcaaattttagttttaaaggcacttctttgaaagtctccttctccacttacgccggtgtaaaatacaagattttactttgagaagaggtgacagaggatgaagaggtttcaagtacaaaacctgagtcggctcagtagaattctaccaaccagaacccctggttaaatggattctgatgatgaagggcatgttatactccccagggacaaagacaaagggtagaaaacaagttatattatggttggtttttttttttttaactttccaagttatttcctaatgtcagtagaggctctgtctaatcacactccttttatatctacagtctaaacaatgattcctgatctattcagaagtatgaaactgcaagaatttgagaaaagcaactatctcatcatgttacactttacattacacattacactttctatggcaggatagtagacactttacaaataatgttaacagccagactactgcaaatatcagtaaaaa

SEQ ID NO: 46265 - DNA, 1764 bp, Bovine  19866880447337
tgcgacccctggactgcagcccccaggctccgccgtccctgggattctccaggcaagaacactggagtgggttgccatttccttctccaatgcatgaaagtgaaacgtgaaagtgaagtcgctcagttgtgtccgactctgtgtgaccccatagatggcagcccaccaggctcctccgtccatgggattttccaggcaagagtaactggagtgtgttgccattgccttctcctagtgtatatggaactattgattaaaaaatggttcaggagtacagttcatctattcctactgtaatagactttaccatgagtacctagcccactagcagtctgtctctctacaatagatgcgagaattaaaaagccagcaccgaagagcctgatgaagtacagtcttctaaggagagagctcctgaaacacgtaagaatctttttgcttgtcacccaacagtggctccttgggagtgtcaacaattctgcatagtgtatcctccagggtggaggtgtatatatgtttagagtcggtgtgaaggtaatccaacatttacagtcacgtgacacatagaaacaactctggaaacagactgttttgataagcagtcttcccaaaagtatcgtgaacatttcttgtgttggtctcttattttggaaacaagcctcaaagaggcgtagagggactggaacttctcttgtaccgtctaaatgctcatcagtgacggcagggatctgctggattccacctcgtgtgaaaaaggcaataagttctcagactgtccttccctttgggggacccacccacccaggtcatgtgcccattctgccacccgctatatactggccctgctccccctgacatgggtctctagagcccaggctttgtcttgcctgctcagactttctccaaaccagtaattttaagcaggaggtgacaatgggattcttccgctatcataggagttctagcagacacttctagagaaagaataaaaactggtttctacaagcaccctactgactttacttcatttaatataaaagttacagggacttccctggtggtccagtgttcctagtgtacagggcacaggttccatacctggttagggaactaagatccaacatgcctcacagtgcggcctaaaaaaaaaaaagttataatgactttcgctatcttattacttttgcttattaaaatttctctttaaattgactttaaaaaatgtggcctcaccctaagtaattatatttatagcaccatcagtttggtatgctagttatgtatattagaaaaaaaaaaactctgaccattaaaataaaaaatgttattcaagtactacctaacattatcacaagaactaccagtacagacagtatagatagatatcacttgggaaaatgctagtctatgggcaccaactagcttatctgatacatttagctaacgggacagggttaaacagcccacttggttcccaggtaactagaatggtggtattccagaaatggcatatttgtctttattttttttttgccttaggactcggtaactttcctagctcaggagggcagagctgtggtaagctgtggaaagaattattccggggcatttgaagctgggcagtccactgaatgtcgtattatgcagacagccagggacctcccttcactgaagggttggtgcaggcttctaggaagggtagctgatttcctgaaagtgtgtttactgcgagctggcctcctgggagttgcctgggagaatcat

SEQ ID NO: 46266 - DNA, 1395 bp, Bovine  19866880469859
ggcagaggtacatatttagctggaaggtcatcttgaacctgagtttttgatgggttagtacttggttgtatgtctaataaatttcttattaagtgctatttccatgaatggggaaaggcaccctcccccaccacacccctggtaatccagtggtgaagagtctgtctgccaatgctggggacgcaggttcgatccctggttggggaactgagatcccacatgccatggggtaactaagcttgcatgccaaaactacagagccagagctgcactattagacagcccgagtacctccacaaagagcaacttaaaatcccacctactgcaactaagatcagatgcagcaaaagagatgaacaaaattttccaaaaaaaaaaatcatattatgtctaagcacatatgacctcttctgatcatcagtaatgcacgaagattggcttccctcatagctcagtcagtaaagaatctgcctgcaatgcaggagacctattaattcctgggttgggaagatccgttggagaagggactggcaacccactccagtattcttgcctggagaatcccatggacagaggagcctggggggctatagtccacgcggtcacaagaggcagacacgacttagtgataaaccaccaccaccaatgcatgtaggtaataaagactgaggagttccgtggtagataacgaatgttattgttttacacaatatcatttggtataacatttggaaagagccatcattagtggttttacgactgtaaatcaggtccccaatggcagaactggcaaaaaacgcatatacaatagcctctaggcatgctttgtgagcgtctgttagagtaatttgcagttttattggtgaattcatagttccctgacatagctctttataaataatgctggagaaattcttggatgaagctaaattcccttctcttatgaaggcactctcttgtctacaatgaattctaaataataaaaaaatctaaataatagatttgtcttgtcattttgttttaaaaattatggtttcaaattctgtaactttccaagcttttttattattgaattttgtagacttttctccataaatactcagttggctatcttgatagtcatttttaactgattaagaaaaaaaaaacaaattgaactaggtacaataaaacaaaatattaaccctcttttttattttttatattaacatttaaaattttaattattactttttattgacgtatagttgatttacaatatcatgttagtttcaggtatacagtacagtgactcagttttatccatgtgcgtgcatctgtatctcacacacacacacacatatatatattctttccaagattcttttccttacagggttattacaaaatattaag

SEQ ID NO: 46267 - DNA, 1063 bp, Bovine  19866880520967
tgatctaaattcctagtgttcttgcccaagcagggtggttaaggaaggctttttaaagtaaagggatttcctgtcactgagggcaggtaagtgctcaagcaagaaaatgaataaataaaagtgaggtaattgtgtgtattccaagctagtaacatggatcattccagacacactattgacaaggatttttctaccaactgggtcatttcccttatagtctttctctaaatttcttaaatgtattcccacaacacctgcagttaagcccagtgtttctagggatataagaacaaagcacacagcctgtctctgaggaaaatggatccagagagcaataatgagagctttgagaatgagaaatctgaagaaaaaaaaaaaaaagaagaaacattgtggtgtcatagattcagatatttcagtaggaaatcaatgttaaatgactaaacaattttcagagttaaattatattttctatccttaaggattatccataatagttacatattgtaaatatatacatgtaaacatcattgataaaattctgacattggttacacctgtccttttttctattaaaattattttcgattgcattattaatgtatttcttatgcatttccatcatctttgtcatagttactccccactgtttcagaaaaaaataaaacttcatgtttacaaattgacatttcttgataagagataaaagtatttgtttaaaaagaattctgtaaattttttattaggctgcttcaatttataaaatgactaaatttttaaataacttcaagttacctggaatataaagcatcattaaagagcatacttaaataattgtttgttaatgctaataatacatttgcttttgttattgttgttgtttgtttacttttttaacacaaaatgatgcgaaaggatcctgtatattaagtgtttaaaaaaaacacagtgtttccctggagactggttttgagacttcacagtttttccagtttccaagtgtagaagatgttataagtattccccaaataaatatctagtaagtgtcatcaggcaacccttc

SEQ ID NO: 46268 - DNA, 1723 bp, Bovine  19866880560679
ctttgtaaattcttcaactggaggctctaagtgtttctaaccgtttatatgaattttcctgctgtaaatgtattaacctttggtcacttttataaacacattttacagactgtggttttttaactttgcttttcttttgcaaacagaagaaacttctgtgtcaaatctcttagttttttttcctttgtgattttgtgtgtcactcagtatcttacaaatccttctcattctggaagtttgataaatattctattttcttcaagcctttctagggttgattttttaacagggatgggtaagttatgtggaattcttttggtgtcagtgtgacgtgaagtacagatgactctattttccaaatagctgttcaaattccttaatgccattattgcaacatttaaagactgcagcaaaatttgcattgagaaagcaccagagggaataccttcccttcctgatttttctgcagggacaaggagccagagaggaagagagtaaggaagagtcaaacaccaaacagcagacagttcctcaaattcctgctcagcacttcctttaccagtgggtcttgcttgggtaagaggagccagtaaggaagtgtgaagaaggacgtggattctagggagactacgtaaaaatctgtgattcatgagagcttatcctgtaggttacaacctcacttaggtaacgagaaagcactcagatctcccagggtactgatgcacaagacgcccgttcttatgacaggtaaatcaaatggtagagtctgcctgcgtgcatcttcctgatacagggatccaactcgtgcctcctgcattggcaggcggattttttttttttttttttaccactgagccaccagggaagccccattatagagtatacatactgtatacatatcataactttgcaatcacacagcttgttgattacagacgtagattgacatattttggggcaaattcaaacacctcaaagcagcagctagatacaagaaaccctcattgtgagactattagcttataactaggggtcacaaactataacccttgtgccaaatttaactttgtgtttttgtaaatcaagttttagtggaacactgccatgcccactcttttacatattgtctgtggctactttccatccaatggcatgtctgaacagtactgacagcaactgtatggcctgaaagcctgagatacttactttctggcccttaagaaatacgctgcttagcacccctggcttatagaataggatagaaccttattccctaatagcagcagcactaaaggcttctactgtggtaaaggagaaacttctttaatgcatttcactctgggctctctgtactaagaaggaatcttccccactatctcagagggaacaagatattgctgtgttcctcgtggcaatgaggaggtgagtgagcctgcagcagtcactcgggaaagtgaagtttccagtgacgacaattaggtgagcaagtccaacatttctccaggcgttagtttctacggtttccttggggtagtgtagagggggcgtggatcggggtgggaggaagaaggttcttggctgggttgaggcgcactttggggtggagagggttagaagaaaggaaagtgtaacagaaaagagaaaagaaaaatctgaaagccagtggaaatggaagcgaggctggcctttccctccactggccactccagaaatgctgaattta

SEQ ID NO: 46269 - DNA, 643 bp, Bovine  19866880561197
tgcttcctgagaactctcctaaggaaagaatgagtctgagaaccgtgaggtatttcacggtttcatcctttcccttcgaggtgttatcctttagtacctggagctgcctgtttctcttccatagtcaaccgtgaatcagtatttggtgtggttgctgtttacagcctgacttgtcaggcttgcagagtttatcagcacaccagctctgcgaatatcttggccaggctgtcctgcatccctttgcccgaaggaatcagttagatgatgtagagcatctggaatctgtaattttgaattaactgtatgattatttagtatcattatagcatgaatgggattgttacattatgcgggcatttaatccatctggcacggtgaccacttccgagctgtcccagaaagcggaggagtttcctaatgcctagccctttggtgggaccaaagcaagtcgaggtcgtcgggttttgggaggggaccacgtgctcctcagtagcctccgtttagaagctcacacatcgctctttcggtccagctgtcacgtgtgtggatttgagacggagctcaacgtccagtttgtcagccacatgtcgctccacgtggacaaggagcagtggatgttctccatctgctgcacggcctgcga

SEQ ID NO: 46270 - DNA, 1045 bp, Bovine  19866880566136
tcggctctgctctctctctctctctgtcctcaaactgtgccaagactgtaagattttcctgatgacggggcatgttctgcatctggattccatggtcataacaaccagaagtttcctgtcctctttggttgaactgattatgctatagagctgggtagcaacagcagcaattgggaggtaagcgctactatttaaaatacagtgctccctcatctgagatttctgggtgcctgggagggagggaaaagagaaactatattcattctgtgctaacactatgctacacgctttactcgtataattctgatttaccttgacagtgaccctgtgaaattgcaggcgttaatatcctgttctgcaaatgaaaccgtgggcctgtagatatagggagggtctagtaggaggctgggtgtgatttaaatgagactttctggtgccaaggcttgtgccctttctgttttgccatgctgcttcatgttctagaaatgctgtggttttttggttaggcaaaacatgttgtggcctcattttatcaactgggtaaattcttttttattttttaattttaatttttttgactgcttgggctcttcattgcaaggtacaagggctttctctagttgcggcatgggatttgttgcccttcagcatgtagagtcttagttccctgaccagagatggatcccgcgtctcctggatgggaaggtgggttcttaaccactgagccaccaggggagtcccatcagttgggtaaactcttgaagttgcatatacattatatacttaagagaaggagaacctgtagttttctagtttaatgttgtctgtgcttggcagctgacacaaacttcgccatttctgcaggagcccagggccagcaagagggagcaggtgttattgttccactttacagatgagggatctgagtaatggggggcagagtgttcacatctgtctggttcatctctgtggtcctaacacccagtcaaaggtttggtatttagtagactctccagttttttgttaaataaacaccaggaattat

SEQ ID NO: 46271 - DNA, 1163 bp, Bovine  19866880658108
ttctagaaatgcatatgttagtgacagggtgttttcttctttaagaagcacctgaaatgatgatgattttgcttcctgcagggtgagctctgggaaaagtggaatccattcatgagaccgtgtaaactgtctccctgtcactcaatcacattgtgtctgaatgatgcatttactctaattccgaatgtattccagcatgttagtctccaagtttgaaaaagatattacaaatgactttcataatcctgagactcaatgcttttgagtaaattccatcaaataattgtgattcctagtagaaggtgcagagaaaaagtcatagtatttgactttcaaaaccctagtgtgaactggtgtcccattgttttctagcattaaatattggggataagtcactttcctctctctttctcacgagggcatcaaaagaggaatagtggagatggcagatctggtggctatcaccaaatctgacggagacttgatcgtgccagctcgaaggatacaagcagagtatgtgagcgcactgaaattactgcgcaggcgttcaggagtctggagaccaaaggttagcttgcattccgttctgcatttttctcccggagtagactgtgcacatcagaagaggggatgtaagtcccaagctagacatacaggccatctttgcttgaatgagatcacagttttaaaaattatgacaaagccagagcctgtagtgattttaagtacagtccgtcaaccaccagatgtcaaaaactggatgtgaggtgatagattagagtgcttaatgctgggctcaagctgtttggaagtgatggcaaatccattctgaaaagatacacccttaagattatggcgcaattaatgacttgattatctacattagagtttgagtaagagagagaagtcttttgatacggtaactctccttcccattatgtttgttgggtgatgtttttaataaggaaaaaaaaatccagtagtaagtgatacagtgatatgatggggacactttatctgtagaaggacaccgtgttattaaagaagaagcggccatcgctgtaatgagaacgatggtgacgtttcttgccgttggctcccagcatgttgtcttttttgctgggtctggagccaccttgtctgtgtgggcactgatgctcagt

SEQ ID NO: 46272 - DNA, 1395 bp, Bovine  19866880746521
catgggaatttgaaaaactgaaagagctacagactccagaaatcttgagtggaaaaacaaatacacttagaaaatttactcatgcagggctgggttctcactactgtaaaattagaggtaaagcttagcagacagcaatgttttataatttttgcatttccttgtaagtggaaggaccatttaaatgtatgaaaaccaattttgccaaaagaataaagtggtggtgagactgttttgcaaaattaacattattgatattaaggaaacaagtagaataaagtcaactaaattatttttttaagtttttaattagaataaataaaataacttatttttaacttattttttaaataattaccctattctattcatgagcttttttgactcatatggactagattcttccaaataacaagaaagaggacaagaattttaagaaatccttaactatattatttcctcttagtatctgtccactacaaataatctaacttaagaagcagagtgggcattttagaagtccccatgaaaccttagatggaattcctatacctggtcagtctaagtatgaagcatatagctggacctcaataaaatgggctacttgatgccatgactggcatttactgtaatcttgttgttcagtcgcttcgtcgtgtctgactctttgcaactccatggactgcacacaccagatttccctgtccttcactgcctatgtgctttatcatcacacagatgacttctgttccctttggccggtcctacttttatatcttcccatctcctgacttgggcttcctctcctatttctgaactcatgcctgtttttgaactgaagattgtgtctggcatattttgtttcttttactttcagttgtgttgtgttctctcagctcagatccatttgtcttccgtcccctgctctgctccttttccaaggttccttgacaagtgacttttttcaaggtctagcaaagtaggctttgagattaaatatgggacagtgaagaaggcaggtactctcaaatctctctttcactctctctctgactgtcttgctctcccctactttggacagcctctagaaggggttgcatctctgttgagttgcaaatactgccaagaagctccagttccttcactctccatattatttcctagaacttttactgttttacctttcctatttagatcactggttaggttttttttaatttatgttttttgttttttttttttttctggaggggtaaaaagttgggttttttttttaacattttttttttcctataagatacctacagtgacaggtaagatcctttttctaaacatgtatatctgagggtctcagtaccatttattaaaagaccatgttttccccacagtactgca

SEQ ID NO: 46273 - DNA, 5168 bp, Bovine  19866880750506
ctccctggtgagggagctgagatccccgtgcctcacagccaaaaaatcaaacattaaacagaagcaatattgtaacaaattcagtaaagaattttaaaacatttgtggtggataattcacagcattcaataaatattattaactcttaagtgtgaaatcttttccgccagggaggtaaactggaattgtcattggcaatgtatgttcttagttgtaccttggtttttagtgggtgagaaaattaagaatcagggaactttaacatttttcacgtaaaagaatgtgttttgcagactttgcctgggcacttggttgatgctgcaggtctcgggctggcccgtcaatgattctgagcagaccatcatcatttttacggcatttgttgccaagtgggaaatggcttttcatttgaatggtgcttttgagttggcagcacgacaaggttcaaataacttgttgtgacttacagattatgtttcaacttggttgtgttttagtgtgaccttattaaaagattttcatcattctcactttggtccctcttttttttttccctttccccttttccagttcttcctccagtactggttccaagacacagcgaatacaatcctcagcacagcctcttagctcagttccgcaacttagggcaaaatgagcctcacatgccactcaacgccactttcccggattctttccagcagcccaacagccatccgtttcctcattctcccaacagcagttaccccaactctcctggaagcagcagcagcacgtaccctcactctccgaccagctcagacccaggaagcccctttcagatgccaggtaggttgctgcattcagtaatgtcctgtggtcagtgagacgcgtcatcacagtgccatggagaagccgggtttcctggaatggggagagctcgcaagccttgggacatggcgctgtgctctaaaactcaggatacaactttgaatggaaggagacacctcgtagccaagcaaggcggtgttttatttgtccggcacagatgcttgaatacgttttcgtgtttgatttttgaaaggttttgaaacagctgcatcattctgggagtggcatggttgttccagcctttgctcttgataaaagcgagcggaaaaaaaatagcacgccgcacacatttgctgttttcatgcaaggaaaaaaaaaaaaccctgtcataagtgcaacctcagaagagatatttcctgggggatctcacacacacacacacacccccacacacacttaattaaattcgtttaagtggtgatgtaatcctgagaaacacagacttgaacaacaaaggacttgcaacagaagtaccggtaaccatctgcttgtttaacttagcaaagacaaaagaccattatccttctgtaggcttctctgagggtgtaatgtctgtcaattaaatgattaattaggacattatatttttcgcgttataggttaataagccagcatctcagaacaataaaaatgattagtgccagattcctagccagtcagcctcacagagggtacattaagcaaagatacacttgacatctattaacatttcaagaagggaaaatgagtgggcaagcatgtttaacatattgaaatgtttggaggccaatttgaattcgatagcagagctagtgtcttctcaaaaattgaaagtggcccatacttgatattcttatcttttatttatgtccttagtgcttttttgcattttaagcctgtttatattgaactggcttgtttttcaatcagaaactgtttaagatgaggaggatgggagacagatttatttcaaaatccaactcatatcatctggtgatttcctgtcccctcctggacccgttgagtttgaggaacaggttggagtcaaagttagatgttttgggtggctttgaagcagtggcagactcagggtagccccaagagtggaaaatactgaagatcattgcttgaatttacactgtccctggctgtcagggattgaggcacaggccgagtagagaaaatgtggagcagagaaagctgaaggggtgggaggagggcctcacggagagagcagagcatcacccatagtatgtggtccttcccaccggagctgaggccacaggagggtgatgaagttttcaccagtctgcttgcagaaatttattggatttggtctcagaggaggctctttgtcttcgtttttggctggaaataaaacagaggcagtgttacagctgcaaggaagaagctgaattttaaaaaagcggtagaaagagtagaaaaggcatccggatcaggtccctgcggtcctgtctctgtgcttggtagcagctgagggacgagggggtggggggttggggagacggtggaagtggccagggtgtgattcagctggagagtcagtctgggaaatcactgagaaactctgcaagagccgtgttagctttttctatttgacggttgccccgagtggtgtcatccaggctactggttaagatgaagctgtgtttcctgctctgtcatatgtgccagatggtaccatgggctcgccggtggcccttgagaaactcgtttttccatcacaaagaattatttgtgggaaaaccataccctgtattttacttaagaaagtacaagactgggacttcgctggtggtccagtggttaagactccttccaatgcaggggctgtagatttcatacctggtcggggcgctgagctcccacatgcctcgtggccaaaataaccaaaacagatgcaatgtcataacaaattcagtaaggacttaaaaattggtccacgtcaaaaaaaaattaaaagtgaaaaatgcaaaagcacaagacttgtattagtgtcgtttcaaaaatcacgatgtttgcatcgtatttgccagttgattgtgaacttttccagaagaaatgtatacaaaaattctgaaatagaagatagttgtgacaaactgatttatttcctctaattctgttgctagagactatttgagtggataggaagttaggtggtcctagcggacttcttgaagtcacgggaaattcagagtttgagtcagtaagttggctgtcttgaaactcagttggtaaattcctaagagcccatagatttaatgcacgagaccctgaagctccttttctgaagaagtccttgtagctttcaaaagttttccatccaccagggaaatgacaaaatgcagaggtcctttgaaggtgggtcgtgtgcaagcacatttaaatactcctctgattgttgtaaaaaggagtgatcctgggtaggcagacagcttccagaactggtatacgatgctttcctcccactgagttttcactgcagtcatagaagaatatgagatggtagccatcttcacaaagcataccccaagcccagtgtttagtatcatctagtcttcagatggggacagtgaagtggccactcaatctcttaagaatttcaggcatggaagagaatatatgttttaagcttgtgtgcttgtgtgtttactaaggataaacaaatctttttttttttttttttaattttgtagcagatacacccccacctgcttacctgccccctgaagaccccatgacccaggatggctctcaacccatggacacaaatatgatggcaccatctctgccttcagaaatcaacagaggaggtagaatgaactgctgctgcttctctttttagagtctgaagttctctgtccaaatgttgctttctctcacaaattttttattcgtcttgaaaaagatagctatttgaagctataaaatatataaggagcacttataagagaatttcagtagaaaggattccttggattagaaataagccttttatatgaagaacagacacactgatttagctaatgaaagtctaaatataattgtgcagccatctgtttagagccttagtacttaatacttccaaattggtgataaaagaatatctttaagtgaaagacaaagggatgttgagggggaaaaaagtgagtataaagttgaagtagagttttcactggtgatttccaaaatgaaaagatcatataacaaggctttccaaaggcttcttttgttgtcaggataaatattcataagcctcgtcttccttctggccctcatctagaatagtggcagcggaaccaaactaacagcatttgttccctgcgcgcatgcttcaattaaggcaagttggaaggacttcacaggtggcacagtggtaaagaagctgcctacgatggaggagacacgggttcagtacctgagatcccctcgagtaggaaatgggcaacccactccagtattcttgcctggagaattccatgggacagatgagcctggcgggctacagtgcatggggtcgcaaagaatcaggcatgattgagcaactaacacttttttacatttcaataattagtgatgttgagcactttttcatgtgactcttggccatatgtacatcttcattgaataaatgtctagttaggccttctgcccatttttggattgggtttgtttgtttctatattgagccatcagttgttagccaaattttggagattaatcctgtcagtcacatagtttgcaaatattttctcccattctgtgggttgtctttccgtctcatttatggtttcctctgctgtgcaaaagtttttgggtttaattagatcccatttgtttatttttatttccattactctaggagatgcattgaaaaagatattgatgcaatttatatcaaagagtgttccacctatgtttttttaagagttttatagtattcagtcttacatataggtttttaatccactttgagtttatttttgtctgtggtattaaagaatgttatgatttcattcctttacttgtagctgtccagttttcccagcaccattcattgaagagactgtctttttctaccatgtattctggtcttctttatcatagactaattgatcataggtgtgtgggtttatttctgggttttctttcctgttccattgacctatatttctctttttgtgccagtaccataatgttttgatgactgtagctttgtagtacactctgaagccagggagcctgattcctccagctctatttttctttctcaagattactttggctattagggg

SEQ ID NO: 46274 - DNA, 1070 bp, Bovine  19866880804645
ccctacactcccttccctgaagcatgtttatggagtgattatgcctgcaaatatttgctatatttagtccctctcctcccctaaccccctcttagacttttttttaacaccccaaatgagcaaaaagccaagcttatggtcttgggaagatttgaaccctaatgacaaggcgcaggggctggaacaagcggtgcagaagcatttgacgagttgggaggcaattagagtgggaaggatgagttattatagcatcacccccacacgaaggtgctttgtggggcctgcggccagcaggtgagggccctcagcggggcgtgatgggttttgacaggtgatggccatagccctgagtgatgaatgcagatagatcccggtggaactttccttcccaggcaactttctcggcacaagaccgcgcaagccctcagatttgtcaccgtgcaccctgagggctctgggggcaggggttggtgggaactctgtgacctcagctgggtcaaggttgctggggtaacccgagtgggccacacctggtctctggctgggggcgctggagctgccctccatcagctgtggagaagcgagggccccctctggcttctagcttaacagctgcacatgtccgctcttggcatttcaggctagatctaggcttacttcaaggcccagtgcctgcctccagtcagcttggccacctattgtttatcctgggaagggctgggtcttggcaacagggcctgaagtggtgcccgcattttatttttagagatgggaaaatgcttgctttttggcagccactctttttctggcacacatcaggatggcgtcaaaaagtccaagcgagagattccaagccctagatccatggtgtgtgtcatcacaggcagtaggaccacgggcctctcaacagaagcttctgcagagcctgagatctctgggtcccactggcttcatcctggcggcacgaggcctttagtcctctaccctcttagcctggtcttctaatgagcccctcttcagagcctcagccggcttgaaatgttagagttcttacctctcttcagctcctt

SEQ ID NO: 46275 - DNA, 1651 bp, Bovine  19866880819605
tgtgtctgcagggtgccctttcctcagtgggtgcacacatagggcaggagagaaatctctcccttcttcttatgaggccactaatcctctcatgttaggaccccaccttcatgaccacatttgaccttaattacttccttaaaggctccaggttccatctccaaatacagtcacactgagacttcaatatgagtttgggggtggggggtgcataattcattccataggacactaatacataaaatcacttaaaaaaatacctggcccatggcaattgtttaataaattgtgattttatggtacagatgattttaaacaccttttccccttttttcttttctaggtgctcgctttgggttccttttggaaacaccaggaatggtcatttctacttttcaggacctccgcacaaagaagctaaggagaatcttatgtagataaagtgaagcctctttcactgtcctttcacattggggacgtctatatttctccctccacaaggagcgtgcgtagcgccatcatgaatgtgacaagtttattttccttcacaagtccagctgtgaagagacttcttggctggaaacagggtgacgaggaagaaaaatgggcagagaaggccgttgatgctttggtgaaaaaactgaagaaaaagaagggtgccatggaggaactggaaaaagccttgagctgcccgggccagcccagcaactgcgtcaccatcccccgctccctggacggcagactgcaggtctcccaccggaaggggctgcctcacgtcatctactgccgcgtgtggcgctggcccgaccttcagagccaccatgaactgaaaccattggaatgctgcgagtttcccttcggctccaagcagaaggaggtgtgcatcaacccctaccactataagcgagtagaaagccccggtgagtgagtcctttcctgtggacgcatttagcagatttgtgttgtttctcgaaatcgtccctttccatgtttttttttgtcgttgttgtaatttctaagtattagggggaaagtcgtgtcagtcagtccttgaaagggtcgtacgttctaacggcatagtctctagttaactttatttcttaggagcagggctgtgaaaactgtcatggaggcattaatgcatctaccttttcataaattgtttttttgctgaatttattttttgtttccctttggttctgtgcatttctcgagacagagttagctatgatttttattgcaagggaagaaaatcgggaaagaagcatgatgttgctgtctacatacttgagggtggttgccagtgacttatatcactttatccttaaaaatagcactttttatcatctccagtagaattctgctatggcatactccctgtggaggatatgaaggaattatgttctgcagtggaatcatttgatactattactttatatgagatactcctagtttttacatgtgtgaccttggagggggtggaggaagcataataaaagatatacttttaacatttacttggttttgacttaaattagagtccacattctagacagtggcatcagctgggaaaatgattaggcaatctcaggcacttaaatatctcagcgtcagattggaatcaaatttgttgatggattagttattaata

SEQ ID NO: 46276 - DNA, 1452 bp, Bovine  19866880963524
ctcttctctacttctcatcacacctttccatttcttcttagggtgttctttgttttctttcccttgttcattcactcagcactatttattgagcccttgatgctgctgctgcttctgctaagtcgcttcagttgtgtccgactctgtgtgaccccatagacggcagcccaccaggctcccccgtccctgggattctccaggcaagaacactggagtgggttgccatttccttctccaatgcatgaaagtgaaaagtgaaagtgaagtcgctcagtcatgtcagactcttagcgacctcatggactgcagcctaccaggctccttcatccatgggattttccaggcaagagtactggactggggtgccattgccttctctgatttgagcccttactaatttccaatttaattactgatttaattgagccgaagaattgatgcttttgaactgtggtgttggagaagactcttgagagtcccttggactgcaaggagatccaaccagtccatccaaaaggagatcagttcctgggtgttcattggaaggactgatgctgaagctgaaactccaatacttacctcatggagaagagttgactcattggaaaagaccctgatgctggtaaagattgagggcaggaggagaagggggcgacagaggatgagatggctggatggcatcactgactccatggacatgggtttgggtggactccgggagttggtaatggacaggcaggcctggcgtgctgcagttcatggggttgcaaagagtcggacacgactgagtgactgaattgaactgaactactaatttctaagcctccatttggccagtagggctaccaagctgaacaagacagtgtcctttcctggtgaccctgtgttcccgtcccatcccatccccctgctcatgctcatgctgggttccagttattatgttattatgcagtgttctgctttctgcaccatctctccagcccttccctgccttctggaaacactgaccgatggaagagaagccgtcagggcttctcaacagagatatccttgggacacgattcagtaatatttagcaccacctaagaaaagcattttaaacttgtctgcatatactaaagcccttttaccatctgttagtggaaaatatttaaaagtttggtaaaactcttagtgattgaaataaaactcttggtatgcgccttcctctcgttgggcattaagggctcactctgctttgtcttcctcattgagggtcaggcaatggcccacccaccaccaggcagagatggaccttgctttttggtcagtttttttaaatatcagcaggacttctgaatctttcaggagttgtgtttaaaatctacttgtgcgtccccccccagcccaaccccatccttcctgcattcaggttcatagaagggtatacaaaggctataatcacaacagata

SEQ ID NO: 46277 - DNA, 1526 bp, Bovine  19866880999955
ataatttttagaaagtcagaatgctggtatggatcctacttggaggatggtaaattcagtttgtaatttacaatgcttggaggatgaaagcaagaaatgtattagtgagacccctacctagtgtcatttcaccagcagttgtgtgtttctggttgaccggtaggttggaaagtaagaaattaataattatttacttaaaattattgcatcagaacagttgaaattcctgtatttgccagtggtgggattaagaattctttcctgtgatgtgaatttaaaacacactggaacttccagggggcatgatttgttacagataaagcataatacaatgattacatccttatcatcaccccatttttctaaactgatggtgcagtttctcctatgtaaatgggaggtcttgcaaggttgtgctaattgctaaaagctgctagtttaaaagaaaacttgttcaggccaacatgctttcataatttgaaccctccctcctatgtcaaaagctcttggtaacatccagtaatctattggctttctagtcaaatcaaggaggtcacacagctctctcctccttctctcataacatggactggcatattatgactttaactctcttccaacagtgactcctgtcccctcctaatggtaagattctagcgtgtaatatttctgtttcagagtttgctgcatagccagcattgcgagctgagaaagctggggtggccccaaaagataatatgcaaacacaagatcgaaggaaagatgttctctaaggaaacagttttatcctaattcttttggatgatgcgatttgagacaatgaagtatgaaatcatttcctgggtagtaatgagatccccaaaatagaatacggctaggcggccatgcacatttaatgatatttgtggtcagtaatggctcttctgaatgcttatgttgagtgttagtgaatacacatgctgtggagctccacgatagttgaatcggaaattccctggcggtccagtgggtaggactccttgctttcatcgccgagtacaggggtttgatccccagcctgggagctaagatcccgcaagccgtagggtgcaaccaaactttaaaaaaaaaagaaaacaaaaaagacaacagttgattggatgacctgttcatatttccaaaggcatctcctctgcttcgtgctgtggaaatgaaaacttgtttgaagactaagataagcatgttttgccctgaaaaaatttcccaagcattctgtgcgctttgatttaggttaaagaaatacgtaccacagtccctaccttctagatacttgtggtctagtcagaaagtaatccagggcagtggaatgcattcaatcagtgctttgcacttggaacttcgtacttgtacagtctagcagattgtggccaggaaactgtgaagaagtctccaagtcattcctaaaaataggagtgtgacttgaaaataacaagtgtcttttcattcctaagccacaaaggtaaagagacctcaccttttattaggtt

SEQ ID NO: 46278 - DNA, 1193 bp, Bovine  19866881020113
tgcgcagtacaggggccgcctcttctgttcctgcactcagagttcaccttgttctactcgtggaactcctttcctgctgagacctgcacttgcctcaagactgctcagcacagtccttgaacttggcatacggggagccagttcgctaaccgtgagttcactgttaacacagtggctcttcaggatggagcatctttgtctctggcctcagtggggtagccaaagtacttagcaggcactcagtgcaacttcgttgaatgaatgtcgattccagtagttaaagcaaaggtctgaaattgtggtcctcaacccccacctccaccgccacacacacaccttctaggataaatccatcagttctagagtttaaaatagccccaagtgattttgatagaaactcaccccctcaatttgaaaactattgactgaaatataaaaacgcagcttttggagttgaagaagaggacatacagggtaaggagaaatgtattctgttgataaattgttactagaggacaaggaaaaaaagttgtctttctcgttcttttgcacaattaacctttagtaaaagtaaataattatttcaggaggtacactctgaccaagtgtgactcttgatgatagcatagtgttttgttttctcttttattgttagacaaaaataatgccactttcaaagaactgataaatctgagtaaaactctttacagaagggaacaactgagtccctgtagcctattaagtaaagctccacccttggccttctaattccttcagggagctaaatcattcatcaaacatttattgagactctgatgtgtgccaggtatagggctctgctccaaagacagaagacagtcagatagaattcctttttcctccagtgaggaagtaactgttggcatgtgcagtttgctgtgacagcagtccatcataaatatccctttcagttctcagaatcagtaatgctttcccccttttattcctgttacgggtaatctgtgccttttcttttattgattagttttgctagaggaatatctggttttattagtattttcaaagagccaactttgattttattttcctattttatatatatagatatatttaatttttgctctcatttccttttactgtctttgggtttaatttgctgttcctttctttttcttttggtagatacatagaaa

SEQ ID NO: 46279 - DNA, 1720 bp, Bovine  19866881026322
gccctttttgtggtctgggacagagagtgagcgaagagagctgtactgaaaagaactacaactgtactggaaacaaaccaacaagccaggtagcaagcgcagctgccacatcagtggtccttaggccttgctgcagttttagaaccatctgaggattttaaagaaaacaccaatgtttaggtcctatccaagaccaactaaatcataatttctggcagtggggctggaccctggcgtgtaagaaacaaaagcttcccaggtgagtctaatgtcagtcaaggtgagcactgctgctagactaaggagagatggcacagcaactgtagggatttaacctcctctcccttgcaaagccccagtcatgcggctactgaagccctcgccctgacatgagacagtctgcctctgtcttctggattcccagagagatctgggcaaacatgcaggctgcagcccccgaaggcttgtctcctagactgaaacgcagagcagagttttcataagtatctttgccatcatcccagaaagccatcagcaagggctgccccatcttctcctctgaggcagttacagtgctgagctccttggtcctagcaaacattaatcgcgaaggactaaggaatgttaagtgtgggctcaggcgggagaagactggatggtttggggaaggggtttgatttcacaatcacagacgctgggaaacctcaaaatggggatcgggatgggtggccttcgagtccccttaaaacagcatccccccagtgatttttaatactgctgtacatgtttagttgcacagcgagtctgtggttccatggactgtagcctgccaggctcctttgtccatggaattctctaggcaagaatacagaagtgggttgtcacttcctactccaaggggatcttcccaaaccagggatcaaacccactctcttgcatcacctgcactggcaggcatattctttacccctagcgacacctcggaagccctttaatcctcctgggttcccttaaagtcatttgtgtgttgaaggagcaaaaaagactccccttaatcaccaagcaagaaagaatcaagtgttttccatctcgcttttgaaaacaagaagatacggacacgcttgaatttgtcactgtgctccggttctgcagtgacgtggctggcagaggctcccagccccggtgtccacaaacagctgcaccctagggtcccagcaggtgcacgcacagagcctggctcaaaaattcaagacgagaacaatagcaccgttatgaggctgggggacaaggcccgatgctaacccgacatctgataagggaaagagccagaagctcagccacagctccctggggtctggccctttggtcctgggatcacagccacggacacagccaggtggagtaccccggcgagaaccgctatcaattataggactctgatcaaccagagagcaagtggaagaaaaaaataataatcgtcccctctcccccgaaaatgtattcctttccttttcacgtctcttctcctcccgtgggctgcgctgcactgtcaccaagtttacatttacatccaaatatgcacacacacaaaaaaattaccgatgcatctcactccccggcgactttgtaacaggttgctaggtaacagtgcacacaagtcaggtttcaggacctctagtaagccaccataaaatagctgcacgggcctttgcataaacag

SEQ ID NO: 46280 - DNA, 1281 bp, Bovine  19866881165468
aatactggagtgggttgccatgccctcctccagaggatcttcctgacccaggaattaaacttgcatctcttacatcttctgcattaaagaacctacagggggattctttaccactagtaacacctgggaagcatgtacttccaaacacactaaatttttcaaagcacactaaatttttatctgttctgaagctcatggacagataggagactgggtgggaaaagaaatccaaaatacatgaatttcaaattcgaaaccaatctgccaaaattggataagctgaaatgacgtttagatactaacaaaaatattatttgtctcaagaacttagattaattactataatattccattatgagaaatttctatttataaaatctcattgctactctattgctaatcacttcaagtgccgtcttaatggtttattaagttcagaaaaatatttttaatggttcgtaaagaaaacagtacaaaaacaccaaacagtgcaaggtcctctattaggaaggaaagacattttgatcaattaacagaagtgctttgcatgtcattagaacccatttaaaattatgacctacatcatcttagaaaagcagcagtgtttcccaacaatttgcagtcataatcaggaaaagaggagcgtatttaataagacaggtacacggctaacatccacaaacaaatttatacacgaaacacatgaatttaagacaagtaagccagtcattcctgactttaccttaataatgtgatattgctgccaacaggctaatgtaacccatgggtagcccagttggcttgcaagtgatggtatcagtatgtgaatattttagaagaaatcaagtacctgatagtttcatgagaagttccgatgctgctttaactgacatatcccgtcttagcacgttgccctttgcttcctggggcttaagcgtgtcctcagagatgctcgcggctgacacttcagactcggggctgaacacatagctggaccgaggcaatgtgacgcttagggtctcctcttccttaggctcctcttttattttaaaattgagattcatgggctccttctgatttgcagctgtcaaaagaagaaagggattacatacatatacatatacgagagaccactcctgctcttagctactcccaactgaatgaagtttggaatgcatgaacacaccgagctaataccggagggaccacaaccccatcaaaataggctgagccctcggcccaaaatacaagacactccatgagagcaggacttaggagagt

SEQ ID NO: 46281 - DNA, 1060 bp, Bovine  19866881229751
aataggattcttttgtaggaactccaatgttagaagaaaatttgaccctctcagaatagagagcgttaccctattaaactttcaattcctttagcctttctatatctctggcactatattttcagacatttggatactatatatgtgcaataagtgagaattattatcttcaaatatgtaaacattttaaaccccatcaggcaagttcttctactctgatagccttcacattacttagcattatgaatctacttattttattttttactggggtatacttgatttacaatgttgtgttaatttcaggtgtacagcgaagtgattcagatatatacacctgtatctattctctttcagattcttttcccttataggttattacaaaacattgagtatagttcccggtgctacacaatagatgacaaatggaaatatcttatgttccatgggatcaactcattcaaagcaaataatatcttcaaaatctctttcccattgaagagagtggggagtaagcacactgtaaaaaaatacgtcctgcccgtcaccttcctgagatgggactttgggggtgaggtgaggaaaaggctgtcaccttacatttctttcagatcactgcacgcattgggaaggtacccagtacctttggcataactgatgattgtcagggcatgggaagccaatcaatttgatgttcattgtcatcaacagagcagaagtactaccccaagggtgggatgaaatttccttgttttaactgagagaattctctctttgctgattcctggagtgggtagaatccaagacatatctttttctccctttaatacacatgctttaaaaagcttagctgattattataatccatcatttccagcaactgaaaaacttcgattatttcaatctgagcattttaaaattaacattaatgttggtggtggtgctgggcagggggatggtggaggggaaaggcaggaaaggtgatcttctattcataggaagagattattttgaaaatgggaattagaagcaacaaacggaaagatggggttcattcaac

SEQ ID NO: 46282 - DNA, 3136 bp, Bovine  19866881279574
ttgtgtccgactctgtgctaccccatagacagcagcccaccaagctcccccgtccctgagattttccaggcaagaacactggagagggttgccatttccttctccaatgcatgaaagtgagaagtgaaagtgaagtcactcagtcatgtccgactcctagcaaccccatggactgcagcctaccaggctcctccgtccatgggatttccaggcgagagtactggagtgggtcgccagtgccttctgagactattaaaaaacaaacaaacaaaaaacagcgtatagggagagacttgcaagtatcagttagactttatcctgagagcaatgggaagccaccagggtggacagtgagatgaagagatatgaagagatatgccttatagccgcaggatgggaggacagaagaccaaccagaggtcactgctgtaacccagaggactcatgatgggagacatgaataaggttactggcatttgggatagaaaggaaaatacttgtttaggagaaatggaggaggaagaatcactgtgggaagacagggtaactggctggaaatggagggtggagaagaggcaataacagaagatgacgcagcaaatgctgccgttcccgcctcccctccccgccatcacccaggcttcaccacttcagcacccgcggggcttcctctggccccgggagtctactctgccctcctgtgtggttgagaccagggtgctggggagctgactctccctggagcagcgtgaatcccagctctctcagcccctcaggcagaaaagccctgaggtgtgtcctccacaacttcccagagtcccctcagacaagaatctccgggtggtccacccaggaaacctgtctgagaaggaacgcggtgctgggtgtcttcctttccctgactggcttccacatccctctcccagggtctcctggtctcgctgccttaaaaaaaaattcttgcacaaatatctgtgtcaggatctgcttctggaggaagctgaacaaatggtattcaaccttaaacctcccgtggtttgtgccatgggaagatggtgatgctactctttaggctaggaaagaagacagagaagagggttttcatccattcgtatcatttggggaggggagggatggaggggaggaaaaacgatacatttaactggggacctgttgagtctaaagaacttgcaagaacccctaggtgggatgtctcaatagaacatgagagagaggctgtggggcctggatttcatggggccaatcaatgcaaagactacccataccgctgtgcttctagctcacacctttctttcctggacgataaattgagaacagaaatggtaagaactctgctaaaggaaacacactgcatcagagagaacggcccccaaataaagcccctaactgtcattccaacaactgcatggagaaatggctgtggcgtgacatggggtcggggggaaggcgggcgtctcttaccacggcgaggtccccatttggcctgcatgtgggaatataggatggatcagtttaaatgaaaaatagatagtctagtttgcaagtggaatggcttttctttttttctaccctggttactggagggcagttgctgccatgcaaaggaataaacacaaagaagaaattgcatgaaatgagaatatgtatttttgatagcaaaggaatggaagaatgtattgtatatacagaaaaggccttgtagattgaattagcccgtcccaaactgaagccagggtcaccacatggcaattttcaaacaaatactctccatcgtccattacacatacgcgaggatttgaccttttacagcactattcattctccaagcatctcaacagtctttgcaaaaactaaaaacacaaccatgggcactgcctcggtcttataaatggcatgcagaaaattttatgctctgctcacagggagatacgaggccagggccaaagtgttcacagccccaggggaaaagctgtacctgagaaataaaagttcttaaactgggtttttttctttcccatgtaataaacttgtgatagtttattataagatattgaatatagttccctgtgctatacggtaagtccttgttgtttatctgttttacatacagtagttcgtttcatgctaatcccagactcctaatttatccctcccgccccttccttccctggtaaccacaagcttgtttaattagtcattaacaaaaaaaaagaaaaagaaagaaagaatgccattagcagcaatatggatggacctagagattatcatgccaagtgaagtaggtcatacacagaaagataaatgttgtatgctatcccttatatatgaaatcatttacaaaatggaaaactgggcttaaaagggcttttgtatgtcaccatttcccacaaagtacaaacacaaaagtgttgatgattatcttcaataccaagtgactcaaccctagtgccatctgggcaaagataaagggatttggcccaaaaaccacaatgtttttttttttcctcctctgtctttgtggcttccatacacagctcaggtgaggcactgaagctggaaataagtttttcctttggaaaggttacccccctcaaaaaaagggagcctccccttcatatgtgaacaccacaactgctggtctgctgagattgattagttatatttttgagaagattaacttggacacacagctgactgtggttaaagcaagacctttcactgcaaaaaaaaatttcagtggagtcaacagctcctctttggaattcatctacactctaagaccaaattaggctgctaagtcgcttcagtcatgtctgactctgtgcgaccccatagacggcagcccaccaggctcccccatccctgggattctccaggcaagaacactagagtgggttgccatttccttctccaatgcatgaaactgaaaagtggaagtgaagtcgctcagtcgtgtctgactcctagcgaccccatggactgcagcctacaggctcctccgtccatgggagtttccaggcaagagtacgggagtggggtgccatcgccttctcccaagaccaaactaggctagtgaggggcaaacagggctaagtgtgcgcacattgttcttagt

SEQ ID NO: 46283 - DNA, 786 bp, Bovine  19866881339582
cctcgaatgtggatttgcatttttaaaacccaagtgttgctgattcttcccttcaaaataagagttaacttttttaaagtgtgagagtttatataatttgtaataaaagtctgtcaagcaaatcacaggaagctctccacttccccctcaacacaccacacacagttaaacatattactctttgaggtctagctgtaacttgactaataaacccttcttaaaatatagccaagccaaacgttaagccagcaatgcagggcttgtatatacatcacaggatgctagctgtatgggtcacagcactctgacaggcaattcctaggcagttattttgacattagaaagtcacaatccatcaacttaacagcagggtgataatttggggaccggggagatagctattcaaaatgacactgtgggaagtaaacagtagttcaaatagcccctgtttgagaatgaagacatcaactaagcagaatttctttccacctctagaaccaggtattatgtaatatgtttttgtgtaagcatgttatttatggcgtttgaatagccctgagaggctaacaagcctgcaggtaccgggaccctttggagatgaggagaaatagatctgccaccacaagactaaagaatgacaaagagtggcttcttccccatggtttgtcacgaaccacttccaacaaccacgagccagtctcagaagatgcaactcggctctttctgaaatgaaaaacgctcagctctgcagccgtctgcatccatgacatgggttccttgcatgtg

SEQ ID NO: 46284 - DNA, 1329 bp, Bovine  19866881349564
ccgtgttgtgaacccataaagtttatgacacggcttgtagctgctcatttactaataccggtgatatttaaagctcttcatagcgaaggcctgggccacttgctgcctcgcccctgtgctgtcctacatcctgttgagacaattgaggtcacctcccttctcttgtgtgcacactcacattgaacacgacctagtggaaccggagcccgagccggccagctgggagctcccaacatcccccagacctttcaaggtcctttgcatagctggctgtgtgagcaaggaagctttttcttccgcctttcttcttagaaggaaattagttgggatgccttaaagtccggcaggtcaaaagggctcacggattttgtcagagcgtctttagaaagtcactttttattacattctcctagattggcaaatagcaaattagaaataagatttaaaaatcactatattctagggttagagaaggttctacaggaagggggacaattgattttattgataccaatggggaggaggagctcggttggaaattttaacttttaaacttataagactgcttttatctttcagtaatgaaagtgctgggaaagtgggtggcaaagtgtagaggaaaaaaagttttgttttaacagctttcaggctcctctttgagcctcatctgggcactgatggacacagcttctagacagtaaagtccacagatgacccggaaaaccctcttccgggactttttcaactgtgggttaatctgcagtggaaattcaaatccattcaaaccacaattacagaatccagaaagaaagtattgcttatagatgggctttcaaactgcttgatcagggagtaacagttctgaatgtctccttttttctgctttttcccttcgaggttagctagcatttgcaaataagtgaaccaacctccgacaccccaaagaagatgagataaaacctgaaacacttgagtcccacaatcagaggcggcctcccagagtttaggcttagggtaggggtggtcatcctcctgccccaccttttgcacacactaggttctggcctgggtgcaagggcccggagagactggatgggctctggaggaaaattgcaaagatgtaaaaagggaatttgtgaggtaccaggactgctttctgccaatatttgaggaatggtcacgtgagagggcagacttgcacagtgtagcttcagagggcagaggaaagagcagagagtggaaatgctggatttcttttttacattttttattgtagtaaaatatatataacataaaatcaatcatcacaaccaattttaggcgtacagt

SEQ ID NO: 46285 - DNA, 1034 bp, Bovine  19866881375958
ctgaggtgtgaactatgtcctcccgtggagaacactgccttcatgtaatggcctagaattgtgagttgttttctaatgaccctacttgttaatccagccaacctctctagagcatgaaacgcagctgtatttggaagggaacaaagtggggataccctgtgcgtaatcacgcagtcgctcagtcgtgtccgactctgtgaccctatgggctggagcctgccaggctcctctgtccatggaattcttcaggcaagaatactgcagtgggttgccatctcctcctccaggaggccctcccgaccaaggcactgaacccaatctccgtcgttttcctgccttggtaggcaggttctttaccaccgagccacctgggaagctgggacaccctgtgcttcaagaaatattcctgaaatgtgctgtgatttctcccttgtaggggaaggcaaacctcaaataacatcttactgggttttaatctgaccttaagaaagagggaaatcaaattatagtgaattgctgctttctgacatttataggaagagaggaatttcataatccagaaggtttgggttggctggaccgctagatcctagaagtgctgtgtaccagtggctactcaaatacatgttgctagataagaaaatatatacacaagaggagaaaagagtacatgtattttatttttctattatttttctttctttttattaatttttattggagtatagttgttttgcagtgtgttagtttctgctgtacagcaatgtgaatcgggtatatgtatacatagatctcctcttttttaagatttccttcctatttaggtcaccacagaacattgaggagagttccctgtgttatgcagtaggttctcattagttatctattttatacatagtagagagtacacatattttaaatatgatttatatactccataaagctggaaccgtggaattaactagttaatagtttattaatttgttttaaaaatctatattggttttttaatgacaagaagaatgcatattaag

SEQ ID NO: 46286 - DNA, 1290 bp, Bovine  19866881393058
tttcactttcattgataaactactcaccaggccagaggcaactagcatgttgtaggctcttgaaatcatcatgtgaagaattagttattccatgttaagtacgtcatgggagtacttaacatgaggtggctcagacagtaaagagtctgcctgcaatgcaggagacatgagtgtgatccctgagtcagaaagatctcctgaagaaggaattgcaacccaccctagtattctggcctggagaatcccatggacagaagagcctggtgggctacagttcactgggtggcagagagtcggacacgactcacaacacacacacacacacatacagtatgaagaaaaagaatgagtggataaaagttgtgcatggtaactaaattcaaatatttgaagttctgtcaagtgaaaaagagagtagacttactctgaattgtcattcatcctaaattcttaccttgtgtctgatactttattcattcattcattcatccaagcagcagtaactgagtgcttctctaccagggattagggatctgcagagctgaatagagtatggtccgagcttgcaagggtctcagagccaagcagggagaggagatgcaaacaaataattaaaattcagcttgaaaagtatttccatagatttctgaaatgctgagcaagaaacagagcctaggaccaatagggaaaaagttagagggaaaataactttgatgtcttaagataaggatctattgaataaataaaatcgcccccaagtgtaacagaagatcttgtgtgttatgaagaagctggtttaaccgcatgtcaggggtgatttttttaaagattgcaagtaaagagggggtgagatggggagcagaaatgttgagaattttgttgagcaaatgctgctttgcttggtttctattataaaatgggaaatctgctcctctagtgggggggaagggggtgtggggggatggggagcatcctttcaatatactgaattgaaagccttttgagaataatacttgggtgttgacacacattacagccatgaggatttgattagttgagagttggagtccctacctggtgcttgttcattgagaaaaagttttgagcatttacctggctcataaaagttgtatggaatgcagtctctgctgacagttcttttaaacgttgacacaaaacaaccgcagagcataattacaaatcaatgtgctaacaggtgcgagccaatataatgtgaattgggtgtgtaaatgtttgaggaaactcagagtaacagtaggctagaagatt

SEQ ID NO: 46287 - DNA, 1367 bp, Bovine  19866881412568
agagaaatgatttcctgctttctcaggcctggtagcactgaatggcaaagcaaattgaatggcaaaggcagagcaccgtattgtcagttttacagttttttgtctgttagcagatcaggtgaatgctgtattttttcttttcaaaatgtctttataaatttcatctccacgctttctgtggttttgaggtctacttttagaattatatctgaagttatatataaaattatatttaaaattttacttgtttaaaaggatactttttgcttaagtatgttgcagcttggttacccattactgccttttgtttactgctgtttctaggtgcctagaatgttgcttggtgcacttgactcttgagtgagtgaatgaatgaatgactgaatctcaatttatgaagtgtatttcatcagaaataatttctaaatgttttttcaggaaagattttataatttaccagaaaccaaatgtttctccttcacaagtaactgaaaataattttcctgaaaaggtaagaattgttccaagtttttctaaaggatttaagtaaaggaaccactcacttgccatcttgactgcctgagctataatttttaagtgacttttttttttttaagttcttattaatcattcacaagttttgttattttgtatttgtttttccgtacaaatgttgaactctgttgtgacattttattagagaaaaataattgagatgccagtgtatgtgattaactagactgtactgttttacatcagtatatacattagatagaaaaataacttgtgaaaataggttctactgcatccagaaacacttaactgtgatatatttcccattacagagatagtttactggctacggtgttgttatctagtcacaaagcagaaacaactgaaaaattatgtaaagcctagaaaggggtggcggggggaacaccatgattcattactagagaattttgttttcatgatctgcattgggttatccagcccaagttgaagtgtctcgtcaccatgtttatggtggcagggggcagggagccgaggtaaatacgcctttgtaaggactcgtgggtgtccaaggtgcctggctctggatctggcctttacagtgtaatttttggaacatgacgtagtctaagcaaagtcaatgtgtgttgctctttgcgtcagtgatcgattatttagaaggtacataaagctgtaaagcagaaaaaaaatgtacttttgattctgcttcttagaggtaagcatcattaaagttttagaatattttcttacagtcttctaacccttctcttgcaagtagttgaaatcatttgttcttacagattgtgtggatttttgtgatgcagtaagcgttt

SEQ ID NO: 46288 - DNA, 1980 bp, Bovine  19866881700706
aataaggctcaggatgataatagtagaagcagcaacaggagtaacaacagtagtgagtagaagaaaacgtgacttctgaaggaaggcagaaaatgacctggattcagttttgcagaaatacagactttgatcaactttcccaagtctatcaagataccaaattactctgtggacaattctaagatgaggtaaaccttatccagcacagtgaggaaagaaacgtctggattccagtggcagcgcctctatgctgctgacttgccgtcttgatttccccaagtacatgcttgttacaagataactgtatttgaaggtatactgcaactggccttaccatcactgctctatttgcactaaacaatgcgtgagaagcctaaaagccttagcacaatttctgacgtatgagattctgagaacgggctcccttgctggggcctctgactctacaacaaggacagaggacagagccaacttccagttctaccacttcttagtgatttggcagaggggatgctggagcctgactgcctggattggaaccccagtcgcaactctcattagctgtgtaaacatgacccagtgtcttagcccgtttctcagttttcatctgtacaatgggaacactaatagtgccttcctctagggttgttagaagttcaagtgggttcagcagcttggagcaggcgctgtgctaactaactagcatcactgactcaatggacaggagtttgagcaaactccagaagacagcggaggacggaagagcctggcggggtcgcaaagagtcggatgtgacttagcaactgaacagcaacaataacaaggcactaagcaactgactcttcaggaaaaaccttaaacaattaatcagtgtcacaaatcctccatccctggaagcctgagcacgtgagtgtgtgactccaggccccattttcttgtaataaccacctgttcccttctgtgactcagatcagcccttgtctcgtggagttgcaagtcactgaaaaacaggaaagagccacacactctctctcacatgaatcacccagttcggtaaaatccaggatttcaacacggagggaggccccttaaagtggcttctgacacgaggagttttagtcacatgatcagttgagtgctcatcgtgagaaaagccaggcagggttaagaaaggccacactgaagatgcaaaggaaggctgcccaaaacaaacctttctggaaggcatacttaggcatagggagagctccggctaacggcagtgaaacctgaggtcatgaatggcagaaaactgacttttctttggaagaaagatgctaagatgtttgacagccaatcagagtcagcaggtaataaggatgcctcgtttaccaggcatctcctggctcccgccttcttcggcagcacaaacaaaggtatcactggataaggagctgccctttacagacaaaccgtagtgtaactacagatgcataaaattctgggaaatagatggaggtggcacagcaaaggcccacgggaacccacaagatacaacacaaaccattcaccagctccccgttgttgattcaagaaaaccttggccattttaccgctgagctcctaacacatttgaaacaattcagcttggactcatttgcaagtcattgctttctgaaatccacctctcatggttaagatgttttcagcctcaattttatgaaattaatagaatgcgggagacagaacatttctttggccagtttccaaactaaaaatagttgaaatgacttgtatctttttattttcaaaaaacccagtacaagaagattaaaaagatattcccagccaacaactgaggtgccaagtttctgtcaactgcttggttctaatttggagagttagatttacatgtgatatcttgaaaagtgtggtttttcagaaagagaagtgatgtaaggccacagcaggcaacttttaatcaggcgtctaatgacgatc

SEQ ID NO: 46289 - DNA, 763 bp, Bovine  19866881860908
atctgtcttgagaactttttcatcccccccaaactgaagcctcgtacccattaaccaagaattcttccctccgctctgccctggtaatcattattctactttctgtctctatgaacataactacactagaaacctcatgtaaagtggaattttaaaaaattgttaatattcttttgtagctgcctcaatgctttttagaaagaagttgtagtatgtcataaaaatgtattactaattgataccactttcaccatcaaattatacatgatgtttcgtttagtgtttcccctccccatttctttaagttgtggaattgaatagggagtgtcatgatgccaaaggagccctgtttttcctgactttttttgtgatgagaaaacatgttgtgggcctgtgcagctcctcattatattttttaaagaatgattttaaattttaaaagagatgtagagggtggggaaaggtcggcagagaattgggttctgtctctcagtgaagacggcaggccccacgatgatttccaaatgccatttcagctctttggagattgacaatacccttttaaatggagaataattggtcaccaccttcctttaaatggactgtgagtcaaatttcactaaatgtcaccgccaggtgaattagaggttctgcttcactctgaaatccctttgctcagtgacgcgtcagtcaggtcttctggaatgttcccatcaccccaggtctgtgcccctcaggagtgctcagggctggttggaagaaa

SEQ ID NO: 46290 - DNA, 1511 bp, Bovine  19866881924810
acacaggagtgggttaccatttcctcctccaggggatcgtcctgacccggggatcaaaccagtatctcctgtgactcctgcatttgcagggggattcttcacctgctgagcattcagtcaggaaatgctggaagttttagagtcgtggagtggcctgggaaacggtggggaagaatctagaagcagcgggtaacaaggatgggaagaagggaaaaataggatgttcagggaaccgtatggttcacagggagagaagtacaatcctcctggtaacacaaaactcgccccgatgttaggaggtggtatttcctgacatcacacttgcttccattcccagaacagaggaggaactaacataactaaataaaaggcttcccttgggacttgccaggtggtccagtggttaagaatccaccttccaatgcagaggatgcaggttccatccttggtccggaaccaagatcccgcaagccttggggcaactaagcccgagtgctacagagcccttgtgctgcaactgagactccacacagccaaataaataagtaaaaaggctctcctagagtccccacagctcgggaatcagagcctttctcactaaaagaaatttgcaaatccaacctcgccttccctggggctacagtggggctcacagggtgaccaaacatccaggtctcaaaggactgatggattccctggatgcaagactttggtttctttcttttctctttttttgcaagtgaaatatatttatcagcccacttaataatgctttttgacatttaagaaactgtttttacgcggtcctgtcccaagacacatttacacacacatgctgcctgcaccatcagaacttacagtctgagcaagaaccaggcagggtccagtgcgggctccgtggcatcctctactaacaggaaattagtttaaaatataacagggattgacacatacatatcaccatatataagatacacaaccaacaaggacctactgcacagcacaggggactcgactcagagcagagtttcaaagtctactcagtcgtagacgttgggctttaactggaacggttctgggcaaaccagctcgagtgggtctctgcacacacacgactcacatgaaggaaagctgactcttcctgcacaagttctgctggaaacttcccatcacccagactgaatggtggctgccacaatccctgtctctcagcagctttaggacccccgaaggtcaaggtcgtgccttgctatcccgtcagtgacctacgactttgcagccagggctccaccttgcagtgcctgggggagaagcctggtggagacgtggaatctcaggccctgcccagacctacaaaatcaaaacctacaggtaacaggacccccggacatctctagacattctcacaccccagagcaggaggtctggggataaagttccttgcttacgcagtccgtgggtctgtgcatatgccgaaaattttatcttttcagtatcagggtgtgtgtgtt

SEQ ID NO: 46291 - DNA, 4049 bp, Bovine  19866880366375
ataggctagtttaaatgataaatgctgcccctcttgaaaatattcttaaaatattgaaatcaagtccctctagtccttgcaaataacttttctcaggaagggaaaatactgatcagttcagttcagttcaggtggtcagtgatgtctgactctttgggaccccatggactgcagaaaatactgatcaaggaatgtctaaacagtgagaatggcagattcatggataccatgataaaaggctatttgggacttcacatttttcctccattgacctttactgtggcactgttgacagtgctcatctgatacttaataaaaaatgatcaccttgattctttgaaaaacagagaccagtttacataaaatcccaccacctgctccagtgtaaatggtaacacccacccacaagccctgtccttcagggattcaaggagaacctttgtgctatgtctttccagcccgtggtggccaggactccctgcaggtggcaaaaaaggtgtcatttagcgggtgatcggtaagtattattgaaggactgccttcaggcagactttcttccctgactcccccattccctttcctctaaccacgatcagtgttttctcctggtccacctgggctgctccaatagcaagaagcttataaacataaacaaagaaaagaagacgttcaggttagaggaattttcaggaggagaattaaaaactgaaaattagaaaacaatttaaaaattagaaaattaaaaaccatgtttcttttttaaaatttatttatttttagttgaaggataattgctttacaatgttgttttggtttctgccataaatcggcattgattagtcatagggatacatatgtcccatccctcttgaaggttccttcccccacctccccatccatcccacccctctaggctgtcacagagcactgaaaactgtgtttcttaaacttagcaagaagggatgttcaaaacaggaggcatatgtgcttagcttgaagtttgcttgaccttgtttggacatcacgtggaccctcttatctgcctcatgataattttttgtcagctcctgcaaaatgtctggactacagtgaaagctaatctacgctgtttggctcaagtgggttgggaaataaaaccatgtgaaaatcttggggctagaaaagaagtccaaatggattaggatgtgcttttaattcgtgagttctattgatacaggtaactgtgtataaactggaaatgtaagctgccttaattccaaaaggtggttttagcacatgtgtgatttacagatccgttcctgaatttttacagtgcatttttgagtctcagttctagagaacttataagacaagtcccagccacggaagtaggtacagtacatacggtagacctcttacctcatttcagactggccagagtgtaatgtgatctcactgctttgatagccttggtaccttaaaggaatgaatgttcagagatcgtcattgggtcctttgatgaaaagaactgatctagaagaaagaaatcccagccagcttgagaaatcaagtaatcagagaaaccacacgggcactgggacacttagcatctggcacagtaggcagaatctactctggtaacaaagcagcctttcccaggtcatccaatagggaaggcagggagtaacccataacgatggggcccagcactgggcgtattatataattagcactctgttactcaggggcttattccccagcagatgttctgtgctctttcctgctgcttgactgttagccagcttggagcttaacaccttcactagaatgttggtttttctataagagatgttagaacattttcacaagccacaatttaaaagcaagggtgataagtacacccgtgttctttattcctattatgacattcaaaacaatactttccgttttaatcatacctttgcttgactgaagaccagtgacagtccagaatttttatccagttctcaaacctcttactgatgagcaggagctcagtgagccagaagttaccacttacttttccttccttgaaattcagtctgactacaagaaagcgcttagttctgggagctatcttggtggtgtcagtgcttcacttgtacgttaatggattattgagagaaactttgtcagatccttagagctggagaggccttggggtcatcactgttttacatttgaagaagtccaagacaaagaaataggagtcgttatctaaaatcacaaggatattgaatgcaggaaagtaagatttgcactttaaaatatgttaagaggatagagctcatcttaagtgtttttaccacacagaaaacccaatccacaccaagccacacacaaaaaggaccacaaaaaacccaacctgcaccaagctattcatgaaacgacacaaggacatttttggatgtgatggagatatttagtaccttgaaaagtatcatgggaatatacataagtccaaactcatcaagatgtgtacattaaatgtatgcaaattttgtataccagttatgcatcaataatgggcttccttggtggctcagttggtaaacaatctgcgtacaatgtaggagaccagagttcgattcctgggtagggaagatgccctgaagaaggaaatggaaactcaccccaatattcttgcctggagaattccatggacaaaggagcctggcgggtgtcagtccatggggtcaccaaagagtcagacacaattgagtgactaatactttcactttcatacctcaataaaacttttcctcccgtttctccaaacaatgctttcttttttgaaaatccttttttcccacagctttattgagatctgtttgacatatgacattgtgtaaatttaaggtgtacaacaataaaagctttaaaaagaaaaaagaaataaaaagacgagcactgactgagagactgtaattacaattaatatattttccggaagatttgtatccagaatatataaataactccttcaattcaacaataaaagatacatagtccactaaaatatgcaaaagcacagatactttcaaagaaagagatataacaatatgagatgaacagcaacttaaaaagagattcgcttgaggtgtttagggccaggttcacagctctttttactaagctattcggaacgaaattatctagtcccatgggtggataatgcaatcgtcataatgcagtcattaacagtaagttatacccagatgtccaaaagactcagctacaagatagaaatttagtttagcatggtttccatgaacatacagctttaatgggttttcctcaaaccagaccgcttagttgattgcaatgcctggattggtgggctgctcgtcacagctctttgaggctccctggccaccaagagagtccagaggttcatgctgccttcttctgtgacgttatggctgagtgtattaatctacttcctcctctccatctgccagcaatatatgccataaaatctgagagatttgagaaatgaataaaatatacctttgttttcttctcaaactgggaatgagtatgagacagccagtatgagctatcctgcattatttgtttctctctagagcagtgtcggagttttcttcctcataaacagttaagtagcacctctcaggccaaagggcgacctcagtatattttaaagcaggagacattgctggtgtgatttaagcccagaggccttcttagcctgggcttctgtgagcttaaggaagaatttgtcatcttaagaaactttgtcatgagtctcctcccgctggtcaggtgtggaagtctgaagtctcctgccaggcgagataactgattggcagtgacactcaggctactctgctgatctttgtaaaggaaccaggaaaaaaggaggctgggacaataggtccaccgctctgcgtctgtgctgtgtgatgtggaatagaaaacgaacttcagaggttaaaccgtttcacaagcccacatcaagccgcgccacctcctggcagaccactgagaggctgtcacaacaaggaaat

SEQ ID NO: 46292 - DNA, 1595 bp, Bovine  19866880443336
tttctgacactgtccttacatcttcttgcccattaatcaggcaggatcagcagagcccagggaacaattggcccagggctacacccctgggaagcagaggttttgatcagaatgcctctccatgatctcctgaactcatctgaggagatttcttcctttattccaaagaaggtttggtttctgaaaaaaattttggccaccttagttccctgaccagggatattgaacccatgctccctggagtggaagcacagtcttaaccactgaattgtcaaggaaggaagtccccaaaagaaggtttccattgccataggttattcatagcaaccgattacaccacaaaagctattattgttaatatacttttagcaaagtcaaggcacacacgatacatcaaaaatgcatcctcaaggaacttgattccctttccactgcacctgttattctttgatatgcaaaatgttatcagtgcacataggctactgtcaaaatatttacacaaggcaatgaaaacatgcttagaatgtaatagtctgcaagatcctaattgcctaatgacagttcagagtcctacaatacactgcttcaatctctggaccacccagatagaatgctgaggtatactcttttaaatgaataaaaatagttggagttataagcacaaagatcttaaaaacatcaagtcatcattgccaggttctctgaccgggcttagaaacacatatgctttcctagtggccttaaataaaacatctgaacttgatggtgattttaatatagaacacatttaatttgatgaaacccatctattgagttgctaatgtttccattagctgtttattgttttaatagatatatactacttcagtaatatgaaaaggaaaacatgctacaagataaataagtcatggggtgtgtatatatgtatatacacataagaaatattatcaataatactgtaataactttttatgggggcagatggttattagactttgtagtaatcattttttggtgtgtatctaatgtcaaatcacttcatggtacacctgaaactaccatagtactgtctgttaactatgatacagtacaataaaaacagtgtaaaaaaaaagaaaagcatgcaatgcttgccttcctatatttttcttacagttaatttactcatccctctacatgttcacacaccacactgccacaacttgtagacatatatatgtgtatgtgtactgctgctgctgctaagtcgcttcattcgtgtccgactctgtgtgaccccatagatggcagcccaccaggctcccccgtccctgggattctccaggcaagaacactggagtgggttgccatttccttctccaatgaatgaaagtgaaaagtgaaagtgaaatcgctcagtcgggtctgactctacgtgactccatggactgcagcccaccaggctcctctgtccatgggattttccaggcaagagtactggagtgggttgccactaacatacagtatatatgtagatagacttatttacttttatcaaggtaaaattatgatttgcatatcattctgtagttattcccactgcctacaacatgttt

SEQ ID NO: 46293 - DNA, 2235 bp, Bovine  19866880540798
taatggtgaaagtaggcacccttgccttgttcctgactttagaggaaatgctttcaatttttcaccattgaggataatgtttgctgtgggtttgtcataaatagcttttattatgttgaggtatgttccttctattcctgctttctggagagtttttatcataaatggatgttgaattttgtcaaaggctttctctgcatctattgagataatcatatggtttttatttttcaatttgttaatgtggtgtattacattgattgatttgcggatattgaagaatccttgcatccctgggataaagcccacttggtcatggtgtatgatctttttaatgtgttgttagattctgattgctaaaattttgttaaggatttttgcatctatattcatcagtgatattggtctgtagtgttcttttttgtgggatctttgttaggttttggtattagggtgatgttggcctcaaaaaatatggaacacttcacaaatttgcttgtcatccttgcgcaggggccgtgctaatcttgtctgtattgttccaattttagtatatgtgctgccgaagcgagcaccctatcccacttttcatgcatactttatttcctcattttctcagtgaattgagagaatgtaacaattgctcaccctaaaataaatgaacttttaaagggcaaaatccaaaggacaaagactgcaggtgaattcactgtgaaactaatgaaacatgtttcagggcacctcttcctgggctctgggaggtctagctatgtgttcatgttgtcatatatttttgcaagatttgcagaagtaagccttttgtttttgtttaatttaaaatgctgtgtctttctaccctgatttctccttcaccacagtgtgccttatatttgatggtgactgtggtcatttttgagattgggctaaggaagtttatttgctccaggatgcatattcctgtgttcctttttccttctacttgaaaagtagggagtagaattctttttttatatttagtcatctaaaaataagaaaacctgaatatatacattagctggtatattagccttggaatcacctttcctgtgcgtccactgacagatttttagttcttatctgtgcacctgttcttaaatatttggtgtcaaatagctaaatcattttaaataaccaactcagttttcagtctttcaggcagatactgtggaaagaatctctctggatttgacagcaacttgaatttcaatgacttgtattgttggtaaattattccatttgctctgattcatttatcctgggagagaaaatgcagtgtgcctatctcaacctccccatgtacaacagtactgattattggtattgaccccttccttttctatcattctgcactgcaatggaatcagtttcaaaagctttcaaatagatttttatttactgaagatttttggcaactgctatctatattattttatgctttcacctcattaaataattatactgcttgattatttattatattcctataccaaatgtgttggggattaaggaaggcagtgtttataacatactctttatagctaattaggtaatctattgttgaattttcttttgcagtattttcattgacttttcttgttagaatacttttcttcttgggacattccaagtgtaacacagtctctctttgtcccttttatgaaaatgtcaatagaatagctctaatatttccttgaagttcacccacattatatcattttggttatatttccttttgtctgaattacttctttgaataaatatgacttttcacaatctgatcagcaaaaaaatatactgaagataatgtgattgattgatacacatgatggttttatcactctgattgccatgtaagtggtccacagcaaatgcttagtctcagaacagatactcctgaaccagggactaattaaagcaatgatcagagtatttttcagatgattttcttatgtatttaaagtgtgaattgacatgactaaggaacactccccatcctcccagtctacctcccactcacccttaccttcatatatatataaaaaacccttccatgatatcttctctgatattttatcttaatgcaaggtatatctctgtatcttgactacaaagacaactagtacctatgtaacactgtggtcatgatacagataaggactgaagcgacaagctctaggcttaaacagcccaatggaa

SEQ ID NO: 46294 - DNA, 1915 bp, Bovine  19866880597846
cttattctacctctgatgaaagagagtaattaaatgagccccaaatgttgcccagaatatggaactctgcagctgaaaactgatcccttggtgaaaacagcatctcaccctcttgacacagtaaggcatttacaactgccacagtgcaactatctaatgatccaaaggacaaatgggaacttggactttgaacgtatgagaccagtcagcattctctccattaacctccatttaccttcatgggaaggaggccctgcagtggcttttgatccaagggcctgaatctacaattgccacatagccaatcagaaccgtgaatctgccacaaatactagttgccaactaccaccaaagaaactgcaacttgattcatgcctctccagccctctactacccctaagtccaagcttccatcatctgttgcctgggttattgcaatggtcttccgagtttccttacttctgctattatgttccaccaatttatctccatatattaaaccagtgcaatctttgaaaacatggattttctatgtcacctcccaccataccccactgaaaagcttgtggttttttaactacatttagaataaaccccaaactccttggcctggacaagtccccatgaagtgacctccccagaatctcctcctacacatggtgttccagacaccaaacttgaacatgcagagttctttcctgttgcggtggccctatcgtggtggctgttgcctctgtctggaagacattcacttctattctgggcataaactgctccctctcatctcagagtctccactacaatatcacctgctcagcatagctgtccctgggcacctgtctcaaggatcctctcccatcactctatcaaatcagcccctttatttcatcttaagaccacttattacattctataaatatcctttatgtttacttctgtcttcctacatgaaaatataaacttctgaggatgaggaatgttgtttctcctttttctaacctagaatatttcctgaaaaatttggaaaattaattgaaattcattgggaagtgctgtatgccattaaaatccatcaatcgaaggctaccggtgtcagggtatgaggaaagctgaatgaaaacagaataaagcagctgatcacaacccaggtgcccatcagcatcacaattatgcaagcgccctctgacctgccaaatcatagtcttcaagggcagagtgaacatccttagtcaggaagttccatgggtgattctgctgcacctttgtcttaaaatgatcagaaagaacctttccttttcctctggaatcatcagggctcataatggactgttatgggattatgacacacggtcagaacaatgcttcaacggtcctgtcttaggagatgcagtgagcatagaggtaccctggcaggaaccatgacaagtgaaagcagagctctcagaagaaatgttttgccacatcccaatcttccagggaagtgtatgaagcaactcagatcaaaagacttctgtgggggtgtatgtgagtagtatgtgtgtgtgtgtttcaactagctctttttataaaagtaaaatattgtagaaaatttggaaaatacagaaaaaatataaaggagatattttagtcctgaggaacaaaaagctatagccactaatacatgtattgagtacttacaatctgtcaggcgtttccctatatgcttcacatgtatttatttatttaactcttacaacaacccaatgagatgttttcctcacccattttactgatgacaatacggaggcacagtgaggtcagaaaagttgccccagatcatacaaccctaggattttaatttagcaattttactccagaactcacgttcttaactactatgcaataaagctctgtgtagttgtgtatatttatattt

SEQ ID NO: 46295 - DNA, 1352 bp, Bovine  19866880606574
cttatttcctgcttcctgtggagaactctagaatggaagaaaccaaggctgtgagggggtggagaatgtggcagggatcctaactttcttgctgaaggaagctcttaataagcacccatctgccttcagggaagaaaacatgattctctttagcctttcaaattcagtgttgaggaccaaatgctctcagcggcaatctgtgtcccagtgccttttcctgtggacttagtttcaaatgttctttcctaaaaaatccattgaagatgacataaaacccagatacttacccaccacattttatttccttagtgagtaattaatgacatttcttcagctattttaatgtgttctctgagtcaggtaaaggagaccataatagttaatcaaagaactaattcctgggtacttaaaaatattttaagcacttaatcatacttaaaatggactgttaatgaagcttataaaccctttggcagctctgaaagtgaatttctctgaaggcttagagagtattaatccacttagatttttaccaaacaaatattattcatgctttaattaatgggaaaagatatttagaagggtgaggttcgtgttccattgtccttcactgggtctagtaattacttactccacgtgggaaaccctgagcatggattaaacattcttcaagttattctcaaacttagagaaagttagtggtctacttttttttattaataaagaaaaaaatgagaagacaaactgaagataagaaagaatgattttgctctaatgttggcatctaaggtaaataggtcacatttgctttttctcaagattactggcccataagaaaaaaaaaaaaaatgaaaaaacagattattccattttagtggcttgtttcaatagtagtattaatataaattgccttctcacttgtttttaaaataaaggaatgaatgaaataatttatttaatatagatagcaatatattaaaagtcattttttaaaaaagatttttttgatgaccattttaatctttgttgaatttgttacagtattgcttctgttttatgttttggtttttttttgcctgagaggcatgtgggatcttaactccccaaccagggttcaaaccggcaacccccacactagaaggcaaagtcccaaccactggactgccagggaagtccccttaaaagcctttaatttgatagcaaggctaaagtaaaggatgaacgaggatcaagatgaaaaatagacagaaaatgaatactgtcaacctttcccccgagaaaagactgatactgctttttaaaagtaagcaattttttagagcaggtatggaaacttttctgtaaaagagcca

SEQ ID NO: 46296 - DNA, 1279 bp, Bovine  19866881020153
ttataatatcagtttataaaggaaaagtaactttttgtagtatactatcttctgtctgaaatcaaaatgactagtaaattcaattacaagatttaattcatctttatactttcttactatgtttttatgagacacagtcaacaaacagttagttaaacctatctcctgctatgcagatctaatccagtggattgctcctgaatgtgtaactgtgtttaatgctaactttgggaagattctaggagaatatggccactcatatccctctgatcaaagtatttcttttgaagtctttttagagtggtaatatatttcatgttagaactgttaaggatgagggacccaatggcacctttgtctggaaagaaagaggatacctaataattaagtgaaatggcaattatacctaccatctcacactaatattctacagccttctgaaagtcataaatcaactaagaaattactccgtgtcctgtgatgtcttcattttgaatatgattagaaagtattaaaaatatgtgtgtttattttcttggagtattgggtaatctacattataatatataaaataattttcaataaagctggtcacaatattccttacctcttctgataagtagaattttacatcatagtggtttgaattttgttttgttttttcttgttgtcttttttattctttacggtatgacaagcttgtttttcaacttagaaaaaatagttggacagttatagatttttggaaaaatgaatattggaaaacagtagaattttgtatgatatctgctttaggagactaaataatttttacctgtcagcatatcaagtagattattgaagtatatagatagctttttagttttctttataccatctgtcaactaggtagagagattgagaattgtatcatttaagtgagaagtggcttgttttaatttatttcatatgtgagttgagcagacaattgaggtaataatttttctctttcttagaataattaataattttaattaagaatttagactgttatttttcctatattattaaataacttaatctctaaaacttgattatttctatagttctaaccattttatgttttctttaaggggggtaacaatggatgttggtatgacaaagtttgagaccaaaaccaaagttattacattaatggatgctccaggccataaggatttcattccaaatatgattacaggagcagcccaggtaccagatatttccttaaccaaagtacagtgaatgtaaataaaatttc

SEQ ID NO: 46297 - DNA, 1255 bp, Bovine  19866881036371
cctgaatactgaagtgggttgccatttccttctccaggggaatttcctgacccagggatcaaacccatgtctcctgcttgggcaggcagattctttaccatcgcaccacctaggaaacccagtgggatgagggggaagatgtaatgtgacagctgctgtgggcaaaagcagaaatgaaccatacttcacttccccattttctatcaggagaaaatggtgagatattacaaaacccatggttctcagatggggtatgcttgtatgatatggtggaacattctcgaccagcagcttaaagaaaatataaataagaaagaaaatataaaccagtgtttaagtcaaatgacacaccaagtgccctcagctttaggaaagatgtttgtatgcatattaattacagattgtaagggtgttcccaagagtatgatccaacttctttatctcatccacaaacaagttgtataaagggcttggacctttatgcttatggcactgtgtgtgaggggtcaggagtaaatttagaagcaatttgaagacatgaaaagctataaccatttattttataggttgaaaatattgaacagtaatgtggatataaatgcaatgagaagggtaaatattgtgtaaaatacttttttagattttcttgaaaaacatgtttcaaaacaatgcatcaaatatgaaccatttaattgaaaactgaacaatttggtgtttcactcaatctcagaagctatcaaatataagccagtccaatttcagacatgttaatatgtgagcacaggtacactttaaaataggtttataaaggttattataaatgctatttatgattatttttaaataaatgtttttaaaggcaggaagagtataagaacaatatattctaaaatgttaacagagaaatatactttaaaatgttaaaaaatacctctacaagaggggagtgagcatgtaatgagagaatttttgtctctctgtgtgtgtataaatgacatcgatgtgagtaaagctatgtgtaaatttgctagtcaaaaaattttgtgtatggagcaaataggccaataggttatgatttttattagcacagcaaacattcacataattcagggaaggtcaaagaaattttctgtttgtgcttcagctgcacattcctacctgctgtgaaataaacccagccttcctgccagggtctgttgattcagctttgccatcggagtcatctagcactcacattctaaaggaataaagctgc

SEQ ID NO: 46298 - DNA, 1448 bp, Bovine  19866881120081
tgcattgacctacgcaccctggttttattgtgatacaacagatgctgtttgacaagcctgctgagttaaaaaacaagcgaaaaaacaaagggggagaaaaacagaggacatacctggttggcaaagctggacctgacagttgtcggaatgcactcggccaggttggcatcttcaaagatgacggcaggattcttgccccccagctccagcgagagcttcttgcagtggggggcgctcagctgcatgatgcgctcggcggtgggctggctcccagtgaaggagatgaggggcacctctgggtgggacaccagggcctcgcctaccctgggccccgttccaaacacaatatttaccacacctgggggaacacctggatgggaagcagtaccggttacagccattcttctcagcgtgtcaagggcttcaggttacacagggattctccttcacagtgtttgtttgtttgtttggggggtggtgttttggggtttttttggcaaaatgattgctgtcaatgttgtgttcgtttctgtagcttgaatgggggtgagaagggacgttaatggttgtctctagtcaatagcaaaacagagacgacagcatcatctctgcctgtattatgccccaggtggaatttctctgggtgctttgccctaggaaatgcagggttaaatgtcctacgtaattcattccagagtattgactaagcctcaggggctgaggatgcagagataccctcaggcaggtcagggcctgtgagagaggacagcaaaggttaagttcagggagcatccacactgcagaagccagagaagagaacagctacctccctaggagagagacggagggtcccccggggaaggtgacttttgagatgaaggtcctgttccccatgatctggatgcaccatcaccctctaagactgagtgtccaagaacacccccacgtaggtgctccaggcttttctgttacaaaaacttactgccctatacctgcacgtattcactgtgttttatggatttacctgttcactacacatccaccaccagaaggggcatcagccaagggcagacacgggtctgcgttttgccctctgttgtatcccctgtgccatggcctactttgccagatagaatgaatactcaatttaaaaacaatctttttttggccatgctgtcggtatatgggatctcagctccccaaacagggatcgaacttggcacccactacatttgaaatgcagggccttaaccaccagaccgccagggaaatccctagaaaaatatttttaatgcatcacatttaaaacagatcaatgagaaaagaagatataatgctacttatatatgttattaaaataattttactaataataaaaataaaaatgtaaagagataataccagtaaatgctcacatttattgggtgctcactgtgaatcaactgtaa

SEQ ID NO: 46299 - DNA, 1136 bp, Bovine  19866881158941
aaaaaagaggagatgtatgtatatgcacatctgattcacttttctgtacagtagaaactaacataacattgtaaagcaactatactccaataaaaattttttttcattattttaaaaatgtcagtgaccctacagtggctgaagcctacaaacatacatctccaaagccagtcatgtgcctctcctctgacaccctaacactgattacctgctttctccaggagtctgcacatcatccacgcggtcacggaagtcagctcgctgggcttagctatcactgtgttgccagcagcgatcgctggcgcgatcttccaggtcagcagatagaggggcagattccagggactgatcagagcagctaacagaggagaacagaagcattgccagcaatgacatacccttcaaagcagatgggccagacatgctttactaatgaaaactccttcgtgctacaccaaatgtcagattgctcttccaaaatcccaatcatttgtggaatttcaatgcttcaaaaaattccacaaagaatctccaatcttttgcagaatttctgtagaatttcagagaaataagtctaaaatatattacaagcagccatacctttaaaactatagtcaatacagcttactcttttcttgatgactttcaattatatttatgaacaagaacagtataagtaccagggctaaaatgctgtcacctctccctaaacagtctcagaatgtgatcagttttgaggtttgtagactgatctttgcactgtctcaacaatcttttttatctttaaatggtctaggcactatttcttctaaatttttccacctgtttttctaattagctgtagattgagacataagatcttaaatcgttcacatttgtaataaataagagcaaataggttctgagatgtgaaatccattttagctaacccagggaattttttaataaataaattatctctaggttctcacctgtatcctaatcagataggtttgctggctaagtaacatctataacatttagaatgtgtcttcatgtaagaagccatccagatttcagaccacaaaacgcataaaaataaaacccatgttagaataagtaaatggagtcactttattttatactctaccctcaaa

SEQ ID NO: 46300 - DNA, 789 bp, Bovine  19866881175770
tgtatgttagccactcagttgtgtctgactctttgcagtcccatggactataggtcaacaagctcctctatccatgggattctctaggcaagaatactggagtgggtagccattcgcttctccagggaatctgtctgacccagggatcaaatccgaatctcctgcattgcaagcagattgtataccgtctgagccacaagcgaagcctttgtttgcagtaataggaatattaaggataatcaatattaattcttcattttatggattaggaaacatttccagagaactggtatgactttattaattctgctaaagaagtaaatttaaaacctaagaatctaatatattggtctagttccaagtctggtcatctttctatttaaaccaattctgcttcacaggtgaagactcactttaagtgctcccaagactatatcagaaccaagtaatagactattcctttccctgttctgtaagtggccccttggaaagacctctccaggtatgggggaggtgggcatggggagcagcggtcccctgcagtgctttataaagccagaggttcataaagagcacacaactgccctcctctctgggattacagctaagctttctctctgctatattcaagtttttgctgcatcttttctgctatctactagcagatttaggcaaatcaattaacttctctgtgaatcagtttccccacttataaaataaatacaattctacccattttgtaaggatttaagaggatggaatgagcaaatacacatatctaatttcatg

SEQ ID NO: 46301 - DNA, 1508 bp, Bovine  19866881227303
aatttgcttttaagttaaaaagtgtgctgtgggccagcagcaggggagatatacttctgcattgtggggaagagaaagcctcagaatttgctctccaggccgcctggaatgctgctcatcatggtgctggagaaggccagtgtggcttcagaatggactgtctgcatcttggcacgtggaatcttccttttgtttctgaagtctattgtctaagagagagctgacattaacttttgtctcttactttatgaatctacagcttcctcttagaaagtagttaagatgattgcaaggaaggcatgtgtatgtgggagagagggacaggcttttcagtgacttaaaggacagaattctcagctgagagcagcaaaaggaagagaatgtccaaatgagaccaaggggaaggtggttttcaagtcaaccttttcttatctcaagccaactcatgacttcctgatgaagacatttgtccaccctccggtgctggtgtttctaactattcccatcacgcagtaacaattgtcaacacctgcctcaggttcaggagttgggaaaaatcacaagtgggcaagagacataagcacacaaccaacatgaccattttaatgacggaattggtcacctcagataatttgctgaattgaagcattaaaagaagaagccatatagtgtctttgacatcgtgttggctgaataatcatttaataaatataattggatggttgcctacgtaaagaaaagagtcatatctgctattcatacaaacatttggcaagtatttggccctatccccaaagaattctgatttcttttctccccccaccagtttggttcttgaagctttaaaatcccaaataaagttgattcttaggatttgagcatattgggctcacaatagagaccctgaaccactagacaaaggagggagggacatagaacagaatggaaaaaattattgaaattttccacccatgaactagacacaccctcatgcaaacaagacttttaggctaaggctatattttacaataatgtgataaaacacttgataagcccacagaggataagcagtagtttttgtttttttcccaattctctgaaatccagtaccacatgctgagcagttggacggaaaagccatttgtcatctctgtttccaaatgtctatttcctttctggagccccagcagtttgaggtgctgtcaaaggcgagaggacatcgtgtcagtggctctgatctcgcatccacccttgtcctcactgagtccatctccaccacttgctagccagctctgacaagaggtgctgggctgggaggtcatgggaggagctgtcaggcgtgtttctttctggctctgcagttggctcttcatcacgcaggaaaaggcagagagtcagagacaagcttcttgagtgctttctcccctttgtaggcctctcccagtgctcttgaacaggggccaagtaacccagtcccttgaaaagttgactcagtcctcaataccttg

SEQ ID NO: 46302 - DNA, 1176 bp, Bovine  19866881279929
gtacttatagtcaaaaaaattccattaagatatagcaagtagatagctagagttcacttttcactttgtgggataggcttaagaaatgattcttagttgaatccacacacacaaaattgcacacacttgcctttcactatcttggtgaaattttcaatgaacatcgaattccagccccacagtgcactctgaaatattcaggcagcaagatatcctgataactcatgttcaagcgggaatagcccttggtttagccacatatacatcttcttctttttaatgattaggtatagcttgaggttacaaaccacaacctgatgtgtctggttatgtattttaaagatctgtatgaaaactcattacgtctggttttgtgtgtacatatgtttgtgtgtttctgtgttttttttgttagtgttctctttttgtgcaggaaatataagtatatggaggaaccgaactggttatattttacagaatattaagtaaaacttttgaaccatcaaactactaatttcagaaattcattcagtgaagaaagatttatggagtacttttatgagtcagatgctgtggtcagcgctgtgaatacagtaaagacaaagctatgtggtggtctgtgtctttgtaggccttccagatttaaataggaacaaacattaactaagtaaccaggcatgtgactcggtaatcacagatgctacaagtgctatgaaaaaaagattgggtactttgagagcatctcataagttgttcccaagtagcttgaggtcaaagaaggtgtcccagaggagatgatatttgaactcatatctgaaggtcaggaagagtgtcagatgagggaaagagaagagcttgatttcaaggagaaaactggcactctggaaggagagggaggccaggtagcttgagggtcaagggtggagggagactggtgagccatgaaggtaaagaggaaagcccaagctgagtccatggaaagaatttggtctttatcttaagagcaattggaaagtctattaagggttttaagcaggggataacatgatccgatttacacttttaagaaaattactttgactggagtctggaaaatggattagattaggcaagagtgcctgctgccctggagaggcagtgattagactattaggagccagtctcttggttgtaaat

SEQ ID NO: 46303 - DNA, 805 bp, Bovine  19866881303755
cgaagagtcagacacgattgagcgcctgagcatgatgttggagtagaagactgggagaagaggcatggcaaaggggggaaagaaagggaaagaggggcagagaaggaagaataagaatgagacaaaggaaaatgatggaggggaaatttaggtcaccccaaacggagaaaagagtaagagaggaaatgagatgggatcagggagggacatattgccttcctgtctcctgttctctggaagcttcactgttagctctatagctggcggcttccaagccacagccgagtctgggtctgtgattgcatctgcaggtggcagctggcaggtgagagcctctcagcctggtcctcttgagaccccacccttcatctctctgattcactccaagtccagctctggaagcctggcttggtgtgacctgagggaagcccctttccagtgagtacatcagccagaggagtcatcagttgctattttttaccatttctagacaatggcttaatctatctataaatgtgttctattaccacagttgtttttcctttttgagctggggacatcttggggaaattttttttttttttaccagccctgttactgtgtcccagagaagatcagtgaaaatctcacatgtgtgaaagagctcttgaatgttctggaagatctgaaaacacagtctatctgactgaccagcattcaaatgatctgccattcgagttttgctccaatgcacaaaattaatgtgaggcgtctgaattgtgagattgatgaattccaattagttctctcttttaaatagcagtgt

SEQ ID NO: 46304 - DNA, 2022 bp, Bovine  19866881342930
caacttcttgtttcttttccttagattcaacaacatgattgctggtaacaactgaatagcccaggtgagcagcattctccacaagcctgtgcagtgcctcactaggttcacacttaatactacacacaaaaatagagcaaaataaaatatttatacattaaaataaagccattaaacaactgaaagaaaatataggtttgtttttttttaaatcttacaacagaaataagctttttaagaaaaaaaaaaaaaagaaaccttagagtgaacactgttacatttgaaaacataaaaaacctttcagaaccttcacatgtctataaaaaatctaaaattgatttttaatagcaaaatgattttgaaaaatattgtagcatatgtaactgattattactatcattttgtaaaagacttttatgaattaacaacaaaaattggaagatacaaaagtattgaataaagatattatagttaattgacaaatgaccacatataaagagctaataaatatcagaaattcaggctcaataatcaaagaaatgcaaataaaatcaatatgatattgtttttgtcccatcaaattatccaaaatttaaaaattataatgttctgcattgggaggcactctatacttttagggatatagatacagctttctggaaaacaatttggaactcatattttaaaagccttaaaaaattgcattttgatacaaaagttgtacttttaagaatttacccaaagggaataataagagacgtagcaattatttttgtgtgagtatattcatgtgacattttatcttttgatgcaatattaagaaaacacaaatattcaattaaataattaaataaaatttgagagaattatatcatggcctattatgcaatctttagaagctgcatttctaagaataatgacaaaatgaaatgccaattatatattcttaaagaaaaatcagaatacagaacaatgtgatctgaatattggaggaggtggtggtggcagggaaacaaggaaaaagaatgtgtttgtttataaatttaggaaaacaaaaataacaacaggagggaaagaaatcagaagttatctgtagttctttttcctatgttggaggataatggatattttaatattttaactttatatttttatggatattctaaattgtttttataggcagacatgaatcttacaacaaatgctacatttatttatttatttatttatttttggtttgtttttgttcagagcacatggaaacacatctttggatgctgtatgtgataagcttccccaggacagtgtattcctgtcctgtgatgaacagggcttatatgttctgcctagcgggaccccaagagtaactgcaaagttggtggggctctttctattcaagtgactctactacatgatacatttaacttggcagtttagaatttcaataaaaggtttggttaaaaatgaacaacatgaaaaatgaaacatggtcagtgattttgtagacctcgtcctctgttactctgtctggctcctcccctttcacagtgtggggtcacgaggtgagcgaggtggactctggccttcacaccttttgaacatgcctgtccaggggtgggtctatttctgtgatagttaaggacagaaatctcctgatggagagctcatccaacaggaattgctgcctggcacagcgaaattggctagtgtcctgagtgtgtgttaataagtgatcagatacttctttcattccagctcctctgtgtctactgttcccatggagttgtcatcccctctgtgttagtgaggcatcgccagtggttatacttgctgctctcttgttggcatccatatgcatcgtcttatatgtaccacttgtggttcaagttgtaacaggtgtctgtgagtgggccctgggcttcctgctaccagatttgtttctgttacgctttggactatagttgtggacactagcacctgaaatcttaaagaataaggctaggataaaattaaatattccca

SEQ ID NO: 46305 - DNA, 1881 bp, Bovine  19866881370325
ttacatcacagcttccatgaagtttcatttgaaaggaaaaaaaaaaaaaacttaaaagttaaaaaaaaaaaccactgagctacagaaaggataaagtggtgaccaaatatacaaaatattatgcagatatgatttgtttgagaaacacagggatatattgtttgatgatcatctaaaccaattaatttctgaaatggagctcagagggataaaaaggaacaaaactgtcatacaactgcagttagaagtggggctattttactgccctgattcactgacagtctcctattcaactgaataatattcaaacactctatatgggtctcctcagctgacgtcaacagtgaccttttcatatattttttattttaattctatgtgtcatgaataatgtacaatctcagagcacaggcattattttattcctgtactatgtttctaggacttggctacacaatggagtgggcatcatttctttcttcaaaacacagagggaacaagtgaaaagttagaatgtattaggtgtctttcttcttccaaaattactttccagaaaatatgggataaaatgctaaaagttgaaactgttgaaccaaaagaaggaaaccttggggtccctaacttgtgaaatggtatgtaatgttatcctgttgccactgtgcctgtcttccacttcttctaattctgtctctctctcaaagcacagcttattctcaccttcttgaccattttcaagagtgatctggtatttctctgccagtgtacacatatagccttgattgtgtgtttacgttccactccctagaggtcttcctagctcatttgaacacttcaaatactaggacctatcttatatttattctcttcttttaagttttttaattggagtacatttgctttacaatgttgtattagtgtctactgtacagcaaagtgaatcagccatacatatacatatgaatatatcccctcttttttgggtttccttcttatttaggtcaccacagagcactgagtagtgctccctgagctctccataagacccagcaatcccactactgggcaaatacacagagaaaaccataaatccaaaggacacatgcgccccagccttcattgcagcactgtccacgatagcagtacatggaagcaacttaaacgtccatcaatagggaaatggatttcttttattcttgaagtggcatgttctacatgcttaaagaaaacattgccaatgctttcctggcagagaccactaagaatctgcctgtgggtggacaagatctatttatgactcattgccatgaaagaggacacacaccatggggaactgtggaaggtggtagaaatgactagtgatgggatttgggcttgtgttaggtgatttgggtgagggcttgaggaaatagggctttgctgtggattggacactgtcaggaagtagaggtaattttgtgatgggatattgtcatagatctgatctagaaggaagggagactagactgaggctatagctataatcagtaaatccacagccataattaacagccataattacattaggcaagacaagagagttggttcatttttgttgtttggacagcgtttctgtttttgttttgaaacatcgtcgtcttgtgtctgtgctgatccatcatagttacagagtggacttccctagtgctggtgctttgtgaaatcttttccatccaatagggaacacccgaacctacctgtaagcaccaggtcagctcccactgtcaggcactgctctgctctttctcgacatggaattgaattggtttttagcaacactgcatctttatcaaagttccctgtttgataccctgggtgggtggagagcatcccaagacataggac

SEQ ID NO: 46306 - DNA, 2010 bp, Bovine  19866881400745
tttaataaatggagatctaagggacagagataggaggtctctgccaggtggaacaggattcaagtcaaggctgtctgggctcccccacactcttttcaccatgttaaggctataggcatccacacccaactttttgttcaaccttcaggattactgagagcagagttcagtctgattcatgcctgtgttccagagaacatttaacatagtgcctggggcagatctaaaaatcaaatcattaactaaatagatgaatagcaagtaggtgaagatggcatcaaggcatctgggcttagatcacataggatacacacgggcttagatcacatgggatacacacgggcttagatcacatgggatacgcacgggcttagatcacatgggatacgcacgggcttagatcacatgagatacacacaggctgatggaactggagaaagatgtcctttctctttggtcatttcattcccacgtactgcccgcctgctaccttccttgggctgctgcactaaaaagagttaaaaagtatgacttgcaagggaaattgtccactgcaggatgacagcagctcttgatgaaactcagaagaagaaatgtgactttgttgctttttcttccccttctattttgttcttccccaatctgggtggctcccatgtgaagtgacctcgtcttaggttgatgggtttgggagaagtcactgctgggttgccaggaagagaacagtctgaccacaccagtgggacaatcacctgaacaatctacaggcacatgctataaaatatatatccactcacacgtatgattcagcctcactcaaatgttccctgcagtttagatttgaatatttgatttacccttccctcataaagcaccataaaatcgccttagtgcatgactcactttctttcatttactcacatttcaatgatgataattaaccttggctaatagttttcttcactggactgactcagaggttgttaaaaccagcaagctcacataatagacagtggaagatagaaacacgcaatgcagtttggctcatgtgttcccacattgacatctaacacatccttgggaactctcagctgggaggtctctcggtcaaaagcagggaccctggagcccaagtcctccattttggtcagtctcatgacagaagtagttcaagagccggcaactgggatagaaaaagcaagaaaaggaatggaagtgttttcttgttattattatattttataataaaacagtgtatttgattatctatttggctttaaattacatgacttgttcctcaaaaagttaaacatagaagtaccatatgacccagcaattttactcctaggtatgtacctaaagaactgaaatcagatattgaaaccaatatacccacttgcactttcagagtggcactattcccagtaactagaacatggaaaaatcccaatgtccatcaacagataaatgggtaaacagactgtggcatacacatagagtagaatactgttcattcataaaaagaagtgagtgctgatacatgctgcactaaggttaaccttgaaaacacatgctaagtcaaagaagccaaacacaaaggtcacttattagtgactccgtttatacaagactttcagaataggtaaatccacagaaacagaaaatgcattaatggcagccagaggctgaaggaaaggagaaatgggagaatgattgcttaatggggaccatattttcttttaaggagatgaagatgcttgggaactagataaacatgatgactatatggcattgtgaatgaactaattgccactgagttgttcacttaaaaatagttaactttatgtgatgtgaatttaatgtcagttttcaaaaattgcatgccttcccattgagatattggtaatataaataaaattataaactttccattcttgggtaaatcaatttggcatacagcctaccatataaggatgatgttcaagatacttaataacagcaaggacacat

SEQ ID NO: 46307 - DNA, 2256 bp, Bovine  19866881431349
tcccctggggaaggaaaaaaggtccgatgccataaagaatgtggagtgtgttctgaggatcaaaggaatctcagtccttccctttcatccaaggctgcttttctgcagaaagtctttcacagtccacttaagcgcaacttcctgtgagcctgggacccctcaccagtcagggagcacctgcagcctctgctggcaacagcccagttctcgacaagttcttgttcacctctgagtcgagccttagggcattgtccaggtgccaagcacatcgagtctctgcagcagggaaatcgtgtccattaatataataagattaactaggaagacaggtgaggtcacctgtaacttggcgccaatctggcaacccaggttggtgctagtgagattaaaaggccctgcctagcaacaactctgatgtcgtgtcaaactggctggagctgcttgcttaacaattgttcaggaagtcctcagtggctcagttcagaaagaacattcaggtaagattagaggaaaaggtcatcggtccccgaacttctcttcaggagatcaaatagctaaagtcacacaggattaagaaaaccctttgggaagtctaaaagagagtacaataaacaagcaagcaagccagaggagatctttcccttgctggtgtgtttcagtgtaattgataaatatggagccatctctccagatgttgaaaccaaaagactagcccccatgagtccacagctctgaaatttgcacagaggtcagtttgtcatttaatctgagcatcttctcctctggagtatttctgtgtctgccctgctgacctccgtcacagccacctgagagaaaaacttgcctaacacacctgctcctgggctcctggatgatccctttgtctgagcctcccggtcaaacccgagggaccaagcgagcttgtcaattccttttgtctccacaataggacaggttcttcacagaagcagactgaggaccccagcctcttgtgtaggatgccaacttgttattctgcagggttgtggtgacacttataaatggtgcatgtcatcagagaaaggtgacgagtgggatgagtaaccaagtggtgggtaaaagcttaaaaaaaaaaaaaaatggaccggcaattccattaatgaaatcagagcaaatgtcctaagacagaacaccttcctctgagcacagccaggtcacaagcagattggatctgggatcccagaagctctcagaaatggggccactgctttaccctttctccttgcacggctgtatctcatgggtctgcttctcctgcatgccccttccatcttcctcgctgcagctgcctcctgggcttcctaagagaaaagccaatgcttacaagattgtgcagacatcttacaagattgtgagaatgaccttacctgggttgcctcccagctcttatcagtggtgcagtattaggaaagatatcacatccaaatctttgttcccttatttcataatcaagatggtggtattacccacccaataggattcttgtctggtgcttggcgcatggaagcttctaaggtgttatctactcttcttgctgttgctgtgttactatttctagtcactacttccatctaatgctagtttgcctgtgactttggtcagctgcaagccacttcctcggtgaccttgcaatctggtttccccagagaaccaccttggtcttgttacatgctgtattcccaatcacactgccattgtgcttcacaccattccatcagctgtagccggagacagtggttacactgtacctttatagtcacctaagccccaccttcagaagggtctgttggtgagggatgatcctaaggaagcagacgttgaatgagacacacttcaaacctacctacgaaattctttcaggaactttaaacaaagctattttcaacctcccatttttcctattaagagttcattgtattgtgaatgctatcagtaaacacttttaattttgagggtctcatgtatcttttctagtgttagggtgaatctctcaaggctgatgctggccccaaatctctgtcagacctgaggatgcattctctttcctcttaaaatccacttggtcaaatcaatgaacctctttctgctggacactcagacgctatcattggtgtcagacttatcccaaagcactgttgttatttctctttttaatgatggaggaaaataacagtttttattaatatatagtgctaagttcaaaatcctccatcgtca

SEQ ID NO: 46308 - DNA, 959 bp, Bovine  19866881469975
tttctctagcataatcataccatcagttacacagaagcatgttcaaggccattcacactggccttcacagaggagacaaagttatatgagttaacatttatgcctcaatcaccttcgcctttgttttcagtgtcgtaagtcagtttgaaacatattgctgtctagatagaaagaagttatgtggcttagtctataataattttgtgaaacccaaagtacaatagacatctgaatgactgtcaaaccaatgattaatttccaatacatgctggaatatatttattgatgaatagttatatcaaatgttggaaataactggactagctatttatagtcaccaaagttcctcagtcacttgaggttagggcttccctttcagttgctataaacacaacttcctctcaagactctgtttatacgtctgcttgtcaacccagcgccagtcaccggcgctcccgtttttactgccactgccccctcatcctgtttataggcaagagggggtgccgtggatgcagaattattttaactcatcaaagccttggagaaactagccacttttgttgtgttttaaaatgattcattttttagttgggcctttagcttaatattgcttttccaagagttcatcggcctgagcaaacaattttaaggcaaattatatcaaaactagatacctatagtcacaaatcttccttgacctcctcaaaggataatttacattatcaactcagagcaaaggatccttttactcttaagaatgaatcttgttaaaattgccttaggaattaaaaaaaaaaaaagatgatagatatgatagatgtttgaaacccatactaatcaattaaaccagtttttttttttaaagctcccctttgattttgttatacagccaggattatgaaccactgctcaaaagtcagtatccatgacaaacaaatgaccaaataaacgtttta

SEQ ID NO: 46309 - DNA, 1198 bp, Bovine  19866881935911
acgctggcttgccacctaggtagaattgactctgacttaatgcacagatcaagagaactttagaattgggatttggggatgatgacttttgttctgtgctacccaatagcactcactagaaatgagaagcagatggtttgcaacttagcactgtgagcaaaagttgcctgtttttgcattttgaccattgaataccaaagcctgggttgagccaagaattctgagcagtctgtccaggctgatttgattctcagaagtcttctaataactgtggagatatgggctcaacttcaaagattaagtcctggaaaaggggccccaaattcccaagttctgtggtgggagacggcacaatgctcatcacaccactcttcgaggcaatgctaattgccttgcatccagatgttttctttctcagagccagagatgaagagtctgagacatcgtgttacagatgttaaggaaatcgtccatgctcctatggcaagtgagtaggagtgggagatgactgccacatccaagctctactcactagaccactttcattccactcctttcaaaagataattatcaattagctaactctattctcagaataggatggagaatacgatttccaagatgacctagaggggaaagtgaaagtgaagtcgctcagtcgtgtccgactctttgcgaccccatggactgtagactaccaggctcctgcatccatgggagtttccaggcaagagaactggagtggattgccatggccttctccaggggatcttcccgacccagggatcaaacccaggtctccgcattgtaggcagtcgctttaccatctgggagaggggaaaggtggtttaaaaactgaagttctgaaggcgttatttatcctgaagccattcatatatgcttctattggttaaataaataataatacagggaatactgcactgtcattagaaataatgatgtaggagaacactgaacgccttggggaagtgaggtatataatatcatagagatatgattccattttagctaaaggaaattatagctgtctatttatacatgcacagaaccagaggatgtatactaaagtgctaacagtatctctaagtgaagtgattaggcatacatttttaaaaacttgcttctcttggctcatttttctatcaaaaatttttaaaagataaacaagaatggaaga

SEQ ID NO: 46310 - DNA, 1103 bp, Bovine  19866881020474
cctagtattcatggtgataaaaactactctctgaatgtagagagatgtgaaatttgtataattctagacatgtttgtcttaactgcagaagtcccagaagaatagattttctcacgtctccatggggtgtttcttaaatctattactttatgaaattaaatattggcatatgaaaacctcagcagctcacttattacctaaattaaaatgtgttataatttgaattttgttcattttaaattgagtgaagattaacagcataaaggaggtttggtaatggaaggtaagaatgtaaaaagataaggaattggcaggatatgcgattttgtaaatggttcagtgatttactctttttgtcccttttgtataacagtgaattgtaaacagcaaatgatacttaactattttttagagttagttctccataagattaggtgtgaaagcccatttccttcacactgtaggtaccacctcagaaacagcttagtttcaaaacgttactgttccaaggttaaaaaaataaaataaaacctaagaaaatttaacttctgatatcctataaatgccagaaaacatgtttcaagttttagagaaaaaaatcaacagttttgtctctgtgggagatattatttcataaaaccactttctaccacctacacctctctctctaccaaattgtggagagattcagggcaacctgaggcttggaacattctatagggccaggcaggaaaggcatagaggtggtctcttgttgctagagtgcccaaggcctggaaatcaggtgctggaataattcagctacagcagaatatcagctgctacaatttcctagaaacacagcagggggtgagaatcttgtacaagtgaaaaatgttagtaatgatgtctctgaacaacaatgttcgtgctttgtgtcttaaacattttttattttatcctcataacaatttgagagcattaattccattttatgaataataataacaactttattatgtgctattttgtctgcatatatggctgtctacattttctcctgtgccagtatggtatagataagcaaatgaaatgtactgaggctaaagattttccaaaaatca

SEQ ID NO: 46311 - DNA, 1524 bp, Bovine  19866881048443
tgatccttttgtgagtgtgcgcagaaggcttaacagtgctgagtgctggtttcctcagctataaaacaggaacaaggctaaccaccctacatattgtgttgttcagaatagcacgataatgcaggtgtaatggggcagtttggctgattgagtaggatacatctgtcgatgcaggcggctcccctggtaaacctgcctttcctccatatctcttttcattctcttataaaagaggagctttggttataaaataaggcagtggaataagggatgggatgaaagttcctggtgtcagtcagacttggttaaacacatgaaatgggacatgacaaccaaaaagcttctcaaactgggtttgtgctcttgtgactagagtaaagttgatcagacaaaaactgatgcagtttcttggaaacttgtttgatctttggcgctttcatctcttgaagtctgcatacccatctgaggaacggtgatgataacaatactatttcatagaggtgctggttggattaaatggaactgtaaaagtacagtgtttggccaatgattaataaatatctattattatttttttatcatctgtgagactctatacaagctagcctatttcagaacctagatgacaagcataggaaagaattgggtaggaagctactttcccacctgtgttcttaccttccaaaccaagtagttccaaactatgagaacatagggagaccacactcctcatgtagattggcattttcatgatgggaaatgatactatgagatttcaccaaatgtatttgtggacagagacagaaataagtggagccagagcaggagtagatatcatggtagcttccagatgagaaccttctttggtaagcacagaatgctgaagtttaggacacctggattacacacgcaaaggcctgaacacagtgccgtaagcattcaaaaaaccgattgctataattattatcattgggtccattttccactcgctgcaacagccagatagctgaaaaagaaaatgaactcctgaaacagcttcaatcatctacaatagtggttttcttggcatgtcgacagtttacaatcacttgggtttaaaataatgacatagtgttgtagttcagcctggttaatgaaaatagagacaaccataaatcctgggggattttctcctcggtgagaagtaaagaaagataagtcaaaacgtgttagaaatacaggatacctatatcactttgctcaatacttagtatttcaacatcttgaaggatgtgtaggattccaataggcaggcatatacattctagaaggaagtaaaaacatgagaaaaccaacaataaaaggaggaaaatgagaaagaatttatggaaaatgtgtgtagtccagtttgtctgggaacaaggctctcctttgtacccaattcagttatttattgatgcataaggaaatacccccaaacagtatcttaaaacaggggatttttacttcttgccattctggaattaactgctcagatcttttgat

SEQ ID NO: 46312 - DNA, 821 bp, Bovine  19866881215262
atcagaaaagagtaataacggcaactagcagtgaacacatagagacaatgcagaatgtatctagcaaaagtcttgataaaagaaaacaactatctatggactctacaaggtctttctcacaggcagttccagaaagttcaccacccaagaaaaaacctatagcacctctcataaaatctcattcatttccagcaggttcagggcagcaaagtccaaaaccttatatgagaaaatttaaaacacctttaatgattgctgaagaaaaatacagacaacaaagagaagagcttgaaaaacagagacaggggagttcgggctacaacatagttagaaaagagagccaaaatcaaaacatatcagagttgaaaaaggaagtgctgttacaaaaaacaaaggaggaggtccccctaactggaatggattcagaggtgactgcagcccaaaccaacccagtctctcaaagtctttctcaagatctaagggtctgtactgataaccagctttccacaacaccggcagtgacattctctgccaagaggctccaacatgttccagcaaccttggaaggcaaagatacgcatgaaaaagggaagttttgcagagctcaaaggggtatgatccaatctaaatcagcttgtgaaattaaacagagtcagcaagaatataggacccagcaaacacaacagaagcatctggagcagttgcacttgcccaaaagccagccagtttcccccagtttcaaagttaaacccatgaaggttccaattctaggtcataagttagatgaaacaaaccacagctaaaaagtcataaaaagcaat

SEQ ID NO: 46313 - DNA, 1251 bp, Bovine  19866880369412
acactcctgtgttcttgcctgggagatcccatgaacagaggagcctggcaggcttacagtcctgaggtcgcaaagagtcagacatgactgagggactaagcacacagtggttttgctagcagggcccacacttgctggctgcaaaccacagtagcgttacacccagaaaaaccacactcagcactggcttacaacgtaagtggcctaagtaattgcatctgaagccccatttgcagaaaggggctgactgacagttcattctctctgagacattgagattgattacctaagaaagacaaggaaatcgcataggaagccccattattggggcaaagtgtgtaactctgtaactcactaactgcactgcgtccacggagcagggggttcgacgccgggctctctgggaagctctagatatgaaatgactttgcatgatgcagctccgatgctaaaagcgcaatgctcaggactacatgattcagtgagaaaatataaatggaaaattactggagctgaaattttattgccaagttatttatctttgttattactttccgaatccttttgtgcgttttgttcacggcgctggatagaggcactcttacttacactttaaacagagattaggagggaaaaatattcctcacgacaccacaaaataccagattaagtctcagccaggcctgtgacttctctcattacaatgaaatatctagacactgaagcaacaataatagtaaaaaaaaaaaaagttctgcagttcttttcacagacagttcacatggcttcctattgatgccacttagcatttcttattagaataataatgtgagaacagggctcccaaagacatggcctggaatttcctaatttcctaattccagcctccagctcatcaggcaggtattctggatcacttccaggaggggatgggtgacggtgacctaggtgaatcagaccagtaagataatatcaatattaataacaataataacctgccttttcctcttacagagctctgtttcctttttttatttaattaaaaattgcatacgattttattaaattgaaactgattttctttgtaaaataaaaaagacatttaaaacaaatgatacataaacatacatatttatgtgttctagcagaagttcacattttttttgcattcattctttgagcaatgatttcctgccacattcagagaaaaaagaatacgctttttgcttttgggtctcttacttgattttt

SEQ ID NO: 46314 - DNA, 3990 bp, Bovine  19866880449447
gtggctcagaggtaaagcgtctgcctgcaatgcaggagacccaggttcaatccctgggtcgggaagatcccctggagaaggaaatggcaacccactccagtattcttgcctggagaaccccatggacagaggagcctggtgggctacagtccacggggtcgcaaagagtcggacatgactgagagactttacttcacttcacatgaggctgttacttttcttttcatccacatttgtagaccagaaaatataagttcatagaaatcataaggtgtatcaaaatgccccatctatcattggtagaactggtgttaaaatctaagggtgcccagcatgctgaccagtgctctgagtcgttgctgctgttggatcagaatcacaaggtccaggggacaccccccatctaacacttactagaagcaagtttccgatgatctctctctctctcagcctggtttccactaggtaaggctggaattcaatacagaactgttttcagggtcatatacaatttttgtaaatactgccgcaatgctaaaatttgcattgttattaaagatgataaatcaccagtcccaacagccttaggacagttttctgtagaaacagacttcacaacaggaatggacatttcctgcaaagagcctcatgctggagagtcccaaagagtgtgaagagttccctttgtaagcagatttcctttccccgatgcttgaaagatataggcagtttgggtctgaggcctctctgaccccagaagcatctccctgttcctctgcattatactatctggtgtggagggcaaggggccactggaaataactgggagtgtgagagctggggtgtgtggttatgacacgctctgaactttctcttctatgctggtcaccaaggcacctcaaccacagtaagctcatcaaccagaggcaattctgccctctccctccagggagggacatttggcgatgtctggagggacatttggcgatgtctacagacacttctcattatcacaactgggggtgctgctagcactggcgtgtagtctggagatgttgctcccagacatgcaacaaagcatctaagggctttctcatagctcagctggtaaagaatccacctgcaatacaggaaaccccagtttaattcctgggtcgggacgatccactggagaagggaacggctactcactccagtattcttgggcttcccccgtggttcagatggtaaagaatccacctacactgtgggagacctgggtttgatccctgggttgggaagatcccttggagaaggggacagctacccctccagtattctggcctggagaatcccatggactgtataatctatggggttgcaaagagtcggacacaactgagcatctttcattttctctttcactgttgtgtcactgatgggaaatggacaggatttgaatgcccatggctgatgggtagcaaaaaccacaagggagccctgatctccctgaggcactggcttgttgctggccctggagccccaaccgaattttcagattcaagatatccaaatgatgagcttcaaaacgccccatcccaccccatttcctgggacatatcacatgacctagaaaaatcccacccggtgtgagaaatcagacattttcaggagcaaaaaaaaaaaaaaaaaaaaaaaaggcctgtttttcactgttgctgctttagtgtttatagagaacttgggaggaaaatattatcagtcacaaaacttcacaagaaactcacagtgttaatgcactgcaccagcctgatgctggttgaataaaatgctcaagaagtggaacatttcacgggaggtgtaggcaggtcctgagtcatttttcttcatcatctggtcatgtttccctggggcaggaagggagggggcacctttctttgaagctattcatcttctttcacctagaagatcatgttttgtagctgtgaagcctaaacacaccatttcataatttcagcaagaagctttctggaaatagtagtcatggtattgattaatctgtacattcaaatagaacagagcctccaatatggaatactgttatctaggcagtcactgcagatggattcatacaccagccagacatgtcttgggtgataatgaagtcccaacctgttgttttccccatatctctgtcttctggcttgaaaggttggcacataaaggcatgcagaattctatcactattaaaattcatcaaacccaaactcagaccctcacctctggcatgcagtatgcttggcactgggggttggcaggaagacagtgaaagatgaggaagaattaggtagcttgctaggcttcctgccctcaatatcctcagagacctcgaaggagaaagaaggcagcaccaagcatggaaggttatgcaagaacacaaaaagaaatgccacacagactcagtgcacacgcattttcaaaagatctcgtttctctacagttgatctttgttttctgtagacactctgcatccatcacacaccactcccatcctttgtaactgtaactccatttcttctgggtgacttgcccctctcctgatggccttgtctttgtaaagcaaagttcccatcagtctccagctgacagggagacaagcgactcaagttagaccagaaaacctgcctcctggacactggaaatggcacagtgagcctaaggaacagctcacagatgtcctttcagtgactattcactgagcacccattctgtgtcagacactgtgctgggtgctgagggtgcacggggaaggagaccagcagacccctggcctcaggaacccgagactgccatagagtggcgggggttggggaggtgatatagaaacaagcaaaatggcatgccatttgccccaaggtggtgataagtcttgtgaaagaggaggaggagaaagaggagagggagggggaaatagggggaggaggagaaggtgtaagaagggaacaggagttgacagatcccttcagggacagcctcctgcaggggtggggcatgttccactcttcattcctctgtttgctttctgttgagacttaggggtggttccaaccccctaggtcaggggcagcaaatattgtcagtaaagggacagatggtaaatattttcagctctgggtggcctgtagcctctgtcagaactctgccccttatgaacacagctgtgggcaatgcatcagtgaatgggtatggctctgttccaataacagtttatttataaaacagatggcacgtaggatctggcctgcagaccagagtcagctgacctcagctcttgatctcaggatctgtgcttattcctaccttttcagagtcagttctccagttgcagctcctattaacctagggcagtccctgatttcttcaaataaaccaacctaacatgacacatcagctttcccttgcttgcaaacaagtgaacctcatggatctagaaggtgcttctcattgagaaagggcaggtgttacatctgtgttattaacaaatagcaaaaggcgcaaagggtacatggtgtcatcaagtcctctcgccacgttttataggttgttacactggggatcagagagggcgagatgcctgcagaagaatacttaccaaaccccgaacaagggccagaattcaagtctattgcttccccaggtcagtacccttatcgtgggtccgtttcaagtggaaataacagaaaatacaaccaattttaataaaagagggttaattttacctacactacaagaagtttgagaaggtagttgctgacatcatttcaggggtctaatggtgttagggctgcagtctccacaatttcccctggccttccttcatgagtacaaaatggctgccacagttccagacatcacacagatgttcaaggcaagagggagaaggaaagggtagtatataaataaatcctttctctccccagagccaaagttttcaagcaaccactcagagca

SEQ ID NO: 46315 - DNA, 1656 bp, Bovine  19866880526137
taattaaaatggagacgcattgcccccagtatttctgcctattctttaatgaaagaaactctagtctctgtctgtttcttgttaccacagttataattacttctatggctttgtggagagttttctggaagcatagaggcaaaaactctgttttcatgaaagctcttccttttaaatgaggctgttgtttcttgtggccagaatgccaccctaatgccaccctaattgtcctttctggattgaatggctccctattaattgctgcacttgtgtctctgcagaaggtactttcttgggctgccgacaaagtggctggtgtgctgtcattgggctcagctggcttttagctccatcctgaccaatgtccatggagcagggactaaaagagcaatttacatgcctcacctggtaaaggtctcatggtcatctgatgagacagataccattgttgcccccattgcacagatgcaaaaaccaaggcctagagactgaacaatcaacccaaagacagacaagtagtcagtacaactaagaagtatctgagaaaggacttgagtgcgtctggtgtgtgggtaaaccagctcgctgggggaacaaaacagggaggggtgggtttttgcacttgctagcttccatattcggagaaggcgatggcaccccactccagtactcttgcctggaaaatcccatggacggaggagcctggtaggctgcagtccatggggtcacaaagagtcagacacaactgagcgacttcactttcacttttcactttcacttttcactttcatgcattggagaaggaaatggcaacccactcccagtgttcttgcctggagaatcccagggatggggggagccctggtgggctgccatccaaaggggtcgcacagagtcagacacgattgaagcaacttagcagcagcagcagcagcagcagcagcagagtgactcagcatgcacacatgcatgtagggcggtggcggggttgtgcctaagccctcagtccctcacaggtgccaaacccctccattactacccctttgtgagaggctgagaggtatccactgtcagctgagacagagtgcctcagtgtagtcctgagaagacttattatctcatcatcagttcatgttttatactgaatatcagcttttttcatctcggacagcaaattaagagcagattaaaaggacaaagagtgaaaaaaggagggagtctgacgtcacatactccatgtatgggtctccagcttgtgaactcatgctggtgaattgaggtggagctgatgtaataataatagaaataaaaggcacaataagtgtaatgtgctttaatcatcctaaaaccatccccccaccaccccagtccatggaaaaattgtcttccatgaaaccagaccctggtgccataagagttggggactgctgcataggagcaagctattgcctactgtaaagagacccaagggactatatattaccaaagtaataattgcacatatttctacatcactctatctatccatctaccaatctatggatcataaatctatccacacataccctaatgcctatttgactgtaaaccccatagggtagattgcccccaattcttcaccatttctttatttgttccctttgccatgtgacttta

SEQ ID NO: 46316 - DNA, 2099 bp, Bovine  19866880531799
tggttttgttgttgttgttcagtcgctcagttgtgtttgactctttgtgaccccatagtatgtagcacaaagaaggcaatggcaccccactccagtactcttgcctggaaaatccatggacagaggagcctggtaggctgcagtccacggggtcgctaagagtcaggaacgactgaacgacttcactttcacttttcactttcatgcattggagaaggaaatgacaacctactccagtgttcttgcctggagaatcccagggacgggggagcctggtgggctgccatctctgggggtcgcacagagtcggacacgactgaagcgacttagcagcagcagcagcagtatgtagcacaccagacctccctgtccttctctttctcctggagtttgctcaaacttatgtctgttgagtcaatgatgccatccaaccatctcgtcctctgtcatccgcttctcctcctgccctcaatctttcccagcatcagggtcttttacaatgagtcagctctttggatcagaaggttagacttggaaaagaggagatgggtagggataagaggagtggtggtggggcagggtttcttggccaaggaacaaccatggccagaaatgtagaacgaatgaggggggacccagatagaagccctccccagaaaccatctgagaagcacaagttgacctgggctgtgaagacaggatgctgaagatgtccaagggagacacgaggacctggtaccattacaaggcgcaacacttgcaatcaatgcctagagctttgttcattgataattgacacccttggccccgactcagaagcacagaaatcaaataaaggctacttggacgtttcctgcagcttgtgaattgataccgatttaacaaagtgcttgttgtcggagaaagcagaccagcagatgggccacataggtgctgatggaaaatgtcttcaaatagacgactgtgccgtttgccccttgaggaggcgtgatccccgattccccttccaaattcatgggtgacgcccatcactgggcaagctcatagccctgctgactcaggcctttaatcgcaggcaattagagtgactgacagcgctaattaagcccttacctgagcaggcacctccactagcatcactgccgagagcagccagccataactttgatctctttgatttgctgttttctcattccggctgtttcaggtcttatctaaatttcctcatcacctttaatgaacatttttctcccatttttcctaacgattttaaggagctggtgcaagatgttctctgaaaacacatgcacagttactatactgttagtcaagagggctcatcagtacagaaagagggattttgcatcaaaattgctgggtgcttggagcagcctgcaatacatcagcttctttttttttttttttttccagatatgacattactgccatttagctgcagaaacttctgatgccaattcttcttattctattaaaaatataagcctgttttttgaggctgaaatacaaactagactttttagaagggactaatggaagaaaactgaagaaaaaaaattacttagcattttactcacttctaagatcaaatgaattaaaaaaaaaactaacggaaagtgaaatcttgcataatttcactttgcctgaattttgtgcttcactccagttcagtgttgtaagattctaaacacacacaactgtcttaagggtgttctccccaaatcccttcttcagtcaacatgcatttctttactgatactctattttgtgacaggcacagggctcttgtgtggtgtctgtttttaggacaaagaaaatatgagaaatactctttcctcagctcttgtgtgcaattagagtgacttttgagttcgtggttcactctttccctgctgcccaacctgcctggcctcttcgatcttcctctcctcttctctcgctgtcctgtacccaggctctctgacccctccttgcctggcctggtttcctggactgaaagacagaggccaaactcaccaccctgcattcagaggcttcatcctgttgttgtccagtcctctgatccagtcccatcccaacct

SEQ ID NO: 46317 - DNA, 1977 bp, Bovine  19866880695305
acaggatggagcagtgtggaaaaagcactgacctataggaacaaagggcaagcccactggttcttgggggcaggattgggggctggagaaatacttttttttttttttaattaggggaggcaaggtgttaactgtcaggtagggaatgggtggagagaggtgaaattaagaaatgtttctgaagggtataaaatgcaccaaaaaggagcttgagtaattctgaagtgcagagatgagaatggtggccagtgtgaggacccaaaatgggtgagtagtagcgagtgttggggactagagtggaggaataggaagaattcccaagggggcttgactcacctccagccaacctgatgctccatgcaaattcagatgtactaatttttagtgaaactccagaaatctgaatttttataagatatatgtttttacctcatattcctatctttctgttcaaaacagctcacaggcaacaacgagaccaagcaaactcagccatcagattttgctgcatttctttgaagtgaggtttaatcagaaccaatatgccaccttttatggatgcatgttccttttcttctattttatcttttttatattaacattttatataatgcaatgctctgcttttgattttagcaatcatctcaactaagaaatctcaaagcttctattaaccaagagaaaacaaaagaggctaaaatgtaatatagccaacactgtacacatttactccttgcccttgcttgcttaattctcttacttttccaaattgagaaaacaggtattttcatgacattcacataagaatatattatacttctcctataattcgggaataagaaagcataaaaatattccatctgagatctgtttggaaaccaaaccactgagtgccctagaagatggtattattcaaataacattattcttcctgtggactctattaacggctgttctataaacgataaaacctattcacccatgaaatccatctatgtgaacgtgatcattatggagacattaaaatcaagaaaacgtatgctagaatttgagtgatataacactgcatattattagggaatattccttgtcgaaagaacaaatattggcagaaaacaaagcccaattcaaatgccgaagtgtgagaggtgctatagaaacggaactttattttctctgggtctgatcattttcatgtaacaggagcaaatatgagacttctgatttgtctcctccacattattctgtttggtcgatttctattcatctgtttccgggtgacttacagtgtgtggggccccaggtcagacccagcctgcctgagaggccctggactgggagaactgtggaaacatcacgtccccctgggctgcacaccccacacaggttccctttccattgagacatatggaagtcaaactatgactgtcaacaaccctttgattattcacattccattttatttctggctggaacaaaagtccactctgttcctcagaagacccagctggcagagcccagagcctggggaacagtactcccctgacatttcctcggctgacaggatgctcacctgagtcctcaggtgtgcctacaacatccacgagggacgggaagctcacaagttagccaacctccctttaaaaaaacaccaaaagaacagattgttgtcccctgtctctttgcggagtagatgcgatactgtttgtcttctgtacaaatgcttcaaaactcagagaagacctgcaccaaataagcagcacaccctagtcacatcctcttaaaagaattataaagaaaatgtacaacatacatggaggaaaacatgccatcaaaggcgggaagaacttcgagaatgtgacataaaaatgtgtgtcttttgcagtataaagttgactgatttgcagagcctgagtttaacctaatatataatggcagctcagaagaaaggagagcttctttttaaagtgaagggtg

SEQ ID NO: 46318 - DNA, 1455 bp, Bovine  19866880762148
atttttctgtctctcagttatcaactgtgggtctctgattaagctttcttgtcaacctttgcttgatttctcttctttcctcttgctctgtctgatcattcctttatatcaaggtatttcttctctccagttcctccaccacgggtctttggctcaatcgtttggagagcttcatttcgatctgctgccggatctcctgcctctcctcatccgtcctctggggggaagatggtttcggtcctccagttcctgcctgctgggccggttcctcagcttcaccgctagaagctccttcttgcatttcctcggcagcgtcccagagatgatagagtcgttcagggcctcttcgtcctgatacaagagcaggtcgtccttgagttcagaattcaggatcaggttctccttattctcctcagactccttggccacagtccgcttaccgtcagaggccccgtcgaagctccaggcctcctcccgctccttgccccgctccacgctgcacgtcctcgacagccggacgtccacgcgcttcttcggggaccctttactgtccctgccttggaagctgaatcagagatgcagcacaggttattcactgtccccgtcacctggacaccctgcaaagttgacctgaagacttataacgggctttgcaaagacggcccccgagtgtgtgcaactgatgctcaggaaaagaagtgccaggggctcacagggctttcagcccaaggctgctcagaatgtgttgctctgaatgatgctgacacgcatgtaacaaaacctgctgagacagcaccgccaacgtgcagatcaaggatttcctaagaaccaagcagggcatcttctttgcccaatatttctgccaagccacgtacgtattctggtatctgttttgccgtccaatgactcactagtcttcagcctatgaggcatgtgaggtcaagagtaagagtcagcttccgggcaggttacctgtgctctcgccagatgaaaatgggacgcgatcagagtccccagacaacataacggctacttctccctctcaatcctctcgtgtgatgctcccactcgaccctgggtccctggaccttccaggggaaacacaggggcttttgtgcctggttctcatgtgtacaattcccaccctatccctctcagaatgtggccactgagaccagctaccaaccagctgcagagcccggtgcaaaactgaaaaaggaagcaccttgctcaacaactgagaattccaggatagtgagagcagagctatgaggccagcctggacccatcccctgtgactgcccccagtgagactggccttggatggggggttcaggcacacaggtccccctgccaggggaggggcctcacctgtcctggcggtgcttggtggccagtgctctgtgcagctcctcaatgacgcggctggggggcagaggccggtggacagtggtg

SEQ ID NO: 46319 - DNA, 1058 bp, Bovine  19866880799551
cctacggattaatgaagataaaaggaggccaaatgcaaagtggtgtactgtgacggctcagagtaagtgcttaataaatatttcctgtcattataacactattcaaggctctgagaagtcttgcaggaaagcactccgttcgactctagctcagcctctccccactgtagctgcctgcagtgccaccatggaaccgagcaagatgcatcgtcacacaggaagcatttgtcctcatcagtttacacggcttcctgaaagccacgagaacctcaggccccacggagacagaatcagggcaggaacctgggccggtggctccgagctcaatgctctctgctgcctttacaacatctctctaccccgaaggcacttcttaccaccaataaacaaaagaattagaagccattctcccagactcccaaaactaaatatttcacatttggattctgcagtgcttagttgtcagctttacagaccacaggcaattaagagtccaagcccgggaagccggttgttaataattctgtcattattctcaattttcagcaccaccacacatgaaatacccatttccaatttctgtaaaggtgctaaatggcttttgcactgtgtcgtgaaagtttaccatcagccaaacggctgcaaagaggacctgcggtccccaggcccagggctgtgaaaactgctggttggcctgcctccgggcgataccctttctctgtgtttcatgctcaggacaggtaacctcctgagacgcggcagtcgttggtcatgctcaggcttgcagggcgtcgctgtccatccagatttcacaaggctcaaagcgcaggatgtgagccggaaaccactccttcctgctggggcaacaccccagagccagatggagaaagctagtgaccagcctctccaactggtctgagttgagaagagggaagtgcgtgggcatcaggccatgtctgcagagagagcaagtaggaaaggtggtctcaagggctgctgaggctgaagggctgcgtttccttctcatgacgaggaagcccatgaatcagaaagcggat

SEQ ID NO: 46320 - DNA, 1444 bp, Bovine  19866880829448
tatagccatgtattgttagggaggtgtacacactggagggacttactactgtcagagatgattattaaaactacaaaattttgcctgcagactaaaacaagcaaaagaaagttattaaaactcatttttgggagtcttcttgtgtccttgagctgggttctgagcagaataggaaattgatactctgataattctcatttactttatatttattagcagtaaatcctttctctccaccaatgaatctttgcaagtttttctcgtttttctaactgttcatttgtctttttcttgtgatacctacagtgcatgaaaatgtttcttaatctgttcttgcattgtgtgtctctctaaagaaactgactaaacttcaaaggggtcaagtcaacatattccaccaccaaagtcttgttagggagagaaaatgcattactgctatggtaatcatgtgacacttcctctctcgatgagaacccttccagcaaacagacgcctctgcagaacccctgaaggccctgagtaaccaattcgctcttcagatctgcttatcccatagtgaaaaggaaccgacagctccagagatggggatactcagtcacattggctgatcgggagagaggttaaacttcagggaatcagagcatctttaagcctagcaacttggaccagagcattcttccaggacaacagctaaaataaaagttgcttttcccaataaatgtaggctttggtccagtgagaaataccttttaatctagaaggtccctgagcagagtcaagattgtcctgactgctgacagaagggctgaggcatcctctggattgctcattttcatattcctggaggcaggcggaatctccatgaggttcctgctcatggaggagtagttcccgaagatggtgatctccaacatgctcgtggttaccctggaatatctgttaaacctcagattctagggcccaactacagcccatttgaaacaaaagtgggcaggaggtattgggggtcagggagcggctctgggttcctgaagtgtatctgggcaggtcagaacctctagagtgacttaaagctgatgagaacactcctggctaggagtggtcttggttgttttaaagacaacattttgtatgcctcaatgcagagtcaaacttttcagttaaattctctaagaaatgggagcttacatctatttgaaaccatattaatcatgacttttaacgtgcagtgccagtcagagccaagagccactgggatgcgatagttgcttccaggacagaaaataagttggcaaacctcgctccatttattctgtggatttaaaatgccagataagggttacctgcttcaaacagaggaactttctaacaactggctccttcttccacctggactatttacagagagcaattgtaagtagcatttcctcactctgttggggaa

SEQ ID NO: 46321 - DNA, 1852 bp, Bovine  19866880884846
tcccaaagcccccaaacagagccctgggcacccctggtttcctggtaaatgtcacacgcctagcgctggcttccttggctgatctgctgtgacaagcacagttggctgcttgagtttctctccttccttttttcagctgaagttaagttaaggtctccaaacggagacattgatccaggatttcattttcctcctctgctgtttcggctttatgaggacccaagtggttactgcggaaactttcgatgggcccagcagtctggcaaattaaatcttgcagccttggcaaatcctgcccttgcgtctccacacagtccccagtcttttctgtggattcatctttctcttctgggacgggtattcgtttacccccatgggtgcaggttaaataataaaaaggctgaagacaaaccagctcatattataggcaacctactgctgctattgccttttcattacagtccagagaaaagggaccactaaagaaaaaaaaaaaagcgttctggaggaaggggaaaagaaaaggtgaagaaggagaagggagtttgcaggtgggcagcactgacctgccatgagatcactcagggagggaagaacatagcagactttctgccgtggatgggcggcaggcccgggtaaagcacagatccccatgaccccgaggactgacggggcaggcggccagccaactggcagagttgatttcctgcagggggacacatcctttttcattcacgtcggcctcaccgttctcagtagggagatagagcagcagcctaaaaatagctgcttgcgctggcctcatggccccagtcaaagccagaggcgtctctcccgtgacacattcccgccacctttggccccgggtggagcggggctggcctcttgccaggcttgatgtgaggaggttaagccgagggtccagctggagcagctgggtcaaagacagtcacaaatctggatttccaggtcatgtggggtcaggccagccgtgtttttgtttgtattatttaaatatatatatatatatatatgttttttttcatgtaaaaatatggatttctggtgaatctagagaaactaggccccagctgcatggagcgtctaggagctgagccagcaggtgagtggcttcgtctggtgggccaccctgctcacgccacctgccctccactgttgcctgtcatcctgaggtgtgtctgctctgtcccctgcagatgcagctgaggaagctggtgacagcttggtggtggcgtgaccctcagggtggacagccccagcccccaactccaatggctgccacccgggggggccctggtgggggaacacaggggagggccgcttcatccagggctaagggcggtgacttcattgagcgatcagggacctgccagtcctccccctgctcagaatgtgggtgcctgtctgtgggcagtgggtccctgccctttgcttccacaaggcacttcccacctcccctagcaagacgctcacacacattattgtgttattgtaactcactggatggcctgtcctccccgccacccaccagtcccgagagaccaaggccagcctgtccatacccttcccaggctgagcccagggcctggtgcacatcagacactcaggaccgttcgtttaatgaaggagccagagacaggccgcgcctccaccagcccccagccctgggcatttgatggcagcttcttgataaaatctgaacaaaatttcaatggcacctaagccctgctggccggtttgtactttagcaagggatgtcagggtcacacagaaaagtcataggtgcacctgggccccggagatggctgtgagtgctgggcaagcgggtccg

SEQ ID NO: 46322 - DNA, 1479 bp, Bovine  19866881020519
ctgtgactccagctcttcttggtggttcagggacgctgcagcttttgcggccgtgctgcccccctgaatcagggcaagcacgaccaaaatgaatctgctgccatcatatccctattatttttctgtatctccaatttattccgggaacacgagagatatttaacaattacttagcagccttctttacaaaaggagaggatgaatacagataacactggaaaagattattgagagcagaatattgaattatctgtgcctgggagatagcacatgaataatgcatcaccctaccttgggtagcatcccctcccagacctgctgggccgagtatggacaggggggtagggaatgtgttgacattttggccctccccattttgcaaaatgtgcagagttccacatggaactcgccatgtcggtgtagctgcatgtcaaccttggtgcttttctgcagagcatgtctaatttttgcatggctgtggacagtaatcagtaatgaagtcattaaatgcaagaggggtggagagagaactgtctgccaaccttctccattaaattcaggtactttggcacatctctaattaagatcaggaggcttgagttccaattgacaaagcactccatccccatgataagcagtcaagagtgctcgagggcagagttaatacagtgagcggggtaatggcttggataattccaataaagatttccagttatacgagattctagaggttaccggagctctccagagaaggcgctcactctaggtgtgtggctagggtctcctagaactacagagacatgatagtcacgagggcacagctgagtgattcacctggagtccaagggtgccaccttagatccctgggactcagcacccctcttatgaaaggggtggcatctccctcggagctctgagatcttcagcattaagtattcccaactggattcactctaggaaacagcaaatagatgccttgtgtctatgggaaaatggatgtccaagtaattcctgggagagggtggggggctctattgttttattttacactcatttagaaatctggaggaaacattttgacatttgctgattatcccccttttccccaaagaaccaagcttgaatacattaattttagattcgtatctaagtaacacatctcatatgtgagtaggggagtctgtgggggtgtggagagagagagggactggtaatgtgttggctactgtagcttcggaaaagcgtttctatttggctgactgggggagagaggcagggagagacaaaggcgagggaggaggtgcctgcaggatgttggttaggggaggaggctggctgcccgccagggatgtcagccaagtgcaggcaggctctctgtccatcaggggtcgctctccaagcccagcttattttccatccacaggcgtcctgcctgcatacaagttaaccagctacctgtctgcaggcaagaagcagaca

SEQ ID NO: 46323 - DNA, 1257 bp, Bovine  19866881083862
gggtctgccttgtctaatgctgtacccgattaacctcatgagaagagttaactcattggaaaagactctgatgctgggagggattgggggcaggaggagaaggggacgacagaggatgagatggctggatggcatcacagactcgatggacgtgagtttgaatgaactccgggagttggtgatggacagggaggcctggcgtgctgcgattcatggggtcgcaaagagtcggacacgactgagtgactgaactgaactgaactgaattacctatcacagtgtctaagctgcacctgatgtttgtggaatgacttgagcaaacttggtcccacagatgttctatgtaaaggagacatgttgataatagcctgcttcatgtctgactttctgccacgttcagggactgtgccagagagaagcccctgaagtttaaacagctctgggagggcccctctgctgccccaaacaactgagagatcctggtgcctccagaggtgcgtgcacagggctctgccctggcctcccatccacatggagaaggtacattcctgtgtttttagggagccaccacttcacatcttcccttttccttttttctttctgagaagctggggaaagcacagccggcctgcatgaatctcaggataaaccaaggatcacaaccagaccctctggctcatgacatcagctctaggtgagaactcccaatggcgcagcccagaaagggaagtggccctgagtttatcacagacacttcatgtccatgaaaagacaccacgtttcctgcgtacaaatttttcctacctgtgaggctctctcctgttggagccagtagcctatgtgtgctccaagggaccgtggcttaaaaatgtccattccaggtaaaaaccttagacatggtgagcaggttgtccagactcccagcccctcccacatacaggtgacataaccaagatgctatcacctctgacccatggctttgcctccatcagttcttctgtggagaacacactggaaatcaaagcccagcttatctcctgcccatcctgatcactgaaacctgatgtcctttcttttaagagataacctttgggagtaacacaccagctgtattggggggattaaatcttgtgctagcagaatgatttatgctccaataaagccaaacaaaacctaattgggtaggatgagaccaccaaaaattatgttcacgataaaaacaggacgagaactaattgtctgggtgcagtgttccat

SEQ ID NO: 46324 - DNA, 1799 bp, Bovine  19866881169753
tgtgttactagcattacagaaaaaatatacagaggcttagcagtaaaggtaaacaccaaaatacaagaatttgattttatctaaaatcttattgcttgatccacaatttggataaaacaataaaaacatatccatttgcaccctgcattattttcttaggcaagcaagcagagtagtgtaaaaaattttactagatcacaacttagtccagctatagctaggaaagaattctagtaacaaaaatgacacccgagagcttccctggtagctcagtggtaaatccatctgaccatgcaggagacacgagtttgatccttgcgttgggaaaatgcactagagaaggaaatgacaacccactccagtattcttgcctggggaatcccatggacagaggggcctggcaggctacagtccatagggttgcaaagagttggacatgacttagcaactaagcaacagcacattttaatagatatagggaccacttcaatgggatcatgcaatgggggagagatgttgagctcatctctgaatatagcataagcaagtgagtacttacagccaaggagtggggagggaggcagtgggtgaaaaattaccaagaggaaacatcaggaataaggggaattttggctgaagctatttcacagtattgctgaaggcaggttagagtgatcagacttcacctgggggatggtggaggataaggaacctaactatgtatcaaggatgatcagatatcaagggtaggggcagtactggtcaaactgacttagcaggattcttgctaaaactggacaattcagggatgaacatgaaagttcaaaaatcaagcctggttgaaaaagaactcaaagtaaactgaatagagtttggtcaatgacagactcgttatcagtatctttcattgactcactctgaaattattttatttcacaaatacagctgtccattgcagaaatatttgaaaatattgataaacataggaaaataaaatattttataatcatctataaatatatactggcttccctggtggctcagacagtaaagaatctgcctgcatgcgggagacctgggttccgtccctgggtcaggaaaatcccctggagaaggaaatggcaactcactccagtgttcttgcctggagaatgccttgaacagaggaacttggtgggctacagtccaaggggtcgcaaagagctggatgaaactaagtgactaagcacgcaagcgagcaggtgaatcacaccctcctcctctgcatgggaccactgtttgggtggagagactgggaactatgtcaatatgctttctctccagggaagtggtgtacttttgaagggctgaataatggatacaaaagactagaccattttaggaatgattctggccatggattggctctttcttccttctttcctggataatgtggtggttttaaataacactaggcagccccacgacaaaagttgtcattttcagccacattctccattcggctgtgaacagttatgccatcaacatggatttaacaatggttcatatttgtcaccatcaaaatggagagcagaaacagcagtgctcaaagacgtgtgtgtgtttcggttgttctgatcagatatctctggtgctttcaaacctcccccaccccctcgcaggaatgaggcacacatgggggtggctgcagagggaagccctgcaggaacctttgtgaagagggacagcaacacacagcaccacaaggattgttctggagacatggtattgggaaactcctcagtacggggaatccattg

SEQ ID NO: 46325 - DNA, 1291 bp, Bovine  19866881206672
tcacatgagctattgcttgacactcatcaaaatggtgatagtttgatggagtaatagcaccgagagctgatagagacatggggaagagagaggtcctgctgctccagtggctggtggaagacccaatgcctccctgtcacatggagagtgctgcagctgctgggtccagaagagcaggaatgtgactggggtctctgcccttcccttctccttcctgccagtgtggattaaacatctttaaccttgttcattagtgtaaaagtcttctttttgatgcttttgaactatggtgctggaatagactcttgagagtcccttggacaccaaggagatcaaatcattcaacctaaaggaaatcaaccctgaatatttgctggaaggactgatgttaaagctgaagctccaatactttggccacctgatgtgaagagccaactcattggaaaagaccctgatgctgggaaagattgagagcaggaggagaaggggatgacagaggatgagatggttggatggcatcaccagctcattggacaggagtctgagcaaactccaggagatagtgaaggacagggaagcctggcatgcttcagcccatggggtcacaaagagtcagacacgaccatgatggaacaacaacgacctccaccagtcagttctccacatgggtcccatttccatctttccctcccacacagccccattatggggaggaaaaagacctcagcatgcccactccccatctccctgtaactgtacctatcctgaaatatatgcacatccaatcatcacaaccacagcctggaaggtgagtaccttcatatctctacttccccctgaggctgggtggaacaagtagcctgcccaggtatgcacaggcaggataactcttacacaaggcacagtgactggtacatacctagcctcactaatatttgttgagtgaaagcagggatggaagaagggaagaaaggagggttcagaacaagaacctgcagcaacatcaattttcctgctcaaaatcgaaagacatggtcaactcagaaaacccagacctgccagaacattagtcagatgcataactcagcatataacttatctgcaggtcataaaagttagggggcacctccctccatgtttgaatttcatgcataaaatctgcacacataataacccctgtcagatgctcacaggtgacgggcttacagctcttatctgtctggtgagcacagcaggtcacttccccaggttacggtcagaaaactgtccaactgcaggacaagcattctac

SEQ ID NO: 46326 - DNA, 3983 bp, Bovine  19866881295846
tccaatagcttaatttctgagaatcaataggcatttatctacaaaagaaactttcaaaacccgcccttaaaagtgatgacaagttctaactagagattaaaaaaaaaaagttctttcttgatagttccacttcttttcaactctgctctgggccaagtaaccactgaggttaattcagattaagtgttaatgtttgatccgaagtcaggtgttacctctcctagctactctttgcatttcattggaaagtttaaagttatcccaaggggagttttaggggaagcacagacaggtggggacatttttttgatgcccctccagcccacagagatgacccccttggctaccaaccacctgacactgtcctgtctgaactcaggattgctgacatccaggcaaggttggaccagctggctgcctggccaagggtcttgctgaggtgcagtgggctctgcttcctctgtgactcacatttaagtctgtaacggagtttttctcctggcgaggctgctgtcttcattcctgcctcgtctgctgggcgttcgatcttgaggatcaggttggaagttgatgctttgattgtctttgatgttttcaaaggcaggaaaggctgtcatcttttcaagtggcactcagctctaggtaaagaatgtttctgatttctggagtgtctatcagaggcaattataccctgattgacccgtttgccattcaaatgtctcctaacacttgctcccatgttgggagtgaagatcttatttctattcttctactcaagcctgcctgctttgagagttcaccagagttctaaactttggggatgaaaagcaccagatggttggtattttttttctgcacagctgacatttttcaaaatcaatattttaagcccaatacagagaacacagaatcttgtctttatttcaaaacaggtatgaaaaatagccaatctgcatagatacagtgacaagtgctagatattcaaagacagaaagagacgtggctcttgcccatgaagaatttacagtctggatgtgtggtagggtggggtggggcagtgagggtcccgaagatgaacattatgacacacaatgggcacacagagtgttgtggttgctgtgttcccatgtccttgacacttagaggtattaacttcaagggtgccttcacccaggcaaatgatactcctcttaaaaattaatttgtaattgattattaatcaggatcggagaatgcaatggcaccccactccagtactcttgcctgggaaatcccatggacggaggagcctggtaggctgcagtccatggggtcgctaagagtcggacacgactgagcaacttcactttcacttttcactttcatgcattagagaaggaaatggcaacccactccagtgtccttgcctggagaatcccagggaggcggggcctcgtgggctgctgtctatggggttgcactgagtcggacacgactgaagcaacttagcagcagcagcagcattaatcaggatatacttttctcccacacccatatgattttattgcctgctttccctctggggcatttcctctttcattactggttttttgtgtgtgtaattttaaaattctctattggggagtagctccaatgcactaagacctagagttttaacctccctgcacattcagatttggaaggacaagaaatgttgataagatgttactaacaagcccactctccccctgtcatttattttccttctctctctaggagtaaccagggtcctgatgtttaaagacagtttcctccgtatgcttctttttctattttttatatatgtatgttggagaaggcaatggcaacccactcccagtactcttgcctggaaaatcccatggacggaggagcctggtgggctgcagtccatggggtcacaaagagtcagacacaactgagcgacttcactactttcacttttcactttcacttttcactttcatgcattggagaaggaaatggcaacccactccaagtgttcttgcctggagaatcccagggacggcagaacctggtgggctgctgtctatggagtcacacagagtcggacacaactgaagcgacacagcagcatgtatgtatgtatccatcacatgtagtttgtatgttttatttgtaactaaaataaagtgtatcagattatttataaccatttgaagtttgctttttctcccacaccaccttatgcttttgatgttttttagatggatcaatatttataccaaatcgcttcagtctctaaagcaaaggttggcaaactttctgttcaaggatagaaggtatgtatggaagactttgtggccatagggagcttgctgatgtctgctcttcagtattccattgcagaccagaatttgtatacatttccttattattttttaaaaatcgctctcaatattttatattattaaaaaaaatgcatcactaaacctacaaacacactgtcttctcgtgcaagtgtaaagaggtggagggtattcatctggaaattgtttgtttgactttcctttccatgaactgtgagagcagctctatccacagtagatggcatgtcagcagaaaaatgaatatcattggttttataccagccagtgcaatcaggacaagaaaaagaaacatttttttaaggtgttgagatgtcaggggtaatttgtaaccatagtgatacagagattatgctgaaggatttaatccttccatcattccttcagtgaggatctgcaaatgtaaaactggtagtttctttatgtctgaaaagttctttatccaccctcatcctcaaacaaaggtgtatctgggtacacattgatagaaacttatgatttcacaattggaagctttctttgtcttctagcttatcgtgtgcttgatgaaaaacatgtagtacctaattgttatttcttttaaaatattttcgctatgattgcttttgagatttccttagtttctttggcatcctgctgtctccgcacaatacgattaattgacatttatattatttatgagcctgtcagtgtgtagattcttgttctttgactctggaaatttctgaagcacacgctctgattattgcctctcctgcaatctctttattgccctagctgaaaatcctactggatgtatttttgaacctactcaatttaccctactggtctcataacgtctgcctcttcttttttcatctctataaatccctgtagtgcattctgggaaattgtctaatttgggtggcttatgaagaaggtggaaattaaatgccaataataagaacattggaggtttaggaaggaatgatcagagttaaagagttctgaggtctatatgctctttgaaagggtaatatacacattaattaattgtagactttgaaggttaaatatctaatgttaaatctttaagggttactaataaaagaatagaaatagaaggcaaatctgatgaaaggttaaaaatcaaaaggaaaatgaagattagtccatcaaacaccataggaaggagaaaagtcatcaagacattaagatcatataaacttacccaaatatttcaaaaaccacaataagtaaatatagattatattgtttagtcaagtaagcaattttcagactgcattaaaaaatccaaccaatttatctttacaaagataaatttaaaatgtaaggcccccccaaaattcaaagtaaaaggatttaaaaacatacaccatacaaagactattcaaaagaaaaagactaaggtagcataaatctgacacaatgggctttggggtaaaagaggttattagggatgaaaggttataacatcttgagaaatgtgattcaccggaaacaccatacacacacaatcctgaacttgtagccccagacagcataacttcaaaatgaattaaaaaataatatagacagaaaaccgagaggatgacaaatcagcaatgatgatgagaa

SEQ ID NO: 46327 - DNA, 945 bp, Bovine  19866881442944
attgttaatgtatgtaatccaaagcctgtttgaagatcaaacactcccatagcactttgtatttaaaggagttaaacctcctttcttactgaagactctcttgccttctttcttttgccgttgggtcctgagtgagtctgtgtgtgtgtgtgtgactggtggggcagtcacagagtttcccaaacttgtttctcaggaagtatctcatgaatgtggtgtttcataattcacattttggggagtgctctcctattccctatctgcataagaagcgccagtgtacccagataagacatttgtaagtatgctgattttagatgcctagaaactaaggaagaagaaaggaatctcagtgggaaaaatgtcaaagtaagaattctgattcaaagctggcagatgctttttacagagtcaaaaaaaagtaaatcagaaagggaaaattccagccctcaagctgaaaacaagctgaaacaaatgaacctaattttatatcaaagtagtaacataataacacagagaaaaattactccatgtaatctctgaaaacagcaacctgaatctaaatccttggtgattataattctaaggataaaaagaactatagagaaaccataacattcactctgtgtttttttttaataataattttgatatcataatttgacaccatttaatgtaccttttagaataaacaagtaacttaatattactagtgcaaacgtatacaaatatatatacatatatatgaaatttaaaaagacaagaaaataaattctgtgatgctaaattgaaatagaaaaggaacacacacatcctatttctctccagtgagagggtttagaagcagtatcttggggctaaaactcagatcttgttttataaataccacttccattagaaggcagtaaggttcaaagacatattatcatgtgtcaaaagcaattc

SEQ ID NO: 46328 - DNA, 921 bp, Bovine  19866881815333
cccattaaaagaatgaagtgttaggtagatttgatgcactaatagctctgaaaatgtgtagcattttcacagctaaaatcttttctggtgtgattttctttcaacctttttgtttatgagcatgtgtgaattgataagttatcaggagctagaaattaaattagctctcaaaggtaagaaaataataggagaggacaggtttacatatattttgggaaaatgctcaaattttgatggtttagagaaaggtcagtttcctgtgctagaatttatctatattcctgctcatttagggtacatatagggcaatattcccaagataaattgtttatttatgaatgagggtccccctgccccagctcaccaacagactatctccaagtcaagtatggttatttactttttaaaattgtgtgtgtgtgtgtgtggctggattgggtcttcgttgcagcacgtgggatcttttgttgtggtggaatggctcagtagttgtggcttgcaggcttaattgccccgtggcatgtgggatcttagaccagggattgaacctgcatccgctgcattgcaagctagacttttaacctctgaaccccagggaagtcccaagaatggttatttacttttagattctcttgtcttcatgctcgtatacccacttcctcagatttctggatctatagaaagggcaaggaacgtgacagcatgtgcccccctctctactaagatgtctcatagggcacccagctgaccaaggggaatacaactcagcgtccaagtgaccgagggatgacagagcaatgcctgcatcctggtgcttggtactcagagatagttagctcaaaatacagtaaagtaggccatttaacgttcgttgggagtgaactgttgtgtcagccaataatgaacctgaaaatgacactt

SEQ ID NO: 46329 - DNA, 777 bp, Bovine  19866881854438
tgagcgagcaatagcaggtccgatctcggttttgaatgcagccgtgcattctgggcagccatgcttgacaggcttcccaacctgcagacactgggaatttatttttccatctatattcatgacactcatgatctgaaatggccattctaatgtccccccacccctctttgcagcaaattagtggagtcaatggcttctggccccaaggtctcatctgttgtgccaaatgtaagctggatgccaaattcccttccagcatcagagggacactctggtactttatggcgctctggacatgaagggatcctgacaggccttctccacagactgggacggggccagcttcacggagcagctgtccccactcccgtccctgagatgtgatgtccgtggtgaaagtggctgctggtggttcctcacagagcagggatggccagaggggaggggtccatggggctctgcgtcagcatggagattatgcttggttgtgggggggagtcaacaaatttcaaactcttgctttcattgtgattatttatgcagtaacctaaggttgttgtgtatggctttttctattcaacaccattttaataatattaaacgtggtatacacaatatatgatttttttctttttttgaaagaagactatgtctttttctttttttaaaaattaataatttatttatttggttttgccaggtcttagttgcagcattgggggtatagtatccgaccagagactaaaccccagccacggaccaccaagtccccaatat

SEQ ID NO: 46330 - DNA, 684 bp, Bovine  19866882054536
tggacagaactgcctcttggaggcagaattacccccaaggtgaatctctgggctagcccacctgtgatgtttgggctctcagctccagtgccactcaaggtcatcctgaagatgatcccacgaccctggttttagtggcagggggcgaactaaatgtctttaaactgacatctagctctgacactcataaacctttaatcaagaagctatgaccttgtggaagaggcagggtgaatgcagaattattctgctttgtattcaagttttccctccagggagacactgaattgagaaagttgcaggtcctctctgtcctggagaagcaaggacgcacttttaagggtccagttacctctggctttcatgaggacaacccatgaaaggtctagccagttccatgccaaatctccttggcacagccttgcccttgtagggcttacaggatccctcagccctgggcaggactaggtggtgactttaaggaaggaaggcctttgaacaggggcctgtcctagccacacacctgcctgtccagttgagggaccacctgctggctctcagcctgacataaggccctctgcaaccacctacatattcagaagatgaaaccaaacacttgaggattaagcacttcggtgaaactaaaattgcaattataatatattttttaacagaagtgaacag

SEQ ID NO: 46331 - DNA, 797 bp, Bovine  19866882180963
aattggtgatggacagggaggcctggtgtgctgcgattatggggtcacaaagagtcagacatgactgagcaactgaactgaactgaactgaactgaagctctactgagtgtaccccagccaacaaattcctacatatcctggcttcttccctacctcttcagagcatggtattcagagctcctgagtggctgtctcccagactagagtcctcagtgagaccccaaataaaactcaaatcctcagctctcatggcatgtttttctttaggctggcactggaaaacacatgacccagttatgctaatgagaggtgggtgtttataggcactggatggtcagaagactggatctgagtcccagcttcacctatctctgttttccagaaaaacaaaacttgttccctctgcctcctggtttgcatgtgcatcgtgtgtacgaaagagctatgaagattgcaagttgctactgcaaatgctggttacttttcagtaagaaaacaattcttaatggccagcagcagttaaataaataacagtctaggtaacgtaagacctgtgcagatattaacttcttggaaattcctcacaggttcccagtggcctcaaccaacaagaaagcttatcttcctgggttttgaggtcacttccagtcctcggttccccagttggtgatttctctttccaaaggtccctatttttagctgttttcacaagggcacctggaggcaagtattatacagaaaccacgacgttccacctgtgatactccacacctgcaggtcgcaaagttaacttccg

SEQ ID NO: 46332 - DNA, 1504 bp, Bovine  19866880188183
ggcttcccaggtggctcagtgataaagaatctgcctgccaatataggagacacgaggttcaatccgttggaaagatccccctggagaaggaaatggcaacccactccgggtatttttggctggagaattccatggacacagaaccctgggtgagttacagttcatggggtcacaaagggtcggacatgactgagcacagcacagcagtttttgaaattatacacaaaattttgcatatgcggtcacaaattcagttttctaggtttgaagctccaaaaacttttattatcatcttctaggaaatgtggacccgatgatgttaaaccccagatgatgattgtgtgcttatctctctagttccccacattggttttctcccaacgtatgtacacccatgattctggattctaccacccctgacaatgatattattaacacttctttctcagtgtcaatttatgtataatttcccttccaaaccacacatgaataattccaaagaagcaagcaaccataaagaagatgttgctttaagggtttgaaattccagtgttctcctcaaacattgagtcatgtctgttgaagtattatctttataagtgcaaatattgccttatgcttgcagaagtgtcttgtacttcattagcccagaaaaaatataccataaacaggcatttaggggataagggagaattccatgggccagaaagagagtgtttagtatgaacaatatacatgtcatcacagtgcatctgttaggacaggaagcatcgtgatcatctgttttacaagccttctctggaattatcttttggatgatttcatataaaagatagtttctggtaaatctggctcaacaattaatatgcaagttgtgattagaggggttgaatttggaagtgataaaggtttaaaaatagaaaacagatgtaatattttaaatgacattttctttgtactgtatttatttctccctttcagtaattagtaaaatgttttcagtttttagaaagagcttatcactgtgagcacaataaacccatatgtggaaaaaaaaacaaaaaagctgcaagaaacagatgatacatactttgggttctgtggataagaaaaaatggcgaaagaatagggtatcataaaaatatagggccccaaatataaataaataaaacaattcaaacaaaaagaaccaatattcaagcaattctttgaatctgtcatttgaacattttttaatttaattgagcatgaataatttatgttgtggtgaggaagattataaatccataaataaattttattggggattaaaaaaaagtgaataatttaaatattgaaaaaaatcacctatagtcttgtctcttatctcccatgatggcattccttagagtccagcacgaccagctggaagtccagagtgtgcttggaaccacttggagccatcggaagtggaagctacttcttcacccctggctgtgccctgttagctggagggcgttcaggt

SEQ ID NO: 46333 - DNA, 3161 bp, Bovine  19866880520489
ccctgagcaggagggaggcagcctgagaaactgtggagttcccgaggaggcagaccccagcgcaggggcagctgccagctgaggatgcaccaggttccgtgggtgccgttgaatgacgtggtcctggcctgggccatctccccgtccctcgtccagcagcaaacattgcgatgtctctttcatgtccactggccacacactttgcaccatgaaatcctcagcttctcgagttatttggtacagaagtgaccagtgattggacgggagtcagctgacgtaacaaggacccatgtgtgtaaacattagtgactatttctgtacatatccacctgcgtcgtgagctttccatgggttgcactgatgtccacagctccacgtaccaccacaccatcgctccaacaaggaacctgcctcccgcccaccctccccagccaggacactgcagagcagcctcacagttgtcagctgctagaagcagggatacacctggtgcccaggtcaggggttccaatacgatggtccagccaaaagaacctgcgttgcccgagacatagctcatcccagaactcgggcaggacacatgcaagaggacctggaatggcttgtagggtcacaaagtacggacgtgctcaaaaccagagaccagcgacagggtgagccaaaggcaggaggaacaactgggggggccagggccaaagtgagccctgcgaccaggaaaggaaacagagcactgcagggtcggcactccagcaccaacgcctgcaccccgtgcagattaaagccagtggctgaatgagaaagcagcagagaagagacgcgcctcccaggcagaaggactccatggaactgacacagactcagttctcgggagcgagagcctgaccccagggctcaggcagggctgctcagcgtggctgccttcccaggggttcacaggacacacagctcctctccacagtcaagttcacactgacagcaaaagtcactttggcaggatgtggtatgaatgactctccacctctgcatcttctgcccagactcccacgtccccagcctgattcaggaggaaaacactgtacaaaattcctgaccactgttactcaaaattgtcagcatcaaaattaaggaaagtctgagaaactctcacagagctgaagaggcttgggagatgtaggactgagtggaagcgggtcctgggtaggatcctgggcaaaaagaaaggacattaggttgaaaaatatagaaatttgtataaaacatggtcattcataataatgtatcaacactggtgagacagatgcactcagccttctttatggtccaactctcacatccacacatgactactggaaaaaccacagctttgactacatggacctttgtagaggattgtgaaataaaggatgttgcccactatccagttctgtaagaatcgagtcattagccactgtggttagtgaccctcagtacacatcacagaactgaagacactaacaacacgccgggctacgtgtggggcatatggggtatatggcagctctctgtccttcttccacgatttctgtcaaactgtagaactgctttcaaattgaagttttgtgagttagctatgggacacacagagggcttcgcgtactaggtaaagaggtctgggcagtaggattttgagcacactgaattgataaaaaaaatagcccaccaagaagccttgacagtcccctgtgggaccttgagcaggctccagcccaggtcagggactttcagcggacacggatggagccctccacacctcaggctctagtctcagctaacgattcgaagaatgatttagaacaaaaccattcaggtgcatctggatcctagttcatgacagtataacttaaattcaaattctctctggtgtaaaacatagggataaaaattcatcaagcaataacgtaaaggtccaaaatgaatatttgagtgccttcaaggagatacgatggtgagaattcacagagccattactcagatgctgttttctggggcccccagagcatggagcccacagggagaccgctaattgggtcaaacccttggcttacaaatgagaagactgtggttccttattacacagccaggtgtgggagctgaggacccacactctggccacgctctcctttcctgttgtagcaccccacatctcggaaatcccttgcttttttacagagcttctttaagctgcttgcaattctgaagagcgtttcagtatagtaccaatgttacagaaaattagggagctggcaccttgctttttgaagagttccatctcctttgtgaatttgctggtgactaggagaaatcaacgtaattgatttcaaaacaaaatcacctttgtttctaccgtagatcaccaaaccacccggcaacagaactgctagggaagtcaatatggctttttgttcagaaggagtagtcttcacagattcctgaggacagtgaaaagcaaagatggagaagactgtgttttcaagagtttctgcgaacccgtctgaagtgttgtaggcatgtgcacagaaaaccctctcctccggcatcactatctcctctgcccgcagggaactcagcttctgtatttccatgtgtcatttccccagctaaatttggggaaaggaacctgaaagaatctgattgctaaatatatagacgtttggggaggaaaaaatgaacttgggttttagttttatagcccaaataatttttagctgaagaaaataatagaaatgaacaacagacataaaactttagcctgtgtaaattaaatggttctgcagcattaacttcataaagccataatcctctcctccataaactattacatgcacggcaacatatctgatttatggggtgtggaatcgatgggaaaaaattaatgcttgaaaaacatattagagacattattgaacagattttaattgagatttgatttcaatgccccttatccacatgattaatgggccctacccttccacggctgcagcctgcaaagagtctttaatatgacaattaagtatctgtctttaggttttatgtagcaccccacccccaccccggccactccatcagtacagtgggcttttgtgcagattaaaccgagactcaattttctctattttccggca

SEQ ID NO: 46334 - DNA, 1410 bp, Bovine  19866880766176
aaggaaggacagataagacaggtggtcagacagaatagcagaagatagcaatgaaaatttcaaaaatttttacagctgaaactggagaaaatcccttaaggaaatgtaagctttcaaaggaaaagccgttgttttttcttctctttgtgttttgttttgtagttgaaagtagataaatgagctctaggtgagtagcagcttgggagagaatctgtggccagtcacaggatccagtgtgtttacccctcgtcattggtcacgatggttcctgaataggacgcccagactgggggatgtcagtgtggatgtccccagctgggtccaccctcgccaccgtgagagacagagccacacatgtgtggccggcagtcagtctgcaggtgtaggcgcgggcgctgttgagggtgaccaccacgttcccttctcacgggagaaacagtgaaactcgggtgcgtgccagccacactggatgcccttcctgacgggcggctccaggccctgcctggactctacctgtgatgcatccctgagcgtcctctgtcaggtggtcctctcctttcccgaagcccctcgtcacacggcctttcccagtgtgggaacagggcggattctcccagctggcagcccacagaaggcccgaccctgggacgtagctcgagtgtcttcccgacgtggccccggggagcccaaggggagggttgacaccctcctgctcctctccctgcagtgtcgtggaaaagcctcacgcctgccggcccttccctccacccgcactagcacagtctcctccgaggacccgtcgtcatcagagaagaccctccccagggcgcccaccagcttatttcagaagcaggggaagtgtccggattctctctgctcccctcgccctcagacatccggcccctcagtgctgcacgtctgtagcgtcttctcattttcattgtgcctggccgtgtaaaacccacagacaaactccattgtgggtgtatttttgaaaacatattggatcattataaacttttcaatgcgagctaaaacaaagcaactcactaaatatttcaatttgcccacctgttcaaattactccccacaatggggttgccattcacgctgctcctccactccttcccctgctattgtctgggctttaacaatagatgcgagttaataaaacccaattaaagatgagggaagcagtttgcaatggttcagatagaatacctgctcaggaataattagcataaagatgtaggcttgttgggtgaaggatttccagaagcatctgtaccactggcgcctttatggccgtccgcagtctgggtggccatggcctgatcacagaagcaacagcttaaaacgtgtccctgcaaagtaaaaaatattagcccagatctgcatttcgattcacag

SEQ ID NO: 46335 - DNA, 1537 bp, Bovine  19866881079429
ccacagtaaattaggcttccctggtggctcagatggtaaagaatctgcctacaacgcagaagacccaggtttgatcctgggattagaaagatccccagaagaagggaatggcaacccacacccgtattcttgcttagaaaattccatggacagagaggagcctggtgggctacagcccactgggtcgcaaagagtcggacacaactgagccactaacacagttacagcctcaatgaattaaaggagaatccctactttcaaggagcttactgctgaaaggcacaaagctgtaagaataaatgcactcataataaaggattcatccatatcacccataggagctgaaggttctaattagacctttaaacacacagtcaatgtgaccagggtgtgaagtggtttcacttatcgttacaattagaacattggcatttgcatttactgactgttttgtgctcacattggtaatctgaactttgctttaacgagtttttgtgttttatttcttctccattttttgaatagcagaaagaaacagacagtacttattagcgtttgcatttcaatcgcctacttgggctgggaagttaccaccttggtgagctgagccatggagggaggaacacaggctttgctaccaggggttggttttctaccttcgctgcagagggtggggttttgttctgttgactgaaaatttgcaactgaaacctggagactactaatttctaaaacgtttgagatttgacaagtgaaggacaagagtgtaaacactggagtgaaaaatactaaaatagcactccttccctagatcaaaaaacacttttgaaattgtggagaaagggtctaattgttgagcggctgatggcgatgggattggatcagggcaagctgtctgagttccaggtgccgctggtgttaggagaatttcaatagcagtgtccgaccgaccagaatccaggaaggacccgtgcactagatcggcctgagttgacagttgggctgctctggttctgttcggatcttgagaatctccatctgaggatgtgacctggtgggtgaccctgaaccacagtccagctgggggctcctggatcaaactggcctgaggaggtgggtctggggcaggtgtggccacacccaggagtgggctcccctccaaaccctccacttcttgcctctgttcctgcgacctttcctctgtctcacagtccctcccttctccccttgatcccgcatcctctagggccacacagggccccgaggagcgggggccggggagaggcagctccggcccgttttgatgctgcttctctaagtttggtcctcaaggagctaatgtggcagctgccactcacagcactggacgtacttggggtcctgactgcatctccccaccaggggacagggctcaccgtgggtgtgggctcagcctctgctggccgggcctcagacctgtggcctggtagggctttggagggagagccaggcagaaagaagggagaggaagacgtgcggcctgtgagaccttcctgtg

SEQ ID NO: 46336 - DNA, 1794 bp, Bovine  19866881103874
tctgatacgaccctgctgatttcgattcatgcattccttcctattttggtttaaaagcatatttattttggttttaatttaggggaaactcaagaagatcctcatgggacaattgctcatccatcacagaaatgggtggcctatttgaacgttttgagaagctcccttgcctggtgaacgtccatccaggaaacatcatagtggccccagcagaagacacttggagaacgctcgtcattcaacagggtcccttctcccctcctccacctccaccacacagtgttttcacttttagccagcagatgccatggctggacccggctccatctttattccgctgtgtggtctgttggtggctctgttctgagggtgttcgggtgcttctgctgtgattagcatgctggcttctctgcactgcggtgggacagtgactggagcttgggtcttgcaggagcatcgcagctgcgaagagtgatggaatgacctcgtttcaggctttctcttagacaacaggcagtaccctatgaagattgatacagaagggcgggctgcctgggccggaccatcaaatggattgatattattctctagcagaggatgaagacagagtaaccgttatcatactcaatacgcaggcttgtcagcagcagaaaatcatcccgtgtcactgattatgggagcgtttcatgactgtcactcgaatttagtagcacgacagcgtgagcaggctactgggtcagaaactccccatttgtaagaaaaggaaaggctgcccgcaaacccagcccccacgaaggtgcccctgatggaagggagaggctggcaatttgcaatatgcatttgcttcttgtctcatagaacaagggtggcaggtccccaggctgggggcgtctgtgggttcagttccccaacacaaagttgctgcatgagaatctgtgccggggtgatcacccagggggagtaggaagtacttgcattctcgaagatagctgtgatgtacccatctcgtacagtcatgtgtcattcactcttcactcacgctgtggacacacccactcacagacgcagacacacacgagaaattaatgcctgtccactgtgaacggagaactgaggttcggtggcagctcgaggcacaagggaacacctggcatctgatgcccacgggggtgaggcagtcattccccacgtggcacgactggggctgcaagtgatcgcgagccaggccctgattccagcttctgaaactgagccatcattctctcattctttgtttcccaccccttgtgagaggcagaccccatgggaagcaggcctggcaagctgtgtcacctcataacgaaagagtgtgacagctggggccctgatgctacgagacggcagtggccaagcgtacatgctccaagtaggtgaggatgaagggagaagaccctcctgggcggcagaatcccgtgagacccaacacacagagcagatcacacacaagactcgctgagtcagtcactgcttctcaggacagaatcaggaacacacgggccgtcacggaggaggtggggaggcttcagcaggagctgagtcgaagggcgcggggccttcggaagtgttgatgctgctctgcaccctgtggatcaggcggcaggggggctgcaggatggtcccatgggtgaggccccacatccggagtgtgttcagaaatgaagcctactgccactgcgtggaccagaggtcacagggcaaccagcgaagagcatctcaggtggggaggggctggggagacctacaaagaggacagag

SEQ ID NO: 46337 - DNA, 798 bp, Bovine  19866881209625
atattcaagcccataaatttgaagggaaactgaatacagaaaattcttgttaatgcagtacattttctggcaattttatagtccaattttcagtgattccccacagaacgaatgcagttcaaaggcaattttataaagtactttgcagataactattatctgctaattattagaaattgcatgttgttgttaattgcataaataaattgttttatctgaaagccattaaaaaaaggtttggtgtttgaagcatatatggttttgatgttcctgtataaaaacgttaaactgtttaactctaaaataatgacatgctgcttttaagacaatttcttagactaatggattatggggagggtgggggtagggatccctaaacatgtattttactttatttctgtgagatacttcacctgattataaatctgcatgggaagcaagattgcaaatattcaccaaatgtattagaacaacatccatatgatgctatagttttcttttttaaatccttagaaagaagttaatataaacattccctttttttccccaaaatagtcttatttttttaatgttccttttttaaaaaatatatttcattcatgattggctataagaagactatatttgtatgaacagttccctttgattttctatgaaataattcagaagagtgtaatggatactctcacagaatttgagggcaggacgcctctggaatgagtgggtgcctcaggggtccactccccgggaggcaccagttgaggccccaggcggcccggacgggcccgatcctgcctg

SEQ ID NO: 46338 - DNA, 1183 bp, Bovine  19866881344294
atcatcactgtcatcatttttcactttattgctactactaaatacataattaagagagaaaagcagttctcgcatctgtccacttccgctggcagagtgtccatccggtttacacatcttacatgcggtccccagggctgcctcctggcggggggacaataattctaaattttttggctgttccctgattagaagtcactgagcaaaacataaatgggcagatccattatcccttttataaaatcagagttgagcacaagttctcttataagccaggtgcttttggaatcaggaaagctgcccactgctggctctgcctctggaggaaattgtgggcttgagaagtcctcttggtttcttagaaagcatccttgctaacagacaggaaatcttgcccagcagcattttccagctatgtgaaggtccttccagaaggaagagtgtgtcctactcagagaaagacactgggcgggggagtaaatatgagccacggctcatctttctgagtttggcaaagatccatgacgttccttctctctttttataactctgatataaatctcactgaggtcttccagatggtgctgaggataaattctacatgaactcttttctgtgtgtgttccaggctgtatcgacatcactatcacaaccagttaaaacttgccttttaaaaaaaattgcatagtgctaaaaagctttgatttttaacttcattgagccttttgccgactggtcaaataaacccaacattccggtcccgtcaactcacaatatttgttcctcaaaacacgttccagggttttcatttccttgaaaagaaaaggaaataactgtagcataagaagatgatatgaagaacctactcattggaaaagaccctgatactgggaaagattgaagggaggaggagaagggggtgacagaccatgagatgattgggtggcatcactaactcaatggacatgagcttgagcaagctccgggaaatggtgaaggatggggaagcctggtgtgctgcagtccgtggggtctcaaagagtcggactcgacttagtgactgaacagcagcaaacaagaaggagatgatggatagatactccctgttgacccaggtttgaatcctagctctgtctcttgcagaggcttttggaatccccggtcttcaacaatgagggggaag

SEQ ID NO: 46339 - DNA, 672 bp, Bovine  19866881453926
ggtcgcggaggcggggacacagagccgctcacacgcgctcatcgcttattcactctgccggtcctgcggcagcggctcggtttacaagacacggagagttaaatgtcacccggagaagacagacaaggcaacgccgcctgtgtatgaaatatgacaccagggtaattagcaaacttcgtggccccatccctcatctccttttggtcacttggccttcggacgctgccctggtgtcctccacccacatctcagctgagttggggaaatagtgactcctccctctttacacacttgtttattaattctgtgtcttttctctctatccttctggcaaaaaaataatgaattctgttctgtaactttcacgacaggcagacttccaggcaagtcagcaaggttggagtttgtcttgacatgtttcttcatcgctttctccggaccatccacccaccgtgcacggagtcttctctttcaactacgaagatgctgaggaggaccccccggcccgcggccacgtccagtcacttcccgattcctccatgaaccccctccacccgccccactcctcatggagcccctgctttccaggctccatgttttccccgagcaattccacacaacgagatggtaacagttgtttgtctataaagcacgtactatttagaacacaga

SEQ ID NO: 46340 - DNA, 1878 bp, Bovine  19866880426930
cgtttggttgaaccaaggcataaggacttgcatgcatgtccggttctttgcaatgccaagcactgcagcccgccaggctcctctgtatgtgggactttccaggcaagaacactggagtgggttgccatttccttctccaggggatcctcccaacctagagactgatcaagattatgtgtcctgcaagtctgtactgtgggaagattctttaccattgatctaccagggagagaagtatagaacacggtcatatattaaagcccatgataatatttttagggattatattgctttgtatattttgaaataatatttgggtatattgggtaaaatgtattatttaaaattaatttcatttactttttaaattattttaattgaagaatgaaagtgaaagtgaaagtgaagtcgctcagtcatgtccgactcttttcaaccccatggactgtagcccaccagcttcctctgtccatggaattctccaggcaagaatactggagtgggtagccattcccttctccaggggatcttcctaactcagggatcaaacccgggtctcctccattgcaggcatattcttcttactgttggggccaccagggaagcccatatatatattcacttacaagtatatatacacacttatatgcacatacatgtgtatataaaaacacacaacatatgtataaaggtcatatatgcacacatatgtgtacatatcgataagtagatacatagtcttaaagaatagtagccaaactcttagttgcttctttctttccaataattgcaaagtcttaaaacgtgcacttccttgcccagaattacctctaaccacattaataactaagattacttggaaattgagatcttaaatcataggaacatcagttataggaaatagaaatttcttagatactaatcaaagtatccatctttgtcccatatatttgacattttaactttcatgaaaatctagctttccccaagagatagccctgtctctatagcctgtcaacttccagccttagtgcattcattgaaattttagtgtcaatactgtagctatgtaataaagtttataactcatagcattttagtacagtcatagagaacaaagagtgatatcataattgcacaaagggatcattaagtcactggctagagtgaaaatgcttctgaatgagcccagaagaaactctgtgagacaggtgaaggattccatgctaaaaggccaagggatgtgacactttgtccttcttgcctgaggcttgtgcaagtcagcttttaggaggcacttatgaaattgacatttctgcacatggtatccatgtggctacgttgcaaatatgctgaattctggccccttttgcaatgttgaaaaagtaaagtcatttcattactgatttacatgggagttattatctgcaacatctgtacacccaacacaagttgatttaatttgctcaaatttgctggtaatcatgcacattgacatggaaaggacattctttccctccttactgtcttgaaaaaaaaaaaaagaacaaccacccatttcctccacttgaatttaatgcacattcaccaatggcagccttggagagtagcttgttgaagagttagaaggattaaggcagctttacttggcatcattctgggaaaatagaatcctagcatttttgcctttagagtttccttactggacagtgaaatgcaaaactcaaggaaggtaaactgtcagttttgcagtgttgctatatgaaagtgggaggatgtgtaatcactgaagagatgaactgtgtcatcttttttttttttttttttcccctccgttaaattcaggattgttccctctggtataatcttcttttttgc

SEQ ID NO: 46341 - DNA, 1462 bp, Bovine  19866880447381
tccatcaccaactcccagagtttactcaaactcatgtccatcgagtcggtgatgccatccagccatctcatcctctgtcgtccccttctcctcctgcccccaatctctcccagcatcaaggtcttttccaatgagtcaactcttcgcatgaggtggccaaagtactggagtttcagctttagcatcagtccttccaatgaacacccaggactaatcttctttaggatggactggttggatctcaagactaaaaaagaaacccaaaataacaaaaacaagaaaaggacaaaattttttttaaataaaagactctgttcttggatggtcaggttactgagatcacctacagagtacagttcttccccagttaaactgtttcatgactcttgtctctgattaaaggacaaacaaaatccactatatacccttttctctcttttgaatggactaacagtgccttcacacttcctaagtaacctgctccttcagaaaatgagaatggtcccaggaaagtcatttcttttttgtgtgtcttaactttttcacttgggaactgaagaaagatttaagaaagaaatatttgcctaacacttcagaagagctttgcggacagtggataatgaaataatgacttctaaaacaccagcagatttgcagataaaagttgctaagagatccaagatgatgagaattttagagaaacagtgcatttaacagccattcacaagagaggtttaattttgagaagtgcttaaagaagtgcttcgatttagttcttaaagtccgagtgattattttaggactttaaaaaatgccagcttgggtagaaaacaaataagcaagtcataaacatgtcacccttgctaaaaatcaaattctttctcctaaatttaaaaagtaataagatcggttacttagcatggaagtaaaggaaaaaatgccaaagaaagcagaaataagcttcataacaacacaaaatgtagttacagaaagaataacaaaataagagcataaaacattccatttccaactgctttgctataacttttaagtatcaaataacataggagatagtttctatattaaatataagaaaagagaatataataattatgtgctgtgcttagtcgttcagtcgtgtctgactctgtgactcaatgaactgtagcctgccaagcacctccgtccatgggaagtcttcaggcaagaatactggagtgggttgccattccctcctcataataattataaagatgggtacaattactatcttctgtttttatcatgttagtaagaaactgcattgacctaaatttcccttcctcatagagtagtttgctttttaagactaacagatttttagagaatgttttaggaatttagttatttagcttggatgaagatatatttccaaactaaccttttcctcaaagagaatgagtttttactaaacaatagataa

SEQ ID NO: 46342 - DNA, 1842 bp, Bovine  19866880488509
actcttttgttgaccatgatggccactccatttcttctgagggattcctgcctgcagtagtagatataatggtcatctgagttaaattcacccattccagtccatttcagttagctcattcttagaatgtcaacattcactcttgccatctcttgtttgaccacttctaatttgccttgattcatgaacctgacattccaggttcctatgcaatattgttctttacagcattggaccttgcttctatcaccagtcacatccacagctgggtattctttttgctttgggtccatcccttcattctttctggagctatttctccactgatctccagtagcatattgggcacctactgacctggggagtttctctttcactatcctatcattttgccttttcatactgttcatggggttctcaaggcaagaatactgaagtggtttgccattcccttctccagggatgatgttagatattaatattcaaatgactgaatatatccttggcttaaaaaaataacccctaaaccaaagataactaattatacaaaattacttttattacaaatgttcattaacacactatttgctttttttttttcttttttagtgactactgtacttcacatccaatgagcataaaatgtagcatctatcattgactatgtacatcgatttcaaggaaatagaaaatacaggcaattctattcctaaaaacttcaagccaaactacatttgtcatttatttgtctattcttatattcaacaatgcatgtcatgaactattcctatattttccccagaatagaaatggtaactttgtggattaaaactctgtatgtattccaacacatatttttttgacatttcaaaataggcattgcattttacttttagaagaaaatgataaaagggcttaaatgtattataacaacattaaaatccaagatataatgatataatatggagagaaagatatgggtaaaatgtaagggaaataaaggctatatatatattttaaaccaaagacattagagaaatcctgaaacaatgacaagccataaaagtatgggaaacatcttttctccggagtgttgaattccttgtaaaaactgaaagcagttctctttcagctagtaactcagtttaaaagtgaagtagtgtgaagtgtgactgaacattgtaaggtacatactctgccttttttgtactgagaaaggaatggatatgatgactcattcctcaaactcttcctggtacttctcaccttggtaccgtttgaaaatgtcaaaatattttaaccacactgactactataattgaatggagaaaaaaaatcatttttccatcaaacatcttcatagtacatgacaatgtcatatgggtcctgaacagtttttctgaaagagatctcaatatatgtctatagcattgaatgtgtctcaaaaatagaaaggcatctacctgctctttagcaaatttattttaataaataccaaaatgagcaagcaagccatctgtgttcttcctgctgataataaaaaaggcatttgtttgatgatgacatatttctcagagtgtaccaagtactttattttatgatggaatttgtacagcttcctctaaatgaaataatgcaagatgtttattatttcagcatctgttcccatattctcttagccacttgaagagtgactcatatttctttgcaaaaaaatcacttgattgtttcatcttatggctacacagatagttcctgttttcttttagcacatcattcactctcaatataacaaatgctgtaaaagagaaatgcagtctttatgaaggaagggaaagagaa

SEQ ID NO: 46343 - DNA, 2150 bp, Bovine  19866880633310
cacaaatggaggaaaatttactagtggtattttaaagtcatatttaaagtttatccctggatttatcagttacctgagccaatatattctttttaattaaaaaaggaaataagaacaaaaatagtacaaagaacaccctttagtaagcaagtacttttagtaagatttgtatattattaacattttataccataacttctttctctgtccctgtctactttctctgtccctgtctctctaaagaagatatacagatggcaaacagtacattgaaaaggtgctcaatgcaaaggcaatgtaaaacacatccattaggaaagttgttagcaaacaccatgggattgatgctgtagagcatatggaacaaatatcctgtagagcatatgtacattcccattcttgttggtgggaatgtaaattggtgcagccagtatggaaaacagtatggagattcctcaaacaattaaaaatagaactaccatacgaccaagcattttcacttctgaacatatatgtggataaaatgaaatcaatatcttgaacagatatttataccccgatgttcactgcagcatgatttacagtaaccaagatacacaaactaagtgaccagcagcagatgaataatcaatgaagacacggtgtgtgtagaacattattcagctacagaaagaaggcaatctcaccatttgtaacaacacagatgaaacttgaggccactgtactaagtgaaataagtcagacagagaaagacaaatactgaatgatctcacttacatgtggaatctaaaaacatcaaactcatagatacagagagtagataggtggttgccagggagagggtagggaaaagttggtcaatggtacaaactttcagctataaaatgaataagttctgaagaatctaacatacagcattataactatagttaaccatgcaatagcaacaactttattgggtacttaaaagttgctaagagagtagatcttaaaagttctcaccacctcccaaaaatggcaactaagtgagatgatatatatgttaactaattttattgtgataatcatttatcaaatattcatgtatatcaaatcatcaccttgtatactttaaacttacacgttacatgaaaaaatttttaattttacttcatgagattaagtgaagataatttcatagataacatatctggattaacaaattgttatttcttcatgggatgaggagtttacacttcattttggaaataaaatcaaagttccataagacagttttgtatttggactcctgattattaatttcaatatttcttcaaatgaattccctctgttcagtcattaagagtaatgattcctctccacacataatttctaaatcatttaaattaattctttggagaaaaaaatctcccataaaagtgataagggtgccccatacatgaaactataaaggactttctaattaaagggtgaagcacgcacacacgtttgaaggcactttatattagtgttctaattatcttggctactaatgatgctgacccaaataatctataaatatagtgtagacagataagcattatatttaatttaaaacatagtttaaagtaatctattgaggaaaaaaaggaagtctagagtctggataggttagcattatcttcaagtcatcaaattataaaacaacagaaagttaaagaaaactttattgagggcaatttgtacctttctctccaattccaggaaaaagatccttcatcaactttggtttagtatctgaaaaatggctttggacttatcttgtaaatttcaatgatatgggccatctgctccatgtgatagtataaaggtggtgatttattccagggcctttatcatatgaataaaacacaactcagatttgcatcaaaaagcaaaaccaaaattaattatacagtgagatgaataaaaacacaaattttccaacatcttaatgaagtagaggtaggcctccactgattacgtttcaaatcagattcaagtcaggttactaggggtttttataacttacatgaaattaaaacaaaaaagtacaaaaaaaatctaatgagattctccaacagaataaagtatctgtcaatatatgccacaatcactaagttaaaactgga

SEQ ID NO: 46344 - DNA, 2180 bp, Bovine  19866880634209
ttttcaacaaacgaacaatctgagattcagaaaggataagtgatttgcccaacattcatcttggaaactagggtattttgatcaaccaattaaacttctccagaccttaattatttgttgctgtgtggttttttgtgtttttcatctgcagaacgcagagtcagaataggtgacctctaaggtatgcaacggcaccccacttgcaggcagttggagaatctggcaatatgatacactgagaatcccagggacgggggagcctggtgggctgccgtctatggggtcgcacagagtcggatgcgactgaagtgacttagcagcagtagcaaggtattttttaactctgtctttgttttgtttggcaggttctctcagccctgcaaggtgagttgtctctctgccatctgagttctagtaaatcagttctgctgccccatccactgggaaaataagaaagaaaggaaaataaagcacatgatgtaagggaggtttctccaaactatgacttctggtagcataacatctgggcttccctggtggctcagatagtaaggaatctgtctgcaatgcaggagaccctagttcgatccctggatcaggaagatcccctggagaaaggaatggcacctcactccagtattcttgcctggagaatcccatggacagaggagcctgatgggctactatccgtggggtcacagagtcacacaaccgagcgactgacagacacacacatacagcacagcacctaggacagagtcagtattgagcgctggctacagtatcagctggtgtttcacttcggtcaacttgcttagtcttaattttccacttagttcaacactgactctgtcccaaataatcaaaatcagacacagaccagaaaaaaaaaattcatttactctgcctttctagttccctcctccttgctttgctttccaagggaatctataaaccacatgtggacatctttgttctcaaagccgaactttaaagaaaattacagaaaggaatatacaatttggcaaattttactgatcaggtagaatttttgaagtatctttgaaattcacttgaaaggttatataaatgtgagattacaaatgcaaggatgagggggaacgagttcagctctagactttaagaggactgtagagcattctgatctgctttccactcataagcagctttaggagaaaatggcaattcaccaaagaacaaagaacaatgatgaagtgttggctttttttatatgtataaaagtaggagtaaactatttgaaataatggagaaaaggaaggctacccactccagtattctgccctgaagaattccgtggactgtatagcccatggggtcacaaacagttggacacgactgagcgactttcacttaaatactaggtttttaaatctgttttgttgtgtgttttgttatgtttatggaagaacttagatgccacacggaagtaaattatcatgcaaatcccacaaactcccatggaagagaaaaattttattttcttgaaactgagaataattcacagtctcaaagattgcagattaatctttgatttgctgaaagcttcttccgtaataatggaagaactttatgtcctacagctttgggttcagacttgcagttgagttttgtttgccagagttcaagattgggtcagggtagaatcaaagcccagttcctgctcagtaaccttagctttctcccatgaactccgtgccatctgcctgtcccttccaccacagtttttctttcccatgaaagcaatctgcctaaatagctaccaactaattactttatactgtagaaatactgctgaatggtacaaataattcaagaagtatattaagtctcttaaatggaaactcattttaagatatcctaaaagttttaagatttgttctcaggtattttaataaaccttagaattccagttcagaagcttagaattccagcttcagaagctttttttagttggaaatctcttcaaacttaaagaaatgctatgagatattagaaaggaccctgatgctgggaaacactgacggcaggaggagaaggggatgacagaggacagggatgggttggatggcatcactgacatgagtttgagcaagttccagaagacggtgaaggacagggaggccctcgtgtgctacagt

SEQ ID NO: 46345 - DNA, 817 bp, Bovine  19866880677797
acaaaaaagttagactataagtttcagcatacactgtgatctaaagcttatcaagtccctttcttgggaggttgaagaccattattcatatatagtatggatcatgctccttaaattgattagaccacacttttctacagtgaaacacatgtaatattcagaaacaaaatgtcaaaatacttggctttcaatgacccatcagatcacttttgagatcacttttgattatttgtcattagagaatacaaaataaaacctcagtcctctacatcaatctttctgtagttctcagcacaaaaaatcaccttggggtggggagagatttgtttaaaattctgtgatttgaaatttaaaagtgtttttgtcttattttctcaaaaaatacaattttatactactttggttttataaaaacaaatagcatattcaacatactttatatttttatctatatgactttgtggtagataggcatatgagcagaaacaagtatgttataataacatgaaatgatacaggagaattttaaatgctgtaataatgtgtatttatagtttggtttgttcattgctcaagcttttaaacctttttttcagttcatggagtttgaaattttactatttctgctatgaactagaaggacataaagtaccctggagagaaactgaaaaagaaaatattactccctataaaatatgaatgcctgtgtggcctctcaggtgtgggaaatacatttattatggattagtctttccccaaagggaggtgggctatggaaataacaaaggagaagaggaaataactggcaataacaatg

SEQ ID NO: 46346 - DNA, 691 bp, Bovine  19866880772092
ggttagcacagacatcagttaatgctggcttcctaatcctaaagtttgcactggatttccatacaacctgcagagggagattaagttgtcagcactctaatcaaccagaatttaaatatgggctaagtctaaagaaatcatttttgtcctgtgctcttaattaatacctgtcaagagtctggggaaagatttgctactgaacataaggaattatttggacataaatctgtatgttaatttctaatgcatttacctgtggataaaaatatggaagctaagatcctgcttcagggaatgacaaggaaaattatctactttattgctataattatcattaattaactaattaattttttaagtttgtggtaggggtttgatatataattatggttttaataatatttttattgataaatgtatgtctttattttcagaatattagctaacatttatgtaatacctcttattgcaggagttgtccaagatatacaggtatatgacatatagaaatatgcatacatatttcaatatatatgtatatatgtgtatacctttaggtatgattatatatgtattttttttggtcagttgctctgttgtgtccaactctttgtgaccccatggactgcaacacgccaggcttccctgtccttcaccatctcatgaaacttgcccaaactcatgtccattg

SEQ ID NO: 46347 - DNA, 2666 bp, Bovine  19866880801271
atactgtttacaattacaagacattgtcccatctttttctctactcaagaatatcttatgagtgaagcaaggaaagcattattatttctattttttcagcttatccctgaatcagaaaattttctgaaactgcagacatacaattttcaaacgtgcattgagaggccactttctcagctatgattccagggcgtggggatgggaagttgaaacaagttatttgcgtaccaggagcttccaacacgacacaaaggaaagaaacataattcatccctgtgattccagcagcagttacagtgagtaaggggagatagaaatgggtttccatactcaacagtgaacaagccttgcaggttatctgattgattccagtgcttctttcatgagaaaatgaggaacaagccatgagattctggtcataaatgctgtcggaatttaggaaagaacaccagggtatgtcaggacttttagagttaagtggggttccgttttggctttagagaataggttgatggctggtgaggtgcacggaaggagagggaccattctgaagaggatgattatgtttagaaagcatggacttggcccgaagcagagtgtttgggggatgaaaaggagttaccagcctgacagaggcagagtatgtgaaatgggaaaaagtatgaagtaaagctccacttggaaaatggcacagaattatgaatgacctttagtgaggagaatttgctcttcaacacagaaggcaatagggtgttggagttacctgaggagtgtcataacaatcatgatattttgggtttagtcgctaagttgtgtctaaccactgtgccctcatggactgtagccctccaggatcctctgtccatgagttttttcaggcaagaatagggttaccatttctttctccattttagggagattattatagtggaaggactgaataagagaagaaacaaatatgggcaggcttatcagatgaaaatctaggctatggtcttagcagccagaattgcaaagacacagtaaatcccagagacattttaggtgatcagaatgactgaacacagtagcagactgttctcaaaatgaagagtgtcaaaaattacttttctctttgtactcattatacttttcatctcattgtactttccattaattctttatgacctgtcatttaagcaatttaatttccactcaggaagatatgtgactctcattttctgagaagtacagtgagatgaaaggtattaaaggtgcactgcatatagtaagtgttcaataaatgctcacaaagcaattaaattttaaaattaccaaatataaacagcaaactcctctttcaaaagctcgctttttaatctagggttgtcacactgagataaatgaaatctagaacaaaaaaactgagattttaagtgttttaagcagtcaagtgtcaccagaaactgcttcataaatgtaggaaaagaaatttttgacacaacttgaaaagtgatatactgaaatgtaaatgagaagtatcccatctaatttttataacaggatggattgataaaattatctacacatatattggtagtactagagttcatttctaaaagaaaccgtatgtcaaatgaaaccatatctgtttagtgacaagatttcatttgtattttcttatctttgtaaatattctgtatatgatagtaattgaactacttttatgagctaacagtaagtgagaagaaagacacccttagttcatttcatgggattaaaactatgaatgataaagaagttaattacaaatacaaaactccaatatgtttaaatccagattattttcacaaaatatataggcaggtttgttggaaaatggcttcaattagcataatgaggtataaaatcataaaaatcttgcttgaatgttaaatattccactttgcttatttaggacaatatatatcttggtaaaatttgatatttgtaagtttataaagatatttatgggcaactaaaaaagaagccaaaccagcgaataatatataaaggtattcatatcataagtaagaaaattgctaccatctccatgaaagtttctttacaaagcatttcatttatgttacacattcaattaaaatgttaaataattttgaaacataaaaaatgctgtgaagtgaatctctagtaagctagatgacttggaaaatttccattatattactcacatgtattttgaaatgagctacagaaaaatatctccaaagtatgtatgtacctatgaactcattaattttcttcatttacatgttccattcagaatgattttgttgtgtcaccctggtatttgttgatgaatgcatttataggttactcccttccaaaacgttttaatgacatttatagttggaattaatcttactttattttcttacaaaagcactttgttcatatctcttttagaaggcttatgtagccattctgctatgaattagtcttccctggaacttatgaaaaactcattcagtccttgttgagtaagtatattaaattttgaatcctcttccctcttttcctggcaccctgtatatagaatgtgctcagaagattaatttgagtctctctatgtttgtcagccctctcagcaatattaaataatatgcctaattagatacataacttag

SEQ ID NO: 46348 - DNA, 1918 bp, Bovine  19866880813890
tacgtttgggaaatggctattaatttgaaatttttctagaaattctttacctattccatacaatagcattatcagccatcatttatatagaaaatataattactggacataaaaaaaagcttgttttactggatatgaaaaaagtttatgttttaccttattgactctagtaaaatataatgaaagatttaaaacttttctagttagaaaataacttttaatagttattttaatagtctatagtagtagactattacaactccattgttaaataaccatcagaaataaagaggcagaaatatagtaaagagatatttactagaataggtaacagaatggttatattatgaaacaattaaaaagtaatttctattaatgatcatgaaaaatagtcattaatacttccagaacataattatcttgatagttaacctatgcactcctggttagatttgttagaacatcataatttatctcagtaaacacaattagcatcaacctcagtcttaagaatggacctcatacctcataaagcaaggggctttctattgggagtgttttaattagaaatatggtggactgtttctccttgtcccttggtagatataatagaactactgtaagttagggcttttttttcatctccagagatctttaatatgagttttggggaaagtttctcaattattaaagtttaaggcatgacaattgaaagaaatgaatttaagtcaagggtattagattaccatctcaatgagaagtgaaatcagcactttcaaaatgctagagagtctataaacatttttcctcccagtgtgagaaacagtgagcagcttaaaatagcagcttttgttgttacttaagattattagtttagataagcagtagacattatcatagtgctaaaataattacaggttttattgagttttaacttgtcactaataacagtctttcattgcattggtcagtactgaaatgtataaaagattttttcttctgctttcaacattgttaaatacacacacacacacacacacacacataaaacacaaaaattaccaaagacgtgtatttcttcctttctttatatgttcttgccttttttctccctgataaatattgaggcacacaaagtgtgttgcagctgtaaagaccctctcaggaacctgggacagaatttcctcgaattaatcctccattaatgctgaaggagtgtaggttcatttggttcagaaagatttctttattttacttgagagtttagattgtaattttgataatatcttgcttggaaagttaattagtttgattgggaatcatggagattttgtcctgaaagtaaaataatagatttttcaagtctaagttgaacttggttttgctggatgggttagttaagggagtatagacctaatctgggacaagaaaacatatgcattaaccttgtgtatttgcccaaagcctttctatttccatactgaaatgaaatgaaataacaacacaagcacacagcctgtgagtttgtatgaactttatcacccgaaagcactctatatttcctttggcttcatattttagattagctgtaaggtccagtggaaactcctgtcatcttattttaatgaattcttcttcagcaattaaattgcttaattgaagcactcttacagcaagggatctcacattagagaccactgaaaactagcaaaagtgaaagtgaggtcggtcagtcgtgtccgactctttgcgaccccatggactgcagcctaccaggctcctccgtccctgggattttccaggcaagagtactggagtggggtgccatttccaagttgtaaatagcaaaagattcccttggtcaaagaaaattggggaacttcaaaactgacttaaaattttttggcttgctctgatc

SEQ ID NO: 46349 - DNA, 1551 bp, Bovine  19866881040657
ctattgtttcttaaatgagaacaaatcctcaagtttattttctgtcttctttggccaccagttttcagcaagcatgcttatcacttttcagttgagctaaaaagaaacaaaaattctttcttgattgctttgttatctgtgcaatggatgctcattcattttgttcagtaaggaagaagagtggctgtgatgaactccctccaacatgtatttgttgtgccagaaaacactattaatggctaaactgctgagaatgtggcacccttgtaaagaatgagcattcaaagcattcaaaatttaattccagatatacaagcaataattctcaaactgtccaggttctgctaatacagaatgacacatttgagaagaaaacattcatttccttcctggtgcatttccaagctgtctgagaagctgaaattttctattacataaaaaaaggccacaaatattcttcagtgattgtccttgatacacagtccctcaggctcaaaaagaaaacagctctcattatgctgtcactacaaagtgcacatattgtgtgtataaagagcaaaagcaaataaataaataaagtccacaacagaaacatgagcgaaaattgctgcaacaacttcattactagggattttaagatgctaaagaggtaacgagtaggaaggtacaaggagaaaaaatggatgttaagatctgcacaactagtgtggattttcccaagggcaaacttcacttttattaaccatctaaggcagaaataaatataacgtatggtggtatctgcagactgctatgacatctttactgtttctggtaaaataatttagcaactgcacccaaaaccagtcaacagaatactcccttcaatccacagtatttatgtcttcaattggtattttcatttaatatcatttcaatgtaatttttaatccttactcttatatctgctatttctcgaccacatagggtggtttttctggcagcaaaatacagccagtgtgggagaagtttacatctggtacttggccagtaggaaggtgccaatggtggggagaagccatggatcattagcttcactcgtaccttttctattatatttctaccaaaatatgctaggtactgttttaggtattaggttaatacggatgcctatgtgacaagggtggtgcaaatgactattaggaatatactatttgctaaatctagatgatgttagaatttcacattttagcagtagttggcaaccagaatttctatctaatgatcctccctgatgtgaagaactgactcattgggaaagaccctgatgttgggaaagattgaaggcaggagaaggggacgacagaggatgagatggttggatggcatcaccaactcaatggacttgtttgagtaaactccgggagttggtgatggacagtgaagcctggcgtgctgcagtccatgggatcgcaaagagtcggacacgactgagcgactgaactgaactaagttctatgctaagtcaagatccaagtaggagcaaaaacgactactaaagcaatttcggac

SEQ ID NO: 46350 - DNA, 838 bp, Bovine  19866881250874
ttaccaaatgcagtcaaggtgcttgttttcccatacttccaatcacatagactactgggagttagtttgtggtaatatttagaatatcaatgaagaaatctattaaagatatagttgtcaataacatcaaaatgcttctgagaccaattctatgaatctgatattcaaatctgccttatagcatttaaacttgatcttgttgtgcaagactgtattgccttagttccttgtaacttttaaaatccctttattaacaatattccataataaacttgacagtgacaaagcttcatatcttttcaaagtggtccccacactattactacaggattctaaagtttttagcagctttcataataacaagtgctacttatttattgcttaatatgggctaggtacgtacacaggcccacagaggcacgtgcacacccacctgaaataaaatatgccgatgtattgaaaattcactaggaaatggaaaaacaagactattgttgttgacttctatcttataacatcactcgcagttgtagtaactgtcacagcagcaccagattacttttttgtgtttctaaaggtaatgcaaaattttatgcctctctaaaactttattatatttttatgaaacaatttggctaatatagcacttgtataattctagggtatgcaacccagagagttttgaaggtggttgttattttgagcaacatgaaggcctttttagctctattgtctatttcttaataaattttctccctacatctgctcggtcagagttgagtgagtagtataatactctcattctgaaatgtttcccatgcattgctgttgttcttat

SEQ ID NO: 46351 - DNA, 1062 bp, Bovine  19866881273398
gggcagcaggagaagcagacaacagaggatgagatgattggatggcatcaccaactcaatggacatgagtttgggtgaactctgggagttggtgatggacagggaggcttggcatgctgtgattcatagggtcacaaagagtcggacacaactgagctactgaactgaagtatgtacaatttctagatttgttaagtttacttaatttttataagttaaagttaagcactgaaagttaagcactgaagacagcatcatttcaatttttatttttaaaaagtgggctcaattttatttttaaatagtttatatataactagcagcatgtggggaagggagagttttggtgatatttatctgaatgcctcttagtgagctaaggggtcatacagagcagacttgggatagaaagaacattccaagtaactaatttcctcactttatacaggaaagtagcagttgaagaatcaaagagtgctctttctccacgtggaaaagtacatgacttttcccccaggcaaaagcctgcttagggttcttttcagcaaagggcaaggatgacttgagtagagtcattttctaaaaggccaggaaatagctgctcattttccccctactaccttgctctagttactctatatttgaaaaggtgaaataaaagttggtgcatttatgtgagggccatgccaaagtgcttctggccttattgctctcctgcttccctgagccattttctcttgtgcttgctcagcacttctgccgctctttgtgtctcagagacatctgaacaaactgggactcgctttaaaatagtttttgtattttttaatagctttattaggtgtacttaaataaaaattgtgtatattcaaggtggaggatgttctgatatgcatatacatggtgaaataagtgtcacagtcaagctgtctaacatatgcatcccctcacatggtgatggctgtatgtatgtgtgtgcatgtggtttgaacagttaagatgagaactgagcctcttttaccattctaacccttccagtgctttccattgtcctttagcccc

SEQ ID NO: 46352 - DNA, 796 bp, Bovine  19866881476582
cttaaaaatagagcgtttcctactagcttaatagacaatcgactcagttgtcaataacatggaaatacaataaatctgaagtacagcaaatgttttccaagtaaggcagttacgatgccagatattagcagcaaaggcatgctttgtggcactacaaatcacagttctgctttgtcttccgtaccttaaatgctcaggctgtaaaatcaggctatgtccttgctagctccttccccttccatagatcagaacctacattcacatattctctttgcatctatgcccacttcaaggttcttctcctttcctgtgcttacctgatgctgtctgggccccttcagtagcaagcccgtaacttttggtgtgttatatttaccaccgcttctgtttctataatgtgcttgaatgcagtgtaagggtaatgaccatttttctggatcttgaattcatgggctcataacaaataaaagtcgtcaaaacttcaaggtcaaatgaataattacctagatcccttgagagaattaaaaggaaaagtgtagagaaaagagacactgtttaatagctgggtagctttaaattcacagcaagtaagttttcaaaacagttatttagttttatttcaacaggctgaaaaaaagacaaaaaaggatacagagtaagttacttcaagattagaaacaaaaggaaaatcagcaaatatataagtaatacaattctcagtaatagcggaaccctcaaagttctgtagtactcatttaatttatgttaattgcaaattataaaataggtttgacag

SEQ ID NO: 46353 - DNA, 1738 bp, Bovine  19866881982772
tagttttgatttgcatttctctgatgattcgtgaagttgagtacctttcatatacctggtagctgtctgtgtatcttgtttgaagagatgtctattcaagccctatggccacttttaaatctggatatttgtgtttttctattgacatgttggagttccctatatatttttgttgttaacccattaccagatatgtggtttgccattattttctcccatactgtaggttctctctttattctgttgattatttccttcactgtgcaggagatttttagtttggtgcagtcccgcttgtgcatttttgcctgtttgtgtgtgcatctttgaaaaaagaacaaaaggttttattcttcctggaataccatatcattattatacctaagaaaattcataattccacaatatcatttaatatccagttcatattgaattttcaccagatgtccccccaaattgagaaattcacaaaacataaaatcaaccatttaaaatgttcgttcaatggcatttgttgctgctgttgctgctaagtcacttcagtcatgtctgactctgtgcaacaccatagagggcggcccaccaggctcccccatccctgggatcctccaggcaagagagtgggttgccatttccttctccgatgcatgaaagtgaaaagtgaaagtgaagtcactcggtcgtgtccaactcttagtgaccccatggactgcagcctaccaggctcctccatccatgggattttccaggcaagagtactggagtggggtgccattgtcttctccggttccttctgttacttcttattaaagaatcagtagttttctgttgcccagtgttccatactttcaaagcacaggcctttctaggtagtatattccttaaataattacaggtctcttttaaaataaactcttctcaacttgttaccagtctatatttttaccagcttttggttttgcctttagagttgtttcagcaatgctaattataaagaaaaagataaggtcaaattgtttttctttcccattcatagcagctcagaaaatgaattgtagcattcttcttatttgtacaggtattgatgtgttcattgtggcaacgtcttcacagataataaaaacgacatcctttttgtagatgtgctaattatctcttcttgatcaagaaaaaaacattgaatcagcttccaactacagagtttcatttacatccatatttcatgccgccaaagagcctggactattttgtgctacttcgtattttgattaggaaataaaaatattctggaatattattattaagaaatgcttaaaataaccaatgtacatgattggttgtatgagatcaccaccagttaagccaaaagactgatgtaaatgcaaagaaatggtgaggaaactaaacagcaaacaggatgaatggttcgcaacatccagcttgagccagttgaactaatccaatgagaggattaattcaatcaactttgaacatgcagaaataactctgctattaaatgtttgcaccaggaagaagcaacctgcatatttttaagacataaaagctatatcagcccctggcaacagaaagaggccaacatattcatgatggtccattcatttatttctttttacttgttcagccttaagaccaaaattgtttgtgattgcagattaggcttcccaaattctgctaccttgattatagttctttgttattttctaaagcctatttagtt

SEQ ID NO: 46354 - DNA, 2394 bp, Bovine  19866880344144
atttagcagcagcagcagcagcagcaagggaaggaaggaaggaaataagggaaaaaagggaaggcaggaagtaaggaagccagagagagagaaagaaagagaggaagggagagaagagggaggggggaaggactgaggaggaggcaaggtgcccactccatgacacgcacacacaggtgtgttccagcccatgcctccgctcatggacagagatcttcaggctgacacacacaaggacacgcagtttaatcacagcagctcactataagagcaggcatttcaactctgcagggggaatctggtcttctatttaggaagtagatacctgtgacaaggaggtggtgggttatgtgatggaggaaagagtgttggcaggacatgacatcagaagacccgtttaatacttagatgcatcattttgcaactttgagaatttgactaagctatttaatctctttaaatctcggttttcttacctgtaaaatgggaataacaattttaactctggttacctccctggaaggtatagaaatagacgtaatgggtatccagatgtccagcagatcaaagtcactgatttccccagctctcaggacttccttggtggctcagatggtaaagtgtctgcctacagtgcaggagactcaggttcaatccctgggttggaaagatctcctggagaagaaaatggcaacccactccagtattcttgcctggaaaaatcccatggatggaggaacctggtaggctatagtccatggggttgcaaagagtcagacacgactgagtgacttcacttccacttttgagagttgactgctaacatccctctctgagacttaccctcaacttttcccaaagtctgtccctggtgcctgcctactccaacaactccttgatccaaattaaaaatatcttcagaatccaactccatctctacacctcctctgcttccaccatgacctatgcctcccttatcgctcatttagcttctttcaataattttgtaattgttctctctcattctgtgcttgacttgctacagcctgaatgattcctttaaaacatgacttaagtcatgtcctccatcacctctcactcccttacataaaagccaaagtccttgcggatggttaccaagccctacacaatgtcccaccatggctcactcatcctggggaaatcctctgatctcgccttgatgtttactgctctccctctcttgttcatgtcaccccagctatactggtctccttgctgttgttcagatgtgtcaggagtgctccaggctcagtccagaccttggaacttgcacctctctttgtctggaacactcttcctttacatgaattgttctttcacttccctcaaatctttgtacaaatgactcctaattagtgacgtcttctctcgccaccttaattaaaattgcaataccccaccccttctttctgctttatttacctaagctaagtcgcttcagtcgtgtccgactctgtgtgaccccatagacagcagcccaccaggctccgccgtccctgggattctccaggcaagaacactggagtgggttgccatttccttctccaatgcaggaaagtgaaaagtgaaagtgaagtcactcagtcgtgtccgactcttcgagaccccatggattgcagcctaccaggctcctccatccatgggattttccaggcaagagtactggagtggggtgccattgccttctccgttattttcctacttaatacttattatttatcaacacactatgtattttacttacatgtttgcttatattcctctccttgcacgggaatataacctctgtgattataggaatttttacttaattttgttcactgctatagcctcaccacctaatatagagctgaacacatactaaatgaccaataaatatttactgatatagtttaataaattaataaaaggtgaggaatttccataacaaatggtaatcaacaattttttcctgtaaggatccaacaaaattcagatacgcctaatctaaatgtatgcatatagatacatatccacacatataacattttgaacacagtgacattatacatcaaaagatacacaaaaaatgtgtagagctggttaggcagtgacagggatatgttctgagaactgacattatcaacatctaactcctactccatctcatttcacagaatgacacattttcattatcatgacatcctttcttctttgtcaaagaaactggtgagaaaagtctgtgaattcaaagggcagatgctagcatacggtctacgtgtttttcttcccttaccatttctcaaagcacttgggctgtaagcatccaatcacatcattgttttccataatgagtactaagcctggggagtc

SEQ ID NO: 46355 - DNA, 1111 bp, Bovine  19866880353825
agagtcccttggactgcaggagatccaccgtccttctaaaggagatcagtcctgggtgttctttggaaggaatgatgttaaagctgaaactccagtactttggccacctcatgcgaagagttgactcattggaaaagactctgatgctgggagggactgggggcaggaggagaaggggacgacagaggatgagatggctggatggcatcactgactcgatggatgtgagtttgagtgaactccgggagttagtgatggacagggaggcctggcgttctgtgattcatggggtcgcaaagagtcggacatgactgagcgactgaattgaactgaactgaaaacaactgctagggtaaacctgctgccaaaattcttctgaaacaaatagcaccaatacaatgctttgcctggaagacttttgataaatatgccttgaatcagcaaacattttaaaataaatgaatattaataattctttgcatccatccatggtttgggttatctgtcatattagattattttctccatttatcccttcttttggttaggtcattgaaaatgtactacaatctgagttgtcctaagagcccataaaataagaatcagaatgttgggaaggaaaatggattatctgcttcacaaaatctgtgtgttatcttacagggctctctcttttatgtctacatgagaggctagataaccttggagggaaatcagaatgccctacaccatccagtggttctaattttttaaaaagttgtgaaggaaataacattattaaatgcctacaacatgcctttgcttttacatatattatcttgcttaacactcaacacatccttgggtagtatatttaaaaaaaaaaaaagaaagaaaaagaactgagactcagaaaaagtaagtggaggaactaatttaaaaatagctcccaatctggcaaggctagctatgctcagcatttgtggaaactgtttgtacagactacacatgcctgagagttactactgatattgctttattgaaggtttagtatggccagacaccattcccagtggtttataggatttactcatgagataggaactgtaggtctctacttcatacgcagaaa

SEQ ID NO: 46356 - DNA, 3102 bp, Bovine  19866880428476
tttcctatttggaaccgtctgttggtcctgtccgttctaactgctgcttcctgacctgcatatacatttctcaagaggcaggtcaggtggtctggtattcccatctctttcagaatgttccacagtttattgtgatctacacagtcaaaggcttgggcatagtcaataaagcagaaataggtgtttttctggaactctcttgctttttccatgttccagcggatgttggcaatttgatttctggttcctctgccttttctaaaaccagcttgaacatctggaagttcacggttcacccaaaacttcaggagaagtgacagttttagactgcttacatgacaatcacaccaagtgacaagaattatcaacatctttattaatattttttgaaatagtggttttttaaatgtttcatttgcctgaactagttgacgatatttgttttcaatcactctacaaagtatctcaatttcccaccccagcgtttcattgatgaaaacgtattaatgacacatcatggcaattattactctgtcagagaaatttgctgaatttgaatgtttgtgagggcagccaccctaagtattcaccttcactataattgtgacagcaaacaactcttaacctcctttctactttccagttccttttttcacaactataaattagttgttagtctttgctcagctttgttactaaggatgaggtgtccctcatagctcagtaggtgaagaatctgcctgcaatgcaggcgacctgggtttgattcctgggttgggaagatcctctggagaagtaaatggcaacccacccccagtattcttgcctggaaaatcccatggacaaggagcctggcaggctacagtccttgggatcgtgtgtcagacatgacttagagactaaaccccccaccaccaccattactaaggatactatcctgagaaaacagcccaagaacaaagaacagctctgaaactgaagtatcactaacaatgtttggatcttttctcccttttaaaagaaggtacaaaacaggaaatgagctttagcctttagtttcaccttgtcttgagagaagttcaataaaaagctgaaaatgaaggatgcttcagatttgaaaggtaattgtgaaatggaagggaagtgtgttcttcaacattctagaagactcttcagccatactaataatattgtaaagaaatggcccataatagcatcgagcgtcccatgttttgttcattccatctatagcacatcaacaggctttttgtaaaagtgtgtgaacaaaacactttgagctgagatctatagccttagcctttgaaagatgatatctacaggttgtcatggtaactctcagggcaccatctttaaaaacattaaattctgaggaaaactacacacagagaaatttctgtcctaaaagctattccctcagacaaactgtccattagcctgcatatttctgttcttttacagctttgctttgatttttattttcattctactgttcaatgaatacagaactctgaaacaagtgaaaaaaaaaattgaggtcttttgctatagattttccatgataaattctgcattagttttgaactgaatgagcaccgctcgcaccactccatgttttgccttctgtttgactttttacgtgcactttctccttttatcaacagacgcaatttgtttcctgaatattgtcctgttgtttcgatgttgtttagtcactaagttgtgtctgactcttttgcaacaccatggactgtagcatgccaggctcttctgtccatgggatttcccaggcaagaatactggagggggtcaccatttccttcttcaggagatcttcctgacccagggatagaacccacatctcctgcattggcaggtggattctttaccactgagccaccagggaaatcccaatattgtccaatagccaatattaaaatgagagatttctcccttttttgaaactgcaagttctagctgctaatccattagtcaacagtatggagacacagtaactgccctcctctcttagaacacttgtttgtgtgtgttagtcatataggaattagcaggtttgaccttgaatctctaactaccttcacattagcatctgataaccctccgggtggcttataagctatcagaagacaaggtgcatactataaactctttgtatctctggagttagaagcactacacataagggcacaacaaatattttatggcttagaccccaactttaaggataatggcactaaaaagacctgtgtgctatgtgctaagtcacttcagtcgtgtccccgactcttcacgaccctagggactgtagcttgccaagctcctctatccatgggattctccaggcaagaatactggagtaggctgccatgtcctcctcccgaggatcttcctgaccgaaggatcaagcctgcatctcctgtgtcacctgcattggcagacaggttctttatcactagtgccacctgggaagcccttggggatcatcaaatctacctcctttttttcataaattaggacactggaaaaaggagaggtaaatattttggctcaatgttatatctagttaaagacattattttgatgtcagcaaaggaggttctaatccccagcctgccagtatggagaaggcaaaaaggaaaactgagattctttattcacaaaacaaagcaactaatagtcattcctcgtttacatacctcatcagattattgttttgaggttcccattcaacagtcatctgtagtagagggaatgttttaagcattgttcaaatatgaagcatcattaagagaagggtgcaaataaagctcatgaggaaaagatgaatggaaaaagtaaggaaaagagttacaggtaaattgagcattgttttgttcttaatttacaggcaatctctcatgatgaaagtgactacatttggaaaactaatgatagggaaaattctaaaccacaagcttaagagagaaatcgggatgaaaataaccagcataagggaatgggctaatcagaagtctaaaataaacatacagagtagtataaagcagattctccgtctctgaattt

SEQ ID NO: 46357 - DNA, 1045 bp, Bovine  19866880472655
taatacaaaaatatatatgatgtaaaaaaaaaaaaaaacccacatggtatgtgtgtataatatagatggtttgtataatgatgtataaatatatggttgacaccaaagctgaataacggatatcagatagatagattgtcttaactgactattcaagtgcagcacaccaaggttagaatctcagctctaacatttactagctcactgttaactttttaaagaacttcaagctctaacacgaggatagtgtacctagttcatgagcatattccatttacaatttagaattttttctttcctgaatattgagtttcctggcttttaggaaatatgacttgaggaaattaagggtctctgaccttgaaatcaaaatcctgccctcctagggagaggccgaaatgtcaacagaagaggtaaccatttagcaacaatccccttgtgcctcctatgacaaatttcctatgttgatttgcaatctacatgacagattgttggtgctaaaggccaatgagctccatctatgtgaagtatgggtcttttgaaaaacaaataaatccaattaaagaagagaactcagaatgaggaagacaaatggtttggtttgttgtgtttattatgccagctcaactagaatgaaaaagtgagaaagtttataactaggtaggtgaaaagtctcaaagcttttttcttcatttattggtcttgatacccaattatatcacccccctttcaagtcaatggattctcttctttttagctcaaaagaaacacaatccaaaacggcggtagcataattctaatttatttccatttcagatttttatacctgtaattatgtttgtattaaattagatgaaaatgtcagtctaccaatttgcttcttcctttgtaaccttttgcatgcaaagtttatcattctgacaaataaaagggctctccaaccttgacaccgaagaagaaatgcaaattatatttctccacattagaaaacaactatcaatcatgtcatttaaaaattagtgagatttccaatgaagtttgaaat

SEQ ID NO: 46358 - DNA, 1913 bp, Bovine  19866880537921
cagttactgctggctgtttttggaaaaatccccaagcttttgctgctggctctgtagtctcaccatttaaggtactctgaacaatcatcctttatgatttgactattcaagtctcttttttttctttttcttgaaggataattgctttatggagaggggaggagagggtgagatgtatggaaagagtaacatggagacttacattaccatatgtaaaatagatagccaatgggaatttgctgtatggcttaggaaactcaaacaggggctttgtatatgttcaagtcttttaagacaattcgtattaagatgttaaaggaatgggcagcagttaacttcaagccaacttaaggagaggttatagcattttaagcttattgcaaagcaaatatgacatgtcaaaatattgttgaaggtattcaggccaactgtagctttcaataggattctaggatatatgtttccaccaagttttcaataaaagggttaatattaatgtataattatgatcaaagtcaaaatgacctaatattctaggacatctgcagacggttttctgagggctgcacatagtgctattcagcacacattcagtattaggttatatagagcttaaggcaaagcgaagtgaaattacttgcattttgctgaaaaatgagtcactaaaggctccagaaattgaagtctagacggagtgagtgaataagccaggcaacagaagggccagtcatcacaattggtcccgacagcctcgcccacgtcagtctgcactgctgaaccaggccattggtgttgactcgctcagatgggcagctgcccttgttcctccaggaaggacctcggtttcacacgcctgcagtgaacccacaacccggaagaagaaatggagtgtaagtggcatagcagcattttgacataaccagcatcttgaactgtgatgctgtgggggcaggattgagggacagatgtcagtcagctccagaatttgcttggtgatttttgaataaaaattgatctgttcacaggtcaactggcaattattcatttcactgtcacgccaagttcactgaggacccacagtttctcttctagtgcaagagagcctctctcctgagtaagtcatgctgcctttcaaaggaaagacgaagccttgacttaggaatatagtacctccttatggggactgatggagtgggaaatgtcaatccactccagtattcttacctggaatataccatggacagaggagcctggaggactgcaatccatggggtcacaaagaattgaatataaccgagcaacagagcatgcaggagttgagagaaatacagttgccttcaagttcctgacaatttggaggcccatccttagaattaaaagacagaggctgggctcacgggcccctgtgtgtaacagtgttattctgttactccatcatgtgatttcttgggatgagtaatacctgatctctccaacacatactctttggagaaggcaatttcttaaatgaaattactttcatttaaagtgacttgattaaaaccatttttaaaagtaaatgccaaattctgtgcttgttctggctggattttataaggtttattttctttctatatgagtttcctcatcgattaaaatttaaaaaaggtataagcattactcctcccaatcttttgatcatgtatcaaagacataagaaagcaaaaatccagagctgatcaatcaacgaggcaggggactgtatggttcgatgcctctcagcagctccaaggctggggttggtaggagaacctgcaggtggcaggtggggaggccctgctgatccaggctgcagctgagttccgttttcctcttgagcatctcactgctgctccgcctgttgccaactaggctctttttgaagtcctccacct

SEQ ID NO: 46359 - DNA, 757 bp, Bovine  19866880556769
caacatggcttcagtttgggtaggaccgtgggttctttgtagggtatgtaactttgaggtgatgagaaatggttctctaatctctaaagcactgttcccatggcaccttctttaagggctatgggtgctagacatcagtaagcagggtgctacagaaaaccctgaaataatcataagcagaagggaaataccccacagcatcttgggataaatggagcagtctgttctgatggcctgttgtacaggggagcctgcacataggccagcagaccgtgaattcagtcaatgtgatctcagttgaacccatagtttggagtggcctagggacatttgagttatatatatatattaataaaattgatgaacatttgcttttccctgttactttgctagatgatattgaattaacaatccttaagttgccttgtaacaatgtcactcattactatttatatattaactaaatatactcaattgaataatcttacacttgacttctttctatttatttttctcactactagcagcttttgtattttttctatttcgatggcacatacaaagaattatttatgaatacacagtgaaacaaagaaatctgcctattcaagtatgcctgaaaaatactagtaacggctcctttgcatatatgtcatattcttttgtgggaattggaaaataattaaaaacaactttcatttgcattacacttagtgtttcacagccctttcataattcagtttttcttcttcaaact

SEQ ID NO: 46360 - DNA, 2055 bp, Bovine  19866880581174
atgacttaagtcagacttcaacccatcgaagtaagagatttcataagatggaatatacaaattagtataaaatgaatgcttagcccactgaatgttacaggagagcagaggagaacaagtcccagggactaagatggcctggaggttttctgaaggaggcatgattgagctgggccttacaggactggaagggagaggtccaggcaagagccaagggcagaggcagaaatgacctagcgcagggctgggcagagcatggcctgtggaccacatctgggccttataggactggaagggagaggtccaggcaagagccaagggcagaggtagaaatgacctagcgcagggccaggcagagcacagcctgtggaccacatctgggccaccgcctgtttctgtacaggccatgagccaagaacagtttcacttttaaaggactaaatatatatatatatatatttatgtgtcatgtgaaaattatataaaatcaaatttcagtgtctgtaaataaagttttattgaaacacagcctcactgactggtttacatatagtctgtggctgctccacaccacaatggcagtgctgagcagtcaaaacagagaccatatattcattccctggctcttcagagaaaacatttgcttctcctggagctacgacatcagaggcagttagtaggctttggctgtagagaagattttatacggaggaactgtgggaaatgggtgcccagggatccattatgaagaatgtgcaatgttatgttaaagaatatgaattcatactaatgtgttctctgtttctttaattttgtcatttcaaaagtatacaaatgaaatcatatagtatgtaaacctatgagagtggctttgttcacttgccataattctctggagatttatccaggttggtatacatcttattcctttttaacgctgaataatattctatcatataaatgtactgcactgtatataaccattcatccactgaaggacattggggttgtttccagtttggatcattatgaataaaactacatgtgttaaagaaaaagaatatgaattcagttcctaggcaatgtgttgcagttatcatgtatgagaatacagtaatattctctgtatgcacataccacaaaactgcaaaaggttcaaaaagatattctgagaaaatgtcagtattctttcctgacctctagatacccagacaactctgcagaggtgcccgctaactcattctcagggaccattacagagacattcttgtgcatccacaaacatatatgagtttgttttatgtcaggacattcttcttcacagctgtgtaacgtggatatactatcctatttacagctggggagaattctgagccagacactacaacgcttctttaggaagccttgctgagcagagggttccaggagaactagaggcaggaagtggaggcaggccactgacgaacaaatccaggagcctgcagtgaggatgcctggtattcccatgtaacccagaaccccagcctgctcaaggccacggagctggggaccccctccctgcaccgtttctctgggggctcataccttggcaggtgtgtcagggatggaagaggtgggagaacctggaaagttcaagacacacttcttcccgaggcagcgaccatgtaactcaacgtcctcataagggttttccttcatgggcggatctgtggtcaaaggcaatgaacagatcagaaactgggaacaccaaggaagctctccttatcagatctctagccaacaccttggtgtctccttgtggggatgtgtgttgtcttgctatgcatttagccttcctcttggtaatggatctcggttttcaccggggcaagtctctgtctccccattctcagatgtgtgaacttaactccactcctggtctcagagcttaagccaatctgaatattctgaatcctggcctcagtgatcatcctggaagggctcatattccaggcctaagcccactgttgcatggcattcctggactctgaagggaacagggaccaacccagtcta

SEQ ID NO: 46361 - DNA, 1466 bp, Bovine  19866880735952
gacagtaatggaatattttcatattacaaatgtggaaattctgaaaaggaacagagaaaatgacttgtctcatgtcactgctgctgctgctgctaagttgcttcagtcgtgtccaactttgtgcgaccccatagacggcagcccaccaggttctgctgttcttgggattctccaggcaagaacactggagtgggtttccatttccttctccaatgcatgaaagtgaaaagtgaaagtgaagtcgctcagtcgttcccgactcttagcgaccccatggactgcagcctaccaggctcctctgtccatggattttccaggcaagagtactggagtggggtgccactgccttctccggtcttatgtcacagagctcactaaatggagagcaacatctgggcccgtttgtccctgactctctgaagcttaaagttgccaattctgagactaagcctccaggaacaagaaattcagccatgaaaccacgttcacatgcttcttcacctggtaattactttttgtaaagacatagtagctttaaaaatatcaaaaccagctccaagagtgggcatgactcagcagtacacaaactagtaaaaaaagaaaaatgtcattaactattttgaaattttaaaaactcaccataagactggcactttcaaatgtagtcattatttccaggcccttggctatttatacagacaaaaattgattcttttttaaaaagttgttcacagaaatcttctttcaatttcttggatttccataggagacaaaggtcatattcttattcataaccaagcttgaagagatttagacttcacctgcactgagatattcctaactctcataatacatgtacctcctggaaaaagaaatgaaagcacctaaaatttattggcctgtgtttttattccctacctcctgcccctttccccagagcgaatataaaatcctgttaaaaaaaaaattacttgaacaatttgaagatctaaaaaggaaattaatatagaaccaatatgtgcttaatgtagaaaatttgataaatacacaaatattttaaaatccaaaccagatcaccctaggatcacaatctgaagcttaccatggggtcacagtgaagtgattttgcacacacacacacacacacacacagtacctgtatatgctggtaaatgcttgtgaccataccgcatgttctactaggaactgcagacacggtgcatgtgtatgactactttcatgcctagggcagatattagtgatcacagaccaccttacctatctcctgaaaaacctgtatgtgggtcaagaaacaacagttagaactggatatggaacaaatggttccatatggttcaaatttgtgaaagaagtacaacaaggctgtgtattgtcaccttgcttatttaacttatatacagagtatatcatgtgaaatgctggactatatgaatcacaagctggaa

SEQ ID NO: 46362 - DNA, 1694 bp, Bovine  19866880764226
tccccaccttctattttgcatattattattaatgcccatatttaaaagtaaaatacaacaggtacacatttggaacttcaatgcctcatcctctggtcactatgcaccggcccctccctatttgctatatgctcccccttcccaagccaaagttttaaattttaatgtaaaagtctgtgtctttctgtttactctagatgtaacagtatctaagtattttggggggcagacaggaataaaataatttgtcgagaatcctataaatgctgtaataagaattttaaaagcataattgttatgaaaatattttcataggtttctctacccaggaataaataagttatctttccttaaggcatttattaataggctgatgaaaatttctggatacagtactgacagtcacgataatgaaatccatgggactaattatactgttaccctccttcagtatcttagatttaatttaaatgactcatagccacaaaagtataagccttaatgcactggtatgataaagtatagttttttaaaatggaaaggactttataaaggaagtttgaacattatttataaataaagcagggttatccttcaatatctgtattctatcagggaagactttatttttttatcttataactttgcttgtgatttatttgccatcaagcatgacagataaaggaatgctagaactttgtggagctggaagaaatggtcaagtacatctaatcaactctcttattttacgatgaggaagagaagacaggggtcaattgcttgactcaggtcatgcactttgctgagaccaaagcctaagacaaggatttctctggccatacagtggttacaacaccaagcttcaaatgcagggagcatgggttcaattcctggtcagggaactaacaccccacatgccacatggcgtagtcaaaaataagaaaaaagcctcatatagttttgctcaaagtcgaatgcaacgattattaatattagggatgctttaagtactggataaaatgtagattcctgagacccactgccatacttaccaataagaatttctaggctagcatccataaatctacacttacacaaaacctccctaggataagtcttatctacactgatgtgtcagaaccactttctggaggtggttctcctcttccggctgtgtttcccatgtagcctaggcactggggagggggggaactgagaagatgcccatggggttaagtggtactatggggcaaggggacaaaagccatagaataaactggaggatcaacccacagggtccatgttacttgaacatttgggaaaaattttacttttatattaaatcatatatttgtaatacatgtactgaaagaaaaatgtgttactaatgcaaatgttaagattaaactacaagttgagaggaagggcagaggatgaggctggaaattccaaccttctaatcacatagttagtttttctggtgaccagtctctgttctcaagctacctaaagcttcctatcattagcataaacttgcctgttactgaaaggacttctttatgaataatagaactcccctatgactaagaatgaaagtgaaagaggagagtgaaaaagttggcttaaagctcaacattcagaaaactaagatcatggcatctggtcccaccacttcaggcaaatagatggggaaa

SEQ ID NO: 46363 - DNA, 1623 bp, Bovine  19866880770273
tacatcctcattttagtctataaagaatgatgctgctgttcttttaacacctgaagcatttcctgcttcagtaagtaaggtgcctttatgtgagattcaaagaactgacttttgtagaatattttccagagtaatttataatagtgattttaaaatttgttttagtgtattttgaaccatgggtctatcaggttatgttgcttctcattttattcatatcttttcatgcattcaaaattgcttgtattctctcaggcaaggctgtccacttcacttttccttatgtgctaacagtttttctcagcaggtgtgctgctgcacctgaaaaccctcataaacaggcaggtgaagttatagtatcttattgtttcaaggacagaaaaaaaaaatcagcaaaaataagttcaagacagagaaatcaattatagagcaagaaaatctaactacagtgtgcatctaggaaagtatacttaaaaaaacatattttaaaatatggactaagtcttcccatttaaactttgagtcctctaagttccaaaaatgatgacacttttgcatgacagagaaaattagtctagtacaatagaccaaaagaaattttgatagatccaaaatatactaaaagtaattctgaagaagtacttgaaagcaatgaaacttcatgagtataaccgaaagacagaacaaaattcattctgatggagctaatccttgagcttacctcatattccacactttgagagcatactgcatactgaaaccatgctcaggtaaatctggaatgcctgctcatcatttggacaccttccctggatgcatggtatatacttttacttttttgcttccaagttggcccaacaaaaaaacctttctcaacagataaacagtgacttacaaacagtccatgtgacttttcatataagcaatgacttacaagcagaccatgtggctgttttagtggttcctttatttagtaaatatttaatgagcatttactatgagttagatgccatggaaacttatgttggaaaagtcaaagttgtagccctcagaaattcaccatctaatatgcaagataaataaatgaacaaatcatttctggactacacagccagttactgcgaaagcagggagttttgcccaagtgtcgacagaggagatggttggaagccgtctttaaggcttcagggttcatgaagtggagagggtaagacaaagaattcaagttgaaagaaagataaagtaatgggggtgcaatatggccttttggttgtttggtgtggcaggagtgtaaggtgagggggagggtgtggcaaggaattgcatttaataatttatcagatattgaacaactctttcacttgggctctgtgcagggactctttcacagatattttttaacatctttattaagatataattcacataccagaaaacttaaaatattcaattcagtggtttttaatatatccaagttatctaactgttaacatacattttttcctagtatatgttaataatatttttttctataacattaggttattgatttgagattttttaaaaatatatgtgtttaccgctataaatttccctctgagtactgctttctctgcatcccat

SEQ ID NO: 46364 - DNA, 1718 bp, Bovine  19866880886283
cttgaagcccactcttataagctcctgtacaaatgtagtcttggaattctgtcattctctttttgagtctaggaagattctagatgaaaatagttgatattattgagcactgcgtgccttaccttatttaatccttataatagtgaagtctaattttacaaatgagaaaaaggaagtccagagcagttaaatcatttgttataggttacacagacagtaaccacttacttgcattacctctgtgggttgactgaactcaacttaaattcttactgacttaaagtctattttctttcctaattgtgtatttcacaaatacattatgtttcagacacatgtgagactctcttgagccatatattgttggtaactgagtataatcatccttattaaagatcagaagaccgatgcagatagaggctactatagcctggggaagctgatggtaagaggagggttaaaactcattttaatactctgttatttttgtaactcctttgagactttataagtttttattttcttcaaatgtatttatttttctttttttatttatttttatttgaggttaattactttacaatattgtattggttttgccatacatcaacatgaatctgccacaggtatacacgtgttccccatcctgaaccctcctccctcctccctccccgtaccataagttttatttaatttttttaacttcacagagatgttcaggagctgaaggtagattcaggtttcattcctggataaaggtagtagcttagatgacaaattactttatagacattttagtacaggtagcagcaggcatgcttgaggatttgaaattttgcccattagtatgcagaaaatccatcgactgcctaagtcattttctaataaaccaggtcttcattacatcccaattgcccaaagtgtgcttgccttgtcagacacagatttctaaaagcagttcagtcttgagtcactttaactaacatggatttctccctccctattcatttgcagggctcctctctggtgctctgtatcttttttccaatatatttgaaaagcttttattccatttaatccatccagctctttttagcacagtcagcaagtttgccagccttatctctttcctcttggcttcagcagtctgttgtttgcacttccacagtttattggcagcatgttttttgacaagtcttcttgaaatctaattgactgtttcttgttttaaaatttctttctcagaggaacactagctggctggttctccatcactgccttctttcattaaccttctacctgcactcctactttaatataaaataaacattcaaactgtgcaaatcaatatatgttgaattaaattaattaaaagaaaatattttgagaatatagtaacatgggaaaaatgttccaccagaaggcaattccttagatgtcagttcaaagaaaacatcatcaaaattttcaaacaaccttcctggggcacacatattttactttcaattctaataagttttctaagtgtacaggaataaaagtattgtcaaaaaatcaaaagggaaaatattttggtattctgatatatcaccccgggtcgagcaaagcaggaatgaaataattttctatttgaatctcaaattgagtataaatgtacacaatcaatattttcaaaactgatggtcattaatagttaagattatattatttttccacag

SEQ ID NO: 46365 - DNA, 1156 bp, Bovine  19866880902165
aacactggagtgggttgccatttccttctcccatgcatgaaagtgaaaagtgaaaagtgaagtcgcttagtcgtgtccgactcttagcgaccccatggactgcagcccaccaagctcctctgtccatgggattttccaggcaagattactggagtggggtgccattacctctcctaatatcagtgtactcaatagatggcaggaaaatgagctgttctccccaggttgagacttgtccaaagtgcctcatgataacagaaataaaatgaaaactaggaacatattctccatctaaaatttgtgaaaccatagtccacctgggctgagtagagctgaggacagttacagaaatcagtggtagcaaaaccaacacctgtggaatataagggaagtaaaatcccttaagactctggaaccacttggttgtaaatattcttaaaccaaggcttataagacaaagacgccagcccatattatactaaaatggttgtcatttttagatgaagcaattcacattcggccactccatcttgatttgttttcccacaggcagatctgaataggcatatccctgtgttccttttttatagagttttactgtcccaagaatagactaatttcacattctattgcctggttcctttaccagtacaccaaacataaggaacaaatagtccaaattatattcctctctggaaatagttataaaagtttatgtcactccacatatacattctgctaggaaagctgggagaaaaaattacctacaacaaattggtccatgaaataagatacaacattgctgtcccagagaatacattaaagaaaaaaaatttttatgacacttgctaaagaatggtatgggtgactttatacaggaccatggcagtaggtgtgaggatcactgcagtgggattttgcaggaggagacagtgatctggctcaagtcagaatagaacaagaagtaggggttttacagccaaggagtgaggtgaggctggtggtcaataaatggaaaattactaagagagagggcaattattgctaaactagcctaccaggattcttgctcaaggcaggccatggtgatcagatgtcacctgggggatgtgggggggttaaagaaacccaatcagatatcaaggatgatcagata

SEQ ID NO: 46366 - DNA, 793 bp, Bovine  19866880917454
ttactggtgtttggtttggctcttgaactgtcctggcattgattcatcttcccagacagctgctcctttgaagcatcactgcaagagaactttgctacttatctagacagtgtacacttatccatcaaaacataaatagcacccaaagtaacctgcatgtctggaggccagaggctgctttcccattgaagatctgccaagcttagaatggccaaattcttactgagctctctgaaactgcagagagggaccccaacatgaaaacttctgcttctgctctcagtcttttatatacaccctttactactctagttaagaaatctctacaggggttcccatgaccacaaaggtactacgctgaggtactgtacttgctctcaggcaaccgaataggattttccattgcttgtcttcttccctactagcattagaatttttttgcttttttaccacccttcaccacgaaatgttcaggcttgaagtttctcattattctaattattgagttccttttctcatggggtctgagagggggtctatgaggatagtcagtgggtgtcttctattcatagcctctggatcagagccaggagggagattgatcctaggaatttatgcaaaatcttcaatagggcttgtgatgcatcaatcacattactcaggatgcctcaaaggtgggggagtgtgactctttctgtggttcatgggctctctccctttccaacgagtgcctggctagcaatcagagagatttggcaaagcccgagaggctgagtgccaccaaaccaaagag
